United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 125

SEQ ID NO: 5301137 - DNA, 22 bp, Homo sapiens
taaaatcatttctgcatcagct

SEQ ID NO: 5301138 - DNA, 20 bp, Homo sapiens
taaaatccaaaatgaatgca

SEQ ID NO: 5301139 - DNA, 17 bp, Homo sapiens
taaaatccatacatttg

SEQ ID NO: 5301140 - DNA, 22 bp, Homo sapiens
taaaatccccttcgctgaaatt

SEQ ID NO: 5301141 - DNA, 20 bp, Homo sapiens
taaaatcctgcttaaaactt

SEQ ID NO: 5301142 - DNA, 15 bp, Homo sapiens
taaaatcctgtgcaa

SEQ ID NO: 5301143 - DNA, 15 bp, Homo sapiens
taaaatctaaaattt

SEQ ID NO: 5301144 - DNA, 14 bp, Homo sapiens
taaaatctaattag

SEQ ID NO: 5301145 - DNA, 15 bp, Homo sapiens
taaaatctactccaa

SEQ ID NO: 5301146 - DNA, 19 bp, Homo sapiens
taaaatctcaactataacc

SEQ ID NO: 5301147 - DNA, 20 bp, Homo sapiens
taaaatctgaattttgcaat

SEQ ID NO: 5301148 - DNA, 21 bp, Homo sapiens
taaaatctgagggaaatgttt

SEQ ID NO: 5301149 - DNA, 21 bp, Homo sapiens
taaaatctgatatgtattgtt

SEQ ID NO: 5301150 - DNA, 15 bp, Homo sapiens
taaaatctgatttaa

SEQ ID NO: 5301151 - DNA, 16 bp, Homo sapiens
taaaatctggaaatct

SEQ ID NO: 5301152 - DNA, 23 bp, Homo sapiens
taaaatctggaaatctgttttgt

SEQ ID NO: 5301153 - DNA, 19 bp, Homo sapiens
taaaatctggcaaagttat

SEQ ID NO: 5301154 - DNA, 18 bp, Homo sapiens
taaaatctgtaaaccata

SEQ ID NO: 5301155 - DNA, 13 bp, Homo sapiens
taaaatctgtgaa

SEQ ID NO: 5301156 - DNA, 14 bp, Homo sapiens
taaaatctgtgaat

SEQ ID NO: 5301157 - DNA, 13 bp, Homo sapiens
taaaatcttatag

SEQ ID NO: 5301158 - DNA, 19 bp, Homo sapiens
taaaatcttatagttctag

SEQ ID NO: 5301159 - DNA, 22 bp, Homo sapiens
taaaatcttattaaagtttcaa

SEQ ID NO: 5301160 - DNA, 14 bp, Homo sapiens
taaaatcttcagct

SEQ ID NO: 5301161 - DNA, 20 bp, Homo sapiens
taaaatcttcagctggtgga

SEQ ID NO: 5301162 - DNA, 13 bp, Homo sapiens
taaaatcttgaaa

SEQ ID NO: 5301163 - DNA, 21 bp, Homo sapiens
taaaatcttgatagctaaata

SEQ ID NO: 5301164 - DNA, 22 bp, Homo sapiens
taaaatcttggaagtacatgaa

SEQ ID NO: 5301165 - DNA, 20 bp, Homo sapiens
taaaatcttggcacagaaac

SEQ ID NO: 5301166 - DNA, 11 bp, Homo sapiens
taaaatcttgt

SEQ ID NO: 5301167 - DNA, 16 bp, Homo sapiens
taaaatcttgtcatgt

SEQ ID NO: 5301168 - DNA, 18 bp, Homo sapiens
taaaatcttgtcatgtgt

SEQ ID NO: 5301169 - DNA, 23 bp, Homo sapiens
taaaatctttccatctcattaca

SEQ ID NO: 5301170 - DNA, 18 bp, Homo sapiens
taaaatctttctttctta

SEQ ID NO: 5301171 - DNA, 19 bp, Homo sapiens
taaaatctttctttcttag

SEQ ID NO: 5301172 - DNA, 23 bp, Homo sapiens
taaaatctttctttggggaaaaa

SEQ ID NO: 5301173 - DNA, 15 bp, Homo sapiens
taaaatgaaaattgt

SEQ ID NO: 5301174 - DNA, 16 bp, Homo sapiens
taaaatgaaatgtttt

SEQ ID NO: 5301175 - DNA, 14 bp, Homo sapiens
taaaatgaaattac

SEQ ID NO: 5301176 - DNA, 17 bp, Homo sapiens
taaaatgaagaatttaa

SEQ ID NO: 5301177 - DNA, 14 bp, Homo sapiens
taaaatgaataatt

SEQ ID NO: 5301178 - DNA, 12 bp, Homo sapiens
taaaatgaatct

SEQ ID NO: 5301179 - DNA, 16 bp, Homo sapiens
taaaatgacaaagcca

SEQ ID NO: 5301180 - DNA, 22 bp, Homo sapiens
taaaatgacaaagccattcttt

SEQ ID NO: 5301181 - DNA, 17 bp, Homo sapiens
taaaatgacaatcatgt

SEQ ID NO: 5301182 - DNA, 18 bp, Homo sapiens
taaaatgacaatcatgtg

SEQ ID NO: 5301183 - DNA, 21 bp, Homo sapiens
taaaatgaccagtaattgtga

SEQ ID NO: 5301184 - DNA, 16 bp, Homo sapiens
taaaatgactacttag

SEQ ID NO: 5301185 - DNA, 19 bp, Homo sapiens
taaaatgactacttagcat

SEQ ID NO: 5301186 - DNA, 16 bp, Homo sapiens
taaaatgagaaatcta

SEQ ID NO: 5301187 - DNA, 23 bp, Homo sapiens
taaaatgagtgatctcaaatcca

SEQ ID NO: 5301188 - DNA, 23 bp, Homo sapiens
taaaatgagtttgtattattaca

SEQ ID NO: 5301189 - DNA, 18 bp, Homo sapiens
taaaatgatatattaaac

SEQ ID NO: 5301190 - DNA, 23 bp, Homo sapiens
taaaatgatattgttatatacat

SEQ ID NO: 5301191 - DNA, 15 bp, Homo sapiens
taaaatgattgtaaa

SEQ ID NO: 5301192 - DNA, 23 bp, Homo sapiens
taaaatgatttgtagtggaaaca

SEQ ID NO: 5301193 - DNA, 14 bp, Homo sapiens
taaaatgattttat

SEQ ID NO: 5301194 - DNA, 17 bp, Homo sapiens
taaaatgattttatctg

SEQ ID NO: 5301195 - DNA, 18 bp, Homo sapiens
taaaatgattttatctgt

SEQ ID NO: 5301196 - DNA, 17 bp, Homo sapiens
taaaatgcaacatgtgt

SEQ ID NO: 5301197 - DNA, 14 bp, Homo sapiens
taaaatgcaccaat

SEQ ID NO: 5301198 - DNA, 17 bp, Homo sapiens
taaaatgcagattcata

SEQ ID NO: 5301199 - DNA, 20 bp, Homo sapiens
taaaatgcaggtgaactttt

SEQ ID NO: 5301200 - DNA, 17 bp, Homo sapiens
taaaatgcagtaacatt

SEQ ID NO: 5301201 - DNA, 21 bp, Homo sapiens
taaaatgcagtaacattctac

SEQ ID NO: 5301202 - DNA, 21 bp, Homo sapiens
taaaatgcagtccagaataag

SEQ ID NO: 5301203 - DNA, 16 bp, Homo sapiens
taaaatgcatatttct

SEQ ID NO: 5301204 - DNA, 19 bp, Homo sapiens
taaaatgcatatttctatg

SEQ ID NO: 5301205 - DNA, 20 bp, Homo sapiens
taaaatgcatatttctatgt

SEQ ID NO: 5301206 - DNA, 15 bp, Homo sapiens
taaaatgccagtctc

SEQ ID NO: 5301207 - DNA, 19 bp, Homo sapiens
taaaatgccatagtttgtg

SEQ ID NO: 5301208 - DNA, 20 bp, Homo sapiens
taaaatgcccatttcgaaga

SEQ ID NO: 5301209 - DNA, 23 bp, Homo sapiens
taaaatgcggcactatttctgaa

SEQ ID NO: 5301210 - DNA, 18 bp, Homo sapiens
taaaatgctatctcaaag

SEQ ID NO: 5301211 - DNA, 15 bp, Homo sapiens
taaaatgctatttta

SEQ ID NO: 5301212 - DNA, 21 bp, Homo sapiens
taaaatgctattttaaaattc

SEQ ID NO: 5301213 - DNA, 22 bp, Homo sapiens
taaaatgctattttaaaattca

SEQ ID NO: 5301214 - DNA, 11 bp, Homo sapiens
taaaatgctgc

SEQ ID NO: 5301215 - DNA, 22 bp, Homo sapiens
taaaatgctggtgaaatgctgt

SEQ ID NO: 5301216 - DNA, 23 bp, Homo sapiens
taaaatgctgttctcaatcattg

SEQ ID NO: 5301217 - DNA, 21 bp, Homo sapiens
taaaatgcttcactgtacgta

SEQ ID NO: 5301218 - DNA, 14 bp, Homo sapiens
taaaatggaagcaa

SEQ ID NO: 5301219 - DNA, 15 bp, Homo sapiens
taaaatggaataaca

SEQ ID NO: 5301220 - DNA, 18 bp, Homo sapiens
taaaatggacacaaattt

SEQ ID NO: 5301221 - DNA, 21 bp, Homo sapiens
taaaatggacacaaattttca

SEQ ID NO: 5301222 - DNA, 17 bp, Homo sapiens
taaaatggacttttgtt

SEQ ID NO: 5301223 - DNA, 16 bp, Homo sapiens
taaaatggatagaaaa

SEQ ID NO: 5301224 - DNA, 17 bp, Homo sapiens
taaaatggatagaaaaa

SEQ ID NO: 5301225 - DNA, 22 bp, Homo sapiens
taaaatggcaacaaactgcaca

SEQ ID NO: 5301226 - DNA, 13 bp, Homo sapiens
taaaatggcacct

SEQ ID NO: 5301227 - DNA, 19 bp, Homo sapiens
taaaatggcatttagcaca

SEQ ID NO: 5301228 - DNA, 23 bp, Homo sapiens
taaaatggggataataatactga

SEQ ID NO: 5301229 - DNA, 16 bp, Homo sapiens
taaaatggtacatttc

SEQ ID NO: 5301230 - DNA, 13 bp, Homo sapiens
taaaatggtcatg

SEQ ID NO: 5301231 - DNA, 21 bp, Homo sapiens
taaaatggtgaagaactagca

SEQ ID NO: 5301232 - DNA, 14 bp, Homo sapiens
taaaatggttatgt

SEQ ID NO: 5301233 - DNA, 13 bp, Homo sapiens
taaaatgtaaaaa

SEQ ID NO: 5301234 - DNA, 15 bp, Homo sapiens
taaaatgtaaagcca

SEQ ID NO: 5301235 - DNA, 21 bp, Homo sapiens
taaaatgtaagaaaagctgat

SEQ ID NO: 5301236 - DNA, 16 bp, Homo sapiens
taaaatgtaatttaaa

SEQ ID NO: 5301237 - DNA, 17 bp, Homo sapiens
taaaatgtacatgtatt

SEQ ID NO: 5301238 - DNA, 21 bp, Homo sapiens
taaaatgtagaaacttaaaca

SEQ ID NO: 5301239 - DNA, 18 bp, Homo sapiens
taaaatgtagaaattcta

SEQ ID NO: 5301240 - DNA, 19 bp, Homo sapiens
taaaatgtagaagaaagca

SEQ ID NO: 5301241 - DNA, 21 bp, Homo sapiens
taaaatgtagaagaaagcaaa

SEQ ID NO: 5301242 - DNA, 12 bp, Homo sapiens
taaaatgtagtt

SEQ ID NO: 5301243 - DNA, 16 bp, Homo sapiens
taaaatgtagttttaa

SEQ ID NO: 5301244 - DNA, 17 bp, Homo sapiens
taaaatgtagttttaaa

SEQ ID NO: 5301245 - DNA, 15 bp, Homo sapiens
taaaatgtataagtt

SEQ ID NO: 5301246 - DNA, 13 bp, Homo sapiens
taaaatgtatctg

SEQ ID NO: 5301247 - DNA, 20 bp, Homo sapiens
taaaatgtattatgtcctgt

SEQ ID NO: 5301248 - DNA, 15 bp, Homo sapiens
taaaatgtattcaag

SEQ ID NO: 5301249 - DNA, 17 bp, Homo sapiens
taaaatgtattcaagca

SEQ ID NO: 5301250 - DNA, 20 bp, Homo sapiens
taaaatgtccagtaagatca

SEQ ID NO: 5301251 - DNA, 22 bp, Homo sapiens
taaaatgtccagtaagatcact

SEQ ID NO: 5301252 - DNA, 23 bp, Homo sapiens
taaaatgtcccagtgtcagtatt

SEQ ID NO: 5301253 - DNA, 20 bp, Homo sapiens
taaaatgtcggatttatctt

SEQ ID NO: 5301254 - DNA, 20 bp, Homo sapiens
taaaatgtctttccaaatta

SEQ ID NO: 5301255 - DNA, 18 bp, Homo sapiens
taaaatgtgaggcaataa

SEQ ID NO: 5301256 - DNA, 12 bp, Homo sapiens
taaaatgtgatt

SEQ ID NO: 5301257 - DNA, 18 bp, Homo sapiens
taaaatgtgatttttctg

SEQ ID NO: 5301258 - DNA, 21 bp, Homo sapiens
taaaatgtgatttttcttcag

SEQ ID NO: 5301259 - DNA, 21 bp, Homo sapiens
taaaatgtgcagtattttcag

SEQ ID NO: 5301260 - DNA, 23 bp, Homo sapiens
taaaatgtgggattatgggtcac

SEQ ID NO: 5301261 - DNA, 19 bp, Homo sapiens
taaaatgtgtacagtgaat

SEQ ID NO: 5301262 - DNA, 14 bp, Homo sapiens
taaaatgtgttgaa

SEQ ID NO: 5301263 - DNA, 19 bp, Homo sapiens
taaaatgtgttgaaactgc

SEQ ID NO: 5301264 - DNA, 23 bp, Homo sapiens
taaaatgtgttgttccaaatact

SEQ ID NO: 5301265 - DNA, 18 bp, Homo sapiens
taaaatgttaaaacataa

SEQ ID NO: 5301266 - DNA, 22 bp, Homo sapiens
taaaatgttcacttttgacaaa

SEQ ID NO: 5301267 - DNA, 16 bp, Homo sapiens
taaaatgttccttttg

SEQ ID NO: 5301268 - DNA, 19 bp, Homo sapiens
taaaatgttccttttgaca

SEQ ID NO: 5301269 - DNA, 22 bp, Homo sapiens
taaaatgttctccttagatgtg

SEQ ID NO: 5301270 - DNA, 12 bp, Homo sapiens
taaaatgtttaa

SEQ ID NO: 5301271 - DNA, 19 bp, Homo sapiens
taaaatgtttacattttct

SEQ ID NO: 5301272 - DNA, 20 bp, Homo sapiens
taaaatgtttacattttctt

SEQ ID NO: 5301273 - DNA, 15 bp, Homo sapiens
taaaatgtttactgt

SEQ ID NO: 5301274 - DNA, 16 bp, Homo sapiens
taaaatgtttactgta

SEQ ID NO: 5301275 - DNA, 19 bp, Homo sapiens
taaaatgtttaggaaattt

SEQ ID NO: 5301276 - DNA, 12 bp, Homo sapiens
taaaatgtttca

SEQ ID NO: 5301277 - DNA, 13 bp, Homo sapiens
taaaatgtttcat

SEQ ID NO: 5301278 - DNA, 22 bp, Homo sapiens
taaaatgtttcattatgcactt

SEQ ID NO: 5301279 - DNA, 19 bp, Homo sapiens
taaaatgttttatgacatt

SEQ ID NO: 5301280 - DNA, 21 bp, Homo sapiens
taaaatgttttcagctaggaa

SEQ ID NO: 5301281 - DNA, 15 bp, Homo sapiens
taaaattaaaagttt

SEQ ID NO: 5301282 - DNA, 14 bp, Homo sapiens
taaaattaaagaaa

SEQ ID NO: 5301283 - DNA, 17 bp, Homo sapiens
taaaattaaataaattt

SEQ ID NO: 5301284 - DNA, 14 bp, Homo sapiens
taaaattaaatact

SEQ ID NO: 5301285 - DNA, 13 bp, Homo sapiens
taaaattaaatgc

SEQ ID NO: 5301286 - DNA, 23 bp, Homo sapiens
taaaattaaatttgatggttgaa

SEQ ID NO: 5301287 - DNA, 10 bp, Homo sapiens
taaaattaag

SEQ ID NO: 5301288 - DNA, 15 bp, Homo sapiens
taaaattaagaatgt

SEQ ID NO: 5301289 - DNA, 15 bp, Homo sapiens
taaaattaagatttc

SEQ ID NO: 5301290 - DNA, 14 bp, Homo sapiens
taaaattaagttga

SEQ ID NO: 5301291 - DNA, 20 bp, Homo sapiens
taaaattaatgcagatttct

SEQ ID NO: 5301292 - DNA, 14 bp, Homo sapiens
taaacctaattgtg

SEQ ID NO: 5301293 - DNA, 14 bp, Homo sapiens
taaacctatctgta

SEQ ID NO: 5301294 - DNA, 19 bp, Homo sapiens
taaacctcaaaatgtctaa

SEQ ID NO: 5301295 - DNA, 14 bp, Homo sapiens
taaacctgaagatg

SEQ ID NO: 5301296 - DNA, 17 bp, Homo sapiens
taaacctgaagatgtct

SEQ ID NO: 5301297 - DNA, 23 bp, Homo sapiens
taaacctgaagatgtctcctcaa

SEQ ID NO: 5301298 - DNA, 14 bp, Homo sapiens
taaacctgaggcag

SEQ ID NO: 5301299 - DNA, 17 bp, Homo sapiens
taaacctggagatgatg

SEQ ID NO: 5301300 - DNA, 12 bp, Homo sapiens
taaacctggagg

SEQ ID NO: 5301301 - DNA, 16 bp, Homo sapiens
taaacctgtgcctccc

SEQ ID NO: 5301302 - DNA, 22 bp, Homo sapiens
taaacctgttcctgactgttct

SEQ ID NO: 5301303 - DNA, 23 bp, Homo sapiens
taaaccttaaatgaaaaaaatga

SEQ ID NO: 5301304 - DNA, 15 bp, Homo sapiens
taaaccttaagtaag

SEQ ID NO: 5301305 - DNA, 14 bp, Homo sapiens
taaaccttaatatt

SEQ ID NO: 5301306 - DNA, 13 bp, Homo sapiens
taaaccttatgaa

SEQ ID NO: 5301307 - DNA, 14 bp, Homo sapiens
taaaccttcagaag

SEQ ID NO: 5301308 - DNA, 16 bp, Homo sapiens
taaaccttgtcaataa

SEQ ID NO: 5301309 - DNA, 23 bp, Homo sapiens
taaaccttgtgctacttagtaaa

SEQ ID NO: 5301310 - DNA, 19 bp, Homo sapiens
taaaccttgtttctttctg

SEQ ID NO: 5301311 - DNA, 21 bp, Homo sapiens
taaaccttgtttctttctgaa

SEQ ID NO: 5301312 - DNA, 13 bp, Homo sapiens
taaacctttcagt

SEQ ID NO: 5301313 - DNA, 16 bp, Homo sapiens
taaacctttcataatt

SEQ ID NO: 5301314 - DNA, 14 bp, Homo sapiens
taaacctttttctt

SEQ ID NO: 5301315 - DNA, 22 bp, Homo sapiens
taaacctttttcttgatcttaa

SEQ ID NO: 5301316 - DNA, 15 bp, Homo sapiens
taaacgaaacacaga

SEQ ID NO: 5301317 - DNA, 13 bp, Homo sapiens
taaacgaaacatt

SEQ ID NO: 5301318 - DNA, 16 bp, Homo sapiens
taaacgaaacatttag

SEQ ID NO: 5301319 - DNA, 14 bp, Homo sapiens
taaacgaagataaa

SEQ ID NO: 5301320 - DNA, 16 bp, Homo sapiens
taaacgaccaaactca

SEQ ID NO: 5301321 - DNA, 19 bp, Homo sapiens
taaacgactccgagaacaa

SEQ ID NO: 5301322 - DNA, 17 bp, Homo sapiens
taaacgatatatgtaaa

SEQ ID NO: 5301323 - DNA, 21 bp, Homo sapiens
taaacgatatatgtaaatata

SEQ ID NO: 5301324 - DNA, 18 bp, Homo sapiens
taaacgatttaattctct

SEQ ID NO: 5301325 - DNA, 22 bp, Homo sapiens
taaacgatttaattctcttgaa

SEQ ID NO: 5301326 - DNA, 17 bp, Homo sapiens
taaacgatttttaaaat

SEQ ID NO: 5301327 - DNA, 18 bp, Homo sapiens
taaacgatttttaaaatg

SEQ ID NO: 5301328 - DNA, 19 bp, Homo sapiens
taaacgcaagctgagctgg

SEQ ID NO: 5301329 - DNA, 14 bp, Homo sapiens
taaacggattattt

SEQ ID NO: 5301330 - DNA, 18 bp, Homo sapiens
taaacggattattttttc

SEQ ID NO: 5301331 - DNA, 21 bp, Homo sapiens
taaacggattattttttcaga

SEQ ID NO: 5301332 - DNA, 23 bp, Homo sapiens
taaacggattattttttcagacc

SEQ ID NO: 5301333 - DNA, 16 bp, Homo sapiens
taaacggcccaggcca

SEQ ID NO: 5301334 - DNA, 16 bp, Homo sapiens
taaacggttcagtttc

SEQ ID NO: 5301335 - DNA, 20 bp, Homo sapiens
taaacggttcagtttcttct

SEQ ID NO: 5301336 - DNA, 21 bp, Homo sapiens
taaacggttcagtttcttctg

SEQ ID NO: 5301337 - DNA, 16 bp, Homo sapiens
taaacggtttttatta

SEQ ID NO: 5301338 - DNA, 22 bp, Homo sapiens
taaacggtttttattaaagatg

SEQ ID NO: 5301339 - DNA, 17 bp, Homo sapiens
taaacgtaagcactgtt

SEQ ID NO: 5301340 - DNA, 15 bp, Homo sapiens
taaacgtatgcatgt

SEQ ID NO: 5301341 - DNA, 22 bp, Homo sapiens
taaacgtattttgatcagtgtt

SEQ ID NO: 5301342 - DNA, 22 bp, Homo sapiens
taaacgtcaccaaggtggcttc

SEQ ID NO: 5301343 - DNA, 19 bp, Homo sapiens
taaacgtgaactaagattt

SEQ ID NO: 5301344 - DNA, 22 bp, Homo sapiens
taaacgtgatgatcagctgttt

SEQ ID NO: 5301345 - DNA, 18 bp, Homo sapiens
taaacgtgatttttaaat

SEQ ID NO: 5301346 - DNA, 21 bp, Homo sapiens
taaacgtgatttttaaattaa

SEQ ID NO: 5301347 - DNA, 23 bp, Homo sapiens
taaacgtggagaatcacaggctg

SEQ ID NO: 5301348 - DNA, 16 bp, Homo sapiens
taaacgtggattttaa

SEQ ID NO: 5301349 - DNA, 20 bp, Homo sapiens
taaacgtggattttaaaaaa

SEQ ID NO: 5301350 - DNA, 15 bp, Homo sapiens
taaacgtggtcacct

SEQ ID NO: 5301351 - DNA, 19 bp, Homo sapiens
taaacgtggtcaccttcga

SEQ ID NO: 5301352 - DNA, 14 bp, Homo sapiens
taaacgtgtaaatt

SEQ ID NO: 5301353 - DNA, 23 bp, Homo sapiens
taaacgtgtatgtttttcagttc

SEQ ID NO: 5301354 - DNA, 17 bp, Homo sapiens
taaactaaagaaaaatt

SEQ ID NO: 5301355 - DNA, 20 bp, Homo sapiens
taaactaaagtatggtacat

SEQ ID NO: 5301356 - DNA, 23 bp, Homo sapiens
taaactaaagtgtgctttataaa

SEQ ID NO: 5301357 - DNA, 14 bp, Homo sapiens
taaactaaatgtgc

SEQ ID NO: 5301358 - DNA, 23 bp, Homo sapiens
taaactaatacgtgccagatata

SEQ ID NO: 5301359 - DNA, 15 bp, Homo sapiens
taaactaatgaacaa

SEQ ID NO: 5301360 - DNA, 23 bp, Homo sapiens
taaactaatgagtttcttttata

SEQ ID NO: 5301361 - DNA, 19 bp, Homo sapiens
taaactacaaagtaaaatg

SEQ ID NO: 5301362 - DNA, 16 bp, Homo sapiens
taaactacagaatatt

SEQ ID NO: 5301363 - DNA, 22 bp, Homo sapiens
taaactacattaggttgtgaat

SEQ ID NO: 5301364 - DNA, 21 bp, Homo sapiens
taaactaccaccctcgctgcc

SEQ ID NO: 5301365 - DNA, 22 bp, Homo sapiens
taaactaccaccctcgctgcca

SEQ ID NO: 5301366 - DNA, 18 bp, Homo sapiens
taaactaccctccagagt

SEQ ID NO: 5301367 - DNA, 22 bp, Homo sapiens
taaactactatttttctttcca

SEQ ID NO: 5301368 - DNA, 18 bp, Homo sapiens
taaactactctttgattt

SEQ ID NO: 5301369 - DNA, 21 bp, Homo sapiens
taaactactgattacttgtaa

SEQ ID NO: 5301370 - DNA, 13 bp, Homo sapiens
taaactactgtaa

SEQ ID NO: 5301371 - DNA, 14 bp, Homo sapiens
taaactactgtaat

SEQ ID NO: 5301372 - DNA, 22 bp, Homo sapiens
taaactagcatatctgccttta

SEQ ID NO: 5301373 - DNA, 17 bp, Homo sapiens
taaactagggttttggc

SEQ ID NO: 5301374 - DNA, 19 bp, Homo sapiens
taaactagggttttggcct

SEQ ID NO: 5301375 - DNA, 23 bp, Homo sapiens
taaactagttgtctgaattgaga

SEQ ID NO: 5301376 - DNA, 17 bp, Homo sapiens
taaactagtttaagggt

SEQ ID NO: 5301377 - DNA, 12 bp, Homo sapiens
taaactagtttc

SEQ ID NO: 5301378 - DNA, 15 bp, Homo sapiens
taaactagtttccag

SEQ ID NO: 5301379 - DNA, 16 bp, Homo sapiens
taaactagtttccagt

SEQ ID NO: 5301380 - DNA, 17 bp, Homo sapiens
taaactagtttccagtg

SEQ ID NO: 5301381 - DNA, 16 bp, Homo sapiens
taaactataaactact

SEQ ID NO: 5301382 - DNA, 19 bp, Homo sapiens
taaactataaactactgta

SEQ ID NO: 5301383 - DNA, 17 bp, Homo sapiens
taaactataagcaagaa

SEQ ID NO: 5301384 - DNA, 14 bp, Homo sapiens
taaactatattttc

SEQ ID NO: 5301385 - DNA, 15 bp, Homo sapiens
taaactatctgtatt

SEQ ID NO: 5301386 - DNA, 18 bp, Homo sapiens
taaactattagagtattt

SEQ ID NO: 5301387 - DNA, 17 bp, Homo sapiens
taaactattggaaagta

SEQ ID NO: 5301388 - DNA, 23 bp, Homo sapiens
taaactatttatatcacacaata

SEQ ID NO: 5301389 - DNA, 19 bp, Homo sapiens
taaactcaaaactcttgaa

SEQ ID NO: 5301390 - DNA, 16 bp, Homo sapiens
taaactcaaaatattt

SEQ ID NO: 5301391 - DNA, 21 bp, Homo sapiens
taaactcaaaatatttgtaca

SEQ ID NO: 5301392 - DNA, 14 bp, Homo sapiens
taaactcaagattt

SEQ ID NO: 5301393 - DNA, 15 bp, Homo sapiens
taaactcagatctga

SEQ ID NO: 5301394 - DNA, 22 bp, Homo sapiens
taaactcatctgaaatgttaca

SEQ ID NO: 5301395 - DNA, 14 bp, Homo sapiens
taaactcatttata

SEQ ID NO: 5301396 - DNA, 16 bp, Homo sapiens
taaactccatgatatt

SEQ ID NO: 5301397 - DNA, 21 bp, Homo sapiens
taaactccctggctgttctga

SEQ ID NO: 5301398 - DNA, 23 bp, Homo sapiens
taaactcctggcctcaagcaatc

SEQ ID NO: 5301399 - DNA, 15 bp, Homo sapiens
taaactcctgtcctt

SEQ ID NO: 5301400 - DNA, 18 bp, Homo sapiens
taaactctggacactcta

SEQ ID NO: 5301401 - DNA, 12 bp, Homo sapiens
taaactcttcaa

SEQ ID NO: 5301402 - DNA, 15 bp, Homo sapiens
taaactgaagaagga

SEQ ID NO: 5301403 - DNA, 16 bp, Homo sapiens
taaactgaagaaggat

SEQ ID NO: 5301404 - DNA, 16 bp, Homo sapiens
taaactgaagctgctg

SEQ ID NO: 5301405 - DNA, 17 bp, Homo sapiens
taaactgaagctgctgt

SEQ ID NO: 5301406 - DNA, 14 bp, Homo sapiens
taaactgaattttt

SEQ ID NO: 5301407 - DNA, 22 bp, Homo sapiens
taaactgaatttttcttgcgaa

SEQ ID NO: 5301408 - DNA, 15 bp, Homo sapiens
taaactgactatcat

SEQ ID NO: 5301409 - DNA, 14 bp, Homo sapiens
taaactgactttat

SEQ ID NO: 5301410 - DNA, 15 bp, Homo sapiens
taaactgactttatc

SEQ ID NO: 5301411 - DNA, 16 bp, Homo sapiens
taaactgactttatcc

SEQ ID NO: 5301412 - DNA, 13 bp, Homo sapiens
taaactgactttt

SEQ ID NO: 5301413 - DNA, 21 bp, Homo sapiens
taaactgactttttcccccca

SEQ ID NO: 5301414 - DNA, 18 bp, Homo sapiens
taaactgagagtaattca

SEQ ID NO: 5301415 - DNA, 21 bp, Homo sapiens
taaactgagagtaattcatct

SEQ ID NO: 5301416 - DNA, 18 bp, Homo sapiens
taaactgagctcgcagcc

SEQ ID NO: 5301417 - DNA, 19 bp, Homo sapiens
taaactgagctgaatgttt

SEQ ID NO: 5301418 - DNA, 18 bp, Homo sapiens
taaactgagtagcagaaa

SEQ ID NO: 5301419 - DNA, 13 bp, Homo sapiens
taaactgatgtat

SEQ ID NO: 5301420 - DNA, 15 bp, Homo sapiens
taaactgatgtatag

SEQ ID NO: 5301421 - DNA, 12 bp, Homo sapiens
taaactgcagcc

SEQ ID NO: 5301422 - DNA, 16 bp, Homo sapiens
taaactgcagcctctc

SEQ ID NO: 5301423 - DNA, 16 bp, Homo sapiens
taaactgcaggagcag

SEQ ID NO: 5301424 - DNA, 23 bp, Homo sapiens
taaactgcaggagcagtttgcca

SEQ ID NO: 5301425 - DNA, 14 bp, Homo sapiens
taaactgcagtttt

SEQ ID NO: 5301426 - DNA, 20 bp, Homo sapiens
taaactgccccctctgccct

SEQ ID NO: 5301427 - DNA, 22 bp, Homo sapiens
taaactgccccctctgccctgc

SEQ ID NO: 5301428 - DNA, 23 bp, Homo sapiens
taaactgccccctctgccctgcg

SEQ ID NO: 5301429 - DNA, 13 bp, Homo sapiens
taaactgccctgt

SEQ ID NO: 5301430 - DNA, 16 bp, Homo sapiens
taaactgccctgtcta

SEQ ID NO: 5301431 - DNA, 11 bp, Homo sapiens
taaactgcggt

SEQ ID NO: 5301432 - DNA, 12 bp, Homo sapiens
taaactggagac

SEQ ID NO: 5301433 - DNA, 16 bp, Homo sapiens
taaactggagactgtg

SEQ ID NO: 5301434 - DNA, 23 bp, Homo sapiens
taaactggagactgtgtgtgccc

SEQ ID NO: 5301435 - DNA, 21 bp, Homo sapiens
taaactggagaggctaacctc

SEQ ID NO: 5301436 - DNA, 16 bp, Homo sapiens
taaactggatactgta

SEQ ID NO: 5301437 - DNA, 18 bp, Homo sapiens
taaactggcatctgctct

SEQ ID NO: 5301438 - DNA, 19 bp, Homo sapiens
taaactgggaaggctttca

SEQ ID NO: 5301439 - DNA, 22 bp, Homo sapiens
taaactggggagttataaaaat

SEQ ID NO: 5301440 - DNA, 20 bp, Homo sapiens
taaactggtatgaataattg

SEQ ID NO: 5301441 - DNA, 14 bp, Homo sapiens
taaactgtaaatca

SEQ ID NO: 5301442 - DNA, 19 bp, Homo sapiens
taaactgtacaaatgaaat

SEQ ID NO: 5301443 - DNA, 12 bp, Homo sapiens
taaactgtacag

SEQ ID NO: 5301444 - DNA, 17 bp, Homo sapiens
taaactgtacagtgtct

SEQ ID NO: 5301445 - DNA, 20 bp, Homo sapiens
taaactgtactagtctgtgt

SEQ ID NO: 5301446 - DNA, 22 bp, Homo sapiens
taaactgtagctgtattagcag

SEQ ID NO: 5301447 - DNA, 22 bp, Homo sapiens
taaactgtatcaaatctgtata

SEQ ID NO: 5301448 - DNA, 18 bp, Homo sapiens
taaactgtattaaatctt

SEQ ID NO: 5301449 - DNA, 13 bp, Homo sapiens
taaactgtatttt

SEQ ID NO: 5301450 - DNA, 19 bp, Homo sapiens
taaactgtcctctttcaga

SEQ ID NO: 5301451 - DNA, 19 bp, Homo sapiens
taaactgtgaaaaatcaga

SEQ ID NO: 5301452 - DNA, 12 bp, Homo sapiens
taaactgtgcac

SEQ ID NO: 5301453 - DNA, 18 bp, Homo sapiens
taaactgtgtacataact

SEQ ID NO: 5301454 - DNA, 17 bp, Homo sapiens
taaactgtgtattccaa

SEQ ID NO: 5301455 - DNA, 20 bp, Homo sapiens
taaactgtgtggactgtgat

SEQ ID NO: 5301456 - DNA, 13 bp, Homo sapiens
taaactgtgttta

SEQ ID NO: 5301457 - DNA, 20 bp, Homo sapiens
taaactgtgttttagtgtaa

SEQ ID NO: 5301458 - DNA, 16 bp, Homo sapiens
taaactgttagcactg

SEQ ID NO: 5301459 - DNA, 20 bp, Homo sapiens
taaactgttgttttgtatga

SEQ ID NO: 5301460 - DNA, 13 bp, Homo sapiens
taaactgtttctc

SEQ ID NO: 5301461 - DNA, 20 bp, Homo sapiens
taaactgtttctcaggcact

SEQ ID NO: 5301462 - DNA, 18 bp, Homo sapiens
taaactgtttctttaaaa

SEQ ID NO: 5301463 - DNA, 17 bp, Homo sapiens
taaactgttttcaagtc

SEQ ID NO: 5301464 - DNA, 16 bp, Homo sapiens
taaactgttttcatgt

SEQ ID NO: 5301465 - DNA, 14 bp, Homo sapiens
taaacttaatctaa

SEQ ID NO: 5301466 - DNA, 18 bp, Homo sapiens
taaacttaatctaaatgg

SEQ ID NO: 5301467 - DNA, 15 bp, Homo sapiens
taaacttataaatca

SEQ ID NO: 5301468 - DNA, 13 bp, Homo sapiens
taaacttatgaat

SEQ ID NO: 5301469 - DNA, 14 bp, Homo sapiens
taaagctactgaat

SEQ ID NO: 5301470 - DNA, 15 bp, Homo sapiens
taaagctactgaatt

SEQ ID NO: 5301471 - DNA, 19 bp, Homo sapiens
taaagctactgatttcctt

SEQ ID NO: 5301472 - DNA, 16 bp, Homo sapiens
taaagctactgtagaa

SEQ ID NO: 5301473 - DNA, 22 bp, Homo sapiens
taaagctactgtagaaacaaag

SEQ ID NO: 5301474 - DNA, 14 bp, Homo sapiens
taaagctagaaatg

SEQ ID NO: 5301475 - DNA, 14 bp, Homo sapiens
taaagctatgttac

SEQ ID NO: 5301476 - DNA, 16 bp, Homo sapiens
taaagctatgttacat

SEQ ID NO: 5301477 - DNA, 14 bp, Homo sapiens
taaagctcaaatga

SEQ ID NO: 5301478 - DNA, 15 bp, Homo sapiens
taaagctcaaatgaa

SEQ ID NO: 5301479 - DNA, 20 bp, Homo sapiens
taaagctcaaatgaaatgta

SEQ ID NO: 5301480 - DNA, 19 bp, Homo sapiens
taaagctcacacttgggct

SEQ ID NO: 5301481 - DNA, 12 bp, Homo sapiens
taaagctccctt

SEQ ID NO: 5301482 - DNA, 14 bp, Homo sapiens
taaagctcctctgc

SEQ ID NO: 5301483 - DNA, 16 bp, Homo sapiens
taaagctcctctgctc

SEQ ID NO: 5301484 - DNA, 20 bp, Homo sapiens
taaagctcctctgctccacc

SEQ ID NO: 5301485 - DNA, 18 bp, Homo sapiens
taaagctcgaaaacaatt

SEQ ID NO: 5301486 - DNA, 22 bp, Homo sapiens
taaagctcgtagaaacaagaca

SEQ ID NO: 5301487 - DNA, 20 bp, Homo sapiens
taaagctctcaaatgtgacc

SEQ ID NO: 5301488 - DNA, 14 bp, Homo sapiens
taaagctctgacat

SEQ ID NO: 5301489 - DNA, 18 bp, Homo sapiens
taaagctgcctgtagtta

SEQ ID NO: 5301490 - DNA, 12 bp, Homo sapiens
taaagctgctag

SEQ ID NO: 5301491 - DNA, 16 bp, Homo sapiens
taaagctggacaagaa

SEQ ID NO: 5301492 - DNA, 22 bp, Homo sapiens
taaagctggacaagaagctgct

SEQ ID NO: 5301493 - DNA, 13 bp, Homo sapiens
taaagctgtacac

SEQ ID NO: 5301494 - DNA, 21 bp, Homo sapiens
taaagctgtgacagttctgtt

SEQ ID NO: 5301495 - DNA, 16 bp, Homo sapiens
taaagctgttaaaata

SEQ ID NO: 5301496 - DNA, 23 bp, Homo sapiens
taaagctgttctcattcctgttc

SEQ ID NO: 5301497 - DNA, 15 bp, Homo sapiens
taaagctgtttctaa

SEQ ID NO: 5301498 - DNA, 17 bp, Homo sapiens
taaagctgtttctaaac

SEQ ID NO: 5301499 - DNA, 17 bp, Homo sapiens
taaagcttaaactgaat

SEQ ID NO: 5301500 - DNA, 13 bp, Homo sapiens
taaagcttaaatt

SEQ ID NO: 5301501 - DNA, 16 bp, Homo sapiens
taaagcttatccataa

SEQ ID NO: 5301502 - DNA, 17 bp, Homo sapiens
taaagcttatttttatg

SEQ ID NO: 5301503 - DNA, 19 bp, Homo sapiens
taaagcttatttttctgtg

SEQ ID NO: 5301504 - DNA, 22 bp, Homo sapiens
taaagcttccctctcagctgct

SEQ ID NO: 5301505 - DNA, 15 bp, Homo sapiens
taaagcttctctctg

SEQ ID NO: 5301506 - DNA, 18 bp, Homo sapiens
taaagcttctctctgagc

SEQ ID NO: 5301507 - DNA, 22 bp, Homo sapiens
taaagcttgatttgatctttgt

SEQ ID NO: 5301508 - DNA, 19 bp, Homo sapiens
taaagcttgcaacaaaatt

SEQ ID NO: 5301509 - DNA, 11 bp, Homo sapiens
taaagcttgtc

SEQ ID NO: 5301510 - DNA, 17 bp, Homo sapiens
taaagcttgtggcccct

SEQ ID NO: 5301511 - DNA, 17 bp, Homo sapiens
taaagctttatctttgt

SEQ ID NO: 5301512 - DNA, 18 bp, Homo sapiens
taaagctttatctttgtg

SEQ ID NO: 5301513 - DNA, 23 bp, Homo sapiens
taaagctttcagaatatgtcagt

SEQ ID NO: 5301514 - DNA, 20 bp, Homo sapiens
taaagctttgaatatctgca

SEQ ID NO: 5301515 - DNA, 16 bp, Homo sapiens
taaagcttttgatgtg

SEQ ID NO: 5301516 - DNA, 15 bp, Homo sapiens
taaagcttttggaag

SEQ ID NO: 5301517 - DNA, 22 bp, Homo sapiens
taaagcttttttttttttccca

SEQ ID NO: 5301518 - DNA, 16 bp, Homo sapiens
taaaggaaaaatcata

SEQ ID NO: 5301519 - DNA, 11 bp, Homo sapiens
taaaggaaaag

SEQ ID NO: 5301520 - DNA, 22 bp, Homo sapiens
taaaggaaaagcacaagaaact

SEQ ID NO: 5301521 - DNA, 20 bp, Homo sapiens
taaaggaaacacgtttagaa

SEQ ID NO: 5301522 - DNA, 20 bp, Homo sapiens
taaaggaaacactaaggctg

SEQ ID NO: 5301523 - DNA, 15 bp, Homo sapiens
taaaggaagaaacca

SEQ ID NO: 5301524 - DNA, 14 bp, Homo sapiens
taaaggacactgga

SEQ ID NO: 5301525 - DNA, 16 bp, Homo sapiens
taaaggaccctgtttc

SEQ ID NO: 5301526 - DNA, 21 bp, Homo sapiens
taaaggaccctgtttctgtag

SEQ ID NO: 5301527 - DNA, 21 bp, Homo sapiens
taaaggactatttataactaa

SEQ ID NO: 5301528 - DNA, 22 bp, Homo sapiens
taaaggactgatttgatgcctc

SEQ ID NO: 5301529 - DNA, 12 bp, Homo sapiens
taaaggactgta

SEQ ID NO: 5301530 - DNA, 13 bp, Homo sapiens
taaaggagcagaa

SEQ ID NO: 5301531 - DNA, 22 bp, Homo sapiens
taaaggagcatttttttattca

SEQ ID NO: 5301532 - DNA, 23 bp, Homo sapiens
taaaggagcatttttttattcag

SEQ ID NO: 5301533 - DNA, 13 bp, Homo sapiens
taaaggaggaatc

SEQ ID NO: 5301534 - DNA, 15 bp, Homo sapiens
taaaggaggaatcag

SEQ ID NO: 5301535 - DNA, 17 bp, Homo sapiens
taaaggaggaatcagac

SEQ ID NO: 5301536 - DNA, 14 bp, Homo sapiens
taaaggataaagaa

SEQ ID NO: 5301537 - DNA, 23 bp, Homo sapiens
taaaggatatgaaactctacatt

SEQ ID NO: 5301538 - DNA, 17 bp, Homo sapiens
taaaggatatttcaaat

SEQ ID NO: 5301539 - DNA, 19 bp, Homo sapiens
taaaggatcagctggttca

SEQ ID NO: 5301540 - DNA, 16 bp, Homo sapiens
taaaggatgctgctgt

SEQ ID NO: 5301541 - DNA, 19 bp, Homo sapiens
taaaggatggaaaaataaa

SEQ ID NO: 5301542 - DNA, 21 bp, Homo sapiens
taaaggattgatcactttgtt

SEQ ID NO: 5301543 - DNA, 22 bp, Homo sapiens
taaaggattgatcactttgtta

SEQ ID NO: 5301544 - DNA, 21 bp, Homo sapiens
taaaggcaatggtttgtgtca

SEQ ID NO: 5301545 - DNA, 15 bp, Homo sapiens
taaaggcacaaatag

SEQ ID NO: 5301546 - DNA, 17 bp, Homo sapiens
taaaggcacaaatagga

SEQ ID NO: 5301547 - DNA, 21 bp, Homo sapiens
taaaggcagacagttttgctt

SEQ ID NO: 5301548 - DNA, 14 bp, Homo sapiens
taaaggcagctgcc

SEQ ID NO: 5301549 - DNA, 17 bp, Homo sapiens
taaaggcagctgcctct

SEQ ID NO: 5301550 - DNA, 19 bp, Homo sapiens
taaaggcagctgcctctgc

SEQ ID NO: 5301551 - DNA, 17 bp, Homo sapiens
taaaggcatccttgtct

SEQ ID NO: 5301552 - DNA, 23 bp, Homo sapiens
taaaggcattgtccaaagtttat

SEQ ID NO: 5301553 - DNA, 17 bp, Homo sapiens
taaaggccacaggagac

SEQ ID NO: 5301554 - DNA, 17 bp, Homo sapiens
taaaggcccagccccta

SEQ ID NO: 5301555 - DNA, 17 bp, Homo sapiens
taaaggcctcctccccc

SEQ ID NO: 5301556 - DNA, 22 bp, Homo sapiens
taaaggcctgcgtgtgtctgtg

SEQ ID NO: 5301557 - DNA, 23 bp, Homo sapiens
taaaggcgatagctgactttcat

SEQ ID NO: 5301558 - DNA, 19 bp, Homo sapiens
taaaggctacctttgtatt

SEQ ID NO: 5301559 - DNA, 17 bp, Homo sapiens
taaaggctcgattttgt

SEQ ID NO: 5301560 - DNA, 19 bp, Homo sapiens
taaaggctcgattttgtat

SEQ ID NO: 5301561 - DNA, 16 bp, Homo sapiens
taaaggctctggaagc

SEQ ID NO: 5301562 - DNA, 13 bp, Homo sapiens
taaaggctctgtg

SEQ ID NO: 5301563 - DNA, 17 bp, Homo sapiens
taaaggcttaggcatgt

SEQ ID NO: 5301564 - DNA, 15 bp, Homo sapiens
taaaggcttctctct

SEQ ID NO: 5301565 - DNA, 17 bp, Homo sapiens
taaaggcttctctctca

SEQ ID NO: 5301566 - DNA, 22 bp, Homo sapiens
taaagggaagaaaacactgtta

SEQ ID NO: 5301567 - DNA, 16 bp, Homo sapiens
taaagggaagccctga

SEQ ID NO: 5301568 - DNA, 17 bp, Homo sapiens
taaagggaatcattttt

SEQ ID NO: 5301569 - DNA, 21 bp, Homo sapiens
taaagggaattcgatgccccc

SEQ ID NO: 5301570 - DNA, 14 bp, Homo sapiens
taaagggacactgg

SEQ ID NO: 5301571 - DNA, 19 bp, Homo sapiens
taaagggaccatctgctgc

SEQ ID NO: 5301572 - DNA, 17 bp, Homo sapiens
taaagggactacctctg

SEQ ID NO: 5301573 - DNA, 18 bp, Homo sapiens
taaagggactacctctgt

SEQ ID NO: 5301574 - DNA, 15 bp, Homo sapiens
taaagggagaaatgc

SEQ ID NO: 5301575 - DNA, 17 bp, Homo sapiens
taaagggagaaatgcca

SEQ ID NO: 5301576 - DNA, 15 bp, Homo sapiens
taaagggcctgcctg

SEQ ID NO: 5301577 - DNA, 20 bp, Homo sapiens
taaaggggacagatcttgag

SEQ ID NO: 5301578 - DNA, 18 bp, Homo sapiens
taaaggggactagacagt

SEQ ID NO: 5301579 - DNA, 21 bp, Homo sapiens
taaagggtatgagctggagct

SEQ ID NO: 5301580 - DNA, 23 bp, Homo sapiens
taaagggtgtgggtcagggaggg

SEQ ID NO: 5301581 - DNA, 18 bp, Homo sapiens
taaagggtttgagatgta

SEQ ID NO: 5301582 - DNA, 18 bp, Homo sapiens
taaaggtaaaatcacttc

SEQ ID NO: 5301583 - DNA, 16 bp, Homo sapiens
taaaggtacaatcaaa

SEQ ID NO: 5301584 - DNA, 22 bp, Homo sapiens
taaaggtacactggtatttata

SEQ ID NO: 5301585 - DNA, 21 bp, Homo sapiens
taaaggtaccaaacaaggaag

SEQ ID NO: 5301586 - DNA, 23 bp, Homo sapiens
taaaggtacgattatacttgaga

SEQ ID NO: 5301587 - DNA, 18 bp, Homo sapiens
taaaggtagagatgtgtg

SEQ ID NO: 5301588 - DNA, 15 bp, Homo sapiens
taaaggtatacaaat

SEQ ID NO: 5301589 - DNA, 22 bp, Homo sapiens
taaaggtatttagaatatatta

SEQ ID NO: 5301590 - DNA, 18 bp, Homo sapiens
taaaggtcaaggaaggaa

SEQ ID NO: 5301591 - DNA, 20 bp, Homo sapiens
taaaggtcaaggaaggaaaa

SEQ ID NO: 5301592 - DNA, 15 bp, Homo sapiens
taaaggtcctgccct

SEQ ID NO: 5301593 - DNA, 21 bp, Homo sapiens
taaaggtgacatcggaaaaat

SEQ ID NO: 5301594 - DNA, 22 bp, Homo sapiens
taaaggtgacatcggaaaaata

SEQ ID NO: 5301595 - DNA, 21 bp, Homo sapiens
taaaggtgatgaatttaccat

SEQ ID NO: 5301596 - DNA, 15 bp, Homo sapiens
taaaggtgatgtaaa

SEQ ID NO: 5301597 - DNA, 22 bp, Homo sapiens
taaaggtggtatgtgtgtgtat

SEQ ID NO: 5301598 - DNA, 18 bp, Homo sapiens
taaaggtgtagaaaaggt

SEQ ID NO: 5301599 - DNA, 19 bp, Homo sapiens
taaaggtgtcttcctccca

SEQ ID NO: 5301600 - DNA, 22 bp, Homo sapiens
taaaggttacaagcctgcacaa

SEQ ID NO: 5301601 - DNA, 13 bp, Homo sapiens
taaaggttatgaa

SEQ ID NO: 5301602 - DNA, 19 bp, Homo sapiens
taaaggttcctttgttccc

SEQ ID NO: 5301603 - DNA, 14 bp, Homo sapiens
taaaggttctatga

SEQ ID NO: 5301604 - DNA, 17 bp, Homo sapiens
taaaggttctatgatat

SEQ ID NO: 5301605 - DNA, 14 bp, Homo sapiens
taaaggttgtgaat

SEQ ID NO: 5301606 - DNA, 17 bp, Homo sapiens
taaaggtttacagtgaa

SEQ ID NO: 5301607 - DNA, 15 bp, Homo sapiens
taaaggtttattttt

SEQ ID NO: 5301608 - DNA, 21 bp, Homo sapiens
taaagtaaaaaagttaaatgt

SEQ ID NO: 5301609 - DNA, 23 bp, Homo sapiens
taaagtaaaaaagttaaatgtgt

SEQ ID NO: 5301610 - DNA, 19 bp, Homo sapiens
taaagtaaaaacaaagaaa

SEQ ID NO: 5301611 - DNA, 21 bp, Homo sapiens
taaagtaaaaagggaattatg

SEQ ID NO: 5301612 - DNA, 17 bp, Homo sapiens
taaagtaaagctaaaat

SEQ ID NO: 5301613 - DNA, 18 bp, Homo sapiens
taaagtaaatctcttttt

SEQ ID NO: 5301614 - DNA, 17 bp, Homo sapiens
taaagtaaatgctacct

SEQ ID NO: 5301615 - DNA, 13 bp, Homo sapiens
taaagtaaattat

SEQ ID NO: 5301616 - DNA, 20 bp, Homo sapiens
taaagtaacccataatctgc

SEQ ID NO: 5301617 - DNA, 14 bp, Homo sapiens
taaagtaataatgt

SEQ ID NO: 5301618 - DNA, 15 bp, Homo sapiens
taaagtaatgatgaa

SEQ ID NO: 5301619 - DNA, 16 bp, Homo sapiens
taaagtaattcataca

SEQ ID NO: 5301620 - DNA, 20 bp, Homo sapiens
taaagtaattgttccagaga

SEQ ID NO: 5301621 - DNA, 20 bp, Homo sapiens
taaagtacacaattgtttta

SEQ ID NO: 5301622 - DNA, 21 bp, Homo sapiens
taaagtacctgtagtgagaaa

SEQ ID NO: 5301623 - DNA, 22 bp, Homo sapiens
taaagtacctgtagtgagaaac

SEQ ID NO: 5301624 - DNA, 17 bp, Homo sapiens
taaagtaccttgacttt

SEQ ID NO: 5301625 - DNA, 16 bp, Homo sapiens
taaagtacctttatgt

SEQ ID NO: 5301626 - DNA, 19 bp, Homo sapiens
taaagtactactgtagaac

SEQ ID NO: 5301627 - DNA, 19 bp, Homo sapiens
taaagtactgagcagtgat

SEQ ID NO: 5301628 - DNA, 22 bp, Homo sapiens
taaagtactgagcagtgatatt

SEQ ID NO: 5301629 - DNA, 15 bp, Homo sapiens
taaagtacttgacta

SEQ ID NO: 5301630 - DNA, 17 bp, Homo sapiens
taaagtacttgactacc

SEQ ID NO: 5301631 - DNA, 21 bp, Homo sapiens
taaagtacttgagtgtaatgt

SEQ ID NO: 5301632 - DNA, 19 bp, Homo sapiens
taaagtagtaaaaattaaa

SEQ ID NO: 5301633 - DNA, 21 bp, Homo sapiens
taaagtagttattttataggg

SEQ ID NO: 5301634 - DNA, 14 bp, Homo sapiens
taaagtataacatg

SEQ ID NO: 5301635 - DNA, 18 bp, Homo sapiens
taaagtatagagagaagt

SEQ ID NO: 5301636 - DNA, 19 bp, Homo sapiens
taaagtatagagagaagtt

SEQ ID NO: 5301637 - DNA, 12 bp, Homo sapiens
taaagtatattg

SEQ ID NO: 5301638 - DNA, 14 bp, Homo sapiens
taaagtatcatgca

SEQ ID NO: 5301639 - DNA, 16 bp, Homo sapiens
taaagtatcatgcatt

SEQ ID NO: 5301640 - DNA, 20 bp, Homo sapiens
taaagtatgaatatttcatt

SEQ ID NO: 5301641 - DNA, 19 bp, Homo sapiens
taaagtatgaatctatgcc

SEQ ID NO: 5301642 - DNA, 21 bp, Homo sapiens
taaagtatgcaaaataaagaa

SEQ ID NO: 5301643 - DNA, 19 bp, Homo sapiens
taaagtatggtattgaaac

SEQ ID NO: 5301644 - DNA, 15 bp, Homo sapiens
taaagtatgtaaaca

SEQ ID NO: 5301645 - DNA, 11 bp, Homo sapiens
taaataaagct

SEQ ID NO: 5301646 - DNA, 21 bp, Homo sapiens
taaataaagtatcatgcattc

SEQ ID NO: 5301647 - DNA, 12 bp, Homo sapiens
taaataaagttt

SEQ ID NO: 5301648 - DNA, 17 bp, Homo sapiens
taaataaataaatagct

SEQ ID NO: 5301649 - DNA, 13 bp, Homo sapiens
taaataaataatc

SEQ ID NO: 5301650 - DNA, 13 bp, Homo sapiens
taaataaatagat

SEQ ID NO: 5301651 - DNA, 11 bp, Homo sapiens
taaataaatgc

SEQ ID NO: 5301652 - DNA, 14 bp, Homo sapiens
taaataaatgccaa

SEQ ID NO: 5301653 - DNA, 19 bp, Homo sapiens
taaataaatgccaacatac

SEQ ID NO: 5301654 - DNA, 16 bp, Homo sapiens
taaataaatgtcatta

SEQ ID NO: 5301655 - DNA, 13 bp, Homo sapiens
taaataaattaag

SEQ ID NO: 5301656 - DNA, 12 bp, Homo sapiens
taaataaattac

SEQ ID NO: 5301657 - DNA, 13 bp, Homo sapiens
taaataaattcaa

SEQ ID NO: 5301658 - DNA, 14 bp, Homo sapiens
taaataaattcaaa

SEQ ID NO: 5301659 - DNA, 14 bp, Homo sapiens
taaataaattgtat

SEQ ID NO: 5301660 - DNA, 17 bp, Homo sapiens
taaataaattgtatatt

SEQ ID NO: 5301661 - DNA, 15 bp, Homo sapiens
taaataaattgtttg

SEQ ID NO: 5301662 - DNA, 14 bp, Homo sapiens
taaataaattttgt

SEQ ID NO: 5301663 - DNA, 17 bp, Homo sapiens
taaataacacagatatt

SEQ ID NO: 5301664 - DNA, 18 bp, Homo sapiens
taaataacacagatattg

SEQ ID NO: 5301665 - DNA, 20 bp, Homo sapiens
taaataacacagatattgtt

SEQ ID NO: 5301666 - DNA, 16 bp, Homo sapiens
taaataacacttgtca

SEQ ID NO: 5301667 - DNA, 22 bp, Homo sapiens
taaataacaggcatttgttcac

SEQ ID NO: 5301668 - DNA, 16 bp, Homo sapiens
taaataaccaatagtt

SEQ ID NO: 5301669 - DNA, 23 bp, Homo sapiens
taaataaccaattcctcatttgt

SEQ ID NO: 5301670 - DNA, 22 bp, Homo sapiens
taaataactatataagacatta

SEQ ID NO: 5301671 - DNA, 14 bp, Homo sapiens
taaataactggaaa

SEQ ID NO: 5301672 - DNA, 13 bp, Homo sapiens
taaataactgtga

SEQ ID NO: 5301673 - DNA, 14 bp, Homo sapiens
taaataactgtgac

SEQ ID NO: 5301674 - DNA, 18 bp, Homo sapiens
taaataactgtgactgtg

SEQ ID NO: 5301675 - DNA, 13 bp, Homo sapiens
taaataactgtgt

SEQ ID NO: 5301676 - DNA, 14 bp, Homo sapiens
taaataactgtgtg

SEQ ID NO: 5301677 - DNA, 22 bp, Homo sapiens
taaataagaaacaactctttga

SEQ ID NO: 5301678 - DNA, 15 bp, Homo sapiens
taaataagaaacttt

SEQ ID NO: 5301679 - DNA, 11 bp, Homo sapiens
taaataagaga

SEQ ID NO: 5301680 - DNA, 13 bp, Homo sapiens
taaataagagatt

SEQ ID NO: 5301681 - DNA, 15 bp, Homo sapiens
taaataagagcatga

SEQ ID NO: 5301682 - DNA, 14 bp, Homo sapiens
taaataagattcta

SEQ ID NO: 5301683 - DNA, 12 bp, Homo sapiens
taaataagcaaa

SEQ ID NO: 5301684 - DNA, 15 bp, Homo sapiens
taaataagcaaataa

SEQ ID NO: 5301685 - DNA, 17 bp, Homo sapiens
taaataagcaaataaac

SEQ ID NO: 5301686 - DNA, 16 bp, Homo sapiens
taaataagcgtttaat

SEQ ID NO: 5301687 - DNA, 23 bp, Homo sapiens
taaataagcgtttaatggtatct

SEQ ID NO: 5301688 - DNA, 17 bp, Homo sapiens
taaataaggaaaagctt

SEQ ID NO: 5301689 - DNA, 22 bp, Homo sapiens
taaataaggaatttcctcccaa

SEQ ID NO: 5301690 - DNA, 14 bp, Homo sapiens
taaataagtaaata

SEQ ID NO: 5301691 - DNA, 18 bp, Homo sapiens
taaataagtaaatacatt

SEQ ID NO: 5301692 - DNA, 19 bp, Homo sapiens
taaataataaaggttctat

SEQ ID NO: 5301693 - DNA, 18 bp, Homo sapiens
taaataatataaaatgtt

SEQ ID NO: 5301694 - DNA, 18 bp, Homo sapiens
taaataatctgtgagtga

SEQ ID NO: 5301695 - DNA, 22 bp, Homo sapiens
taaataatctgtgagtgaaagt

SEQ ID NO: 5301696 - DNA, 12 bp, Homo sapiens
taaataatgaaa

SEQ ID NO: 5301697 - DNA, 20 bp, Homo sapiens
taaataatgaataaactgaa

SEQ ID NO: 5301698 - DNA, 14 bp, Homo sapiens
taaataatgatctt

SEQ ID NO: 5301699 - DNA, 15 bp, Homo sapiens
taaataatgattcaa

SEQ ID NO: 5301700 - DNA, 18 bp, Homo sapiens
taaataatgcttaacata

SEQ ID NO: 5301701 - DNA, 16 bp, Homo sapiens
taaataatgctttgaa

SEQ ID NO: 5301702 - DNA, 15 bp, Homo sapiens
taaataatgtacata

SEQ ID NO: 5301703 - DNA, 18 bp, Homo sapiens
taaataatgtatttactt

SEQ ID NO: 5301704 - DNA, 17 bp, Homo sapiens
taaataatttatttaat

SEQ ID NO: 5301705 - DNA, 19 bp, Homo sapiens
taaataattttaaataacc

SEQ ID NO: 5301706 - DNA, 14 bp, Homo sapiens
taaataattttaca

SEQ ID NO: 5301707 - DNA, 16 bp, Homo sapiens
taaataattttacatg

SEQ ID NO: 5301708 - DNA, 13 bp, Homo sapiens
taaataattttct

SEQ ID NO: 5301709 - DNA, 22 bp, Homo sapiens
taaataattttctaagacagtt

SEQ ID NO: 5301710 - DNA, 18 bp, Homo sapiens
taaataattttgttttaa

SEQ ID NO: 5301711 - DNA, 21 bp, Homo sapiens
taaataattttgttttaatct

SEQ ID NO: 5301712 - DNA, 14 bp, Homo sapiens
taaatacaaaaatg

SEQ ID NO: 5301713 - DNA, 17 bp, Homo sapiens
taaatacaaaaatgaat

SEQ ID NO: 5301714 - DNA, 23 bp, Homo sapiens
taaatacaaaataaaattatggt

SEQ ID NO: 5301715 - DNA, 15 bp, Homo sapiens
taaatacaaatctgt

SEQ ID NO: 5301716 - DNA, 15 bp, Homo sapiens
taaatacaaattttg

SEQ ID NO: 5301717 - DNA, 14 bp, Homo sapiens
taaatacaagactg

SEQ ID NO: 5301718 - DNA, 15 bp, Homo sapiens
taaatacaagactgt

SEQ ID NO: 5301719 - DNA, 16 bp, Homo sapiens
taaatacaagactgtt

SEQ ID NO: 5301720 - DNA, 19 bp, Homo sapiens
taaatacaagttctattta

SEQ ID NO: 5301721 - DNA, 20 bp, Homo sapiens
taaatacacagcatgcagac

SEQ ID NO: 5301722 - DNA, 16 bp, Homo sapiens
taaatacacattatca

SEQ ID NO: 5301723 - DNA, 15 bp, Homo sapiens
taaatacactgtgaa

SEQ ID NO: 5301724 - DNA, 15 bp, Homo sapiens
taaatacagacacta

SEQ ID NO: 5301725 - DNA, 19 bp, Homo sapiens
taaatacagataattcatt

SEQ ID NO: 5301726 - DNA, 22 bp, Homo sapiens
taaatacagataattcatttgt

SEQ ID NO: 5301727 - DNA, 15 bp, Homo sapiens
taaatacaggaaaca

SEQ ID NO: 5301728 - DNA, 13 bp, Homo sapiens
taaatacagtctt

SEQ ID NO: 5301729 - DNA, 17 bp, Homo sapiens
taaatacagtcttccat

SEQ ID NO: 5301730 - DNA, 15 bp, Homo sapiens
taaatacataaataa

SEQ ID NO: 5301731 - DNA, 20 bp, Homo sapiens
taaatacatgcacacacttg

SEQ ID NO: 5301732 - DNA, 20 bp, Homo sapiens
taaatacatgcatataatga

SEQ ID NO: 5301733 - DNA, 20 bp, Homo sapiens
taaatacatgccacatcaaa

SEQ ID NO: 5301734 - DNA, 16 bp, Homo sapiens
taaatacatggaaatc

SEQ ID NO: 5301735 - DNA, 15 bp, Homo sapiens
taaatacatgtgtgg

SEQ ID NO: 5301736 - DNA, 14 bp, Homo sapiens
taaataccaaagat

SEQ ID NO: 5301737 - DNA, 14 bp, Homo sapiens
taaataccaagagc

SEQ ID NO: 5301738 - DNA, 17 bp, Homo sapiens
taaataccaagagcaat

SEQ ID NO: 5301739 - DNA, 17 bp, Homo sapiens
taaataccagacacgta

SEQ ID NO: 5301740 - DNA, 18 bp, Homo sapiens
taaataccagactgcagg

SEQ ID NO: 5301741 - DNA, 20 bp, Homo sapiens
taaatacccattgaactctg

SEQ ID NO: 5301742 - DNA, 21 bp, Homo sapiens
taaatactaactgctgatttt

SEQ ID NO: 5301743 - DNA, 13 bp, Homo sapiens
taaatactggact

SEQ ID NO: 5301744 - DNA, 17 bp, Homo sapiens
taaatactggactcagg

SEQ ID NO: 5301745 - DNA, 23 bp, Homo sapiens
taaatactggactcaggaacttt

SEQ ID NO: 5301746 - DNA, 17 bp, Homo sapiens
taaatactgtacataga

SEQ ID NO: 5301747 - DNA, 13 bp, Homo sapiens
taaatactgtgaa

SEQ ID NO: 5301748 - DNA, 17 bp, Homo sapiens
taaatactgtgcagaat

SEQ ID NO: 5301749 - DNA, 20 bp, Homo sapiens
taaatactgtgcagaataat

SEQ ID NO: 5301750 - DNA, 21 bp, Homo sapiens
taaatactgtgcagaataatg

SEQ ID NO: 5301751 - DNA, 21 bp, Homo sapiens
taaatactgtgtggaactttt

SEQ ID NO: 5301752 - DNA, 18 bp, Homo sapiens
taaatactttaacttcca

SEQ ID NO: 5301753 - DNA, 16 bp, Homo sapiens
taaatactttccatgt

SEQ ID NO: 5301754 - DNA, 17 bp, Homo sapiens
taaatactttttcagtt

SEQ ID NO: 5301755 - DNA, 15 bp, Homo sapiens
taaatagacacgcac

SEQ ID NO: 5301756 - DNA, 17 bp, Homo sapiens
taaatagaccattaatc

SEQ ID NO: 5301757 - DNA, 12 bp, Homo sapiens
taaatagagcaa

SEQ ID NO: 5301758 - DNA, 20 bp, Homo sapiens
taaatagaggtctgtaaaga

SEQ ID NO: 5301759 - DNA, 15 bp, Homo sapiens
taaatagagtgcata

SEQ ID NO: 5301760 - DNA, 20 bp, Homo sapiens
taaatagagtgcataaataa

SEQ ID NO: 5301761 - DNA, 18 bp, Homo sapiens
taaatagagtgtttttca

SEQ ID NO: 5301762 - DNA, 14 bp, Homo sapiens
taaatagagttcca

SEQ ID NO: 5301763 - DNA, 14 bp, Homo sapiens
taaatagatgacat

SEQ ID NO: 5301764 - DNA, 21 bp, Homo sapiens
taaatagatgacattgactat

SEQ ID NO: 5301765 - DNA, 20 bp, Homo sapiens
taaatagatgtaaataaaat

SEQ ID NO: 5301766 - DNA, 18 bp, Homo sapiens
taaatagatttagtctgt

SEQ ID NO: 5301767 - DNA, 21 bp, Homo sapiens
taaatagatttttagattcct

SEQ ID NO: 5301768 - DNA, 16 bp, Homo sapiens
taaatagcatctgctc

SEQ ID NO: 5301769 - DNA, 12 bp, Homo sapiens
taaatagcatgt

SEQ ID NO: 5301770 - DNA, 13 bp, Homo sapiens
taaatagcatgta

SEQ ID NO: 5301771 - DNA, 18 bp, Homo sapiens
taaatagcatgtattgtg

SEQ ID NO: 5301772 - DNA, 15 bp, Homo sapiens
taaatagcattctct

SEQ ID NO: 5301773 - DNA, 21 bp, Homo sapiens
taaatagcccagatcccaaga

SEQ ID NO: 5301774 - DNA, 16 bp, Homo sapiens
taaatagcctaaatga

SEQ ID NO: 5301775 - DNA, 16 bp, Homo sapiens
taaatagctaaatggc

SEQ ID NO: 5301776 - DNA, 18 bp, Homo sapiens
taaatagctagactggtg

SEQ ID NO: 5301777 - DNA, 23 bp, Homo sapiens
taaatagctagactggtgactga

SEQ ID NO: 5301778 - DNA, 19 bp, Homo sapiens
taaatagctatatccatgt

SEQ ID NO: 5301779 - DNA, 20 bp, Homo sapiens
taaatagctatatccatgta

SEQ ID NO: 5301780 - DNA, 16 bp, Homo sapiens
taaatagctatattta

SEQ ID NO: 5301781 - DNA, 13 bp, Homo sapiens
taaataggaaagt

SEQ ID NO: 5301782 - DNA, 15 bp, Homo sapiens
taaataggaaagttt

SEQ ID NO: 5301783 - DNA, 23 bp, Homo sapiens
taaataggaatcattcagaaatg

SEQ ID NO: 5301784 - DNA, 21 bp, Homo sapiens
taaataggagaggatgagagc

SEQ ID NO: 5301785 - DNA, 12 bp, Homo sapiens
taaataggattt

SEQ ID NO: 5301786 - DNA, 23 bp, Homo sapiens
taaatagggaagatggagacacc

SEQ ID NO: 5301787 - DNA, 22 bp, Homo sapiens
taaataggtaggcctctaattg

SEQ ID NO: 5301788 - DNA, 20 bp, Homo sapiens
taaatagtaaaaataaaatt

SEQ ID NO: 5301789 - DNA, 14 bp, Homo sapiens
taaatagtagaaaa

SEQ ID NO: 5301790 - DNA, 22 bp, Homo sapiens
taaatagtatccaactttgtag

SEQ ID NO: 5301791 - DNA, 12 bp, Homo sapiens
taaatagtattt

SEQ ID NO: 5301792 - DNA, 13 bp, Homo sapiens
taaatagtatttc

SEQ ID NO: 5301793 - DNA, 21 bp, Homo sapiens
taaatagtctagactaaaaga

SEQ ID NO: 5301794 - DNA, 23 bp, Homo sapiens
taaatagtgagacataaatagag

SEQ ID NO: 5301795 - DNA, 18 bp, Homo sapiens
taaatagttcagtataaa

SEQ ID NO: 5301796 - DNA, 21 bp, Homo sapiens
taaatagttcagtataaattg

SEQ ID NO: 5301797 - DNA, 14 bp, Homo sapiens
taaatagtttactt

SEQ ID NO: 5301798 - DNA, 24 bp, Homo sapiens
taaatagttttaaatatgaacaaa

SEQ ID NO: 5301799 - DNA, 15 bp, Homo sapiens
taaatataaaataca

SEQ ID NO: 5301800 - DNA, 17 bp, Homo sapiens
taaatataaagacgttt

SEQ ID NO: 5301801 - DNA, 13 bp, Homo sapiens
taaatataacact

SEQ ID NO: 5301802 - DNA, 22 bp, Homo sapiens
taaatataagccttttatactg

SEQ ID NO: 5301803 - DNA, 15 bp, Homo sapiens
taaatataattctgt

SEQ ID NO: 5301804 - DNA, 18 bp, Homo sapiens
taaatataattgggattt

SEQ ID NO: 5301805 - DNA, 21 bp, Homo sapiens
taaatataattgggattttaa

SEQ ID NO: 5301806 - DNA, 15 bp, Homo sapiens
taaatataatttata

SEQ ID NO: 5301807 - DNA, 22 bp, Homo sapiens
taaatatacactttacattctt

SEQ ID NO: 5301808 - DNA, 23 bp, Homo sapiens
taaatatacagcatgagattgta

SEQ ID NO: 5301809 - DNA, 19 bp, Homo sapiens
taaatataccactctttac

SEQ ID NO: 5301810 - DNA, 12 bp, Homo sapiens
taaatatactaa

SEQ ID NO: 5301811 - DNA, 18 bp, Homo sapiens
taaatatactaataaaaa

SEQ ID NO: 5301812 - DNA, 22 bp, Homo sapiens
taaatatactaataaaaaggtt

SEQ ID NO: 5301813 - DNA, 17 bp, Homo sapiens
taaatatagattagaaa

SEQ ID NO: 5301814 - DNA, 16 bp, Homo sapiens
taaatatagttcctaa

SEQ ID NO: 5301815 - DNA, 16 bp, Homo sapiens
taaatatagttgtctt

SEQ ID NO: 5301816 - DNA, 17 bp, Homo sapiens
taaatatataaacaaac

SEQ ID NO: 5301817 - DNA, 13 bp, Homo sapiens
taaatatataaat

SEQ ID NO: 5301818 - DNA, 11 bp, Homo sapiens
taaatatatat

SEQ ID NO: 5301819 - DNA, 17 bp, Homo sapiens
taaatatatataaacct

SEQ ID NO: 5301820 - DNA, 18 bp, Homo sapiens
taaatatatataaaccta

SEQ ID NO: 5301821 - DNA, 19 bp, Homo sapiens
taaatatatataaatatat

SEQ ID NO: 5301822 - DNA, 12 bp, Homo sapiens
taaatatatatt

SEQ ID NO: 5301823 - DNA, 19 bp, Homo sapiens
taaatatatattattctca

SEQ ID NO: 5301824 - DNA, 22 bp, Homo sapiens
taaatatatattattctcattt

SEQ ID NO: 5301825 - DNA, 24 bp, Homo sapiens
taaatctagagtttatacagtgta

SEQ ID NO: 5301826 - DNA, 17 bp, Homo sapiens
taaatctaggatgtgat

SEQ ID NO: 5301827 - DNA, 18 bp, Homo sapiens
taaatctagtatacattg

SEQ ID NO: 5301828 - DNA, 13 bp, Homo sapiens
taaatctatctct

SEQ ID NO: 5301829 - DNA, 19 bp, Homo sapiens
taaatctatctctatataa

SEQ ID NO: 5301830 - DNA, 20 bp, Homo sapiens
taaatctatctctatataaa

SEQ ID NO: 5301831 - DNA, 17 bp, Homo sapiens
taaatctcaaatttatt

SEQ ID NO: 5301832 - DNA, 19 bp, Homo sapiens
taaatctccaaaataaaac

SEQ ID NO: 5301833 - DNA, 16 bp, Homo sapiens
taaatctccaagacct

SEQ ID NO: 5301834 - DNA, 18 bp, Homo sapiens
taaatctccagcttacta

SEQ ID NO: 5301835 - DNA, 16 bp, Homo sapiens
taaatctcctgtggag

SEQ ID NO: 5301836 - DNA, 22 bp, Homo sapiens
taaatctcgcactacatctgat

SEQ ID NO: 5301837 - DNA, 15 bp, Homo sapiens
taaatctctaatatg

SEQ ID NO: 5301838 - DNA, 17 bp, Homo sapiens
taaatctctatctcttt

SEQ ID NO: 5301839 - DNA, 14 bp, Homo sapiens
taaatctcttctgt

SEQ ID NO: 5301840 - DNA, 18 bp, Homo sapiens
taaatctcttctgtgttt

SEQ ID NO: 5301841 - DNA, 15 bp, Homo sapiens
taaatctctttaaga

SEQ ID NO: 5301842 - DNA, 22 bp, Homo sapiens
taaatctgaagaaagttattct

SEQ ID NO: 5301843 - DNA, 22 bp, Homo sapiens
taaatctgaagtggttcagtct

SEQ ID NO: 5301844 - DNA, 19 bp, Homo sapiens
taaatctgacagtctcaaa

SEQ ID NO: 5301845 - DNA, 21 bp, Homo sapiens
taaatctgacagtctcaaatt

SEQ ID NO: 5301846 - DNA, 14 bp, Homo sapiens
taaatctgacccag

SEQ ID NO: 5301847 - DNA, 23 bp, Homo sapiens
taaatctgagatctccctccagg

SEQ ID NO: 5301848 - DNA, 19 bp, Homo sapiens
taaatctgagcctaaatct

SEQ ID NO: 5301849 - DNA, 13 bp, Homo sapiens
taaatctgattaa

SEQ ID NO: 5301850 - DNA, 15 bp, Homo sapiens
taaatctgcagcaca

SEQ ID NO: 5301851 - DNA, 14 bp, Homo sapiens
taaatctgtacttt

SEQ ID NO: 5301852 - DNA, 21 bp, Homo sapiens
taaatctgtacttttttcaaa

SEQ ID NO: 5301853 - DNA, 19 bp, Homo sapiens
taaatctgtctgattctat

SEQ ID NO: 5301854 - DNA, 15 bp, Homo sapiens
taaatctgtgaactt

SEQ ID NO: 5301855 - DNA, 16 bp, Homo sapiens
taaatctgtgaacttg

SEQ ID NO: 5301856 - DNA, 19 bp, Homo sapiens
taaatctgtgaacttgaaa

SEQ ID NO: 5301857 - DNA, 16 bp, Homo sapiens
taaatctgttagcatt

SEQ ID NO: 5301858 - DNA, 21 bp, Homo sapiens
taaatctgttctgggctcttt

SEQ ID NO: 5301859 - DNA, 14 bp, Homo sapiens
taaatcttaaacaa

SEQ ID NO: 5301860 - DNA, 20 bp, Homo sapiens
taaatcttaaacaatgtata

SEQ ID NO: 5301861 - DNA, 11 bp, Homo sapiens
taaatcttaag

SEQ ID NO: 5301862 - DNA, 16 bp, Homo sapiens
taaatcttaatgttcc

SEQ ID NO: 5301863 - DNA, 21 bp, Homo sapiens
taaatcttcaatatgaaggac

SEQ ID NO: 5301864 - DNA, 12 bp, Homo sapiens
taaatcttcctt

SEQ ID NO: 5301865 - DNA, 14 bp, Homo sapiens
taaatcttccttgt

SEQ ID NO: 5301866 - DNA, 17 bp, Homo sapiens
taaatcttgaccaacag

SEQ ID NO: 5301867 - DNA, 13 bp, Homo sapiens
taaatctttcaaa

SEQ ID NO: 5301868 - DNA, 22 bp, Homo sapiens
taaatctttgtgaacattctgt

SEQ ID NO: 5301869 - DNA, 16 bp, Homo sapiens
taaatctttgttaaaa

SEQ ID NO: 5301870 - DNA, 19 bp, Homo sapiens
taaatctttgttaaaatat

SEQ ID NO: 5301871 - DNA, 23 bp, Homo sapiens
taaatcttttataggatttattt

SEQ ID NO: 5301872 - DNA, 16 bp, Homo sapiens
taaatctttttgcttc

SEQ ID NO: 5301873 - DNA, 17 bp, Homo sapiens
taaatctttttgcttct

SEQ ID NO: 5301874 - DNA, 21 bp, Homo sapiens
taaatgaaaaaaatgatctat

SEQ ID NO: 5301875 - DNA, 22 bp, Homo sapiens
taaatgaaaacacctgagctgg

SEQ ID NO: 5301876 - DNA, 17 bp, Homo sapiens
taaatgaaaatgtaact

SEQ ID NO: 5301877 - DNA, 17 bp, Homo sapiens
taaatgaaacttaagaa

SEQ ID NO: 5301878 - DNA, 12 bp, Homo sapiens
taaatgaaagaa

SEQ ID NO: 5301879 - DNA, 14 bp, Homo sapiens
taaatgaaagaaaa

SEQ ID NO: 5301880 - DNA, 22 bp, Homo sapiens
taaatgaaagaaaattgagttg

SEQ ID NO: 5301881 - DNA, 15 bp, Homo sapiens
taaatgaaagaaacc

SEQ ID NO: 5301882 - DNA, 21 bp, Homo sapiens
taaatgaaagaaacccacaga

SEQ ID NO: 5301883 - DNA, 15 bp, Homo sapiens
taaatgaaaggagtt

SEQ ID NO: 5301884 - DNA, 21 bp, Homo sapiens
taaatgaaaggagtttaaaaa

SEQ ID NO: 5301885 - DNA, 15 bp, Homo sapiens
taaatgaaataaacg

SEQ ID NO: 5301886 - DNA, 17 bp, Homo sapiens
taaatgaaattgatttg

SEQ ID NO: 5301887 - DNA, 16 bp, Homo sapiens
taaatgaaattgtaaa

SEQ ID NO: 5301888 - DNA, 15 bp, Homo sapiens
taaatgaaatttgca

SEQ ID NO: 5301889 - DNA, 16 bp, Homo sapiens
taaatgaacaagagaa

SEQ ID NO: 5301890 - DNA, 19 bp, Homo sapiens
taaatgaacacagctcttt

SEQ ID NO: 5301891 - DNA, 16 bp, Homo sapiens
taaatgaacataatga

SEQ ID NO: 5301892 - DNA, 19 bp, Homo sapiens
taaatgaactactgctatt

SEQ ID NO: 5301893 - DNA, 23 bp, Homo sapiens
taaatgaagaaagggaggcccag

SEQ ID NO: 5301894 - DNA, 12 bp, Homo sapiens
taaatgaagatg

SEQ ID NO: 5301895 - DNA, 15 bp, Homo sapiens
taaatgaagatgcat

SEQ ID NO: 5301896 - DNA, 21 bp, Homo sapiens
taaatgaagggccagcatata

SEQ ID NO: 5301897 - DNA, 17 bp, Homo sapiens
taaatgaagtattatct

SEQ ID NO: 5301898 - DNA, 23 bp, Homo sapiens
taaatgaagtttatacagtacag

SEQ ID NO: 5301899 - DNA, 14 bp, Homo sapiens
taaatgaatatttt

SEQ ID NO: 5301900 - DNA, 16 bp, Homo sapiens
taaatgaatattttga

SEQ ID NO: 5301901 - DNA, 23 bp, Homo sapiens
taaatgaatctcgttcccaaaga

SEQ ID NO: 5301902 - DNA, 22 bp, Homo sapiens
taaatgaatgaaatataaactg

SEQ ID NO: 5301903 - DNA, 13 bp, Homo sapiens
taaatgaatgttt

SEQ ID NO: 5301904 - DNA, 13 bp, Homo sapiens
taaatgaattcat

SEQ ID NO: 5301905 - DNA, 13 bp, Homo sapiens
taaatgacattat

SEQ ID NO: 5301906 - DNA, 20 bp, Homo sapiens
taaatgacattattaaagtt

SEQ ID NO: 5301907 - DNA, 15 bp, Homo sapiens
taaatgaccaagaaa

SEQ ID NO: 5301908 - DNA, 12 bp, Homo sapiens
taaatgaccagt

SEQ ID NO: 5301909 - DNA, 15 bp, Homo sapiens
taaatgaccagttta

SEQ ID NO: 5301910 - DNA, 19 bp, Homo sapiens
taaatgaccagtttacctg

SEQ ID NO: 5301911 - DNA, 13 bp, Homo sapiens
taaatgacctcag

SEQ ID NO: 5301912 - DNA, 14 bp, Homo sapiens
taaatgacctcaga

SEQ ID NO: 5301913 - DNA, 15 bp, Homo sapiens
taaatgacttagaaa

SEQ ID NO: 5301914 - DNA, 22 bp, Homo sapiens
taaatgacttagaaacaatgtt

SEQ ID NO: 5301915 - DNA, 15 bp, Homo sapiens
taaatgacttattga

SEQ ID NO: 5301916 - DNA, 17 bp, Homo sapiens
taaatgacttattgatt

SEQ ID NO: 5301917 - DNA, 15 bp, Homo sapiens
taaatgacttgattg

SEQ ID NO: 5301918 - DNA, 15 bp, Homo sapiens
taaatgactttttga

SEQ ID NO: 5301919 - DNA, 22 bp, Homo sapiens
taaatgagacacatacaaaaaa

SEQ ID NO: 5301920 - DNA, 22 bp, Homo sapiens
taaatgagacccctttaaactg

SEQ ID NO: 5301921 - DNA, 13 bp, Homo sapiens
taaatgagcattt

SEQ ID NO: 5301922 - DNA, 15 bp, Homo sapiens
taaatgagcattttt

SEQ ID NO: 5301923 - DNA, 14 bp, Homo sapiens
taaatgagctgttg

SEQ ID NO: 5301924 - DNA, 18 bp, Homo sapiens
taaatgagggtttctgat

SEQ ID NO: 5301925 - DNA, 18 bp, Homo sapiens
taaatgatatcaaagaag

SEQ ID NO: 5301926 - DNA, 19 bp, Homo sapiens
taaatgatatgtctttaaa

SEQ ID NO: 5301927 - DNA, 14 bp, Homo sapiens
taaatgatctgcct

SEQ ID NO: 5301928 - DNA, 15 bp, Homo sapiens
taaatgattatcttg

SEQ ID NO: 5301929 - DNA, 13 bp, Homo sapiens
taaatgattccaa

SEQ ID NO: 5301930 - DNA, 17 bp, Homo sapiens
taaatgattcttagtga

SEQ ID NO: 5301931 - DNA, 20 bp, Homo sapiens
taaatgatttaaatttaagt

SEQ ID NO: 5301932 - DNA, 19 bp, Homo sapiens
taaatgcaaagttctgtgt

SEQ ID NO: 5301933 - DNA, 15 bp, Homo sapiens
taaatgcaataagat

SEQ ID NO: 5301934 - DNA, 18 bp, Homo sapiens
taaatgcaatattcttga

SEQ ID NO: 5301935 - DNA, 20 bp, Homo sapiens
taaatgcacagttctatttg

SEQ ID NO: 5301936 - DNA, 22 bp, Homo sapiens
taaatgcacagttctatttgct

SEQ ID NO: 5301937 - DNA, 23 bp, Homo sapiens
taaatgcacagttctatttgcta

SEQ ID NO: 5301938 - DNA, 15 bp, Homo sapiens
taaatgcacatttca

SEQ ID NO: 5301939 - DNA, 19 bp, Homo sapiens
taaatgcaccaagaaagct

SEQ ID NO: 5301940 - DNA, 13 bp, Homo sapiens
taaatgcactgta

SEQ ID NO: 5301941 - DNA, 15 bp, Homo sapiens
taaatgcataattta

SEQ ID NO: 5301942 - DNA, 14 bp, Homo sapiens
taaatgcatagagc

SEQ ID NO: 5301943 - DNA, 16 bp, Homo sapiens
taaatgcatagagcaa

SEQ ID NO: 5301944 - DNA, 24 bp, Homo sapiens
taaatgcatagagcaattaaactg

SEQ ID NO: 5301945 - DNA, 22 bp, Homo sapiens
taaatgcatgattttatacata

SEQ ID NO: 5301946 - DNA, 23 bp, Homo sapiens
taaatgcatgattttatacatag

SEQ ID NO: 5301947 - DNA, 15 bp, Homo sapiens
taaatgcatgtctta

SEQ ID NO: 5301948 - DNA, 21 bp, Homo sapiens
taaatgcatgtcttaaatgct

SEQ ID NO: 5301949 - DNA, 11 bp, Homo sapiens
taaatgccaca

SEQ ID NO: 5301950 - DNA, 15 bp, Homo sapiens
taaatgccacacacc

SEQ ID NO: 5301951 - DNA, 14 bp, Homo sapiens
taaatgccagagcc

SEQ ID NO: 5301952 - DNA, 20 bp, Homo sapiens
taaatgccagagccaacctg

SEQ ID NO: 5301953 - DNA, 13 bp, Homo sapiens
taaatgcccagcc

SEQ ID NO: 5301954 - DNA, 14 bp, Homo sapiens
taaatgcccagccc

SEQ ID NO: 5301955 - DNA, 17 bp, Homo sapiens
taaatgcccagcccctt

SEQ ID NO: 5301956 - DNA, 15 bp, Homo sapiens
taaatgccctcttct

SEQ ID NO: 5301957 - DNA, 13 bp, Homo sapiens
taaatgccctgct

SEQ ID NO: 5301958 - DNA, 20 bp, Homo sapiens
taaatgcctagtttttagta

SEQ ID NO: 5301959 - DNA, 16 bp, Homo sapiens
taaatgcctcttaaat

SEQ ID NO: 5301960 - DNA, 17 bp, Homo sapiens
taaatgcctcttaaatt

SEQ ID NO: 5301961 - DNA, 18 bp, Homo sapiens
taaatgccttgcttgtat

SEQ ID NO: 5301962 - DNA, 23 bp, Homo sapiens
taaatgccttggtttgatttcta

SEQ ID NO: 5301963 - DNA, 16 bp, Homo sapiens
taaatgccttgtataa

SEQ ID NO: 5301964 - DNA, 13 bp, Homo sapiens
taaatgcctttat

SEQ ID NO: 5301965 - DNA, 16 bp, Homo sapiens
taaatgctacctctga

SEQ ID NO: 5301966 - DNA, 16 bp, Homo sapiens
taaatgctatggaaat

SEQ ID NO: 5301967 - DNA, 21 bp, Homo sapiens
taaatgctatggaaatacatt

SEQ ID NO: 5301968 - DNA, 23 bp, Homo sapiens
taaatgctatggaaatacattta

SEQ ID NO: 5301969 - DNA, 24 bp, Homo sapiens
taaatgctattatactgttatcca

SEQ ID NO: 5301970 - DNA, 14 bp, Homo sapiens
taaatgctgaaata

SEQ ID NO: 5301971 - DNA, 14 bp, Homo sapiens
taaatgctgaatga

SEQ ID NO: 5301972 - DNA, 13 bp, Homo sapiens
taaatgctgcttt

SEQ ID NO: 5301973 - DNA, 22 bp, Homo sapiens
taaatgctgtaaatatttcata

SEQ ID NO: 5301974 - DNA, 12 bp, Homo sapiens
taaatgctgtgt

SEQ ID NO: 5301975 - DNA, 19 bp, Homo sapiens
taaatgctgttcttacaca

SEQ ID NO: 5301976 - DNA, 13 bp, Homo sapiens
taaatgcttttta

SEQ ID NO: 5301977 - DNA, 22 bp, Homo sapiens
taaatggaaactgaaactactg

SEQ ID NO: 5301978 - DNA, 14 bp, Homo sapiens
taaatggaataatt

SEQ ID NO: 5301979 - DNA, 15 bp, Homo sapiens
taaatggacttgctt

SEQ ID NO: 5301980 - DNA, 18 bp, Homo sapiens
taaatggagaaagctgtg

SEQ ID NO: 5301981 - DNA, 16 bp, Homo sapiens
taaatggagcttgtac

SEQ ID NO: 5301982 - DNA, 20 bp, Homo sapiens
taaatggagcttgtacatat

SEQ ID NO: 5301983 - DNA, 20 bp, Homo sapiens
taaatggaggtacaggatat

SEQ ID NO: 5301984 - DNA, 14 bp, Homo sapiens
taaatggattaatt

SEQ ID NO: 5301985 - DNA, 17 bp, Homo sapiens
taaatggcacctgtata

SEQ ID NO: 5301986 - DNA, 18 bp, Homo sapiens
taaatggcacctgtatac

SEQ ID NO: 5301987 - DNA, 18 bp, Homo sapiens
taaatggcagtatttcat

SEQ ID NO: 5301988 - DNA, 19 bp, Homo sapiens
taaatggcagtatttcatt

SEQ ID NO: 5301989 - DNA, 20 bp, Homo sapiens
taaatggcctctctccacta

SEQ ID NO: 5301990 - DNA, 13 bp, Homo sapiens
taaatggctgtaa

SEQ ID NO: 5301991 - DNA, 20 bp, Homo sapiens
taaatggcttcctggcaata

SEQ ID NO: 5301992 - DNA, 19 bp, Homo sapiens
taaatggcttcttctagaa

SEQ ID NO: 5301993 - DNA, 22 bp, Homo sapiens
taaatgggactggagtccctgt

SEQ ID NO: 5301994 - DNA, 22 bp, Homo sapiens
taaatggggacattcactataa

SEQ ID NO: 5301995 - DNA, 14 bp, Homo sapiens
taaatgggggtgca

SEQ ID NO: 5301996 - DNA, 17 bp, Homo sapiens
taaatgggggtgcattt

SEQ ID NO: 5301997 - DNA, 19 bp, Homo sapiens
taaatgggggtgcatttga

SEQ ID NO: 5301998 - DNA, 22 bp, Homo sapiens
taaatgggtcatgacaagatgg

SEQ ID NO: 5301999 - DNA, 23 bp, Homo sapiens
taaatgggtgtatataattttat

SEQ ID NO: 5302000 - DNA, 18 bp, Homo sapiens
taaatggtaataagcact

SEQ ID NO: 5302001 - DNA, 21 bp, Homo sapiens
taaatggtgagaattaaaata

SEQ ID NO: 5302002 - DNA, 16 bp, Homo sapiens
taaatggtgatttctt

SEQ ID NO: 5302003 - DNA, 11 bp, Homo sapiens
taaatttggtg

SEQ ID NO: 5302004 - DNA, 20 bp, Homo sapiens
taaatttgtaagtttcaggt

SEQ ID NO: 5302005 - DNA, 13 bp, Homo sapiens
taaatttgtacta

SEQ ID NO: 5302006 - DNA, 20 bp, Homo sapiens
taaatttgtactatttaact

SEQ ID NO: 5302007 - DNA, 22 bp, Homo sapiens
taaatttgtactatttaactga

SEQ ID NO: 5302008 - DNA, 13 bp, Homo sapiens
taaatttgttgtc

SEQ ID NO: 5302009 - DNA, 21 bp, Homo sapiens
taaatttgttgtcatgtgtat

SEQ ID NO: 5302010 - DNA, 22 bp, Homo sapiens
taaatttgttgtcatgtgtatg

SEQ ID NO: 5302011 - DNA, 19 bp, Homo sapiens
taaatttgtttaattaaat

SEQ ID NO: 5302012 - DNA, 13 bp, Homo sapiens
taaattttaaaaa

SEQ ID NO: 5302013 - DNA, 14 bp, Homo sapiens
taaattttaaagcc

SEQ ID NO: 5302014 - DNA, 20 bp, Homo sapiens
taaattttaatgtaaaattc

SEQ ID NO: 5302015 - DNA, 16 bp, Homo sapiens
taaattttaatgttaa

SEQ ID NO: 5302016 - DNA, 12 bp, Homo sapiens
taaattttaatt

SEQ ID NO: 5302017 - DNA, 16 bp, Homo sapiens
taaattttaattcaag

SEQ ID NO: 5302018 - DNA, 18 bp, Homo sapiens
taaattttagagcatacc

SEQ ID NO: 5302019 - DNA, 16 bp, Homo sapiens
taaattttagatcttt

SEQ ID NO: 5302020 - DNA, 17 bp, Homo sapiens
taaattttagtacattt

SEQ ID NO: 5302021 - DNA, 23 bp, Homo sapiens
taaattttataaggctgactctt

SEQ ID NO: 5302022 - DNA, 15 bp, Homo sapiens
taaattttatctcag

SEQ ID NO: 5302023 - DNA, 22 bp, Homo sapiens
taaattttatgtcatagaaata

SEQ ID NO: 5302024 - DNA, 18 bp, Homo sapiens
taaattttatttttatta

SEQ ID NO: 5302025 - DNA, 17 bp, Homo sapiens
taaattttcaaatcctt

SEQ ID NO: 5302026 - DNA, 12 bp, Homo sapiens
taaattttcacc

SEQ ID NO: 5302027 - DNA, 15 bp, Homo sapiens
taaattttcacctgt

SEQ ID NO: 5302028 - DNA, 15 bp, Homo sapiens
taaattttcagaatt

SEQ ID NO: 5302029 - DNA, 22 bp, Homo sapiens
taaattttcagaattaatgcat

SEQ ID NO: 5302030 - DNA, 23 bp, Homo sapiens
taaattttccattaatttcaaca

SEQ ID NO: 5302031 - DNA, 16 bp, Homo sapiens
taaattttcctgtcct

SEQ ID NO: 5302032 - DNA, 17 bp, Homo sapiens
taaattttctctaaact

SEQ ID NO: 5302033 - DNA, 20 bp, Homo sapiens
taaattttctctaaactgtt

SEQ ID NO: 5302034 - DNA, 11 bp, Homo sapiens
taaattttctt

SEQ ID NO: 5302035 - DNA, 20 bp, Homo sapiens
taaattttcttttaagcatt

SEQ ID NO: 5302036 - DNA, 15 bp, Homo sapiens
taaattttgaaaagt

SEQ ID NO: 5302037 - DNA, 16 bp, Homo sapiens
taaattttgaatgttt

SEQ ID NO: 5302038 - DNA, 16 bp, Homo sapiens
taaattttgagttcta

SEQ ID NO: 5302039 - DNA, 17 bp, Homo sapiens
taaattttgagttctac

SEQ ID NO: 5302040 - DNA, 19 bp, Homo sapiens
taaattttggaagaattca

SEQ ID NO: 5302041 - DNA, 23 bp, Homo sapiens
taaattttggaagaattcatgat

SEQ ID NO: 5302042 - DNA, 24 bp, Homo sapiens
taaattttggaagaattcatgatg

SEQ ID NO: 5302043 - DNA, 16 bp, Homo sapiens
taaattttgtacattt

SEQ ID NO: 5302044 - DNA, 20 bp, Homo sapiens
taaattttgtctttaactca

SEQ ID NO: 5302045 - DNA, 14 bp, Homo sapiens
taaattttgtgatg

SEQ ID NO: 5302046 - DNA, 14 bp, Homo sapiens
taaattttgtgcaa

SEQ ID NO: 5302047 - DNA, 15 bp, Homo sapiens
taaatttttaaaatc

SEQ ID NO: 5302048 - DNA, 17 bp, Homo sapiens
taaatttttaaaatctg

SEQ ID NO: 5302049 - DNA, 13 bp, Homo sapiens
taaatttttaaga

SEQ ID NO: 5302050 - DNA, 15 bp, Homo sapiens
taaatttttaagtgt

SEQ ID NO: 5302051 - DNA, 18 bp, Homo sapiens
taaatttttaggcaaaga

SEQ ID NO: 5302052 - DNA, 20 bp, Homo sapiens
taaatttttaggcaaagata

SEQ ID NO: 5302053 - DNA, 17 bp, Homo sapiens
taaatttttataataat

SEQ ID NO: 5302054 - DNA, 19 bp, Homo sapiens
taaatttttgtaagaaaat

SEQ ID NO: 5302055 - DNA, 14 bp, Homo sapiens
taaatttttgtcat

SEQ ID NO: 5302056 - DNA, 15 bp, Homo sapiens
taaatttttgtcttt

SEQ ID NO: 5302057 - DNA, 17 bp, Homo sapiens
taaattttttgaaacac

SEQ ID NO: 5302058 - DNA, 16 bp, Homo sapiens
taaatttttttcctta

SEQ ID NO: 5302059 - DNA, 16 bp, Homo sapiens
taaatttttttgtatg

SEQ ID NO: 5302060 - DNA, 21 bp, Homo sapiens
taaatttttttgtatgaaaac

SEQ ID NO: 5302061 - DNA, 20 bp, Homo sapiens
taaattttttttggtcaaat

SEQ ID NO: 5302062 - DNA, 19 bp, Homo sapiens
taaattttttttgtttcat

SEQ ID NO: 5302063 - DNA, 14 bp, Homo sapiens
taacaaaaaaagaa

SEQ ID NO: 5302064 - DNA, 15 bp, Homo sapiens
taacaaaaaagagaa

SEQ ID NO: 5302065 - DNA, 15 bp, Homo sapiens
taacaaaaaagctaa

SEQ ID NO: 5302066 - DNA, 18 bp, Homo sapiens
taacaaaaaataaagaat

SEQ ID NO: 5302067 - DNA, 14 bp, Homo sapiens
taacaaaaaatgta

SEQ ID NO: 5302068 - DNA, 15 bp, Homo sapiens
taacaaaacaagaaa

SEQ ID NO: 5302069 - DNA, 17 bp, Homo sapiens
taacaaaacttcttaga

SEQ ID NO: 5302070 - DNA, 20 bp, Homo sapiens
taacaaaagatatgaagaac

SEQ ID NO: 5302071 - DNA, 18 bp, Homo sapiens
taacaaaagatgaaagca

SEQ ID NO: 5302072 - DNA, 21 bp, Homo sapiens
taacaaaagttccctgaaaca

SEQ ID NO: 5302073 - DNA, 12 bp, Homo sapiens
taacaaaatgga

SEQ ID NO: 5302074 - DNA, 15 bp, Homo sapiens
taacaaaatggacat

SEQ ID NO: 5302075 - DNA, 14 bp, Homo sapiens
taacaaaatttgaa

SEQ ID NO: 5302076 - DNA, 16 bp, Homo sapiens
taacaaactaaaaata

SEQ ID NO: 5302077 - DNA, 19 bp, Homo sapiens
taacaaactgaaaaatcta

SEQ ID NO: 5302078 - DNA, 22 bp, Homo sapiens
taacaaactgaaaaatctagac

SEQ ID NO: 5302079 - DNA, 15 bp, Homo sapiens
taacaaagaagtgta

SEQ ID NO: 5302080 - DNA, 22 bp, Homo sapiens
taacaaagatatcttttcttta

SEQ ID NO: 5302081 - DNA, 21 bp, Homo sapiens
taacaaagcaacctttccctt

SEQ ID NO: 5302082 - DNA, 23 bp, Homo sapiens
taacaaagcacataactggattt

SEQ ID NO: 5302083 - DNA, 16 bp, Homo sapiens
taacaaaggatactta

SEQ ID NO: 5302084 - DNA, 20 bp, Homo sapiens
taacaaaggatacttattta

SEQ ID NO: 5302085 - DNA, 19 bp, Homo sapiens
taacaaaggcagctgtgtc

SEQ ID NO: 5302086 - DNA, 21 bp, Homo sapiens
taacaaaggcagctgtgtctg

SEQ ID NO: 5302087 - DNA, 21 bp, Homo sapiens
taacaaataaaaaagctcttt

SEQ ID NO: 5302088 - DNA, 13 bp, Homo sapiens
taacaaataaatt

SEQ ID NO: 5302089 - DNA, 15 bp, Homo sapiens
taacaaatacattca

SEQ ID NO: 5302090 - DNA, 12 bp, Homo sapiens
taacaaatctaa

SEQ ID NO: 5302091 - DNA, 11 bp, Homo sapiens
taacaaatgag

SEQ ID NO: 5302092 - DNA, 19 bp, Homo sapiens
taacaaatgctattaaagt

SEQ ID NO: 5302093 - DNA, 13 bp, Homo sapiens
taacaaatgtaaa

SEQ ID NO: 5302094 - DNA, 23 bp, Homo sapiens
taacaaatgttttcatttacagg

SEQ ID NO: 5302095 - DNA, 12 bp, Homo sapiens
taacaaattatg

SEQ ID NO: 5302096 - DNA, 13 bp, Homo sapiens
taacaaattattt

SEQ ID NO: 5302097 - DNA, 15 bp, Homo sapiens
taacaaattgcattt

SEQ ID NO: 5302098 - DNA, 17 bp, Homo sapiens
taacaaattgcatttgt

SEQ ID NO: 5302099 - DNA, 9 bp, Homo sapiens
taacaacaa

SEQ ID NO: 5302100 - DNA, 16 bp, Homo sapiens
taacaacaacttaatg

SEQ ID NO: 5302101 - DNA, 17 bp, Homo sapiens
taacaacaacttaatgt

SEQ ID NO: 5302102 - DNA, 23 bp, Homo sapiens
taacaacaatggtttacatgaac

SEQ ID NO: 5302103 - DNA, 17 bp, Homo sapiens
taacaacaatttaggaa

SEQ ID NO: 5302104 - DNA, 12 bp, Homo sapiens
taacaacactaa

SEQ ID NO: 5302105 - DNA, 19 bp, Homo sapiens
taacaacagcttcttgctt

SEQ ID NO: 5302106 - DNA, 21 bp, Homo sapiens
taacaacatataaaactgttt

SEQ ID NO: 5302107 - DNA, 19 bp, Homo sapiens
taacaacatgtttccagca

SEQ ID NO: 5302108 - DNA, 22 bp, Homo sapiens
taacaacccacaccgtcttcct

SEQ ID NO: 5302109 - DNA, 23 bp, Homo sapiens
taacaacccacaccgtcttcctt

SEQ ID NO: 5302110 - DNA, 18 bp, Homo sapiens
taacaacctatctagatg

SEQ ID NO: 5302111 - DNA, 14 bp, Homo sapiens
taacaacctggaga

SEQ ID NO: 5302112 - DNA, 17 bp, Homo sapiens
taacaactaatcaagag

SEQ ID NO: 5302113 - DNA, 20 bp, Homo sapiens
taacaactcattctgatcct

SEQ ID NO: 5302114 - DNA, 19 bp, Homo sapiens
taacaactgctcttacttt

SEQ ID NO: 5302115 - DNA, 15 bp, Homo sapiens
taacaagaaaggaga

SEQ ID NO: 5302116 - DNA, 19 bp, Homo sapiens
taacaagaactttaaattg

SEQ ID NO: 5302117 - DNA, 14 bp, Homo sapiens
taacaagaagatga

SEQ ID NO: 5302118 - DNA, 19 bp, Homo sapiens
taacaagaagatgaatggc

SEQ ID NO: 5302119 - DNA, 15 bp, Homo sapiens
taacaagaggggaaa

SEQ ID NO: 5302120 - DNA, 16 bp, Homo sapiens
taacaagagtatgtgg

SEQ ID NO: 5302121 - DNA, 13 bp, Homo sapiens
taacaagagtgat

SEQ ID NO: 5302122 - DNA, 14 bp, Homo sapiens
taacaagagtgatt

SEQ ID NO: 5302123 - DNA, 12 bp, Homo sapiens
taacaagagttt

SEQ ID NO: 5302124 - DNA, 21 bp, Homo sapiens
taacaagatatttatatgtta

SEQ ID NO: 5302125 - DNA, 16 bp, Homo sapiens
taacaagatctttcag

SEQ ID NO: 5302126 - DNA, 21 bp, Homo sapiens
taacaagatgtttcattttac

SEQ ID NO: 5302127 - DNA, 18 bp, Homo sapiens
taacaagatttgtaatta

SEQ ID NO: 5302128 - DNA, 15 bp, Homo sapiens
taacaagatttttaa

SEQ ID NO: 5302129 - DNA, 19 bp, Homo sapiens
taacaagcatgcataaatc

SEQ ID NO: 5302130 - DNA, 22 bp, Homo sapiens
taacaagcatgcataaatcaat

SEQ ID NO: 5302131 - DNA, 15 bp, Homo sapiens
taacaagccagattt

SEQ ID NO: 5302132 - DNA, 15 bp, Homo sapiens
taacaagctcccagg

SEQ ID NO: 5302133 - DNA, 16 bp, Homo sapiens
taacaaggaaaacagt

SEQ ID NO: 5302134 - DNA, 19 bp, Homo sapiens
taacaaggaatgcctgtgc

SEQ ID NO: 5302135 - DNA, 21 bp, Homo sapiens
taacaaggaatgcctgtgcca

SEQ ID NO: 5302136 - DNA, 22 bp, Homo sapiens
taacaagggttttaatgtaatt

SEQ ID NO: 5302137 - DNA, 16 bp, Homo sapiens
taacaaggtccaagat

SEQ ID NO: 5302138 - DNA, 23 bp, Homo sapiens
taacaaggtgccctttagccaga

SEQ ID NO: 5302139 - DNA, 16 bp, Homo sapiens
taacaagtaccaaagt

SEQ ID NO: 5302140 - DNA, 20 bp, Homo sapiens
taacaagtataaaaaattct

SEQ ID NO: 5302141 - DNA, 21 bp, Homo sapiens
taacaagtataaaaaattctc

SEQ ID NO: 5302142 - DNA, 15 bp, Homo sapiens
taacaagtataatta

SEQ ID NO: 5302143 - DNA, 15 bp, Homo sapiens
taacaagtattggga

SEQ ID NO: 5302144 - DNA, 13 bp, Homo sapiens
taacaagtgtatc

SEQ ID NO: 5302145 - DNA, 16 bp, Homo sapiens
taacaataatatttca

SEQ ID NO: 5302146 - DNA, 17 bp, Homo sapiens
taacaataatatttcaa

SEQ ID NO: 5302147 - DNA, 24 bp, Homo sapiens
taacaataatatttcaagtgccta

SEQ ID NO: 5302148 - DNA, 13 bp, Homo sapiens
taacaatacaaat

SEQ ID NO: 5302149 - DNA, 17 bp, Homo sapiens
taacaatacaaatggat

SEQ ID NO: 5302150 - DNA, 19 bp, Homo sapiens
taacaatacaaatggattt

SEQ ID NO: 5302151 - DNA, 18 bp, Homo sapiens
taacaatacatgagaaag

SEQ ID NO: 5302152 - DNA, 21 bp, Homo sapiens
taacaatacatgagaaagatg

SEQ ID NO: 5302153 - DNA, 22 bp, Homo sapiens
taacaatactgggcagcctttt

SEQ ID NO: 5302154 - DNA, 15 bp, Homo sapiens
taacaatagttctta

SEQ ID NO: 5302155 - DNA, 14 bp, Homo sapiens
taacaatataactg

SEQ ID NO: 5302156 - DNA, 14 bp, Homo sapiens
taacaatatataga

SEQ ID NO: 5302157 - DNA, 22 bp, Homo sapiens
taacaatatgattgcactaaat

SEQ ID NO: 5302158 - DNA, 23 bp, Homo sapiens
taacaatatgattgcactaaata

SEQ ID NO: 5302159 - DNA, 18 bp, Homo sapiens
taacaatccattcacaag

SEQ ID NO: 5302160 - DNA, 21 bp, Homo sapiens
taacaatctaacaataatatt

SEQ ID NO: 5302161 - DNA, 17 bp, Homo sapiens
taacaatgaagataaaa

SEQ ID NO: 5302162 - DNA, 19 bp, Homo sapiens
taacaatgatatatggata

SEQ ID NO: 5302163 - DNA, 22 bp, Homo sapiens
taacaatgatgaccccggcctg

SEQ ID NO: 5302164 - DNA, 12 bp, Homo sapiens
taacaatgcaac

SEQ ID NO: 5302165 - DNA, 18 bp, Homo sapiens
taacaatgcaacttttaa

SEQ ID NO: 5302166 - DNA, 17 bp, Homo sapiens
taacaatgcatgctttg

SEQ ID NO: 5302167 - DNA, 17 bp, Homo sapiens
taacaatgcgaatggta

SEQ ID NO: 5302168 - DNA, 13 bp, Homo sapiens
taacaatgctgta

SEQ ID NO: 5302169 - DNA, 24 bp, Homo sapiens
taacaatggaagatttgcccattt

SEQ ID NO: 5302170 - DNA, 22 bp, Homo sapiens
taacaatggcaggttttacacg

SEQ ID NO: 5302171 - DNA, 17 bp, Homo sapiens
taacaatgtaataaaaa

SEQ ID NO: 5302172 - DNA, 19 bp, Homo sapiens
taacaatgtcttcttgaaa

SEQ ID NO: 5302173 - DNA, 15 bp, Homo sapiens
taacaatgttaaatg

SEQ ID NO: 5302174 - DNA, 16 bp, Homo sapiens
taacaatgttaaggaa

SEQ ID NO: 5302175 - DNA, 19 bp, Homo sapiens
taacaatgttaaggaaact

SEQ ID NO: 5302176 - DNA, 21 bp, Homo sapiens
taacaatgttaaggaaactct

SEQ ID NO: 5302177 - DNA, 22 bp, Homo sapiens
taacaatgttaaggaaactctt

SEQ ID NO: 5302178 - DNA, 14 bp, Homo sapiens
taacaattaaaatc

SEQ ID NO: 5302179 - DNA, 17 bp, Homo sapiens
taacaattcagatccag

SEQ ID NO: 5302180 - DNA, 23 bp, Homo sapiens
taacaattcagtaacaaaggttt

SEQ ID NO: 5302181 - DNA, 14 bp, Homo sapiens
taacatatatctta

SEQ ID NO: 5302182 - DNA, 16 bp, Homo sapiens
taacatatatgtatat

SEQ ID NO: 5302183 - DNA, 13 bp, Homo sapiens
taacatatctaaa

SEQ ID NO: 5302184 - DNA, 13 bp, Homo sapiens
taacatatctgat

SEQ ID NO: 5302185 - DNA, 13 bp, Homo sapiens
taacatatctgta

SEQ ID NO: 5302186 - DNA, 18 bp, Homo sapiens
taacatatctgtaaatag

SEQ ID NO: 5302187 - DNA, 13 bp, Homo sapiens
taacatatcttta

SEQ ID NO: 5302188 - DNA, 17 bp, Homo sapiens
taacatatctttatctt

SEQ ID NO: 5302189 - DNA, 20 bp, Homo sapiens
taacatatgtacataaattg

SEQ ID NO: 5302190 - DNA, 15 bp, Homo sapiens
taacatattatttca

SEQ ID NO: 5302191 - DNA, 20 bp, Homo sapiens
taacatattctgtatgaact

SEQ ID NO: 5302192 - DNA, 15 bp, Homo sapiens
taacatattcttgct

SEQ ID NO: 5302193 - DNA, 22 bp, Homo sapiens
taacatattcttgctttcacaa

SEQ ID NO: 5302194 - DNA, 22 bp, Homo sapiens
taacatcactacaaaaagaaga

SEQ ID NO: 5302195 - DNA, 20 bp, Homo sapiens
taacatcactatccatgcac

SEQ ID NO: 5302196 - DNA, 11 bp, Homo sapiens
taacatcactg

SEQ ID NO: 5302197 - DNA, 20 bp, Homo sapiens
taacatcagaactgaaataa

SEQ ID NO: 5302198 - DNA, 21 bp, Homo sapiens
taacatcagccatttttagat

SEQ ID NO: 5302199 - DNA, 16 bp, Homo sapiens
taacatcataattaca

SEQ ID NO: 5302200 - DNA, 17 bp, Homo sapiens
taacatcataattacat

SEQ ID NO: 5302201 - DNA, 21 bp, Homo sapiens
taacatcatcactttttttga

SEQ ID NO: 5302202 - DNA, 17 bp, Homo sapiens
taacatcatgcattcac

SEQ ID NO: 5302203 - DNA, 19 bp, Homo sapiens
taacatcattgtattaacg

SEQ ID NO: 5302204 - DNA, 14 bp, Homo sapiens
taacatccaagcca

SEQ ID NO: 5302205 - DNA, 16 bp, Homo sapiens
taacatccaagccaga

SEQ ID NO: 5302206 - DNA, 24 bp, Homo sapiens
taacatccaataggaatgctaaca

SEQ ID NO: 5302207 - DNA, 13 bp, Homo sapiens
taacatccagaag

SEQ ID NO: 5302208 - DNA, 18 bp, Homo sapiens
taacatcccaataaagtc

SEQ ID NO: 5302209 - DNA, 23 bp, Homo sapiens
taacatcctttctattgaaaaat

SEQ ID NO: 5302210 - DNA, 19 bp, Homo sapiens
taacatcgaaaagttattt

SEQ ID NO: 5302211 - DNA, 20 bp, Homo sapiens
taacatctaaaaatagactt

SEQ ID NO: 5302212 - DNA, 14 bp, Homo sapiens
taacatctgaaaag

SEQ ID NO: 5302213 - DNA, 18 bp, Homo sapiens
taacatctgaaaagaaat

SEQ ID NO: 5302214 - DNA, 17 bp, Homo sapiens
taacatctgcagtgttc

SEQ ID NO: 5302215 - DNA, 20 bp, Homo sapiens
taacatctgcagtgttctgt

SEQ ID NO: 5302216 - DNA, 22 bp, Homo sapiens
taacatctgcagtgttctgtga

SEQ ID NO: 5302217 - DNA, 15 bp, Homo sapiens
taacatctgggtcta

SEQ ID NO: 5302218 - DNA, 23 bp, Homo sapiens
taacatctttacgtactgtaact

SEQ ID NO: 5302219 - DNA, 17 bp, Homo sapiens
taacatctttattgaaa

SEQ ID NO: 5302220 - DNA, 21 bp, Homo sapiens
taacatctttattgaaattct

SEQ ID NO: 5302221 - DNA, 22 bp, Homo sapiens
taacatctttattgaaattcta

SEQ ID NO: 5302222 - DNA, 15 bp, Homo sapiens
taacatctttgtttt

SEQ ID NO: 5302223 - DNA, 10 bp, Homo sapiens
taacatgaaa

SEQ ID NO: 5302224 - DNA, 20 bp, Homo sapiens
taacatgaaaaacacggcag

SEQ ID NO: 5302225 - DNA, 22 bp, Homo sapiens
taacatgaaaaacacggcagct

SEQ ID NO: 5302226 - DNA, 11 bp, Homo sapiens
taacatgaaat

SEQ ID NO: 5302227 - DNA, 15 bp, Homo sapiens
taacatgaagacctt

SEQ ID NO: 5302228 - DNA, 21 bp, Homo sapiens
taacatgaatatttagtgttc

SEQ ID NO: 5302229 - DNA, 23 bp, Homo sapiens
taacatgaggggacattttggtg

SEQ ID NO: 5302230 - DNA, 22 bp, Homo sapiens
taacatgatgtactaaagtaga

SEQ ID NO: 5302231 - DNA, 14 bp, Homo sapiens
taacatgatttggg

SEQ ID NO: 5302232 - DNA, 15 bp, Homo sapiens
taacatgcaacaaaa

SEQ ID NO: 5302233 - DNA, 20 bp, Homo sapiens
taacatgcaacaaaaatgtg

SEQ ID NO: 5302234 - DNA, 16 bp, Homo sapiens
taacatgcaataacaa

SEQ ID NO: 5302235 - DNA, 18 bp, Homo sapiens
taacatgcgcattttgtg

SEQ ID NO: 5302236 - DNA, 14 bp, Homo sapiens
taacatgctgccat

SEQ ID NO: 5302237 - DNA, 15 bp, Homo sapiens
taacatgctgtgtaa

SEQ ID NO: 5302238 - DNA, 13 bp, Homo sapiens
taacatggaagat

SEQ ID NO: 5302239 - DNA, 20 bp, Homo sapiens
taacatgggcaaaatggcta

SEQ ID NO: 5302240 - DNA, 11 bp, Homo sapiens
taacatgggct

SEQ ID NO: 5302241 - DNA, 18 bp, Homo sapiens
taacatgggctcttcact

SEQ ID NO: 5302242 - DNA, 18 bp, Homo sapiens
taacatggtttaaaagaa

SEQ ID NO: 5302243 - DNA, 12 bp, Homo sapiens
taacatgtaaaa

SEQ ID NO: 5302244 - DNA, 19 bp, Homo sapiens
taacatgtaattaagtact

SEQ ID NO: 5302245 - DNA, 18 bp, Homo sapiens
taacatgtggaagaaaac

SEQ ID NO: 5302246 - DNA, 16 bp, Homo sapiens
taacatgtgttaaaca

SEQ ID NO: 5302247 - DNA, 12 bp, Homo sapiens
taacatgttaaa

SEQ ID NO: 5302248 - DNA, 17 bp, Homo sapiens
taacatgttaaaccatg

SEQ ID NO: 5302249 - DNA, 10 bp, Homo sapiens
taacatgttt

SEQ ID NO: 5302250 - DNA, 15 bp, Homo sapiens
taacattaaatcaca

SEQ ID NO: 5302251 - DNA, 17 bp, Homo sapiens
taacattaacatctatt

SEQ ID NO: 5302252 - DNA, 19 bp, Homo sapiens
taacattaccttactgtgg

SEQ ID NO: 5302253 - DNA, 16 bp, Homo sapiens
taacattactgccttc

SEQ ID NO: 5302254 - DNA, 20 bp, Homo sapiens
taacattagttttaaaaagg

SEQ ID NO: 5302255 - DNA, 16 bp, Homo sapiens
taacattataaatgac

SEQ ID NO: 5302256 - DNA, 17 bp, Homo sapiens
taacattataaatgaca

SEQ ID NO: 5302257 - DNA, 14 bp, Homo sapiens
taacattatataac

SEQ ID NO: 5302258 - DNA, 21 bp, Homo sapiens
taacattatataacaaaaaag

SEQ ID NO: 5302259 - DNA, 18 bp, Homo sapiens
taacattatattcccaaa

SEQ ID NO: 5302260 - DNA, 23 bp, Homo sapiens
taacattatattcccaaatctca

SEQ ID NO: 5302261 - DNA, 13 bp, Homo sapiens
taacattatattg

SEQ ID NO: 5302262 - DNA, 16 bp, Homo sapiens
taacattatattgcaa

SEQ ID NO: 5302263 - DNA, 17 bp, Homo sapiens
taacattatattgcaat

SEQ ID NO: 5302264 - DNA, 14 bp, Homo sapiens
taacattatttata

SEQ ID NO: 5302265 - DNA, 13 bp, Homo sapiens
taacattcaattt

SEQ ID NO: 5302266 - DNA, 16 bp, Homo sapiens
taacattcaatttgct

SEQ ID NO: 5302267 - DNA, 17 bp, Homo sapiens
taacattcacagcccag

SEQ ID NO: 5302268 - DNA, 16 bp, Homo sapiens
taacattcatgagatt

SEQ ID NO: 5302269 - DNA, 13 bp, Homo sapiens
taacattccaaga

SEQ ID NO: 5302270 - DNA, 18 bp, Homo sapiens
taacattccaagactcta

SEQ ID NO: 5302271 - DNA, 13 bp, Homo sapiens
taacattcctaaa

SEQ ID NO: 5302272 - DNA, 11 bp, Homo sapiens
taacattcctc

SEQ ID NO: 5302273 - DNA, 18 bp, Homo sapiens
taacattctacttgctta

SEQ ID NO: 5302274 - DNA, 23 bp, Homo sapiens
taacattctattgactttcttaa

SEQ ID NO: 5302275 - DNA, 12 bp, Homo sapiens
taacattctgac

SEQ ID NO: 5302276 - DNA, 18 bp, Homo sapiens
taacattgaccaagaact

SEQ ID NO: 5302277 - DNA, 23 bp, Homo sapiens
taacattgaccaagaactgcatg

SEQ ID NO: 5302278 - DNA, 20 bp, Homo sapiens
taacattgggtcctgggtct

SEQ ID NO: 5302279 - DNA, 12 bp, Homo sapiens
taacattgtaaa

SEQ ID NO: 5302280 - DNA, 13 bp, Homo sapiens
taacattgtaaag

SEQ ID NO: 5302281 - DNA, 19 bp, Homo sapiens
taacattgtaaagtatgtg

SEQ ID NO: 5302282 - DNA, 15 bp, Homo sapiens
taacattgtaaatga

SEQ ID NO: 5302283 - DNA, 17 bp, Homo sapiens
taacattgtaaatgata

SEQ ID NO: 5302284 - DNA, 20 bp, Homo sapiens
taacattgtgactttgcttt

SEQ ID NO: 5302285 - DNA, 13 bp, Homo sapiens
taacatttaaatt

SEQ ID NO: 5302286 - DNA, 14 bp, Homo sapiens
taacatttaattta

SEQ ID NO: 5302287 - DNA, 17 bp, Homo sapiens
taacatttaatttagat

SEQ ID NO: 5302288 - DNA, 17 bp, Homo sapiens
taacatttacgaattat

SEQ ID NO: 5302289 - DNA, 19 bp, Homo sapiens
taacatttaggagaagttg

SEQ ID NO: 5302290 - DNA, 17 bp, Homo sapiens
taacatttcattgtaca

SEQ ID NO: 5302291 - DNA, 21 bp, Homo sapiens
taacatttcccccgagctctt

SEQ ID NO: 5302292 - DNA, 12 bp, Homo sapiens
taacatttccta

SEQ ID NO: 5302293 - DNA, 23 bp, Homo sapiens
taacatttctaactctgatgtaa

SEQ ID NO: 5302294 - DNA, 16 bp, Homo sapiens
taacatttctgttctc

SEQ ID NO: 5302295 - DNA, 17 bp, Homo sapiens
taacatttctgttctca

SEQ ID NO: 5302296 - DNA, 18 bp, Homo sapiens
taacatttgagtcccttc

SEQ ID NO: 5302297 - DNA, 13 bp, Homo sapiens
taacatttgcctt

SEQ ID NO: 5302298 - DNA, 15 bp, Homo sapiens
taacatttgccttgc

SEQ ID NO: 5302299 - DNA, 23 bp, Homo sapiens
taacatttgccttgcagaactgc

SEQ ID NO: 5302300 - DNA, 13 bp, Homo sapiens
taacattttaaat

SEQ ID NO: 5302301 - DNA, 12 bp, Homo sapiens
taacattttaca

SEQ ID NO: 5302302 - DNA, 15 bp, Homo sapiens
taacattttatacaa

SEQ ID NO: 5302303 - DNA, 14 bp, Homo sapiens
taacattttgttct

SEQ ID NO: 5302304 - DNA, 19 bp, Homo sapiens
taacatttttgaggaagtt

SEQ ID NO: 5302305 - DNA, 14 bp, Homo sapiens
taaccaaaaaatgt

SEQ ID NO: 5302306 - DNA, 18 bp, Homo sapiens
taaccaaaggtgaaggaa

SEQ ID NO: 5302307 - DNA, 22 bp, Homo sapiens
taaccaaatgcatcaatcctgt

SEQ ID NO: 5302308 - DNA, 16 bp, Homo sapiens
taaccaacaatataaa

SEQ ID NO: 5302309 - DNA, 15 bp, Homo sapiens
taaccaaccttgttt

SEQ ID NO: 5302310 - DNA, 21 bp, Homo sapiens
taaccaagaatgtctccattg

SEQ ID NO: 5302311 - DNA, 21 bp, Homo sapiens
taaccaagagataactgtaaa

SEQ ID NO: 5302312 - DNA, 15 bp, Homo sapiens
taaccaagaggctgg

SEQ ID NO: 5302313 - DNA, 11 bp, Homo sapiens
taaccaagctg

SEQ ID NO: 5302314 - DNA, 19 bp, Homo sapiens
taaccaagctgagtttcct

SEQ ID NO: 5302315 - DNA, 14 bp, Homo sapiens
taaccaaggccctg

SEQ ID NO: 5302316 - DNA, 20 bp, Homo sapiens
taaccaaggccctgtctctg

SEQ ID NO: 5302317 - DNA, 21 bp, Homo sapiens
taaccaaggccctgtctctgg

SEQ ID NO: 5302318 - DNA, 17 bp, Homo sapiens
taaccaaggctgtgttt

SEQ ID NO: 5302319 - DNA, 12 bp, Homo sapiens
taaccaagttcc

SEQ ID NO: 5302320 - DNA, 18 bp, Homo sapiens
taaccaagtttattcagt

SEQ ID NO: 5302321 - DNA, 15 bp, Homo sapiens
taaccaatctacaat

SEQ ID NO: 5302322 - DNA, 17 bp, Homo sapiens
taaccaatgccttttta

SEQ ID NO: 5302323 - DNA, 17 bp, Homo sapiens
taaccaatgtttaaaaa

SEQ ID NO: 5302324 - DNA, 22 bp, Homo sapiens
taaccaatgtttaaaaaagttt

SEQ ID NO: 5302325 - DNA, 18 bp, Homo sapiens
taaccaatttctttctaa

SEQ ID NO: 5302326 - DNA, 21 bp, Homo sapiens
taaccaattttcagacacatt

SEQ ID NO: 5302327 - DNA, 13 bp, Homo sapiens
taaccacaaggtc

SEQ ID NO: 5302328 - DNA, 21 bp, Homo sapiens
taaccacactgaaacctcttc

SEQ ID NO: 5302329 - DNA, 19 bp, Homo sapiens
taaccacagctccttttcc

SEQ ID NO: 5302330 - DNA, 18 bp, Homo sapiens
taaccacatcaatattgt

SEQ ID NO: 5302331 - DNA, 16 bp, Homo sapiens
taaccacattaattaa

SEQ ID NO: 5302332 - DNA, 15 bp, Homo sapiens
taaccacatttctaa

SEQ ID NO: 5302333 - DNA, 14 bp, Homo sapiens
taaccacattttag

SEQ ID NO: 5302334 - DNA, 17 bp, Homo sapiens
taaccacccgccccgcc

SEQ ID NO: 5302335 - DNA, 22 bp, Homo sapiens
taaccacccgccccgccccctc

SEQ ID NO: 5302336 - DNA, 22 bp, Homo sapiens
taaccaccctagctttatattt

SEQ ID NO: 5302337 - DNA, 15 bp, Homo sapiens
taaccacctacaagg

SEQ ID NO: 5302338 - DNA, 15 bp, Homo sapiens
taaccacggaaaaga

SEQ ID NO: 5302339 - DNA, 21 bp, Homo sapiens
taaccacggttatttaagcat

SEQ ID NO: 5302340 - DNA, 20 bp, Homo sapiens
taaccacgtctgtcttcaca

SEQ ID NO: 5302341 - DNA, 16 bp, Homo sapiens
taaccactaacattgt

SEQ ID NO: 5302342 - DNA, 14 bp, Homo sapiens
taaccactcctcag

SEQ ID NO: 5302343 - DNA, 19 bp, Homo sapiens
taaccactcctcaggaaca

SEQ ID NO: 5302344 - DNA, 16 bp, Homo sapiens
taaccagaattataca

SEQ ID NO: 5302345 - DNA, 20 bp, Homo sapiens
taaccagacacatactcatt

SEQ ID NO: 5302346 - DNA, 22 bp, Homo sapiens
taaccagacacatactcatttt

SEQ ID NO: 5302347 - DNA, 18 bp, Homo sapiens
taaccagcagtcacaggt

SEQ ID NO: 5302348 - DNA, 19 bp, Homo sapiens
taaccagcagtcacaggtc

SEQ ID NO: 5302349 - DNA, 21 bp, Homo sapiens
taaccagcattccctacagcc

SEQ ID NO: 5302350 - DNA, 13 bp, Homo sapiens
taaccagccacag

SEQ ID NO: 5302351 - DNA, 22 bp, Homo sapiens
taaccagccacagtacatatgt

SEQ ID NO: 5302352 - DNA, 17 bp, Homo sapiens
taaccagctcagtgttt

SEQ ID NO: 5302353 - DNA, 15 bp, Homo sapiens
taaccagctgtaaca

SEQ ID NO: 5302354 - DNA, 23 bp, Homo sapiens
taaccaggaagtgcttattctct

SEQ ID NO: 5302355 - DNA, 15 bp, Homo sapiens
taaccaggcccagcc

SEQ ID NO: 5302356 - DNA, 23 bp, Homo sapiens
taaccaggggtcctaaccactaa

SEQ ID NO: 5302357 - DNA, 17 bp, Homo sapiens
taaccagtacttctaag

SEQ ID NO: 5302358 - DNA, 23 bp, Homo sapiens
taaccagtctgaagtttcattta

SEQ ID NO: 5302359 - DNA, 20 bp, Homo sapiens
taaccagtgcagaaatgaaa

SEQ ID NO: 5302360 - DNA, 15 bp, Homo sapiens
taactaaagaagagg

SEQ ID NO: 5302361 - DNA, 16 bp, Homo sapiens
taactaaattaacatt

SEQ ID NO: 5302362 - DNA, 17 bp, Homo sapiens
taactaaatttgatact

SEQ ID NO: 5302363 - DNA, 20 bp, Homo sapiens
taactaactgcttcatctcc

SEQ ID NO: 5302364 - DNA, 14 bp, Homo sapiens
taactaagaagtgg

SEQ ID NO: 5302365 - DNA, 15 bp, Homo sapiens
taactaagactcccg

SEQ ID NO: 5302366 - DNA, 19 bp, Homo sapiens
taactaagatatagaaact

SEQ ID NO: 5302367 - DNA, 20 bp, Homo sapiens
taactaagcacattatgttt

SEQ ID NO: 5302368 - DNA, 23 bp, Homo sapiens
taactaagggggtagaagtagtt

SEQ ID NO: 5302369 - DNA, 17 bp, Homo sapiens
taactaatatggttttg

SEQ ID NO: 5302370 - DNA, 22 bp, Homo sapiens
taactaatctattgggttcatt

SEQ ID NO: 5302371 - DNA, 13 bp, Homo sapiens
taactaatgtaaa

SEQ ID NO: 5302372 - DNA, 14 bp, Homo sapiens
taactaatgtaaat

SEQ ID NO: 5302373 - DNA, 22 bp, Homo sapiens
taactaattggaaggagagggg

SEQ ID NO: 5302374 - DNA, 13 bp, Homo sapiens
taactaatttaaa

SEQ ID NO: 5302375 - DNA, 18 bp, Homo sapiens
taactaatttaaaccagc

SEQ ID NO: 5302376 - DNA, 19 bp, Homo sapiens
taactaatttaaaccagca

SEQ ID NO: 5302377 - DNA, 20 bp, Homo sapiens
taactaatttaaaccagcag

SEQ ID NO: 5302378 - DNA, 15 bp, Homo sapiens
taactaatttgtggt

SEQ ID NO: 5302379 - DNA, 16 bp, Homo sapiens
taactaattttgttga

SEQ ID NO: 5302380 - DNA, 20 bp, Homo sapiens
taactaattttgttgaaaat

SEQ ID NO: 5302381 - DNA, 17 bp, Homo sapiens
taactacaaattatcat

SEQ ID NO: 5302382 - DNA, 12 bp, Homo sapiens
taactacaatga

SEQ ID NO: 5302383 - DNA, 16 bp, Homo sapiens
taactacactaataaa

SEQ ID NO: 5302384 - DNA, 14 bp, Homo sapiens
taactacagaaaag

SEQ ID NO: 5302385 - DNA, 17 bp, Homo sapiens
taactacattaaaagct

SEQ ID NO: 5302386 - DNA, 17 bp, Homo sapiens
taactaccctacacctc

SEQ ID NO: 5302387 - DNA, 14 bp, Homo sapiens
taactacctcctca

SEQ ID NO: 5302388 - DNA, 15 bp, Homo sapiens
taactacctcctcac

SEQ ID NO: 5302389 - DNA, 17 bp, Homo sapiens
taactacctttggctta

SEQ ID NO: 5302390 - DNA, 21 bp, Homo sapiens
taactacctttggcttaattc

SEQ ID NO: 5302391 - DNA, 16 bp, Homo sapiens
taactactaagaataa

SEQ ID NO: 5302392 - DNA, 22 bp, Homo sapiens
taactactatattgattgtcct

SEQ ID NO: 5302393 - DNA, 18 bp, Homo sapiens
taactactgacgaaagag

SEQ ID NO: 5302394 - DNA, 18 bp, Homo sapiens
taactactgcaaaaagta

SEQ ID NO: 5302395 - DNA, 20 bp, Homo sapiens
taactactgcaaaaagtaca

SEQ ID NO: 5302396 - DNA, 15 bp, Homo sapiens
taactactgctaatg

SEQ ID NO: 5302397 - DNA, 14 bp, Homo sapiens
taactactgtgttc

SEQ ID NO: 5302398 - DNA, 17 bp, Homo sapiens
taactactgtgttcctg

SEQ ID NO: 5302399 - DNA, 18 bp, Homo sapiens
taactactttactaaatt

SEQ ID NO: 5302400 - DNA, 14 bp, Homo sapiens
taactactttataa

SEQ ID NO: 5302401 - DNA, 17 bp, Homo sapiens
taactactttataacta

SEQ ID NO: 5302402 - DNA, 22 bp, Homo sapiens
taactactttctgttatctaga

SEQ ID NO: 5302403 - DNA, 17 bp, Homo sapiens
taactactttttatact

SEQ ID NO: 5302404 - DNA, 22 bp, Homo sapiens
taactagaattagtatgtctgt

SEQ ID NO: 5302405 - DNA, 18 bp, Homo sapiens
taactagaatttattcaa

SEQ ID NO: 5302406 - DNA, 17 bp, Homo sapiens
taactagacaccaaagt

SEQ ID NO: 5302407 - DNA, 12 bp, Homo sapiens
taactagagcac

SEQ ID NO: 5302408 - DNA, 13 bp, Homo sapiens
taactagagcacg

SEQ ID NO: 5302409 - DNA, 22 bp, Homo sapiens
taactagagcagccctggagtc

SEQ ID NO: 5302410 - DNA, 16 bp, Homo sapiens
taactagagtatgtgt

SEQ ID NO: 5302411 - DNA, 19 bp, Homo sapiens
taactagatggtgctgaga

SEQ ID NO: 5302412 - DNA, 20 bp, Homo sapiens
taactagatggtgctgagaa

SEQ ID NO: 5302413 - DNA, 21 bp, Homo sapiens
taactagatggtgctgagaag

SEQ ID NO: 5302414 - DNA, 23 bp, Homo sapiens
taactagattaagatctgtgttt

SEQ ID NO: 5302415 - DNA, 19 bp, Homo sapiens
taactagcctttttggtat

SEQ ID NO: 5302416 - DNA, 12 bp, Homo sapiens
taactaggagct

SEQ ID NO: 5302417 - DNA, 17 bp, Homo sapiens
taactaggccatttgta

SEQ ID NO: 5302418 - DNA, 23 bp, Homo sapiens
taactaggccatttgtatttgta

SEQ ID NO: 5302419 - DNA, 22 bp, Homo sapiens
taactaggttgctactttattt

SEQ ID NO: 5302420 - DNA, 23 bp, Homo sapiens
taactagtaataccaaagactat

SEQ ID NO: 5302421 - DNA, 22 bp, Homo sapiens
taactagtcctgcagaggattt

SEQ ID NO: 5302422 - DNA, 17 bp, Homo sapiens
taactataaatatgtac

SEQ ID NO: 5302423 - DNA, 15 bp, Homo sapiens
taactataacaaaaa

SEQ ID NO: 5302424 - DNA, 23 bp, Homo sapiens
taactataagatacaataaaaca

SEQ ID NO: 5302425 - DNA, 19 bp, Homo sapiens
taactataaggtgcctcag

SEQ ID NO: 5302426 - DNA, 17 bp, Homo sapiens
taactatataagacatt

SEQ ID NO: 5302427 - DNA, 18 bp, Homo sapiens
taactatatttgcttttt

SEQ ID NO: 5302428 - DNA, 18 bp, Homo sapiens
taactatcaccagtgcat

SEQ ID NO: 5302429 - DNA, 20 bp, Homo sapiens
taactatcaggcagaagaat

SEQ ID NO: 5302430 - DNA, 22 bp, Homo sapiens
taactatcgaaatgacggtgtt

SEQ ID NO: 5302431 - DNA, 20 bp, Homo sapiens
taactatctcacttccagat

SEQ ID NO: 5302432 - DNA, 16 bp, Homo sapiens
taactatcttctctat

SEQ ID NO: 5302433 - DNA, 18 bp, Homo sapiens
taactatcttctttggac

SEQ ID NO: 5302434 - DNA, 14 bp, Homo sapiens
taactatgatcatc

SEQ ID NO: 5302435 - DNA, 22 bp, Homo sapiens
taactatggtaaataactgtga

SEQ ID NO: 5302436 - DNA, 13 bp, Homo sapiens
taactatgtaata

SEQ ID NO: 5302437 - DNA, 17 bp, Homo sapiens
taactatgtacaatatt

SEQ ID NO: 5302438 - DNA, 22 bp, Homo sapiens
taactatgtacaatattttaag

SEQ ID NO: 5302439 - DNA, 16 bp, Homo sapiens
taactatgttgataaa

SEQ ID NO: 5302440 - DNA, 15 bp, Homo sapiens
taactatgtttaaag

SEQ ID NO: 5302441 - DNA, 16 bp, Homo sapiens
taactattaacctttt

SEQ ID NO: 5302442 - DNA, 15 bp, Homo sapiens
taactattacagtgt

SEQ ID NO: 5302443 - DNA, 16 bp, Homo sapiens
taactattacagtgtt

SEQ ID NO: 5302444 - DNA, 16 bp, Homo sapiens
taactattagaatata

SEQ ID NO: 5302445 - DNA, 12 bp, Homo sapiens
taactattcagt

SEQ ID NO: 5302446 - DNA, 22 bp, Homo sapiens
taactattcagttgtgtttgtt

SEQ ID NO: 5302447 - DNA, 18 bp, Homo sapiens
taactattcctgtgtaaa

SEQ ID NO: 5302448 - DNA, 15 bp, Homo sapiens
taactattgcattta

SEQ ID NO: 5302449 - DNA, 21 bp, Homo sapiens
taactattgcatttatatgta

SEQ ID NO: 5302450 - DNA, 13 bp, Homo sapiens
taactatttagag

SEQ ID NO: 5302451 - DNA, 16 bp, Homo sapiens
taactatttagagaat

SEQ ID NO: 5302452 - DNA, 20 bp, Homo sapiens
taactattttgttttaatct

SEQ ID NO: 5302453 - DNA, 18 bp, Homo sapiens
taactatttttttcaaag

SEQ ID NO: 5302454 - DNA, 22 bp, Homo sapiens
taactcaaggataccttcttat

SEQ ID NO: 5302455 - DNA, 18 bp, Homo sapiens
taactcacacccctgccc

SEQ ID NO: 5302456 - DNA, 16 bp, Homo sapiens
taactcacctaactca

SEQ ID NO: 5302457 - DNA, 18 bp, Homo sapiens
taactcacctggcatctt

SEQ ID NO: 5302458 - DNA, 18 bp, Homo sapiens
taactcactatggttttt

SEQ ID NO: 5302459 - DNA, 21 bp, Homo sapiens
taactcactttaaatatgaaa

SEQ ID NO: 5302460 - DNA, 14 bp, Homo sapiens
taactcagaattat

SEQ ID NO: 5302461 - DNA, 23 bp, Homo sapiens
taactcagatcactactgcagtc

SEQ ID NO: 5302462 - DNA, 22 bp, Homo sapiens
taactcagtgaaggcccatgaa

SEQ ID NO: 5302463 - DNA, 22 bp, Homo sapiens
taactcataatttttgcagaaa

SEQ ID NO: 5302464 - DNA, 19 bp, Homo sapiens
taactcatacctttaaagg

SEQ ID NO: 5302465 - DNA, 14 bp, Homo sapiens
taactcatcataaa

SEQ ID NO: 5302466 - DNA, 14 bp, Homo sapiens
taactcatctgtca

SEQ ID NO: 5302467 - DNA, 21 bp, Homo sapiens
taactcatggcaggcatctgt

SEQ ID NO: 5302468 - DNA, 15 bp, Homo sapiens
taactcattgctctg

SEQ ID NO: 5302469 - DNA, 14 bp, Homo sapiens
taactccactgctt

SEQ ID NO: 5302470 - DNA, 19 bp, Homo sapiens
taactccagtctcctgaca

SEQ ID NO: 5302471 - DNA, 19 bp, Homo sapiens
taactccagtgatgttctt

SEQ ID NO: 5302472 - DNA, 16 bp, Homo sapiens
taactcccactcctaa

SEQ ID NO: 5302473 - DNA, 14 bp, Homo sapiens
taactcccattacc

SEQ ID NO: 5302474 - DNA, 18 bp, Homo sapiens
taactccctaggcctgag

SEQ ID NO: 5302475 - DNA, 16 bp, Homo sapiens
taactccctccaccag

SEQ ID NO: 5302476 - DNA, 18 bp, Homo sapiens
taactccctccaccagcc

SEQ ID NO: 5302477 - DNA, 19 bp, Homo sapiens
taactccctccaccagcct

SEQ ID NO: 5302478 - DNA, 12 bp, Homo sapiens
taactccctcct

SEQ ID NO: 5302479 - DNA, 14 bp, Homo sapiens
taactccctcctca

SEQ ID NO: 5302480 - DNA, 16 bp, Homo sapiens
taactcctataaagtg

SEQ ID NO: 5302481 - DNA, 17 bp, Homo sapiens
taactcctcaattccaa

SEQ ID NO: 5302482 - DNA, 16 bp, Homo sapiens
taactcctcccagggt

SEQ ID NO: 5302483 - DNA, 21 bp, Homo sapiens
taactcctcccagggttttaa

SEQ ID NO: 5302484 - DNA, 19 bp, Homo sapiens
taactcctgccattcttct

SEQ ID NO: 5302485 - DNA, 17 bp, Homo sapiens
taactctaaccctgtgg

SEQ ID NO: 5302486 - DNA, 19 bp, Homo sapiens
taactctaaccctgtggaa

SEQ ID NO: 5302487 - DNA, 21 bp, Homo sapiens
taactctaaccctgtggaagc

SEQ ID NO: 5302488 - DNA, 22 bp, Homo sapiens
taactctatagttattgtttta

SEQ ID NO: 5302489 - DNA, 12 bp, Homo sapiens
taactctccagt

SEQ ID NO: 5302490 - DNA, 22 bp, Homo sapiens
taactctccagttatcagtact

SEQ ID NO: 5302491 - DNA, 15 bp, Homo sapiens
taactctcgggacct

SEQ ID NO: 5302492 - DNA, 13 bp, Homo sapiens
taactctctttcc

SEQ ID NO: 5302493 - DNA, 14 bp, Homo sapiens
taactctctttcct

SEQ ID NO: 5302494 - DNA, 17 bp, Homo sapiens
taactctctttccttga

SEQ ID NO: 5302495 - DNA, 17 bp, Homo sapiens
taactctgatgtaaatg

SEQ ID NO: 5302496 - DNA, 21 bp, Homo sapiens
taactctgcactactcctctg

SEQ ID NO: 5302497 - DNA, 16 bp, Homo sapiens
taactctgcatagaca

SEQ ID NO: 5302498 - DNA, 19 bp, Homo sapiens
taactctggattttgaatt

SEQ ID NO: 5302499 - DNA, 22 bp, Homo sapiens
taactctgtccttacatactca

SEQ ID NO: 5302500 - DNA, 11 bp, Homo sapiens
taactctgtct

SEQ ID NO: 5302501 - DNA, 20 bp, Homo sapiens
taactcttacctaaactgag

SEQ ID NO: 5302502 - DNA, 21 bp, Homo sapiens
taactcttacctaaactgagc

SEQ ID NO: 5302503 - DNA, 21 bp, Homo sapiens
taactcttagaagtgttgtaa

SEQ ID NO: 5302504 - DNA, 24 bp, Homo sapiens
taactcttagaagtgttgtaaaag

SEQ ID NO: 5302505 - DNA, 14 bp, Homo sapiens
taactcttgctcac

SEQ ID NO: 5302506 - DNA, 16 bp, Homo sapiens
taactcttgtctattt

SEQ ID NO: 5302507 - DNA, 21 bp, Homo sapiens
taactctttgcctttgccacc

SEQ ID NO: 5302508 - DNA, 18 bp, Homo sapiens
taactctttggctattgt

SEQ ID NO: 5302509 - DNA, 19 bp, Homo sapiens
taactctttggctattgtc

SEQ ID NO: 5302510 - DNA, 23 bp, Homo sapiens
taactctttggctattgtccttg

SEQ ID NO: 5302511 - DNA, 17 bp, Homo sapiens
taactgaaaatgtaaat

SEQ ID NO: 5302512 - DNA, 14 bp, Homo sapiens
taactgaaaatgtg

SEQ ID NO: 5302513 - DNA, 20 bp, Homo sapiens
taactgaaaatgtgctatac

SEQ ID NO: 5302514 - DNA, 21 bp, Homo sapiens
taactgaaaatgtgctatact

SEQ ID NO: 5302515 - DNA, 23 bp, Homo sapiens
taactgaacatccaaaatcttga

SEQ ID NO: 5302516 - DNA, 12 bp, Homo sapiens
taactgaagaaa

SEQ ID NO: 5302517 - DNA, 13 bp, Homo sapiens
taactgaagaaaa

SEQ ID NO: 5302518 - DNA, 16 bp, Homo sapiens
taactgaagcaaatac

SEQ ID NO: 5302519 - DNA, 14 bp, Homo sapiens
taactgaagcataa

SEQ ID NO: 5302520 - DNA, 15 bp, Homo sapiens
taactgaagcataaa

SEQ ID NO: 5302521 - DNA, 20 bp, Homo sapiens
taactgaagcataaacatca

SEQ ID NO: 5302522 - DNA, 16 bp, Homo sapiens
taactgaaggagaagg

SEQ ID NO: 5302523 - DNA, 17 bp, Homo sapiens
taactgaaggtgcagtt

SEQ ID NO: 5302524 - DNA, 14 bp, Homo sapiens
taactgaataccac

SEQ ID NO: 5302525 - DNA, 19 bp, Homo sapiens
taactgaataccactctgt

SEQ ID NO: 5302526 - DNA, 13 bp, Homo sapiens
taactgaatttgg

SEQ ID NO: 5302527 - DNA, 14 bp, Homo sapiens
taactgacaaatca

SEQ ID NO: 5302528 - DNA, 17 bp, Homo sapiens
taactgacaaatcaagt

SEQ ID NO: 5302529 - DNA, 13 bp, Homo sapiens
taactgacaactt

SEQ ID NO: 5302530 - DNA, 20 bp, Homo sapiens
taactgacaagccatcttga

SEQ ID NO: 5302531 - DNA, 15 bp, Homo sapiens
taactgactctgtta

SEQ ID NO: 5302532 - DNA, 15 bp, Homo sapiens
taactgacttagttc

SEQ ID NO: 5302533 - DNA, 18 bp, Homo sapiens
taactgacttagttcttc

SEQ ID NO: 5302534 - DNA, 14 bp, Homo sapiens
taactgacttcact

SEQ ID NO: 5302535 - DNA, 14 bp, Homo sapiens
taactgagaatttt

SEQ ID NO: 5302536 - DNA, 16 bp, Homo sapiens
taactgaggagctagt

SEQ ID NO: 5302537 - DNA, 18 bp, Homo sapiens
taagaacaaaagcgaccc

SEQ ID NO: 5302538 - DNA, 22 bp, Homo sapiens
taagaacaagttttggcagcca

SEQ ID NO: 5302539 - DNA, 22 bp, Homo sapiens
taagaacacctgacaacttctg

SEQ ID NO: 5302540 - DNA, 23 bp, Homo sapiens
taagaacacctgacaacttctga

SEQ ID NO: 5302541 - DNA, 14 bp, Homo sapiens
taagaacagaacag

SEQ ID NO: 5302542 - DNA, 13 bp, Homo sapiens
taagaacagctca

SEQ ID NO: 5302543 - DNA, 19 bp, Homo sapiens
taagaacattaattatatg

SEQ ID NO: 5302544 - DNA, 12 bp, Homo sapiens
taagaaccaaaa

SEQ ID NO: 5302545 - DNA, 23 bp, Homo sapiens
taagaaccaaactcctatttcaa

SEQ ID NO: 5302546 - DNA, 15 bp, Homo sapiens
taagaacccagggtg

SEQ ID NO: 5302547 - DNA, 23 bp, Homo sapiens
taagaacccatggaaaaatgcca

SEQ ID NO: 5302548 - DNA, 16 bp, Homo sapiens
taagaaccttaatgac

SEQ ID NO: 5302549 - DNA, 16 bp, Homo sapiens
taagaactaaaatgtt

SEQ ID NO: 5302550 - DNA, 16 bp, Homo sapiens
taagaactaaagaaga

SEQ ID NO: 5302551 - DNA, 17 bp, Homo sapiens
taagaactaaagaagat

SEQ ID NO: 5302552 - DNA, 21 bp, Homo sapiens
taagaactacaaacaaaattt

SEQ ID NO: 5302553 - DNA, 22 bp, Homo sapiens
taagaactgcttcatgtgaaca

SEQ ID NO: 5302554 - DNA, 15 bp, Homo sapiens
taagaactgtgaaat

SEQ ID NO: 5302555 - DNA, 13 bp, Homo sapiens
taagaacttcatt

SEQ ID NO: 5302556 - DNA, 22 bp, Homo sapiens
taagaagaaaattgctgtgcct

SEQ ID NO: 5302557 - DNA, 15 bp, Homo sapiens
taagaagaaactgct

SEQ ID NO: 5302558 - DNA, 14 bp, Homo sapiens
taagaagaaagcaa

SEQ ID NO: 5302559 - DNA, 17 bp, Homo sapiens
taagaagaagagaggca

SEQ ID NO: 5302560 - DNA, 17 bp, Homo sapiens
taagaagaagttcatgt

SEQ ID NO: 5302561 - DNA, 22 bp, Homo sapiens
taagaagaagttcatgtccaaa

SEQ ID NO: 5302562 - DNA, 15 bp, Homo sapiens
taagaagacatgaac

SEQ ID NO: 5302563 - DNA, 14 bp, Homo sapiens
taagaagacatttt

SEQ ID NO: 5302564 - DNA, 14 bp, Homo sapiens
taagaagatgactt

SEQ ID NO: 5302565 - DNA, 23 bp, Homo sapiens
taagaagatgttttgaaatgtac

SEQ ID NO: 5302566 - DNA, 15 bp, Homo sapiens
taagaagattcaaga

SEQ ID NO: 5302567 - DNA, 18 bp, Homo sapiens
taagaagcaatctttgaa

SEQ ID NO: 5302568 - DNA, 22 bp, Homo sapiens
taagaagcaatctttgaaataa

SEQ ID NO: 5302569 - DNA, 23 bp, Homo sapiens
taagaagcacgtggtaaaacact

SEQ ID NO: 5302570 - DNA, 14 bp, Homo sapiens
taagaagccaaggg

SEQ ID NO: 5302571 - DNA, 15 bp, Homo sapiens
taagaagcgaacaaa

SEQ ID NO: 5302572 - DNA, 21 bp, Homo sapiens
taagaagcgaacaaaaagtaa

SEQ ID NO: 5302573 - DNA, 13 bp, Homo sapiens
taagaagctgttg

SEQ ID NO: 5302574 - DNA, 19 bp, Homo sapiens
taagaagctgttgtacatt

SEQ ID NO: 5302575 - DNA, 22 bp, Homo sapiens
taagaagctgttgtacatttat

SEQ ID NO: 5302576 - DNA, 14 bp, Homo sapiens
taagaagcttctaa

SEQ ID NO: 5302577 - DNA, 20 bp, Homo sapiens
taagaagcttctaataaatt

SEQ ID NO: 5302578 - DNA, 15 bp, Homo sapiens
taagaaggcaatatt

SEQ ID NO: 5302579 - DNA, 20 bp, Homo sapiens
taagaaggcaatattaacct

SEQ ID NO: 5302580 - DNA, 19 bp, Homo sapiens
taagaagggatggattcca

SEQ ID NO: 5302581 - DNA, 21 bp, Homo sapiens
taagaagggggagtgaaacag

SEQ ID NO: 5302582 - DNA, 13 bp, Homo sapiens
taagaagtgaaaa

SEQ ID NO: 5302583 - DNA, 15 bp, Homo sapiens
taagaagtggggcag

SEQ ID NO: 5302584 - DNA, 22 bp, Homo sapiens
taagaagttattttcttgttta

SEQ ID NO: 5302585 - DNA, 23 bp, Homo sapiens
taagaagttattttcttgtttaa

SEQ ID NO: 5302586 - DNA, 15 bp, Homo sapiens
taagaagttgtttga

SEQ ID NO: 5302587 - DNA, 15 bp, Homo sapiens
taagaagttttaaaa

SEQ ID NO: 5302588 - DNA, 21 bp, Homo sapiens
taagaataaaatgttgaaaag

SEQ ID NO: 5302589 - DNA, 23 bp, Homo sapiens
taagaataaagtaccttgacttt

SEQ ID NO: 5302590 - DNA, 20 bp, Homo sapiens
taagaataaataaagaagaa

SEQ ID NO: 5302591 - DNA, 21 bp, Homo sapiens
taagaataaataaagaagaaa

SEQ ID NO: 5302592 - DNA, 18 bp, Homo sapiens
taagaataacaagaagcc

SEQ ID NO: 5302593 - DNA, 13 bp, Homo sapiens
taagaataataaa

SEQ ID NO: 5302594 - DNA, 14 bp, Homo sapiens
taagaataataaaa

SEQ ID NO: 5302595 - DNA, 23 bp, Homo sapiens
taagaataatgacgtattgtgaa

SEQ ID NO: 5302596 - DNA, 16 bp, Homo sapiens
taagaatacagctttc

SEQ ID NO: 5302597 - DNA, 18 bp, Homo sapiens
taagaataccacatcaaa

SEQ ID NO: 5302598 - DNA, 22 bp, Homo sapiens
taagaataccacatcaaataag

SEQ ID NO: 5302599 - DNA, 19 bp, Homo sapiens
taagaatagaacaacatat

SEQ ID NO: 5302600 - DNA, 18 bp, Homo sapiens
taagaatagtagatgtgg

SEQ ID NO: 5302601 - DNA, 17 bp, Homo sapiens
taagaatagttctaaaa

SEQ ID NO: 5302602 - DNA, 16 bp, Homo sapiens
taagaatataaatatt

SEQ ID NO: 5302603 - DNA, 19 bp, Homo sapiens
taagaatatctgtaatggt

SEQ ID NO: 5302604 - DNA, 23 bp, Homo sapiens
taagaatatttttagactatttc

SEQ ID NO: 5302605 - DNA, 17 bp, Homo sapiens
taagaatcagagtagaa

SEQ ID NO: 5302606 - DNA, 18 bp, Homo sapiens
taagaatcagagtagaaa

SEQ ID NO: 5302607 - DNA, 19 bp, Homo sapiens
taagaatcagagtagaaat

SEQ ID NO: 5302608 - DNA, 20 bp, Homo sapiens
taagaatcagagtagaaata

SEQ ID NO: 5302609 - DNA, 16 bp, Homo sapiens
taagaatcattgtgct

SEQ ID NO: 5302610 - DNA, 19 bp, Homo sapiens
taagaatcattgtgcttaa

SEQ ID NO: 5302611 - DNA, 17 bp, Homo sapiens
taagaatctagcaagaa

SEQ ID NO: 5302612 - DNA, 18 bp, Homo sapiens
taagaatgaaactataaa

SEQ ID NO: 5302613 - DNA, 13 bp, Homo sapiens
taagaatgaaata

SEQ ID NO: 5302614 - DNA, 15 bp, Homo sapiens
taagaatgactgatg

SEQ ID NO: 5302615 - DNA, 13 bp, Homo sapiens
taagaatgagttt

SEQ ID NO: 5302616 - DNA, 18 bp, Homo sapiens
taagaatgagtttcttag

SEQ ID NO: 5302617 - DNA, 22 bp, Homo sapiens
taagaatgcagattcctgggcc

SEQ ID NO: 5302618 - DNA, 14 bp, Homo sapiens
taagaatggaaaag

SEQ ID NO: 5302619 - DNA, 19 bp, Homo sapiens
taagaatgttggtttactt

SEQ ID NO: 5302620 - DNA, 18 bp, Homo sapiens
taagaattcaaactgggg

SEQ ID NO: 5302621 - DNA, 15 bp, Homo sapiens
taagaattcagacat

SEQ ID NO: 5302622 - DNA, 19 bp, Homo sapiens
taagaattcagtagcattt

SEQ ID NO: 5302623 - DNA, 19 bp, Homo sapiens
taagaattgagtaatggtg

SEQ ID NO: 5302624 - DNA, 22 bp, Homo sapiens
taagaattgagtaatggtgtag

SEQ ID NO: 5302625 - DNA, 10 bp, Homo sapiens
taagaattgt

SEQ ID NO: 5302626 - DNA, 13 bp, Homo sapiens
taagaatttcact

SEQ ID NO: 5302627 - DNA, 15 bp, Homo sapiens
taagaatttcactgt

SEQ ID NO: 5302628 - DNA, 17 bp, Homo sapiens
taagacaaaaagccttg

SEQ ID NO: 5302629 - DNA, 23 bp, Homo sapiens
taagacaaaaagccttgaagaaa

SEQ ID NO: 5302630 - DNA, 20 bp, Homo sapiens
taagacaaacactgccatat

SEQ ID NO: 5302631 - DNA, 19 bp, Homo sapiens
taagacaaatattcctttg

SEQ ID NO: 5302632 - DNA, 14 bp, Homo sapiens
taagacaaatgcag

SEQ ID NO: 5302633 - DNA, 13 bp, Homo sapiens
taagacaaatggg

SEQ ID NO: 5302634 - DNA, 16 bp, Homo sapiens
taagacaaatgggact

SEQ ID NO: 5302635 - DNA, 22 bp, Homo sapiens
taagacaaatgggactgatgtc

SEQ ID NO: 5302636 - DNA, 15 bp, Homo sapiens
taagacaacaggcat

SEQ ID NO: 5302637 - DNA, 17 bp, Homo sapiens
taagacaagaacattct

SEQ ID NO: 5302638 - DNA, 22 bp, Homo sapiens
taagacaagaatatgttcacat

SEQ ID NO: 5302639 - DNA, 16 bp, Homo sapiens
taagacaagagatcta

SEQ ID NO: 5302640 - DNA, 21 bp, Homo sapiens
taagacaagagatctacacat

SEQ ID NO: 5302641 - DNA, 22 bp, Homo sapiens
taagacaagagatctacacatg

SEQ ID NO: 5302642 - DNA, 23 bp, Homo sapiens
taagacaagagatctacacatgt

SEQ ID NO: 5302643 - DNA, 14 bp, Homo sapiens
taagacaagtctga

SEQ ID NO: 5302644 - DNA, 15 bp, Homo sapiens
taagacaatagtatt

SEQ ID NO: 5302645 - DNA, 20 bp, Homo sapiens
taagacaatagtatttctcc

SEQ ID NO: 5302646 - DNA, 22 bp, Homo sapiens
taagacaatggaccctttttgt

SEQ ID NO: 5302647 - DNA, 19 bp, Homo sapiens
taagacacacagcctttct

SEQ ID NO: 5302648 - DNA, 19 bp, Homo sapiens
taagacacgtgcaacagac

SEQ ID NO: 5302649 - DNA, 20 bp, Homo sapiens
taagacactgaaaaatctaa

SEQ ID NO: 5302650 - DNA, 12 bp, Homo sapiens
taagacactgtg

SEQ ID NO: 5302651 - DNA, 16 bp, Homo sapiens
taagacagagaaacag

SEQ ID NO: 5302652 - DNA, 22 bp, Homo sapiens
taagacagggtctcattctatc

SEQ ID NO: 5302653 - DNA, 14 bp, Homo sapiens
taagacagtgtaca

SEQ ID NO: 5302654 - DNA, 18 bp, Homo sapiens
taagacagttgggatcca

SEQ ID NO: 5302655 - DNA, 16 bp, Homo sapiens
taagacataaacaaag

SEQ ID NO: 5302656 - DNA, 17 bp, Homo sapiens
taagacataacgttttt

SEQ ID NO: 5302657 - DNA, 22 bp, Homo sapiens
taagacataacgtttttccttt

SEQ ID NO: 5302658 - DNA, 17 bp, Homo sapiens
taagacatgatttcctt

SEQ ID NO: 5302659 - DNA, 20 bp, Homo sapiens
taagacatgatttccttgaa

SEQ ID NO: 5302660 - DNA, 21 bp, Homo sapiens
taagacatgatttccttgaat

SEQ ID NO: 5302661 - DNA, 21 bp, Homo sapiens
taagacatgcactatgaggaa

SEQ ID NO: 5302662 - DNA, 19 bp, Homo sapiens
taagacatgtaacgaaaca

SEQ ID NO: 5302663 - DNA, 12 bp, Homo sapiens
taagacattaag

SEQ ID NO: 5302664 - DNA, 21 bp, Homo sapiens
taagacattagtttgaggtac

SEQ ID NO: 5302665 - DNA, 19 bp, Homo sapiens
taagacattcaccaacaac

SEQ ID NO: 5302666 - DNA, 16 bp, Homo sapiens
taagacatttcctttt

SEQ ID NO: 5302667 - DNA, 20 bp, Homo sapiens
taagacatttgtatattgtg

SEQ ID NO: 5302668 - DNA, 20 bp, Homo sapiens
taagacatttgtttgctgta

SEQ ID NO: 5302669 - DNA, 15 bp, Homo sapiens
taagacattttcatg

SEQ ID NO: 5302670 - DNA, 21 bp, Homo sapiens
taagacattttcatgcttcca

SEQ ID NO: 5302671 - DNA, 17 bp, Homo sapiens
taagacatttttggaag

SEQ ID NO: 5302672 - DNA, 12 bp, Homo sapiens
taagaccaaaga

SEQ ID NO: 5302673 - DNA, 19 bp, Homo sapiens
taagaccaaagacttgtta

SEQ ID NO: 5302674 - DNA, 18 bp, Homo sapiens
taagaccaccacctcaga

SEQ ID NO: 5302675 - DNA, 12 bp, Homo sapiens
taagaccacctt

SEQ ID NO: 5302676 - DNA, 16 bp, Homo sapiens
taagaccactacagtc

SEQ ID NO: 5302677 - DNA, 13 bp, Homo sapiens
taagaccagcctg

SEQ ID NO: 5302678 - DNA, 14 bp, Homo sapiens
taagaccagcctgg

SEQ ID NO: 5302679 - DNA, 19 bp, Homo sapiens
taagaccataacagccaac

SEQ ID NO: 5302680 - DNA, 15 bp, Homo sapiens
taagaccccatctct

SEQ ID NO: 5302681 - DNA, 16 bp, Homo sapiens
taagaccctaattctt

SEQ ID NO: 5302682 - DNA, 14 bp, Homo sapiens
taagacctactgtt

SEQ ID NO: 5302683 - DNA, 19 bp, Homo sapiens
taagacctactgttctaaa

SEQ ID NO: 5302684 - DNA, 13 bp, Homo sapiens
taagacctggcag

SEQ ID NO: 5302685 - DNA, 17 bp, Homo sapiens
taagacgtatgtaacat

SEQ ID NO: 5302686 - DNA, 19 bp, Homo sapiens
taagactataaataaaaac

SEQ ID NO: 5302687 - DNA, 20 bp, Homo sapiens
taagactatatatataaatg

SEQ ID NO: 5302688 - DNA, 18 bp, Homo sapiens
taagactcaaatgttcta

SEQ ID NO: 5302689 - DNA, 18 bp, Homo sapiens
taagactcattccctaga

SEQ ID NO: 5302690 - DNA, 18 bp, Homo sapiens
taagactcccgccccggg

SEQ ID NO: 5302691 - DNA, 22 bp, Homo sapiens
taagactcctcggcctggctcc

SEQ ID NO: 5302692 - DNA, 23 bp, Homo sapiens
taagactcctcggcctggctcct

SEQ ID NO: 5302693 - DNA, 21 bp, Homo sapiens
taagactctgtctcaaaaata

SEQ ID NO: 5302694 - DNA, 19 bp, Homo sapiens
taagactctgtgtggctgt

SEQ ID NO: 5302695 - DNA, 20 bp, Homo sapiens
taagactctgtgtggctgtg

SEQ ID NO: 5302696 - DNA, 22 bp, Homo sapiens
taagactgaatgttttatttat

SEQ ID NO: 5302697 - DNA, 13 bp, Homo sapiens
taagactgccttc

SEQ ID NO: 5302698 - DNA, 16 bp, Homo sapiens
taagactgccttcagt

SEQ ID NO: 5302699 - DNA, 14 bp, Homo sapiens
taagactgctgcag

SEQ ID NO: 5302700 - DNA, 19 bp, Homo sapiens
taagactgtaatgaatcta

SEQ ID NO: 5302701 - DNA, 17 bp, Homo sapiens
taagactgtagatatgt

SEQ ID NO: 5302702 - DNA, 15 bp, Homo sapiens
taagacttaatatgt

SEQ ID NO: 5302703 - DNA, 16 bp, Homo sapiens
taagacttaatgagac

SEQ ID NO: 5302704 - DNA, 21 bp, Homo sapiens
taagacttagtactatctgtg

SEQ ID NO: 5302705 - DNA, 15 bp, Homo sapiens
taagacttagttatt

SEQ ID NO: 5302706 - DNA, 17 bp, Homo sapiens
taagacttcagatttca

SEQ ID NO: 5302707 - DNA, 19 bp, Homo sapiens
taagacttcagatttcaaa

SEQ ID NO: 5302708 - DNA, 17 bp, Homo sapiens
taagacttgacagtgga

SEQ ID NO: 5302709 - DNA, 18 bp, Homo sapiens
taagacttgtttctttct

SEQ ID NO: 5302710 - DNA, 17 bp, Homo sapiens
taagactttctgaaaac

SEQ ID NO: 5302711 - DNA, 22 bp, Homo sapiens
taagacttttctctactttaaa

SEQ ID NO: 5302712 - DNA, 18 bp, Homo sapiens
taagagaaaagagagaaa

SEQ ID NO: 5302713 - DNA, 21 bp, Homo sapiens
taagagaaacctgccaaggag

SEQ ID NO: 5302714 - DNA, 23 bp, Homo sapiens
taagagaaacctgccaaggagca

SEQ ID NO: 5302715 - DNA, 13 bp, Homo sapiens
taagagaaacttt

SEQ ID NO: 5302716 - DNA, 16 bp, Homo sapiens
taagagaaactttata

SEQ ID NO: 5302717 - DNA, 12 bp, Homo sapiens
taagagaaatgg

SEQ ID NO: 5302718 - DNA, 16 bp, Homo sapiens
taagagaagaaatgtt

SEQ ID NO: 5302719 - DNA, 20 bp, Homo sapiens
taagagaagtagaaatcata

SEQ ID NO: 5302720 - DNA, 14 bp, Homo sapiens
taagagaatgttat

SEQ ID NO: 5302721 - DNA, 21 bp, Homo sapiens
taagagaattatatatttcta

SEQ ID NO: 5302722 - DNA, 21 bp, Homo sapiens
taagagacagtcaccccagga

SEQ ID NO: 5302723 - DNA, 12 bp, Homo sapiens
taagagagaaat

SEQ ID NO: 5302724 - DNA, 14 bp, Homo sapiens
taagagagaaatct

SEQ ID NO: 5302725 - DNA, 18 bp, Homo sapiens
taagagagaaatctgaaa

SEQ ID NO: 5302726 - DNA, 23 bp, Homo sapiens
taagagagaatgagagacacact

SEQ ID NO: 5302727 - DNA, 16 bp, Homo sapiens
taagagataattctta

SEQ ID NO: 5302728 - DNA, 15 bp, Homo sapiens
taagagatgtgacta

SEQ ID NO: 5302729 - DNA, 12 bp, Homo sapiens
taagagattctt

SEQ ID NO: 5302730 - DNA, 14 bp, Homo sapiens
taagagattttatg

SEQ ID NO: 5302731 - DNA, 15 bp, Homo sapiens
taagagattttatgt

SEQ ID NO: 5302732 - DNA, 14 bp, Homo sapiens
taagagcaataaat

SEQ ID NO: 5302733 - DNA, 16 bp, Homo sapiens
taagagcaattctggg

SEQ ID NO: 5302734 - DNA, 21 bp, Homo sapiens
taagagcacaggttagggcat

SEQ ID NO: 5302735 - DNA, 22 bp, Homo sapiens
taagagcaccttcctcacttcc

SEQ ID NO: 5302736 - DNA, 22 bp, Homo sapiens
taagagcagtccatttctacca

SEQ ID NO: 5302737 - DNA, 22 bp, Homo sapiens
taagagcatccggccaaatgca

SEQ ID NO: 5302738 - DNA, 12 bp, Homo sapiens
taagagccacaa

SEQ ID NO: 5302739 - DNA, 13 bp, Homo sapiens
taagagcctctgg

SEQ ID NO: 5302740 - DNA, 16 bp, Homo sapiens
taagagctagcgctgc

SEQ ID NO: 5302741 - DNA, 14 bp, Homo sapiens
taagagctatacag

SEQ ID NO: 5302742 - DNA, 23 bp, Homo sapiens
taagagctattttagaaagctaa

SEQ ID NO: 5302743 - DNA, 15 bp, Homo sapiens
taagagctcaggatg

SEQ ID NO: 5302744 - DNA, 22 bp, Homo sapiens
taagagctcaggatgagggaaa

SEQ ID NO: 5302745 - DNA, 14 bp, Homo sapiens
taagagctggtgtc

SEQ ID NO: 5302746 - DNA, 18 bp, Homo sapiens
taagagcttgatctgtga

SEQ ID NO: 5302747 - DNA, 18 bp, Homo sapiens
taagaggaaagtacattt

SEQ ID NO: 5302748 - DNA, 22 bp, Homo sapiens
taagaggaatttggtataatta

SEQ ID NO: 5302749 - DNA, 18 bp, Homo sapiens
taagaggacgccttcagg

SEQ ID NO: 5302750 - DNA, 21 bp, Homo sapiens
taagaggagtaggccctggtt

SEQ ID NO: 5302751 - DNA, 15 bp, Homo sapiens
taagaggatgaagtg

SEQ ID NO: 5302752 - DNA, 22 bp, Homo sapiens
taagaggatggatgaatctgga

SEQ ID NO: 5302753 - DNA, 14 bp, Homo sapiens
taagaggcaaagaa

SEQ ID NO: 5302754 - DNA, 20 bp, Homo sapiens
taagaggcagaaaattgcac

SEQ ID NO: 5302755 - DNA, 22 bp, Homo sapiens
taagaggcagggtctcactctg

SEQ ID NO: 5302756 - DNA, 22 bp, Homo sapiens
taagaggcaggtcttaatcagt

SEQ ID NO: 5302757 - DNA, 14 bp, Homo sapiens
taagaggctgataa

SEQ ID NO: 5302758 - DNA, 20 bp, Homo sapiens
taagaggctgccctcctgtg

SEQ ID NO: 5302759 - DNA, 20 bp, Homo sapiens
taagagggaaactctggaga

SEQ ID NO: 5302760 - DNA, 12 bp, Homo sapiens
taagagggaggg

SEQ ID NO: 5302761 - DNA, 17 bp, Homo sapiens
taagagggcacacactg

SEQ ID NO: 5302762 - DNA, 20 bp, Homo sapiens
taagagggcacacactgtgt

SEQ ID NO: 5302763 - DNA, 23 bp, Homo sapiens
taagagggcagactgtgaacttg

SEQ ID NO: 5302764 - DNA, 18 bp, Homo sapiens
taagagggcatatacagt

SEQ ID NO: 5302765 - DNA, 21 bp, Homo sapiens
taagagggtgaacaaagaaaa

SEQ ID NO: 5302766 - DNA, 22 bp, Homo sapiens
taagagggtgaacaaagaaaag

SEQ ID NO: 5302767 - DNA, 15 bp, Homo sapiens
taagaggtactaaaa

SEQ ID NO: 5302768 - DNA, 18 bp, Homo sapiens
taagaggtactaaaaaca

SEQ ID NO: 5302769 - DNA, 21 bp, Homo sapiens
taagaggtgtgggtgtctgtt

SEQ ID NO: 5302770 - DNA, 18 bp, Homo sapiens
taagaggttctaacttct

SEQ ID NO: 5302771 - DNA, 16 bp, Homo sapiens
taagaggttggtgtgg

SEQ ID NO: 5302772 - DNA, 14 bp, Homo sapiens
taagagtaaagcaa

SEQ ID NO: 5302773 - DNA, 17 bp, Homo sapiens
taagagtacaagctctt

SEQ ID NO: 5302774 - DNA, 21 bp, Homo sapiens
taagagtagaaactgcaggga

SEQ ID NO: 5302775 - DNA, 19 bp, Homo sapiens
taagagtcacaatttgcaa

SEQ ID NO: 5302776 - DNA, 23 bp, Homo sapiens
taagagtctctatttcacaatta

SEQ ID NO: 5302777 - DNA, 17 bp, Homo sapiens
taagagtggaggaggag

SEQ ID NO: 5302778 - DNA, 12 bp, Homo sapiens
taagagtgtaga

SEQ ID NO: 5302779 - DNA, 16 bp, Homo sapiens
taagagtgtagaagca

SEQ ID NO: 5302780 - DNA, 18 bp, Homo sapiens
taagagtgtagaagcatt

SEQ ID NO: 5302781 - DNA, 23 bp, Homo sapiens
taagagtgtagaagcattccttc

SEQ ID NO: 5302782 - DNA, 23 bp, Homo sapiens
taagagttgctttgccagagcag

SEQ ID NO: 5302783 - DNA, 13 bp, Homo sapiens
taagataaaaaag

SEQ ID NO: 5302784 - DNA, 13 bp, Homo sapiens
taagataaaataa

SEQ ID NO: 5302785 - DNA, 17 bp, Homo sapiens
taagataaaatgatgtt

SEQ ID NO: 5302786 - DNA, 14 bp, Homo sapiens
taagataataatat

SEQ ID NO: 5302787 - DNA, 21 bp, Homo sapiens
taagataatatttaaaatagt

SEQ ID NO: 5302788 - DNA, 17 bp, Homo sapiens
taagataattaaatgaa

SEQ ID NO: 5302789 - DNA, 18 bp, Homo sapiens
taagataattaaatgaaa

SEQ ID NO: 5302790 - DNA, 21 bp, Homo sapiens
taagataattaaatgaaatac

SEQ ID NO: 5302791 - DNA, 13 bp, Homo sapiens
taagataattata

SEQ ID NO: 5302792 - DNA, 19 bp, Homo sapiens
taagataattgtactttga

SEQ ID NO: 5302793 - DNA, 22 bp, Homo sapiens
taagatacaaattaattttact

SEQ ID NO: 5302794 - DNA, 22 bp, Homo sapiens
taagatacaagtttcagacagg

SEQ ID NO: 5302795 - DNA, 14 bp, Homo sapiens
taagatacactgca

SEQ ID NO: 5302796 - DNA, 19 bp, Homo sapiens
taagatacactgcactttg

SEQ ID NO: 5302797 - DNA, 21 bp, Homo sapiens
taagatacactgcactttgtt

SEQ ID NO: 5302798 - DNA, 17 bp, Homo sapiens
taagatagaaagctgga

SEQ ID NO: 5302799 - DNA, 18 bp, Homo sapiens
taagatagaaagctggac

SEQ ID NO: 5302800 - DNA, 12 bp, Homo sapiens
taagatagaaca

SEQ ID NO: 5302801 - DNA, 15 bp, Homo sapiens
taagatatagaaact

SEQ ID NO: 5302802 - DNA, 14 bp, Homo sapiens
taagatatatacat

SEQ ID NO: 5302803 - DNA, 17 bp, Homo sapiens
taagatatctcaatgaa

SEQ ID NO: 5302804 - DNA, 14 bp, Homo sapiens
taagatattcttta

SEQ ID NO: 5302805 - DNA, 15 bp, Homo sapiens
taagatcactgttta

SEQ ID NO: 5302806 - DNA, 20 bp, Homo sapiens
taagatcactgtttagattt

SEQ ID NO: 5302807 - DNA, 15 bp, Homo sapiens
taagatccaccccct

SEQ ID NO: 5302808 - DNA, 21 bp, Homo sapiens
taagatcccagtgtgaagtat

SEQ ID NO: 5302809 - DNA, 15 bp, Homo sapiens
taagatcctaaactc

SEQ ID NO: 5302810 - DNA, 19 bp, Homo sapiens
taagatcctaaactctcta

SEQ ID NO: 5302811 - DNA, 16 bp, Homo sapiens
taagatcggttaacaa

SEQ ID NO: 5302812 - DNA, 17 bp, Homo sapiens
taagatcggttaacaaa

SEQ ID NO: 5302813 - DNA, 19 bp, Homo sapiens
taagatcggttaacaaata

SEQ ID NO: 5302814 - DNA, 17 bp, Homo sapiens
taagatctatgggaaga

SEQ ID NO: 5302815 - DNA, 16 bp, Homo sapiens
taagatctgactgcca

SEQ ID NO: 5302816 - DNA, 16 bp, Homo sapiens
taagatcttagattct

SEQ ID NO: 5302817 - DNA, 20 bp, Homo sapiens
taagatcttagattctctgt

SEQ ID NO: 5302818 - DNA, 19 bp, Homo sapiens
taagatgaaacatcatttc

SEQ ID NO: 5302819 - DNA, 21 bp, Homo sapiens
taagatgaaacatcatttcaa

SEQ ID NO: 5302820 - DNA, 13 bp, Homo sapiens
taagatgaaattg

SEQ ID NO: 5302821 - DNA, 18 bp, Homo sapiens
taagatgaaattgccaaa

SEQ ID NO: 5302822 - DNA, 15 bp, Homo sapiens
taagatgaatccaaa

SEQ ID NO: 5302823 - DNA, 23 bp, Homo sapiens
taagatgaatccaaatgtgaaag

SEQ ID NO: 5302824 - DNA, 15 bp, Homo sapiens
taagatgacattgct

SEQ ID NO: 5302825 - DNA, 17 bp, Homo sapiens
taagatgacattgctaa

SEQ ID NO: 5302826 - DNA, 17 bp, Homo sapiens
taagatgagatttgcca

SEQ ID NO: 5302827 - DNA, 21 bp, Homo sapiens
taagatgagatttgccagcac

SEQ ID NO: 5302828 - DNA, 15 bp, Homo sapiens
taagatgaggaaata

SEQ ID NO: 5302829 - DNA, 19 bp, Homo sapiens
taagatgatcatctaattt

SEQ ID NO: 5302830 - DNA, 17 bp, Homo sapiens
taagatgatgttaaatg

SEQ ID NO: 5302831 - DNA, 20 bp, Homo sapiens
taagatgccagcatatactg

SEQ ID NO: 5302832 - DNA, 14 bp, Homo sapiens
taagatgccttgaa

SEQ ID NO: 5302833 - DNA, 22 bp, Homo sapiens
taagatgccttgaattgtctag

SEQ ID NO: 5302834 - DNA, 17 bp, Homo sapiens
taagatgctaccttgtg

SEQ ID NO: 5302835 - DNA, 18 bp, Homo sapiens
taagatggagaataaatt

SEQ ID NO: 5302836 - DNA, 17 bp, Homo sapiens
taagatggattctcaga

SEQ ID NO: 5302837 - DNA, 22 bp, Homo sapiens
taagatggcttatttgtataat

SEQ ID NO: 5302838 - DNA, 18 bp, Homo sapiens
taagatgggcatagggtt

SEQ ID NO: 5302839 - DNA, 22 bp, Homo sapiens
taagatgggcatagggtttgga

SEQ ID NO: 5302840 - DNA, 12 bp, Homo sapiens
taagatgtctgt

SEQ ID NO: 5302841 - DNA, 13 bp, Homo sapiens
taagatgtgaaaa

SEQ ID NO: 5302842 - DNA, 14 bp, Homo sapiens
taagatgtgaaaat

SEQ ID NO: 5302843 - DNA, 16 bp, Homo sapiens
taagatgtgaaaatta

SEQ ID NO: 5302844 - DNA, 21 bp, Homo sapiens
taagatgtgatattctaagac

SEQ ID NO: 5302845 - DNA, 22 bp, Homo sapiens
taagatgttatatttttcttaa

SEQ ID NO: 5302846 - DNA, 20 bp, Homo sapiens
taagattaaattatatctga

SEQ ID NO: 5302847 - DNA, 23 bp, Homo sapiens
taagattaactggtagttcattg

SEQ ID NO: 5302848 - DNA, 17 bp, Homo sapiens
taagattaataagattt

SEQ ID NO: 5302849 - DNA, 22 bp, Homo sapiens
taagattaataagatttttcaa

SEQ ID NO: 5302850 - DNA, 23 bp, Homo sapiens
taagattaataagatttttcaaa

SEQ ID NO: 5302851 - DNA, 15 bp, Homo sapiens
taagattatagattc

SEQ ID NO: 5302852 - DNA, 21 bp, Homo sapiens
taagattatatacaaagctgt

SEQ ID NO: 5302853 - DNA, 16 bp, Homo sapiens
taagattatctgggga

SEQ ID NO: 5302854 - DNA, 13 bp, Homo sapiens
taagattcagttt

SEQ ID NO: 5302855 - DNA, 21 bp, Homo sapiens
taagattccagagagtggctc

SEQ ID NO: 5302856 - DNA, 16 bp, Homo sapiens
taagattccattttgg

SEQ ID NO: 5302857 - DNA, 14 bp, Homo sapiens
taagattctaaagg

SEQ ID NO: 5302858 - DNA, 17 bp, Homo sapiens
taagattctaaaggtcc

SEQ ID NO: 5302859 - DNA, 12 bp, Homo sapiens
taagattctaac

SEQ ID NO: 5302860 - DNA, 12 bp, Homo sapiens
taagattctaat

SEQ ID NO: 5302861 - DNA, 14 bp, Homo sapiens
taagattctagatc

SEQ ID NO: 5302862 - DNA, 20 bp, Homo sapiens
taagattctctgcccagccg

SEQ ID NO: 5302863 - DNA, 13 bp, Homo sapiens
taagattctgatt

SEQ ID NO: 5302864 - DNA, 14 bp, Homo sapiens
taagattcttggta

SEQ ID NO: 5302865 - DNA, 14 bp, Homo sapiens
taagattcttttaa

SEQ ID NO: 5302866 - DNA, 18 bp, Homo sapiens
taagattgaaattccagt

SEQ ID NO: 5302867 - DNA, 17 bp, Homo sapiens
taagattgaagctaaaa

SEQ ID NO: 5302868 - DNA, 19 bp, Homo sapiens
taagattgaagctaaaaca

SEQ ID NO: 5302869 - DNA, 19 bp, Homo sapiens
taagattgcgcctgagata

SEQ ID NO: 5302870 - DNA, 13 bp, Homo sapiens
taagattggaaat

SEQ ID NO: 5302871 - DNA, 16 bp, Homo sapiens
taagattgtaaaaata

SEQ ID NO: 5302872 - DNA, 18 bp, Homo sapiens
taagattgtaaaaataat

SEQ ID NO: 5302873 - DNA, 16 bp, Homo sapiens
taagattgtacatatg

SEQ ID NO: 5302874 - DNA, 19 bp, Homo sapiens
taagatttaattgtaattg

SEQ ID NO: 5302875 - DNA, 12 bp, Homo sapiens
taagatttaccc

SEQ ID NO: 5302876 - DNA, 16 bp, Homo sapiens
taagatttattttgtt

SEQ ID NO: 5302877 - DNA, 15 bp, Homo sapiens
taagatttccttctt

SEQ ID NO: 5302878 - DNA, 17 bp, Homo sapiens
taagatttctctaatat

SEQ ID NO: 5302879 - DNA, 17 bp, Homo sapiens
taagatttgtacatatt

SEQ ID NO: 5302880 - DNA, 23 bp, Homo sapiens
taagatttgtgtttttctttttc

SEQ ID NO: 5302881 - DNA, 22 bp, Homo sapiens
taagatttgtttttctcttttc

SEQ ID NO: 5302882 - DNA, 16 bp, Homo sapiens
taagattttacaaaag

SEQ ID NO: 5302883 - DNA, 22 bp, Homo sapiens
taagattttatccctttctctt

SEQ ID NO: 5302884 - DNA, 17 bp, Homo sapiens
taagattttgaaaacta

SEQ ID NO: 5302885 - DNA, 14 bp, Homo sapiens
taagatttttcaaa

SEQ ID NO: 5302886 - DNA, 15 bp, Homo sapiens
taagatttttcaaaa

SEQ ID NO: 5302887 - DNA, 16 bp, Homo sapiens
taagatttttcaaaat

SEQ ID NO: 5302888 - DNA, 17 bp, Homo sapiens
taagatttttcaaaatc

SEQ ID NO: 5302889 - DNA, 15 bp, Homo sapiens
taagatttttctcaa

SEQ ID NO: 5302890 - DNA, 19 bp, Homo sapiens
taaggcagacaggaaggaa

SEQ ID NO: 5302891 - DNA, 18 bp, Homo sapiens
taaggcagctctgtcgtg

SEQ ID NO: 5302892 - DNA, 14 bp, Homo sapiens
taaggcaggcattg

SEQ ID NO: 5302893 - DNA, 18 bp, Homo sapiens
taaggcaggtgggcagac

SEQ ID NO: 5302894 - DNA, 18 bp, Homo sapiens
taaggcatacttttaatc

SEQ ID NO: 5302895 - DNA, 16 bp, Homo sapiens
taaggcatatacaaat

SEQ ID NO: 5302896 - DNA, 13 bp, Homo sapiens
taaggcatgaagg

SEQ ID NO: 5302897 - DNA, 18 bp, Homo sapiens
taaggcatgcgaaatgtt

SEQ ID NO: 5302898 - DNA, 18 bp, Homo sapiens
taaggcatgctcccagca

SEQ ID NO: 5302899 - DNA, 18 bp, Homo sapiens
taaggcatgtgtgaaaca

SEQ ID NO: 5302900 - DNA, 12 bp, Homo sapiens
taaggcatgtta

SEQ ID NO: 5302901 - DNA, 17 bp, Homo sapiens
taaggcatgttgggata

SEQ ID NO: 5302902 - DNA, 19 bp, Homo sapiens
taaggccaaggcctcagga

SEQ ID NO: 5302903 - DNA, 14 bp, Homo sapiens
taaggccacactgg

SEQ ID NO: 5302904 - DNA, 16 bp, Homo sapiens
taaggccactgtttta

SEQ ID NO: 5302905 - DNA, 18 bp, Homo sapiens
taaggccagggcctctcc

SEQ ID NO: 5302906 - DNA, 15 bp, Homo sapiens
taaggccatttcctt

SEQ ID NO: 5302907 - DNA, 14 bp, Homo sapiens
taaggcccagctgc

SEQ ID NO: 5302908 - DNA, 15 bp, Homo sapiens
taaggcccagctgcc

SEQ ID NO: 5302909 - DNA, 22 bp, Homo sapiens
taaggccccctctcaggagcca

SEQ ID NO: 5302910 - DNA, 19 bp, Homo sapiens
taaggccgagcccacacca

SEQ ID NO: 5302911 - DNA, 16 bp, Homo sapiens
taaggccgtgtctctg

SEQ ID NO: 5302912 - DNA, 16 bp, Homo sapiens
taaggcctaggattct

SEQ ID NO: 5302913 - DNA, 19 bp, Homo sapiens
taaggcctaggattctaaa

SEQ ID NO: 5302914 - DNA, 21 bp, Homo sapiens
taaggcctaggattctaaaat

SEQ ID NO: 5302915 - DNA, 16 bp, Homo sapiens
taaggcctcttgctgg

SEQ ID NO: 5302916 - DNA, 17 bp, Homo sapiens
taaggcctcttgctggt

SEQ ID NO: 5302917 - DNA, 19 bp, Homo sapiens
taaggcctcttgctggtgc

SEQ ID NO: 5302918 - DNA, 14 bp, Homo sapiens
taaggcctgaatca

SEQ ID NO: 5302919 - DNA, 17 bp, Homo sapiens
taaggcgtggagctgcc

SEQ ID NO: 5302920 - DNA, 15 bp, Homo sapiens
taaggctctgagagt

SEQ ID NO: 5302921 - DNA, 19 bp, Homo sapiens
taaggctctgagagtctag

SEQ ID NO: 5302922 - DNA, 17 bp, Homo sapiens
taaggctctgtgccttg

SEQ ID NO: 5302923 - DNA, 22 bp, Homo sapiens
taaggctgagggctgccagcag

SEQ ID NO: 5302924 - DNA, 23 bp, Homo sapiens
taaggcttcaatttattgcacaa

SEQ ID NO: 5302925 - DNA, 12 bp, Homo sapiens
taagggaaaaat

SEQ ID NO: 5302926 - DNA, 15 bp, Homo sapiens
taagggaaaaatcaa

SEQ ID NO: 5302927 - DNA, 17 bp, Homo sapiens
taagggaaaagggaaca

SEQ ID NO: 5302928 - DNA, 23 bp, Homo sapiens
taagggaaataacagtatttcca

SEQ ID NO: 5302929 - DNA, 23 bp, Homo sapiens
taagggaacaagttgagctatga

SEQ ID NO: 5302930 - DNA, 16 bp, Homo sapiens
taagggaagatcactg

SEQ ID NO: 5302931 - DNA, 15 bp, Homo sapiens
taagggaagctgata

SEQ ID NO: 5302932 - DNA, 21 bp, Homo sapiens
taagggaaggaactctggctt

SEQ ID NO: 5302933 - DNA, 19 bp, Homo sapiens
taagggaagtagttatcat

SEQ ID NO: 5302934 - DNA, 13 bp, Homo sapiens
taagggaataaaa

SEQ ID NO: 5302935 - DNA, 19 bp, Homo sapiens
taagggaatttaatacttt

SEQ ID NO: 5302936 - DNA, 20 bp, Homo sapiens
taagggacatgttttgataa

SEQ ID NO: 5302937 - DNA, 17 bp, Homo sapiens
taagggacatttctata

SEQ ID NO: 5302938 - DNA, 21 bp, Homo sapiens
taagggaccttcagggagagc

SEQ ID NO: 5302939 - DNA, 23 bp, Homo sapiens
taagggactaggaaattccaaat

SEQ ID NO: 5302940 - DNA, 15 bp, Homo sapiens
taagggactgatgtt

SEQ ID NO: 5302941 - DNA, 12 bp, Homo sapiens
taagggactgtg

SEQ ID NO: 5302942 - DNA, 21 bp, Homo sapiens
taagggaggaggagcttctgg

SEQ ID NO: 5302943 - DNA, 22 bp, Homo sapiens
taagggaggcacttcctcccct

SEQ ID NO: 5302944 - DNA, 12 bp, Homo sapiens
taagggcagagt

SEQ ID NO: 5302945 - DNA, 13 bp, Homo sapiens
taagggcagccct

SEQ ID NO: 5302946 - DNA, 14 bp, Homo sapiens
taagggcagtgccc

SEQ ID NO: 5302947 - DNA, 15 bp, Homo sapiens
taagggcatgccttg

SEQ ID NO: 5302948 - DNA, 22 bp, Homo sapiens
taagggcatgttgggataaata

SEQ ID NO: 5302949 - DNA, 18 bp, Homo sapiens
taagggcatttaatcagg

SEQ ID NO: 5302950 - DNA, 13 bp, Homo sapiens
taagggcatttta

SEQ ID NO: 5302951 - DNA, 22 bp, Homo sapiens
taagggcgtggctctgggtggg

SEQ ID NO: 5302952 - DNA, 23 bp, Homo sapiens
taagggcgtggctctgggtgggc

SEQ ID NO: 5302953 - DNA, 17 bp, Homo sapiens
taaggggaggctgcttt

SEQ ID NO: 5302954 - DNA, 23 bp, Homo sapiens
taaggggcaaaaaaaaaaattac

SEQ ID NO: 5302955 - DNA, 18 bp, Homo sapiens
taaggggcagctcctgac

SEQ ID NO: 5302956 - DNA, 13 bp, Homo sapiens
taaggggcagctt

SEQ ID NO: 5302957 - DNA, 19 bp, Homo sapiens
taaggggccttgctctgag

SEQ ID NO: 5302958 - DNA, 17 bp, Homo sapiens
taagggggccttggaat

SEQ ID NO: 5302959 - DNA, 21 bp, Homo sapiens
taagggggtgaccatgcaatt

SEQ ID NO: 5302960 - DNA, 13 bp, Homo sapiens
taaggggtggggc

SEQ ID NO: 5302961 - DNA, 23 bp, Homo sapiens
taaggggtgggtcagaacatgtt

SEQ ID NO: 5302962 - DNA, 13 bp, Homo sapiens
taagggtaaaaaa

SEQ ID NO: 5302963 - DNA, 14 bp, Homo sapiens
taagggtagaagag

SEQ ID NO: 5302964 - DNA, 18 bp, Homo sapiens
taagggtaggatgttgct

SEQ ID NO: 5302965 - DNA, 16 bp, Homo sapiens
taagggtgacaaatgg

SEQ ID NO: 5302966 - DNA, 13 bp, Homo sapiens
taagggtgggtgc

SEQ ID NO: 5302967 - DNA, 18 bp, Homo sapiens
taagggtgggtgctcaga

SEQ ID NO: 5302968 - DNA, 20 bp, Homo sapiens
taagggttagtttacaatca

SEQ ID NO: 5302969 - DNA, 23 bp, Homo sapiens
taaggtaacatttatagaagaaa

SEQ ID NO: 5302970 - DNA, 23 bp, Homo sapiens
taaggtaatttctgtgtattttg

SEQ ID NO: 5302971 - DNA, 20 bp, Homo sapiens
taaggtacatcattattgta

SEQ ID NO: 5302972 - DNA, 21 bp, Homo sapiens
taaggtacatcattattgtag

SEQ ID NO: 5302973 - DNA, 22 bp, Homo sapiens
taaggtacatcattattgtagt

SEQ ID NO: 5302974 - DNA, 20 bp, Homo sapiens
taaggtaccaagatcacaaa

SEQ ID NO: 5302975 - DNA, 21 bp, Homo sapiens
taaggtacctttcacatagag

SEQ ID NO: 5302976 - DNA, 19 bp, Homo sapiens
taaggtactgtggggtgga

SEQ ID NO: 5302977 - DNA, 21 bp, Homo sapiens
taaggtatatcattctaaaga

SEQ ID NO: 5302978 - DNA, 16 bp, Homo sapiens
taaggtatatgtttta

SEQ ID NO: 5302979 - DNA, 21 bp, Homo sapiens
taaggtatctggtatctgcat

SEQ ID NO: 5302980 - DNA, 18 bp, Homo sapiens
taaggtatttcgaaactg

SEQ ID NO: 5302981 - DNA, 19 bp, Homo sapiens
taaggtcagtgttataaaa

SEQ ID NO: 5302982 - DNA, 20 bp, Homo sapiens
taaggtccaacaagaatgca

SEQ ID NO: 5302983 - DNA, 18 bp, Homo sapiens
taaggtccccagcagaat

SEQ ID NO: 5302984 - DNA, 17 bp, Homo sapiens
taaggtccctgctcggc

SEQ ID NO: 5302985 - DNA, 17 bp, Homo sapiens
taaggtccggtgttcta

SEQ ID NO: 5302986 - DNA, 18 bp, Homo sapiens
taaggtccggtgttctaa

SEQ ID NO: 5302987 - DNA, 21 bp, Homo sapiens
taaggtccggtgttctaagat

SEQ ID NO: 5302988 - DNA, 21 bp, Homo sapiens
taaggtctaactgtggaatat

SEQ ID NO: 5302989 - DNA, 18 bp, Homo sapiens
taaggtctgtttgctgtt

SEQ ID NO: 5302990 - DNA, 18 bp, Homo sapiens
taaggtctttcagtactt

SEQ ID NO: 5302991 - DNA, 21 bp, Homo sapiens
taaggtctttcagtacttttt

SEQ ID NO: 5302992 - DNA, 12 bp, Homo sapiens
taaggtctttgt

SEQ ID NO: 5302993 - DNA, 15 bp, Homo sapiens
taaggtctttgtaaa

SEQ ID NO: 5302994 - DNA, 17 bp, Homo sapiens
taaggtctttgtaaaat

SEQ ID NO: 5302995 - DNA, 13 bp, Homo sapiens
taaggtgaagtga

SEQ ID NO: 5302996 - DNA, 16 bp, Homo sapiens
taaggtgactttctga

SEQ ID NO: 5302997 - DNA, 22 bp, Homo sapiens
taaggtgaggcctgtctgtgac

SEQ ID NO: 5302998 - DNA, 23 bp, Homo sapiens
taaggtgcctcagttttccttct

SEQ ID NO: 5302999 - DNA, 13 bp, Homo sapiens
taaggtgccttct

SEQ ID NO: 5303000 - DNA, 23 bp, Homo sapiens
taaggtgggagaattgcttgagc

SEQ ID NO: 5303001 - DNA, 22 bp, Homo sapiens
taaggtgtacgtatcatttcta

SEQ ID NO: 5303002 - DNA, 21 bp, Homo sapiens
taaggtgtagccacaccagga

SEQ ID NO: 5303003 - DNA, 19 bp, Homo sapiens
taaggtgtgcagtgttttt

SEQ ID NO: 5303004 - DNA, 12 bp, Homo sapiens
taaggtgtttga

SEQ ID NO: 5303005 - DNA, 16 bp, Homo sapiens
taaggtgtttgaaaat

SEQ ID NO: 5303006 - DNA, 18 bp, Homo sapiens
taaggtgtttgaaaatag

SEQ ID NO: 5303007 - DNA, 14 bp, Homo sapiens
taaggttaattatg

SEQ ID NO: 5303008 - DNA, 21 bp, Homo sapiens
taaggttagaaacattttgat

SEQ ID NO: 5303009 - DNA, 14 bp, Homo sapiens
taaggttatatgag

SEQ ID NO: 5303010 - DNA, 21 bp, Homo sapiens
taaggttatttatttaaatgt

SEQ ID NO: 5303011 - DNA, 14 bp, Homo sapiens
taaggttcagactt

SEQ ID NO: 5303012 - DNA, 15 bp, Homo sapiens
taaggttctaaggcc

SEQ ID NO: 5303013 - DNA, 16 bp, Homo sapiens
taaggttctcatagga

SEQ ID NO: 5303014 - DNA, 21 bp, Homo sapiens
taaggttgcacacagtacaca

SEQ ID NO: 5303015 - DNA, 17 bp, Homo sapiens
taaggtttcaacaaatt

SEQ ID NO: 5303016 - DNA, 20 bp, Homo sapiens
taaggtttcctgctccagtg

SEQ ID NO: 5303017 - DNA, 22 bp, Homo sapiens
taaggtttgttttccatccatt

SEQ ID NO: 5303018 - DNA, 23 bp, Homo sapiens
taaggtttgttttccatccattc

SEQ ID NO: 5303019 - DNA, 23 bp, Homo sapiens
taaggttttcttttttccccttt

SEQ ID NO: 5303020 - DNA, 16 bp, Homo sapiens
taaggttttttttgta

SEQ ID NO: 5303021 - DNA, 16 bp, Homo sapiens
taagtaaaaatattaa

SEQ ID NO: 5303022 - DNA, 13 bp, Homo sapiens
taagtaaaagtct

SEQ ID NO: 5303023 - DNA, 12 bp, Homo sapiens
taagtaaagtga

SEQ ID NO: 5303024 - DNA, 14 bp, Homo sapiens
taagtaaagtggtt

SEQ ID NO: 5303025 - DNA, 17 bp, Homo sapiens
taagtaaatacattatt

SEQ ID NO: 5303026 - DNA, 22 bp, Homo sapiens
taagtaaatctcttctgtgttt

SEQ ID NO: 5303027 - DNA, 19 bp, Homo sapiens
taagtaaatgtcttcatgt

SEQ ID NO: 5303028 - DNA, 20 bp, Homo sapiens
taagtaaatgtcttcatgtt

SEQ ID NO: 5303029 - DNA, 18 bp, Homo sapiens
taagtaaattgcctgatt

SEQ ID NO: 5303030 - DNA, 21 bp, Homo sapiens
taagtaacgtgctcactgtgt

SEQ ID NO: 5303031 - DNA, 23 bp, Homo sapiens
taagtaacgtgctcactgtgtat

SEQ ID NO: 5303032 - DNA, 20 bp, Homo sapiens
taagtaacttttaaaatttg

SEQ ID NO: 5303033 - DNA, 14 bp, Homo sapiens
taagtaagaaaata

SEQ ID NO: 5303034 - DNA, 22 bp, Homo sapiens
taagtaaggtgcaatgaagaag

SEQ ID NO: 5303035 - DNA, 17 bp, Homo sapiens
taagtaagtttcttcct

SEQ ID NO: 5303036 - DNA, 13 bp, Homo sapiens
taagtaataattt

SEQ ID NO: 5303037 - DNA, 16 bp, Homo sapiens
taagtaatatttaaag

SEQ ID NO: 5303038 - DNA, 14 bp, Homo sapiens
taagtaatcaataa

SEQ ID NO: 5303039 - DNA, 12 bp, Homo sapiens
taagtaatctca

SEQ ID NO: 5303040 - DNA, 22 bp, Homo sapiens
taagtaatctcacagcatttgc

SEQ ID NO: 5303041 - DNA, 20 bp, Homo sapiens
taagtaatgataactggaaa

SEQ ID NO: 5303042 - DNA, 15 bp, Homo sapiens
taagtaatgtggaag

SEQ ID NO: 5303043 - DNA, 22 bp, Homo sapiens
taagtaatgtggaagaaaatgg

SEQ ID NO: 5303044 - DNA, 18 bp, Homo sapiens
taagtaattgcatttctg

SEQ ID NO: 5303045 - DNA, 16 bp, Homo sapiens
taagtaattgcctaca

SEQ ID NO: 5303046 - DNA, 23 bp, Homo sapiens
taagtaattgcctacaataaaaa

SEQ ID NO: 5303047 - DNA, 15 bp, Homo sapiens
taagtaatttagaag

SEQ ID NO: 5303048 - DNA, 12 bp, Homo sapiens
taagtacaaaaa

SEQ ID NO: 5303049 - DNA, 13 bp, Homo sapiens
taagtacaaggtg

SEQ ID NO: 5303050 - DNA, 13 bp, Homo sapiens
taagtacagagaa

SEQ ID NO: 5303051 - DNA, 14 bp, Homo sapiens
taagtacagagaag

SEQ ID NO: 5303052 - DNA, 21 bp, Homo sapiens
taagtacagagaagccatcac

SEQ ID NO: 5303053 - DNA, 18 bp, Homo sapiens
taagtaccactcaggcca

SEQ ID NO: 5303054 - DNA, 16 bp, Homo sapiens
taagtaccctgatgcc

SEQ ID NO: 5303055 - DNA, 19 bp, Homo sapiens
taagtaccctgatgccttt

SEQ ID NO: 5303056 - DNA, 17 bp, Homo sapiens
taagtacctcagcattt

SEQ ID NO: 5303057 - DNA, 16 bp, Homo sapiens
taagtacctttcctac

SEQ ID NO: 5303058 - DNA, 21 bp, Homo sapiens
taagtactagatgcatcactg

SEQ ID NO: 5303059 - DNA, 18 bp, Homo sapiens
taagtactatctttgtct

SEQ ID NO: 5303060 - DNA, 19 bp, Homo sapiens
taagtactatctttgtcta

SEQ ID NO: 5303061 - DNA, 17 bp, Homo sapiens
taagtactgtaataata

SEQ ID NO: 5303062 - DNA, 23 bp, Homo sapiens
taagtactgtaataatacctcaa

SEQ ID NO: 5303063 - DNA, 15 bp, Homo sapiens
taagtagatctgctt

SEQ ID NO: 5303064 - DNA, 16 bp, Homo sapiens
taagtagatctgcttt

SEQ ID NO: 5303065 - DNA, 22 bp, Homo sapiens
taagtagatctgctttctgttc

SEQ ID NO: 5303066 - DNA, 17 bp, Homo sapiens
taagtagatgaaacatt

SEQ ID NO: 5303067 - DNA, 21 bp, Homo sapiens
taagtagcaaccctgtgatac

SEQ ID NO: 5303068 - DNA, 15 bp, Homo sapiens
taagtagtaaatcag

SEQ ID NO: 5303069 - DNA, 16 bp, Homo sapiens
taagtagtaaatcaga

SEQ ID NO: 5303070 - DNA, 21 bp, Homo sapiens
taagtataaacaaaagttttt

SEQ ID NO: 5303071 - DNA, 14 bp, Homo sapiens
taagtataacaaac

SEQ ID NO: 5303072 - DNA, 18 bp, Homo sapiens
taagtataacaaactatg

SEQ ID NO: 5303073 - DNA, 19 bp, Homo sapiens
taagtataagaaattttat

SEQ ID NO: 5303074 - DNA, 17 bp, Homo sapiens
taagtataattaataga

SEQ ID NO: 5303075 - DNA, 13 bp, Homo sapiens
taagtatacagtt

SEQ ID NO: 5303076 - DNA, 24 bp, Homo sapiens
taagtatagccactgatggtgaca

SEQ ID NO: 5303077 - DNA, 19 bp, Homo sapiens
taagtatcaagtatagaaa

SEQ ID NO: 5303078 - DNA, 21 bp, Homo sapiens
taagtatctcaacaacatgtc

SEQ ID NO: 5303079 - DNA, 23 bp, Homo sapiens
taagtatctcaacaacatgtcaa

SEQ ID NO: 5303080 - DNA, 15 bp, Homo sapiens
taagtatctgacatc

SEQ ID NO: 5303081 - DNA, 21 bp, Homo sapiens
taagtatctgggattattctt

SEQ ID NO: 5303082 - DNA, 13 bp, Homo sapiens
taagtatgagtta

SEQ ID NO: 5303083 - DNA, 16 bp, Homo sapiens
taagtatgagttatca

SEQ ID NO: 5303084 - DNA, 21 bp, Homo sapiens
taagtatgagttatcagctct

SEQ ID NO: 5303085 - DNA, 17 bp, Homo sapiens
taagtatgtcaacagcc

SEQ ID NO: 5303086 - DNA, 20 bp, Homo sapiens
taagtatgtgtaaaatgtga

SEQ ID NO: 5303087 - DNA, 19 bp, Homo sapiens
taagtatgttttttatgtt

SEQ ID NO: 5303088 - DNA, 14 bp, Homo sapiens
taagtattaaaaca

SEQ ID NO: 5303089 - DNA, 18 bp, Homo sapiens
taagtattaaaacattgg

SEQ ID NO: 5303090 - DNA, 19 bp, Homo sapiens
taagtattaaaacattgga

SEQ ID NO: 5303091 - DNA, 16 bp, Homo sapiens
taagtattcaagaaag

SEQ ID NO: 5303092 - DNA, 22 bp, Homo sapiens
taagtattccttggcccagcag

SEQ ID NO: 5303093 - DNA, 19 bp, Homo sapiens
taagtattcttatttaatg

SEQ ID NO: 5303094 - DNA, 20 bp, Homo sapiens
taagtattcttatttaatga

SEQ ID NO: 5303095 - DNA, 20 bp, Homo sapiens
taagtattgcatctgtataa

SEQ ID NO: 5303096 - DNA, 10 bp, Homo sapiens
taagtattta

SEQ ID NO: 5303097 - DNA, 18 bp, Homo sapiens
taagtatttaaatgttct

SEQ ID NO: 5303098 - DNA, 20 bp, Homo sapiens
taagtatttaggtttttgtt

SEQ ID NO: 5303099 - DNA, 14 bp, Homo sapiens
taagtatttataat

SEQ ID NO: 5303100 - DNA, 13 bp, Homo sapiens
taagtatttatat

SEQ ID NO: 5303101 - DNA, 19 bp, Homo sapiens
taagtatttatatatttat

SEQ ID NO: 5303102 - DNA, 19 bp, Homo sapiens
taagtatttcagatgcttt

SEQ ID NO: 5303103 - DNA, 21 bp, Homo sapiens
taagtatttcagatgctttag

SEQ ID NO: 5303104 - DNA, 14 bp, Homo sapiens
taagtatttcccag

SEQ ID NO: 5303105 - DNA, 14 bp, Homo sapiens
taagtatttctgat

SEQ ID NO: 5303106 - DNA, 17 bp, Homo sapiens
taagtatttgaaactga

SEQ ID NO: 5303107 - DNA, 15 bp, Homo sapiens
taagtcaaaaggaac

SEQ ID NO: 5303108 - DNA, 22 bp, Homo sapiens
taagtcaaaataatctgaaatg

SEQ ID NO: 5303109 - DNA, 16 bp, Homo sapiens
taagtcaacagtaaac

SEQ ID NO: 5303110 - DNA, 17 bp, Homo sapiens
taagtcaacagtaaacc

SEQ ID NO: 5303111 - DNA, 17 bp, Homo sapiens
taagtcaacctgcctga

SEQ ID NO: 5303112 - DNA, 18 bp, Homo sapiens
taagtcaagcacatgtaa

SEQ ID NO: 5303113 - DNA, 14 bp, Homo sapiens
taagtcacatatca

SEQ ID NO: 5303114 - DNA, 22 bp, Homo sapiens
taagtcaccctagccctctccc

SEQ ID NO: 5303115 - DNA, 13 bp, Homo sapiens
taagtcagaacag

SEQ ID NO: 5303116 - DNA, 14 bp, Homo sapiens
taagtcagaacagc

SEQ ID NO: 5303117 - DNA, 18 bp, Homo sapiens
taagtcaggacagcttgt

SEQ ID NO: 5303118 - DNA, 18 bp, Homo sapiens
taagtcaggagtgtagtt

SEQ ID NO: 5303119 - DNA, 12 bp, Homo sapiens
taagtcagtgtt

SEQ ID NO: 5303120 - DNA, 13 bp, Homo sapiens
taagtcagtgttg

SEQ ID NO: 5303121 - DNA, 16 bp, Homo sapiens
taagtcagtgttgaga

SEQ ID NO: 5303122 - DNA, 15 bp, Homo sapiens
taagtcataatgaat

SEQ ID NO: 5303123 - DNA, 18 bp, Homo sapiens
taagtcatcatctccaaa

SEQ ID NO: 5303124 - DNA, 13 bp, Homo sapiens
taagtcatcatta

SEQ ID NO: 5303125 - DNA, 20 bp, Homo sapiens
taagtcatctacttaataaa

SEQ ID NO: 5303126 - DNA, 20 bp, Homo sapiens
taagtcatctgatgagaaca

SEQ ID NO: 5303127 - DNA, 20 bp, Homo sapiens
taagtcattttcatgtgtgt

SEQ ID NO: 5303128 - DNA, 15 bp, Homo sapiens
taagtcattttgtaa

SEQ ID NO: 5303129 - DNA, 12 bp, Homo sapiens
taagtcattttt

SEQ ID NO: 5303130 - DNA, 16 bp, Homo sapiens
taagtcattttttact

SEQ ID NO: 5303131 - DNA, 13 bp, Homo sapiens
taagtccaaatct

SEQ ID NO: 5303132 - DNA, 18 bp, Homo sapiens
taagtccaaatctccaag

SEQ ID NO: 5303133 - DNA, 14 bp, Homo sapiens
taagtccacttaaa

SEQ ID NO: 5303134 - DNA, 18 bp, Homo sapiens
taagtccatctgtcactt

SEQ ID NO: 5303135 - DNA, 15 bp, Homo sapiens
taagtccattaactg

SEQ ID NO: 5303136 - DNA, 19 bp, Homo sapiens
taagtccctataataaagg

SEQ ID NO: 5303137 - DNA, 19 bp, Homo sapiens
taagtccctgtcacctctt

SEQ ID NO: 5303138 - DNA, 23 bp, Homo sapiens
taagtcctcagagctccatgctg

SEQ ID NO: 5303139 - DNA, 17 bp, Homo sapiens
taagtcctctcttctct

SEQ ID NO: 5303140 - DNA, 18 bp, Homo sapiens
taagtccttccacctgcc

SEQ ID NO: 5303141 - DNA, 17 bp, Homo sapiens
taagtcctttatgtgga

SEQ ID NO: 5303142 - DNA, 15 bp, Homo sapiens
taagtcgctgaacaa

SEQ ID NO: 5303143 - DNA, 18 bp, Homo sapiens
taagtcgttgagggaatg

SEQ ID NO: 5303144 - DNA, 23 bp, Homo sapiens
taagtctcagtacacttcctgtg

SEQ ID NO: 5303145 - DNA, 14 bp, Homo sapiens
taagtctcctgtct

SEQ ID NO: 5303146 - DNA, 16 bp, Homo sapiens
taagtctcctgtctta

SEQ ID NO: 5303147 - DNA, 21 bp, Homo sapiens
taagtctcctgtcttatggtc

SEQ ID NO: 5303148 - DNA, 22 bp, Homo sapiens
taagtctcctttactgaatgta

SEQ ID NO: 5303149 - DNA, 16 bp, Homo sapiens
taagtctcgaatgtaa

SEQ ID NO: 5303150 - DNA, 11 bp, Homo sapiens
taagtctctga

SEQ ID NO: 5303151 - DNA, 11 bp, Homo sapiens
taagtctctgt

SEQ ID NO: 5303152 - DNA, 19 bp, Homo sapiens
taagtctcttacaaaagct

SEQ ID NO: 5303153 - DNA, 18 bp, Homo sapiens
taagtctcttttttacaa

SEQ ID NO: 5303154 - DNA, 13 bp, Homo sapiens
taagtctgttatt

SEQ ID NO: 5303155 - DNA, 19 bp, Homo sapiens
taagtctgttttatgactt

SEQ ID NO: 5303156 - DNA, 20 bp, Homo sapiens
taagtcttatcaagcagcca

SEQ ID NO: 5303157 - DNA, 20 bp, Homo sapiens
taagtcttccttaaatgact

SEQ ID NO: 5303158 - DNA, 21 bp, Homo sapiens
taagtcttccttaaatgactt

SEQ ID NO: 5303159 - DNA, 23 bp, Homo sapiens
taagtcttccttagctaaatgca

SEQ ID NO: 5303160 - DNA, 17 bp, Homo sapiens
taagtcttgcctatatt

SEQ ID NO: 5303161 - DNA, 14 bp, Homo sapiens
taagtctttcatgg

SEQ ID NO: 5303162 - DNA, 12 bp, Homo sapiens
taagtctttccc

SEQ ID NO: 5303163 - DNA, 15 bp, Homo sapiens
taagtgaaaaacatg

SEQ ID NO: 5303164 - DNA, 20 bp, Homo sapiens
taagtgaaaataatttgttg

SEQ ID NO: 5303165 - DNA, 16 bp, Homo sapiens
taagtgaaattttaaa

SEQ ID NO: 5303166 - DNA, 18 bp, Homo sapiens
taagtgaaattttaaaag

SEQ ID NO: 5303167 - DNA, 18 bp, Homo sapiens
taagtgaacaactggaaa

SEQ ID NO: 5303168 - DNA, 18 bp, Homo sapiens
taagtgaacacccatgaa

SEQ ID NO: 5303169 - DNA, 14 bp, Homo sapiens
taagtgaaggagaa

SEQ ID NO: 5303170 - DNA, 14 bp, Homo sapiens
taagtgaagggaaa

SEQ ID NO: 5303171 - DNA, 23 bp, Homo sapiens
taagtgacaaaagcagcacaagg

SEQ ID NO: 5303172 - DNA, 20 bp, Homo sapiens
taagtgacaaagccagagga

SEQ ID NO: 5303173 - DNA, 23 bp, Homo sapiens
taagtgacaaataagattaataa

SEQ ID NO: 5303174 - DNA, 20 bp, Homo sapiens
taagtgacaccaataaatgt

SEQ ID NO: 5303175 - DNA, 21 bp, Homo sapiens
taagtgacaccaataaatgtt

SEQ ID NO: 5303176 - DNA, 17 bp, Homo sapiens
taagtgacagtcactta

SEQ ID NO: 5303177 - DNA, 12 bp, Homo sapiens
taagtgagagag

SEQ ID NO: 5303178 - DNA, 16 bp, Homo sapiens
taagtgagcagaacag

SEQ ID NO: 5303179 - DNA, 15 bp, Homo sapiens
taagtgagtgtgctg

SEQ ID NO: 5303180 - DNA, 22 bp, Homo sapiens
taagtgataaatctagaaaatt

SEQ ID NO: 5303181 - DNA, 13 bp, Homo sapiens
taagtgcaacatt

SEQ ID NO: 5303182 - DNA, 21 bp, Homo sapiens
taagtgcaacatttctgtata

SEQ ID NO: 5303183 - DNA, 19 bp, Homo sapiens
taagtgcacacagaaatat

SEQ ID NO: 5303184 - DNA, 22 bp, Homo sapiens
taagtgcacacagaaatatata

SEQ ID NO: 5303185 - DNA, 17 bp, Homo sapiens
taagtgcacttttttat

SEQ ID NO: 5303186 - DNA, 23 bp, Homo sapiens
taagtgcacttttttatgaagaa

SEQ ID NO: 5303187 - DNA, 23 bp, Homo sapiens
taagtgcagggaggaaaagtgca

SEQ ID NO: 5303188 - DNA, 21 bp, Homo sapiens
taagtgcatgcattgagctgc

SEQ ID NO: 5303189 - DNA, 20 bp, Homo sapiens
taagtgccattactactgta

SEQ ID NO: 5303190 - DNA, 21 bp, Homo sapiens
taagtgccattactactgtac

SEQ ID NO: 5303191 - DNA, 15 bp, Homo sapiens
taagtgcccaaagtg

SEQ ID NO: 5303192 - DNA, 18 bp, Homo sapiens
taagtgcccacatttgat

SEQ ID NO: 5303193 - DNA, 15 bp, Homo sapiens
taagtgccctctccc

SEQ ID NO: 5303194 - DNA, 16 bp, Homo sapiens
taagtgccttccatgt

SEQ ID NO: 5303195 - DNA, 19 bp, Homo sapiens
taagtgcgtgtgtagagtt

SEQ ID NO: 5303196 - DNA, 21 bp, Homo sapiens
taagtgcgtgtgtagagttaa

SEQ ID NO: 5303197 - DNA, 23 bp, Homo sapiens
taagtgcgtgtgtagagttaaga

SEQ ID NO: 5303198 - DNA, 18 bp, Homo sapiens
taagtgctatgcatattt

SEQ ID NO: 5303199 - DNA, 15 bp, Homo sapiens
taagtgctcagtatt

SEQ ID NO: 5303200 - DNA, 15 bp, Homo sapiens
taagtgctgcattta

SEQ ID NO: 5303201 - DNA, 16 bp, Homo sapiens
taagtgctgcatttaa

SEQ ID NO: 5303202 - DNA, 22 bp, Homo sapiens
taagtgctgcatttaaaagata

SEQ ID NO: 5303203 - DNA, 14 bp, Homo sapiens
taagtgctgtataa

SEQ ID NO: 5303204 - DNA, 15 bp, Homo sapiens
taagtgctgtttgag

SEQ ID NO: 5303205 - DNA, 23 bp, Homo sapiens
taagtgcttgaggccaaatgagt

SEQ ID NO: 5303206 - DNA, 22 bp, Homo sapiens
taagtgctttacctaagtgttg

SEQ ID NO: 5303207 - DNA, 13 bp, Homo sapiens
taagtgctttgta

SEQ ID NO: 5303208 - DNA, 20 bp, Homo sapiens
taagtggaattagagggcct

SEQ ID NO: 5303209 - DNA, 19 bp, Homo sapiens
taagtggactctctgacaa

SEQ ID NO: 5303210 - DNA, 14 bp, Homo sapiens
taagtggactgtat

SEQ ID NO: 5303211 - DNA, 11 bp, Homo sapiens
taagtggagca

SEQ ID NO: 5303212 - DNA, 21 bp, Homo sapiens
taagtggaggaaatgttggaa

SEQ ID NO: 5303213 - DNA, 17 bp, Homo sapiens
taagtggaggcacttta

SEQ ID NO: 5303214 - DNA, 13 bp, Homo sapiens
taagtggctgcct

SEQ ID NO: 5303215 - DNA, 16 bp, Homo sapiens
taagtggctgccttct

SEQ ID NO: 5303216 - DNA, 19 bp, Homo sapiens
taagtgggaagtgaagccc

SEQ ID NO: 5303217 - DNA, 13 bp, Homo sapiens
taagtgggctcct

SEQ ID NO: 5303218 - DNA, 14 bp, Homo sapiens
taagtgggctcctg

SEQ ID NO: 5303219 - DNA, 15 bp, Homo sapiens
taagtgggctcctga

SEQ ID NO: 5303220 - DNA, 19 bp, Homo sapiens
taagtggggcaaaaccttg

SEQ ID NO: 5303221 - DNA, 21 bp, Homo sapiens
taagtggggtagactgaggga

SEQ ID NO: 5303222 - DNA, 20 bp, Homo sapiens
taagtggggttgcaaccact

SEQ ID NO: 5303223 - DNA, 20 bp, Homo sapiens
taagtggtactaactttcct

SEQ ID NO: 5303224 - DNA, 16 bp, Homo sapiens
taagtggtagtaattt

SEQ ID NO: 5303225 - DNA, 15 bp, Homo sapiens
taagtggtgtgtgta

SEQ ID NO: 5303226 - DNA, 17 bp, Homo sapiens
taagtggtttgatcatt

SEQ ID NO: 5303227 - DNA, 21 bp, Homo sapiens
taagtggtttttatattttca

SEQ ID NO: 5303228 - DNA, 22 bp, Homo sapiens
taagtggtttttatattttcac

SEQ ID NO: 5303229 - DNA, 15 bp, Homo sapiens
taagtgtaaaaaatg

SEQ ID NO: 5303230 - DNA, 16 bp, Homo sapiens
taagtgtaaaagtagt

SEQ ID NO: 5303231 - DNA, 13 bp, Homo sapiens
taagtgtaaatag

SEQ ID NO: 5303232 - DNA, 15 bp, Homo sapiens
taagtgtaagtaaat

SEQ ID NO: 5303233 - DNA, 13 bp, Homo sapiens
taagtgtacaatt

SEQ ID NO: 5303234 - DNA, 21 bp, Homo sapiens
taagtgtacaattgatctttt

SEQ ID NO: 5303235 - DNA, 16 bp, Homo sapiens
taagtgtacatatgta

SEQ ID NO: 5303236 - DNA, 20 bp, Homo sapiens
taagtgtacatatgtaaaat

SEQ ID NO: 5303237 - DNA, 14 bp, Homo sapiens
taagtgtattttga

SEQ ID NO: 5303238 - DNA, 20 bp, Homo sapiens
taagtgtatttttcaataaa

SEQ ID NO: 5303239 - DNA, 23 bp, Homo sapiens
taagtgtatttttcaataaagca

SEQ ID NO: 5303240 - DNA, 15 bp, Homo sapiens
taagtgtcatttctt

SEQ ID NO: 5303241 - DNA, 18 bp, Homo sapiens
taagtgtgcttagtttta

SEQ ID NO: 5303242 - DNA, 12 bp, Homo sapiens
taagtgtggatg

SEQ ID NO: 5303243 - DNA, 20 bp, Homo sapiens
taataccaccaacaaatata

SEQ ID NO: 5303244 - DNA, 23 bp, Homo sapiens
taataccactgagaccttcaggc

SEQ ID NO: 5303245 - DNA, 23 bp, Homo sapiens
taataccatacccagatgtttta

SEQ ID NO: 5303246 - DNA, 15 bp, Homo sapiens
taatacccagagcac

SEQ ID NO: 5303247 - DNA, 20 bp, Homo sapiens
taataccctgtacatatctt

SEQ ID NO: 5303248 - DNA, 11 bp, Homo sapiens
taatacctcaa

SEQ ID NO: 5303249 - DNA, 13 bp, Homo sapiens
taatacctccctt

SEQ ID NO: 5303250 - DNA, 18 bp, Homo sapiens
taatacctctgtgtgctc

SEQ ID NO: 5303251 - DNA, 21 bp, Homo sapiens
taatacctgacctcacagagt

SEQ ID NO: 5303252 - DNA, 17 bp, Homo sapiens
taataccttagaaggta

SEQ ID NO: 5303253 - DNA, 13 bp, Homo sapiens
taatacctttcta

SEQ ID NO: 5303254 - DNA, 18 bp, Homo sapiens
taatacctttggaaaaat

SEQ ID NO: 5303255 - DNA, 13 bp, Homo sapiens
taatactaaaact

SEQ ID NO: 5303256 - DNA, 16 bp, Homo sapiens
taatactaaaactcag

SEQ ID NO: 5303257 - DNA, 17 bp, Homo sapiens
taatactaaaatatgtc

SEQ ID NO: 5303258 - DNA, 14 bp, Homo sapiens
taatactaatttat

SEQ ID NO: 5303259 - DNA, 15 bp, Homo sapiens
taatactaccttgaa

SEQ ID NO: 5303260 - DNA, 15 bp, Homo sapiens
taatactagttgtga

SEQ ID NO: 5303261 - DNA, 22 bp, Homo sapiens
taatactagttgtgaccttagt

SEQ ID NO: 5303262 - DNA, 16 bp, Homo sapiens
taatactcaaatgagt

SEQ ID NO: 5303263 - DNA, 18 bp, Homo sapiens
taatactcaaatgagtaa

SEQ ID NO: 5303264 - DNA, 20 bp, Homo sapiens
taatactcaaatgagtaaca

SEQ ID NO: 5303265 - DNA, 15 bp, Homo sapiens
taatactcacctcct

SEQ ID NO: 5303266 - DNA, 16 bp, Homo sapiens
taatactccagagaca

SEQ ID NO: 5303267 - DNA, 15 bp, Homo sapiens
taatactctgttgta

SEQ ID NO: 5303268 - DNA, 19 bp, Homo sapiens
taatactgaaccacttgta

SEQ ID NO: 5303269 - DNA, 20 bp, Homo sapiens
taatactgaaccacttgtag

SEQ ID NO: 5303270 - DNA, 21 bp, Homo sapiens
taatactgaaccacttgtaga

SEQ ID NO: 5303271 - DNA, 17 bp, Homo sapiens
taatactgacctacctc

SEQ ID NO: 5303272 - DNA, 19 bp, Homo sapiens
taatactgctgagatacat

SEQ ID NO: 5303273 - DNA, 12 bp, Homo sapiens
taatactggaat

SEQ ID NO: 5303274 - DNA, 17 bp, Homo sapiens
taatactggaataattt

SEQ ID NO: 5303275 - DNA, 21 bp, Homo sapiens
taatactggaataatttgtaa

SEQ ID NO: 5303276 - DNA, 23 bp, Homo sapiens
taatactggaataatttgtaaat

SEQ ID NO: 5303277 - DNA, 21 bp, Homo sapiens
taatactggtatttttactta

SEQ ID NO: 5303278 - DNA, 14 bp, Homo sapiens
taatactgtatttg

SEQ ID NO: 5303279 - DNA, 11 bp, Homo sapiens
taatactgtgt

SEQ ID NO: 5303280 - DNA, 13 bp, Homo sapiens
taatactgttatt

SEQ ID NO: 5303281 - DNA, 15 bp, Homo sapiens
taatactgttattct

SEQ ID NO: 5303282 - DNA, 16 bp, Homo sapiens
taatactgttattctt

SEQ ID NO: 5303283 - DNA, 17 bp, Homo sapiens
taatactgttattcttt

SEQ ID NO: 5303284 - DNA, 14 bp, Homo sapiens
taatacttaaaaat

SEQ ID NO: 5303285 - DNA, 14 bp, Homo sapiens
taatacttcataca

SEQ ID NO: 5303286 - DNA, 17 bp, Homo sapiens
taatacttccttataaa

SEQ ID NO: 5303287 - DNA, 21 bp, Homo sapiens
taatacttctttgttattata

SEQ ID NO: 5303288 - DNA, 20 bp, Homo sapiens
taatacttgaactgttgccc

SEQ ID NO: 5303289 - DNA, 18 bp, Homo sapiens
taatacttgctttggaaa

SEQ ID NO: 5303290 - DNA, 14 bp, Homo sapiens
taatactttctatg

SEQ ID NO: 5303291 - DNA, 13 bp, Homo sapiens
taatactttgtat

SEQ ID NO: 5303292 - DNA, 13 bp, Homo sapiens
taatactttttaa

SEQ ID NO: 5303293 - DNA, 17 bp, Homo sapiens
taatactttttaaatta

SEQ ID NO: 5303294 - DNA, 18 bp, Homo sapiens
taatactttttaaattac

SEQ ID NO: 5303295 - DNA, 19 bp, Homo sapiens
taatagaaaactgaaaatc

SEQ ID NO: 5303296 - DNA, 17 bp, Homo sapiens
taatagaaaagtatgtt

SEQ ID NO: 5303297 - DNA, 14 bp, Homo sapiens
taatagaaaagtct

SEQ ID NO: 5303298 - DNA, 20 bp, Homo sapiens
taatagaaaattaaaataac

SEQ ID NO: 5303299 - DNA, 12 bp, Homo sapiens
taatagaaagaa

SEQ ID NO: 5303300 - DNA, 21 bp, Homo sapiens
taatagaaagaaattacttct

SEQ ID NO: 5303301 - DNA, 14 bp, Homo sapiens
taatagaaatgcat

SEQ ID NO: 5303302 - DNA, 15 bp, Homo sapiens
taatagaacttgtta

SEQ ID NO: 5303303 - DNA, 22 bp, Homo sapiens
taatagaataaaggcagttttc

SEQ ID NO: 5303304 - DNA, 21 bp, Homo sapiens
taatagaatatactgtcttgt

SEQ ID NO: 5303305 - DNA, 15 bp, Homo sapiens
taatagaatgataaa

SEQ ID NO: 5303306 - DNA, 13 bp, Homo sapiens
taatagaatttcc

SEQ ID NO: 5303307 - DNA, 22 bp, Homo sapiens
taatagacaatttattatggca

SEQ ID NO: 5303308 - DNA, 19 bp, Homo sapiens
taatagacatacagagata

SEQ ID NO: 5303309 - DNA, 15 bp, Homo sapiens
taatagacttctctt

SEQ ID NO: 5303310 - DNA, 19 bp, Homo sapiens
taatagacttctcttacat

SEQ ID NO: 5303311 - DNA, 21 bp, Homo sapiens
taatagagaatgattgtcttc

SEQ ID NO: 5303312 - DNA, 18 bp, Homo sapiens
taatagagagattagtaa

SEQ ID NO: 5303313 - DNA, 12 bp, Homo sapiens
taatagagcaaa

SEQ ID NO: 5303314 - DNA, 14 bp, Homo sapiens
taatagaggagctg

SEQ ID NO: 5303315 - DNA, 16 bp, Homo sapiens
taatagagttggagtt

SEQ ID NO: 5303316 - DNA, 22 bp, Homo sapiens
taatagagttggagttttattt

SEQ ID NO: 5303317 - DNA, 22 bp, Homo sapiens
taatagatggggcatataataa

SEQ ID NO: 5303318 - DNA, 21 bp, Homo sapiens
taatagatgtttgatagattt

SEQ ID NO: 5303319 - DNA, 22 bp, Homo sapiens
taatagattttttcagacttgt

SEQ ID NO: 5303320 - DNA, 23 bp, Homo sapiens
taatagattttttcagacttgtc

SEQ ID NO: 5303321 - DNA, 20 bp, Homo sapiens
taatagcaacttttgtgtaa

SEQ ID NO: 5303322 - DNA, 15 bp, Homo sapiens
taatagcagcctttc

SEQ ID NO: 5303323 - DNA, 18 bp, Homo sapiens
taatagcatccactggaa

SEQ ID NO: 5303324 - DNA, 20 bp, Homo sapiens
taatagcatccactggaaaa

SEQ ID NO: 5303325 - DNA, 17 bp, Homo sapiens
taatagccaaagatttc

SEQ ID NO: 5303326 - DNA, 15 bp, Homo sapiens
taatagcctaaaaga

SEQ ID NO: 5303327 - DNA, 12 bp, Homo sapiens
taatagcctgtc

SEQ ID NO: 5303328 - DNA, 15 bp, Homo sapiens
taatagcctgtcata

SEQ ID NO: 5303329 - DNA, 22 bp, Homo sapiens
taatagcctgtcataggtttta

SEQ ID NO: 5303330 - DNA, 22 bp, Homo sapiens
taatagcgggttactttcacat

SEQ ID NO: 5303331 - DNA, 11 bp, Homo sapiens
taatagctgta

SEQ ID NO: 5303332 - DNA, 15 bp, Homo sapiens
taatagcttctgtgt

SEQ ID NO: 5303333 - DNA, 16 bp, Homo sapiens
taatagcttctgtgtg

SEQ ID NO: 5303334 - DNA, 18 bp, Homo sapiens
taatagcttttattgtat

SEQ ID NO: 5303335 - DNA, 21 bp, Homo sapiens
taatagcttttgattagtata

SEQ ID NO: 5303336 - DNA, 22 bp, Homo sapiens
taataggaacaatctttgctgt

SEQ ID NO: 5303337 - DNA, 22 bp, Homo sapiens
taataggaatgtccaccatgaa

SEQ ID NO: 5303338 - DNA, 14 bp, Homo sapiens
taataggcatttta

SEQ ID NO: 5303339 - DNA, 15 bp, Homo sapiens
taataggcattttaa

SEQ ID NO: 5303340 - DNA, 18 bp, Homo sapiens
taataggcattttaagta

SEQ ID NO: 5303341 - DNA, 15 bp, Homo sapiens
taatagggaatatat

SEQ ID NO: 5303342 - DNA, 21 bp, Homo sapiens
taataggtactgccatatttt

SEQ ID NO: 5303343 - DNA, 20 bp, Homo sapiens
taataggtatatagaacaca

SEQ ID NO: 5303344 - DNA, 16 bp, Homo sapiens
taataggtcatatgtt

SEQ ID NO: 5303345 - DNA, 13 bp, Homo sapiens
taataggtctgga

SEQ ID NO: 5303346 - DNA, 14 bp, Homo sapiens
taataggtttggac

SEQ ID NO: 5303347 - DNA, 21 bp, Homo sapiens
taatagtaatttgtaaagttg

SEQ ID NO: 5303348 - DNA, 14 bp, Homo sapiens
taatagtactatta

SEQ ID NO: 5303349 - DNA, 17 bp, Homo sapiens
taatagtactattaaca

SEQ ID NO: 5303350 - DNA, 14 bp, Homo sapiens
taatagtagatttg

SEQ ID NO: 5303351 - DNA, 17 bp, Homo sapiens
taatagtccaatatttg

SEQ ID NO: 5303352 - DNA, 20 bp, Homo sapiens
taatagtctagaatgttatt

SEQ ID NO: 5303353 - DNA, 19 bp, Homo sapiens
taatagtcttgcagaaaat

SEQ ID NO: 5303354 - DNA, 21 bp, Homo sapiens
taatagtgcttaaaaatcatt

SEQ ID NO: 5303355 - DNA, 17 bp, Homo sapiens
taatagtggcaaatgaa

SEQ ID NO: 5303356 - DNA, 17 bp, Homo sapiens
taatagtgttaatcaat

SEQ ID NO: 5303357 - DNA, 16 bp, Homo sapiens
taatagttattattta

SEQ ID NO: 5303358 - DNA, 20 bp, Homo sapiens
taatagttattatttaattg

SEQ ID NO: 5303359 - DNA, 21 bp, Homo sapiens
taatagttcaggtaacaggca

SEQ ID NO: 5303360 - DNA, 14 bp, Homo sapiens
taatagttcagtag

SEQ ID NO: 5303361 - DNA, 18 bp, Homo sapiens
taatagttcagtagaatt

SEQ ID NO: 5303362 - DNA, 23 bp, Homo sapiens
taatagttctatccttttgcctg

SEQ ID NO: 5303363 - DNA, 19 bp, Homo sapiens
taatagtttacatgtagta

SEQ ID NO: 5303364 - DNA, 21 bp, Homo sapiens
taatagtttttcactttgtgt

SEQ ID NO: 5303365 - DNA, 15 bp, Homo sapiens
taatataaaagatat

SEQ ID NO: 5303366 - DNA, 18 bp, Homo sapiens
taatataaaatgtttcaa

SEQ ID NO: 5303367 - DNA, 14 bp, Homo sapiens
taatataaactggt

SEQ ID NO: 5303368 - DNA, 14 bp, Homo sapiens
taatataaagttgg

SEQ ID NO: 5303369 - DNA, 22 bp, Homo sapiens
taatataaagttttatatatta

SEQ ID NO: 5303370 - DNA, 13 bp, Homo sapiens
taatataaatgaa

SEQ ID NO: 5303371 - DNA, 16 bp, Homo sapiens
taatataaatgaatga

SEQ ID NO: 5303372 - DNA, 13 bp, Homo sapiens
taatataaatgca

SEQ ID NO: 5303373 - DNA, 22 bp, Homo sapiens
taatataaatgcaaataacaaa

SEQ ID NO: 5303374 - DNA, 13 bp, Homo sapiens
taatataaatgtt

SEQ ID NO: 5303375 - DNA, 14 bp, Homo sapiens
taatataaatgttg

SEQ ID NO: 5303376 - DNA, 16 bp, Homo sapiens
taatataaatgttgct

SEQ ID NO: 5303377 - DNA, 18 bp, Homo sapiens
taatataaattcactttc

SEQ ID NO: 5303378 - DNA, 17 bp, Homo sapiens
taatataaatttaagca

SEQ ID NO: 5303379 - DNA, 19 bp, Homo sapiens
taatataaatttaagcaaa

SEQ ID NO: 5303380 - DNA, 16 bp, Homo sapiens
taatataacaatatat

SEQ ID NO: 5303381 - DNA, 16 bp, Homo sapiens
taatataactgcctta

SEQ ID NO: 5303382 - DNA, 22 bp, Homo sapiens
taatataactgccttaaaactt

SEQ ID NO: 5303383 - DNA, 17 bp, Homo sapiens
taatataacttgaaaat

SEQ ID NO: 5303384 - DNA, 18 bp, Homo sapiens
taatataagaagctttca

SEQ ID NO: 5303385 - DNA, 22 bp, Homo sapiens
taatataagaagctttcagtat

SEQ ID NO: 5303386 - DNA, 19 bp, Homo sapiens
taatataagaatcatagtg

SEQ ID NO: 5303387 - DNA, 20 bp, Homo sapiens
taatataataatagttatta

SEQ ID NO: 5303388 - DNA, 14 bp, Homo sapiens
taatataataatgt

SEQ ID NO: 5303389 - DNA, 22 bp, Homo sapiens
taatataatgagtcacaaaata

SEQ ID NO: 5303390 - DNA, 16 bp, Homo sapiens
taatataatgtatttt

SEQ ID NO: 5303391 - DNA, 20 bp, Homo sapiens
taatatacaagcaagcaaaa

SEQ ID NO: 5303392 - DNA, 16 bp, Homo sapiens
taatatacagtgtgta

SEQ ID NO: 5303393 - DNA, 18 bp, Homo sapiens
taatatacagtgtgtagt

SEQ ID NO: 5303394 - DNA, 21 bp, Homo sapiens
taatataccagcttgtatgca

SEQ ID NO: 5303395 - DNA, 17 bp, Homo sapiens
taatatacctggtttac

SEQ ID NO: 5303396 - DNA, 18 bp, Homo sapiens
taatatactaaccatttc

SEQ ID NO: 5303397 - DNA, 19 bp, Homo sapiens
taatatactaaccatttct

SEQ ID NO: 5303398 - DNA, 16 bp, Homo sapiens
taatatactgcatatc

SEQ ID NO: 5303399 - DNA, 13 bp, Homo sapiens
taatatacttgtg

SEQ ID NO: 5303400 - DNA, 21 bp, Homo sapiens
taatatacttgtggactaaaa

SEQ ID NO: 5303401 - DNA, 23 bp, Homo sapiens
taatatagaaaaaaacattctat

SEQ ID NO: 5303402 - DNA, 15 bp, Homo sapiens
taatatagaaagaaa

SEQ ID NO: 5303403 - DNA, 14 bp, Homo sapiens
taatatagcctgta

SEQ ID NO: 5303404 - DNA, 15 bp, Homo sapiens
taatatagctatcat

SEQ ID NO: 5303405 - DNA, 18 bp, Homo sapiens
taatatagctatcatttc

SEQ ID NO: 5303406 - DNA, 15 bp, Homo sapiens
taatatataaaagaa

SEQ ID NO: 5303407 - DNA, 11 bp, Homo sapiens
taatatataat

SEQ ID NO: 5303408 - DNA, 15 bp, Homo sapiens
taatatataatcaaa

SEQ ID NO: 5303409 - DNA, 16 bp, Homo sapiens
taatatataatttaat

SEQ ID NO: 5303410 - DNA, 22 bp, Homo sapiens
taatatatacatattcaaagta

SEQ ID NO: 5303411 - DNA, 18 bp, Homo sapiens
taatatatataatactta

SEQ ID NO: 5303412 - DNA, 19 bp, Homo sapiens
taatatatatatatatcag

SEQ ID NO: 5303413 - DNA, 22 bp, Homo sapiens
taatatatatatatatcagttt

SEQ ID NO: 5303414 - DNA, 14 bp, Homo sapiens
taatatatatgaat

SEQ ID NO: 5303415 - DNA, 21 bp, Homo sapiens
taatatatatgtagagaaaga

SEQ ID NO: 5303416 - DNA, 18 bp, Homo sapiens
taatatatattatctttt

SEQ ID NO: 5303417 - DNA, 19 bp, Homo sapiens
taatatatattatcttttc

SEQ ID NO: 5303418 - DNA, 17 bp, Homo sapiens
taatatatattttaagg

SEQ ID NO: 5303419 - DNA, 14 bp, Homo sapiens
taatatatcaaatc

SEQ ID NO: 5303420 - DNA, 17 bp, Homo sapiens
taatatatcccagaaat

SEQ ID NO: 5303421 - DNA, 12 bp, Homo sapiens
taatatatcctg

SEQ ID NO: 5303422 - DNA, 20 bp, Homo sapiens
taatatatcctgaaagcatt

SEQ ID NO: 5303423 - DNA, 14 bp, Homo sapiens
taatatatcctgtt

SEQ ID NO: 5303424 - DNA, 15 bp, Homo sapiens
taatatatggaagat

SEQ ID NO: 5303425 - DNA, 18 bp, Homo sapiens
taatatatgggggaaaat

SEQ ID NO: 5303426 - DNA, 14 bp, Homo sapiens
taatatatgtttac

SEQ ID NO: 5303427 - DNA, 12 bp, Homo sapiens
taatatattaag

SEQ ID NO: 5303428 - DNA, 12 bp, Homo sapiens
taatatattgaa

SEQ ID NO: 5303429 - DNA, 12 bp, Homo sapiens
taatatattgct

SEQ ID NO: 5303430 - DNA, 18 bp, Homo sapiens
taatatattgtgttttaa

SEQ ID NO: 5303431 - DNA, 22 bp, Homo sapiens
taatatattgtgttttaacacc

SEQ ID NO: 5303432 - DNA, 15 bp, Homo sapiens
taatatatttaaagg

SEQ ID NO: 5303433 - DNA, 22 bp, Homo sapiens
taatatatttaaagggaaattg

SEQ ID NO: 5303434 - DNA, 12 bp, Homo sapiens
taatatatttat

SEQ ID NO: 5303435 - DNA, 18 bp, Homo sapiens
taatatatttcagacatt

SEQ ID NO: 5303436 - DNA, 19 bp, Homo sapiens
taatatatttgtgtattta

SEQ ID NO: 5303437 - DNA, 13 bp, Homo sapiens
taatatattttct

SEQ ID NO: 5303438 - DNA, 22 bp, Homo sapiens
taatatcaaaacaagtactggt

SEQ ID NO: 5303439 - DNA, 22 bp, Homo sapiens
taatatcaaaagaaaattgata

SEQ ID NO: 5303440 - DNA, 21 bp, Homo sapiens
taatatcaaatgcagtatatt

SEQ ID NO: 5303441 - DNA, 16 bp, Homo sapiens
taatatcaactctgaa

SEQ ID NO: 5303442 - DNA, 12 bp, Homo sapiens
taatatcagtta

SEQ ID NO: 5303443 - DNA, 16 bp, Homo sapiens
taatatcatagaccca

SEQ ID NO: 5303444 - DNA, 17 bp, Homo sapiens
taatatcattttataga

SEQ ID NO: 5303445 - DNA, 18 bp, Homo sapiens
taatatcattttatagaa

SEQ ID NO: 5303446 - DNA, 19 bp, Homo sapiens
taatatcattttattcaca

SEQ ID NO: 5303447 - DNA, 19 bp, Homo sapiens
taatatccaggtcaacaga

SEQ ID NO: 5303448 - DNA, 16 bp, Homo sapiens
taatatcctgtaataa

SEQ ID NO: 5303449 - DNA, 17 bp, Homo sapiens
taatatcggggggtgga

SEQ ID NO: 5303450 - DNA, 21 bp, Homo sapiens
taatatctaaagttatatttc

SEQ ID NO: 5303451 - DNA, 20 bp, Homo sapiens
taatatctattccatttgta

SEQ ID NO: 5303452 - DNA, 15 bp, Homo sapiens
taatatctcctggaa

SEQ ID NO: 5303453 - DNA, 17 bp, Homo sapiens
taatatctgagaagtgt

SEQ ID NO: 5303454 - DNA, 22 bp, Homo sapiens
taatatctgagaagtgtatata

SEQ ID NO: 5303455 - DNA, 17 bp, Homo sapiens
taatatctgatactgta

SEQ ID NO: 5303456 - DNA, 15 bp, Homo sapiens
taatatctgtgaggt

SEQ ID NO: 5303457 - DNA, 21 bp, Homo sapiens
taatatctgtgaggtgctgat

SEQ ID NO: 5303458 - DNA, 17 bp, Homo sapiens
taatatcttcacattgt

SEQ ID NO: 5303459 - DNA, 22 bp, Homo sapiens
taatatcttgaagaatattgtt

SEQ ID NO: 5303460 - DNA, 18 bp, Homo sapiens
taatatctttaaatgatg

SEQ ID NO: 5303461 - DNA, 14 bp, Homo sapiens
taatatgaaaactt

SEQ ID NO: 5303462 - DNA, 15 bp, Homo sapiens
taatatgaaaactta

SEQ ID NO: 5303463 - DNA, 11 bp, Homo sapiens
taatatgagaa

SEQ ID NO: 5303464 - DNA, 12 bp, Homo sapiens
taatatgagctt

SEQ ID NO: 5303465 - DNA, 15 bp, Homo sapiens
taatatgagcttcaa

SEQ ID NO: 5303466 - DNA, 16 bp, Homo sapiens
taatatgatctgtgga

SEQ ID NO: 5303467 - DNA, 15 bp, Homo sapiens
taatatgcaaagtct

SEQ ID NO: 5303468 - DNA, 16 bp, Homo sapiens
taatatgcaaagtcta

SEQ ID NO: 5303469 - DNA, 13 bp, Homo sapiens
taatatgcatata

SEQ ID NO: 5303470 - DNA, 20 bp, Homo sapiens
taatatgcatatatatgtat

SEQ ID NO: 5303471 - DNA, 13 bp, Homo sapiens
taatatgcatctt

SEQ ID NO: 5303472 - DNA, 15 bp, Homo sapiens
taatatgctacagta

SEQ ID NO: 5303473 - DNA, 22 bp, Homo sapiens
taatatgctacagtactatgta

SEQ ID NO: 5303474 - DNA, 21 bp, Homo sapiens
taatatgctgcaacaaaatgt

SEQ ID NO: 5303475 - DNA, 22 bp, Homo sapiens
taatatgctgcaacaaaatgta

SEQ ID NO: 5303476 - DNA, 20 bp, Homo sapiens
taatatgcttataacctagt

SEQ ID NO: 5303477 - DNA, 17 bp, Homo sapiens
taatatgctttttactc

SEQ ID NO: 5303478 - DNA, 15 bp, Homo sapiens
taatatggaaatctt

SEQ ID NO: 5303479 - DNA, 13 bp, Homo sapiens
taatatggaacct

SEQ ID NO: 5303480 - DNA, 18 bp, Homo sapiens
taatatggaaccttccct

SEQ ID NO: 5303481 - DNA, 22 bp, Homo sapiens
taatatggactcagccttgcaa

SEQ ID NO: 5303482 - DNA, 22 bp, Homo sapiens
taatatggctcttcataattct

SEQ ID NO: 5303483 - DNA, 18 bp, Homo sapiens
taatatgggcattgtagt

SEQ ID NO: 5303484 - DNA, 16 bp, Homo sapiens
taatatggtgtatttt

SEQ ID NO: 5303485 - DNA, 20 bp, Homo sapiens
taatatggttttgttttcaa

SEQ ID NO: 5303486 - DNA, 22 bp, Homo sapiens
taatatggttttgttttcaatg

SEQ ID NO: 5303487 - DNA, 22 bp, Homo sapiens
taatatgtacttttccatttat

SEQ ID NO: 5303488 - DNA, 19 bp, Homo sapiens
taatatgtattttatgtat

SEQ ID NO: 5303489 - DNA, 19 bp, Homo sapiens
taatatgtgccttaagttt

SEQ ID NO: 5303490 - DNA, 21 bp, Homo sapiens
taatatgtgggaattagtgag

SEQ ID NO: 5303491 - DNA, 21 bp, Homo sapiens
taatatgttaacctcagtgtc

SEQ ID NO: 5303492 - DNA, 20 bp, Homo sapiens
taatatgttcttttaaatga

SEQ ID NO: 5303493 - DNA, 11 bp, Homo sapiens
taatatgttga

SEQ ID NO: 5303494 - DNA, 15 bp, Homo sapiens
taatatgttgacttt

SEQ ID NO: 5303495 - DNA, 17 bp, Homo sapiens
taatatgttgactttat

SEQ ID NO: 5303496 - DNA, 18 bp, Homo sapiens
taatatgtttaatgttca

SEQ ID NO: 5303497 - DNA, 16 bp, Homo sapiens
taatatgttttattca

SEQ ID NO: 5303498 - DNA, 15 bp, Homo sapiens
taatattaaaaagaa

SEQ ID NO: 5303499 - DNA, 20 bp, Homo sapiens
taatattaaaaagaagtttc

SEQ ID NO: 5303500 - DNA, 12 bp, Homo sapiens
taatattaaaag

SEQ ID NO: 5303501 - DNA, 18 bp, Homo sapiens
taatattaaaagtcacaa

SEQ ID NO: 5303502 - DNA, 15 bp, Homo sapiens
taatattaaagccat

SEQ ID NO: 5303503 - DNA, 17 bp, Homo sapiens
taatattaaagccatgt

SEQ ID NO: 5303504 - DNA, 20 bp, Homo sapiens
taatattaaagccatgttta

SEQ ID NO: 5303505 - DNA, 17 bp, Homo sapiens
taatattaactacagaa

SEQ ID NO: 5303506 - DNA, 18 bp, Homo sapiens
taatattaactacagaaa

SEQ ID NO: 5303507 - DNA, 14 bp, Homo sapiens
taatattaactttt

SEQ ID NO: 5303508 - DNA, 16 bp, Homo sapiens
taatattacatttcat

SEQ ID NO: 5303509 - DNA, 21 bp, Homo sapiens
taatattactgtctttattct

SEQ ID NO: 5303510 - DNA, 17 bp, Homo sapiens
taatattagtgattctg

SEQ ID NO: 5303511 - DNA, 19 bp, Homo sapiens
taatattagtgattctgat

SEQ ID NO: 5303512 - DNA, 23 bp, Homo sapiens
taatattagttggctttcataaa

SEQ ID NO: 5303513 - DNA, 18 bp, Homo sapiens
taatattcagccagctta

SEQ ID NO: 5303514 - DNA, 15 bp, Homo sapiens
taatattcatacaac

SEQ ID NO: 5303515 - DNA, 16 bp, Homo sapiens
taatattcatacaaca

SEQ ID NO: 5303516 - DNA, 18 bp, Homo sapiens
taatattcatacaacaaa

SEQ ID NO: 5303517 - DNA, 17 bp, Homo sapiens
taatattcatgaagagt

SEQ ID NO: 5303518 - DNA, 17 bp, Homo sapiens
taatattcctatatgta

SEQ ID NO: 5303519 - DNA, 17 bp, Homo sapiens
taatattctccccaccc

SEQ ID NO: 5303520 - DNA, 14 bp, Homo sapiens
taatattctctgat

SEQ ID NO: 5303521 - DNA, 21 bp, Homo sapiens
taatattcttttgttattaaa

SEQ ID NO: 5303522 - DNA, 20 bp, Homo sapiens
taatattgaaaattgaaaag

SEQ ID NO: 5303523 - DNA, 19 bp, Homo sapiens
taatattgagaaagaaact

SEQ ID NO: 5303524 - DNA, 14 bp, Homo sapiens
taatattgagaatc

SEQ ID NO: 5303525 - DNA, 15 bp, Homo sapiens
taatattgagaatca

SEQ ID NO: 5303526 - DNA, 20 bp, Homo sapiens
taatattgagaatcaggttg

SEQ ID NO: 5303527 - DNA, 16 bp, Homo sapiens
taatattgatgtcagt

SEQ ID NO: 5303528 - DNA, 20 bp, Homo sapiens
taatattgccttgatgtttc

SEQ ID NO: 5303529 - DNA, 21 bp, Homo sapiens
taatattgccttgatgtttct

SEQ ID NO: 5303530 - DNA, 11 bp, Homo sapiens
taatattgctt

SEQ ID NO: 5303531 - DNA, 16 bp, Homo sapiens
taatattggaagtgaa

SEQ ID NO: 5303532 - DNA, 17 bp, Homo sapiens
taatattgtctgtctct

SEQ ID NO: 5303533 - DNA, 18 bp, Homo sapiens
taatattgttgtataatt

SEQ ID NO: 5303534 - DNA, 21 bp, Homo sapiens
taatattgtttggtaaatgtt

SEQ ID NO: 5303535 - DNA, 23 bp, Homo sapiens
taatattgtttttctttctacaa

SEQ ID NO: 5303536 - DNA, 15 bp, Homo sapiens
taatatttaaaatag

SEQ ID NO: 5303537 - DNA, 17 bp, Homo sapiens
taatatttaaatattac

SEQ ID NO: 5303538 - DNA, 17 bp, Homo sapiens
taatatttaacctcttt

SEQ ID NO: 5303539 - DNA, 13 bp, Homo sapiens
taatatttacaat

SEQ ID NO: 5303540 - DNA, 14 bp, Homo sapiens
taatatttaccaaa

SEQ ID NO: 5303541 - DNA, 20 bp, Homo sapiens
taatatttagctgtaaactg

SEQ ID NO: 5303542 - DNA, 22 bp, Homo sapiens
taatatttagctgtaaactgaa

SEQ ID NO: 5303543 - DNA, 20 bp, Homo sapiens
taatatttatagagttcata

SEQ ID NO: 5303544 - DNA, 21 bp, Homo sapiens
taatatttatgtctatttaag

SEQ ID NO: 5303545 - DNA, 21 bp, Homo sapiens
taatatttatgtctctgttat

SEQ ID NO: 5303546 - DNA, 14 bp, Homo sapiens
taatatttatgttt

SEQ ID NO: 5303547 - DNA, 15 bp, Homo sapiens
taatatttatgttta

SEQ ID NO: 5303548 - DNA, 19 bp, Homo sapiens
taatatttatgtttaagtg

SEQ ID NO: 5303549 - DNA, 18 bp, Homo sapiens
taatatttattgctttat

SEQ ID NO: 5303550 - DNA, 14 bp, Homo sapiens
taatatttcaagtg

SEQ ID NO: 5303551 - DNA, 17 bp, Homo sapiens
taatatttcaagtgcct

SEQ ID NO: 5303552 - DNA, 13 bp, Homo sapiens
taatatttctaaa

SEQ ID NO: 5303553 - DNA, 17 bp, Homo sapiens
taatatttcttaatttg

SEQ ID NO: 5303554 - DNA, 21 bp, Homo sapiens
taatatttcttaatttggata

SEQ ID NO: 5303555 - DNA, 12 bp, Homo sapiens
taatatttcttc

SEQ ID NO: 5303556 - DNA, 18 bp, Homo sapiens
taatatttcttcaaatat

SEQ ID NO: 5303557 - DNA, 18 bp, Homo sapiens
taatatttgaacaaaaat

SEQ ID NO: 5303558 - DNA, 20 bp, Homo sapiens
taatatttgaacaaaaattg

SEQ ID NO: 5303559 - DNA, 14 bp, Homo sapiens
taatatttgtgctt

SEQ ID NO: 5303560 - DNA, 20 bp, Homo sapiens
taatattttacttttacagt

SEQ ID NO: 5303561 - DNA, 17 bp, Homo sapiens
taatattttagattaca

SEQ ID NO: 5303562 - DNA, 14 bp, Homo sapiens
taatattttatgtg

SEQ ID NO: 5303563 - DNA, 15 bp, Homo sapiens
taatattttatgtgt

SEQ ID NO: 5303564 - DNA, 17 bp, Homo sapiens
taatattttatgtgtaa

SEQ ID NO: 5303565 - DNA, 17 bp, Homo sapiens
taatattttatttgaaa

SEQ ID NO: 5303566 - DNA, 14 bp, Homo sapiens
taatattttctgtg

SEQ ID NO: 5303567 - DNA, 20 bp, Homo sapiens
taatattttgtaatattctg

SEQ ID NO: 5303568 - DNA, 22 bp, Homo sapiens
taatattttgtaatattctgtt

SEQ ID NO: 5303569 - DNA, 15 bp, Homo sapiens
taatattttgtatta

SEQ ID NO: 5303570 - DNA, 16 bp, Homo sapiens
taatattttgtattat

SEQ ID NO: 5303571 - DNA, 20 bp, Homo sapiens
taatattttgtattattgct

SEQ ID NO: 5303572 - DNA, 14 bp, Homo sapiens
taatatttttaatt

SEQ ID NO: 5303573 - DNA, 15 bp, Homo sapiens
taatatttttaatta

SEQ ID NO: 5303574 - DNA, 17 bp, Homo sapiens
taatatttttacatgca

SEQ ID NO: 5303575 - DNA, 13 bp, Homo sapiens
taatatttttcct

SEQ ID NO: 5303576 - DNA, 15 bp, Homo sapiens
taatcaaaattgtct

SEQ ID NO: 5303577 - DNA, 12 bp, Homo sapiens
taatcaaatatg

SEQ ID NO: 5303578 - DNA, 22 bp, Homo sapiens
taatcaaatgatttcatattga

SEQ ID NO: 5303579 - DNA, 18 bp, Homo sapiens
taatcaaattctgtctgg

SEQ ID NO: 5303580 - DNA, 21 bp, Homo sapiens
taatcaagaatattcaaatgt

SEQ ID NO: 5303581 - DNA, 11 bp, Homo sapiens
taatcaagaga

SEQ ID NO: 5303582 - DNA, 13 bp, Homo sapiens
taatcaagagaaa

SEQ ID NO: 5303583 - DNA, 10 bp, Homo sapiens
taatcaagat

SEQ ID NO: 5303584 - DNA, 14 bp, Homo sapiens
taatcaagtgcatt

SEQ ID NO: 5303585 - DNA, 14 bp, Homo sapiens
taatcaagttgaat

SEQ ID NO: 5303586 - DNA, 17 bp, Homo sapiens
taatcaagttgtaactt

SEQ ID NO: 5303587 - DNA, 22 bp, Homo sapiens
taatcaatacccttggcactga

SEQ ID NO: 5303588 - DNA, 20 bp, Homo sapiens
taatcaatactttgaacaca

SEQ ID NO: 5303589 - DNA, 23 bp, Homo sapiens
taatcaatactttgaacacaaag

SEQ ID NO: 5303590 - DNA, 17 bp, Homo sapiens
taatcaatcatctgtgt

SEQ ID NO: 5303591 - DNA, 20 bp, Homo sapiens
taatcaatgaatattgaagt

SEQ ID NO: 5303592 - DNA, 20 bp, Homo sapiens
taatcaatgaatttgttctt

SEQ ID NO: 5303593 - DNA, 18 bp, Homo sapiens
taatcaatgtttcttcta

SEQ ID NO: 5303594 - DNA, 13 bp, Homo sapiens
taatcaattatta

SEQ ID NO: 5303595 - DNA, 23 bp, Homo sapiens
taatcaatttctcaatagttctt

SEQ ID NO: 5303596 - DNA, 15 bp, Homo sapiens
taatcacatgtgctg

SEQ ID NO: 5303597 - DNA, 15 bp, Homo sapiens
taatcacgctttcct

SEQ ID NO: 5303598 - DNA, 15 bp, Homo sapiens
taatcactactgtat

SEQ ID NO: 5303599 - DNA, 17 bp, Homo sapiens
taatcactccaaccctg

SEQ ID NO: 5303600 - DNA, 23 bp, Homo sapiens
taatgcactctgggtctggccag

SEQ ID NO: 5303601 - DNA, 18 bp, Homo sapiens
taatgcactgtttttaat

SEQ ID NO: 5303602 - DNA, 15 bp, Homo sapiens
taatgcagaagtatt

SEQ ID NO: 5303603 - DNA, 17 bp, Homo sapiens
taatgcagacatttaca

SEQ ID NO: 5303604 - DNA, 18 bp, Homo sapiens
taatgcagataaatacat

SEQ ID NO: 5303605 - DNA, 20 bp, Homo sapiens
taatgcagataaatacattt

SEQ ID NO: 5303606 - DNA, 22 bp, Homo sapiens
taatgcagataaatacatttat

SEQ ID NO: 5303607 - DNA, 23 bp, Homo sapiens
taatgcagccacgattggagaat

SEQ ID NO: 5303608 - DNA, 17 bp, Homo sapiens
taatgcagtatggtaca

SEQ ID NO: 5303609 - DNA, 20 bp, Homo sapiens
taatgcagtatggtacattt

SEQ ID NO: 5303610 - DNA, 16 bp, Homo sapiens
taatgcataagctttt

SEQ ID NO: 5303611 - DNA, 19 bp, Homo sapiens
taatgcatatttataagag

SEQ ID NO: 5303612 - DNA, 21 bp, Homo sapiens
taatgcatatttataagagaa

SEQ ID NO: 5303613 - DNA, 18 bp, Homo sapiens
taatgcatatttttgcac

SEQ ID NO: 5303614 - DNA, 22 bp, Homo sapiens
taatgcatcatcatagaaaaac

SEQ ID NO: 5303615 - DNA, 17 bp, Homo sapiens
taatgcatgaagcaacg

SEQ ID NO: 5303616 - DNA, 20 bp, Homo sapiens
taatgcatgtggtatgagta

SEQ ID NO: 5303617 - DNA, 21 bp, Homo sapiens
taatgcatgttaggaaaattt

SEQ ID NO: 5303618 - DNA, 12 bp, Homo sapiens
taatgcattatt

SEQ ID NO: 5303619 - DNA, 16 bp, Homo sapiens
taatgcattgcctgta

SEQ ID NO: 5303620 - DNA, 11 bp, Homo sapiens
taatgcattgt

SEQ ID NO: 5303621 - DNA, 17 bp, Homo sapiens
taatgcattgttgtaaa

SEQ ID NO: 5303622 - DNA, 15 bp, Homo sapiens
taatgccaagggtaa

SEQ ID NO: 5303623 - DNA, 12 bp, Homo sapiens
taatgccaagtt

SEQ ID NO: 5303624 - DNA, 23 bp, Homo sapiens
taatgccaatatgacacagcttg

SEQ ID NO: 5303625 - DNA, 14 bp, Homo sapiens
taatgcccagccag

SEQ ID NO: 5303626 - DNA, 20 bp, Homo sapiens
taatgcccagccagccaccc

SEQ ID NO: 5303627 - DNA, 14 bp, Homo sapiens
taatgccccaagga

SEQ ID NO: 5303628 - DNA, 17 bp, Homo sapiens
taatgcccttaatgtga

SEQ ID NO: 5303629 - DNA, 23 bp, Homo sapiens
taatgcctagcagagaactgcct

SEQ ID NO: 5303630 - DNA, 19 bp, Homo sapiens
taatgcctataactttttt

SEQ ID NO: 5303631 - DNA, 12 bp, Homo sapiens
taatgcctgccc

SEQ ID NO: 5303632 - DNA, 22 bp, Homo sapiens
taatgcctttaaagtatgaatc

SEQ ID NO: 5303633 - DNA, 15 bp, Homo sapiens
taatgcgaatagtgc

SEQ ID NO: 5303634 - DNA, 16 bp, Homo sapiens
taatgcgatttcttcc

SEQ ID NO: 5303635 - DNA, 21 bp, Homo sapiens
taatgcgatttcttccttgtt

SEQ ID NO: 5303636 - DNA, 19 bp, Homo sapiens
taatgcgcaggctggccct

SEQ ID NO: 5303637 - DNA, 22 bp, Homo sapiens
taatgcgcaggctggccctgcc

SEQ ID NO: 5303638 - DNA, 17 bp, Homo sapiens
taatgcgccaataaacc

SEQ ID NO: 5303639 - DNA, 22 bp, Homo sapiens
taatgcggacacttttgaggac

SEQ ID NO: 5303640 - DNA, 22 bp, Homo sapiens
taatgcgtgcataccacttttg

SEQ ID NO: 5303641 - DNA, 23 bp, Homo sapiens
taatgcgtgcataccacttttgt

SEQ ID NO: 5303642 - DNA, 22 bp, Homo sapiens
taatgctaaatgtaagaatcat

SEQ ID NO: 5303643 - DNA, 15 bp, Homo sapiens
taatgctaaatgtgt

SEQ ID NO: 5303644 - DNA, 22 bp, Homo sapiens
taatgctaatcttgtgaaaata

SEQ ID NO: 5303645 - DNA, 19 bp, Homo sapiens
taatgctaatttaaagaga

SEQ ID NO: 5303646 - DNA, 15 bp, Homo sapiens
taatgctacaatttt

SEQ ID NO: 5303647 - DNA, 14 bp, Homo sapiens
taatgctaccagga

SEQ ID NO: 5303648 - DNA, 18 bp, Homo sapiens
taatgctacgtgtgattt

SEQ ID NO: 5303649 - DNA, 13 bp, Homo sapiens
taatgctccttgt

SEQ ID NO: 5303650 - DNA, 19 bp, Homo sapiens
taatgctctatgtttgtat

SEQ ID NO: 5303651 - DNA, 16 bp, Homo sapiens
taatgctgtctttgtg

SEQ ID NO: 5303652 - DNA, 16 bp, Homo sapiens
taatgctgttgcctca

SEQ ID NO: 5303653 - DNA, 23 bp, Homo sapiens
taatgcttaacataaacttgtac

SEQ ID NO: 5303654 - DNA, 13 bp, Homo sapiens
taatgcttaagat

SEQ ID NO: 5303655 - DNA, 20 bp, Homo sapiens
taatgcttaagggagtttaa

SEQ ID NO: 5303656 - DNA, 19 bp, Homo sapiens
taatgcttagagaatgttc

SEQ ID NO: 5303657 - DNA, 20 bp, Homo sapiens
taatgcttagagaatgttct

SEQ ID NO: 5303658 - DNA, 16 bp, Homo sapiens
taatgcttcaagtgtt

SEQ ID NO: 5303659 - DNA, 23 bp, Homo sapiens
taatgcttcaagtgttgctcttg

SEQ ID NO: 5303660 - DNA, 14 bp, Homo sapiens
taatgcttcagata

SEQ ID NO: 5303661 - DNA, 21 bp, Homo sapiens
taatgcttctttcattttctg

SEQ ID NO: 5303662 - DNA, 21 bp, Homo sapiens
taatgcttgtaatttaaacat

SEQ ID NO: 5303663 - DNA, 14 bp, Homo sapiens
taatgctttggaaa

SEQ ID NO: 5303664 - DNA, 17 bp, Homo sapiens
taatgctttggaaaaat

SEQ ID NO: 5303665 - DNA, 21 bp, Homo sapiens
taatgctttggaaaaatgggt

SEQ ID NO: 5303666 - DNA, 16 bp, Homo sapiens
taatgctttggttctg

SEQ ID NO: 5303667 - DNA, 15 bp, Homo sapiens
taatgcttttctaat

SEQ ID NO: 5303668 - DNA, 14 bp, Homo sapiens
taatgctttttaga

SEQ ID NO: 5303669 - DNA, 23 bp, Homo sapiens
taatgctttttgagtttcatgtt

SEQ ID NO: 5303670 - DNA, 21 bp, Homo sapiens
taatggaaaaaaaaaaaagag

SEQ ID NO: 5303671 - DNA, 17 bp, Homo sapiens
taatggaaaaaaagact

SEQ ID NO: 5303672 - DNA, 16 bp, Homo sapiens
taatggaaaaatagta

SEQ ID NO: 5303673 - DNA, 14 bp, Homo sapiens
taatggaaacatgc

SEQ ID NO: 5303674 - DNA, 18 bp, Homo sapiens
taatggaaacattacagt

SEQ ID NO: 5303675 - DNA, 18 bp, Homo sapiens
taatggaaagtttgtagc

SEQ ID NO: 5303676 - DNA, 13 bp, Homo sapiens
taatggaagagaa

SEQ ID NO: 5303677 - DNA, 20 bp, Homo sapiens
taatggaagtgtatttattt

SEQ ID NO: 5303678 - DNA, 17 bp, Homo sapiens
taatggacagattaata

SEQ ID NO: 5303679 - DNA, 19 bp, Homo sapiens
taatggacatgagataatg

SEQ ID NO: 5303680 - DNA, 22 bp, Homo sapiens
taatggactgtgaatttcaaaa

SEQ ID NO: 5303681 - DNA, 14 bp, Homo sapiens
taatggaggtccca

SEQ ID NO: 5303682 - DNA, 17 bp, Homo sapiens
taatggagtgtttgaaa

SEQ ID NO: 5303683 - DNA, 18 bp, Homo sapiens
taatggagtgtttgaaaa

SEQ ID NO: 5303684 - DNA, 14 bp, Homo sapiens
taatggcagcagaa

SEQ ID NO: 5303685 - DNA, 21 bp, Homo sapiens
taatggcagttatattttgca

SEQ ID NO: 5303686 - DNA, 22 bp, Homo sapiens
taatggcataacaaaggcaaga

SEQ ID NO: 5303687 - DNA, 16 bp, Homo sapiens
taatggcatgtcagac

SEQ ID NO: 5303688 - DNA, 15 bp, Homo sapiens
taatggccaagtgta

SEQ ID NO: 5303689 - DNA, 21 bp, Homo sapiens
taatggccatggtaccccctt

SEQ ID NO: 5303690 - DNA, 17 bp, Homo sapiens
taatggctagtactgta

SEQ ID NO: 5303691 - DNA, 18 bp, Homo sapiens
taatggctagtactgtat

SEQ ID NO: 5303692 - DNA, 23 bp, Homo sapiens
taatggctcatcaacaatcacaa

SEQ ID NO: 5303693 - DNA, 23 bp, Homo sapiens
taatgggccaattaaaatatata

SEQ ID NO: 5303694 - DNA, 23 bp, Homo sapiens
taatgggcctatttgacttctga

SEQ ID NO: 5303695 - DNA, 19 bp, Homo sapiens
taatggggactctccaggc

SEQ ID NO: 5303696 - DNA, 16 bp, Homo sapiens
taatggggattaatta

SEQ ID NO: 5303697 - DNA, 15 bp, Homo sapiens
taatggggcagacac

SEQ ID NO: 5303698 - DNA, 15 bp, Homo sapiens
taatggggcggtgag

SEQ ID NO: 5303699 - DNA, 23 bp, Homo sapiens
taatgggggcagtctccccttcc

SEQ ID NO: 5303700 - DNA, 15 bp, Homo sapiens
taatgggtatattga

SEQ ID NO: 5303701 - DNA, 17 bp, Homo sapiens
taatgggtatattgata

SEQ ID NO: 5303702 - DNA, 20 bp, Homo sapiens
taatgggtatattgataaat

SEQ ID NO: 5303703 - DNA, 13 bp, Homo sapiens
taatggtaacttt

SEQ ID NO: 5303704 - DNA, 14 bp, Homo sapiens
taatggtaactttt

SEQ ID NO: 5303705 - DNA, 17 bp, Homo sapiens
taatggtaacttttgta

SEQ ID NO: 5303706 - DNA, 21 bp, Homo sapiens
taatggtaacttttgtagtct

SEQ ID NO: 5303707 - DNA, 22 bp, Homo sapiens
taatggtaacttttgtagtctt

SEQ ID NO: 5303708 - DNA, 14 bp, Homo sapiens
taatggtaatttag

SEQ ID NO: 5303709 - DNA, 14 bp, Homo sapiens
taatggtaccagat

SEQ ID NO: 5303710 - DNA, 18 bp, Homo sapiens
taatggtagttttacagt

SEQ ID NO: 5303711 - DNA, 22 bp, Homo sapiens
taatggtatcctactgagcatt

SEQ ID NO: 5303712 - DNA, 14 bp, Homo sapiens
taatggtcccatcc

SEQ ID NO: 5303713 - DNA, 20 bp, Homo sapiens
taatggtcccatccaggcag

SEQ ID NO: 5303714 - DNA, 23 bp, Homo sapiens
taatggtctcatctcctttgcta

SEQ ID NO: 5303715 - DNA, 13 bp, Homo sapiens
taatggtgaacat

SEQ ID NO: 5303716 - DNA, 15 bp, Homo sapiens
taatggtgaacattt

SEQ ID NO: 5303717 - DNA, 18 bp, Homo sapiens
taatggtgaacattttaa

SEQ ID NO: 5303718 - DNA, 14 bp, Homo sapiens
taatggtgcttatt

SEQ ID NO: 5303719 - DNA, 18 bp, Homo sapiens
taatggtgcttattaaga

SEQ ID NO: 5303720 - DNA, 13 bp, Homo sapiens
taatggtgtagaa

SEQ ID NO: 5303721 - DNA, 17 bp, Homo sapiens
taatggtgtccagtctt

SEQ ID NO: 5303722 - DNA, 19 bp, Homo sapiens
taatggtgttactaaagtc

SEQ ID NO: 5303723 - DNA, 15 bp, Homo sapiens
taatggttaagtttt

SEQ ID NO: 5303724 - DNA, 14 bp, Homo sapiens
taatggttgtgaaa

SEQ ID NO: 5303725 - DNA, 21 bp, Homo sapiens
taatggttgtgaaatgtaaca

SEQ ID NO: 5303726 - DNA, 22 bp, Homo sapiens
taatggttgtgaaatgtaacat

SEQ ID NO: 5303727 - DNA, 15 bp, Homo sapiens
taatggtttcaaaga

SEQ ID NO: 5303728 - DNA, 13 bp, Homo sapiens
taatgtaaaatga

SEQ ID NO: 5303729 - DNA, 17 bp, Homo sapiens
taatgtaaaattcatag

SEQ ID NO: 5303730 - DNA, 11 bp, Homo sapiens
taatgtaaact

SEQ ID NO: 5303731 - DNA, 12 bp, Homo sapiens
taatgtaaagat

SEQ ID NO: 5303732 - DNA, 18 bp, Homo sapiens
taatgtaaagatttgctt

SEQ ID NO: 5303733 - DNA, 14 bp, Homo sapiens
taatgtaaatacat

SEQ ID NO: 5303734 - DNA, 15 bp, Homo sapiens
taatgtaaatacatc

SEQ ID NO: 5303735 - DNA, 13 bp, Homo sapiens
taatgtaaatttt

SEQ ID NO: 5303736 - DNA, 15 bp, Homo sapiens
taatgtaaattttaa

SEQ ID NO: 5303737 - DNA, 17 bp, Homo sapiens
taatgtaaattttaatg

SEQ ID NO: 5303738 - DNA, 14 bp, Homo sapiens
taatgtaacacagt

SEQ ID NO: 5303739 - DNA, 16 bp, Homo sapiens
taatgtaacatgattt

SEQ ID NO: 5303740 - DNA, 16 bp, Homo sapiens
taatgtaacttcctct

SEQ ID NO: 5303741 - DNA, 20 bp, Homo sapiens
taatgtaagaaaatttgaag

SEQ ID NO: 5303742 - DNA, 22 bp, Homo sapiens
taatgtaagaaaatttgaagta

SEQ ID NO: 5303743 - DNA, 20 bp, Homo sapiens
taatgtaagggtctgttgta

SEQ ID NO: 5303744 - DNA, 14 bp, Homo sapiens
taatgtaataaagt

SEQ ID NO: 5303745 - DNA, 15 bp, Homo sapiens
taatgtaataaagtg

SEQ ID NO: 5303746 - DNA, 17 bp, Homo sapiens
taatgtaataactgtga

SEQ ID NO: 5303747 - DNA, 19 bp, Homo sapiens
taatgtaatcggcttgaat

SEQ ID NO: 5303748 - DNA, 21 bp, Homo sapiens
taatgtaatgaggtggtacta

SEQ ID NO: 5303749 - DNA, 19 bp, Homo sapiens
taatgtacaagttttgtat

SEQ ID NO: 5303750 - DNA, 21 bp, Homo sapiens
taatgtacaattttatataat

SEQ ID NO: 5303751 - DNA, 15 bp, Homo sapiens
taatgtacagaggaa

SEQ ID NO: 5303752 - DNA, 13 bp, Homo sapiens
taatgtacatagt

SEQ ID NO: 5303753 - DNA, 19 bp, Homo sapiens
taatgtacatagtgctaac

SEQ ID NO: 5303754 - DNA, 14 bp, Homo sapiens
taatgtactcacat

SEQ ID NO: 5303755 - DNA, 17 bp, Homo sapiens
taatgtactcacatata

SEQ ID NO: 5303756 - DNA, 12 bp, Homo sapiens
taatgtactgta

SEQ ID NO: 5303757 - DNA, 15 bp, Homo sapiens
taatgtactgtacat

SEQ ID NO: 5303758 - DNA, 15 bp, Homo sapiens
taatgtacttgaaaa

SEQ ID NO: 5303759 - DNA, 19 bp, Homo sapiens
taatgtactttttattgca

SEQ ID NO: 5303760 - DNA, 11 bp, Homo sapiens
taatgtagaaa

SEQ ID NO: 5303761 - DNA, 17 bp, Homo sapiens
taatgtagaaatgtttc

SEQ ID NO: 5303762 - DNA, 20 bp, Homo sapiens
taatgtagacagactttgta

SEQ ID NO: 5303763 - DNA, 16 bp, Homo sapiens
taatgtagataaagca

SEQ ID NO: 5303764 - DNA, 13 bp, Homo sapiens
taatgtagctatt

SEQ ID NO: 5303765 - DNA, 14 bp, Homo sapiens
taatgtaggactgt

SEQ ID NO: 5303766 - DNA, 19 bp, Homo sapiens
taatgtaggtttagatata

SEQ ID NO: 5303767 - DNA, 19 bp, Homo sapiens
taatgtagtatgatgtaat

SEQ ID NO: 5303768 - DNA, 15 bp, Homo sapiens
taatgtagtgcagtc

SEQ ID NO: 5303769 - DNA, 14 bp, Homo sapiens
taatgtatataaaa

SEQ ID NO: 5303770 - DNA, 23 bp, Homo sapiens
taatgtatataaactgggatgta

SEQ ID NO: 5303771 - DNA, 17 bp, Homo sapiens
taatgtatatctgtaat

SEQ ID NO: 5303772 - DNA, 17 bp, Homo sapiens
taatgtatatttgctgc

SEQ ID NO: 5303773 - DNA, 19 bp, Homo sapiens
taatgtatatttgctgcaa

SEQ ID NO: 5303774 - DNA, 10 bp, Homo sapiens
taatgtatct

SEQ ID NO: 5303775 - DNA, 15 bp, Homo sapiens
taatgtatctatttg

SEQ ID NO: 5303776 - DNA, 21 bp, Homo sapiens
taatgtatctatttgtacaat

SEQ ID NO: 5303777 - DNA, 16 bp, Homo sapiens
taattaaattttaatg

SEQ ID NO: 5303778 - DNA, 14 bp, Homo sapiens
taattaacatataa

SEQ ID NO: 5303779 - DNA, 16 bp, Homo sapiens
taattaacatatcaag

SEQ ID NO: 5303780 - DNA, 12 bp, Homo sapiens
taattaacatgt

SEQ ID NO: 5303781 - DNA, 18 bp, Homo sapiens
taattaacatgttaaacc

SEQ ID NO: 5303782 - DNA, 21 bp, Homo sapiens
taattaacatgttaaaccatg

SEQ ID NO: 5303783 - DNA, 19 bp, Homo sapiens
taattaacttaactgaaga

SEQ ID NO: 5303784 - DNA, 22 bp, Homo sapiens
taattaagaaaactattaagat

SEQ ID NO: 5303785 - DNA, 18 bp, Homo sapiens
taattaagactgaaaata

SEQ ID NO: 5303786 - DNA, 15 bp, Homo sapiens
taattaagcagaaac

SEQ ID NO: 5303787 - DNA, 17 bp, Homo sapiens
taattaagctccttcag

SEQ ID NO: 5303788 - DNA, 17 bp, Homo sapiens
taattaaggcagctgaa

SEQ ID NO: 5303789 - DNA, 19 bp, Homo sapiens
taattaagggacatgtatg

SEQ ID NO: 5303790 - DNA, 17 bp, Homo sapiens
taattaaggtacatcat

SEQ ID NO: 5303791 - DNA, 13 bp, Homo sapiens
taattaagtgcaa

SEQ ID NO: 5303792 - DNA, 15 bp, Homo sapiens
taattaataaacgaa

SEQ ID NO: 5303793 - DNA, 20 bp, Homo sapiens
taattaataaacgaagataa

SEQ ID NO: 5303794 - DNA, 15 bp, Homo sapiens
taattaatcagctcg

SEQ ID NO: 5303795 - DNA, 15 bp, Homo sapiens
taattaatcatgaat

SEQ ID NO: 5303796 - DNA, 19 bp, Homo sapiens
taattaatgaaatatctgt

SEQ ID NO: 5303797 - DNA, 16 bp, Homo sapiens
taattaatgtcatgtt

SEQ ID NO: 5303798 - DNA, 23 bp, Homo sapiens
taattaatgtgtgtctgaagact

SEQ ID NO: 5303799 - DNA, 22 bp, Homo sapiens
taattaatgtttgtgggtattt

SEQ ID NO: 5303800 - DNA, 15 bp, Homo sapiens
taattaattaaagcc

SEQ ID NO: 5303801 - DNA, 17 bp, Homo sapiens
taattaattaattaaca

SEQ ID NO: 5303802 - DNA, 19 bp, Homo sapiens
taattaattctcagattcc

SEQ ID NO: 5303803 - DNA, 13 bp, Homo sapiens
taattaatttgat

SEQ ID NO: 5303804 - DNA, 16 bp, Homo sapiens
taattaatttgattaa

SEQ ID NO: 5303805 - DNA, 23 bp, Homo sapiens
taattaatttgattaacaaatat

SEQ ID NO: 5303806 - DNA, 16 bp, Homo sapiens
taattacaatatttct

SEQ ID NO: 5303807 - DNA, 14 bp, Homo sapiens
taattacagaatat

SEQ ID NO: 5303808 - DNA, 23 bp, Homo sapiens
taattacaggagggaacatttcc

SEQ ID NO: 5303809 - DNA, 13 bp, Homo sapiens
taattacatattt

SEQ ID NO: 5303810 - DNA, 15 bp, Homo sapiens
taattacatatttga

SEQ ID NO: 5303811 - DNA, 22 bp, Homo sapiens
taattacattcctaactagaat

SEQ ID NO: 5303812 - DNA, 23 bp, Homo sapiens
taattacctggtgagtaacttag

SEQ ID NO: 5303813 - DNA, 18 bp, Homo sapiens
taattaccttattggata

SEQ ID NO: 5303814 - DNA, 23 bp, Homo sapiens
taattacgtttaaagtgcagtca

SEQ ID NO: 5303815 - DNA, 16 bp, Homo sapiens
taattactgccttgaa

SEQ ID NO: 5303816 - DNA, 22 bp, Homo sapiens
taattactgtgtgtgagccaga

SEQ ID NO: 5303817 - DNA, 13 bp, Homo sapiens
taattacttaatg

SEQ ID NO: 5303818 - DNA, 14 bp, Homo sapiens
taattacttaatgt

SEQ ID NO: 5303819 - DNA, 15 bp, Homo sapiens
taattacttaatgtg

SEQ ID NO: 5303820 - DNA, 22 bp, Homo sapiens
taattagaaacacacttttgca

SEQ ID NO: 5303821 - DNA, 19 bp, Homo sapiens
taattagaaatcaacttgt

SEQ ID NO: 5303822 - DNA, 12 bp, Homo sapiens
taattagaaatt

SEQ ID NO: 5303823 - DNA, 17 bp, Homo sapiens
taattagatccattaat

SEQ ID NO: 5303824 - DNA, 14 bp, Homo sapiens
taattagcattctg

SEQ ID NO: 5303825 - DNA, 15 bp, Homo sapiens
taattagcttttgga

SEQ ID NO: 5303826 - DNA, 16 bp, Homo sapiens
taattagcttttggag

SEQ ID NO: 5303827 - DNA, 12 bp, Homo sapiens
taattaggaatt

SEQ ID NO: 5303828 - DNA, 13 bp, Homo sapiens
taattaggaatta

SEQ ID NO: 5303829 - DNA, 17 bp, Homo sapiens
taattaggataactaaa

SEQ ID NO: 5303830 - DNA, 21 bp, Homo sapiens
taattaggataactaaaattc

SEQ ID NO: 5303831 - DNA, 20 bp, Homo sapiens
taattaggatctatgcaatt

SEQ ID NO: 5303832 - DNA, 22 bp, Homo sapiens
taattaggatctatgcaatttt

SEQ ID NO: 5303833 - DNA, 21 bp, Homo sapiens
taattaggcaaggctatgtga

SEQ ID NO: 5303834 - DNA, 18 bp, Homo sapiens
taattagggtacatttat

SEQ ID NO: 5303835 - DNA, 17 bp, Homo sapiens
taattaggttaactatg

SEQ ID NO: 5303836 - DNA, 22 bp, Homo sapiens
taattaggttaactatgtacaa

SEQ ID NO: 5303837 - DNA, 19 bp, Homo sapiens
taattagtgccacttaatg

SEQ ID NO: 5303838 - DNA, 13 bp, Homo sapiens
taattagtgtcca

SEQ ID NO: 5303839 - DNA, 23 bp, Homo sapiens
taattagttcctcattagcattt

SEQ ID NO: 5303840 - DNA, 14 bp, Homo sapiens
taattataggaagt

SEQ ID NO: 5303841 - DNA, 16 bp, Homo sapiens
taattatatattttgt

SEQ ID NO: 5303842 - DNA, 13 bp, Homo sapiens
taattatatctga

SEQ ID NO: 5303843 - DNA, 17 bp, Homo sapiens
taattatatctgaggaa

SEQ ID NO: 5303844 - DNA, 23 bp, Homo sapiens
taattatatctgaggaattctgt

SEQ ID NO: 5303845 - DNA, 14 bp, Homo sapiens
taattatatgctat

SEQ ID NO: 5303846 - DNA, 19 bp, Homo sapiens
taattatatgctatttcta

SEQ ID NO: 5303847 - DNA, 20 bp, Homo sapiens
taattatatgtatattgtct

SEQ ID NO: 5303848 - DNA, 22 bp, Homo sapiens
taattatcacaatgtactatat

SEQ ID NO: 5303849 - DNA, 15 bp, Homo sapiens
taattatcagttggt

SEQ ID NO: 5303850 - DNA, 20 bp, Homo sapiens
taattatcctcaagttgtgt

SEQ ID NO: 5303851 - DNA, 17 bp, Homo sapiens
taattatcggaagcagt

SEQ ID NO: 5303852 - DNA, 19 bp, Homo sapiens
taattatcgggaacagtgt

SEQ ID NO: 5303853 - DNA, 19 bp, Homo sapiens
taattatctcctaattgta

SEQ ID NO: 5303854 - DNA, 22 bp, Homo sapiens
taattatctcctaattgtatgt

SEQ ID NO: 5303855 - DNA, 12 bp, Homo sapiens
taattatctgat

SEQ ID NO: 5303856 - DNA, 14 bp, Homo sapiens
taattatgaaaact

SEQ ID NO: 5303857 - DNA, 13 bp, Homo sapiens
taattatgacagt

SEQ ID NO: 5303858 - DNA, 17 bp, Homo sapiens
taattatggagtcattt

SEQ ID NO: 5303859 - DNA, 21 bp, Homo sapiens
taattatgggaacaagtgtac

SEQ ID NO: 5303860 - DNA, 18 bp, Homo sapiens
taattatgtaaataactc

SEQ ID NO: 5303861 - DNA, 16 bp, Homo sapiens
taattatgtaacctat

SEQ ID NO: 5303862 - DNA, 20 bp, Homo sapiens
taattatgtaacctatttat

SEQ ID NO: 5303863 - DNA, 23 bp, Homo sapiens
taattatgtaccatgaatattta

SEQ ID NO: 5303864 - DNA, 14 bp, Homo sapiens
taattatgtagctc

SEQ ID NO: 5303865 - DNA, 22 bp, Homo sapiens
taattatgtgatataaaatatt

SEQ ID NO: 5303866 - DNA, 15 bp, Homo sapiens
taattatgttattga

SEQ ID NO: 5303867 - DNA, 15 bp, Homo sapiens
taattattataaaaa

SEQ ID NO: 5303868 - DNA, 18 bp, Homo sapiens
taattattataaaaatat

SEQ ID NO: 5303869 - DNA, 12 bp, Homo sapiens
taattattattt

SEQ ID NO: 5303870 - DNA, 17 bp, Homo sapiens
taattattatttccagt

SEQ ID NO: 5303871 - DNA, 14 bp, Homo sapiens
taattattccttct

SEQ ID NO: 5303872 - DNA, 16 bp, Homo sapiens
taattattgatgtttt

SEQ ID NO: 5303873 - DNA, 18 bp, Homo sapiens
taattattgatgttttca

SEQ ID NO: 5303874 - DNA, 15 bp, Homo sapiens
taattattgtaatgt

SEQ ID NO: 5303875 - DNA, 15 bp, Homo sapiens
taattattgtttata

SEQ ID NO: 5303876 - DNA, 15 bp, Homo sapiens
taattatttaaatgt

SEQ ID NO: 5303877 - DNA, 17 bp, Homo sapiens
taattatttaaatgtac

SEQ ID NO: 5303878 - DNA, 16 bp, Homo sapiens
taattatttatgtatg

SEQ ID NO: 5303879 - DNA, 18 bp, Homo sapiens
taattatttcactttaga

SEQ ID NO: 5303880 - DNA, 19 bp, Homo sapiens
taattatttctaacactag

SEQ ID NO: 5303881 - DNA, 13 bp, Homo sapiens
taattatttgaat

SEQ ID NO: 5303882 - DNA, 14 bp, Homo sapiens
taattattttaaaa

SEQ ID NO: 5303883 - DNA, 14 bp, Homo sapiens
taattattttaatt

SEQ ID NO: 5303884 - DNA, 19 bp, Homo sapiens
taattattttccaaaatct

SEQ ID NO: 5303885 - DNA, 14 bp, Homo sapiens
taattattttctga

SEQ ID NO: 5303886 - DNA, 18 bp, Homo sapiens
taattatttttaatttaa

SEQ ID NO: 5303887 - DNA, 19 bp, Homo sapiens
taattcaaagcaccaaaat

SEQ ID NO: 5303888 - DNA, 15 bp, Homo sapiens
taattcaaatggctt

SEQ ID NO: 5303889 - DNA, 21 bp, Homo sapiens
taattcaaatggcttaagcaa

SEQ ID NO: 5303890 - DNA, 22 bp, Homo sapiens
taattcaaatggcttaagcaat

SEQ ID NO: 5303891 - DNA, 12 bp, Homo sapiens
taattcaacatc

SEQ ID NO: 5303892 - DNA, 13 bp, Homo sapiens
taattcaagaaaa

SEQ ID NO: 5303893 - DNA, 15 bp, Homo sapiens
taattcaagctttcc

SEQ ID NO: 5303894 - DNA, 20 bp, Homo sapiens
taattcaaggagaatatgat

SEQ ID NO: 5303895 - DNA, 14 bp, Homo sapiens
taattcaatgaaat

SEQ ID NO: 5303896 - DNA, 13 bp, Homo sapiens
taattcaatttct

SEQ ID NO: 5303897 - DNA, 16 bp, Homo sapiens
taattcaatttctcac

SEQ ID NO: 5303898 - DNA, 21 bp, Homo sapiens
taattcacagtgctcttttct

SEQ ID NO: 5303899 - DNA, 17 bp, Homo sapiens
taattcaccaaagtatt

SEQ ID NO: 5303900 - DNA, 23 bp, Homo sapiens
taattcacctatgttattttgtg

SEQ ID NO: 5303901 - DNA, 14 bp, Homo sapiens
taattcacctcagc

SEQ ID NO: 5303902 - DNA, 21 bp, Homo sapiens
taattcactcaagcactgata

SEQ ID NO: 5303903 - DNA, 20 bp, Homo sapiens
taattcactgtactatcagg

SEQ ID NO: 5303904 - DNA, 21 bp, Homo sapiens
taattcagaaaacataatata

SEQ ID NO: 5303905 - DNA, 18 bp, Homo sapiens
taattcagaaatccttgt

SEQ ID NO: 5303906 - DNA, 18 bp, Homo sapiens
taattcagaactaaattt

SEQ ID NO: 5303907 - DNA, 23 bp, Homo sapiens
taattcagagtggtttcattgcc

SEQ ID NO: 5303908 - DNA, 19 bp, Homo sapiens
taattcagcactgatttca

SEQ ID NO: 5303909 - DNA, 19 bp, Homo sapiens
taattcagcgttatttaag

SEQ ID NO: 5303910 - DNA, 13 bp, Homo sapiens
taattcaggactc

SEQ ID NO: 5303911 - DNA, 17 bp, Homo sapiens
taattcaggcacatgtg

SEQ ID NO: 5303912 - DNA, 23 bp, Homo sapiens
taattcagggtggtaaagtatgt

SEQ ID NO: 5303913 - DNA, 20 bp, Homo sapiens
taattcaggtgataactcac

SEQ ID NO: 5303914 - DNA, 14 bp, Homo sapiens
taattcaggttttt

SEQ ID NO: 5303915 - DNA, 17 bp, Homo sapiens
taattcaggtttttcct

SEQ ID NO: 5303916 - DNA, 19 bp, Homo sapiens
taattcagtacaacccata

SEQ ID NO: 5303917 - DNA, 21 bp, Homo sapiens
taattcagtatgttttacact

SEQ ID NO: 5303918 - DNA, 12 bp, Homo sapiens
taattcataatt

SEQ ID NO: 5303919 - DNA, 15 bp, Homo sapiens
taattcataattaga

SEQ ID NO: 5303920 - DNA, 21 bp, Homo sapiens
taattcataattagaacaata

SEQ ID NO: 5303921 - DNA, 15 bp, Homo sapiens
taattcatatctaaa

SEQ ID NO: 5303922 - DNA, 18 bp, Homo sapiens
taattcatatctaaatag

SEQ ID NO: 5303923 - DNA, 13 bp, Homo sapiens
taattcatatttt

SEQ ID NO: 5303924 - DNA, 19 bp, Homo sapiens
taattcatatttttcctta

SEQ ID NO: 5303925 - DNA, 12 bp, Homo sapiens
taattcatcttt

SEQ ID NO: 5303926 - DNA, 15 bp, Homo sapiens
taattcatcttttaa

SEQ ID NO: 5303927 - DNA, 14 bp, Homo sapiens
taattcatgtttct

SEQ ID NO: 5303928 - DNA, 15 bp, Homo sapiens
taattcatgtttctt

SEQ ID NO: 5303929 - DNA, 17 bp, Homo sapiens
taattcatttaagaaca

SEQ ID NO: 5303930 - DNA, 19 bp, Homo sapiens
taattcatttgtattgctt

SEQ ID NO: 5303931 - DNA, 23 bp, Homo sapiens
taattccaagattaaaagttcat

SEQ ID NO: 5303932 - DNA, 19 bp, Homo sapiens
taattccaatatgatgact

SEQ ID NO: 5303933 - DNA, 20 bp, Homo sapiens
taattccaatatgatgactc

SEQ ID NO: 5303934 - DNA, 15 bp, Homo sapiens
taattccacaccttt

SEQ ID NO: 5303935 - DNA, 13 bp, Homo sapiens
taattccacagct

SEQ ID NO: 5303936 - DNA, 10 bp, Homo sapiens
taattccatg

SEQ ID NO: 5303937 - DNA, 20 bp, Homo sapiens
taattccatgtcagataagt

SEQ ID NO: 5303938 - DNA, 22 bp, Homo sapiens
taattccatgtcagataagtgt

SEQ ID NO: 5303939 - DNA, 19 bp, Homo sapiens
taattcccaacatttctta

SEQ ID NO: 5303940 - DNA, 22 bp, Homo sapiens
taattcccatctgctttattgc

SEQ ID NO: 5303941 - DNA, 16 bp, Homo sapiens
taattcccattttgca

SEQ ID NO: 5303942 - DNA, 19 bp, Homo sapiens
taattcccattttgcaaaa

SEQ ID NO: 5303943 - DNA, 21 bp, Homo sapiens
taattcccattttgcaaaatt

SEQ ID NO: 5303944 - DNA, 23 bp, Homo sapiens
taattcccattttgcaaaatttc

SEQ ID NO: 5303945 - DNA, 15 bp, Homo sapiens
taattccctatcttt

SEQ ID NO: 5303946 - DNA, 13 bp, Homo sapiens
taattcctacagc

SEQ ID NO: 5303947 - DNA, 19 bp, Homo sapiens
taattcctacctccctgca

SEQ ID NO: 5303948 - DNA, 15 bp, Homo sapiens
taattcctcagttat

SEQ ID NO: 5303949 - DNA, 19 bp, Homo sapiens
taattcctctagctaccat

SEQ ID NO: 5303950 - DNA, 15 bp, Homo sapiens
taattcctcttttta

SEQ ID NO: 5303951 - DNA, 15 bp, Homo sapiens
taattcctggcatga

SEQ ID NO: 5303952 - DNA, 21 bp, Homo sapiens
taattccttaaatgaactact

SEQ ID NO: 5303953 - DNA, 23 bp, Homo sapiens
taattccttaaatgaactactgc

SEQ ID NO: 5303954 - DNA, 20 bp, Homo sapiens
taattccttatcctagcctt

SEQ ID NO: 5303955 - DNA, 16 bp, Homo sapiens
taatttgtatgctaaa

SEQ ID NO: 5303956 - DNA, 22 bp, Homo sapiens
taatttgtatgctaaatgagga

SEQ ID NO: 5303957 - DNA, 15 bp, Homo sapiens
taatttgtcactgga

SEQ ID NO: 5303958 - DNA, 23 bp, Homo sapiens
taatttgtgaaagtggcaagctc

SEQ ID NO: 5303959 - DNA, 20 bp, Homo sapiens
taatttgtgaatttgcaaca

SEQ ID NO: 5303960 - DNA, 14 bp, Homo sapiens
taatttgtgataca

SEQ ID NO: 5303961 - DNA, 22 bp, Homo sapiens
taatttgtgatacaatgctgtg

SEQ ID NO: 5303962 - DNA, 22 bp, Homo sapiens
taatttgtgcatcagaaaatgc

SEQ ID NO: 5303963 - DNA, 23 bp, Homo sapiens
taatttgtgcatcagaaaatgca

SEQ ID NO: 5303964 - DNA, 13 bp, Homo sapiens
taatttgtgtaat

SEQ ID NO: 5303965 - DNA, 15 bp, Homo sapiens
taatttgtgtgtttt

SEQ ID NO: 5303966 - DNA, 15 bp, Homo sapiens
taatttgttatatca

SEQ ID NO: 5303967 - DNA, 21 bp, Homo sapiens
taatttgttggggctttacat

SEQ ID NO: 5303968 - DNA, 15 bp, Homo sapiens
taatttgttgtactt

SEQ ID NO: 5303969 - DNA, 19 bp, Homo sapiens
taatttgttgtacttttta

SEQ ID NO: 5303970 - DNA, 12 bp, Homo sapiens
taatttgtttcc

SEQ ID NO: 5303971 - DNA, 21 bp, Homo sapiens
taatttgtttttcttatccaa

SEQ ID NO: 5303972 - DNA, 18 bp, Homo sapiens
taattttaaaagttggga

SEQ ID NO: 5303973 - DNA, 15 bp, Homo sapiens
taattttaaaatgtt

SEQ ID NO: 5303974 - DNA, 23 bp, Homo sapiens
taattttaaagtaatttctaaag

SEQ ID NO: 5303975 - DNA, 19 bp, Homo sapiens
taattttaaataatttcta

SEQ ID NO: 5303976 - DNA, 13 bp, Homo sapiens
taattttaaattc

SEQ ID NO: 5303977 - DNA, 13 bp, Homo sapiens
taattttaacatc

SEQ ID NO: 5303978 - DNA, 14 bp, Homo sapiens
taattttaaccaaa

SEQ ID NO: 5303979 - DNA, 12 bp, Homo sapiens
taattttaactg

SEQ ID NO: 5303980 - DNA, 12 bp, Homo sapiens
taattttaatat

SEQ ID NO: 5303981 - DNA, 14 bp, Homo sapiens
taattttaatggct

SEQ ID NO: 5303982 - DNA, 18 bp, Homo sapiens
taattttacacgcttttg

SEQ ID NO: 5303983 - DNA, 19 bp, Homo sapiens
taattttacacgcttttgt

SEQ ID NO: 5303984 - DNA, 21 bp, Homo sapiens
taattttacacgcttttgtga

SEQ ID NO: 5303985 - DNA, 17 bp, Homo sapiens
taattttacagcccttg

SEQ ID NO: 5303986 - DNA, 15 bp, Homo sapiens
taattttacatgtct

SEQ ID NO: 5303987 - DNA, 14 bp, Homo sapiens
taattttacttttt

SEQ ID NO: 5303988 - DNA, 13 bp, Homo sapiens
taattttagaaag

SEQ ID NO: 5303989 - DNA, 19 bp, Homo sapiens
taattttagaaagaaaatt

SEQ ID NO: 5303990 - DNA, 23 bp, Homo sapiens
taattttagaaagaaaattatat

SEQ ID NO: 5303991 - DNA, 19 bp, Homo sapiens
taattttagtaatttccta

SEQ ID NO: 5303992 - DNA, 19 bp, Homo sapiens
taattttagtgacagctct

SEQ ID NO: 5303993 - DNA, 19 bp, Homo sapiens
taattttagtttttcatta

SEQ ID NO: 5303994 - DNA, 21 bp, Homo sapiens
taattttagtttttcattaaa

SEQ ID NO: 5303995 - DNA, 15 bp, Homo sapiens
taattttatagaaaa

SEQ ID NO: 5303996 - DNA, 12 bp, Homo sapiens
taattttattat

SEQ ID NO: 5303997 - DNA, 20 bp, Homo sapiens
taattttattattagattct

SEQ ID NO: 5303998 - DNA, 14 bp, Homo sapiens
taattttattcatt

SEQ ID NO: 5303999 - DNA, 19 bp, Homo sapiens
taattttattttaaaattt

SEQ ID NO: 5304000 - DNA, 14 bp, Homo sapiens
taattttattttgt

SEQ ID NO: 5304001 - DNA, 19 bp, Homo sapiens
taattttcaagagaagaaa

SEQ ID NO: 5304002 - DNA, 14 bp, Homo sapiens
taattttcacaaaa

SEQ ID NO: 5304003 - DNA, 19 bp, Homo sapiens
taattttcacaaaatgtct

SEQ ID NO: 5304004 - DNA, 13 bp, Homo sapiens
taattttcccaat

SEQ ID NO: 5304005 - DNA, 17 bp, Homo sapiens
taattttcctaataaag

SEQ ID NO: 5304006 - DNA, 20 bp, Homo sapiens
taattttcctctaattaaaa

SEQ ID NO: 5304007 - DNA, 16 bp, Homo sapiens
taattttcctgtgaca

SEQ ID NO: 5304008 - DNA, 22 bp, Homo sapiens
taattttcctttaatatgaaat

SEQ ID NO: 5304009 - DNA, 17 bp, Homo sapiens
taattttcctttgtcat

SEQ ID NO: 5304010 - DNA, 10 bp, Homo sapiens
taattttcta

SEQ ID NO: 5304011 - DNA, 12 bp, Homo sapiens
taattttctaaa

SEQ ID NO: 5304012 - DNA, 22 bp, Homo sapiens
taattttctcaaaagcatttat

SEQ ID NO: 5304013 - DNA, 20 bp, Homo sapiens
taattttctctttaggagaa

SEQ ID NO: 5304014 - DNA, 21 bp, Homo sapiens
taattttctctttaggagaaa

SEQ ID NO: 5304015 - DNA, 22 bp, Homo sapiens
taattttctctttgtatgtctg

SEQ ID NO: 5304016 - DNA, 14 bp, Homo sapiens
taattttcttgatg

SEQ ID NO: 5304017 - DNA, 23 bp, Homo sapiens
taattttcttgatgactggaatt

SEQ ID NO: 5304018 - DNA, 14 bp, Homo sapiens
taattttctttatg

SEQ ID NO: 5304019 - DNA, 14 bp, Homo sapiens
taattttgaactgt

SEQ ID NO: 5304020 - DNA, 18 bp, Homo sapiens
taattttgaagtgctgtt

SEQ ID NO: 5304021 - DNA, 17 bp, Homo sapiens
taattttgacactgaaa

SEQ ID NO: 5304022 - DNA, 20 bp, Homo sapiens
taattttgacactgaaataa

SEQ ID NO: 5304023 - DNA, 22 bp, Homo sapiens
taattttgaccataaattaatt

SEQ ID NO: 5304024 - DNA, 19 bp, Homo sapiens
taattttgatatattcaaa

SEQ ID NO: 5304025 - DNA, 13 bp, Homo sapiens
taattttgatttc

SEQ ID NO: 5304026 - DNA, 18 bp, Homo sapiens
taattttgcaaatctgtt

SEQ ID NO: 5304027 - DNA, 18 bp, Homo sapiens
taattttgcatactgaaa

SEQ ID NO: 5304028 - DNA, 22 bp, Homo sapiens
taattttgccacagggtactaa

SEQ ID NO: 5304029 - DNA, 13 bp, Homo sapiens
taattttgctaac

SEQ ID NO: 5304030 - DNA, 15 bp, Homo sapiens
taattttgctaactg

SEQ ID NO: 5304031 - DNA, 20 bp, Homo sapiens
taattttgctaactgggtta

SEQ ID NO: 5304032 - DNA, 15 bp, Homo sapiens
taattttggaataat

SEQ ID NO: 5304033 - DNA, 23 bp, Homo sapiens
taattttggtccaaattctttat

SEQ ID NO: 5304034 - DNA, 14 bp, Homo sapiens
taattttggttgta

SEQ ID NO: 5304035 - DNA, 21 bp, Homo sapiens
taattttggttgtaattaaat

SEQ ID NO: 5304036 - DNA, 17 bp, Homo sapiens
taattttggttgtattc

SEQ ID NO: 5304037 - DNA, 18 bp, Homo sapiens
taattttggttgtattct

SEQ ID NO: 5304038 - DNA, 22 bp, Homo sapiens
taattttggttgtattctttga

SEQ ID NO: 5304039 - DNA, 12 bp, Homo sapiens
taattttgtaat

SEQ ID NO: 5304040 - DNA, 15 bp, Homo sapiens
taattttgtagtagt

SEQ ID NO: 5304041 - DNA, 19 bp, Homo sapiens
taattttgtagtagttgat

SEQ ID NO: 5304042 - DNA, 14 bp, Homo sapiens
taattttgtatctt

SEQ ID NO: 5304043 - DNA, 13 bp, Homo sapiens
taattttgtattt

SEQ ID NO: 5304044 - DNA, 18 bp, Homo sapiens
taattttgtattttccaa

SEQ ID NO: 5304045 - DNA, 21 bp, Homo sapiens
taattttgtattttccaagtg

SEQ ID NO: 5304046 - DNA, 14 bp, Homo sapiens
taattttgtgcatt

SEQ ID NO: 5304047 - DNA, 18 bp, Homo sapiens
taattttgtgcattcttt

SEQ ID NO: 5304048 - DNA, 20 bp, Homo sapiens
taattttgtgcattctttgg

SEQ ID NO: 5304049 - DNA, 22 bp, Homo sapiens
taattttgtgcattctttggta

SEQ ID NO: 5304050 - DNA, 19 bp, Homo sapiens
taattttgtgctctttcct

SEQ ID NO: 5304051 - DNA, 11 bp, Homo sapiens
taattttgtgt

SEQ ID NO: 5304052 - DNA, 22 bp, Homo sapiens
taattttgtgttgtacaattaa

SEQ ID NO: 5304053 - DNA, 21 bp, Homo sapiens
taattttgttaagaatttcaa

SEQ ID NO: 5304054 - DNA, 18 bp, Homo sapiens
taatttttaaaagacttt

SEQ ID NO: 5304055 - DNA, 17 bp, Homo sapiens
taatttttaaaagagga

SEQ ID NO: 5304056 - DNA, 18 bp, Homo sapiens
taatttttaaatgtttat

SEQ ID NO: 5304057 - DNA, 12 bp, Homo sapiens
taatttttaact

SEQ ID NO: 5304058 - DNA, 13 bp, Homo sapiens
taatttttaactt

SEQ ID NO: 5304059 - DNA, 16 bp, Homo sapiens
taatttttacagaatt

SEQ ID NO: 5304060 - DNA, 17 bp, Homo sapiens
taatttttacagaattg

SEQ ID NO: 5304061 - DNA, 22 bp, Homo sapiens
taatttttacagaattgcttgt

SEQ ID NO: 5304062 - DNA, 15 bp, Homo sapiens
taatttttacctaat

SEQ ID NO: 5304063 - DNA, 16 bp, Homo sapiens
taatttttacctaatc

SEQ ID NO: 5304064 - DNA, 15 bp, Homo sapiens
taatttttataaata

SEQ ID NO: 5304065 - DNA, 22 bp, Homo sapiens
taatttttataaatatgtgaaa

SEQ ID NO: 5304066 - DNA, 17 bp, Homo sapiens
taatttttatactgaca

SEQ ID NO: 5304067 - DNA, 12 bp, Homo sapiens
taatttttatat

SEQ ID NO: 5304068 - DNA, 16 bp, Homo sapiens
taatttttatatttga

SEQ ID NO: 5304069 - DNA, 17 bp, Homo sapiens
taatttttatatttgaa

SEQ ID NO: 5304070 - DNA, 23 bp, Homo sapiens
taatttttattatgaaactttcc

SEQ ID NO: 5304071 - DNA, 23 bp, Homo sapiens
taatttttatttttggcaaagcc

SEQ ID NO: 5304072 - DNA, 17 bp, Homo sapiens
taatttttcacttcaaa

SEQ ID NO: 5304073 - DNA, 22 bp, Homo sapiens
taatttttcatatatatttgtt

SEQ ID NO: 5304074 - DNA, 13 bp, Homo sapiens
taatttttccaac

SEQ ID NO: 5304075 - DNA, 14 bp, Homo sapiens
taatttttccaact

SEQ ID NO: 5304076 - DNA, 16 bp, Homo sapiens
taatttttcctatatt

SEQ ID NO: 5304077 - DNA, 15 bp, Homo sapiens
taatttttcctgcat

SEQ ID NO: 5304078 - DNA, 12 bp, Homo sapiens
taatttttctgt

SEQ ID NO: 5304079 - DNA, 21 bp, Homo sapiens
taatttttcttacacatttta

SEQ ID NO: 5304080 - DNA, 20 bp, Homo sapiens
taatttttgatactaagcat

SEQ ID NO: 5304081 - DNA, 23 bp, Homo sapiens
taatttttgatactaagcattga

SEQ ID NO: 5304082 - DNA, 15 bp, Homo sapiens
taatttttgcagaaa

SEQ ID NO: 5304083 - DNA, 16 bp, Homo sapiens
taatttttgctctaga

SEQ ID NO: 5304084 - DNA, 17 bp, Homo sapiens
taatttttgcttaacat

SEQ ID NO: 5304085 - DNA, 18 bp, Homo sapiens
taatttttgcttaacatt

SEQ ID NO: 5304086 - DNA, 15 bp, Homo sapiens
taatttttgctttta

SEQ ID NO: 5304087 - DNA, 21 bp, Homo sapiens
taatttttggagaaatgtcat

SEQ ID NO: 5304088 - DNA, 23 bp, Homo sapiens
taatttttggggaaaaaagcaca

SEQ ID NO: 5304089 - DNA, 13 bp, Homo sapiens
taatttttgtaca

SEQ ID NO: 5304090 - DNA, 14 bp, Homo sapiens
taatttttgtacat

SEQ ID NO: 5304091 - DNA, 21 bp, Homo sapiens
taatttttgtacattacacta

SEQ ID NO: 5304092 - DNA, 23 bp, Homo sapiens
taatttttgtacattacactaaa

SEQ ID NO: 5304093 - DNA, 15 bp, Homo sapiens
taatttttgtagaga

SEQ ID NO: 5304094 - DNA, 21 bp, Homo sapiens
taatttttgtattatttttgt

SEQ ID NO: 5304095 - DNA, 15 bp, Homo sapiens
taatttttgtatttt

SEQ ID NO: 5304096 - DNA, 21 bp, Homo sapiens
taatttttgtatttttagtag

SEQ ID NO: 5304097 - DNA, 19 bp, Homo sapiens
taattttttaaagaatcca

SEQ ID NO: 5304098 - DNA, 19 bp, Homo sapiens
taattttttaaatgaaaat

SEQ ID NO: 5304099 - DNA, 21 bp, Homo sapiens
taattttttaaatgaaaatgt

SEQ ID NO: 5304100 - DNA, 14 bp, Homo sapiens
taattttttaatta

SEQ ID NO: 5304101 - DNA, 18 bp, Homo sapiens
taattttttagttaaaat

SEQ ID NO: 5304102 - DNA, 15 bp, Homo sapiens
taattttttcttaag

SEQ ID NO: 5304103 - DNA, 18 bp, Homo sapiens
taattttttgcagtcttt

SEQ ID NO: 5304104 - DNA, 22 bp, Homo sapiens
taattttttgcagtcttttgct

SEQ ID NO: 5304105 - DNA, 20 bp, Homo sapiens
taatttttttaaccaaaggt

SEQ ID NO: 5304106 - DNA, 21 bp, Homo sapiens
taatttttttaaccaaaggtg

SEQ ID NO: 5304107 - DNA, 22 bp, Homo sapiens
taatttttttaaccaaaggtga

SEQ ID NO: 5304108 - DNA, 16 bp, Homo sapiens
taatttttttaagttc

SEQ ID NO: 5304109 - DNA, 17 bp, Homo sapiens
taatttttttattgttt

SEQ ID NO: 5304110 - DNA, 16 bp, Homo sapiens
taatttttttcttgta

SEQ ID NO: 5304111 - DNA, 19 bp, Homo sapiens
taatttttttcttgtagta

SEQ ID NO: 5304112 - DNA, 13 bp, Homo sapiens
taatttttttgaa

SEQ ID NO: 5304113 - DNA, 14 bp, Homo sapiens
taatttttttgaaa

SEQ ID NO: 5304114 - DNA, 17 bp, Homo sapiens
taattttttttaaaata

SEQ ID NO: 5304115 - DNA, 16 bp, Homo sapiens
taattttttttaatgt

SEQ ID NO: 5304116 - DNA, 16 bp, Homo sapiens
taattttttttagtat

SEQ ID NO: 5304117 - DNA, 21 bp, Homo sapiens
taattttttttgttttttgta

SEQ ID NO: 5304118 - DNA, 22 bp, Homo sapiens
taattttttttttccttttaaa

SEQ ID NO: 5304119 - DNA, 17 bp, Homo sapiens
taattttttttttctca

SEQ ID NO: 5304120 - DNA, 21 bp, Homo sapiens
tacaaaaaaaaaaaaaaatta

SEQ ID NO: 5304121 - DNA, 19 bp, Homo sapiens
tacaaaaaaaaagttttat

SEQ ID NO: 5304122 - DNA, 19 bp, Homo sapiens
tacaaaaaaaatctttaat

SEQ ID NO: 5304123 - DNA, 17 bp, Homo sapiens
tacaaaaaaccaggatg

SEQ ID NO: 5304124 - DNA, 19 bp, Homo sapiens
tacaaaaaagttataagaa

SEQ ID NO: 5304125 - DNA, 22 bp, Homo sapiens
tacaaaaaagtttaagattgca

SEQ ID NO: 5304126 - DNA, 15 bp, Homo sapiens
tacaaaaacaaaaca

SEQ ID NO: 5304127 - DNA, 13 bp, Homo sapiens
tacaaaaacacaa

SEQ ID NO: 5304128 - DNA, 17 bp, Homo sapiens
tacaaaaacacagcaag

SEQ ID NO: 5304129 - DNA, 13 bp, Homo sapiens
tacaaaaacactt

SEQ ID NO: 5304130 - DNA, 19 bp, Homo sapiens
tacaaaaactttttgttgt

SEQ ID NO: 5304131 - DNA, 13 bp, Homo sapiens
tacaaaaagaaaa

SEQ ID NO: 5304132 - DNA, 14 bp, Homo sapiens
tacaaccatatatt

SEQ ID NO: 5304133 - DNA, 18 bp, Homo sapiens
tacaacccataatcatgt

SEQ ID NO: 5304134 - DNA, 16 bp, Homo sapiens
tacaaccctaccctgg

SEQ ID NO: 5304135 - DNA, 17 bp, Homo sapiens
tacaaccggttatcagt

SEQ ID NO: 5304136 - DNA, 15 bp, Homo sapiens
tacaacctatgtaat

SEQ ID NO: 5304137 - DNA, 20 bp, Homo sapiens
tacaacctccaccttccagg

SEQ ID NO: 5304138 - DNA, 15 bp, Homo sapiens
tacaacctccctctt

SEQ ID NO: 5304139 - DNA, 22 bp, Homo sapiens
tacaacctccctcttgttttgt

SEQ ID NO: 5304140 - DNA, 12 bp, Homo sapiens
tacaacctgctt

SEQ ID NO: 5304141 - DNA, 20 bp, Homo sapiens
tacaacctggaaaataaatc

SEQ ID NO: 5304142 - DNA, 15 bp, Homo sapiens
tacaacggaggcctg

SEQ ID NO: 5304143 - DNA, 15 bp, Homo sapiens
tacaacggagtcaaa

SEQ ID NO: 5304144 - DNA, 20 bp, Homo sapiens
tacaactaaataacacagat

SEQ ID NO: 5304145 - DNA, 18 bp, Homo sapiens
tacaactatgtaatttat

SEQ ID NO: 5304146 - DNA, 17 bp, Homo sapiens
tacaactcattccagat

SEQ ID NO: 5304147 - DNA, 18 bp, Homo sapiens
tacaactcattccagatc

SEQ ID NO: 5304148 - DNA, 20 bp, Homo sapiens
tacaactcattccagatccc

SEQ ID NO: 5304149 - DNA, 15 bp, Homo sapiens
tacaactcccccacc

SEQ ID NO: 5304150 - DNA, 12 bp, Homo sapiens
tacaactgaaac

SEQ ID NO: 5304151 - DNA, 17 bp, Homo sapiens
tacaactgattgcaaca

SEQ ID NO: 5304152 - DNA, 23 bp, Homo sapiens
tacaactgcctcgaaacacagaa

SEQ ID NO: 5304153 - DNA, 17 bp, Homo sapiens
tacaactgtaaagcaaa

SEQ ID NO: 5304154 - DNA, 18 bp, Homo sapiens
tacaacttccagatttga

SEQ ID NO: 5304155 - DNA, 22 bp, Homo sapiens
tacaacttctccttagacactt

SEQ ID NO: 5304156 - DNA, 18 bp, Homo sapiens
tacaacttgatactttta

SEQ ID NO: 5304157 - DNA, 18 bp, Homo sapiens
tacaacttgtatttccaa

SEQ ID NO: 5304158 - DNA, 16 bp, Homo sapiens
tacaactttcatttaa

SEQ ID NO: 5304159 - DNA, 15 bp, Homo sapiens
tacaacttttgtttt

SEQ ID NO: 5304160 - DNA, 14 bp, Homo sapiens
tacaagaaaaagta

SEQ ID NO: 5304161 - DNA, 19 bp, Homo sapiens
tacaagaaaaagtagaaaa

SEQ ID NO: 5304162 - DNA, 14 bp, Homo sapiens
tacaagaagcattt

SEQ ID NO: 5304163 - DNA, 15 bp, Homo sapiens
tacaagaagcatttt

SEQ ID NO: 5304164 - DNA, 19 bp, Homo sapiens
tacaagaagcattttgtaa

SEQ ID NO: 5304165 - DNA, 16 bp, Homo sapiens
tacaagacctctggct

SEQ ID NO: 5304166 - DNA, 23 bp, Homo sapiens
tacaagacggggagtgagactcc

SEQ ID NO: 5304167 - DNA, 15 bp, Homo sapiens
tacaagactaacctt

SEQ ID NO: 5304168 - DNA, 14 bp, Homo sapiens
tacaagactgtaaa

SEQ ID NO: 5304169 - DNA, 15 bp, Homo sapiens
tacaagactgtaaat

SEQ ID NO: 5304170 - DNA, 14 bp, Homo sapiens
tacaagactgttgt

SEQ ID NO: 5304171 - DNA, 23 bp, Homo sapiens
tacaagagaaaaagcagaggcca

SEQ ID NO: 5304172 - DNA, 16 bp, Homo sapiens
tacaagagagtgaaat

SEQ ID NO: 5304173 - DNA, 20 bp, Homo sapiens
tacaagagcagcctgtggca

SEQ ID NO: 5304174 - DNA, 22 bp, Homo sapiens
tacaagagccatgtaccagtgt

SEQ ID NO: 5304175 - DNA, 20 bp, Homo sapiens
tacaagagggcaaagctgat

SEQ ID NO: 5304176 - DNA, 16 bp, Homo sapiens
tacaagagtccctttg

SEQ ID NO: 5304177 - DNA, 23 bp, Homo sapiens
tacaagagtggagagaagctctt

SEQ ID NO: 5304178 - DNA, 12 bp, Homo sapiens
tacaagataaaa

SEQ ID NO: 5304179 - DNA, 22 bp, Homo sapiens
tacaagatattatgtataaaat

SEQ ID NO: 5304180 - DNA, 17 bp, Homo sapiens
tacaagatattgatgat

SEQ ID NO: 5304181 - DNA, 21 bp, Homo sapiens
tacaagatccatttgcctttc

SEQ ID NO: 5304182 - DNA, 23 bp, Homo sapiens
tacaagatggcgaccaccaaagt

SEQ ID NO: 5304183 - DNA, 15 bp, Homo sapiens
tacaagattgaaaat

SEQ ID NO: 5304184 - DNA, 17 bp, Homo sapiens
tacaagatttagaaaaa

SEQ ID NO: 5304185 - DNA, 12 bp, Homo sapiens
tacaagatttcc

SEQ ID NO: 5304186 - DNA, 15 bp, Homo sapiens
tacaagcaagcaaaa

SEQ ID NO: 5304187 - DNA, 21 bp, Homo sapiens
tacaagcaagcaaaattattt

SEQ ID NO: 5304188 - DNA, 13 bp, Homo sapiens
tacaagcaggcac

SEQ ID NO: 5304189 - DNA, 17 bp, Homo sapiens
tacaagcagttaatcac

SEQ ID NO: 5304190 - DNA, 18 bp, Homo sapiens
tacaagcatatttgagaa

SEQ ID NO: 5304191 - DNA, 21 bp, Homo sapiens
tacaagcatttgccctgtgga

SEQ ID NO: 5304192 - DNA, 14 bp, Homo sapiens
tacaagccccccct

SEQ ID NO: 5304193 - DNA, 15 bp, Homo sapiens
tacaagccccccctt

SEQ ID NO: 5304194 - DNA, 16 bp, Homo sapiens
tacaagcctgcacaat

SEQ ID NO: 5304195 - DNA, 18 bp, Homo sapiens
tacaagcgtgagccactg

SEQ ID NO: 5304196 - DNA, 16 bp, Homo sapiens
tacaagctacagttgt

SEQ ID NO: 5304197 - DNA, 17 bp, Homo sapiens
tacaagctcttgtttct

SEQ ID NO: 5304198 - DNA, 23 bp, Homo sapiens
tacaagctcttgtttctgtttag

SEQ ID NO: 5304199 - DNA, 18 bp, Homo sapiens
tacaaggacattcactgc

SEQ ID NO: 5304200 - DNA, 19 bp, Homo sapiens
tacaaggacattcactgct

SEQ ID NO: 5304201 - DNA, 21 bp, Homo sapiens
tacaaggacattcactgctga

SEQ ID NO: 5304202 - DNA, 15 bp, Homo sapiens
tacaaggatgaaaga

SEQ ID NO: 5304203 - DNA, 14 bp, Homo sapiens
tacaaggcaacata

SEQ ID NO: 5304204 - DNA, 17 bp, Homo sapiens
tacaaggcaatggaaac

SEQ ID NO: 5304205 - DNA, 17 bp, Homo sapiens
tacaaggcaggcctttc

SEQ ID NO: 5304206 - DNA, 19 bp, Homo sapiens
tacaaggcaggcctttcct

SEQ ID NO: 5304207 - DNA, 19 bp, Homo sapiens
tacaaggggccatttggca

SEQ ID NO: 5304208 - DNA, 13 bp, Homo sapiens
tacaaggggccca

SEQ ID NO: 5304209 - DNA, 16 bp, Homo sapiens
tacaaggtaattgttt

SEQ ID NO: 5304210 - DNA, 17 bp, Homo sapiens
tacaaggtaattgtttt

SEQ ID NO: 5304211 - DNA, 16 bp, Homo sapiens
tacaaggtataataaa

SEQ ID NO: 5304212 - DNA, 17 bp, Homo sapiens
tacaaggtataataaaa

SEQ ID NO: 5304213 - DNA, 19 bp, Homo sapiens
tacaaggtataataaaatt

SEQ ID NO: 5304214 - DNA, 20 bp, Homo sapiens
tacaaggtataataaaatta

SEQ ID NO: 5304215 - DNA, 18 bp, Homo sapiens
tacaaggtatttacacat

SEQ ID NO: 5304216 - DNA, 14 bp, Homo sapiens
tacaaggtgttcat

SEQ ID NO: 5304217 - DNA, 21 bp, Homo sapiens
tacaagtaaatagtttgaatt

SEQ ID NO: 5304218 - DNA, 13 bp, Homo sapiens
tacaagtaaattc

SEQ ID NO: 5304219 - DNA, 16 bp, Homo sapiens
tacaagtaatattatt

SEQ ID NO: 5304220 - DNA, 17 bp, Homo sapiens
tacaagtaatattatta

SEQ ID NO: 5304221 - DNA, 19 bp, Homo sapiens
tacaagtaatgtaaagatg

SEQ ID NO: 5304222 - DNA, 20 bp, Homo sapiens
tacaagtaggggttgtgggt

SEQ ID NO: 5304223 - DNA, 14 bp, Homo sapiens
tacaagtagttctg

SEQ ID NO: 5304224 - DNA, 15 bp, Homo sapiens
tacaagtagttctgt

SEQ ID NO: 5304225 - DNA, 16 bp, Homo sapiens
tacaagtagttctgta

SEQ ID NO: 5304226 - DNA, 19 bp, Homo sapiens
tacaagtagttctgtattt

SEQ ID NO: 5304227 - DNA, 22 bp, Homo sapiens
tacaagtagttctgtatttgaa

SEQ ID NO: 5304228 - DNA, 23 bp, Homo sapiens
tacaagtagttctgtatttgaaa

SEQ ID NO: 5304229 - DNA, 17 bp, Homo sapiens
tacaagtatttttaatt

SEQ ID NO: 5304230 - DNA, 17 bp, Homo sapiens
tacaagtgaacaaaata

SEQ ID NO: 5304231 - DNA, 22 bp, Homo sapiens
tacaagtgctcagttccaatgt

SEQ ID NO: 5304232 - DNA, 12 bp, Homo sapiens
tacaagtggctc

SEQ ID NO: 5304233 - DNA, 18 bp, Homo sapiens
tacaagtggctccccacc

SEQ ID NO: 5304234 - DNA, 22 bp, Homo sapiens
tacaagtggctccccacctgga

SEQ ID NO: 5304235 - DNA, 19 bp, Homo sapiens
tacaagtggtgaccaaaat

SEQ ID NO: 5304236 - DNA, 14 bp, Homo sapiens
tacaagtgttctta

SEQ ID NO: 5304237 - DNA, 24 bp, Homo sapiens
tacaagtgtttctagtaacagtat

SEQ ID NO: 5304238 - DNA, 17 bp, Homo sapiens
tacaagttctttttaaa

SEQ ID NO: 5304239 - DNA, 19 bp, Homo sapiens
tacaagttgatcatgcagg

SEQ ID NO: 5304240 - DNA, 14 bp, Homo sapiens
tacaagttgctttg

SEQ ID NO: 5304241 - DNA, 15 bp, Homo sapiens
tacaagttgctttgt

SEQ ID NO: 5304242 - DNA, 20 bp, Homo sapiens
tacaagttgttattgttgaa

SEQ ID NO: 5304243 - DNA, 22 bp, Homo sapiens
tacaagttgttattgttgaaca

SEQ ID NO: 5304244 - DNA, 18 bp, Homo sapiens
tacaagtttcagacaggg

SEQ ID NO: 5304245 - DNA, 14 bp, Homo sapiens
tacaagtttgaaca

SEQ ID NO: 5304246 - DNA, 13 bp, Homo sapiens
tacaagttttgta

SEQ ID NO: 5304247 - DNA, 13 bp, Homo sapiens
tacaataaaaaca

SEQ ID NO: 5304248 - DNA, 13 bp, Homo sapiens
tacaataaaaaga

SEQ ID NO: 5304249 - DNA, 15 bp, Homo sapiens
tacaataaaaagaaa

SEQ ID NO: 5304250 - DNA, 21 bp, Homo sapiens
tacaataaaactaaatgtgta

SEQ ID NO: 5304251 - DNA, 14 bp, Homo sapiens
tacaataaaagagc

SEQ ID NO: 5304252 - DNA, 13 bp, Homo sapiens
tacaataaaagta

SEQ ID NO: 5304253 - DNA, 19 bp, Homo sapiens
tacaataaactattggaaa

SEQ ID NO: 5304254 - DNA, 23 bp, Homo sapiens
tacaataaagtttacaagcgaga

SEQ ID NO: 5304255 - DNA, 10 bp, Homo sapiens
tacaataaat

SEQ ID NO: 5304256 - DNA, 15 bp, Homo sapiens
tacaataaatattct

SEQ ID NO: 5304257 - DNA, 12 bp, Homo sapiens
tacaataaatgc

SEQ ID NO: 5304258 - DNA, 13 bp, Homo sapiens
tacaataaatgct

SEQ ID NO: 5304259 - DNA, 13 bp, Homo sapiens
tacaataacataa

SEQ ID NO: 5304260 - DNA, 14 bp, Homo sapiens
tacaataacccagt

SEQ ID NO: 5304261 - DNA, 18 bp, Homo sapiens
tacaataacccagttact

SEQ ID NO: 5304262 - DNA, 13 bp, Homo sapiens
tacaataagtgtt

SEQ ID NO: 5304263 - DNA, 18 bp, Homo sapiens
tacaataagttacttgaa

SEQ ID NO: 5304264 - DNA, 21 bp, Homo sapiens
tacaataagttacttgaaata

SEQ ID NO: 5304265 - DNA, 20 bp, Homo sapiens
tacaataataaatcctcagg

SEQ ID NO: 5304266 - DNA, 13 bp, Homo sapiens
tacaataatctct

SEQ ID NO: 5304267 - DNA, 15 bp, Homo sapiens
tacaataatctctat

SEQ ID NO: 5304268 - DNA, 16 bp, Homo sapiens
tacaataatggaaaaa

SEQ ID NO: 5304269 - DNA, 18 bp, Homo sapiens
tacaataatgtaatttag

SEQ ID NO: 5304270 - DNA, 19 bp, Homo sapiens
tacaataatgtaatttagt

SEQ ID NO: 5304271 - DNA, 22 bp, Homo sapiens
tacaataatgtaatttagtcta

SEQ ID NO: 5304272 - DNA, 20 bp, Homo sapiens
tacaataattaatgtgtgtc

SEQ ID NO: 5304273 - DNA, 18 bp, Homo sapiens
tacaatacagtatttctt

SEQ ID NO: 5304274 - DNA, 12 bp, Homo sapiens
tacaataccaga

SEQ ID NO: 5304275 - DNA, 17 bp, Homo sapiens
tacaataccgttaagat

SEQ ID NO: 5304276 - DNA, 21 bp, Homo sapiens
tacaataggatttaatttgtt

SEQ ID NO: 5304277 - DNA, 16 bp, Homo sapiens
tacaatagtatacatt

SEQ ID NO: 5304278 - DNA, 18 bp, Homo sapiens
tacaatagtatacatttt

SEQ ID NO: 5304279 - DNA, 23 bp, Homo sapiens
tacaatatatagctggcaagaat

SEQ ID NO: 5304280 - DNA, 14 bp, Homo sapiens
tacaatatatattt

SEQ ID NO: 5304281 - DNA, 20 bp, Homo sapiens
tacaatatcattttcctggg

SEQ ID NO: 5304282 - DNA, 15 bp, Homo sapiens
tacaatatgaaaagg

SEQ ID NO: 5304283 - DNA, 16 bp, Homo sapiens
tacaatatgtacattt

SEQ ID NO: 5304284 - DNA, 20 bp, Homo sapiens
tacaatattaattataataa

SEQ ID NO: 5304285 - DNA, 21 bp, Homo sapiens
tacaatattaattataataaa

SEQ ID NO: 5304286 - DNA, 14 bp, Homo sapiens
tacaatattgattg

SEQ ID NO: 5304287 - DNA, 11 bp, Homo sapiens
tacaatattgc

SEQ ID NO: 5304288 - DNA, 20 bp, Homo sapiens
tacaatattgtgcatgctag

SEQ ID NO: 5304289 - DNA, 22 bp, Homo sapiens
tacaatattgtgcatgctagtg

SEQ ID NO: 5304290 - DNA, 12 bp, Homo sapiens
tacaatatttaa

SEQ ID NO: 5304291 - DNA, 16 bp, Homo sapiens
tacaatatttaaaatt

SEQ ID NO: 5304292 - DNA, 17 bp, Homo sapiens
tacaatatttgtgtgct

SEQ ID NO: 5304293 - DNA, 16 bp, Homo sapiens
tacaatattttaagca

SEQ ID NO: 5304294 - DNA, 20 bp, Homo sapiens
tacaatattttaagcattac

SEQ ID NO: 5304295 - DNA, 21 bp, Homo sapiens
tacaatcaaaacacactacta

SEQ ID NO: 5304296 - DNA, 22 bp, Homo sapiens
tacaatcaaaacacactactac

SEQ ID NO: 5304297 - DNA, 20 bp, Homo sapiens
tacaatcacattaacatttt

SEQ ID NO: 5304298 - DNA, 20 bp, Homo sapiens
tacaatcagcccagtgcaaa

SEQ ID NO: 5304299 - DNA, 14 bp, Homo sapiens
tacaatcagctgct

SEQ ID NO: 5304300 - DNA, 23 bp, Homo sapiens
tacaatcagctgctttgttacct

SEQ ID NO: 5304301 - DNA, 12 bp, Homo sapiens
tacaatcatgtt

SEQ ID NO: 5304302 - DNA, 23 bp, Homo sapiens
tacaatcattgctgaaaatggta

SEQ ID NO: 5304303 - DNA, 15 bp, Homo sapiens
tacaatcgacatcct

SEQ ID NO: 5304304 - DNA, 23 bp, Homo sapiens
tacaatcgacatcctagccccac

SEQ ID NO: 5304305 - DNA, 22 bp, Homo sapiens
tacaatcgagactgcaatgtga

SEQ ID NO: 5304306 - DNA, 16 bp, Homo sapiens
tacaatctatttattg

SEQ ID NO: 5304307 - DNA, 17 bp, Homo sapiens
tacaatctatttattgg

SEQ ID NO: 5304308 - DNA, 22 bp, Homo sapiens
tacaatctcccttcacaagttt

SEQ ID NO: 5304309 - DNA, 13 bp, Homo sapiens
tacaatctggctc

SEQ ID NO: 5304310 - DNA, 15 bp, Homo sapiens
tacagaaaaagactt

SEQ ID NO: 5304311 - DNA, 17 bp, Homo sapiens
tacagaaaaatatatat

SEQ ID NO: 5304312 - DNA, 15 bp, Homo sapiens
tacagaaaaatcttg

SEQ ID NO: 5304313 - DNA, 15 bp, Homo sapiens
tacagaaaacatgtt

SEQ ID NO: 5304314 - DNA, 14 bp, Homo sapiens
tacagaaaatagct

SEQ ID NO: 5304315 - DNA, 16 bp, Homo sapiens
tacagaaaatagcttt

SEQ ID NO: 5304316 - DNA, 24 bp, Homo sapiens
tacagaaaatttgcaacatataaa

SEQ ID NO: 5304317 - DNA, 15 bp, Homo sapiens
tacagaaactgatgc

SEQ ID NO: 5304318 - DNA, 19 bp, Homo sapiens
tacagaaagaagcagttct

SEQ ID NO: 5304319 - DNA, 13 bp, Homo sapiens
tacagaaagctgc

SEQ ID NO: 5304320 - DNA, 22 bp, Homo sapiens
tacagaaagtggtgctcagttg

SEQ ID NO: 5304321 - DNA, 19 bp, Homo sapiens
tacagaaatactgctctga

SEQ ID NO: 5304322 - DNA, 20 bp, Homo sapiens
tacagaaatactgctctgaa

SEQ ID NO: 5304323 - DNA, 16 bp, Homo sapiens
tacagaaatatccatg

SEQ ID NO: 5304324 - DNA, 14 bp, Homo sapiens
tacagaaatgcaaa

SEQ ID NO: 5304325 - DNA, 23 bp, Homo sapiens
tacagaaatgccaaaaatgtgcc

SEQ ID NO: 5304326 - DNA, 17 bp, Homo sapiens
tacagaaattctgcaag

SEQ ID NO: 5304327 - DNA, 19 bp, Homo sapiens
tacagaaatttaattcaga

SEQ ID NO: 5304328 - DNA, 20 bp, Homo sapiens
tacagaacagagggccagag

SEQ ID NO: 5304329 - DNA, 21 bp, Homo sapiens
tacagaacagtttaagaagtg

SEQ ID NO: 5304330 - DNA, 16 bp, Homo sapiens
tacagaactctttcaa

SEQ ID NO: 5304331 - DNA, 15 bp, Homo sapiens
tacagaacttcagaa

SEQ ID NO: 5304332 - DNA, 14 bp, Homo sapiens
tacagaagaaactg

SEQ ID NO: 5304333 - DNA, 19 bp, Homo sapiens
tacagaagaagctcctgaa

SEQ ID NO: 5304334 - DNA, 23 bp, Homo sapiens
tacagaagccaagctccctggag

SEQ ID NO: 5304335 - DNA, 18 bp, Homo sapiens
tacagaagcccatgtctt

SEQ ID NO: 5304336 - DNA, 20 bp, Homo sapiens
tacagaagcccatgtcttct

SEQ ID NO: 5304337 - DNA, 16 bp, Homo sapiens
tacagaagtggaagga

SEQ ID NO: 5304338 - DNA, 14 bp, Homo sapiens
tacagaataaaaga

SEQ ID NO: 5304339 - DNA, 17 bp, Homo sapiens
tacagaataaaagaatt

SEQ ID NO: 5304340 - DNA, 22 bp, Homo sapiens
tacagaataatggagaacaagt

SEQ ID NO: 5304341 - DNA, 19 bp, Homo sapiens
tacagaatagaatacattg

SEQ ID NO: 5304342 - DNA, 17 bp, Homo sapiens
tacagaatattatataa

SEQ ID NO: 5304343 - DNA, 13 bp, Homo sapiens
tacagaatatttc

SEQ ID NO: 5304344 - DNA, 18 bp, Homo sapiens
tacagaatatttctattg

SEQ ID NO: 5304345 - DNA, 11 bp, Homo sapiens
tacagaatcat

SEQ ID NO: 5304346 - DNA, 16 bp, Homo sapiens
tacagaatcattgctt

SEQ ID NO: 5304347 - DNA, 18 bp, Homo sapiens
tacagaatcattgcttat

SEQ ID NO: 5304348 - DNA, 17 bp, Homo sapiens
tacagaatgcattaaaa

SEQ ID NO: 5304349 - DNA, 18 bp, Homo sapiens
tacagaatgcattaaaaa

SEQ ID NO: 5304350 - DNA, 15 bp, Homo sapiens
tacagaattactgta

SEQ ID NO: 5304351 - DNA, 22 bp, Homo sapiens
tacagaattcctaccaaacagc

SEQ ID NO: 5304352 - DNA, 19 bp, Homo sapiens
tacagaatttatagaataa

SEQ ID NO: 5304353 - DNA, 14 bp, Homo sapiens
tacagaatttccac

SEQ ID NO: 5304354 - DNA, 14 bp, Homo sapiens
tacagaatttgaat

SEQ ID NO: 5304355 - DNA, 11 bp, Homo sapiens
tacagaatttt

SEQ ID NO: 5304356 - DNA, 13 bp, Homo sapiens
tacagaattttta

SEQ ID NO: 5304357 - DNA, 16 bp, Homo sapiens
tacagaatttttaatg

SEQ ID NO: 5304358 - DNA, 17 bp, Homo sapiens
tacagaatttttaatga

SEQ ID NO: 5304359 - DNA, 18 bp, Homo sapiens
tacagaatttttaatgac

SEQ ID NO: 5304360 - DNA, 21 bp, Homo sapiens
tacagaatttttaatgacttt

SEQ ID NO: 5304361 - DNA, 14 bp, Homo sapiens
tacagacaaagcgt

SEQ ID NO: 5304362 - DNA, 22 bp, Homo sapiens
tacagacaacaaacctgtttct

SEQ ID NO: 5304363 - DNA, 14 bp, Homo sapiens
tacagacaaggagg

SEQ ID NO: 5304364 - DNA, 19 bp, Homo sapiens
tacagacaaggcaggcctg

SEQ ID NO: 5304365 - DNA, 20 bp, Homo sapiens
tacagacaaggttctgccct

SEQ ID NO: 5304366 - DNA, 13 bp, Homo sapiens
tacagacagaaga

SEQ ID NO: 5304367 - DNA, 14 bp, Homo sapiens
tacagacagacata

SEQ ID NO: 5304368 - DNA, 22 bp, Homo sapiens
tacagacagagaatatgtctgc

SEQ ID NO: 5304369 - DNA, 22 bp, Homo sapiens
tacagacagcttacaggagcca

SEQ ID NO: 5304370 - DNA, 13 bp, Homo sapiens
tacagacatattt

SEQ ID NO: 5304371 - DNA, 13 bp, Homo sapiens
tacagacatgagc

SEQ ID NO: 5304372 - DNA, 22 bp, Homo sapiens
tacagacattcaatgaattata

SEQ ID NO: 5304373 - DNA, 23 bp, Homo sapiens
tacagaccgaactgttgtataaa

SEQ ID NO: 5304374 - DNA, 20 bp, Homo sapiens
tacagacctaatatcatttt

SEQ ID NO: 5304375 - DNA, 13 bp, Homo sapiens
tacagacctccag

SEQ ID NO: 5304376 - DNA, 20 bp, Homo sapiens
tacagacctgctttttgaaa

SEQ ID NO: 5304377 - DNA, 13 bp, Homo sapiens
tacagacgtatgc

SEQ ID NO: 5304378 - DNA, 20 bp, Homo sapiens
tacagactgttttactgttt

SEQ ID NO: 5304379 - DNA, 15 bp, Homo sapiens
tacagacttctccag

SEQ ID NO: 5304380 - DNA, 22 bp, Homo sapiens
tacagacttgttgtgactttga

SEQ ID NO: 5304381 - DNA, 15 bp, Homo sapiens
tacagagaaaatcaa

SEQ ID NO: 5304382 - DNA, 20 bp, Homo sapiens
tacagagaaaatcaaagcag

SEQ ID NO: 5304383 - DNA, 19 bp, Homo sapiens
tacagagaaaccagcttcc

SEQ ID NO: 5304384 - DNA, 18 bp, Homo sapiens
tacagagaaattctgtgg

SEQ ID NO: 5304385 - DNA, 10 bp, Homo sapiens
tacagagaag

SEQ ID NO: 5304386 - DNA, 11 bp, Homo sapiens
tacagagaagc

SEQ ID NO: 5304387 - DNA, 19 bp, Homo sapiens
tacagagaagccagcttgt

SEQ ID NO: 5304388 - DNA, 16 bp, Homo sapiens
tacagagaagccatca

SEQ ID NO: 5304389 - DNA, 18 bp, Homo sapiens
tacagagaagccatcacc

SEQ ID NO: 5304390 - DNA, 14 bp, Homo sapiens
tacagagaagcctt

SEQ ID NO: 5304391 - DNA, 18 bp, Homo sapiens
tacagagaagccttcaag

SEQ ID NO: 5304392 - DNA, 21 bp, Homo sapiens
tacagagaagccttcaagctc

SEQ ID NO: 5304393 - DNA, 13 bp, Homo sapiens
tacagagaaggaa

SEQ ID NO: 5304394 - DNA, 20 bp, Homo sapiens
tacagagaagtcacagggca

SEQ ID NO: 5304395 - DNA, 20 bp, Homo sapiens
tacagagaatttctaaagta

SEQ ID NO: 5304396 - DNA, 16 bp, Homo sapiens
tacagagactctccct

SEQ ID NO: 5304397 - DNA, 16 bp, Homo sapiens
tacagagaggagaaac

SEQ ID NO: 5304398 - DNA, 17 bp, Homo sapiens
tacagagaggatacatt

SEQ ID NO: 5304399 - DNA, 21 bp, Homo sapiens
tacagagaggatacatttaat

SEQ ID NO: 5304400 - DNA, 22 bp, Homo sapiens
tacagagatatacaaatatatt

SEQ ID NO: 5304401 - DNA, 15 bp, Homo sapiens
tacagagatgtctct

SEQ ID NO: 5304402 - DNA, 22 bp, Homo sapiens
tacagagatgtctcttatatct

SEQ ID NO: 5304403 - DNA, 22 bp, Homo sapiens
tacagagcagctccccaggagc

SEQ ID NO: 5304404 - DNA, 19 bp, Homo sapiens
tacagagcccacgccccca

SEQ ID NO: 5304405 - DNA, 22 bp, Homo sapiens
tacagagcccacgcccccactg

SEQ ID NO: 5304406 - DNA, 16 bp, Homo sapiens
tacagagcctgtttta

SEQ ID NO: 5304407 - DNA, 21 bp, Homo sapiens
tacagagcctgttttaaaaaa

SEQ ID NO: 5304408 - DNA, 14 bp, Homo sapiens
tacagaggacagta

SEQ ID NO: 5304409 - DNA, 16 bp, Homo sapiens
tacagaggacatacca

SEQ ID NO: 5304410 - DNA, 15 bp, Homo sapiens
tacagaggaccctta

SEQ ID NO: 5304411 - DNA, 12 bp, Homo sapiens
tacagaggagaa

SEQ ID NO: 5304412 - DNA, 12 bp, Homo sapiens
tacagaggagat

SEQ ID NO: 5304413 - DNA, 20 bp, Homo sapiens
tacagaggatgccttttctg

SEQ ID NO: 5304414 - DNA, 22 bp, Homo sapiens
tacagaggatgccttttctgtg

SEQ ID NO: 5304415 - DNA, 23 bp, Homo sapiens
tacagaggatgccttttctgtga

SEQ ID NO: 5304416 - DNA, 22 bp, Homo sapiens
tacagagtaacaaaaaataaag

SEQ ID NO: 5304417 - DNA, 18 bp, Homo sapiens
tacagagtctgacaggaa

SEQ ID NO: 5304418 - DNA, 20 bp, Homo sapiens
tacagagtctgacaggaaga

SEQ ID NO: 5304419 - DNA, 14 bp, Homo sapiens
tacagataaaatgt

SEQ ID NO: 5304420 - DNA, 13 bp, Homo sapiens
tacagataaatga

SEQ ID NO: 5304421 - DNA, 21 bp, Homo sapiens
tacagataaatgattcaaaaa

SEQ ID NO: 5304422 - DNA, 12 bp, Homo sapiens
tacagataacat

SEQ ID NO: 5304423 - DNA, 13 bp, Homo sapiens
tacagataacatt

SEQ ID NO: 5304424 - DNA, 22 bp, Homo sapiens
tacagataagtgttcttcagtg

SEQ ID NO: 5304425 - DNA, 22 bp, Homo sapiens
tacagataattcatttgtattg

SEQ ID NO: 5304426 - DNA, 20 bp, Homo sapiens
tacagataatttattttgta

SEQ ID NO: 5304427 - DNA, 17 bp, Homo sapiens
tacagatactgtgagct

SEQ ID NO: 5304428 - DNA, 18 bp, Homo sapiens
tacagatactgtgagctt

SEQ ID NO: 5304429 - DNA, 19 bp, Homo sapiens
tacagataggccttcttgt

SEQ ID NO: 5304430 - DNA, 20 bp, Homo sapiens
tacagataggccttcttgtg

SEQ ID NO: 5304431 - DNA, 13 bp, Homo sapiens
tacagatatattt

SEQ ID NO: 5304432 - DNA, 21 bp, Homo sapiens
tacagatatattttctttctc

SEQ ID NO: 5304433 - DNA, 19 bp, Homo sapiens
tacagatattctaagtcgt

SEQ ID NO: 5304434 - DNA, 22 bp, Homo sapiens
tacagatcaggcagtgtttaaa

SEQ ID NO: 5304435 - DNA, 19 bp, Homo sapiens
tacagatccccagcccctc

SEQ ID NO: 5304436 - DNA, 15 bp, Homo sapiens
tacagatccgcatgt

SEQ ID NO: 5304437 - DNA, 17 bp, Homo sapiens
tacagatccgcatgtgt

SEQ ID NO: 5304438 - DNA, 14 bp, Homo sapiens
tacagatctgttta

SEQ ID NO: 5304439 - DNA, 13 bp, Homo sapiens
tacagatctttgg

SEQ ID NO: 5304440 - DNA, 13 bp, Homo sapiens
tacagatgaaaat

SEQ ID NO: 5304441 - DNA, 18 bp, Homo sapiens
tacagatgaatgtattta

SEQ ID NO: 5304442 - DNA, 22 bp, Homo sapiens
tacagatggtgtcctgcatgta

SEQ ID NO: 5304443 - DNA, 15 bp, Homo sapiens
tacagatgtacatta

SEQ ID NO: 5304444 - DNA, 21 bp, Homo sapiens
tacagatgtagatataaatat

SEQ ID NO: 5304445 - DNA, 19 bp, Homo sapiens
tacagatgtcccattttca

SEQ ID NO: 5304446 - DNA, 20 bp, Homo sapiens
tacagatgttttccactgag

SEQ ID NO: 5304447 - DNA, 21 bp, Homo sapiens
tacagatgttttccactgagc

SEQ ID NO: 5304448 - DNA, 17 bp, Homo sapiens
tacagattgctgcttct

SEQ ID NO: 5304449 - DNA, 16 bp, Homo sapiens
tacagattgggcgggg

SEQ ID NO: 5304450 - DNA, 21 bp, Homo sapiens
tacagattgtcatagttgttt

SEQ ID NO: 5304451 - DNA, 14 bp, Homo sapiens
tacagatttagttt

SEQ ID NO: 5304452 - DNA, 19 bp, Homo sapiens
tacagatttattcctttgt

SEQ ID NO: 5304453 - DNA, 20 bp, Homo sapiens
tacagatttattcctttgtt

SEQ ID NO: 5304454 - DNA, 16 bp, Homo sapiens
tacagattttatttgt

SEQ ID NO: 5304455 - DNA, 21 bp, Homo sapiens
tacagattttgatagcaaagc

SEQ ID NO: 5304456 - DNA, 20 bp, Homo sapiens
tacagcaaataaaacagtga

SEQ ID NO: 5304457 - DNA, 12 bp, Homo sapiens
tacagcaaattt

SEQ ID NO: 5304458 - DNA, 22 bp, Homo sapiens
tacagcaacaatttatgaattg

SEQ ID NO: 5304459 - DNA, 15 bp, Homo sapiens
tacagcactactctg

SEQ ID NO: 5304460 - DNA, 13 bp, Homo sapiens
tacagcactgtga

SEQ ID NO: 5304461 - DNA, 13 bp, Homo sapiens
tacagcagatcca

SEQ ID NO: 5304462 - DNA, 20 bp, Homo sapiens
tacagcagatccacctgcac

SEQ ID NO: 5304463 - DNA, 22 bp, Homo sapiens
tacagcagatccacctgcacaa

SEQ ID NO: 5304464 - DNA, 13 bp, Homo sapiens
tacagcagcaaga

SEQ ID NO: 5304465 - DNA, 16 bp, Homo sapiens
tacagcagcaagaaaa

SEQ ID NO: 5304466 - DNA, 23 bp, Homo sapiens
tacagcagcaagaaaaaaaaatg

SEQ ID NO: 5304467 - DNA, 13 bp, Homo sapiens
tacagcagcaata

SEQ ID NO: 5304468 - DNA, 11 bp, Homo sapiens
tacagcagggt

SEQ ID NO: 5304469 - DNA, 14 bp, Homo sapiens
tacagcagtagaca

SEQ ID NO: 5304470 - DNA, 17 bp, Homo sapiens
tacagcagtagacattt

SEQ ID NO: 5304471 - DNA, 18 bp, Homo sapiens
tacagcagtgtggtctct

SEQ ID NO: 5304472 - DNA, 22 bp, Homo sapiens
tacagcatcaatagaaagtcat

SEQ ID NO: 5304473 - DNA, 20 bp, Homo sapiens
tacagcatgagattgtacat

SEQ ID NO: 5304474 - DNA, 15 bp, Homo sapiens
tacagcattaaaatt

SEQ ID NO: 5304475 - DNA, 20 bp, Homo sapiens
tacagcattgtctttgctgt

SEQ ID NO: 5304476 - DNA, 23 bp, Homo sapiens
tacagcattgtctttgctgtact

SEQ ID NO: 5304477 - DNA, 13 bp, Homo sapiens
tacagccacatcc

SEQ ID NO: 5304478 - DNA, 14 bp, Homo sapiens
tacagccacatccc

SEQ ID NO: 5304479 - DNA, 12 bp, Homo sapiens
tacagccagaag

SEQ ID NO: 5304480 - DNA, 19 bp, Homo sapiens
tacagccagaccagattaa

SEQ ID NO: 5304481 - DNA, 21 bp, Homo sapiens
tacagccagaggaaccagcac

SEQ ID NO: 5304482 - DNA, 22 bp, Homo sapiens
tacagccagaggaaccagcact

SEQ ID NO: 5304483 - DNA, 18 bp, Homo sapiens
tacagccagtaaggcagc

SEQ ID NO: 5304484 - DNA, 12 bp, Homo sapiens
tacagcccagag

SEQ ID NO: 5304485 - DNA, 20 bp, Homo sapiens
tacagcccagtggaggaggg

SEQ ID NO: 5304486 - DNA, 19 bp, Homo sapiens
tacagcccctttttcatat

SEQ ID NO: 5304487 - DNA, 19 bp, Homo sapiens
tacatgactcagcatacct

SEQ ID NO: 5304488 - DNA, 16 bp, Homo sapiens
tacatgactgggcctc

SEQ ID NO: 5304489 - DNA, 16 bp, Homo sapiens
tacatgagaaggaact

SEQ ID NO: 5304490 - DNA, 17 bp, Homo sapiens
tacatgagccagtgatt

SEQ ID NO: 5304491 - DNA, 19 bp, Homo sapiens
tacatgaggaactgtagat

SEQ ID NO: 5304492 - DNA, 20 bp, Homo sapiens
tacatgaggaactgtagatg

SEQ ID NO: 5304493 - DNA, 15 bp, Homo sapiens
tacatgatgatttca

SEQ ID NO: 5304494 - DNA, 23 bp, Homo sapiens
tacatgcaaatctggcttagtaa

SEQ ID NO: 5304495 - DNA, 16 bp, Homo sapiens
tacatgcaatttatta

SEQ ID NO: 5304496 - DNA, 13 bp, Homo sapiens
tacatgcacacac

SEQ ID NO: 5304497 - DNA, 18 bp, Homo sapiens
tacatgcacactcatgtg

SEQ ID NO: 5304498 - DNA, 23 bp, Homo sapiens
tacatgcaccttatatttctgtg

SEQ ID NO: 5304499 - DNA, 21 bp, Homo sapiens
tacatgcacttggctgcataa

SEQ ID NO: 5304500 - DNA, 14 bp, Homo sapiens
tacatgcagcccat

SEQ ID NO: 5304501 - DNA, 22 bp, Homo sapiens
tacatgcagcccatgcccacct

SEQ ID NO: 5304502 - DNA, 16 bp, Homo sapiens
tacatgcataaactaa

SEQ ID NO: 5304503 - DNA, 14 bp, Homo sapiens
tacatgcatacttc

SEQ ID NO: 5304504 - DNA, 22 bp, Homo sapiens
tacatgcatgttttatgtgcac

SEQ ID NO: 5304505 - DNA, 20 bp, Homo sapiens
tacatgcattactgcatgca

SEQ ID NO: 5304506 - DNA, 22 bp, Homo sapiens
tacatgcattgagctctctcat

SEQ ID NO: 5304507 - DNA, 19 bp, Homo sapiens
tacatgcctaccaatattt

SEQ ID NO: 5304508 - DNA, 22 bp, Homo sapiens
tacatgcctttccagtgctgct

SEQ ID NO: 5304509 - DNA, 23 bp, Homo sapiens
tacatgctatgctgaagacattc

SEQ ID NO: 5304510 - DNA, 17 bp, Homo sapiens
tacatgctgaaaaatat

SEQ ID NO: 5304511 - DNA, 22 bp, Homo sapiens
tacatgctgaaaaatatagcct

SEQ ID NO: 5304512 - DNA, 24 bp, Homo sapiens
tacatgctgctatacacaagcaat

SEQ ID NO: 5304513 - DNA, 14 bp, Homo sapiens
tacatgctggggtc

SEQ ID NO: 5304514 - DNA, 17 bp, Homo sapiens
tacatgctgtgctcttt

SEQ ID NO: 5304515 - DNA, 20 bp, Homo sapiens
tacatgcttattccatgact

SEQ ID NO: 5304516 - DNA, 21 bp, Homo sapiens
tacatgcttattccatgactg

SEQ ID NO: 5304517 - DNA, 18 bp, Homo sapiens
tacatggaataacatgta

SEQ ID NO: 5304518 - DNA, 19 bp, Homo sapiens
tacatggaataacatgtaa

SEQ ID NO: 5304519 - DNA, 21 bp, Homo sapiens
tacatggagctcaggtttctg

SEQ ID NO: 5304520 - DNA, 22 bp, Homo sapiens
tacatggcagagtttgtgtgtt

SEQ ID NO: 5304521 - DNA, 20 bp, Homo sapiens
tacatggcagtgttttagtt

SEQ ID NO: 5304522 - DNA, 16 bp, Homo sapiens
tacatggccacaaagg

SEQ ID NO: 5304523 - DNA, 13 bp, Homo sapiens
tacatgggactat

SEQ ID NO: 5304524 - DNA, 15 bp, Homo sapiens
tacatgggtgaatta

SEQ ID NO: 5304525 - DNA, 20 bp, Homo sapiens
tacatggtggtgatgtccaa

SEQ ID NO: 5304526 - DNA, 15 bp, Homo sapiens
tacatggtttaaagt

SEQ ID NO: 5304527 - DNA, 14 bp, Homo sapiens
tacatgtaaagctg

SEQ ID NO: 5304528 - DNA, 18 bp, Homo sapiens
tacatgtaaagctgttaa

SEQ ID NO: 5304529 - DNA, 13 bp, Homo sapiens
tacatgtaaatta

SEQ ID NO: 5304530 - DNA, 17 bp, Homo sapiens
tacatgtagaaaaatac

SEQ ID NO: 5304531 - DNA, 17 bp, Homo sapiens
tacatgtataaagtgat

SEQ ID NO: 5304532 - DNA, 18 bp, Homo sapiens
tacatgtataaagtgatt

SEQ ID NO: 5304533 - DNA, 16 bp, Homo sapiens
tacatgtatagtgagt

SEQ ID NO: 5304534 - DNA, 19 bp, Homo sapiens
tacatgtatcaagcctaga

SEQ ID NO: 5304535 - DNA, 17 bp, Homo sapiens
tacatgtattaaattac

SEQ ID NO: 5304536 - DNA, 19 bp, Homo sapiens
tacatgtattaaattacat

SEQ ID NO: 5304537 - DNA, 20 bp, Homo sapiens
tacatgtattgcacattgta

SEQ ID NO: 5304538 - DNA, 15 bp, Homo sapiens
tacatgtctcatatt

SEQ ID NO: 5304539 - DNA, 18 bp, Homo sapiens
tacatgtctcatattttc

SEQ ID NO: 5304540 - DNA, 19 bp, Homo sapiens
tacatgtctcatattttca

SEQ ID NO: 5304541 - DNA, 22 bp, Homo sapiens
tacatgtctcatattttcagtg

SEQ ID NO: 5304542 - DNA, 19 bp, Homo sapiens
tacatgtgagatagttttc

SEQ ID NO: 5304543 - DNA, 20 bp, Homo sapiens
tacatgtgcacattgtgcag

SEQ ID NO: 5304544 - DNA, 17 bp, Homo sapiens
tacatgtgccgaatgtg

SEQ ID NO: 5304545 - DNA, 18 bp, Homo sapiens
tacatgtgtagcctgtgc

SEQ ID NO: 5304546 - DNA, 19 bp, Homo sapiens
tacatgtgtagggaaagtt

SEQ ID NO: 5304547 - DNA, 19 bp, Homo sapiens
tacatgtgtgcagagcaga

SEQ ID NO: 5304548 - DNA, 18 bp, Homo sapiens
tacatgtgtggatgtgta

SEQ ID NO: 5304549 - DNA, 19 bp, Homo sapiens
tacatgtgtggatgtgtaa

SEQ ID NO: 5304550 - DNA, 16 bp, Homo sapiens
tacatgtgtgtatata

SEQ ID NO: 5304551 - DNA, 23 bp, Homo sapiens
tacatgtgtttattcatccagca

SEQ ID NO: 5304552 - DNA, 18 bp, Homo sapiens
tacatgttcatcgtattt

SEQ ID NO: 5304553 - DNA, 16 bp, Homo sapiens
tacatgttcttgtcat

SEQ ID NO: 5304554 - DNA, 15 bp, Homo sapiens
tacatgttctttgta

SEQ ID NO: 5304555 - DNA, 16 bp, Homo sapiens
tacatgttctttgtac

SEQ ID NO: 5304556 - DNA, 20 bp, Homo sapiens
tacatgttctttgtaccttt

SEQ ID NO: 5304557 - DNA, 22 bp, Homo sapiens
tacatgttctttgtaccttttg

SEQ ID NO: 5304558 - DNA, 21 bp, Homo sapiens
tacatgttgggcatgattcta

SEQ ID NO: 5304559 - DNA, 20 bp, Homo sapiens
tacatgtttaaattgtaaat

SEQ ID NO: 5304560 - DNA, 22 bp, Homo sapiens
tacatgtttaaattgtaaattt

SEQ ID NO: 5304561 - DNA, 13 bp, Homo sapiens
tacatgtttataa

SEQ ID NO: 5304562 - DNA, 15 bp, Homo sapiens
tacatgtttataaat

SEQ ID NO: 5304563 - DNA, 14 bp, Homo sapiens
tacatgtttatgta

SEQ ID NO: 5304564 - DNA, 15 bp, Homo sapiens
tacatgtttatgtaa

SEQ ID NO: 5304565 - DNA, 12 bp, Homo sapiens
tacatgtttgca

SEQ ID NO: 5304566 - DNA, 15 bp, Homo sapiens
tacatgtttgcagtg

SEQ ID NO: 5304567 - DNA, 17 bp, Homo sapiens
tacatgtttgcagtgtt

SEQ ID NO: 5304568 - DNA, 18 bp, Homo sapiens
tacatgtttgttggttga

SEQ ID NO: 5304569 - DNA, 15 bp, Homo sapiens
tacatgttttttcat

SEQ ID NO: 5304570 - DNA, 21 bp, Homo sapiens
tacattaaaaagccttacagt

SEQ ID NO: 5304571 - DNA, 21 bp, Homo sapiens
tacattaaaataaaccaaata

SEQ ID NO: 5304572 - DNA, 14 bp, Homo sapiens
tacattaaaatgac

SEQ ID NO: 5304573 - DNA, 15 bp, Homo sapiens
tacattaaaatgaca

SEQ ID NO: 5304574 - DNA, 16 bp, Homo sapiens
tacattaaaatgacaa

SEQ ID NO: 5304575 - DNA, 15 bp, Homo sapiens
tacattaaaatggac

SEQ ID NO: 5304576 - DNA, 13 bp, Homo sapiens
tacattaaacaat

SEQ ID NO: 5304577 - DNA, 20 bp, Homo sapiens
tacattaaacatgactccat

SEQ ID NO: 5304578 - DNA, 18 bp, Homo sapiens
tacattaaagatttctgc

SEQ ID NO: 5304579 - DNA, 15 bp, Homo sapiens
tacattaaagcagtc

SEQ ID NO: 5304580 - DNA, 18 bp, Homo sapiens
tacattaacatttaggaa

SEQ ID NO: 5304581 - DNA, 15 bp, Homo sapiens
tacattaacggtgct

SEQ ID NO: 5304582 - DNA, 16 bp, Homo sapiens
tacattaacggtgcta

SEQ ID NO: 5304583 - DNA, 19 bp, Homo sapiens
tacattaacggtgctaaaa

SEQ ID NO: 5304584 - DNA, 14 bp, Homo sapiens
tacattaagtgggg

SEQ ID NO: 5304585 - DNA, 18 bp, Homo sapiens
tacattaagtggggtaga

SEQ ID NO: 5304586 - DNA, 17 bp, Homo sapiens
tacattacactaaatta

SEQ ID NO: 5304587 - DNA, 13 bp, Homo sapiens
tacattacatgta

SEQ ID NO: 5304588 - DNA, 14 bp, Homo sapiens
tacattacatgtaa

SEQ ID NO: 5304589 - DNA, 18 bp, Homo sapiens
tacattacatgtaaatta

SEQ ID NO: 5304590 - DNA, 16 bp, Homo sapiens
tacattactgtatgta

SEQ ID NO: 5304591 - DNA, 22 bp, Homo sapiens
tacattagacacacatatacat

SEQ ID NO: 5304592 - DNA, 23 bp, Homo sapiens
tacattagacacacatatacatt

SEQ ID NO: 5304593 - DNA, 20 bp, Homo sapiens
tacattaggaagctgaatta

SEQ ID NO: 5304594 - DNA, 16 bp, Homo sapiens
tacattaggttgtgaa

SEQ ID NO: 5304595 - DNA, 12 bp, Homo sapiens
tacattagtaaa

SEQ ID NO: 5304596 - DNA, 18 bp, Homo sapiens
tacattagtatcccacta

SEQ ID NO: 5304597 - DNA, 21 bp, Homo sapiens
tacattataataaaatttctt

SEQ ID NO: 5304598 - DNA, 21 bp, Homo sapiens
tacattatctaactgtgctca

SEQ ID NO: 5304599 - DNA, 13 bp, Homo sapiens
tacattatgttat

SEQ ID NO: 5304600 - DNA, 21 bp, Homo sapiens
tacattatgttattggaattt

SEQ ID NO: 5304601 - DNA, 22 bp, Homo sapiens
tacattatgttattggaatttt

SEQ ID NO: 5304602 - DNA, 19 bp, Homo sapiens
tacattattaatcattcca

SEQ ID NO: 5304603 - DNA, 16 bp, Homo sapiens
tacattatttctgtat

SEQ ID NO: 5304604 - DNA, 13 bp, Homo sapiens
tacattcaaattt

SEQ ID NO: 5304605 - DNA, 13 bp, Homo sapiens
tacattcacagca

SEQ ID NO: 5304606 - DNA, 15 bp, Homo sapiens
tacattcatttagct

SEQ ID NO: 5304607 - DNA, 14 bp, Homo sapiens
tacattccaccctg

SEQ ID NO: 5304608 - DNA, 19 bp, Homo sapiens
tacattccatcacagccag

SEQ ID NO: 5304609 - DNA, 15 bp, Homo sapiens
tacattccattgttt

SEQ ID NO: 5304610 - DNA, 15 bp, Homo sapiens
tacattccatttcat

SEQ ID NO: 5304611 - DNA, 20 bp, Homo sapiens
tacattccctatcaaaacat

SEQ ID NO: 5304612 - DNA, 21 bp, Homo sapiens
tacattccctctcctgcccag

SEQ ID NO: 5304613 - DNA, 10 bp, Homo sapiens
tacattcctc

SEQ ID NO: 5304614 - DNA, 19 bp, Homo sapiens
tacattcctcagctgccaa

SEQ ID NO: 5304615 - DNA, 23 bp, Homo sapiens
tacattcctcagctgccaagcac

SEQ ID NO: 5304616 - DNA, 12 bp, Homo sapiens
tacattcctgag

SEQ ID NO: 5304617 - DNA, 14 bp, Homo sapiens
tacattcctgagat

SEQ ID NO: 5304618 - DNA, 17 bp, Homo sapiens
tacattcctgagattct

SEQ ID NO: 5304619 - DNA, 18 bp, Homo sapiens
tacattcctgagattctg

SEQ ID NO: 5304620 - DNA, 18 bp, Homo sapiens
tacattctagttcagagc

SEQ ID NO: 5304621 - DNA, 13 bp, Homo sapiens
tacattctgctct

SEQ ID NO: 5304622 - DNA, 16 bp, Homo sapiens
tacattctgctctgcc

SEQ ID NO: 5304623 - DNA, 19 bp, Homo sapiens
tacattctgctctgcccat

SEQ ID NO: 5304624 - DNA, 12 bp, Homo sapiens
tacattctgtta

SEQ ID NO: 5304625 - DNA, 23 bp, Homo sapiens
tacattcttccatcatcactgta

SEQ ID NO: 5304626 - DNA, 17 bp, Homo sapiens
tacattcttgctctgct

SEQ ID NO: 5304627 - DNA, 16 bp, Homo sapiens
tacattctttattctg

SEQ ID NO: 5304628 - DNA, 14 bp, Homo sapiens
tacattctttgcta

SEQ ID NO: 5304629 - DNA, 16 bp, Homo sapiens
tacattctttttgctc

SEQ ID NO: 5304630 - DNA, 22 bp, Homo sapiens
tacattgaaacttgagtttgtt

SEQ ID NO: 5304631 - DNA, 17 bp, Homo sapiens
tacattgacacacagaa

SEQ ID NO: 5304632 - DNA, 18 bp, Homo sapiens
tacattgatacaaagtac

SEQ ID NO: 5304633 - DNA, 13 bp, Homo sapiens
tacattgccattt

SEQ ID NO: 5304634 - DNA, 15 bp, Homo sapiens
tacattgcttaaaat

SEQ ID NO: 5304635 - DNA, 16 bp, Homo sapiens
tacattggttttgaaa

SEQ ID NO: 5304636 - DNA, 20 bp, Homo sapiens
tacattggttttgaaatgtt

SEQ ID NO: 5304637 - DNA, 16 bp, Homo sapiens
tacattgtaaaataaa

SEQ ID NO: 5304638 - DNA, 19 bp, Homo sapiens
tacattgtacgaagagtat

SEQ ID NO: 5304639 - DNA, 20 bp, Homo sapiens
tacattgtacgaagagtatt

SEQ ID NO: 5304640 - DNA, 23 bp, Homo sapiens
tacattgtacgaagagtattttt

SEQ ID NO: 5304641 - DNA, 15 bp, Homo sapiens
tacattgtatatatg

SEQ ID NO: 5304642 - DNA, 16 bp, Homo sapiens
tacattgtgaaacttc

SEQ ID NO: 5304643 - DNA, 18 bp, Homo sapiens
tacattgtgccctgtagc

SEQ ID NO: 5304644 - DNA, 16 bp, Homo sapiens
tacattgtgtcctgct

SEQ ID NO: 5304645 - DNA, 13 bp, Homo sapiens
tacattgtgtgaa

SEQ ID NO: 5304646 - DNA, 23 bp, Homo sapiens
tacattgtgtgaaaaaagaaaat

SEQ ID NO: 5304647 - DNA, 19 bp, Homo sapiens
tacattgtttgtctgtctt

SEQ ID NO: 5304648 - DNA, 16 bp, Homo sapiens
tacatttaaaacatta

SEQ ID NO: 5304649 - DNA, 19 bp, Homo sapiens
tacatttaaagatttaaag

SEQ ID NO: 5304650 - DNA, 11 bp, Homo sapiens
tacatttaata

SEQ ID NO: 5304651 - DNA, 14 bp, Homo sapiens
tacatttaataata

SEQ ID NO: 5304652 - DNA, 15 bp, Homo sapiens
tacatttaataatat

SEQ ID NO: 5304653 - DNA, 15 bp, Homo sapiens
tacatttaatacagc

SEQ ID NO: 5304654 - DNA, 15 bp, Homo sapiens
tacatttacaaactg

SEQ ID NO: 5304655 - DNA, 16 bp, Homo sapiens
tacatttacaaactga

SEQ ID NO: 5304656 - DNA, 18 bp, Homo sapiens
tacatttacaaactgaag

SEQ ID NO: 5304657 - DNA, 13 bp, Homo sapiens
tacatttactgaa

SEQ ID NO: 5304658 - DNA, 14 bp, Homo sapiens
tacatttagagtat

SEQ ID NO: 5304659 - DNA, 14 bp, Homo sapiens
tacatttataattg

SEQ ID NO: 5304660 - DNA, 16 bp, Homo sapiens
tacatttatacatcac

SEQ ID NO: 5304661 - DNA, 13 bp, Homo sapiens
tacatttatcatg

SEQ ID NO: 5304662 - DNA, 15 bp, Homo sapiens
tacatttatcttctg

SEQ ID NO: 5304663 - DNA, 16 bp, Homo sapiens
tacatttatcttctgt

SEQ ID NO: 5304664 - DNA, 19 bp, Homo sapiens
tacatttatcttctgtttt

SEQ ID NO: 5304665 - DNA, 17 bp, Homo sapiens
taccattattttacagt

SEQ ID NO: 5304666 - DNA, 18 bp, Homo sapiens
taccattatttttaggat

SEQ ID NO: 5304667 - DNA, 20 bp, Homo sapiens
taccattcagatcactgaat

SEQ ID NO: 5304668 - DNA, 14 bp, Homo sapiens
taccattcagtgat

SEQ ID NO: 5304669 - DNA, 23 bp, Homo sapiens
taccattcagtgattactgtcaa

SEQ ID NO: 5304670 - DNA, 21 bp, Homo sapiens
taccattccttcaaataaaga

SEQ ID NO: 5304671 - DNA, 22 bp, Homo sapiens
taccattccttcaaataaagaa

SEQ ID NO: 5304672 - DNA, 20 bp, Homo sapiens
taccattctattctccagac

SEQ ID NO: 5304673 - DNA, 23 bp, Homo sapiens
taccattctattctccagacatg

SEQ ID NO: 5304674 - DNA, 17 bp, Homo sapiens
taccattgaaatcagca

SEQ ID NO: 5304675 - DNA, 20 bp, Homo sapiens
taccattgaaggaaagctat

SEQ ID NO: 5304676 - DNA, 15 bp, Homo sapiens
taccattggaaattt

SEQ ID NO: 5304677 - DNA, 19 bp, Homo sapiens
taccattggaaatttcacg

SEQ ID NO: 5304678 - DNA, 13 bp, Homo sapiens
taccatttacatg

SEQ ID NO: 5304679 - DNA, 19 bp, Homo sapiens
taccatttagtaagaatac

SEQ ID NO: 5304680 - DNA, 14 bp, Homo sapiens
taccatttatacaa

SEQ ID NO: 5304681 - DNA, 17 bp, Homo sapiens
taccatttatacaaatt

SEQ ID NO: 5304682 - DNA, 21 bp, Homo sapiens
taccatttatacaaattagaa

SEQ ID NO: 5304683 - DNA, 23 bp, Homo sapiens
taccatttcctcagcttatctct

SEQ ID NO: 5304684 - DNA, 14 bp, Homo sapiens
taccatttgatctg

SEQ ID NO: 5304685 - DNA, 20 bp, Homo sapiens
taccatttgtaataaagtat

SEQ ID NO: 5304686 - DNA, 12 bp, Homo sapiens
taccatttgtgt

SEQ ID NO: 5304687 - DNA, 16 bp, Homo sapiens
taccatttgtgtctct

SEQ ID NO: 5304688 - DNA, 18 bp, Homo sapiens
taccattttaaagttagt

SEQ ID NO: 5304689 - DNA, 20 bp, Homo sapiens
taccattttaacgctgccta

SEQ ID NO: 5304690 - DNA, 22 bp, Homo sapiens
taccattttgcgatgtgtttta

SEQ ID NO: 5304691 - DNA, 17 bp, Homo sapiens
taccatttttctggatt

SEQ ID NO: 5304692 - DNA, 20 bp, Homo sapiens
taccattttttaaggaaaca

SEQ ID NO: 5304693 - DNA, 21 bp, Homo sapiens
taccattttttaaggaaacaa

SEQ ID NO: 5304694 - DNA, 20 bp, Homo sapiens
tacccaaacccatggctcta

SEQ ID NO: 5304695 - DNA, 14 bp, Homo sapiens
tacccaaactgctt

SEQ ID NO: 5304696 - DNA, 14 bp, Homo sapiens
tacccaaagcacat

SEQ ID NO: 5304697 - DNA, 19 bp, Homo sapiens
tacccaaaggaatagaaat

SEQ ID NO: 5304698 - DNA, 13 bp, Homo sapiens
tacccaaatatgt

SEQ ID NO: 5304699 - DNA, 15 bp, Homo sapiens
tacccaaatatgttt

SEQ ID NO: 5304700 - DNA, 17 bp, Homo sapiens
tacccaaatgtccctgc

SEQ ID NO: 5304701 - DNA, 21 bp, Homo sapiens
tacccaaccactcaaattaat

SEQ ID NO: 5304702 - DNA, 15 bp, Homo sapiens
tacccaatagctgcc

SEQ ID NO: 5304703 - DNA, 22 bp, Homo sapiens
tacccaatgggaccgtgcccca

SEQ ID NO: 5304704 - DNA, 14 bp, Homo sapiens
tacccaatgtctcc

SEQ ID NO: 5304705 - DNA, 22 bp, Homo sapiens
tacccaatgtctcccacaccca

SEQ ID NO: 5304706 - DNA, 18 bp, Homo sapiens
tacccaatttaattccat

SEQ ID NO: 5304707 - DNA, 18 bp, Homo sapiens
tacccacaatctgagcac

SEQ ID NO: 5304708 - DNA, 18 bp, Homo sapiens
tacccacacctctgccag

SEQ ID NO: 5304709 - DNA, 14 bp, Homo sapiens
tacccacagggcct

SEQ ID NO: 5304710 - DNA, 20 bp, Homo sapiens
tacccacagggcctgacttt

SEQ ID NO: 5304711 - DNA, 23 bp, Homo sapiens
tacccacagggcctgacttttac

SEQ ID NO: 5304712 - DNA, 18 bp, Homo sapiens
tacccacatgtacagaca

SEQ ID NO: 5304713 - DNA, 22 bp, Homo sapiens
tacccaccccagcacagccacc

SEQ ID NO: 5304714 - DNA, 15 bp, Homo sapiens
tacccacccccaccc

SEQ ID NO: 5304715 - DNA, 19 bp, Homo sapiens
tacccaccctaatttgccc

SEQ ID NO: 5304716 - DNA, 20 bp, Homo sapiens
tacccacccttacttcctgg

SEQ ID NO: 5304717 - DNA, 15 bp, Homo sapiens
tacccacctcagcct

SEQ ID NO: 5304718 - DNA, 11 bp, Homo sapiens
tacccacctga

SEQ ID NO: 5304719 - DNA, 14 bp, Homo sapiens
tacccacctgagct

SEQ ID NO: 5304720 - DNA, 18 bp, Homo sapiens
tacccacctgagctttgg

SEQ ID NO: 5304721 - DNA, 17 bp, Homo sapiens
tacccactcggtcccag

SEQ ID NO: 5304722 - DNA, 13 bp, Homo sapiens
tacccactctttg

SEQ ID NO: 5304723 - DNA, 14 bp, Homo sapiens
tacccactctttgc

SEQ ID NO: 5304724 - DNA, 21 bp, Homo sapiens
tacccactctttgctacaata

SEQ ID NO: 5304725 - DNA, 22 bp, Homo sapiens
tacccactctttgctacaataa

SEQ ID NO: 5304726 - DNA, 13 bp, Homo sapiens
tacccactgctct

SEQ ID NO: 5304727 - DNA, 14 bp, Homo sapiens
tacccactgctctg

SEQ ID NO: 5304728 - DNA, 15 bp, Homo sapiens
tacccagagaatata

SEQ ID NO: 5304729 - DNA, 13 bp, Homo sapiens
tacccagagagaa

SEQ ID NO: 5304730 - DNA, 19 bp, Homo sapiens
tacccagagcacccagatc

SEQ ID NO: 5304731 - DNA, 13 bp, Homo sapiens
tacccagagcatt

SEQ ID NO: 5304732 - DNA, 16 bp, Homo sapiens
tacccagagccttctc

SEQ ID NO: 5304733 - DNA, 12 bp, Homo sapiens
tacccagatgcc

SEQ ID NO: 5304734 - DNA, 10 bp, Homo sapiens
tacccagcaa

SEQ ID NO: 5304735 - DNA, 23 bp, Homo sapiens
tacccagccaccttcctgactgg

SEQ ID NO: 5304736 - DNA, 18 bp, Homo sapiens
tacccagccatctgccca

SEQ ID NO: 5304737 - DNA, 20 bp, Homo sapiens
tacccagccatctgcccagg

SEQ ID NO: 5304738 - DNA, 23 bp, Homo sapiens
tacccagccatctgcccaggggt

SEQ ID NO: 5304739 - DNA, 15 bp, Homo sapiens
tacccagccatgtgt

SEQ ID NO: 5304740 - DNA, 15 bp, Homo sapiens
tacccagcccatctt

SEQ ID NO: 5304741 - DNA, 16 bp, Homo sapiens
tacccagcgtggccca

SEQ ID NO: 5304742 - DNA, 20 bp, Homo sapiens
tacccagcgtggcccaggcc

SEQ ID NO: 5304743 - DNA, 13 bp, Homo sapiens
tacccagctcctt

SEQ ID NO: 5304744 - DNA, 21 bp, Homo sapiens
tacccaggaggctgaggcagg

SEQ ID NO: 5304745 - DNA, 18 bp, Homo sapiens
tacccagggtggagtgca

SEQ ID NO: 5304746 - DNA, 16 bp, Homo sapiens
tacccagtattactgc

SEQ ID NO: 5304747 - DNA, 19 bp, Homo sapiens
tacccagtattactgctgc

SEQ ID NO: 5304748 - DNA, 21 bp, Homo sapiens
tacccagtattactgctgctg

SEQ ID NO: 5304749 - DNA, 19 bp, Homo sapiens
tacccagtccccattttct

SEQ ID NO: 5304750 - DNA, 23 bp, Homo sapiens
tacccagtttctaaactggagac

SEQ ID NO: 5304751 - DNA, 14 bp, Homo sapiens
tacccataaacagc

SEQ ID NO: 5304752 - DNA, 18 bp, Homo sapiens
tacccataaacagcacac

SEQ ID NO: 5304753 - DNA, 19 bp, Homo sapiens
tacccataagtaatattta

SEQ ID NO: 5304754 - DNA, 23 bp, Homo sapiens
tacccatacaccccctcttctga

SEQ ID NO: 5304755 - DNA, 15 bp, Homo sapiens
tacccatagacatga

SEQ ID NO: 5304756 - DNA, 12 bp, Homo sapiens
tacccatatccc

SEQ ID NO: 5304757 - DNA, 20 bp, Homo sapiens
tacccatcagttccagcctt

SEQ ID NO: 5304758 - DNA, 20 bp, Homo sapiens
tacccatctagtacttgaaa

SEQ ID NO: 5304759 - DNA, 21 bp, Homo sapiens
tacccatctagtacttgaaaa

SEQ ID NO: 5304760 - DNA, 15 bp, Homo sapiens
tacccatcttaaaaa

SEQ ID NO: 5304761 - DNA, 13 bp, Homo sapiens
tacccatcttgct

SEQ ID NO: 5304762 - DNA, 17 bp, Homo sapiens
tacccatcttgcttcca

SEQ ID NO: 5304763 - DNA, 18 bp, Homo sapiens
tacccatgactttatatg

SEQ ID NO: 5304764 - DNA, 16 bp, Homo sapiens
tacccatgagcctgcc

SEQ ID NO: 5304765 - DNA, 13 bp, Homo sapiens
tacccatgcacag

SEQ ID NO: 5304766 - DNA, 18 bp, Homo sapiens
tacccatgcacagtacaa

SEQ ID NO: 5304767 - DNA, 17 bp, Homo sapiens
tacccatgggacaaaat

SEQ ID NO: 5304768 - DNA, 19 bp, Homo sapiens
tacccatgttgggaaaaac

SEQ ID NO: 5304769 - DNA, 22 bp, Homo sapiens
tacccatgttgggaaaaactgg

SEQ ID NO: 5304770 - DNA, 23 bp, Homo sapiens
tacccatgttgggaaaaactggc

SEQ ID NO: 5304771 - DNA, 21 bp, Homo sapiens
tacccattcgtggtgatcaat

SEQ ID NO: 5304772 - DNA, 15 bp, Homo sapiens
tacccattctgtttt

SEQ ID NO: 5304773 - DNA, 22 bp, Homo sapiens
tacccattctgttttcccccag

SEQ ID NO: 5304774 - DNA, 17 bp, Homo sapiens
tacccattgcagaccct

SEQ ID NO: 5304775 - DNA, 17 bp, Homo sapiens
tacccattgttcccttc

SEQ ID NO: 5304776 - DNA, 22 bp, Homo sapiens
tacccattttttaaaaaagcaa

SEQ ID NO: 5304777 - DNA, 17 bp, Homo sapiens
taccccaaagtccaggc

SEQ ID NO: 5304778 - DNA, 19 bp, Homo sapiens
taccccaagactcccatga

SEQ ID NO: 5304779 - DNA, 19 bp, Homo sapiens
taccccaagcgccctggcc

SEQ ID NO: 5304780 - DNA, 20 bp, Homo sapiens
taccccaagtccacctgcct

SEQ ID NO: 5304781 - DNA, 14 bp, Homo sapiens
taccccacaccagc

SEQ ID NO: 5304782 - DNA, 14 bp, Homo sapiens
taccccaccagcag

SEQ ID NO: 5304783 - DNA, 12 bp, Homo sapiens
taccccaccctc

SEQ ID NO: 5304784 - DNA, 15 bp, Homo sapiens
taccccaccctcagc

SEQ ID NO: 5304785 - DNA, 23 bp, Homo sapiens
taccccaccctcagcaccccttc

SEQ ID NO: 5304786 - DNA, 16 bp, Homo sapiens
taccccacgaagacat

SEQ ID NO: 5304787 - DNA, 14 bp, Homo sapiens
taccccactgggca

SEQ ID NO: 5304788 - DNA, 19 bp, Homo sapiens
taccccactgggcacacgc

SEQ ID NO: 5304789 - DNA, 21 bp, Homo sapiens
taccccactgggccagccctg

SEQ ID NO: 5304790 - DNA, 22 bp, Homo sapiens
taccccagactagatgtagtat

SEQ ID NO: 5304791 - DNA, 23 bp, Homo sapiens
taccccagcctcgttggagagca

SEQ ID NO: 5304792 - DNA, 13 bp, Homo sapiens
taccccagggccc

SEQ ID NO: 5304793 - DNA, 19 bp, Homo sapiens
taccccagggccctggcca

SEQ ID NO: 5304794 - DNA, 20 bp, Homo sapiens
taccccagggccctggccag

SEQ ID NO: 5304795 - DNA, 20 bp, Homo sapiens
taccccagggcctactgcca

SEQ ID NO: 5304796 - DNA, 13 bp, Homo sapiens
taccccagttcct

SEQ ID NO: 5304797 - DNA, 12 bp, Homo sapiens
taccccataccc

SEQ ID NO: 5304798 - DNA, 22 bp, Homo sapiens
taccccatatacacctggaaca

SEQ ID NO: 5304799 - DNA, 15 bp, Homo sapiens
taccccatcattcat

SEQ ID NO: 5304800 - DNA, 13 bp, Homo sapiens
taccccatccctt

SEQ ID NO: 5304801 - DNA, 14 bp, Homo sapiens
taccccatcccttc

SEQ ID NO: 5304802 - DNA, 16 bp, Homo sapiens
taccccatcccttcct

SEQ ID NO: 5304803 - DNA, 14 bp, Homo sapiens
tacccccagagacc

SEQ ID NO: 5304804 - DNA, 15 bp, Homo sapiens
tacccccagagacct

SEQ ID NO: 5304805 - DNA, 20 bp, Homo sapiens
tacccccccttttctcccca

SEQ ID NO: 5304806 - DNA, 19 bp, Homo sapiens
taccccccgtctcctgccg

SEQ ID NO: 5304807 - DNA, 20 bp, Homo sapiens
tacccccgacgtgctcccct

SEQ ID NO: 5304808 - DNA, 22 bp, Homo sapiens
tacccccgcccaggctggccag

SEQ ID NO: 5304809 - DNA, 16 bp, Homo sapiens
tacccccgtggtcttt

SEQ ID NO: 5304810 - DNA, 21 bp, Homo sapiens
tacccccgtggtctttgaata

SEQ ID NO: 5304811 - DNA, 18 bp, Homo sapiens
taccccctcatcccccag

SEQ ID NO: 5304812 - DNA, 17 bp, Homo sapiens
taccccctccttcagac

SEQ ID NO: 5304813 - DNA, 18 bp, Homo sapiens
taccccctccttcagaca

SEQ ID NO: 5304814 - DNA, 16 bp, Homo sapiens
taccccctcttcaaag

SEQ ID NO: 5304815 - DNA, 12 bp, Homo sapiens
taccccctgccc

SEQ ID NO: 5304816 - DNA, 15 bp, Homo sapiens
taccccctgccccag

SEQ ID NO: 5304817 - DNA, 16 bp, Homo sapiens
taccccctgccccaga

SEQ ID NO: 5304818 - DNA, 18 bp, Homo sapiens
taccccctgccccagaga

SEQ ID NO: 5304819 - DNA, 23 bp, Homo sapiens
tacccccttctgggcatctgttc

SEQ ID NO: 5304820 - DNA, 22 bp, Homo sapiens
tacccccttttcagctgagccc

SEQ ID NO: 5304821 - DNA, 15 bp, Homo sapiens
taccccgtccctttc

SEQ ID NO: 5304822 - DNA, 15 bp, Homo sapiens
tacccctcaaactgc

SEQ ID NO: 5304823 - DNA, 21 bp, Homo sapiens
tacccctcccggccctgcctg

SEQ ID NO: 5304824 - DNA, 19 bp, Homo sapiens
tacccctcgactcagcacc

SEQ ID NO: 5304825 - DNA, 21 bp, Homo sapiens
tacccctcgactcagcaccac

SEQ ID NO: 5304826 - DNA, 20 bp, Homo sapiens
tacccctctcagtctgcagt

SEQ ID NO: 5304827 - DNA, 15 bp, Homo sapiens
tacccctcttccagc

SEQ ID NO: 5304828 - DNA, 17 bp, Homo sapiens
tacccctcttccagctt

SEQ ID NO: 5304829 - DNA, 15 bp, Homo sapiens
tacccctgcagctgg

SEQ ID NO: 5304830 - DNA, 13 bp, Homo sapiens
tacccctgccctg

SEQ ID NO: 5304831 - DNA, 13 bp, Homo sapiens
tacccctgcctgg

SEQ ID NO: 5304832 - DNA, 14 bp, Homo sapiens
tacccctgcctggg

SEQ ID NO: 5304833 - DNA, 16 bp, Homo sapiens
tacccctgcctgggtt

SEQ ID NO: 5304834 - DNA, 22 bp, Homo sapiens
tacccctgcctttgggagcagg

SEQ ID NO: 5304835 - DNA, 20 bp, Homo sapiens
tacccctgctcccattcctc

SEQ ID NO: 5304836 - DNA, 22 bp, Homo sapiens
tacccctgctcccattcctccc

SEQ ID NO: 5304837 - DNA, 19 bp, Homo sapiens
taccccttacaaatgaaaa

SEQ ID NO: 5304838 - DNA, 17 bp, Homo sapiens
taccccttacttagcat

SEQ ID NO: 5304839 - DNA, 12 bp, Homo sapiens
taccccttcctg

SEQ ID NO: 5304840 - DNA, 15 bp, Homo sapiens
taccccttcctgtcc

SEQ ID NO: 5304841 - DNA, 17 bp, Homo sapiens
taccccttcctgtcctg

SEQ ID NO: 5304842 - DNA, 22 bp, Homo sapiens
tacgcactttgcaggatgacct

SEQ ID NO: 5304843 - DNA, 22 bp, Homo sapiens
tacgcagcgtgctttaaaaaat

SEQ ID NO: 5304844 - DNA, 19 bp, Homo sapiens
tacgcaggtatttagaagc

SEQ ID NO: 5304845 - DNA, 21 bp, Homo sapiens
tacgcatcccatctctcccac

SEQ ID NO: 5304846 - DNA, 16 bp, Homo sapiens
tacgcatgactaattt

SEQ ID NO: 5304847 - DNA, 20 bp, Homo sapiens
tacgcattaagggcctgctg

SEQ ID NO: 5304848 - DNA, 12 bp, Homo sapiens
tacgcgccaccg

SEQ ID NO: 5304849 - DNA, 21 bp, Homo sapiens
tacgctagagcatgctgcctg

SEQ ID NO: 5304850 - DNA, 13 bp, Homo sapiens
tacgctagttatc

SEQ ID NO: 5304851 - DNA, 14 bp, Homo sapiens
tacgctcatcacct

SEQ ID NO: 5304852 - DNA, 15 bp, Homo sapiens
tacgctcatctctgg

SEQ ID NO: 5304853 - DNA, 24 bp, Homo sapiens
tacgctccatcgctgtcatctcag

SEQ ID NO: 5304854 - DNA, 19 bp, Homo sapiens
tacgctctcctttctttct

SEQ ID NO: 5304855 - DNA, 14 bp, Homo sapiens
tacgctctctgtct

SEQ ID NO: 5304856 - DNA, 16 bp, Homo sapiens
tacgctgcgtgccatg

SEQ ID NO: 5304857 - DNA, 17 bp, Homo sapiens
tacgctgctgcaggaca

SEQ ID NO: 5304858 - DNA, 14 bp, Homo sapiens
tacgctggtgctga

SEQ ID NO: 5304859 - DNA, 15 bp, Homo sapiens
tacgctttgattcat

SEQ ID NO: 5304860 - DNA, 13 bp, Homo sapiens
tacggaagagcag

SEQ ID NO: 5304861 - DNA, 19 bp, Homo sapiens
tacggaccaggtatagaga

SEQ ID NO: 5304862 - DNA, 20 bp, Homo sapiens
tacggagaagaatagaggtc

SEQ ID NO: 5304863 - DNA, 19 bp, Homo sapiens
tacggagggaggacatcat

SEQ ID NO: 5304864 - DNA, 19 bp, Homo sapiens
tacggatcatcaacaagat

SEQ ID NO: 5304865 - DNA, 22 bp, Homo sapiens
tacggatcctgcactgactctg

SEQ ID NO: 5304866 - DNA, 15 bp, Homo sapiens
tacggattttcagtt

SEQ ID NO: 5304867 - DNA, 17 bp, Homo sapiens
tacggattttcagttac

SEQ ID NO: 5304868 - DNA, 14 bp, Homo sapiens
tacggcaaccacat

SEQ ID NO: 5304869 - DNA, 22 bp, Homo sapiens
tacggcaaccacatgtcccaga

SEQ ID NO: 5304870 - DNA, 14 bp, Homo sapiens
tacggcaagaaggc

SEQ ID NO: 5304871 - DNA, 23 bp, Homo sapiens
tacggcaggtggcctaaggctgc

SEQ ID NO: 5304872 - DNA, 21 bp, Homo sapiens
tacggctatattggtttatgt

SEQ ID NO: 5304873 - DNA, 18 bp, Homo sapiens
tacgggagggtaaggctg

SEQ ID NO: 5304874 - DNA, 18 bp, Homo sapiens
tacgggagtgacccagct

SEQ ID NO: 5304875 - DNA, 20 bp, Homo sapiens
tacgggcacaactggaagct

SEQ ID NO: 5304876 - DNA, 22 bp, Homo sapiens
tacggtacaagctacatatgta

SEQ ID NO: 5304877 - DNA, 22 bp, Homo sapiens
tacggtgatattgtgcatgcaa

SEQ ID NO: 5304878 - DNA, 15 bp, Homo sapiens
tacggttgcttcacc

SEQ ID NO: 5304879 - DNA, 16 bp, Homo sapiens
tacggttgtctagagg

SEQ ID NO: 5304880 - DNA, 15 bp, Homo sapiens
tacgtaaaacatttg

SEQ ID NO: 5304881 - DNA, 16 bp, Homo sapiens
tacgtaataaggtttt

SEQ ID NO: 5304882 - DNA, 12 bp, Homo sapiens
tacgtacacatt

SEQ ID NO: 5304883 - DNA, 13 bp, Homo sapiens
tacgtacacattt

SEQ ID NO: 5304884 - DNA, 13 bp, Homo sapiens
tacgtacatacac

SEQ ID NO: 5304885 - DNA, 23 bp, Homo sapiens
tacgtacatacacacatacatac

SEQ ID NO: 5304886 - DNA, 16 bp, Homo sapiens
tacgtacatgtgaggc

SEQ ID NO: 5304887 - DNA, 22 bp, Homo sapiens
tacgtagaagctcttggacaac

SEQ ID NO: 5304888 - DNA, 18 bp, Homo sapiens
tacgtagcaggccatggc

SEQ ID NO: 5304889 - DNA, 22 bp, Homo sapiens
tacgtagccacaggagccctgc

SEQ ID NO: 5304890 - DNA, 16 bp, Homo sapiens
tacgtagtgtagattt

SEQ ID NO: 5304891 - DNA, 17 bp, Homo sapiens
tacgtagttgtgctttt

SEQ ID NO: 5304892 - DNA, 16 bp, Homo sapiens
tacgtataaatatcag

SEQ ID NO: 5304893 - DNA, 17 bp, Homo sapiens
tacgtataaatatcagt

SEQ ID NO: 5304894 - DNA, 17 bp, Homo sapiens
tacgtataaatatgaaa

SEQ ID NO: 5304895 - DNA, 20 bp, Homo sapiens
tacgtataaatatgaaatga

SEQ ID NO: 5304896 - DNA, 15 bp, Homo sapiens
tacgtatcatttcta

SEQ ID NO: 5304897 - DNA, 18 bp, Homo sapiens
tacgtatgcaagtctgtg

SEQ ID NO: 5304898 - DNA, 21 bp, Homo sapiens
tacgtatgcatttttttagtt

SEQ ID NO: 5304899 - DNA, 18 bp, Homo sapiens
tacgtatgtctggttctc

SEQ ID NO: 5304900 - DNA, 14 bp, Homo sapiens
tacgtatttttctg

SEQ ID NO: 5304901 - DNA, 18 bp, Homo sapiens
tacgtcatgtattttatg

SEQ ID NO: 5304902 - DNA, 21 bp, Homo sapiens
tacgtcccagcggcctcaggg

SEQ ID NO: 5304903 - DNA, 15 bp, Homo sapiens
tacgtcccgctgctg

SEQ ID NO: 5304904 - DNA, 19 bp, Homo sapiens
tacgtcccgctgctgtgct

SEQ ID NO: 5304905 - DNA, 23 bp, Homo sapiens
tacgtccgtgtgtcccagatgct

SEQ ID NO: 5304906 - DNA, 15 bp, Homo sapiens
tacgtcctgcctggc

SEQ ID NO: 5304907 - DNA, 16 bp, Homo sapiens
tacgtcctgcctggca

SEQ ID NO: 5304908 - DNA, 14 bp, Homo sapiens
tacgtctgacaggc

SEQ ID NO: 5304909 - DNA, 21 bp, Homo sapiens
tacgtcttgagaaatactata

SEQ ID NO: 5304910 - DNA, 18 bp, Homo sapiens
tacgtcttgatcagacat

SEQ ID NO: 5304911 - DNA, 17 bp, Homo sapiens
tacgtctttagatgcta

SEQ ID NO: 5304912 - DNA, 22 bp, Homo sapiens
tacgtgaccctctgctgaagac

SEQ ID NO: 5304913 - DNA, 16 bp, Homo sapiens
tacgtgcaaacaacct

SEQ ID NO: 5304914 - DNA, 20 bp, Homo sapiens
tacgtgcaaacaacctgaat

SEQ ID NO: 5304915 - DNA, 11 bp, Homo sapiens
tacgtgcattt

SEQ ID NO: 5304916 - DNA, 20 bp, Homo sapiens
tacgtgccagatataactgt

SEQ ID NO: 5304917 - DNA, 15 bp, Homo sapiens
tacgtggcttcagag

SEQ ID NO: 5304918 - DNA, 16 bp, Homo sapiens
tacgtgggagaggcag

SEQ ID NO: 5304919 - DNA, 17 bp, Homo sapiens
tacgtgggtacccaggc

SEQ ID NO: 5304920 - DNA, 15 bp, Homo sapiens
tacgtgtatgtttct

SEQ ID NO: 5304921 - DNA, 17 bp, Homo sapiens
tacgtgtatgtttcttc

SEQ ID NO: 5304922 - DNA, 19 bp, Homo sapiens
tacgtgtatgtttcttctt

SEQ ID NO: 5304923 - DNA, 16 bp, Homo sapiens
tacgtgtcaatgtgtg

SEQ ID NO: 5304924 - DNA, 20 bp, Homo sapiens
tacgtgtgaaatctgtcttt

SEQ ID NO: 5304925 - DNA, 14 bp, Homo sapiens
tacgtgtgcatgtg

SEQ ID NO: 5304926 - DNA, 13 bp, Homo sapiens
tacgtgtggcttg

SEQ ID NO: 5304927 - DNA, 21 bp, Homo sapiens
tacgtgtggttcatccatcat

SEQ ID NO: 5304928 - DNA, 22 bp, Homo sapiens
tacgtgtgtgtgtgtgtatgtg

SEQ ID NO: 5304929 - DNA, 21 bp, Homo sapiens
tacgtgtttacttggtgagga

SEQ ID NO: 5304930 - DNA, 15 bp, Homo sapiens
tacgttaattaaaca

SEQ ID NO: 5304931 - DNA, 23 bp, Homo sapiens
tacgttaggaggacaaaaggaat

SEQ ID NO: 5304932 - DNA, 12 bp, Homo sapiens
tacgttctcttt

SEQ ID NO: 5304933 - DNA, 15 bp, Homo sapiens
tacgttctctttaaa

SEQ ID NO: 5304934 - DNA, 22 bp, Homo sapiens
tacgttgagaatcactgctcca

SEQ ID NO: 5304935 - DNA, 14 bp, Homo sapiens
tacgttgtgcattt

SEQ ID NO: 5304936 - DNA, 21 bp, Homo sapiens
tacgtttaaaataaaactctc

SEQ ID NO: 5304937 - DNA, 15 bp, Homo sapiens
tacgtttaaagtgca

SEQ ID NO: 5304938 - DNA, 23 bp, Homo sapiens
tacgtttattaggaaaagatatt

SEQ ID NO: 5304939 - DNA, 16 bp, Homo sapiens
tacgtttgaagacatt

SEQ ID NO: 5304940 - DNA, 12 bp, Homo sapiens
tacgtttgaagt

SEQ ID NO: 5304941 - DNA, 19 bp, Homo sapiens
tacgtttgtgcagaatctc

SEQ ID NO: 5304942 - DNA, 20 bp, Homo sapiens
tacgtttgtgcagaatctct

SEQ ID NO: 5304943 - DNA, 14 bp, Homo sapiens
tacgtttgtgtttc

SEQ ID NO: 5304944 - DNA, 12 bp, Homo sapiens
tacgttttattg

SEQ ID NO: 5304945 - DNA, 23 bp, Homo sapiens
tacgtttttaaataggctaattt

SEQ ID NO: 5304946 - DNA, 13 bp, Homo sapiens
tacgtttttgtaa

SEQ ID NO: 5304947 - DNA, 12 bp, Homo sapiens
tactaaaaagta

SEQ ID NO: 5304948 - DNA, 21 bp, Homo sapiens
tactaaaaagtataaaatagt

SEQ ID NO: 5304949 - DNA, 18 bp, Homo sapiens
tactaaaaatacaaaaaa

SEQ ID NO: 5304950 - DNA, 14 bp, Homo sapiens
tactaaaaatgcaa

SEQ ID NO: 5304951 - DNA, 16 bp, Homo sapiens
tactaaaaatgcaaaa

SEQ ID NO: 5304952 - DNA, 15 bp, Homo sapiens
tactaaaagaaacta

SEQ ID NO: 5304953 - DNA, 12 bp, Homo sapiens
tactaaaagcaa

SEQ ID NO: 5304954 - DNA, 22 bp, Homo sapiens
tactaaaagcaaatctacagat

SEQ ID NO: 5304955 - DNA, 20 bp, Homo sapiens
tactaaaagttcttctccaa

SEQ ID NO: 5304956 - DNA, 19 bp, Homo sapiens
tactaaaagtttagaactt

SEQ ID NO: 5304957 - DNA, 14 bp, Homo sapiens
tactaaaatatgca

SEQ ID NO: 5304958 - DNA, 16 bp, Homo sapiens
tactaaaatatgcagg

SEQ ID NO: 5304959 - DNA, 23 bp, Homo sapiens
tactaaaatggactgtggtgact

SEQ ID NO: 5304960 - DNA, 18 bp, Homo sapiens
tactaaaatgtaactttt

SEQ ID NO: 5304961 - DNA, 18 bp, Homo sapiens
tactaaaattatgttact

SEQ ID NO: 5304962 - DNA, 20 bp, Homo sapiens
tactaaaattatgttactgt

SEQ ID NO: 5304963 - DNA, 14 bp, Homo sapiens
tactaaacatgtat

SEQ ID NO: 5304964 - DNA, 18 bp, Homo sapiens
tactaaacattttgttat

SEQ ID NO: 5304965 - DNA, 16 bp, Homo sapiens
tactaaaccaactcta

SEQ ID NO: 5304966 - DNA, 18 bp, Homo sapiens
tactaaaccaactctaat

SEQ ID NO: 5304967 - DNA, 20 bp, Homo sapiens
tactaaaccaactctaatat

SEQ ID NO: 5304968 - DNA, 15 bp, Homo sapiens
tactaaagaaagatt

SEQ ID NO: 5304969 - DNA, 14 bp, Homo sapiens
tactaaagagacat

SEQ ID NO: 5304970 - DNA, 20 bp, Homo sapiens
tactaaagatatcagagctc

SEQ ID NO: 5304971 - DNA, 22 bp, Homo sapiens
tactaaagatatcagagctctt

SEQ ID NO: 5304972 - DNA, 16 bp, Homo sapiens
tactaaagcaaattgt

SEQ ID NO: 5304973 - DNA, 23 bp, Homo sapiens
tactaaagcaaattgtttcagtt

SEQ ID NO: 5304974 - DNA, 11 bp, Homo sapiens
tactaaagcag

SEQ ID NO: 5304975 - DNA, 16 bp, Homo sapiens
tactaaagcagtgttt

SEQ ID NO: 5304976 - DNA, 14 bp, Homo sapiens
tactaaagtgtcta

SEQ ID NO: 5304977 - DNA, 14 bp, Homo sapiens
tactaaataaacat

SEQ ID NO: 5304978 - DNA, 17 bp, Homo sapiens
tactaaatatataaagt

SEQ ID NO: 5304979 - DNA, 12 bp, Homo sapiens
tactaaatatga

SEQ ID NO: 5304980 - DNA, 14 bp, Homo sapiens
tactaaatatgaaa

SEQ ID NO: 5304981 - DNA, 16 bp, Homo sapiens
tactaaatatgggaat

SEQ ID NO: 5304982 - DNA, 16 bp, Homo sapiens
tactaaatgtacagat

SEQ ID NO: 5304983 - DNA, 20 bp, Homo sapiens
tactaaattacgtatgcaag

SEQ ID NO: 5304984 - DNA, 14 bp, Homo sapiens
tactaaatttaaat

SEQ ID NO: 5304985 - DNA, 21 bp, Homo sapiens
tactaaatttaaatttaaaga

SEQ ID NO: 5304986 - DNA, 22 bp, Homo sapiens
tactaaatttaaatttaaagat

SEQ ID NO: 5304987 - DNA, 23 bp, Homo sapiens
tactaacaatcagctccttcctg

SEQ ID NO: 5304988 - DNA, 14 bp, Homo sapiens
tactaacacaagga

SEQ ID NO: 5304989 - DNA, 11 bp, Homo sapiens
tactaacagat

SEQ ID NO: 5304990 - DNA, 20 bp, Homo sapiens
tactaacagattataataaa

SEQ ID NO: 5304991 - DNA, 17 bp, Homo sapiens
tactaaccaccatttcc

SEQ ID NO: 5304992 - DNA, 18 bp, Homo sapiens
tactaaccagcagaaatg

SEQ ID NO: 5304993 - DNA, 19 bp, Homo sapiens
tactaaccagcagaaatgc

SEQ ID NO: 5304994 - DNA, 14 bp, Homo sapiens
tactaaccatttct

SEQ ID NO: 5304995 - DNA, 24 bp, Homo sapiens
tactaacccagtctttcttcactc

SEQ ID NO: 5304996 - DNA, 22 bp, Homo sapiens
tactaacgataaaaggtaataa

SEQ ID NO: 5304997 - DNA, 14 bp, Homo sapiens
tactaactaaactc

SEQ ID NO: 5304998 - DNA, 16 bp, Homo sapiens
tactaactaaatacca

SEQ ID NO: 5304999 - DNA, 16 bp, Homo sapiens
tactaagaataaataa

SEQ ID NO: 5305000 - DNA, 17 bp, Homo sapiens
tactaagaatgtcctta

SEQ ID NO: 5305001 - DNA, 18 bp, Homo sapiens
tactaagaatgtccttat

SEQ ID NO: 5305002 - DNA, 20 bp, Homo sapiens
tactaagcattgaatggcta

SEQ ID NO: 5305003 - DNA, 17 bp, Homo sapiens
tactaaggaaaataata

SEQ ID NO: 5305004 - DNA, 14 bp, Homo sapiens
tactaaggaatctt

SEQ ID NO: 5305005 - DNA, 16 bp, Homo sapiens
tactaaggagaaatga

SEQ ID NO: 5305006 - DNA, 13 bp, Homo sapiens
tactaaggagaat

SEQ ID NO: 5305007 - DNA, 16 bp, Homo sapiens
tactaaggagcctaac

SEQ ID NO: 5305008 - DNA, 18 bp, Homo sapiens
tactaaggagtaatctgt

SEQ ID NO: 5305009 - DNA, 20 bp, Homo sapiens
tactaaggtgactttctgaa

SEQ ID NO: 5305010 - DNA, 21 bp, Homo sapiens
tactaagtaatctcacagcat

SEQ ID NO: 5305011 - DNA, 14 bp, Homo sapiens
tactaagtcctcag

SEQ ID NO: 5305012 - DNA, 12 bp, Homo sapiens
tactaagtgaca

SEQ ID NO: 5305013 - DNA, 22 bp, Homo sapiens
tactaagttcacattagaatta

SEQ ID NO: 5305014 - DNA, 16 bp, Homo sapiens
tactaagtttcctttt

SEQ ID NO: 5305015 - DNA, 20 bp, Homo sapiens
tactaagtttccttttaatt

SEQ ID NO: 5305016 - DNA, 12 bp, Homo sapiens
tactaataaaaa

SEQ ID NO: 5305017 - DNA, 14 bp, Homo sapiens
tactaataaaaagg

SEQ ID NO: 5305018 - DNA, 21 bp, Homo sapiens
tactaataaaaaggtttaatt

SEQ ID NO: 5305019 - DNA, 16 bp, Homo sapiens
tactaataaaatacat

SEQ ID NO: 5305020 - DNA, 11 bp, Homo sapiens
tactctagaag

SEQ ID NO: 5305021 - DNA, 12 bp, Homo sapiens
tactctagattt

SEQ ID NO: 5305022 - DNA, 18 bp, Homo sapiens
tactctaggactgggccc

SEQ ID NO: 5305023 - DNA, 15 bp, Homo sapiens
tactctaggacttca

SEQ ID NO: 5305024 - DNA, 20 bp, Homo sapiens
tactctatgccccaaatata

SEQ ID NO: 5305025 - DNA, 17 bp, Homo sapiens
tactctatgtgatttat

SEQ ID NO: 5305026 - DNA, 21 bp, Homo sapiens
tactctcaaagccatgtgtgg

SEQ ID NO: 5305027 - DNA, 22 bp, Homo sapiens
tactctcacactggttctcaat

SEQ ID NO: 5305028 - DNA, 14 bp, Homo sapiens
tactctcagcacca

SEQ ID NO: 5305029 - DNA, 14 bp, Homo sapiens
tactctccaacctg

SEQ ID NO: 5305030 - DNA, 16 bp, Homo sapiens
tactctccaacctgga

SEQ ID NO: 5305031 - DNA, 19 bp, Homo sapiens
tactctcctcggccccctc

SEQ ID NO: 5305032 - DNA, 15 bp, Homo sapiens
tactctcctgtttgg

SEQ ID NO: 5305033 - DNA, 14 bp, Homo sapiens
tactctccttttat

SEQ ID NO: 5305034 - DNA, 11 bp, Homo sapiens
tactctctctc

SEQ ID NO: 5305035 - DNA, 14 bp, Homo sapiens
tactctcttatgca

SEQ ID NO: 5305036 - DNA, 21 bp, Homo sapiens
tactctcttatgcattagtat

SEQ ID NO: 5305037 - DNA, 15 bp, Homo sapiens
tactctcttcccttt

SEQ ID NO: 5305038 - DNA, 15 bp, Homo sapiens
tactctcttcctcca

SEQ ID NO: 5305039 - DNA, 19 bp, Homo sapiens
tactctgaaacatggcctg

SEQ ID NO: 5305040 - DNA, 18 bp, Homo sapiens
tactctgaaatgcactag

SEQ ID NO: 5305041 - DNA, 19 bp, Homo sapiens
tactctgaagggcatcatg

SEQ ID NO: 5305042 - DNA, 21 bp, Homo sapiens
tactctgagacaaaagaaaaa

SEQ ID NO: 5305043 - DNA, 22 bp, Homo sapiens
tactctgagacaaaagaaaaaa

SEQ ID NO: 5305044 - DNA, 16 bp, Homo sapiens
tactctgagcccaggc

SEQ ID NO: 5305045 - DNA, 13 bp, Homo sapiens
tactctgagctca

SEQ ID NO: 5305046 - DNA, 12 bp, Homo sapiens
tactctgatccc

SEQ ID NO: 5305047 - DNA, 14 bp, Homo sapiens
tactctgccctcta

SEQ ID NO: 5305048 - DNA, 23 bp, Homo sapiens
tactctgcggtggtgccagaggt

SEQ ID NO: 5305049 - DNA, 15 bp, Homo sapiens
tactctgctatttct

SEQ ID NO: 5305050 - DNA, 12 bp, Homo sapiens
tactctggcctc

SEQ ID NO: 5305051 - DNA, 17 bp, Homo sapiens
tactctggttctttgtt

SEQ ID NO: 5305052 - DNA, 13 bp, Homo sapiens
tactctgtagtct

SEQ ID NO: 5305053 - DNA, 15 bp, Homo sapiens
tactctgtcagatgg

SEQ ID NO: 5305054 - DNA, 15 bp, Homo sapiens
tactctgtccactct

SEQ ID NO: 5305055 - DNA, 14 bp, Homo sapiens
tactctgtccaggc

SEQ ID NO: 5305056 - DNA, 17 bp, Homo sapiens
tactctgtcgcccaggc

SEQ ID NO: 5305057 - DNA, 15 bp, Homo sapiens
tactctgtctcccag

SEQ ID NO: 5305058 - DNA, 15 bp, Homo sapiens
tactctgtgaaagaa

SEQ ID NO: 5305059 - DNA, 23 bp, Homo sapiens
tactctgtgccagagcctggggc

SEQ ID NO: 5305060 - DNA, 11 bp, Homo sapiens
tactctgtgtg

SEQ ID NO: 5305061 - DNA, 14 bp, Homo sapiens
tactctgttccttc

SEQ ID NO: 5305062 - DNA, 17 bp, Homo sapiens
tactctgttgaatattt

SEQ ID NO: 5305063 - DNA, 13 bp, Homo sapiens
tactctgttgcct

SEQ ID NO: 5305064 - DNA, 15 bp, Homo sapiens
tactctgttgcctcc

SEQ ID NO: 5305065 - DNA, 16 bp, Homo sapiens
tactctgttgcctcct

SEQ ID NO: 5305066 - DNA, 20 bp, Homo sapiens
tactctgttgcctcctctct

SEQ ID NO: 5305067 - DNA, 23 bp, Homo sapiens
tactctgttgcctcctctctccc

SEQ ID NO: 5305068 - DNA, 16 bp, Homo sapiens
tactcttaagccatct

SEQ ID NO: 5305069 - DNA, 20 bp, Homo sapiens
tactcttaagccatcttggt

SEQ ID NO: 5305070 - DNA, 22 bp, Homo sapiens
tactcttaagccatcttggtaa

SEQ ID NO: 5305071 - DNA, 23 bp, Homo sapiens
tactcttaagccatcttggtaaa

SEQ ID NO: 5305072 - DNA, 20 bp, Homo sapiens
tactcttaagtttctcagct

SEQ ID NO: 5305073 - DNA, 22 bp, Homo sapiens
tactcttaatctcacttcatca

SEQ ID NO: 5305074 - DNA, 17 bp, Homo sapiens
tactcttaatgatgtta

SEQ ID NO: 5305075 - DNA, 14 bp, Homo sapiens
tactcttaggatat

SEQ ID NO: 5305076 - DNA, 15 bp, Homo sapiens
tactcttcctgtcct

SEQ ID NO: 5305077 - DNA, 20 bp, Homo sapiens
tactcttctgcctcctagac

SEQ ID NO: 5305078 - DNA, 17 bp, Homo sapiens
tactcttcttgaaattt

SEQ ID NO: 5305079 - DNA, 19 bp, Homo sapiens
tactcttgatgtgaagata

SEQ ID NO: 5305080 - DNA, 14 bp, Homo sapiens
tactcttgggacat

SEQ ID NO: 5305081 - DNA, 14 bp, Homo sapiens
tactcttgtaagat

SEQ ID NO: 5305082 - DNA, 20 bp, Homo sapiens
tactcttgtaagattttgaa

SEQ ID NO: 5305083 - DNA, 17 bp, Homo sapiens
tactcttgttgcccagg

SEQ ID NO: 5305084 - DNA, 20 bp, Homo sapiens
tactctttcatgccatttta

SEQ ID NO: 5305085 - DNA, 13 bp, Homo sapiens
tactctttctctc

SEQ ID NO: 5305086 - DNA, 13 bp, Homo sapiens
tactctttctgta

SEQ ID NO: 5305087 - DNA, 17 bp, Homo sapiens
tactctttgagatagaa

SEQ ID NO: 5305088 - DNA, 19 bp, Homo sapiens
tactcttttgaagtgtttt

SEQ ID NO: 5305089 - DNA, 22 bp, Homo sapiens
tactgaaaaaatgctgagccag

SEQ ID NO: 5305090 - DNA, 19 bp, Homo sapiens
tactgaaaaagaatgaaaa

SEQ ID NO: 5305091 - DNA, 18 bp, Homo sapiens
tactgaaaacaaaatatc

SEQ ID NO: 5305092 - DNA, 19 bp, Homo sapiens
tactgaaaacaaaatatct

SEQ ID NO: 5305093 - DNA, 20 bp, Homo sapiens
tactgaaaacaaaatatctg

SEQ ID NO: 5305094 - DNA, 23 bp, Homo sapiens
tactgaaaacaaaatatctgaca

SEQ ID NO: 5305095 - DNA, 14 bp, Homo sapiens
tactgaaaatccaa

SEQ ID NO: 5305096 - DNA, 14 bp, Homo sapiens
tactgaaacagatt

SEQ ID NO: 5305097 - DNA, 11 bp, Homo sapiens
tactgaaagac

SEQ ID NO: 5305098 - DNA, 15 bp, Homo sapiens
tactgaaagacagga

SEQ ID NO: 5305099 - DNA, 17 bp, Homo sapiens
tactgaaagatctctgt

SEQ ID NO: 5305100 - DNA, 20 bp, Homo sapiens
tactgaaagatctctgtcac

SEQ ID NO: 5305101 - DNA, 12 bp, Homo sapiens
tactgaaatctt

SEQ ID NO: 5305102 - DNA, 21 bp, Homo sapiens
tactgaaatgaggagagaagg

SEQ ID NO: 5305103 - DNA, 22 bp, Homo sapiens
tactgaaatttgttatacttca

SEQ ID NO: 5305104 - DNA, 22 bp, Homo sapiens
tactgaacaatcaaagcacttg

SEQ ID NO: 5305105 - DNA, 20 bp, Homo sapiens
tactgaacatctgagtcctg

SEQ ID NO: 5305106 - DNA, 19 bp, Homo sapiens
tactgaaccacttgtagat

SEQ ID NO: 5305107 - DNA, 22 bp, Homo sapiens
tactgaaccacttgtagatttg

SEQ ID NO: 5305108 - DNA, 16 bp, Homo sapiens
tactgaaccactttga

SEQ ID NO: 5305109 - DNA, 15 bp, Homo sapiens
tactgaacccagagt

SEQ ID NO: 5305110 - DNA, 18 bp, Homo sapiens
tactgaacccagagtcag

SEQ ID NO: 5305111 - DNA, 15 bp, Homo sapiens
tactgaactgttacc

SEQ ID NO: 5305112 - DNA, 15 bp, Homo sapiens
tactgaactttctta

SEQ ID NO: 5305113 - DNA, 22 bp, Homo sapiens
tactgaagaaatctttccagtt

SEQ ID NO: 5305114 - DNA, 18 bp, Homo sapiens
tactgaagccaaatgaaa

SEQ ID NO: 5305115 - DNA, 14 bp, Homo sapiens
tactgaaggaaaaa

SEQ ID NO: 5305116 - DNA, 16 bp, Homo sapiens
tactgaaggtctgaca

SEQ ID NO: 5305117 - DNA, 16 bp, Homo sapiens
tactgaagtaaaacaa

SEQ ID NO: 5305118 - DNA, 20 bp, Homo sapiens
tactgaagtgcagctcagga

SEQ ID NO: 5305119 - DNA, 16 bp, Homo sapiens
tactgaagtggctggt

SEQ ID NO: 5305120 - DNA, 18 bp, Homo sapiens
tactgaagttatctgtgt

SEQ ID NO: 5305121 - DNA, 18 bp, Homo sapiens
tactgaataatatcaaat

SEQ ID NO: 5305122 - DNA, 19 bp, Homo sapiens
tactgaatgaccacttgat

SEQ ID NO: 5305123 - DNA, 15 bp, Homo sapiens
tactgaatgatctat

SEQ ID NO: 5305124 - DNA, 17 bp, Homo sapiens
tactgaatgcataaata

SEQ ID NO: 5305125 - DNA, 18 bp, Homo sapiens
tactgaatgcataaataa

SEQ ID NO: 5305126 - DNA, 15 bp, Homo sapiens
tactgaattctttat

SEQ ID NO: 5305127 - DNA, 14 bp, Homo sapiens
tactgaatttattg

SEQ ID NO: 5305128 - DNA, 17 bp, Homo sapiens
tactgaatttttaaaat

SEQ ID NO: 5305129 - DNA, 18 bp, Homo sapiens
tactgaatttttttgtaa

SEQ ID NO: 5305130 - DNA, 14 bp, Homo sapiens
tactgacaatgtat

SEQ ID NO: 5305131 - DNA, 17 bp, Homo sapiens
tactgacagaagttatt

SEQ ID NO: 5305132 - DNA, 14 bp, Homo sapiens
tactgacagggagc

SEQ ID NO: 5305133 - DNA, 21 bp, Homo sapiens
tactgacagggagcagccccc

SEQ ID NO: 5305134 - DNA, 14 bp, Homo sapiens
tactgacatttctt

SEQ ID NO: 5305135 - DNA, 16 bp, Homo sapiens
tactgacatttcttct

SEQ ID NO: 5305136 - DNA, 17 bp, Homo sapiens
tactgaccagacaagct

SEQ ID NO: 5305137 - DNA, 17 bp, Homo sapiens
tactgacccaactgggg

SEQ ID NO: 5305138 - DNA, 13 bp, Homo sapiens
tactgacccagga

SEQ ID NO: 5305139 - DNA, 22 bp, Homo sapiens
tactgaccctggggctggcttt

SEQ ID NO: 5305140 - DNA, 22 bp, Homo sapiens
tactgacctacctcaaagggca

SEQ ID NO: 5305141 - DNA, 15 bp, Homo sapiens
tactgacgaaagagt

SEQ ID NO: 5305142 - DNA, 12 bp, Homo sapiens
tactgactgaga

SEQ ID NO: 5305143 - DNA, 17 bp, Homo sapiens
tactgactttgcttgct

SEQ ID NO: 5305144 - DNA, 22 bp, Homo sapiens
tactgactttgcttgctttgaa

SEQ ID NO: 5305145 - DNA, 20 bp, Homo sapiens
tactgagaaaagcctctcca

SEQ ID NO: 5305146 - DNA, 17 bp, Homo sapiens
tactgagacaaaaagga

SEQ ID NO: 5305147 - DNA, 16 bp, Homo sapiens
tactgagacagggtgc

SEQ ID NO: 5305148 - DNA, 15 bp, Homo sapiens
tactgagacttggaa

SEQ ID NO: 5305149 - DNA, 13 bp, Homo sapiens
tactgagagaagg

SEQ ID NO: 5305150 - DNA, 21 bp, Homo sapiens
tactgagaggaggggtaaata

SEQ ID NO: 5305151 - DNA, 23 bp, Homo sapiens
tactgagaggaggggtaaatata

SEQ ID NO: 5305152 - DNA, 17 bp, Homo sapiens
tactgagatgctgggct

SEQ ID NO: 5305153 - DNA, 15 bp, Homo sapiens
tactgagcagtgata

SEQ ID NO: 5305154 - DNA, 21 bp, Homo sapiens
tactgagcagtgatattcttt

SEQ ID NO: 5305155 - DNA, 11 bp, Homo sapiens
tactgagcctg

SEQ ID NO: 5305156 - DNA, 16 bp, Homo sapiens
tactgagcgcaagcca

SEQ ID NO: 5305157 - DNA, 22 bp, Homo sapiens
tactgagcgcaagccacagcct

SEQ ID NO: 5305158 - DNA, 19 bp, Homo sapiens
tactgagcggacagaatga

SEQ ID NO: 5305159 - DNA, 22 bp, Homo sapiens
tactgaggcctaaaagtaaaca

SEQ ID NO: 5305160 - DNA, 16 bp, Homo sapiens
tactgaggggattctc

SEQ ID NO: 5305161 - DNA, 17 bp, Homo sapiens
tactgaggggattctct

SEQ ID NO: 5305162 - DNA, 15 bp, Homo sapiens
tactgaggtgctatg

SEQ ID NO: 5305163 - DNA, 21 bp, Homo sapiens
tactgaggtgctatgaagcca

SEQ ID NO: 5305164 - DNA, 19 bp, Homo sapiens
tactgagtactctttctct

SEQ ID NO: 5305165 - DNA, 15 bp, Homo sapiens
tactgagtgcctgca

SEQ ID NO: 5305166 - DNA, 17 bp, Homo sapiens
tactgagtgcctgcagc

SEQ ID NO: 5305167 - DNA, 16 bp, Homo sapiens
tactgagttacattgt

SEQ ID NO: 5305168 - DNA, 21 bp, Homo sapiens
tactgagttttttattccagt

SEQ ID NO: 5305169 - DNA, 16 bp, Homo sapiens
tactgatactattcaa

SEQ ID NO: 5305170 - DNA, 22 bp, Homo sapiens
tactgatactattcaatgcaat

SEQ ID NO: 5305171 - DNA, 15 bp, Homo sapiens
tactgatatcagagt

SEQ ID NO: 5305172 - DNA, 14 bp, Homo sapiens
tactgatccctttc

SEQ ID NO: 5305173 - DNA, 16 bp, Homo sapiens
tactgatcttaccttt

SEQ ID NO: 5305174 - DNA, 22 bp, Homo sapiens
tactgatgaaacagcctctgca

SEQ ID NO: 5305175 - DNA, 11 bp, Homo sapiens
tactgatgaga

SEQ ID NO: 5305176 - DNA, 21 bp, Homo sapiens
tactgatgagagaatgtggaa

SEQ ID NO: 5305177 - DNA, 13 bp, Homo sapiens
tactgatgatgtg

SEQ ID NO: 5305178 - DNA, 19 bp, Homo sapiens
tactgatgctgtcatgtgg

SEQ ID NO: 5305179 - DNA, 14 bp, Homo sapiens
tactgatggaggct

SEQ ID NO: 5305180 - DNA, 22 bp, Homo sapiens
tactgatgtgatattctgttgc

SEQ ID NO: 5305181 - DNA, 16 bp, Homo sapiens
tactgattatgaaatg

SEQ ID NO: 5305182 - DNA, 13 bp, Homo sapiens
tactgattattct

SEQ ID NO: 5305183 - DNA, 18 bp, Homo sapiens
tactgattattcttctta

SEQ ID NO: 5305184 - DNA, 14 bp, Homo sapiens
tactgattcaagaa

SEQ ID NO: 5305185 - DNA, 22 bp, Homo sapiens
tactgattcaattataattgta

SEQ ID NO: 5305186 - DNA, 14 bp, Homo sapiens
tactgattccagca

SEQ ID NO: 5305187 - DNA, 23 bp, Homo sapiens
tactgattctcctgtcagagatc

SEQ ID NO: 5305188 - DNA, 16 bp, Homo sapiens
tactgattgggaggtg

SEQ ID NO: 5305189 - DNA, 14 bp, Homo sapiens
tactgattgtttca

SEQ ID NO: 5305190 - DNA, 17 bp, Homo sapiens
tactgatttagaagcaa

SEQ ID NO: 5305191 - DNA, 14 bp, Homo sapiens
tactgatttcagta

SEQ ID NO: 5305192 - DNA, 22 bp, Homo sapiens
tactgatttgggctgaatgtat

SEQ ID NO: 5305193 - DNA, 18 bp, Homo sapiens
tactgattttaaaatgaa

SEQ ID NO: 5305194 - DNA, 17 bp, Homo sapiens
tactgcaaaaagtacat

SEQ ID NO: 5305195 - DNA, 20 bp, Homo sapiens
tactgcaaaaagtacatagt

SEQ ID NO: 5305196 - DNA, 16 bp, Homo sapiens
tactgcaaagtcgcca

SEQ ID NO: 5305197 - DNA, 20 bp, Homo sapiens
tactgcaaagtcgccagtca

SEQ ID NO: 5305198 - DNA, 21 bp, Homo sapiens
tactgcaaatcaggcttttgt

SEQ ID NO: 5305199 - DNA, 12 bp, Homo sapiens
tacttgactcta

SEQ ID NO: 5305200 - DNA, 14 bp, Homo sapiens
tacttgactctaat

SEQ ID NO: 5305201 - DNA, 16 bp, Homo sapiens
tacttgagactcttga

SEQ ID NO: 5305202 - DNA, 20 bp, Homo sapiens
tacttgaggatcatatgaat

SEQ ID NO: 5305203 - DNA, 20 bp, Homo sapiens
tacttgagggaccaatatta

SEQ ID NO: 5305204 - DNA, 16 bp, Homo sapiens
tacttgagggccagga

SEQ ID NO: 5305205 - DNA, 13 bp, Homo sapiens
tacttgagtgtgc

SEQ ID NO: 5305206 - DNA, 13 bp, Homo sapiens
tacttgatactga

SEQ ID NO: 5305207 - DNA, 14 bp, Homo sapiens
tacttgatagactt

SEQ ID NO: 5305208 - DNA, 16 bp, Homo sapiens
tacttgatttttcaaa

SEQ ID NO: 5305209 - DNA, 14 bp, Homo sapiens
tacttgcacaagct

SEQ ID NO: 5305210 - DNA, 11 bp, Homo sapiens
tacttgcactg

SEQ ID NO: 5305211 - DNA, 22 bp, Homo sapiens
tacttgcagcattcatttgttt

SEQ ID NO: 5305212 - DNA, 22 bp, Homo sapiens
tacttgcagctcccattctatg

SEQ ID NO: 5305213 - DNA, 22 bp, Homo sapiens
tacttgccaagcagtgcacatt

SEQ ID NO: 5305214 - DNA, 14 bp, Homo sapiens
tacttgccagaagt

SEQ ID NO: 5305215 - DNA, 17 bp, Homo sapiens
tacttgcctatctgact

SEQ ID NO: 5305216 - DNA, 23 bp, Homo sapiens
tacttgccttattagagtgtctt

SEQ ID NO: 5305217 - DNA, 21 bp, Homo sapiens
tacttgctataaatagattta

SEQ ID NO: 5305218 - DNA, 19 bp, Homo sapiens
tacttgctccttgaataag

SEQ ID NO: 5305219 - DNA, 16 bp, Homo sapiens
tacttgctctggacct

SEQ ID NO: 5305220 - DNA, 15 bp, Homo sapiens
tacttgctgctattt

SEQ ID NO: 5305221 - DNA, 17 bp, Homo sapiens
tacttgcttattacatt

SEQ ID NO: 5305222 - DNA, 17 bp, Homo sapiens
tacttgcttcagtggac

SEQ ID NO: 5305223 - DNA, 19 bp, Homo sapiens
tacttgctttaccttttca

SEQ ID NO: 5305224 - DNA, 23 bp, Homo sapiens
tacttgctttaccttttcagggc

SEQ ID NO: 5305225 - DNA, 20 bp, Homo sapiens
tacttgctttcaattgacaa

SEQ ID NO: 5305226 - DNA, 16 bp, Homo sapiens
tacttggaaataataa

SEQ ID NO: 5305227 - DNA, 19 bp, Homo sapiens
tacttggagtaattgcaca

SEQ ID NO: 5305228 - DNA, 14 bp, Homo sapiens
tacttggcaggctg

SEQ ID NO: 5305229 - DNA, 17 bp, Homo sapiens
tacttggcccccttcag

SEQ ID NO: 5305230 - DNA, 20 bp, Homo sapiens
tacttggctttttactatta

SEQ ID NO: 5305231 - DNA, 21 bp, Homo sapiens
tacttgggagacctgtaatca

SEQ ID NO: 5305232 - DNA, 23 bp, Homo sapiens
tacttgggagacctgtaatcata

SEQ ID NO: 5305233 - DNA, 19 bp, Homo sapiens
tacttgggagcctgaggca

SEQ ID NO: 5305234 - DNA, 19 bp, Homo sapiens
tacttgggcttcaacagcc

SEQ ID NO: 5305235 - DNA, 21 bp, Homo sapiens
tacttggggacataatttcag

SEQ ID NO: 5305236 - DNA, 20 bp, Homo sapiens
tacttgggtcacatgactct

SEQ ID NO: 5305237 - DNA, 18 bp, Homo sapiens
tacttggtcacagccagg

SEQ ID NO: 5305238 - DNA, 18 bp, Homo sapiens
tacttggtgaggaggagg

SEQ ID NO: 5305239 - DNA, 22 bp, Homo sapiens
tacttggtttgtgaatccatct

SEQ ID NO: 5305240 - DNA, 14 bp, Homo sapiens
tacttggtttgtgt

SEQ ID NO: 5305241 - DNA, 13 bp, Homo sapiens
tacttgtaaatat

SEQ ID NO: 5305242 - DNA, 15 bp, Homo sapiens
tacttgtaaatataa

SEQ ID NO: 5305243 - DNA, 20 bp, Homo sapiens
tacttgtaaatataaagacg

SEQ ID NO: 5305244 - DNA, 15 bp, Homo sapiens
tacttgtaaattgat

SEQ ID NO: 5305245 - DNA, 12 bp, Homo sapiens
tacttgtaactt

SEQ ID NO: 5305246 - DNA, 13 bp, Homo sapiens
tacttgtaattat

SEQ ID NO: 5305247 - DNA, 15 bp, Homo sapiens
tacttgtaattatgg

SEQ ID NO: 5305248 - DNA, 20 bp, Homo sapiens
tacttgtagaaatctgtaat

SEQ ID NO: 5305249 - DNA, 14 bp, Homo sapiens
tacttgtcaaagaa

SEQ ID NO: 5305250 - DNA, 17 bp, Homo sapiens
tacttgtcctcagcttg

SEQ ID NO: 5305251 - DNA, 14 bp, Homo sapiens
tacttgtctgaggc

SEQ ID NO: 5305252 - DNA, 14 bp, Homo sapiens
tacttgtctttctg

SEQ ID NO: 5305253 - DNA, 18 bp, Homo sapiens
tacttgtgaaacacagct

SEQ ID NO: 5305254 - DNA, 20 bp, Homo sapiens
tacttgtgaaacacagctgt

SEQ ID NO: 5305255 - DNA, 13 bp, Homo sapiens
tacttgtgcactt

SEQ ID NO: 5305256 - DNA, 16 bp, Homo sapiens
tacttgtggactaaaa

SEQ ID NO: 5305257 - DNA, 14 bp, Homo sapiens
tacttgtggtgtga

SEQ ID NO: 5305258 - DNA, 17 bp, Homo sapiens
tacttgtggttttcaaa

SEQ ID NO: 5305259 - DNA, 18 bp, Homo sapiens
tacttgtggttttcaaat

SEQ ID NO: 5305260 - DNA, 14 bp, Homo sapiens
tacttgtgttcatt

SEQ ID NO: 5305261 - DNA, 15 bp, Homo sapiens
tacttgtgttcattg

SEQ ID NO: 5305262 - DNA, 18 bp, Homo sapiens
tacttgtgtttgcttaaa

SEQ ID NO: 5305263 - DNA, 18 bp, Homo sapiens
tacttgtgtttttccctt

SEQ ID NO: 5305264 - DNA, 14 bp, Homo sapiens
tacttgttataaac

SEQ ID NO: 5305265 - DNA, 18 bp, Homo sapiens
tacttgttatgttgtaat

SEQ ID NO: 5305266 - DNA, 19 bp, Homo sapiens
tacttgttatgttgtaata

SEQ ID NO: 5305267 - DNA, 17 bp, Homo sapiens
tacttgttcatttctgt

SEQ ID NO: 5305268 - DNA, 20 bp, Homo sapiens
tacttgttcatttctgtctc

SEQ ID NO: 5305269 - DNA, 15 bp, Homo sapiens
tacttgttcatttgg

SEQ ID NO: 5305270 - DNA, 12 bp, Homo sapiens
tacttgttctgt

SEQ ID NO: 5305271 - DNA, 14 bp, Homo sapiens
tacttgttgcctat

SEQ ID NO: 5305272 - DNA, 15 bp, Homo sapiens
tacttgtttcaaatg

SEQ ID NO: 5305273 - DNA, 14 bp, Homo sapiens
tacttgtttcagag

SEQ ID NO: 5305274 - DNA, 12 bp, Homo sapiens
tacttgtttcat

SEQ ID NO: 5305275 - DNA, 19 bp, Homo sapiens
tacttgtttcatctggttt

SEQ ID NO: 5305276 - DNA, 16 bp, Homo sapiens
tacttgtttctctgtt

SEQ ID NO: 5305277 - DNA, 16 bp, Homo sapiens
tacttgtttttgtaaa

SEQ ID NO: 5305278 - DNA, 16 bp, Homo sapiens
tactttaaaaagaaat

SEQ ID NO: 5305279 - DNA, 13 bp, Homo sapiens
tactttaaaaagg

SEQ ID NO: 5305280 - DNA, 23 bp, Homo sapiens
tactttaaaaaggaaatttgttt

SEQ ID NO: 5305281 - DNA, 12 bp, Homo sapiens
tactttaaacta

SEQ ID NO: 5305282 - DNA, 21 bp, Homo sapiens
tactttaaaggaaaaaatgtt

SEQ ID NO: 5305283 - DNA, 13 bp, Homo sapiens
tactttaaatcct

SEQ ID NO: 5305284 - DNA, 15 bp, Homo sapiens
tactttaaatcctac

SEQ ID NO: 5305285 - DNA, 19 bp, Homo sapiens
tactttaaatcctaccaaa

SEQ ID NO: 5305286 - DNA, 20 bp, Homo sapiens
tactttaaatcctaccaaag

SEQ ID NO: 5305287 - DNA, 16 bp, Homo sapiens
tactttaaattatatg

SEQ ID NO: 5305288 - DNA, 22 bp, Homo sapiens
tactttaaattatatgatatgc

SEQ ID NO: 5305289 - DNA, 15 bp, Homo sapiens
tactttaaattgtgg

SEQ ID NO: 5305290 - DNA, 16 bp, Homo sapiens
tactttaaattgtgga

SEQ ID NO: 5305291 - DNA, 12 bp, Homo sapiens
tactttaaattt

SEQ ID NO: 5305292 - DNA, 20 bp, Homo sapiens
tactttaacattttggaaat

SEQ ID NO: 5305293 - DNA, 23 bp, Homo sapiens
tactttaacttagttttgcatag

SEQ ID NO: 5305294 - DNA, 14 bp, Homo sapiens
tactttaatgcgaa

SEQ ID NO: 5305295 - DNA, 17 bp, Homo sapiens
tactttaattcatgaag

SEQ ID NO: 5305296 - DNA, 15 bp, Homo sapiens
tactttacaatcatg

SEQ ID NO: 5305297 - DNA, 18 bp, Homo sapiens
tactttacaatcatgcct

SEQ ID NO: 5305298 - DNA, 20 bp, Homo sapiens
tactttacactctctgtaca

SEQ ID NO: 5305299 - DNA, 17 bp, Homo sapiens
tactttacatatgcttt

SEQ ID NO: 5305300 - DNA, 17 bp, Homo sapiens
tactttacctctctgtc

SEQ ID NO: 5305301 - DNA, 18 bp, Homo sapiens
tactttacctctctgtca

SEQ ID NO: 5305302 - DNA, 19 bp, Homo sapiens
tactttacctctctgtcat

SEQ ID NO: 5305303 - DNA, 16 bp, Homo sapiens
tactttactcattttt

SEQ ID NO: 5305304 - DNA, 15 bp, Homo sapiens
tactttactgcctga

SEQ ID NO: 5305305 - DNA, 17 bp, Homo sapiens
tactttagaagcctgca

SEQ ID NO: 5305306 - DNA, 19 bp, Homo sapiens
tactttataactaacatgt

SEQ ID NO: 5305307 - DNA, 19 bp, Homo sapiens
tactttataatcaagacaa

SEQ ID NO: 5305308 - DNA, 13 bp, Homo sapiens
tactttatagaag

SEQ ID NO: 5305309 - DNA, 14 bp, Homo sapiens
tactttatagaaga

SEQ ID NO: 5305310 - DNA, 16 bp, Homo sapiens
tactttatagaagaat

SEQ ID NO: 5305311 - DNA, 18 bp, Homo sapiens
tactttatatctgtaatg

SEQ ID NO: 5305312 - DNA, 21 bp, Homo sapiens
tactttatatctgtaatgata

SEQ ID NO: 5305313 - DNA, 15 bp, Homo sapiens
tactttatatcttgt

SEQ ID NO: 5305314 - DNA, 18 bp, Homo sapiens
tactttatcaaagattgg

SEQ ID NO: 5305315 - DNA, 14 bp, Homo sapiens
tactttatcacttt

SEQ ID NO: 5305316 - DNA, 20 bp, Homo sapiens
tactttatcactttttgaac

SEQ ID NO: 5305317 - DNA, 22 bp, Homo sapiens
tactttatcatgaatgctttta

SEQ ID NO: 5305318 - DNA, 18 bp, Homo sapiens
tactttattaatatgagt

SEQ ID NO: 5305319 - DNA, 15 bp, Homo sapiens
tactttattagagta

SEQ ID NO: 5305320 - DNA, 11 bp, Homo sapiens
tactttattct

SEQ ID NO: 5305321 - DNA, 14 bp, Homo sapiens
tactttattgtaca

SEQ ID NO: 5305322 - DNA, 13 bp, Homo sapiens
tactttatttctg

SEQ ID NO: 5305323 - DNA, 19 bp, Homo sapiens
tactttatttgaataacaa

SEQ ID NO: 5305324 - DNA, 17 bp, Homo sapiens
tactttatttttctgat

SEQ ID NO: 5305325 - DNA, 10 bp, Homo sapiens
tactttcaaa

SEQ ID NO: 5305326 - DNA, 17 bp, Homo sapiens
tactttcacatctctgt

SEQ ID NO: 5305327 - DNA, 16 bp, Homo sapiens
tactttcagaatgttg

SEQ ID NO: 5305328 - DNA, 16 bp, Homo sapiens
tactttcatcttaaac

SEQ ID NO: 5305329 - DNA, 20 bp, Homo sapiens
tactttcatcttaaactaat

SEQ ID NO: 5305330 - DNA, 19 bp, Homo sapiens
tactttccaattctccttt

SEQ ID NO: 5305331 - DNA, 14 bp, Homo sapiens
tactttccatgttt

SEQ ID NO: 5305332 - DNA, 16 bp, Homo sapiens
tactttccatgttttt

SEQ ID NO: 5305333 - DNA, 16 bp, Homo sapiens
tactttccatttggta

SEQ ID NO: 5305334 - DNA, 12 bp, Homo sapiens
tactttcccagg

SEQ ID NO: 5305335 - DNA, 15 bp, Homo sapiens
tactttccctaccct

SEQ ID NO: 5305336 - DNA, 21 bp, Homo sapiens
tactttccctaccctctagag

SEQ ID NO: 5305337 - DNA, 12 bp, Homo sapiens
tactttcccttg

SEQ ID NO: 5305338 - DNA, 23 bp, Homo sapiens
tactttcccttgcttttccctct

SEQ ID NO: 5305339 - DNA, 22 bp, Homo sapiens
tactttcctattttcttttcca

SEQ ID NO: 5305340 - DNA, 17 bp, Homo sapiens
tactttcctgatgttga

SEQ ID NO: 5305341 - DNA, 20 bp, Homo sapiens
tactttcctttccccagccc

SEQ ID NO: 5305342 - DNA, 20 bp, Homo sapiens
tactttcgtaatagctcaga

SEQ ID NO: 5305343 - DNA, 20 bp, Homo sapiens
tactttctatctcatctgtc

SEQ ID NO: 5305344 - DNA, 15 bp, Homo sapiens
tactttctatgtgac

SEQ ID NO: 5305345 - DNA, 15 bp, Homo sapiens
tactttctcacatgt

SEQ ID NO: 5305346 - DNA, 23 bp, Homo sapiens
tactttctcccagtatgttttaa

SEQ ID NO: 5305347 - DNA, 16 bp, Homo sapiens
tactttctctgtagtt

SEQ ID NO: 5305348 - DNA, 11 bp, Homo sapiens
tactttctctt

SEQ ID NO: 5305349 - DNA, 15 bp, Homo sapiens
tactttctgaaaatt

SEQ ID NO: 5305350 - DNA, 18 bp, Homo sapiens
tactttctgaaaatttat

SEQ ID NO: 5305351 - DNA, 23 bp, Homo sapiens
tactttctgaaaatttatataac

SEQ ID NO: 5305352 - DNA, 22 bp, Homo sapiens
tactttctggtggcaaatgaat

SEQ ID NO: 5305353 - DNA, 15 bp, Homo sapiens
tactttctgttaaaa

SEQ ID NO: 5305354 - DNA, 13 bp, Homo sapiens
tactttcttataa

SEQ ID NO: 5305355 - DNA, 15 bp, Homo sapiens
tactttcttcaaaat

SEQ ID NO: 5305356 - DNA, 23 bp, Homo sapiens
tactttcttcaccaagtgcaata

SEQ ID NO: 5305357 - DNA, 19 bp, Homo sapiens
tactttctttcagatgttt

SEQ ID NO: 5305358 - DNA, 21 bp, Homo sapiens
tactttgaaaacaattcagtg

SEQ ID NO: 5305359 - DNA, 23 bp, Homo sapiens
tactttgaacattaatgttgaaa

SEQ ID NO: 5305360 - DNA, 18 bp, Homo sapiens
tactttgaatagtcctaa

SEQ ID NO: 5305361 - DNA, 14 bp, Homo sapiens
tactttgaatgtgt

SEQ ID NO: 5305362 - DNA, 18 bp, Homo sapiens
tactttgagaagatgacc

SEQ ID NO: 5305363 - DNA, 12 bp, Homo sapiens
tactttgattca

SEQ ID NO: 5305364 - DNA, 21 bp, Homo sapiens
tactttgattcacatgttttc

SEQ ID NO: 5305365 - DNA, 18 bp, Homo sapiens
tactttgattccatttta

SEQ ID NO: 5305366 - DNA, 20 bp, Homo sapiens
tactttgatttttatccatt

SEQ ID NO: 5305367 - DNA, 18 bp, Homo sapiens
tactttgcaatccaaata

SEQ ID NO: 5305368 - DNA, 12 bp, Homo sapiens
tactttgcattt

SEQ ID NO: 5305369 - DNA, 16 bp, Homo sapiens
tactttgccactgctg

SEQ ID NO: 5305370 - DNA, 13 bp, Homo sapiens
tactttgccattt

SEQ ID NO: 5305371 - DNA, 20 bp, Homo sapiens
tactttgccatttttctata

SEQ ID NO: 5305372 - DNA, 17 bp, Homo sapiens
tactttgcttctctcca

SEQ ID NO: 5305373 - DNA, 23 bp, Homo sapiens
tactttgcttctctccacccatg

SEQ ID NO: 5305374 - DNA, 13 bp, Homo sapiens
tactttggactga

SEQ ID NO: 5305375 - DNA, 15 bp, Homo sapiens
tactttggactgagt

SEQ ID NO: 5305376 - DNA, 21 bp, Homo sapiens
tactttggatgcaattaaaac

SEQ ID NO: 5305377 - DNA, 16 bp, Homo sapiens
tactttggcaatttcc

SEQ ID NO: 5305378 - DNA, 16 bp, Homo sapiens
tagaactttgtatttt

SEQ ID NO: 5305379 - DNA, 17 bp, Homo sapiens
tagaacttttttaaata

SEQ ID NO: 5305380 - DNA, 21 bp, Homo sapiens
tagaacttttttaaataaact

SEQ ID NO: 5305381 - DNA, 11 bp, Homo sapiens
tagaagaaaac

SEQ ID NO: 5305382 - DNA, 12 bp, Homo sapiens
tagaagaaaagc

SEQ ID NO: 5305383 - DNA, 17 bp, Homo sapiens
tagaagaaaagcccatt

SEQ ID NO: 5305384 - DNA, 12 bp, Homo sapiens
tagaagaaaagt

SEQ ID NO: 5305385 - DNA, 12 bp, Homo sapiens
tagaagaaagaa

SEQ ID NO: 5305386 - DNA, 16 bp, Homo sapiens
tagaagaaagaaaatg

SEQ ID NO: 5305387 - DNA, 19 bp, Homo sapiens
tagaagaaagcaaaaaata

SEQ ID NO: 5305388 - DNA, 19 bp, Homo sapiens
tagaagaaagtaaaaagaa

SEQ ID NO: 5305389 - DNA, 20 bp, Homo sapiens
tagaagaaccaaatacctca

SEQ ID NO: 5305390 - DNA, 21 bp, Homo sapiens
tagaagaaccaaatacctcaa

SEQ ID NO: 5305391 - DNA, 12 bp, Homo sapiens
tagaagaactgc

SEQ ID NO: 5305392 - DNA, 16 bp, Homo sapiens
tagaagaagaggaaga

SEQ ID NO: 5305393 - DNA, 17 bp, Homo sapiens
tagaagaagaggaagaa

SEQ ID NO: 5305394 - DNA, 19 bp, Homo sapiens
tagaagaagaggaagaaat

SEQ ID NO: 5305395 - DNA, 18 bp, Homo sapiens
tagaagaagctatgtcaa

SEQ ID NO: 5305396 - DNA, 21 bp, Homo sapiens
tagaagaaggactgaagaaaa

SEQ ID NO: 5305397 - DNA, 14 bp, Homo sapiens
tagaagaagtgtgt

SEQ ID NO: 5305398 - DNA, 16 bp, Homo sapiens
tagaagaatattgtat

SEQ ID NO: 5305399 - DNA, 13 bp, Homo sapiens
tagaagaatttta

SEQ ID NO: 5305400 - DNA, 18 bp, Homo sapiens
tagaagacaaaatgttca

SEQ ID NO: 5305401 - DNA, 15 bp, Homo sapiens
tagaagacatttata

SEQ ID NO: 5305402 - DNA, 20 bp, Homo sapiens
tagaagactctaccagactg

SEQ ID NO: 5305403 - DNA, 14 bp, Homo sapiens
tagaagagagaggt

SEQ ID NO: 5305404 - DNA, 13 bp, Homo sapiens
tagaagagcacag

SEQ ID NO: 5305405 - DNA, 18 bp, Homo sapiens
tagaagagcacagagccc

SEQ ID NO: 5305406 - DNA, 18 bp, Homo sapiens
tagaagagggagaaggag

SEQ ID NO: 5305407 - DNA, 19 bp, Homo sapiens
tagaagagggttttaggta

SEQ ID NO: 5305408 - DNA, 14 bp, Homo sapiens
tagaagataacatt

SEQ ID NO: 5305409 - DNA, 19 bp, Homo sapiens
tagaagataacattttcaa

SEQ ID NO: 5305410 - DNA, 22 bp, Homo sapiens
tagaagatagcatgggaggtga

SEQ ID NO: 5305411 - DNA, 19 bp, Homo sapiens
tagaagatcacagcagggc

SEQ ID NO: 5305412 - DNA, 16 bp, Homo sapiens
tagaagatcctacccc

SEQ ID NO: 5305413 - DNA, 18 bp, Homo sapiens
tagaagatgaatcagtat

SEQ ID NO: 5305414 - DNA, 21 bp, Homo sapiens
tagaagatgaatcagtatgaa

SEQ ID NO: 5305415 - DNA, 15 bp, Homo sapiens
tagaagatgtgtaaa

SEQ ID NO: 5305416 - DNA, 17 bp, Homo sapiens
tagaagattagaaacta

SEQ ID NO: 5305417 - DNA, 19 bp, Homo sapiens
tagaagcaaagatttcagt

SEQ ID NO: 5305418 - DNA, 20 bp, Homo sapiens
tagaagcaaagatttcagta

SEQ ID NO: 5305419 - DNA, 23 bp, Homo sapiens
tagaagcaaattaaacggtaaca

SEQ ID NO: 5305420 - DNA, 22 bp, Homo sapiens
tagaagcaagctggatgcagtg

SEQ ID NO: 5305421 - DNA, 17 bp, Homo sapiens
tagaagcacggctgtgg

SEQ ID NO: 5305422 - DNA, 22 bp, Homo sapiens
tagaagcactacaccttgcctt

SEQ ID NO: 5305423 - DNA, 14 bp, Homo sapiens
tagaagcagaggga

SEQ ID NO: 5305424 - DNA, 21 bp, Homo sapiens
tagaagcatttgatattatct

SEQ ID NO: 5305425 - DNA, 18 bp, Homo sapiens
tagaagccacccttccct

SEQ ID NO: 5305426 - DNA, 22 bp, Homo sapiens
tagaagccacccttccctgcct

SEQ ID NO: 5305427 - DNA, 10 bp, Homo sapiens
tagaagccag

SEQ ID NO: 5305428 - DNA, 17 bp, Homo sapiens
tagaagccatgggacct

SEQ ID NO: 5305429 - DNA, 16 bp, Homo sapiens
tagaagcccattcatt

SEQ ID NO: 5305430 - DNA, 22 bp, Homo sapiens
tagaagccccgttataactcct

SEQ ID NO: 5305431 - DNA, 17 bp, Homo sapiens
tagaagccgtgggaaga

SEQ ID NO: 5305432 - DNA, 21 bp, Homo sapiens
tagaagcctactggtagaaaa

SEQ ID NO: 5305433 - DNA, 13 bp, Homo sapiens
tagaagcctctcg

SEQ ID NO: 5305434 - DNA, 12 bp, Homo sapiens
tagaagcctgca

SEQ ID NO: 5305435 - DNA, 21 bp, Homo sapiens
tagaagccttatgaaaattat

SEQ ID NO: 5305436 - DNA, 24 bp, Homo sapiens
tagaagcgatttaagttacaatgt

SEQ ID NO: 5305437 - DNA, 18 bp, Homo sapiens
tagaagcggtttccaggc

SEQ ID NO: 5305438 - DNA, 13 bp, Homo sapiens
tagaagctcaggt

SEQ ID NO: 5305439 - DNA, 15 bp, Homo sapiens
tagaagctcttggac

SEQ ID NO: 5305440 - DNA, 20 bp, Homo sapiens
tagaagcttcttgctcctgt

SEQ ID NO: 5305441 - DNA, 23 bp, Homo sapiens
tagaaggaaaaaagttccttcct

SEQ ID NO: 5305442 - DNA, 21 bp, Homo sapiens
tagaaggaaagcatgtctctg

SEQ ID NO: 5305443 - DNA, 21 bp, Homo sapiens
tagaaggaagcacctatgaaa

SEQ ID NO: 5305444 - DNA, 20 bp, Homo sapiens
tagaaggaagtgtgtttgcc

SEQ ID NO: 5305445 - DNA, 19 bp, Homo sapiens
tagaaggaatttgtacttc

SEQ ID NO: 5305446 - DNA, 19 bp, Homo sapiens
tagaaggagattgtgggga

SEQ ID NO: 5305447 - DNA, 13 bp, Homo sapiens
tagaaggagcctt

SEQ ID NO: 5305448 - DNA, 15 bp, Homo sapiens
tagaaggagccttgt

SEQ ID NO: 5305449 - DNA, 17 bp, Homo sapiens
tagaaggatgtacattt

SEQ ID NO: 5305450 - DNA, 21 bp, Homo sapiens
tagaaggatgtacatttccaa

SEQ ID NO: 5305451 - DNA, 21 bp, Homo sapiens
tagaaggcgtccatgtttatt

SEQ ID NO: 5305452 - DNA, 14 bp, Homo sapiens
tagaaggctgtctt

SEQ ID NO: 5305453 - DNA, 18 bp, Homo sapiens
tagaaggctgtggtgagg

SEQ ID NO: 5305454 - DNA, 17 bp, Homo sapiens
tagaaggcttaagaact

SEQ ID NO: 5305455 - DNA, 18 bp, Homo sapiens
tagaaggcttctctccac

SEQ ID NO: 5305456 - DNA, 24 bp, Homo sapiens
tagaagggctagaacctggagagc

SEQ ID NO: 5305457 - DNA, 16 bp, Homo sapiens
tagaaggtcggaggct

SEQ ID NO: 5305458 - DNA, 21 bp, Homo sapiens
tagaagtaagaagaggagcct

SEQ ID NO: 5305459 - DNA, 24 bp, Homo sapiens
tagaagtaagaagaggagcctcag

SEQ ID NO: 5305460 - DNA, 14 bp, Homo sapiens
tagaagtagattct

SEQ ID NO: 5305461 - DNA, 20 bp, Homo sapiens
tagaagtaggaggaaacagt

SEQ ID NO: 5305462 - DNA, 16 bp, Homo sapiens
tagaagtcacacagta

SEQ ID NO: 5305463 - DNA, 20 bp, Homo sapiens
tagaagtccacagacatctt

SEQ ID NO: 5305464 - DNA, 14 bp, Homo sapiens
tagaagtctggaaa

SEQ ID NO: 5305465 - DNA, 22 bp, Homo sapiens
tagaagtctgtctttctataga

SEQ ID NO: 5305466 - DNA, 22 bp, Homo sapiens
tagaagtcttaattgtgtttat

SEQ ID NO: 5305467 - DNA, 23 bp, Homo sapiens
tagaagtcttaattgtgtttatt

SEQ ID NO: 5305468 - DNA, 20 bp, Homo sapiens
tagaagtcttagatgtatat

SEQ ID NO: 5305469 - DNA, 18 bp, Homo sapiens
tagaagtcttcatgaaat

SEQ ID NO: 5305470 - DNA, 20 bp, Homo sapiens
tagaagtcttcatgaaatgc

SEQ ID NO: 5305471 - DNA, 22 bp, Homo sapiens
tagaagtcttcatgaaatgcta

SEQ ID NO: 5305472 - DNA, 15 bp, Homo sapiens
tagaagtctttcaga

SEQ ID NO: 5305473 - DNA, 18 bp, Homo sapiens
tagaagtctttcagatga

SEQ ID NO: 5305474 - DNA, 16 bp, Homo sapiens
tagaagtctttcagtg

SEQ ID NO: 5305475 - DNA, 12 bp, Homo sapiens
tagaagtgacat

SEQ ID NO: 5305476 - DNA, 21 bp, Homo sapiens
tagaagtgagtttgtaaatat

SEQ ID NO: 5305477 - DNA, 15 bp, Homo sapiens
tagaagtgcatttct

SEQ ID NO: 5305478 - DNA, 16 bp, Homo sapiens
tagaagtgcatttctg

SEQ ID NO: 5305479 - DNA, 16 bp, Homo sapiens
tagaagtgctcccctc

SEQ ID NO: 5305480 - DNA, 16 bp, Homo sapiens
tagaagtggaccagga

SEQ ID NO: 5305481 - DNA, 20 bp, Homo sapiens
tagaagtggcatctgaaaac

SEQ ID NO: 5305482 - DNA, 19 bp, Homo sapiens
tagaagtgggccaggacag

SEQ ID NO: 5305483 - DNA, 16 bp, Homo sapiens
tagaagtgtcatgttt

SEQ ID NO: 5305484 - DNA, 17 bp, Homo sapiens
tagaagtgttgtaaaag

SEQ ID NO: 5305485 - DNA, 16 bp, Homo sapiens
tagaagttaaagtcaa

SEQ ID NO: 5305486 - DNA, 14 bp, Homo sapiens
tagaagttaccaaa

SEQ ID NO: 5305487 - DNA, 15 bp, Homo sapiens
tagaagttactgaat

SEQ ID NO: 5305488 - DNA, 20 bp, Homo sapiens
tagaagttactgaatgcacc

SEQ ID NO: 5305489 - DNA, 22 bp, Homo sapiens
tagaagttctagtgttttcaat

SEQ ID NO: 5305490 - DNA, 21 bp, Homo sapiens
tagaagtttggctgctgtcat

SEQ ID NO: 5305491 - DNA, 21 bp, Homo sapiens
tagaagtttgtccatttgtaa

SEQ ID NO: 5305492 - DNA, 14 bp, Homo sapiens
tagaagtttttgta

SEQ ID NO: 5305493 - DNA, 18 bp, Homo sapiens
tagaagtttttgtactgt

SEQ ID NO: 5305494 - DNA, 15 bp, Homo sapiens
tagaataaaagctgt

SEQ ID NO: 5305495 - DNA, 22 bp, Homo sapiens
tagaataaaagctgtggaatga

SEQ ID NO: 5305496 - DNA, 22 bp, Homo sapiens
tagaataaaggcagttttctaa

SEQ ID NO: 5305497 - DNA, 15 bp, Homo sapiens
tagaataaagttgaa

SEQ ID NO: 5305498 - DNA, 14 bp, Homo sapiens
tagaataaatggtt

SEQ ID NO: 5305499 - DNA, 18 bp, Homo sapiens
tagaataagaatttgcat

SEQ ID NO: 5305500 - DNA, 23 bp, Homo sapiens
tagaataaggaggaggagggaga

SEQ ID NO: 5305501 - DNA, 16 bp, Homo sapiens
tagaataatctattat

SEQ ID NO: 5305502 - DNA, 22 bp, Homo sapiens
tagaataatctattatttggag

SEQ ID NO: 5305503 - DNA, 15 bp, Homo sapiens
tagaataatctcatc

SEQ ID NO: 5305504 - DNA, 17 bp, Homo sapiens
tagaataatcttgctca

SEQ ID NO: 5305505 - DNA, 20 bp, Homo sapiens
tagaataattcttttctgag

SEQ ID NO: 5305506 - DNA, 16 bp, Homo sapiens
tagaatacatattaca

SEQ ID NO: 5305507 - DNA, 22 bp, Homo sapiens
tagaatacattgatacaaagta

SEQ ID NO: 5305508 - DNA, 22 bp, Homo sapiens
tagaatacattgtacttataca

SEQ ID NO: 5305509 - DNA, 16 bp, Homo sapiens
tagaatacattttgta

SEQ ID NO: 5305510 - DNA, 13 bp, Homo sapiens
tagaataccccac

SEQ ID NO: 5305511 - DNA, 18 bp, Homo sapiens
tagaatactttttaaaag

SEQ ID NO: 5305512 - DNA, 21 bp, Homo sapiens
tagaatacttttttctagttt

SEQ ID NO: 5305513 - DNA, 22 bp, Homo sapiens
tagaataggcactttaaaacac

SEQ ID NO: 5305514 - DNA, 13 bp, Homo sapiens
tagaatataaaaa

SEQ ID NO: 5305515 - DNA, 18 bp, Homo sapiens
tagaatataaacacataa

SEQ ID NO: 5305516 - DNA, 17 bp, Homo sapiens
tagaatatactgtcttg

SEQ ID NO: 5305517 - DNA, 24 bp, Homo sapiens
tagaatatagcatctttcatatgg

SEQ ID NO: 5305518 - DNA, 22 bp, Homo sapiens
tagaatataggtctcttctccc

SEQ ID NO: 5305519 - DNA, 16 bp, Homo sapiens
tagaatatcctacttc

SEQ ID NO: 5305520 - DNA, 22 bp, Homo sapiens
tagaatatcctatactggttat

SEQ ID NO: 5305521 - DNA, 20 bp, Homo sapiens
tagaatatggacttaaatgt

SEQ ID NO: 5305522 - DNA, 13 bp, Homo sapiens
tagaatattaaaa

SEQ ID NO: 5305523 - DNA, 15 bp, Homo sapiens
tagaatatttattac

SEQ ID NO: 5305524 - DNA, 20 bp, Homo sapiens
tagaatatttattacctctg

SEQ ID NO: 5305525 - DNA, 15 bp, Homo sapiens
tagaatcaaatactc

SEQ ID NO: 5305526 - DNA, 20 bp, Homo sapiens
tagaatcagatacaaaacta

SEQ ID NO: 5305527 - DNA, 21 bp, Homo sapiens
tagaatcagcctaggggtcag

SEQ ID NO: 5305528 - DNA, 23 bp, Homo sapiens
tagaatccaaacttggatttttg

SEQ ID NO: 5305529 - DNA, 19 bp, Homo sapiens
tagaatccaaattctctga

SEQ ID NO: 5305530 - DNA, 18 bp, Homo sapiens
tagaatcccagccccctg

SEQ ID NO: 5305531 - DNA, 16 bp, Homo sapiens
tagaatccgaagggaa

SEQ ID NO: 5305532 - DNA, 15 bp, Homo sapiens
tagaatcctgcttta

SEQ ID NO: 5305533 - DNA, 16 bp, Homo sapiens
tagaatcgctttcctt

SEQ ID NO: 5305534 - DNA, 16 bp, Homo sapiens
tagaatctattttcta

SEQ ID NO: 5305535 - DNA, 22 bp, Homo sapiens
tagaatctattttctatgtact

SEQ ID NO: 5305536 - DNA, 18 bp, Homo sapiens
tagaatctgatgccttta

SEQ ID NO: 5305537 - DNA, 22 bp, Homo sapiens
tagaatctgcaattcaaaagtt

SEQ ID NO: 5305538 - DNA, 12 bp, Homo sapiens
tagaatctggag

SEQ ID NO: 5305539 - DNA, 20 bp, Homo sapiens
tagaatctttattcaaactt

SEQ ID NO: 5305540 - DNA, 20 bp, Homo sapiens
tagaatgaagaactgcatgt

SEQ ID NO: 5305541 - DNA, 15 bp, Homo sapiens
tagaatgaccttgta

SEQ ID NO: 5305542 - DNA, 17 bp, Homo sapiens
tagaatgaccttgtaat

SEQ ID NO: 5305543 - DNA, 19 bp, Homo sapiens
tagaatgagaaatcatgtt

SEQ ID NO: 5305544 - DNA, 17 bp, Homo sapiens
tagaatgagatctgaat

SEQ ID NO: 5305545 - DNA, 13 bp, Homo sapiens
tagaatgataaat

SEQ ID NO: 5305546 - DNA, 18 bp, Homo sapiens
tagaatgatctattgctc

SEQ ID NO: 5305547 - DNA, 21 bp, Homo sapiens
tagaatgatttcatgctatct

SEQ ID NO: 5305548 - DNA, 18 bp, Homo sapiens
tagaatgatttttgctat

SEQ ID NO: 5305549 - DNA, 19 bp, Homo sapiens
tagaatgcatgtaaggtct

SEQ ID NO: 5305550 - DNA, 22 bp, Homo sapiens
tagaatgccggttaaattccat

SEQ ID NO: 5305551 - DNA, 20 bp, Homo sapiens
tagaatgctacaagtaactc

SEQ ID NO: 5305552 - DNA, 16 bp, Homo sapiens
tagaatgctgtagaat

SEQ ID NO: 5305553 - DNA, 19 bp, Homo sapiens
tagaatggaaaactgcctg

SEQ ID NO: 5305554 - DNA, 18 bp, Homo sapiens
tagataaattactataaa

SEQ ID NO: 5305555 - DNA, 21 bp, Homo sapiens
tagataacattcatgagattg

SEQ ID NO: 5305556 - DNA, 17 bp, Homo sapiens
tagataaccaattttca

SEQ ID NO: 5305557 - DNA, 17 bp, Homo sapiens
tagataaccttgtttat

SEQ ID NO: 5305558 - DNA, 20 bp, Homo sapiens
tagataacgaagtgcactta

SEQ ID NO: 5305559 - DNA, 17 bp, Homo sapiens
tagataacggctctcca

SEQ ID NO: 5305560 - DNA, 22 bp, Homo sapiens
tagataacggctctccagacct

SEQ ID NO: 5305561 - DNA, 13 bp, Homo sapiens
tagataactcttt

SEQ ID NO: 5305562 - DNA, 16 bp, Homo sapiens
tagataactctttgga

SEQ ID NO: 5305563 - DNA, 20 bp, Homo sapiens
tagataactgctcttttact

SEQ ID NO: 5305564 - DNA, 13 bp, Homo sapiens
tagataacttaaa

SEQ ID NO: 5305565 - DNA, 17 bp, Homo sapiens
tagataatatttctgaa

SEQ ID NO: 5305566 - DNA, 15 bp, Homo sapiens
tagataatttacaag

SEQ ID NO: 5305567 - DNA, 16 bp, Homo sapiens
tagatacaaaaccttg

SEQ ID NO: 5305568 - DNA, 13 bp, Homo sapiens
tagatacaataaa

SEQ ID NO: 5305569 - DNA, 12 bp, Homo sapiens
tagatacaatca

SEQ ID NO: 5305570 - DNA, 23 bp, Homo sapiens
tagatacagatccgcatgtgtct

SEQ ID NO: 5305571 - DNA, 17 bp, Homo sapiens
tagatactactttctct

SEQ ID NO: 5305572 - DNA, 21 bp, Homo sapiens
tagatagaaataaatagctat

SEQ ID NO: 5305573 - DNA, 16 bp, Homo sapiens
tagatagaagaatttt

SEQ ID NO: 5305574 - DNA, 23 bp, Homo sapiens
tagatagccctgtcctggtggta

SEQ ID NO: 5305575 - DNA, 22 bp, Homo sapiens
tagatagctgcatgtggctttt

SEQ ID NO: 5305576 - DNA, 20 bp, Homo sapiens
tagataggaagaaagaagac

SEQ ID NO: 5305577 - DNA, 22 bp, Homo sapiens
tagataggtcagtgcaaatact

SEQ ID NO: 5305578 - DNA, 22 bp, Homo sapiens
tagataggtgcttttaactggg

SEQ ID NO: 5305579 - DNA, 18 bp, Homo sapiens
tagatagtcatgctgcta

SEQ ID NO: 5305580 - DNA, 19 bp, Homo sapiens
tagatagttaaaagactgc

SEQ ID NO: 5305581 - DNA, 15 bp, Homo sapiens
tagatatataaataa

SEQ ID NO: 5305582 - DNA, 14 bp, Homo sapiens
tagatatataactt

SEQ ID NO: 5305583 - DNA, 15 bp, Homo sapiens
tagatatatgctctg

SEQ ID NO: 5305584 - DNA, 16 bp, Homo sapiens
tagatatattctctaa

SEQ ID NO: 5305585 - DNA, 17 bp, Homo sapiens
tagatatcacttactca

SEQ ID NO: 5305586 - DNA, 22 bp, Homo sapiens
tagatatcctctccccctcctc

SEQ ID NO: 5305587 - DNA, 19 bp, Homo sapiens
tagatatctttttattgat

SEQ ID NO: 5305588 - DNA, 20 bp, Homo sapiens
tagatatctttttattgatg

SEQ ID NO: 5305589 - DNA, 22 bp, Homo sapiens
tagatatctttttattgatgtg

SEQ ID NO: 5305590 - DNA, 14 bp, Homo sapiens
tagatattaaaatt

SEQ ID NO: 5305591 - DNA, 21 bp, Homo sapiens
tagatattaggtccattcatt

SEQ ID NO: 5305592 - DNA, 17 bp, Homo sapiens
tagatattcatactttc

SEQ ID NO: 5305593 - DNA, 22 bp, Homo sapiens
tagatattgaggccaagaatat

SEQ ID NO: 5305594 - DNA, 14 bp, Homo sapiens
tagatattgctact

SEQ ID NO: 5305595 - DNA, 17 bp, Homo sapiens
tagatattgctactata

SEQ ID NO: 5305596 - DNA, 14 bp, Homo sapiens
tagatattggaaga

SEQ ID NO: 5305597 - DNA, 16 bp, Homo sapiens
tagatattggacaaag

SEQ ID NO: 5305598 - DNA, 21 bp, Homo sapiens
tagatattgtcctaagtgtca

SEQ ID NO: 5305599 - DNA, 14 bp, Homo sapiens
tagatatttcatgt

SEQ ID NO: 5305600 - DNA, 19 bp, Homo sapiens
tagatatttcgaccctggg

SEQ ID NO: 5305601 - DNA, 20 bp, Homo sapiens
tagatatttcgaccctgggg

SEQ ID NO: 5305602 - DNA, 21 bp, Homo sapiens
tagatatttcgaccctggggc

SEQ ID NO: 5305603 - DNA, 13 bp, Homo sapiens
tagatatttgaaa

SEQ ID NO: 5305604 - DNA, 19 bp, Homo sapiens
tagatatttgaaatagatt

SEQ ID NO: 5305605 - DNA, 21 bp, Homo sapiens
tagatatttggcttaaatata

SEQ ID NO: 5305606 - DNA, 17 bp, Homo sapiens
tagatattttatatgta

SEQ ID NO: 5305607 - DNA, 17 bp, Homo sapiens
tagatattttccatata

SEQ ID NO: 5305608 - DNA, 14 bp, Homo sapiens
tagatcaaatactt

SEQ ID NO: 5305609 - DNA, 17 bp, Homo sapiens
tagatcaaatactttaa

SEQ ID NO: 5305610 - DNA, 23 bp, Homo sapiens
tagatcaaatactttaaaggaaa

SEQ ID NO: 5305611 - DNA, 22 bp, Homo sapiens
tagatcaactcatgttaattga

SEQ ID NO: 5305612 - DNA, 15 bp, Homo sapiens
tagatcaataaatgt

SEQ ID NO: 5305613 - DNA, 17 bp, Homo sapiens
tagatcaataaatgtca

SEQ ID NO: 5305614 - DNA, 17 bp, Homo sapiens
tagatcacataacagaa

SEQ ID NO: 5305615 - DNA, 15 bp, Homo sapiens
tagatcagccattaa

SEQ ID NO: 5305616 - DNA, 16 bp, Homo sapiens
tagatcagccattaaa

SEQ ID NO: 5305617 - DNA, 13 bp, Homo sapiens
tagatcagtattt

SEQ ID NO: 5305618 - DNA, 21 bp, Homo sapiens
tagatcataaggcttcaaaat

SEQ ID NO: 5305619 - DNA, 13 bp, Homo sapiens
tagatcatagttt

SEQ ID NO: 5305620 - DNA, 13 bp, Homo sapiens
tagatcatttcta

SEQ ID NO: 5305621 - DNA, 14 bp, Homo sapiens
tagatcatttctag

SEQ ID NO: 5305622 - DNA, 17 bp, Homo sapiens
tagatccaaatgtaaag

SEQ ID NO: 5305623 - DNA, 21 bp, Homo sapiens
tagatccacgtgtggcctccg

SEQ ID NO: 5305624 - DNA, 21 bp, Homo sapiens
tagatccagatccagactgta

SEQ ID NO: 5305625 - DNA, 14 bp, Homo sapiens
tagatccagcccaa

SEQ ID NO: 5305626 - DNA, 19 bp, Homo sapiens
tagatccagcccaaacctg

SEQ ID NO: 5305627 - DNA, 22 bp, Homo sapiens
tagatccagcccaaacctggga

SEQ ID NO: 5305628 - DNA, 21 bp, Homo sapiens
tagatccaggcttctcccgga

SEQ ID NO: 5305629 - DNA, 18 bp, Homo sapiens
tagatccatttccattgc

SEQ ID NO: 5305630 - DNA, 22 bp, Homo sapiens
tagatccatttggacaaaatgg

SEQ ID NO: 5305631 - DNA, 18 bp, Homo sapiens
tagatcccacatcgtata

SEQ ID NO: 5305632 - DNA, 21 bp, Homo sapiens
tagatcccacgttgatgtctg

SEQ ID NO: 5305633 - DNA, 19 bp, Homo sapiens
tagatcccatgtcacctca

SEQ ID NO: 5305634 - DNA, 21 bp, Homo sapiens
tagatcccatgtcacctcagc

SEQ ID NO: 5305635 - DNA, 14 bp, Homo sapiens
tagatcctttaaaa

SEQ ID NO: 5305636 - DNA, 15 bp, Homo sapiens
tagatcgcttgagcc

SEQ ID NO: 5305637 - DNA, 16 bp, Homo sapiens
tagatctagtgccatt

SEQ ID NO: 5305638 - DNA, 13 bp, Homo sapiens
tagatctctgaag

SEQ ID NO: 5305639 - DNA, 18 bp, Homo sapiens
tagatctgagccctccct

SEQ ID NO: 5305640 - DNA, 15 bp, Homo sapiens
tagatctgcaggctg

SEQ ID NO: 5305641 - DNA, 17 bp, Homo sapiens
tagatctgcaggctgca

SEQ ID NO: 5305642 - DNA, 23 bp, Homo sapiens
tagatctgctttctgttcatctc

SEQ ID NO: 5305643 - DNA, 15 bp, Homo sapiens
tagatctggcatgtt

SEQ ID NO: 5305644 - DNA, 21 bp, Homo sapiens
tagatcttaagcagtaatctg

SEQ ID NO: 5305645 - DNA, 15 bp, Homo sapiens
tagatcttacatctg

SEQ ID NO: 5305646 - DNA, 17 bp, Homo sapiens
tagatcttatattggtt

SEQ ID NO: 5305647 - DNA, 12 bp, Homo sapiens
tagatcttctga

SEQ ID NO: 5305648 - DNA, 13 bp, Homo sapiens
tagatcttctgaa

SEQ ID NO: 5305649 - DNA, 15 bp, Homo sapiens
tagatcttctgaaat

SEQ ID NO: 5305650 - DNA, 17 bp, Homo sapiens
tagatgaaaaagcatgt

SEQ ID NO: 5305651 - DNA, 21 bp, Homo sapiens
tagatgaaaaagcatgtacag

SEQ ID NO: 5305652 - DNA, 16 bp, Homo sapiens
tagatgaagaaagaga

SEQ ID NO: 5305653 - DNA, 18 bp, Homo sapiens
tagatgaatactaaatgg

SEQ ID NO: 5305654 - DNA, 15 bp, Homo sapiens
tagatgacaaatatt

SEQ ID NO: 5305655 - DNA, 19 bp, Homo sapiens
tagatgacaaatattctga

SEQ ID NO: 5305656 - DNA, 22 bp, Homo sapiens
tagatgacctcattaaccgatg

SEQ ID NO: 5305657 - DNA, 15 bp, Homo sapiens
tagatgactttgcag

SEQ ID NO: 5305658 - DNA, 21 bp, Homo sapiens
tagatgagattgttttatcat

SEQ ID NO: 5305659 - DNA, 23 bp, Homo sapiens
tagatgagcccagccctgttctg

SEQ ID NO: 5305660 - DNA, 16 bp, Homo sapiens
tagatgagccgggtcc

SEQ ID NO: 5305661 - DNA, 17 bp, Homo sapiens
tagatgagctgggccgg

SEQ ID NO: 5305662 - DNA, 13 bp, Homo sapiens
tagatgaggctca

SEQ ID NO: 5305663 - DNA, 16 bp, Homo sapiens
tagatgagggtgactg

SEQ ID NO: 5305664 - DNA, 17 bp, Homo sapiens
tagatgagggtgactgt

SEQ ID NO: 5305665 - DNA, 15 bp, Homo sapiens
tagatgatcaacata

SEQ ID NO: 5305666 - DNA, 14 bp, Homo sapiens
tagatgatgtattt

SEQ ID NO: 5305667 - DNA, 21 bp, Homo sapiens
tagatgattaaataagattct

SEQ ID NO: 5305668 - DNA, 23 bp, Homo sapiens
tagatgattaaataagattctaa

SEQ ID NO: 5305669 - DNA, 22 bp, Homo sapiens
tagatgcaagtaaaaaaaatca

SEQ ID NO: 5305670 - DNA, 12 bp, Homo sapiens
tagatgcagaaa

SEQ ID NO: 5305671 - DNA, 17 bp, Homo sapiens
tagatgcaggaggctca

SEQ ID NO: 5305672 - DNA, 19 bp, Homo sapiens
tagatgcatttgggtccag

SEQ ID NO: 5305673 - DNA, 20 bp, Homo sapiens
tagatgcatttgggtccagg

SEQ ID NO: 5305674 - DNA, 21 bp, Homo sapiens
tagatgcatttgggtccagga

SEQ ID NO: 5305675 - DNA, 22 bp, Homo sapiens
tagatgcatttgggtccaggag

SEQ ID NO: 5305676 - DNA, 23 bp, Homo sapiens
tagatgcatttgggtccaggagg

SEQ ID NO: 5305677 - DNA, 19 bp, Homo sapiens
tagatgcgcagccccatct

SEQ ID NO: 5305678 - DNA, 16 bp, Homo sapiens
tagatgctactaagaa

SEQ ID NO: 5305679 - DNA, 22 bp, Homo sapiens
tagatgctattaaagtttcatt

SEQ ID NO: 5305680 - DNA, 16 bp, Homo sapiens
tagatgctattaagaa

SEQ ID NO: 5305681 - DNA, 19 bp, Homo sapiens
tagatgctattaagaaggc

SEQ ID NO: 5305682 - DNA, 17 bp, Homo sapiens
tagatgctggcatctct

SEQ ID NO: 5305683 - DNA, 18 bp, Homo sapiens
tagatgctggcccagggc

SEQ ID NO: 5305684 - DNA, 21 bp, Homo sapiens
tagatgctggcccagggccca

SEQ ID NO: 5305685 - DNA, 20 bp, Homo sapiens
tagatgctttcctaaatcag

SEQ ID NO: 5305686 - DNA, 17 bp, Homo sapiens
tagatggaaaaatgtga

SEQ ID NO: 5305687 - DNA, 16 bp, Homo sapiens
tagatggaatggaaaa

SEQ ID NO: 5305688 - DNA, 16 bp, Homo sapiens
tagatggacagtttgt

SEQ ID NO: 5305689 - DNA, 20 bp, Homo sapiens
tagatggaccagtagacaac

SEQ ID NO: 5305690 - DNA, 18 bp, Homo sapiens
tagatggagcaagtgagc

SEQ ID NO: 5305691 - DNA, 15 bp, Homo sapiens
tagatggcgatgtgt

SEQ ID NO: 5305692 - DNA, 13 bp, Homo sapiens
tagatgggaatga

SEQ ID NO: 5305693 - DNA, 17 bp, Homo sapiens
tagatgggaatgaagct

SEQ ID NO: 5305694 - DNA, 16 bp, Homo sapiens
tagatgggaggatgaa

SEQ ID NO: 5305695 - DNA, 20 bp, Homo sapiens
tagatgggtctggctgagct

SEQ ID NO: 5305696 - DNA, 15 bp, Homo sapiens
tagatgggtgggggc

SEQ ID NO: 5305697 - DNA, 14 bp, Homo sapiens
tagatggtgaaatt

SEQ ID NO: 5305698 - DNA, 19 bp, Homo sapiens
tagatggtgctgagaagct

SEQ ID NO: 5305699 - DNA, 14 bp, Homo sapiens
tagatggttacact

SEQ ID NO: 5305700 - DNA, 16 bp, Homo sapiens
tagatggttacactgt

SEQ ID NO: 5305701 - DNA, 17 bp, Homo sapiens
tagatggttacactgtt

SEQ ID NO: 5305702 - DNA, 20 bp, Homo sapiens
tagatggttacactgttaga

SEQ ID NO: 5305703 - DNA, 20 bp, Homo sapiens
tagatggttctcaattgtat

SEQ ID NO: 5305704 - DNA, 21 bp, Homo sapiens
tagatgtaaataaaattgagt

SEQ ID NO: 5305705 - DNA, 23 bp, Homo sapiens
tagatgtagataaactcagaaat

SEQ ID NO: 5305706 - DNA, 19 bp, Homo sapiens
tagatgtagcattgttcca

SEQ ID NO: 5305707 - DNA, 15 bp, Homo sapiens
tagatgtatcattaa

SEQ ID NO: 5305708 - DNA, 16 bp, Homo sapiens
tagatgtatgcacaca

SEQ ID NO: 5305709 - DNA, 19 bp, Homo sapiens
tagatgtatgcacacacat

SEQ ID NO: 5305710 - DNA, 18 bp, Homo sapiens
tagatgtccctttcttgg

SEQ ID NO: 5305711 - DNA, 15 bp, Homo sapiens
tagatgtctgtgtat

SEQ ID NO: 5305712 - DNA, 19 bp, Homo sapiens
tagatgtctgtgtatacat

SEQ ID NO: 5305713 - DNA, 19 bp, Homo sapiens
tagatgtcttcatcacttc

SEQ ID NO: 5305714 - DNA, 14 bp, Homo sapiens
tagatgtcttttat

SEQ ID NO: 5305715 - DNA, 12 bp, Homo sapiens
tagatgtgatta

SEQ ID NO: 5305716 - DNA, 13 bp, Homo sapiens
tagatgtgattta

SEQ ID NO: 5305717 - DNA, 19 bp, Homo sapiens
tagatgtgatttaatagtg

SEQ ID NO: 5305718 - DNA, 21 bp, Homo sapiens
tagatgtgatttaatagtgtt

SEQ ID NO: 5305719 - DNA, 18 bp, Homo sapiens
tagatgtgcaacctgtgg

SEQ ID NO: 5305720 - DNA, 19 bp, Homo sapiens
tagatgtgcaacctgtggc

SEQ ID NO: 5305721 - DNA, 13 bp, Homo sapiens
tagatgtgcaata

SEQ ID NO: 5305722 - DNA, 18 bp, Homo sapiens
tagatgtgcagtttggaa

SEQ ID NO: 5305723 - DNA, 21 bp, Homo sapiens
tagatgtgcagtttggaatta

SEQ ID NO: 5305724 - DNA, 18 bp, Homo sapiens
tagatgtgcccttttata

SEQ ID NO: 5305725 - DNA, 16 bp, Homo sapiens
tagatgtgctgctttg

SEQ ID NO: 5305726 - DNA, 18 bp, Homo sapiens
tagatgtggtccttagga

SEQ ID NO: 5305727 - DNA, 21 bp, Homo sapiens
tagatgtgtatacagaaaatg

SEQ ID NO: 5305728 - DNA, 11 bp, Homo sapiens
tagatgtgtgg

SEQ ID NO: 5305729 - DNA, 14 bp, Homo sapiens
tagatgttaaatgt

SEQ ID NO: 5305730 - DNA, 15 bp, Homo sapiens
tagatgttaaatgtt

SEQ ID NO: 5305731 - DNA, 24 bp, Homo sapiens
tagccccgccccagccctcagtca

SEQ ID NO: 5305732 - DNA, 14 bp, Homo sapiens
tagcccctcccaag

SEQ ID NO: 5305733 - DNA, 20 bp, Homo sapiens
tagcccctcccaagctggct

SEQ ID NO: 5305734 - DNA, 22 bp, Homo sapiens
tagcccctcccaagctggctgg

SEQ ID NO: 5305735 - DNA, 16 bp, Homo sapiens
tagcccctctcctgga

SEQ ID NO: 5305736 - DNA, 14 bp, Homo sapiens
tagcccctctctta

SEQ ID NO: 5305737 - DNA, 14 bp, Homo sapiens
tagcccctgaaagc

SEQ ID NO: 5305738 - DNA, 20 bp, Homo sapiens
tagccccttggattcctgca

SEQ ID NO: 5305739 - DNA, 12 bp, Homo sapiens
tagcccgcctgc

SEQ ID NO: 5305740 - DNA, 16 bp, Homo sapiens
tagcccgcctgccagt

SEQ ID NO: 5305741 - DNA, 19 bp, Homo sapiens
tagcccgcctgccagtcct

SEQ ID NO: 5305742 - DNA, 15 bp, Homo sapiens
tagcccggccaagga

SEQ ID NO: 5305743 - DNA, 23 bp, Homo sapiens
tagcccggccaaggacactgatg

SEQ ID NO: 5305744 - DNA, 16 bp, Homo sapiens
tagccctcacattaga

SEQ ID NO: 5305745 - DNA, 14 bp, Homo sapiens
tagccctcagccca

SEQ ID NO: 5305746 - DNA, 12 bp, Homo sapiens
tagccctcagtc

SEQ ID NO: 5305747 - DNA, 15 bp, Homo sapiens
tagccctccccccag

SEQ ID NO: 5305748 - DNA, 19 bp, Homo sapiens
tagccctccccccagctcc

SEQ ID NO: 5305749 - DNA, 23 bp, Homo sapiens
tagccctccccctcaacctcacc

SEQ ID NO: 5305750 - DNA, 15 bp, Homo sapiens
tagccctctttctct

SEQ ID NO: 5305751 - DNA, 18 bp, Homo sapiens
tagccctctttctctctg

SEQ ID NO: 5305752 - DNA, 24 bp, Homo sapiens
tagccctctttctctctgtgtggc

SEQ ID NO: 5305753 - DNA, 14 bp, Homo sapiens
tagccctgaacatt

SEQ ID NO: 5305754 - DNA, 12 bp, Homo sapiens
tagccctgagcc

SEQ ID NO: 5305755 - DNA, 13 bp, Homo sapiens
tagccctgagccc

SEQ ID NO: 5305756 - DNA, 17 bp, Homo sapiens
tagccctgccctcccaa

SEQ ID NO: 5305757 - DNA, 17 bp, Homo sapiens
tagccctgctccaactc

SEQ ID NO: 5305758 - DNA, 18 bp, Homo sapiens
tagccctggatggcctct

SEQ ID NO: 5305759 - DNA, 14 bp, Homo sapiens
tagccctggcccgg

SEQ ID NO: 5305760 - DNA, 19 bp, Homo sapiens
tagccctggcccggtccca

SEQ ID NO: 5305761 - DNA, 13 bp, Homo sapiens
tagccctgtcctg

SEQ ID NO: 5305762 - DNA, 18 bp, Homo sapiens
tagccctgttgacctgcc

SEQ ID NO: 5305763 - DNA, 14 bp, Homo sapiens
tagcccttcagatt

SEQ ID NO: 5305764 - DNA, 18 bp, Homo sapiens
tagcccttccagcctggg

SEQ ID NO: 5305765 - DNA, 15 bp, Homo sapiens
tagcccttccctgag

SEQ ID NO: 5305766 - DNA, 18 bp, Homo sapiens
tagcccttccctgagtgc

SEQ ID NO: 5305767 - DNA, 17 bp, Homo sapiens
tagcccttctaccccac

SEQ ID NO: 5305768 - DNA, 13 bp, Homo sapiens
tagccgacctcag

SEQ ID NO: 5305769 - DNA, 16 bp, Homo sapiens
tagccgacctcagcct

SEQ ID NO: 5305770 - DNA, 17 bp, Homo sapiens
tagccgacctcagcctt

SEQ ID NO: 5305771 - DNA, 15 bp, Homo sapiens
tagccgactgtcttg

SEQ ID NO: 5305772 - DNA, 17 bp, Homo sapiens
tagccgagagcctgctc

SEQ ID NO: 5305773 - DNA, 18 bp, Homo sapiens
tagccgagagcctgctcc

SEQ ID NO: 5305774 - DNA, 19 bp, Homo sapiens
tagccgagagcctgctccc

SEQ ID NO: 5305775 - DNA, 21 bp, Homo sapiens
tagccgatatcagaatttgtg

SEQ ID NO: 5305776 - DNA, 16 bp, Homo sapiens
tagccgattctctgcc

SEQ ID NO: 5305777 - DNA, 21 bp, Homo sapiens
tagccgcaccctgcacctgct

SEQ ID NO: 5305778 - DNA, 19 bp, Homo sapiens
tagccgcccatgcactggg

SEQ ID NO: 5305779 - DNA, 13 bp, Homo sapiens
tagccgccctgag

SEQ ID NO: 5305780 - DNA, 23 bp, Homo sapiens
tagccgcgtgacggacatccagg

SEQ ID NO: 5305781 - DNA, 14 bp, Homo sapiens
tagccgctgccctg

SEQ ID NO: 5305782 - DNA, 16 bp, Homo sapiens
tagccgctgccctggg

SEQ ID NO: 5305783 - DNA, 19 bp, Homo sapiens
tagccggagtgacagagta

SEQ ID NO: 5305784 - DNA, 16 bp, Homo sapiens
tagccggttcctgtcc

SEQ ID NO: 5305785 - DNA, 21 bp, Homo sapiens
tagcctaaaacgaatggtctt

SEQ ID NO: 5305786 - DNA, 16 bp, Homo sapiens
tagcctaaagggcagg

SEQ ID NO: 5305787 - DNA, 14 bp, Homo sapiens
tagcctaagatata

SEQ ID NO: 5305788 - DNA, 19 bp, Homo sapiens
tagcctaagatatacttgt

SEQ ID NO: 5305789 - DNA, 15 bp, Homo sapiens
tagcctaatattcat

SEQ ID NO: 5305790 - DNA, 16 bp, Homo sapiens
tagcctaatattcatg

SEQ ID NO: 5305791 - DNA, 15 bp, Homo sapiens
tagcctacaaatgtt

SEQ ID NO: 5305792 - DNA, 11 bp, Homo sapiens
tagcctaccat

SEQ ID NO: 5305793 - DNA, 16 bp, Homo sapiens
tagcctaggtgacaga

SEQ ID NO: 5305794 - DNA, 16 bp, Homo sapiens
tagcctcaattctcca

SEQ ID NO: 5305795 - DNA, 20 bp, Homo sapiens
tagcctcacgaaactggaat

SEQ ID NO: 5305796 - DNA, 18 bp, Homo sapiens
tagcctcacttttaatga

SEQ ID NO: 5305797 - DNA, 20 bp, Homo sapiens
tagcctcagatgatttcccc

SEQ ID NO: 5305798 - DNA, 12 bp, Homo sapiens
tagcctccacca

SEQ ID NO: 5305799 - DNA, 14 bp, Homo sapiens
tagcctccagcttt

SEQ ID NO: 5305800 - DNA, 16 bp, Homo sapiens
tagcctccctctcctc

SEQ ID NO: 5305801 - DNA, 22 bp, Homo sapiens
tagcctccgtttatgggccttg

SEQ ID NO: 5305802 - DNA, 17 bp, Homo sapiens
tagcctcctcctgggct

SEQ ID NO: 5305803 - DNA, 23 bp, Homo sapiens
tagcctcctcctgggctccagag

SEQ ID NO: 5305804 - DNA, 17 bp, Homo sapiens
tagcctcctgacctgag

SEQ ID NO: 5305805 - DNA, 15 bp, Homo sapiens
tagcctcgatgtcct

SEQ ID NO: 5305806 - DNA, 22 bp, Homo sapiens
tagcctcgatgtcctcctctgt

SEQ ID NO: 5305807 - DNA, 19 bp, Homo sapiens
tagcctcgtctttcagcga

SEQ ID NO: 5305808 - DNA, 20 bp, Homo sapiens
tagcctcgtctttcagcgag

SEQ ID NO: 5305809 - DNA, 15 bp, Homo sapiens
tagcctctctttgtt

SEQ ID NO: 5305810 - DNA, 19 bp, Homo sapiens
tagcctctggactggaaag

SEQ ID NO: 5305811 - DNA, 20 bp, Homo sapiens
tagcctctggactggaaagc

SEQ ID NO: 5305812 - DNA, 19 bp, Homo sapiens
tagcctctgggatctgcca

SEQ ID NO: 5305813 - DNA, 16 bp, Homo sapiens
tagcctctgtctggca

SEQ ID NO: 5305814 - DNA, 13 bp, Homo sapiens
tagcctgaaggat

SEQ ID NO: 5305815 - DNA, 20 bp, Homo sapiens
tagcctgaaggattctggga

SEQ ID NO: 5305816 - DNA, 20 bp, Homo sapiens
tagcctgatctttctagagc

SEQ ID NO: 5305817 - DNA, 12 bp, Homo sapiens
tagcctgcaccg

SEQ ID NO: 5305818 - DNA, 22 bp, Homo sapiens
tagcctgcaccgccgccaccct

SEQ ID NO: 5305819 - DNA, 23 bp, Homo sapiens
tagcctgcagaagtaagcctcat

SEQ ID NO: 5305820 - DNA, 17 bp, Homo sapiens
tagcctgcgtcatggct

SEQ ID NO: 5305821 - DNA, 17 bp, Homo sapiens
tagcctgctctgccact

SEQ ID NO: 5305822 - DNA, 15 bp, Homo sapiens
tagcctgctgtgggg

SEQ ID NO: 5305823 - DNA, 11 bp, Homo sapiens
tagcctggacc

SEQ ID NO: 5305824 - DNA, 14 bp, Homo sapiens
tagcctggactgct

SEQ ID NO: 5305825 - DNA, 21 bp, Homo sapiens
tagcctggactgtttcatagt

SEQ ID NO: 5305826 - DNA, 23 bp, Homo sapiens
tagcctggactgtttcatagttt

SEQ ID NO: 5305827 - DNA, 18 bp, Homo sapiens
tagcctggatagccttga

SEQ ID NO: 5305828 - DNA, 22 bp, Homo sapiens
tagcctggatattattcttgta

SEQ ID NO: 5305829 - DNA, 14 bp, Homo sapiens
tagcctggatggcc

SEQ ID NO: 5305830 - DNA, 22 bp, Homo sapiens
tagcctggatgtgggccaagtc

SEQ ID NO: 5305831 - DNA, 17 bp, Homo sapiens
tagcctggccaccagcc

SEQ ID NO: 5305832 - DNA, 11 bp, Homo sapiens
tagcctggcta

SEQ ID NO: 5305833 - DNA, 12 bp, Homo sapiens
tagcctggctgt

SEQ ID NO: 5305834 - DNA, 17 bp, Homo sapiens
tagcctgggccacaggg

SEQ ID NO: 5305835 - DNA, 14 bp, Homo sapiens
tagcctgggccaga

SEQ ID NO: 5305836 - DNA, 16 bp, Homo sapiens
tagcctgggccagaga

SEQ ID NO: 5305837 - DNA, 22 bp, Homo sapiens
tagcctgggcctcctcctagct

SEQ ID NO: 5305838 - DNA, 19 bp, Homo sapiens
tagcctggggcttgaattt

SEQ ID NO: 5305839 - DNA, 13 bp, Homo sapiens
tagcctggtctgt

SEQ ID NO: 5305840 - DNA, 19 bp, Homo sapiens
tagcctggtgacaggcaga

SEQ ID NO: 5305841 - DNA, 20 bp, Homo sapiens
tagcctgtcctgtcatcatc

SEQ ID NO: 5305842 - DNA, 14 bp, Homo sapiens
tagcctgtggcagt

SEQ ID NO: 5305843 - DNA, 20 bp, Homo sapiens
tagcctgtttcttcctgtta

SEQ ID NO: 5305844 - DNA, 13 bp, Homo sapiens
tagccttcccagc

SEQ ID NO: 5305845 - DNA, 19 bp, Homo sapiens
tagccttcccagcttcccg

SEQ ID NO: 5305846 - DNA, 15 bp, Homo sapiens
tagccttctctgttc

SEQ ID NO: 5305847 - DNA, 14 bp, Homo sapiens
tagccttgaaaaca

SEQ ID NO: 5305848 - DNA, 16 bp, Homo sapiens
tagccttgaaaacaaa

SEQ ID NO: 5305849 - DNA, 18 bp, Homo sapiens
tagccttgaaaacaaaca

SEQ ID NO: 5305850 - DNA, 20 bp, Homo sapiens
tagccttgctgtagagactt

SEQ ID NO: 5305851 - DNA, 13 bp, Homo sapiens
tagccttgcttgt

SEQ ID NO: 5305852 - DNA, 15 bp, Homo sapiens
tagccttgcttgtta

SEQ ID NO: 5305853 - DNA, 16 bp, Homo sapiens
tagccttgtgccctgc

SEQ ID NO: 5305854 - DNA, 21 bp, Homo sapiens
tagcctttacatggacagaat

SEQ ID NO: 5305855 - DNA, 11 bp, Homo sapiens
tagcctttccc

SEQ ID NO: 5305856 - DNA, 13 bp, Homo sapiens
tagcctttcttgt

SEQ ID NO: 5305857 - DNA, 14 bp, Homo sapiens
tagcctttgccctg

SEQ ID NO: 5305858 - DNA, 15 bp, Homo sapiens
tagcctttttgtata

SEQ ID NO: 5305859 - DNA, 23 bp, Homo sapiens
tagccttttttccccagacttgt

SEQ ID NO: 5305860 - DNA, 15 bp, Homo sapiens
tagcgaatgcactca

SEQ ID NO: 5305861 - DNA, 16 bp, Homo sapiens
tagcgaccccagactg

SEQ ID NO: 5305862 - DNA, 14 bp, Homo sapiens
tagcgagctgctct

SEQ ID NO: 5305863 - DNA, 17 bp, Homo sapiens
tagcgagctgctctgct

SEQ ID NO: 5305864 - DNA, 15 bp, Homo sapiens
tagcgaggctctaac

SEQ ID NO: 5305865 - DNA, 19 bp, Homo sapiens
tagcgaggctctaaccaca

SEQ ID NO: 5305866 - DNA, 17 bp, Homo sapiens
tagcgatctctcctggc

SEQ ID NO: 5305867 - DNA, 20 bp, Homo sapiens
tagcgatctctcctggccta

SEQ ID NO: 5305868 - DNA, 21 bp, Homo sapiens
tagcgctatctccctgcctcc

SEQ ID NO: 5305869 - DNA, 22 bp, Homo sapiens
tagcgctgccgcaccccagagt

SEQ ID NO: 5305870 - DNA, 17 bp, Homo sapiens
tagcgctggctcaggaa

SEQ ID NO: 5305871 - DNA, 20 bp, Homo sapiens
tagcgctggctcaggaagaa

SEQ ID NO: 5305872 - DNA, 20 bp, Homo sapiens
tagcgctggcttcattctca

SEQ ID NO: 5305873 - DNA, 13 bp, Homo sapiens
tagcgctgttttt

SEQ ID NO: 5305874 - DNA, 22 bp, Homo sapiens
tagcgggactcagtgagctggg

SEQ ID NO: 5305875 - DNA, 17 bp, Homo sapiens
tagcgtcaagacatttg

SEQ ID NO: 5305876 - DNA, 21 bp, Homo sapiens
tagcgtcaagacatttgctga

SEQ ID NO: 5305877 - DNA, 19 bp, Homo sapiens
tagcgtcctgaggaataaa

SEQ ID NO: 5305878 - DNA, 15 bp, Homo sapiens
tagcgtcctgccctg

SEQ ID NO: 5305879 - DNA, 18 bp, Homo sapiens
tagcgtgtgtagatagta

SEQ ID NO: 5305880 - DNA, 18 bp, Homo sapiens
tagcgttcccaacaacat

SEQ ID NO: 5305881 - DNA, 14 bp, Homo sapiens
tagcgttctggact

SEQ ID NO: 5305882 - DNA, 21 bp, Homo sapiens
tagcgttctggactctgcccc

SEQ ID NO: 5305883 - DNA, 15 bp, Homo sapiens
tagcgttcttgtaat

SEQ ID NO: 5305884 - DNA, 18 bp, Homo sapiens
tagcgttttttaaatgta

SEQ ID NO: 5305885 - DNA, 19 bp, Homo sapiens
tagctaaacggattccaaa

SEQ ID NO: 5305886 - DNA, 15 bp, Homo sapiens
tagctaacagtgaag

SEQ ID NO: 5305887 - DNA, 17 bp, Homo sapiens
tagctaactaattctgt

SEQ ID NO: 5305888 - DNA, 17 bp, Homo sapiens
tagctaactgtaaatca

SEQ ID NO: 5305889 - DNA, 19 bp, Homo sapiens
tagctaagatataatttaa

SEQ ID NO: 5305890 - DNA, 15 bp, Homo sapiens
tagctaagcaagcca

SEQ ID NO: 5305891 - DNA, 20 bp, Homo sapiens
tagctaagcaagccaggaga

SEQ ID NO: 5305892 - DNA, 22 bp, Homo sapiens
tagctaagcaagccaggagaag

SEQ ID NO: 5305893 - DNA, 20 bp, Homo sapiens
tagctaataaaaagcttttg

SEQ ID NO: 5305894 - DNA, 21 bp, Homo sapiens
tagctaataaaaagcttttgt

SEQ ID NO: 5305895 - DNA, 22 bp, Homo sapiens
tagctaataaaaagcttttgtc

SEQ ID NO: 5305896 - DNA, 14 bp, Homo sapiens
tagctaataataaa

SEQ ID NO: 5305897 - DNA, 17 bp, Homo sapiens
tagctaatctcggtaga

SEQ ID NO: 5305898 - DNA, 19 bp, Homo sapiens
tagctaatgtaataactgt

SEQ ID NO: 5305899 - DNA, 20 bp, Homo sapiens
tagctaatttatttccccag

SEQ ID NO: 5305900 - DNA, 19 bp, Homo sapiens
tagctacaaatgaaaacaa

SEQ ID NO: 5305901 - DNA, 21 bp, Homo sapiens
tagctacaatcctaccttttg

SEQ ID NO: 5305902 - DNA, 17 bp, Homo sapiens
tagctacacagcatctg

SEQ ID NO: 5305903 - DNA, 22 bp, Homo sapiens
tagctacagagaaaccagcttc

SEQ ID NO: 5305904 - DNA, 15 bp, Homo sapiens
tagctacaggaagca

SEQ ID NO: 5305905 - DNA, 15 bp, Homo sapiens
tagctacatcagttt

SEQ ID NO: 5305906 - DNA, 23 bp, Homo sapiens
tagctacctacatgctgaaaaat

SEQ ID NO: 5305907 - DNA, 21 bp, Homo sapiens
tagctacgtttactcacagcc

SEQ ID NO: 5305908 - DNA, 18 bp, Homo sapiens
tagctactggaaatatta

SEQ ID NO: 5305909 - DNA, 17 bp, Homo sapiens
taggaagatatgccact

SEQ ID NO: 5305910 - DNA, 14 bp, Homo sapiens
taggaagcctcaga

SEQ ID NO: 5305911 - DNA, 14 bp, Homo sapiens
taggaaggaaaaaa

SEQ ID NO: 5305912 - DNA, 22 bp, Homo sapiens
taggaaggccatggggcagcct

SEQ ID NO: 5305913 - DNA, 23 bp, Homo sapiens
taggaaggccatggggcagcctc

SEQ ID NO: 5305914 - DNA, 20 bp, Homo sapiens
taggaaggctactggcatta

SEQ ID NO: 5305915 - DNA, 14 bp, Homo sapiens
taggaaggctgtga

SEQ ID NO: 5305916 - DNA, 15 bp, Homo sapiens
taggaagggaccaag

SEQ ID NO: 5305917 - DNA, 17 bp, Homo sapiens
taggaagggatctgaga

SEQ ID NO: 5305918 - DNA, 14 bp, Homo sapiens
taggaaggtactgt

SEQ ID NO: 5305919 - DNA, 15 bp, Homo sapiens
taggaaggtactgta

SEQ ID NO: 5305920 - DNA, 14 bp, Homo sapiens
taggaaggtcattt

SEQ ID NO: 5305921 - DNA, 19 bp, Homo sapiens
taggaaggtcatttccatg

SEQ ID NO: 5305922 - DNA, 18 bp, Homo sapiens
taggaaggtctcattctt

SEQ ID NO: 5305923 - DNA, 21 bp, Homo sapiens
taggaaggtctcattcttcca

SEQ ID NO: 5305924 - DNA, 21 bp, Homo sapiens
taggaagtgaacccatatttt

SEQ ID NO: 5305925 - DNA, 13 bp, Homo sapiens
taggaagtgactt

SEQ ID NO: 5305926 - DNA, 17 bp, Homo sapiens
taggaagtgtaacagct

SEQ ID NO: 5305927 - DNA, 21 bp, Homo sapiens
taggaagttcttttttgtaca

SEQ ID NO: 5305928 - DNA, 17 bp, Homo sapiens
taggaagttttctgtag

SEQ ID NO: 5305929 - DNA, 14 bp, Homo sapiens
taggaataataaat

SEQ ID NO: 5305930 - DNA, 14 bp, Homo sapiens
taggaatactgttt

SEQ ID NO: 5305931 - DNA, 18 bp, Homo sapiens
taggaatactgttttatc

SEQ ID NO: 5305932 - DNA, 22 bp, Homo sapiens
taggaatactgttttatctcca

SEQ ID NO: 5305933 - DNA, 14 bp, Homo sapiens
taggaatagaggaa

SEQ ID NO: 5305934 - DNA, 22 bp, Homo sapiens
taggaatatacatagtctttgt

SEQ ID NO: 5305935 - DNA, 17 bp, Homo sapiens
taggaatattatatttg

SEQ ID NO: 5305936 - DNA, 20 bp, Homo sapiens
taggaatattatatttggat

SEQ ID NO: 5305937 - DNA, 14 bp, Homo sapiens
taggaatcagcaag

SEQ ID NO: 5305938 - DNA, 15 bp, Homo sapiens
taggaatcagcaaga

SEQ ID NO: 5305939 - DNA, 21 bp, Homo sapiens
taggaatcccagaggtgggat

SEQ ID NO: 5305940 - DNA, 22 bp, Homo sapiens
taggaatcctttgagaatgtga

SEQ ID NO: 5305941 - DNA, 14 bp, Homo sapiens
taggaatctcttca

SEQ ID NO: 5305942 - DNA, 14 bp, Homo sapiens
taggaatctgcctt

SEQ ID NO: 5305943 - DNA, 19 bp, Homo sapiens
taggaatctgccttccagc

SEQ ID NO: 5305944 - DNA, 21 bp, Homo sapiens
taggaatgaccacgggcctca

SEQ ID NO: 5305945 - DNA, 22 bp, Homo sapiens
taggaatgaccacgggcctcag

SEQ ID NO: 5305946 - DNA, 16 bp, Homo sapiens
taggaatgatcataaa

SEQ ID NO: 5305947 - DNA, 14 bp, Homo sapiens
taggaatgctcaat

SEQ ID NO: 5305948 - DNA, 18 bp, Homo sapiens
taggaatgctcaatgtgc

SEQ ID NO: 5305949 - DNA, 16 bp, Homo sapiens
taggaatggaaaggat

SEQ ID NO: 5305950 - DNA, 17 bp, Homo sapiens
taggaatgggataagaa

SEQ ID NO: 5305951 - DNA, 18 bp, Homo sapiens
taggaatgggataagaag

SEQ ID NO: 5305952 - DNA, 17 bp, Homo sapiens
taggaatgtacatgaag

SEQ ID NO: 5305953 - DNA, 17 bp, Homo sapiens
taggaattactttatta

SEQ ID NO: 5305954 - DNA, 23 bp, Homo sapiens
taggaattactttattataaaat

SEQ ID NO: 5305955 - DNA, 20 bp, Homo sapiens
taggaattcaatttggcaaa

SEQ ID NO: 5305956 - DNA, 21 bp, Homo sapiens
taggaattcccagcccaaagc

SEQ ID NO: 5305957 - DNA, 19 bp, Homo sapiens
taggaattctttgcattcc

SEQ ID NO: 5305958 - DNA, 19 bp, Homo sapiens
taggaattcttttggggaa

SEQ ID NO: 5305959 - DNA, 14 bp, Homo sapiens
taggaattgaatta

SEQ ID NO: 5305960 - DNA, 22 bp, Homo sapiens
taggaattgaattaataataaa

SEQ ID NO: 5305961 - DNA, 12 bp, Homo sapiens
taggaattgacc

SEQ ID NO: 5305962 - DNA, 14 bp, Homo sapiens
taggaattgtgttt

SEQ ID NO: 5305963 - DNA, 16 bp, Homo sapiens
taggaatttgtataaa

SEQ ID NO: 5305964 - DNA, 14 bp, Homo sapiens
taggaatttgtatt

SEQ ID NO: 5305965 - DNA, 18 bp, Homo sapiens
taggaatttgtattttgg

SEQ ID NO: 5305966 - DNA, 21 bp, Homo sapiens
taggacaaaaagaccttctcc

SEQ ID NO: 5305967 - DNA, 22 bp, Homo sapiens
taggacaaggctgtgccaggct

SEQ ID NO: 5305968 - DNA, 19 bp, Homo sapiens
taggacaagggaaaataaa

SEQ ID NO: 5305969 - DNA, 20 bp, Homo sapiens
taggacaaggtgcaggcagg

SEQ ID NO: 5305970 - DNA, 21 bp, Homo sapiens
taggacaagttttagttaaaa

SEQ ID NO: 5305971 - DNA, 20 bp, Homo sapiens
taggacaatcagtcccctcc

SEQ ID NO: 5305972 - DNA, 20 bp, Homo sapiens
taggacaattactgtacaca

SEQ ID NO: 5305973 - DNA, 17 bp, Homo sapiens
taggacatctctgtaaa

SEQ ID NO: 5305974 - DNA, 23 bp, Homo sapiens
taggacatgttcccttctccttc

SEQ ID NO: 5305975 - DNA, 22 bp, Homo sapiens
taggaccaagcatcttgggggg

SEQ ID NO: 5305976 - DNA, 15 bp, Homo sapiens
taggaccaatgttgt

SEQ ID NO: 5305977 - DNA, 16 bp, Homo sapiens
taggaccactcagccc

SEQ ID NO: 5305978 - DNA, 13 bp, Homo sapiens
taggaccagagcg

SEQ ID NO: 5305979 - DNA, 20 bp, Homo sapiens
taggaccaggatccagcctc

SEQ ID NO: 5305980 - DNA, 13 bp, Homo sapiens
taggaccaggcca

SEQ ID NO: 5305981 - DNA, 15 bp, Homo sapiens
taggaccaggccacc

SEQ ID NO: 5305982 - DNA, 23 bp, Homo sapiens
taggaccatttctctgcaggcca

SEQ ID NO: 5305983 - DNA, 22 bp, Homo sapiens
taggacccaaggtggtcttgga

SEQ ID NO: 5305984 - DNA, 15 bp, Homo sapiens
taggaccctcgagag

SEQ ID NO: 5305985 - DNA, 13 bp, Homo sapiens
taggacccttccc

SEQ ID NO: 5305986 - DNA, 23 bp, Homo sapiens
taggacctgcatccttcctgggg

SEQ ID NO: 5305987 - DNA, 19 bp, Homo sapiens
taggacctttccaccacag

SEQ ID NO: 5305988 - DNA, 21 bp, Homo sapiens
taggacctttccaccacagcc

SEQ ID NO: 5305989 - DNA, 22 bp, Homo sapiens
taggacctttccaccacagcca

SEQ ID NO: 5305990 - DNA, 22 bp, Homo sapiens
taggacgccaacttctcccacc

SEQ ID NO: 5305991 - DNA, 15 bp, Homo sapiens
taggacgccacccag

SEQ ID NO: 5305992 - DNA, 16 bp, Homo sapiens
taggacgtatttataa

SEQ ID NO: 5305993 - DNA, 20 bp, Homo sapiens
taggactacagacatgtgca

SEQ ID NO: 5305994 - DNA, 17 bp, Homo sapiens
taggactaccgcaggcc

SEQ ID NO: 5305995 - DNA, 13 bp, Homo sapiens
taggactatataa

SEQ ID NO: 5305996 - DNA, 19 bp, Homo sapiens
taggactcaaagtttcaga

SEQ ID NO: 5305997 - DNA, 19 bp, Homo sapiens
taggactcaggcctgccaa

SEQ ID NO: 5305998 - DNA, 20 bp, Homo sapiens
taggactcaggcctgccaat

SEQ ID NO: 5305999 - DNA, 13 bp, Homo sapiens
taggactgaggag

SEQ ID NO: 5306000 - DNA, 14 bp, Homo sapiens
taggactgcagtgt

SEQ ID NO: 5306001 - DNA, 13 bp, Homo sapiens
taggactgtagaa

SEQ ID NO: 5306002 - DNA, 17 bp, Homo sapiens
taggactgtggagggga

SEQ ID NO: 5306003 - DNA, 15 bp, Homo sapiens
taggactgtggcaaa

SEQ ID NO: 5306004 - DNA, 21 bp, Homo sapiens
taggactgtggcaaacaaaac

SEQ ID NO: 5306005 - DNA, 18 bp, Homo sapiens
taggacttcaaaaggtga

SEQ ID NO: 5306006 - DNA, 19 bp, Homo sapiens
taggacttccttaagcatg

SEQ ID NO: 5306007 - DNA, 19 bp, Homo sapiens
taggactttagggatctgg

SEQ ID NO: 5306008 - DNA, 22 bp, Homo sapiens
taggactttagggatctgggga

SEQ ID NO: 5306009 - DNA, 21 bp, Homo sapiens
taggactttggtggtttaaaa

SEQ ID NO: 5306010 - DNA, 19 bp, Homo sapiens
taggagaaagcaaaataca

SEQ ID NO: 5306011 - DNA, 21 bp, Homo sapiens
taggagaagaggcatcctgcc

SEQ ID NO: 5306012 - DNA, 18 bp, Homo sapiens
taggagaagcagcctcct

SEQ ID NO: 5306013 - DNA, 16 bp, Homo sapiens
taggagaagccaggaa

SEQ ID NO: 5306014 - DNA, 22 bp, Homo sapiens
taggagaagtcttctatttatt

SEQ ID NO: 5306015 - DNA, 14 bp, Homo sapiens
taggagacacagat

SEQ ID NO: 5306016 - DNA, 17 bp, Homo sapiens
taggagacagagccaag

SEQ ID NO: 5306017 - DNA, 21 bp, Homo sapiens
taggagacagatcactcctgg

SEQ ID NO: 5306018 - DNA, 23 bp, Homo sapiens
taggagacagatcactcctggag

SEQ ID NO: 5306019 - DNA, 14 bp, Homo sapiens
taggagaccaaggc

SEQ ID NO: 5306020 - DNA, 20 bp, Homo sapiens
taggagacttgccagagccg

SEQ ID NO: 5306021 - DNA, 16 bp, Homo sapiens
taggagagactggcca

SEQ ID NO: 5306022 - DNA, 18 bp, Homo sapiens
taggagagactggccaga

SEQ ID NO: 5306023 - DNA, 19 bp, Homo sapiens
taggagagattgggagaaa

SEQ ID NO: 5306024 - DNA, 12 bp, Homo sapiens
taggagagcact

SEQ ID NO: 5306025 - DNA, 12 bp, Homo sapiens
taggagaggaaa

SEQ ID NO: 5306026 - DNA, 12 bp, Homo sapiens
taggagaggaga

SEQ ID NO: 5306027 - DNA, 14 bp, Homo sapiens
taggagaggatgag

SEQ ID NO: 5306028 - DNA, 22 bp, Homo sapiens
taggagagggggcgatatagag

SEQ ID NO: 5306029 - DNA, 16 bp, Homo sapiens
taggagataccaggtt

SEQ ID NO: 5306030 - DNA, 18 bp, Homo sapiens
taggagcaagaagaaaat

SEQ ID NO: 5306031 - DNA, 13 bp, Homo sapiens
taggagcaggctt

SEQ ID NO: 5306032 - DNA, 13 bp, Homo sapiens
taggagccccagc

SEQ ID NO: 5306033 - DNA, 15 bp, Homo sapiens
taggagcccttctct

SEQ ID NO: 5306034 - DNA, 18 bp, Homo sapiens
taggagcccttctctttg

SEQ ID NO: 5306035 - DNA, 15 bp, Homo sapiens
taggagcctgctggt

SEQ ID NO: 5306036 - DNA, 23 bp, Homo sapiens
taggagctcccctgtttgcatga

SEQ ID NO: 5306037 - DNA, 18 bp, Homo sapiens
taggagctgccttggctc

SEQ ID NO: 5306038 - DNA, 19 bp, Homo sapiens
taggagctggctggcaggt

SEQ ID NO: 5306039 - DNA, 18 bp, Homo sapiens
taggagctgggaggaaaa

SEQ ID NO: 5306040 - DNA, 18 bp, Homo sapiens
taggagcttccagatggg

SEQ ID NO: 5306041 - DNA, 23 bp, Homo sapiens
taggagctttgactcaggagcct

SEQ ID NO: 5306042 - DNA, 22 bp, Homo sapiens
taggaggaaaacacagcctccc

SEQ ID NO: 5306043 - DNA, 12 bp, Homo sapiens
taggaggaaaag

SEQ ID NO: 5306044 - DNA, 20 bp, Homo sapiens
taggaggaaaagacagagcc

SEQ ID NO: 5306045 - DNA, 13 bp, Homo sapiens
taggaggaaaatt

SEQ ID NO: 5306046 - DNA, 14 bp, Homo sapiens
taggaggaacaggt

SEQ ID NO: 5306047 - DNA, 20 bp, Homo sapiens
taggaggaggcatggaaacc

SEQ ID NO: 5306048 - DNA, 21 bp, Homo sapiens
taggaggatgcctaacagaga

SEQ ID NO: 5306049 - DNA, 20 bp, Homo sapiens
taggaggctctaattctcta

SEQ ID NO: 5306050 - DNA, 12 bp, Homo sapiens
taggagggactg

SEQ ID NO: 5306051 - DNA, 14 bp, Homo sapiens
taggagggactgtc

SEQ ID NO: 5306052 - DNA, 14 bp, Homo sapiens
taggagggagacac

SEQ ID NO: 5306053 - DNA, 21 bp, Homo sapiens
taggagggggcggcagggctg

SEQ ID NO: 5306054 - DNA, 18 bp, Homo sapiens
taggaggggttaataagt

SEQ ID NO: 5306055 - DNA, 17 bp, Homo sapiens
taggagggtgcccctgg

SEQ ID NO: 5306056 - DNA, 19 bp, Homo sapiens
taggaggtgtgggtgcctt

SEQ ID NO: 5306057 - DNA, 13 bp, Homo sapiens
taggagtctgagc

SEQ ID NO: 5306058 - DNA, 13 bp, Homo sapiens
taggagtggctga

SEQ ID NO: 5306059 - DNA, 14 bp, Homo sapiens
taggagtggctgac

SEQ ID NO: 5306060 - DNA, 20 bp, Homo sapiens
taggagtggctgaccaggcc

SEQ ID NO: 5306061 - DNA, 21 bp, Homo sapiens
taggagtggctgaccaggccc

SEQ ID NO: 5306062 - DNA, 22 bp, Homo sapiens
taggagtggggcttcccccgcc

SEQ ID NO: 5306063 - DNA, 21 bp, Homo sapiens
taggagtgggtgacaagagcc

SEQ ID NO: 5306064 - DNA, 19 bp, Homo sapiens
taggagtggtgatttgaaa

SEQ ID NO: 5306065 - DNA, 20 bp, Homo sapiens
taggagtgtgtgacattcca

SEQ ID NO: 5306066 - DNA, 23 bp, Homo sapiens
taggagttcacttcatcttctca

SEQ ID NO: 5306067 - DNA, 15 bp, Homo sapiens
taggagttcatagaa

SEQ ID NO: 5306068 - DNA, 21 bp, Homo sapiens
taggagttcatagaagggagt

SEQ ID NO: 5306069 - DNA, 17 bp, Homo sapiens
taggagttcgagaccag

SEQ ID NO: 5306070 - DNA, 21 bp, Homo sapiens
taggagttcgagaccagcctg

SEQ ID NO: 5306071 - DNA, 16 bp, Homo sapiens
taggagttctcctgga

SEQ ID NO: 5306072 - DNA, 17 bp, Homo sapiens
taggagttctcctggag

SEQ ID NO: 5306073 - DNA, 13 bp, Homo sapiens
taggagttctctg

SEQ ID NO: 5306074 - DNA, 15 bp, Homo sapiens
taggagttctctgat

SEQ ID NO: 5306075 - DNA, 23 bp, Homo sapiens
taggagttctctgatgcagaaat

SEQ ID NO: 5306076 - DNA, 20 bp, Homo sapiens
taggagttttatatactgtg

SEQ ID NO: 5306077 - DNA, 21 bp, Homo sapiens
taggagttttgttccagagga

SEQ ID NO: 5306078 - DNA, 19 bp, Homo sapiens
taggataaattacattaaa

SEQ ID NO: 5306079 - DNA, 18 bp, Homo sapiens
taggataactaaaattct

SEQ ID NO: 5306080 - DNA, 19 bp, Homo sapiens
taggataattagcagtatc

SEQ ID NO: 5306081 - DNA, 18 bp, Homo sapiens
taggataatttttaaaag

SEQ ID NO: 5306082 - DNA, 18 bp, Homo sapiens
taggatacttaacaaata

SEQ ID NO: 5306083 - DNA, 15 bp, Homo sapiens
taggatagacactgg

SEQ ID NO: 5306084 - DNA, 19 bp, Homo sapiens
taggatagacactggacat

SEQ ID NO: 5306085 - DNA, 14 bp, Homo sapiens
taggtttactgtga

SEQ ID NO: 5306086 - DNA, 16 bp, Homo sapiens
taggtttactgtgaag

SEQ ID NO: 5306087 - DNA, 20 bp, Homo sapiens
taggtttactgtgaagagaa

SEQ ID NO: 5306088 - DNA, 23 bp, Homo sapiens
taggtttagaatcaagtctgtga

SEQ ID NO: 5306089 - DNA, 15 bp, Homo sapiens
taggtttcaggaagt

SEQ ID NO: 5306090 - DNA, 18 bp, Homo sapiens
taggtttctaaaaagtca

SEQ ID NO: 5306091 - DNA, 17 bp, Homo sapiens
taggtttctctccctcc

SEQ ID NO: 5306092 - DNA, 15 bp, Homo sapiens
taggtttctctgcct

SEQ ID NO: 5306093 - DNA, 22 bp, Homo sapiens
taggtttctctgcctccaggtt

SEQ ID NO: 5306094 - DNA, 14 bp, Homo sapiens
taggtttgtcaaca

SEQ ID NO: 5306095 - DNA, 23 bp, Homo sapiens
taggtttgtcccagtcagaaata

SEQ ID NO: 5306096 - DNA, 16 bp, Homo sapiens
taggtttgtgtcttaa

SEQ ID NO: 5306097 - DNA, 14 bp, Homo sapiens
taggttttaaatct

SEQ ID NO: 5306098 - DNA, 13 bp, Homo sapiens
taggttttccctg

SEQ ID NO: 5306099 - DNA, 23 bp, Homo sapiens
taggttttgtttgctatcttaat

SEQ ID NO: 5306100 - DNA, 15 bp, Homo sapiens
taggtttttattagt

SEQ ID NO: 5306101 - DNA, 20 bp, Homo sapiens
taggtttttctcatgtatct

SEQ ID NO: 5306102 - DNA, 15 bp, Homo sapiens
taggtttttcttgct

SEQ ID NO: 5306103 - DNA, 15 bp, Homo sapiens
taggtttttgtttgt

SEQ ID NO: 5306104 - DNA, 19 bp, Homo sapiens
taggtttttttgtatagta

SEQ ID NO: 5306105 - DNA, 19 bp, Homo sapiens
tagtaaaaaagagaattgt

SEQ ID NO: 5306106 - DNA, 13 bp, Homo sapiens
tagtaaaaacatt

SEQ ID NO: 5306107 - DNA, 16 bp, Homo sapiens
tagtaaaaataaaatt

SEQ ID NO: 5306108 - DNA, 14 bp, Homo sapiens
tagtaaaaataaat

SEQ ID NO: 5306109 - DNA, 15 bp, Homo sapiens
tagtaaaaatacaaa

SEQ ID NO: 5306110 - DNA, 13 bp, Homo sapiens
tagtaaaaattaa

SEQ ID NO: 5306111 - DNA, 15 bp, Homo sapiens
tagtaaaacacagag

SEQ ID NO: 5306112 - DNA, 16 bp, Homo sapiens
tagtaaaacacagagg

SEQ ID NO: 5306113 - DNA, 23 bp, Homo sapiens
tagtaaaaccttgttctattttt

SEQ ID NO: 5306114 - DNA, 17 bp, Homo sapiens
tagtaaaagtcataaat

SEQ ID NO: 5306115 - DNA, 19 bp, Homo sapiens
tagtaaaagtggtctctgc

SEQ ID NO: 5306116 - DNA, 20 bp, Homo sapiens
tagtaaaagtggtctctgct

SEQ ID NO: 5306117 - DNA, 18 bp, Homo sapiens
tagtaaaatgttttcatt

SEQ ID NO: 5306118 - DNA, 15 bp, Homo sapiens
tagtaaaatttattt

SEQ ID NO: 5306119 - DNA, 22 bp, Homo sapiens
tagtaaactaaagtatggtaca

SEQ ID NO: 5306120 - DNA, 17 bp, Homo sapiens
tagtaaataatgctttg

SEQ ID NO: 5306121 - DNA, 12 bp, Homo sapiens
tagtaaatacat

SEQ ID NO: 5306122 - DNA, 16 bp, Homo sapiens
tagtaaatatgtgaag

SEQ ID NO: 5306123 - DNA, 17 bp, Homo sapiens
tagtaaatatgtgaaga

SEQ ID NO: 5306124 - DNA, 18 bp, Homo sapiens
tagtaaatatgtgaagaa

SEQ ID NO: 5306125 - DNA, 12 bp, Homo sapiens
tagtaaatatta

SEQ ID NO: 5306126 - DNA, 22 bp, Homo sapiens
tagtaaatattatgattttatt

SEQ ID NO: 5306127 - DNA, 18 bp, Homo sapiens
tagtaaatcacgcttttt

SEQ ID NO: 5306128 - DNA, 19 bp, Homo sapiens
tagtaaatggtatcatttg

SEQ ID NO: 5306129 - DNA, 14 bp, Homo sapiens
tagtaaatgtcttt

SEQ ID NO: 5306130 - DNA, 18 bp, Homo sapiens
tagtaaatgtctttgtaa

SEQ ID NO: 5306131 - DNA, 19 bp, Homo sapiens
tagtaaatgtctttgtaag

SEQ ID NO: 5306132 - DNA, 22 bp, Homo sapiens
tagtaaatgtctttgtaagtca

SEQ ID NO: 5306133 - DNA, 20 bp, Homo sapiens
tagtaacacataaagtaaat

SEQ ID NO: 5306134 - DNA, 21 bp, Homo sapiens
tagtaacacataaagtaaatg

SEQ ID NO: 5306135 - DNA, 22 bp, Homo sapiens
tagtaacaggccttgagcacaa

SEQ ID NO: 5306136 - DNA, 16 bp, Homo sapiens
tagtaacctttaaaaa

SEQ ID NO: 5306137 - DNA, 16 bp, Homo sapiens
tagtaacgtgttactg

SEQ ID NO: 5306138 - DNA, 22 bp, Homo sapiens
tagtaactactttttatactcc

SEQ ID NO: 5306139 - DNA, 15 bp, Homo sapiens
tagtaactataagat

SEQ ID NO: 5306140 - DNA, 11 bp, Homo sapiens
tagtaactctt

SEQ ID NO: 5306141 - DNA, 15 bp, Homo sapiens
tagtaactgctgtcg

SEQ ID NO: 5306142 - DNA, 18 bp, Homo sapiens
tagtaagaagacaaactg

SEQ ID NO: 5306143 - DNA, 22 bp, Homo sapiens
tagtaagaataccacatcaaat

SEQ ID NO: 5306144 - DNA, 23 bp, Homo sapiens
tagtaagaattctggtgtttaca

SEQ ID NO: 5306145 - DNA, 21 bp, Homo sapiens
tagtaagattgatatctataa

SEQ ID NO: 5306146 - DNA, 16 bp, Homo sapiens
tagtaagatttggaga

SEQ ID NO: 5306147 - DNA, 12 bp, Homo sapiens
tagtaagcatag

SEQ ID NO: 5306148 - DNA, 19 bp, Homo sapiens
tagtaagcctccctcctcg

SEQ ID NO: 5306149 - DNA, 23 bp, Homo sapiens
tagtaagcggctcaagcccagga

SEQ ID NO: 5306150 - DNA, 17 bp, Homo sapiens
tagtaagtaattatgca

SEQ ID NO: 5306151 - DNA, 22 bp, Homo sapiens
tagtaagtcttgcctatatttt

SEQ ID NO: 5306152 - DNA, 23 bp, Homo sapiens
tagtaagttaatgtatataaaaa

SEQ ID NO: 5306153 - DNA, 14 bp, Homo sapiens
tagtaataaagact

SEQ ID NO: 5306154 - DNA, 20 bp, Homo sapiens
tagtaatagtccaatatttg

SEQ ID NO: 5306155 - DNA, 15 bp, Homo sapiens
tagtaatataataca

SEQ ID NO: 5306156 - DNA, 23 bp, Homo sapiens
tagtaatatatttaaagggaaat

SEQ ID NO: 5306157 - DNA, 14 bp, Homo sapiens
tagtaatcacagtt

SEQ ID NO: 5306158 - DNA, 15 bp, Homo sapiens
tagtaatcacagttg

SEQ ID NO: 5306159 - DNA, 12 bp, Homo sapiens
tagtaatcattg

SEQ ID NO: 5306160 - DNA, 15 bp, Homo sapiens
tagtaatctgtacat

SEQ ID NO: 5306161 - DNA, 15 bp, Homo sapiens
tagtaatgagtttaa

SEQ ID NO: 5306162 - DNA, 17 bp, Homo sapiens
tagtaatgagtttaaaa

SEQ ID NO: 5306163 - DNA, 21 bp, Homo sapiens
tagtaatttattgtctgtcta

SEQ ID NO: 5306164 - DNA, 20 bp, Homo sapiens
tagtaatttctttttttcct

SEQ ID NO: 5306165 - DNA, 21 bp, Homo sapiens
tagtaatttctttttttcctt

SEQ ID NO: 5306166 - DNA, 17 bp, Homo sapiens
tagtacaaagtttcaat

SEQ ID NO: 5306167 - DNA, 15 bp, Homo sapiens
tagtacaaattataa

SEQ ID NO: 5306168 - DNA, 13 bp, Homo sapiens
tagtacaatcttg

SEQ ID NO: 5306169 - DNA, 15 bp, Homo sapiens
tagtacaatcttggg

SEQ ID NO: 5306170 - DNA, 13 bp, Homo sapiens
tagtacactttta

SEQ ID NO: 5306171 - DNA, 19 bp, Homo sapiens
tagtacacttttatgagct

SEQ ID NO: 5306172 - DNA, 16 bp, Homo sapiens
tagtacagtagcttaa

SEQ ID NO: 5306173 - DNA, 18 bp, Homo sapiens
tagtacataattgattaa

SEQ ID NO: 5306174 - DNA, 19 bp, Homo sapiens
tagtacatggagctcaggt

SEQ ID NO: 5306175 - DNA, 20 bp, Homo sapiens
tagtaccaaatgctttaaaa

SEQ ID NO: 5306176 - DNA, 23 bp, Homo sapiens
tagtaccaatcattttaattatt

SEQ ID NO: 5306177 - DNA, 18 bp, Homo sapiens
tagtaccatttatacaaa

SEQ ID NO: 5306178 - DNA, 14 bp, Homo sapiens
tagtaccctgcagg

SEQ ID NO: 5306179 - DNA, 16 bp, Homo sapiens
tagtacctgtgactct

SEQ ID NO: 5306180 - DNA, 13 bp, Homo sapiens
tagtaccttcaaa

SEQ ID NO: 5306181 - DNA, 17 bp, Homo sapiens
tagtaccttcaaataat

SEQ ID NO: 5306182 - DNA, 13 bp, Homo sapiens
tagtaccttgttt

SEQ ID NO: 5306183 - DNA, 14 bp, Homo sapiens
tagtacctttgctc

SEQ ID NO: 5306184 - DNA, 16 bp, Homo sapiens
tagtacctttttaaca

SEQ ID NO: 5306185 - DNA, 15 bp, Homo sapiens
tagtacggctgctgc

SEQ ID NO: 5306186 - DNA, 16 bp, Homo sapiens
tagtacggctgctgca

SEQ ID NO: 5306187 - DNA, 14 bp, Homo sapiens
tagtactaactcct

SEQ ID NO: 5306188 - DNA, 14 bp, Homo sapiens
tagtactaagcatt

SEQ ID NO: 5306189 - DNA, 22 bp, Homo sapiens
tagtactagagatattttgtaa

SEQ ID NO: 5306190 - DNA, 16 bp, Homo sapiens
tagtactatatctgtt

SEQ ID NO: 5306191 - DNA, 14 bp, Homo sapiens
tagtactattacta

SEQ ID NO: 5306192 - DNA, 12 bp, Homo sapiens
tagtactcaatg

SEQ ID NO: 5306193 - DNA, 17 bp, Homo sapiens
tagtactcaatgtttct

SEQ ID NO: 5306194 - DNA, 23 bp, Homo sapiens
tagtactcaatgtttctggacat

SEQ ID NO: 5306195 - DNA, 19 bp, Homo sapiens
tagtactcctgcaaaattt

SEQ ID NO: 5306196 - DNA, 21 bp, Homo sapiens
tagtactcctgcaaaatttta

SEQ ID NO: 5306197 - DNA, 14 bp, Homo sapiens
tagtactctctgct

SEQ ID NO: 5306198 - DNA, 20 bp, Homo sapiens
tagtactgaagccaaatgaa

SEQ ID NO: 5306199 - DNA, 13 bp, Homo sapiens
tagtactgctctt

SEQ ID NO: 5306200 - DNA, 15 bp, Homo sapiens
tagtactgctcttgt

SEQ ID NO: 5306201 - DNA, 16 bp, Homo sapiens
tagtactgtattggct

SEQ ID NO: 5306202 - DNA, 14 bp, Homo sapiens
tagtactgtgtact

SEQ ID NO: 5306203 - DNA, 18 bp, Homo sapiens
tagtactgtgtactgtat

SEQ ID NO: 5306204 - DNA, 18 bp, Homo sapiens
tagtacttcttctgtaat

SEQ ID NO: 5306205 - DNA, 13 bp, Homo sapiens
tagtactttatag

SEQ ID NO: 5306206 - DNA, 15 bp, Homo sapiens
tagtactttatagaa

SEQ ID NO: 5306207 - DNA, 12 bp, Homo sapiens
tagtagaaaaat

SEQ ID NO: 5306208 - DNA, 21 bp, Homo sapiens
tagtagacatttgtgtggaaa

SEQ ID NO: 5306209 - DNA, 14 bp, Homo sapiens
tagtagagacaggg

SEQ ID NO: 5306210 - DNA, 15 bp, Homo sapiens
tagtagagacagggt

SEQ ID NO: 5306211 - DNA, 16 bp, Homo sapiens
tagtagagacagtgtt

SEQ ID NO: 5306212 - DNA, 21 bp, Homo sapiens
tagtagagcaaagacttaatc

SEQ ID NO: 5306213 - DNA, 23 bp, Homo sapiens
tagtagagcaacccattaatctt

SEQ ID NO: 5306214 - DNA, 17 bp, Homo sapiens
tagtagatctgtggcga

SEQ ID NO: 5306215 - DNA, 14 bp, Homo sapiens
tagtagattaaaaa

SEQ ID NO: 5306216 - DNA, 12 bp, Homo sapiens
tagtagatttct

SEQ ID NO: 5306217 - DNA, 24 bp, Homo sapiens
tagtagcagaaatatattatgaaa

SEQ ID NO: 5306218 - DNA, 11 bp, Homo sapiens
tagtagcattt

SEQ ID NO: 5306219 - DNA, 18 bp, Homo sapiens
tagtagccctttctgtgt

SEQ ID NO: 5306220 - DNA, 17 bp, Homo sapiens
tagtagcctttcctgat

SEQ ID NO: 5306221 - DNA, 19 bp, Homo sapiens
tagtagcgttttttaaatg

SEQ ID NO: 5306222 - DNA, 16 bp, Homo sapiens
tagtagctgataaaga

SEQ ID NO: 5306223 - DNA, 18 bp, Homo sapiens
tagtagctgataaagaaa

SEQ ID NO: 5306224 - DNA, 17 bp, Homo sapiens
tagtaggaatgtacatg

SEQ ID NO: 5306225 - DNA, 16 bp, Homo sapiens
tagtaggagctgagct

SEQ ID NO: 5306226 - DNA, 16 bp, Homo sapiens
tagtaggcatttttac

SEQ ID NO: 5306227 - DNA, 21 bp, Homo sapiens
tagtaggggttgaagaaaaca

SEQ ID NO: 5306228 - DNA, 17 bp, Homo sapiens
tagtaggtcctcaataa

SEQ ID NO: 5306229 - DNA, 14 bp, Homo sapiens
tagtagtacctttc

SEQ ID NO: 5306230 - DNA, 18 bp, Homo sapiens
tagtagtatgatgataca

SEQ ID NO: 5306231 - DNA, 22 bp, Homo sapiens
tagtagtcaaaaacaaagctga

SEQ ID NO: 5306232 - DNA, 23 bp, Homo sapiens
tagtagtcaaaaacaaagctgat

SEQ ID NO: 5306233 - DNA, 23 bp, Homo sapiens
tagtagtcaattagtacagtagc

SEQ ID NO: 5306234 - DNA, 13 bp, Homo sapiens
tagtagtgggaaa

SEQ ID NO: 5306235 - DNA, 19 bp, Homo sapiens
tagtagttagcttaagtag

SEQ ID NO: 5306236 - DNA, 19 bp, Homo sapiens
tagtagttcctgctacaac

SEQ ID NO: 5306237 - DNA, 14 bp, Homo sapiens
tagtagttctcttg

SEQ ID NO: 5306238 - DNA, 14 bp, Homo sapiens
tagtagtttgggtg

SEQ ID NO: 5306239 - DNA, 14 bp, Homo sapiens
tagtagtttttaca

SEQ ID NO: 5306240 - DNA, 14 bp, Homo sapiens
tagtataaagaaaa

SEQ ID NO: 5306241 - DNA, 16 bp, Homo sapiens
tagtataaagaaaagt

SEQ ID NO: 5306242 - DNA, 19 bp, Homo sapiens
tagtatacattgtctctaa

SEQ ID NO: 5306243 - DNA, 14 bp, Homo sapiens
tagtataccagaga

SEQ ID NO: 5306244 - DNA, 16 bp, Homo sapiens
tagtataccagagaag

SEQ ID NO: 5306245 - DNA, 16 bp, Homo sapiens
tagtatacccactgca

SEQ ID NO: 5306246 - DNA, 17 bp, Homo sapiens
tagtatacgtataaata

SEQ ID NO: 5306247 - DNA, 19 bp, Homo sapiens
tagtatagaagtctggaaa

SEQ ID NO: 5306248 - DNA, 23 bp, Homo sapiens
tagtatagtagaaagacatctgc

SEQ ID NO: 5306249 - DNA, 16 bp, Homo sapiens
tagtatagtctccctt

SEQ ID NO: 5306250 - DNA, 16 bp, Homo sapiens
tagtatatctggacaa

SEQ ID NO: 5306251 - DNA, 16 bp, Homo sapiens
tagtatattaaaaatg

SEQ ID NO: 5306252 - DNA, 18 bp, Homo sapiens
tagtatattaaaaatggt

SEQ ID NO: 5306253 - DNA, 13 bp, Homo sapiens
tagtatatttata

SEQ ID NO: 5306254 - DNA, 23 bp, Homo sapiens
tagtatcaaatattagatgtgat

SEQ ID NO: 5306255 - DNA, 16 bp, Homo sapiens
tagtatcaagtgttct

SEQ ID NO: 5306256 - DNA, 22 bp, Homo sapiens
tagtatcagtgttttaaattct

SEQ ID NO: 5306257 - DNA, 13 bp, Homo sapiens
tagtatcctgtta

SEQ ID NO: 5306258 - DNA, 17 bp, Homo sapiens
tagtatctaataatgaa

SEQ ID NO: 5306259 - DNA, 16 bp, Homo sapiens
tagtatctagcaatca

SEQ ID NO: 5306260 - DNA, 15 bp, Homo sapiens
tagtatcttttaaaa

SEQ ID NO: 5306261 - DNA, 15 bp, Homo sapiens
tagtatgaaattata

SEQ ID NO: 5306262 - DNA, 18 bp, Homo sapiens
tagtatgaggcatttgtt

SEQ ID NO: 5306263 - DNA, 17 bp, Homo sapiens
tagtatgatttttacaa

SEQ ID NO: 5306264 - DNA, 20 bp, Homo sapiens
tagttgagtcttcacattta

SEQ ID NO: 5306265 - DNA, 20 bp, Homo sapiens
tagttgatgaccaatctctg

SEQ ID NO: 5306266 - DNA, 23 bp, Homo sapiens
tagttgatgaccaatctctgtga

SEQ ID NO: 5306267 - DNA, 21 bp, Homo sapiens
tagttgattgcgagaattttc

SEQ ID NO: 5306268 - DNA, 22 bp, Homo sapiens
tagttgattgcgagaattttca

SEQ ID NO: 5306269 - DNA, 22 bp, Homo sapiens
tagttgcaaagagacatttcaa

SEQ ID NO: 5306270 - DNA, 23 bp, Homo sapiens
tagttgcaaagagacatttcaaa

SEQ ID NO: 5306271 - DNA, 19 bp, Homo sapiens
tagttgcagaaacattttg

SEQ ID NO: 5306272 - DNA, 14 bp, Homo sapiens
tagttgcagcccaa

SEQ ID NO: 5306273 - DNA, 15 bp, Homo sapiens
tagttgcagcccaag

SEQ ID NO: 5306274 - DNA, 19 bp, Homo sapiens
tagttgcagcccaaggaca

SEQ ID NO: 5306275 - DNA, 19 bp, Homo sapiens
tagttgcatagcagtatat

SEQ ID NO: 5306276 - DNA, 21 bp, Homo sapiens
tagttgcattggtttgagaaa

SEQ ID NO: 5306277 - DNA, 22 bp, Homo sapiens
tagttgcccccattcccagcct

SEQ ID NO: 5306278 - DNA, 16 bp, Homo sapiens
tagttgctccgcctct

SEQ ID NO: 5306279 - DNA, 17 bp, Homo sapiens
tagttgcttaattttga

SEQ ID NO: 5306280 - DNA, 15 bp, Homo sapiens
tagttgcttacaaaa

SEQ ID NO: 5306281 - DNA, 13 bp, Homo sapiens
tagttgcttgcct

SEQ ID NO: 5306282 - DNA, 22 bp, Homo sapiens
tagttgcttgctaatatttcca

SEQ ID NO: 5306283 - DNA, 14 bp, Homo sapiens
tagttgctttgtta

SEQ ID NO: 5306284 - DNA, 18 bp, Homo sapiens
tagttgcttttgaaggaa

SEQ ID NO: 5306285 - DNA, 16 bp, Homo sapiens
tagttggaaacaaatc

SEQ ID NO: 5306286 - DNA, 14 bp, Homo sapiens
tagttggaaatatt

SEQ ID NO: 5306287 - DNA, 19 bp, Homo sapiens
tagttggaactttctgttc

SEQ ID NO: 5306288 - DNA, 16 bp, Homo sapiens
tagttggagctagaaa

SEQ ID NO: 5306289 - DNA, 19 bp, Homo sapiens
tagttgggagagttggaga

SEQ ID NO: 5306290 - DNA, 22 bp, Homo sapiens
tagttgggatgccaatttcctc

SEQ ID NO: 5306291 - DNA, 20 bp, Homo sapiens
tagttgggtagaaaaattat

SEQ ID NO: 5306292 - DNA, 23 bp, Homo sapiens
tagttggtaatgcttggaatggc

SEQ ID NO: 5306293 - DNA, 18 bp, Homo sapiens
tagttggtctttccatct

SEQ ID NO: 5306294 - DNA, 16 bp, Homo sapiens
tagttggtgctgatgg

SEQ ID NO: 5306295 - DNA, 14 bp, Homo sapiens
tagttggtttgtat

SEQ ID NO: 5306296 - DNA, 16 bp, Homo sapiens
tagttggtttgtatga

SEQ ID NO: 5306297 - DNA, 20 bp, Homo sapiens
tagttggtttgtatgagatg

SEQ ID NO: 5306298 - DNA, 19 bp, Homo sapiens
tagttgtattcttctgtat

SEQ ID NO: 5306299 - DNA, 21 bp, Homo sapiens
tagttgtcacagtcttgtgaa

SEQ ID NO: 5306300 - DNA, 22 bp, Homo sapiens
tagttgtcacagtcttgtgaac

SEQ ID NO: 5306301 - DNA, 18 bp, Homo sapiens
tagttgtcagtattattc

SEQ ID NO: 5306302 - DNA, 15 bp, Homo sapiens
tagttgtctgtgctt

SEQ ID NO: 5306303 - DNA, 21 bp, Homo sapiens
tagttgtctttctttgctgct

SEQ ID NO: 5306304 - DNA, 19 bp, Homo sapiens
tagttgttggtctgtagca

SEQ ID NO: 5306305 - DNA, 17 bp, Homo sapiens
tagttgttgtagagaaa

SEQ ID NO: 5306306 - DNA, 21 bp, Homo sapiens
tagttgtttctagactataaa

SEQ ID NO: 5306307 - DNA, 21 bp, Homo sapiens
tagttgtttgattcagacagc

SEQ ID NO: 5306308 - DNA, 14 bp, Homo sapiens
tagtttaaaaatat

SEQ ID NO: 5306309 - DNA, 18 bp, Homo sapiens
tagtttaaaatcttgcat

SEQ ID NO: 5306310 - DNA, 18 bp, Homo sapiens
tagtttaagggtggaaaa

SEQ ID NO: 5306311 - DNA, 13 bp, Homo sapiens
tagtttaatacag

SEQ ID NO: 5306312 - DNA, 14 bp, Homo sapiens
tagtttacaaacaa

SEQ ID NO: 5306313 - DNA, 12 bp, Homo sapiens
tagtttacaata

SEQ ID NO: 5306314 - DNA, 19 bp, Homo sapiens
tagtttacaatattatgtt

SEQ ID NO: 5306315 - DNA, 12 bp, Homo sapiens
tagtttacacac

SEQ ID NO: 5306316 - DNA, 23 bp, Homo sapiens
tagtttaccacttgcctttttct

SEQ ID NO: 5306317 - DNA, 17 bp, Homo sapiens
tagtttaggaaaatgag

SEQ ID NO: 5306318 - DNA, 14 bp, Homo sapiens
tagtttataaaaga

SEQ ID NO: 5306319 - DNA, 21 bp, Homo sapiens
tagtttatacagttttaaaga

SEQ ID NO: 5306320 - DNA, 18 bp, Homo sapiens
tagtttatgatgcaaatc

SEQ ID NO: 5306321 - DNA, 15 bp, Homo sapiens
tagtttcaaaatgtt

SEQ ID NO: 5306322 - DNA, 16 bp, Homo sapiens
tagtttcaccactcct

SEQ ID NO: 5306323 - DNA, 17 bp, Homo sapiens
tagtttcaccactcctc

SEQ ID NO: 5306324 - DNA, 18 bp, Homo sapiens
tagtttcaccactcctct

SEQ ID NO: 5306325 - DNA, 19 bp, Homo sapiens
tagtttcaccactcctctc

SEQ ID NO: 5306326 - DNA, 22 bp, Homo sapiens
tagtttcaccactcctctccct

SEQ ID NO: 5306327 - DNA, 23 bp, Homo sapiens
tagtttcaccactcctctccctt

SEQ ID NO: 5306328 - DNA, 15 bp, Homo sapiens
tagtttcagaagtac

SEQ ID NO: 5306329 - DNA, 22 bp, Homo sapiens
tagtttcagctgaccagaagtg

SEQ ID NO: 5306330 - DNA, 21 bp, Homo sapiens
tagtttcaggcaaggcagctc

SEQ ID NO: 5306331 - DNA, 14 bp, Homo sapiens
tagtttcagtaaat

SEQ ID NO: 5306332 - DNA, 15 bp, Homo sapiens
tagtttccctggtgc

SEQ ID NO: 5306333 - DNA, 16 bp, Homo sapiens
tagtttccctggtgcc

SEQ ID NO: 5306334 - DNA, 15 bp, Homo sapiens
tagtttcctatggaa

SEQ ID NO: 5306335 - DNA, 15 bp, Homo sapiens
tagtttcctttttga

SEQ ID NO: 5306336 - DNA, 22 bp, Homo sapiens
tagtttctatctctaagctgtt

SEQ ID NO: 5306337 - DNA, 21 bp, Homo sapiens
tagtttctcaaaacccttaaa

SEQ ID NO: 5306338 - DNA, 15 bp, Homo sapiens
tagtttctgaactct

SEQ ID NO: 5306339 - DNA, 12 bp, Homo sapiens
tagtttctgagt

SEQ ID NO: 5306340 - DNA, 20 bp, Homo sapiens
tagtttctgagttttaccaa

SEQ ID NO: 5306341 - DNA, 12 bp, Homo sapiens
tagtttctgtaa

SEQ ID NO: 5306342 - DNA, 17 bp, Homo sapiens
tagtttctgttctgtgg

SEQ ID NO: 5306343 - DNA, 18 bp, Homo sapiens
tagtttctgttctgtgga

SEQ ID NO: 5306344 - DNA, 20 bp, Homo sapiens
tagtttctgttctgtggaaa

SEQ ID NO: 5306345 - DNA, 16 bp, Homo sapiens
tagtttctttctgtct

SEQ ID NO: 5306346 - DNA, 22 bp, Homo sapiens
tagtttgaaagttgtacatgat

SEQ ID NO: 5306347 - DNA, 14 bp, Homo sapiens
tagtttgaatgttt

SEQ ID NO: 5306348 - DNA, 15 bp, Homo sapiens
tagtttgaatgtttt

SEQ ID NO: 5306349 - DNA, 17 bp, Homo sapiens
tagtttgaattcagtaa

SEQ ID NO: 5306350 - DNA, 12 bp, Homo sapiens
tagtttgacact

SEQ ID NO: 5306351 - DNA, 13 bp, Homo sapiens
tagtttgacactg

SEQ ID NO: 5306352 - DNA, 20 bp, Homo sapiens
tagtttgacctcacagtgac

SEQ ID NO: 5306353 - DNA, 21 bp, Homo sapiens
tagtttgacctcacagtgacc

SEQ ID NO: 5306354 - DNA, 20 bp, Homo sapiens
tagtttgaggaaatttgcag

SEQ ID NO: 5306355 - DNA, 15 bp, Homo sapiens
tagtttgattaaatt

SEQ ID NO: 5306356 - DNA, 23 bp, Homo sapiens
tagtttgattaaattcttgcaaa

SEQ ID NO: 5306357 - DNA, 20 bp, Homo sapiens
tagtttgatttaatatctga

SEQ ID NO: 5306358 - DNA, 13 bp, Homo sapiens
tagtttgcagagg

SEQ ID NO: 5306359 - DNA, 12 bp, Homo sapiens
tagtttgcagtt

SEQ ID NO: 5306360 - DNA, 18 bp, Homo sapiens
tagtttgcattcctgata

SEQ ID NO: 5306361 - DNA, 15 bp, Homo sapiens
tagtttgcatttaag

SEQ ID NO: 5306362 - DNA, 17 bp, Homo sapiens
tagtttgcatttcagaa

SEQ ID NO: 5306363 - DNA, 19 bp, Homo sapiens
tagtttgcctgcagtttct

SEQ ID NO: 5306364 - DNA, 11 bp, Homo sapiens
tagtttggata

SEQ ID NO: 5306365 - DNA, 17 bp, Homo sapiens
tagtttggatatttttg

SEQ ID NO: 5306366 - DNA, 15 bp, Homo sapiens
tagtttggcatttca

SEQ ID NO: 5306367 - DNA, 16 bp, Homo sapiens
tagtttgggcttcagc

SEQ ID NO: 5306368 - DNA, 16 bp, Homo sapiens
tagtttgggtattttt

SEQ ID NO: 5306369 - DNA, 17 bp, Homo sapiens
tagtttgtacatgcatt

SEQ ID NO: 5306370 - DNA, 14 bp, Homo sapiens
tagtttgtataact

SEQ ID NO: 5306371 - DNA, 18 bp, Homo sapiens
tagtttgtataacttctt

SEQ ID NO: 5306372 - DNA, 15 bp, Homo sapiens
tagtttgtgagaaac

SEQ ID NO: 5306373 - DNA, 23 bp, Homo sapiens
tagtttgtgatgtaaggcactgt

SEQ ID NO: 5306374 - DNA, 23 bp, Homo sapiens
tagtttgtgggttaaacaaaatg

SEQ ID NO: 5306375 - DNA, 19 bp, Homo sapiens
tagtttgtgtgttgtctct

SEQ ID NO: 5306376 - DNA, 19 bp, Homo sapiens
tagtttgttaaagcctgtt

SEQ ID NO: 5306377 - DNA, 21 bp, Homo sapiens
tagtttgtttaatgtgaactt

SEQ ID NO: 5306378 - DNA, 19 bp, Homo sapiens
tagttttaaaactctttat

SEQ ID NO: 5306379 - DNA, 13 bp, Homo sapiens
tagttttaaaata

SEQ ID NO: 5306380 - DNA, 17 bp, Homo sapiens
tagttttaaaatactat

SEQ ID NO: 5306381 - DNA, 14 bp, Homo sapiens
tagttttaaactca

SEQ ID NO: 5306382 - DNA, 16 bp, Homo sapiens
tagttttaaactcatt

SEQ ID NO: 5306383 - DNA, 21 bp, Homo sapiens
tagttttaaataaagtttgga

SEQ ID NO: 5306384 - DNA, 13 bp, Homo sapiens
tagttttaaatat

SEQ ID NO: 5306385 - DNA, 18 bp, Homo sapiens
tagttttaaatatgaaca

SEQ ID NO: 5306386 - DNA, 14 bp, Homo sapiens
tagttttaacagaa

SEQ ID NO: 5306387 - DNA, 14 bp, Homo sapiens
tagttttaatctct

SEQ ID NO: 5306388 - DNA, 23 bp, Homo sapiens
tagttttaatctcttaatattga

SEQ ID NO: 5306389 - DNA, 19 bp, Homo sapiens
tagttttaccctatatcta

SEQ ID NO: 5306390 - DNA, 22 bp, Homo sapiens
tagttttacttttaaactgtgt

SEQ ID NO: 5306391 - DNA, 14 bp, Homo sapiens
tagttttagttgca

SEQ ID NO: 5306392 - DNA, 16 bp, Homo sapiens
tagttttagttgcaga

SEQ ID NO: 5306393 - DNA, 15 bp, Homo sapiens
tagttttatcttaaa

SEQ ID NO: 5306394 - DNA, 18 bp, Homo sapiens
tagttttatggcatgatt

SEQ ID NO: 5306395 - DNA, 13 bp, Homo sapiens
tagttttattctt

SEQ ID NO: 5306396 - DNA, 22 bp, Homo sapiens
tagttttatttatatttattga

SEQ ID NO: 5306397 - DNA, 15 bp, Homo sapiens
tagttttattttcta

SEQ ID NO: 5306398 - DNA, 22 bp, Homo sapiens
tagttttcagctgctcagaatt

SEQ ID NO: 5306399 - DNA, 10 bp, Homo sapiens
tagttttcca

SEQ ID NO: 5306400 - DNA, 12 bp, Homo sapiens
tagttttcccta

SEQ ID NO: 5306401 - DNA, 17 bp, Homo sapiens
tagttttctaaatgttt

SEQ ID NO: 5306402 - DNA, 11 bp, Homo sapiens
tagttttctcc

SEQ ID NO: 5306403 - DNA, 21 bp, Homo sapiens
tagttttcttcctttgaaaga

SEQ ID NO: 5306404 - DNA, 19 bp, Homo sapiens
tagttttcttgttgctttg

SEQ ID NO: 5306405 - DNA, 13 bp, Homo sapiens
tagttttctttgt

SEQ ID NO: 5306406 - DNA, 21 bp, Homo sapiens
tagttttgcatcacattgtca

SEQ ID NO: 5306407 - DNA, 22 bp, Homo sapiens
tagttttgctccttctgtgttt

SEQ ID NO: 5306408 - DNA, 16 bp, Homo sapiens
tagttttgctttgttg

SEQ ID NO: 5306409 - DNA, 14 bp, Homo sapiens
tagttttgtataca

SEQ ID NO: 5306410 - DNA, 19 bp, Homo sapiens
tagttttgtgatgcatttt

SEQ ID NO: 5306411 - DNA, 20 bp, Homo sapiens
tagtttttaaaaaggccttt

SEQ ID NO: 5306412 - DNA, 22 bp, Homo sapiens
tagtttttaaaaaggcctttgg

SEQ ID NO: 5306413 - DNA, 23 bp, Homo sapiens
tagtttttaaaaaggcctttggg

SEQ ID NO: 5306414 - DNA, 22 bp, Homo sapiens
tagtttttaaaatatcttttga

SEQ ID NO: 5306415 - DNA, 23 bp, Homo sapiens
tagtttttaaaatttatttgcaa

SEQ ID NO: 5306416 - DNA, 20 bp, Homo sapiens
tagtttttacagctgtgtta

SEQ ID NO: 5306417 - DNA, 14 bp, Homo sapiens
tagtttttcacttt

SEQ ID NO: 5306418 - DNA, 14 bp, Homo sapiens
tagtttttcagcta

SEQ ID NO: 5306419 - DNA, 20 bp, Homo sapiens
tagtttttcatcaagagttt

SEQ ID NO: 5306420 - DNA, 14 bp, Homo sapiens
tagtttttcattaa

SEQ ID NO: 5306421 - DNA, 16 bp, Homo sapiens
tagtttttcctgtgca

SEQ ID NO: 5306422 - DNA, 19 bp, Homo sapiens
tagtttttctaatactaat

SEQ ID NO: 5306423 - DNA, 14 bp, Homo sapiens
tagtttttgaaaat

SEQ ID NO: 5306424 - DNA, 17 bp, Homo sapiens
tagtttttgaaaattat

SEQ ID NO: 5306425 - DNA, 17 bp, Homo sapiens
tagtttttgtaatttat

SEQ ID NO: 5306426 - DNA, 22 bp, Homo sapiens
tagtttttgttcaccttctgtg

SEQ ID NO: 5306427 - DNA, 21 bp, Homo sapiens
tagtttttgttcttaattgca

SEQ ID NO: 5306428 - DNA, 14 bp, Homo sapiens
tagttttttcatct

SEQ ID NO: 5306429 - DNA, 15 bp, Homo sapiens
tagttttttcatctt

SEQ ID NO: 5306430 - DNA, 20 bp, Homo sapiens
tagttttttcttccttttca

SEQ ID NO: 5306431 - DNA, 23 bp, Homo sapiens
tagttttttcttccttttcactg

SEQ ID NO: 5306432 - DNA, 13 bp, Homo sapiens
tagttttttgctt

SEQ ID NO: 5306433 - DNA, 22 bp, Homo sapiens
tagttttttggttttgtttctg

SEQ ID NO: 5306434 - DNA, 21 bp, Homo sapiens
tagttttttttgtaaactgta

SEQ ID NO: 5306435 - DNA, 19 bp, Homo sapiens
tagtttttttttttttcct

SEQ ID NO: 5306436 - DNA, 23 bp, Homo sapiens
tagttttttttttttttatgtga

SEQ ID NO: 5306437 - DNA, 20 bp, Homo sapiens
tataaaaaaaagttgtttat

SEQ ID NO: 5306438 - DNA, 14 bp, Homo sapiens
tataaaaaaaatag

SEQ ID NO: 5306439 - DNA, 19 bp, Homo sapiens
tataaaaaaaatgaaatgt

SEQ ID NO: 5306440 - DNA, 15 bp, Homo sapiens
tataaaaaaattgta

SEQ ID NO: 5306441 - DNA, 12 bp, Homo sapiens
tataagccatag

SEQ ID NO: 5306442 - DNA, 20 bp, Homo sapiens
tataagccctgcataatgtt

SEQ ID NO: 5306443 - DNA, 14 bp, Homo sapiens
tataagcgtattta

SEQ ID NO: 5306444 - DNA, 21 bp, Homo sapiens
tataagctatgagttgaaatg

SEQ ID NO: 5306445 - DNA, 13 bp, Homo sapiens
tataagctgtaat

SEQ ID NO: 5306446 - DNA, 19 bp, Homo sapiens
tataagctgtaatatcatt

SEQ ID NO: 5306447 - DNA, 17 bp, Homo sapiens
tataagctgtttagttt

SEQ ID NO: 5306448 - DNA, 17 bp, Homo sapiens
tataagcttaaaataag

SEQ ID NO: 5306449 - DNA, 19 bp, Homo sapiens
tataagcttaaaataagtg

SEQ ID NO: 5306450 - DNA, 14 bp, Homo sapiens
tataagcttttctt

SEQ ID NO: 5306451 - DNA, 23 bp, Homo sapiens
tataaggaaagcaataaatgaat

SEQ ID NO: 5306452 - DNA, 10 bp, Homo sapiens
tataaggact

SEQ ID NO: 5306453 - DNA, 12 bp, Homo sapiens
tataaggactgc

SEQ ID NO: 5306454 - DNA, 21 bp, Homo sapiens
tataaggactgcatggtaatt

SEQ ID NO: 5306455 - DNA, 17 bp, Homo sapiens
tataaggagctttgctc

SEQ ID NO: 5306456 - DNA, 17 bp, Homo sapiens
tataaggccatttcctt

SEQ ID NO: 5306457 - DNA, 17 bp, Homo sapiens
tataaggctaaatgtaa

SEQ ID NO: 5306458 - DNA, 17 bp, Homo sapiens
tataagggagagctgag

SEQ ID NO: 5306459 - DNA, 18 bp, Homo sapiens
tataagggagtaggctgt

SEQ ID NO: 5306460 - DNA, 22 bp, Homo sapiens
tataagggagtaggctgtattt

SEQ ID NO: 5306461 - DNA, 12 bp, Homo sapiens
tataagggccct

SEQ ID NO: 5306462 - DNA, 16 bp, Homo sapiens
tataaggggaaagata

SEQ ID NO: 5306463 - DNA, 14 bp, Homo sapiens
tataaggtaatgta

SEQ ID NO: 5306464 - DNA, 17 bp, Homo sapiens
tataaggtacatatttt

SEQ ID NO: 5306465 - DNA, 22 bp, Homo sapiens
tataaggtgctctctttctgtc

SEQ ID NO: 5306466 - DNA, 22 bp, Homo sapiens
tataaggtgttttctgtgtaac

SEQ ID NO: 5306467 - DNA, 15 bp, Homo sapiens
tataaggttttaagt

SEQ ID NO: 5306468 - DNA, 22 bp, Homo sapiens
tataagtaactttattcttgaa

SEQ ID NO: 5306469 - DNA, 15 bp, Homo sapiens
tataagtagaaactt

SEQ ID NO: 5306470 - DNA, 15 bp, Homo sapiens
tataagtagtaaatc

SEQ ID NO: 5306471 - DNA, 16 bp, Homo sapiens
tataagtatataaata

SEQ ID NO: 5306472 - DNA, 16 bp, Homo sapiens
tataagtattctaaat

SEQ ID NO: 5306473 - DNA, 15 bp, Homo sapiens
tataagtcaagcaca

SEQ ID NO: 5306474 - DNA, 14 bp, Homo sapiens
tataagtcacaaag

SEQ ID NO: 5306475 - DNA, 18 bp, Homo sapiens
tataagtcattgtatgtt

SEQ ID NO: 5306476 - DNA, 17 bp, Homo sapiens
tataagtccatgaatgt

SEQ ID NO: 5306477 - DNA, 23 bp, Homo sapiens
tataagtctgggcactggatgca

SEQ ID NO: 5306478 - DNA, 21 bp, Homo sapiens
tataagtcttggtaacaaata

SEQ ID NO: 5306479 - DNA, 13 bp, Homo sapiens
tataagtgacttt

SEQ ID NO: 5306480 - DNA, 22 bp, Homo sapiens
tataagtgactttaaactttcc

SEQ ID NO: 5306481 - DNA, 17 bp, Homo sapiens
tataagtgcacacagaa

SEQ ID NO: 5306482 - DNA, 19 bp, Homo sapiens
tataagtggtgcttagaaa

SEQ ID NO: 5306483 - DNA, 20 bp, Homo sapiens
tataagtggtgcttagaaaa

SEQ ID NO: 5306484 - DNA, 23 bp, Homo sapiens
tataagtgtaaatataatcagac

SEQ ID NO: 5306485 - DNA, 15 bp, Homo sapiens
tataagtgttcagtg

SEQ ID NO: 5306486 - DNA, 16 bp, Homo sapiens
tataagtgttcagtgt

SEQ ID NO: 5306487 - DNA, 17 bp, Homo sapiens
tataagtgttcagtgtt

SEQ ID NO: 5306488 - DNA, 20 bp, Homo sapiens
tataagtgttcagtgttgac

SEQ ID NO: 5306489 - DNA, 17 bp, Homo sapiens
tataagttaaaacaaag

SEQ ID NO: 5306490 - DNA, 13 bp, Homo sapiens
tataagttaaaga

SEQ ID NO: 5306491 - DNA, 20 bp, Homo sapiens
tataagttatttttgtacat

SEQ ID NO: 5306492 - DNA, 21 bp, Homo sapiens
tataagttatttttgtacatg

SEQ ID NO: 5306493 - DNA, 17 bp, Homo sapiens
tataagttcacaaaatg

SEQ ID NO: 5306494 - DNA, 23 bp, Homo sapiens
tataagttctattttactgtctt

SEQ ID NO: 5306495 - DNA, 16 bp, Homo sapiens
tataagttgaaggaaa

SEQ ID NO: 5306496 - DNA, 14 bp, Homo sapiens
tataagttgacctt

SEQ ID NO: 5306497 - DNA, 17 bp, Homo sapiens
tataagttgagaaggtg

SEQ ID NO: 5306498 - DNA, 22 bp, Homo sapiens
tataagttgagaaggtgcctgc

SEQ ID NO: 5306499 - DNA, 14 bp, Homo sapiens
tataagttgctgta

SEQ ID NO: 5306500 - DNA, 15 bp, Homo sapiens
tataagttgtattat

SEQ ID NO: 5306501 - DNA, 21 bp, Homo sapiens
tataagttgtattattagact

SEQ ID NO: 5306502 - DNA, 22 bp, Homo sapiens
tataagtttattgtaaaagtga

SEQ ID NO: 5306503 - DNA, 18 bp, Homo sapiens
tataagtttctttagaaa

SEQ ID NO: 5306504 - DNA, 18 bp, Homo sapiens
tataataaaaatatattt

SEQ ID NO: 5306505 - DNA, 14 bp, Homo sapiens
tataataaaaccaa

SEQ ID NO: 5306506 - DNA, 22 bp, Homo sapiens
tataataaaaggaaaagcaaat

SEQ ID NO: 5306507 - DNA, 17 bp, Homo sapiens
tataataaaagttatta

SEQ ID NO: 5306508 - DNA, 14 bp, Homo sapiens
tataataaaatgtg

SEQ ID NO: 5306509 - DNA, 20 bp, Homo sapiens
tataataaaatgtgttgaaa

SEQ ID NO: 5306510 - DNA, 16 bp, Homo sapiens
tataataaaatttctt

SEQ ID NO: 5306511 - DNA, 14 bp, Homo sapiens
tataataaaggact

SEQ ID NO: 5306512 - DNA, 22 bp, Homo sapiens
tataataaaggactgtaatctt

SEQ ID NO: 5306513 - DNA, 12 bp, Homo sapiens
tataataaatat

SEQ ID NO: 5306514 - DNA, 22 bp, Homo sapiens
tataataaatgggaaatgtcga

SEQ ID NO: 5306515 - DNA, 11 bp, Homo sapiens
tataataactt

SEQ ID NO: 5306516 - DNA, 14 bp, Homo sapiens
tataataactttat

SEQ ID NO: 5306517 - DNA, 18 bp, Homo sapiens
tataataagttttgatat

SEQ ID NO: 5306518 - DNA, 21 bp, Homo sapiens
tataataagttttgatataat

SEQ ID NO: 5306519 - DNA, 21 bp, Homo sapiens
tataataatagttattattta

SEQ ID NO: 5306520 - DNA, 18 bp, Homo sapiens
tataataatgttctctgg

SEQ ID NO: 5306521 - DNA, 18 bp, Homo sapiens
tataatacacaaaatcaa

SEQ ID NO: 5306522 - DNA, 12 bp, Homo sapiens
tataataccttt

SEQ ID NO: 5306523 - DNA, 15 bp, Homo sapiens
tataatacctttcta

SEQ ID NO: 5306524 - DNA, 16 bp, Homo sapiens
tataatactaaaactc

SEQ ID NO: 5306525 - DNA, 15 bp, Homo sapiens
tataatactaaagtg

SEQ ID NO: 5306526 - DNA, 13 bp, Homo sapiens
tataatactacta

SEQ ID NO: 5306527 - DNA, 20 bp, Homo sapiens
tataatactactactgttat

SEQ ID NO: 5306528 - DNA, 12 bp, Homo sapiens
tataatactgtt

SEQ ID NO: 5306529 - DNA, 16 bp, Homo sapiens
tataatacttgcaact

SEQ ID NO: 5306530 - DNA, 19 bp, Homo sapiens
tataatagattgagttatt

SEQ ID NO: 5306531 - DNA, 23 bp, Homo sapiens
tataataggaacaatctttgctg

SEQ ID NO: 5306532 - DNA, 18 bp, Homo sapiens
tataataggtatatagaa

SEQ ID NO: 5306533 - DNA, 14 bp, Homo sapiens
tataatataaatat

SEQ ID NO: 5306534 - DNA, 20 bp, Homo sapiens
tataatatactatatttatg

SEQ ID NO: 5306535 - DNA, 16 bp, Homo sapiens
tataatatagaaagaa

SEQ ID NO: 5306536 - DNA, 14 bp, Homo sapiens
tataatatatatat

SEQ ID NO: 5306537 - DNA, 14 bp, Homo sapiens
tataatatatatct

SEQ ID NO: 5306538 - DNA, 15 bp, Homo sapiens
tataatatatatcta

SEQ ID NO: 5306539 - DNA, 16 bp, Homo sapiens
tataatatatttgtgt

SEQ ID NO: 5306540 - DNA, 15 bp, Homo sapiens
tataatatcctttgt

SEQ ID NO: 5306541 - DNA, 20 bp, Homo sapiens
tataatatctaaagttatat

SEQ ID NO: 5306542 - DNA, 15 bp, Homo sapiens
tataatatgaatata

SEQ ID NO: 5306543 - DNA, 18 bp, Homo sapiens
tataatatgtgccttaag

SEQ ID NO: 5306544 - DNA, 22 bp, Homo sapiens
tataatattcagccagcttaaa

SEQ ID NO: 5306545 - DNA, 18 bp, Homo sapiens
tataatattcatacaaca

SEQ ID NO: 5306546 - DNA, 22 bp, Homo sapiens
tataatattcatacaacaaaga

SEQ ID NO: 5306547 - DNA, 15 bp, Homo sapiens
tataatattgcagtt

SEQ ID NO: 5306548 - DNA, 17 bp, Homo sapiens
tataatatttcttaatt

SEQ ID NO: 5306549 - DNA, 18 bp, Homo sapiens
tataatatttcttaattt

SEQ ID NO: 5306550 - DNA, 19 bp, Homo sapiens
tataatatttgaagcagct

SEQ ID NO: 5306551 - DNA, 22 bp, Homo sapiens
tataatcaaaataatacttcat

SEQ ID NO: 5306552 - DNA, 18 bp, Homo sapiens
tataatcaatgaatttgt

SEQ ID NO: 5306553 - DNA, 17 bp, Homo sapiens
tataatcacttggggtt

SEQ ID NO: 5306554 - DNA, 18 bp, Homo sapiens
tataatcccagcactttg

SEQ ID NO: 5306555 - DNA, 19 bp, Homo sapiens
tataatcccagcatgttga

SEQ ID NO: 5306556 - DNA, 22 bp, Homo sapiens
tataatccttaaatcttaatgt

SEQ ID NO: 5306557 - DNA, 17 bp, Homo sapiens
tataatctcaaaggaga

SEQ ID NO: 5306558 - DNA, 13 bp, Homo sapiens
tataatctgaaga

SEQ ID NO: 5306559 - DNA, 13 bp, Homo sapiens
tataatctgtcaa

SEQ ID NO: 5306560 - DNA, 20 bp, Homo sapiens
tataatctgtcaaaacactg

SEQ ID NO: 5306561 - DNA, 21 bp, Homo sapiens
tataatctgtcaaaacactgt

SEQ ID NO: 5306562 - DNA, 17 bp, Homo sapiens
tataatcttataattgt

SEQ ID NO: 5306563 - DNA, 14 bp, Homo sapiens
tataatcttataca

SEQ ID NO: 5306564 - DNA, 15 bp, Homo sapiens
tataatcttatacaa

SEQ ID NO: 5306565 - DNA, 16 bp, Homo sapiens
tataatcttatacaac

SEQ ID NO: 5306566 - DNA, 20 bp, Homo sapiens
tataatcttccatacttctt

SEQ ID NO: 5306567 - DNA, 19 bp, Homo sapiens
tataatcttggcttcttaa

SEQ ID NO: 5306568 - DNA, 20 bp, Homo sapiens
tataatcttggcttcttaaa

SEQ ID NO: 5306569 - DNA, 16 bp, Homo sapiens
tataatcttgtagaca

SEQ ID NO: 5306570 - DNA, 18 bp, Homo sapiens
tataatcttgtagacact

SEQ ID NO: 5306571 - DNA, 14 bp, Homo sapiens
tataatgaaaacat

SEQ ID NO: 5306572 - DNA, 20 bp, Homo sapiens
tataatgaaatctgtttgtt

SEQ ID NO: 5306573 - DNA, 16 bp, Homo sapiens
tataatgaacaaaatt

SEQ ID NO: 5306574 - DNA, 17 bp, Homo sapiens
tataatgaagaacactg

SEQ ID NO: 5306575 - DNA, 16 bp, Homo sapiens
tataatgaataaatca

SEQ ID NO: 5306576 - DNA, 18 bp, Homo sapiens
tataatgaatgaaacatt

SEQ ID NO: 5306577 - DNA, 16 bp, Homo sapiens
tataatgaatttagtg

SEQ ID NO: 5306578 - DNA, 13 bp, Homo sapiens
tataatgactggt

SEQ ID NO: 5306579 - DNA, 16 bp, Homo sapiens
tataatgacttttaaa

SEQ ID NO: 5306580 - DNA, 19 bp, Homo sapiens
tataatgacttttaaaatt

SEQ ID NO: 5306581 - DNA, 20 bp, Homo sapiens
tataatgacttttaaaattt

SEQ ID NO: 5306582 - DNA, 23 bp, Homo sapiens
tataatgatcagcaaaaagactg

SEQ ID NO: 5306583 - DNA, 13 bp, Homo sapiens
tataatgctttct

SEQ ID NO: 5306584 - DNA, 21 bp, Homo sapiens
tataatggaagagaaatctca

SEQ ID NO: 5306585 - DNA, 17 bp, Homo sapiens
tataatggcctcttaaa

SEQ ID NO: 5306586 - DNA, 22 bp, Homo sapiens
tataatggcctcttaaaaatta

SEQ ID NO: 5306587 - DNA, 20 bp, Homo sapiens
tataatggtaatagaatagc

SEQ ID NO: 5306588 - DNA, 18 bp, Homo sapiens
tataatggtgatgtcata

SEQ ID NO: 5306589 - DNA, 12 bp, Homo sapiens
tataatggttta

SEQ ID NO: 5306590 - DNA, 19 bp, Homo sapiens
tataatggtttactgctgt

SEQ ID NO: 5306591 - DNA, 20 bp, Homo sapiens
tataatggtttactgctgtc

SEQ ID NO: 5306592 - DNA, 14 bp, Homo sapiens
tataatgtaagctc

SEQ ID NO: 5306593 - DNA, 20 bp, Homo sapiens
tataatgtaagctctactga

SEQ ID NO: 5306594 - DNA, 16 bp, Homo sapiens
tataatgtaatgtttt

SEQ ID NO: 5306595 - DNA, 16 bp, Homo sapiens
tataatgtatataaac

SEQ ID NO: 5306596 - DNA, 18 bp, Homo sapiens
tataatgtattcatattt

SEQ ID NO: 5306597 - DNA, 13 bp, Homo sapiens
tataatgtatttg

SEQ ID NO: 5306598 - DNA, 14 bp, Homo sapiens
tataatgtatttga

SEQ ID NO: 5306599 - DNA, 15 bp, Homo sapiens
tataatgtatttgaa

SEQ ID NO: 5306600 - DNA, 20 bp, Homo sapiens
tataatgtcattaaacatga

SEQ ID NO: 5306601 - DNA, 21 bp, Homo sapiens
tataatgtgagtagttactaa

SEQ ID NO: 5306602 - DNA, 23 bp, Homo sapiens
tataatgtgctttatttgcaaat

SEQ ID NO: 5306603 - DNA, 18 bp, Homo sapiens
tataatgtggatttccta

SEQ ID NO: 5306604 - DNA, 21 bp, Homo sapiens
tataatgtgtgctttattgaa

SEQ ID NO: 5306605 - DNA, 14 bp, Homo sapiens
tataatgtgtgtat

SEQ ID NO: 5306606 - DNA, 22 bp, Homo sapiens
tataatgtgtgtatgtgtattt

SEQ ID NO: 5306607 - DNA, 14 bp, Homo sapiens
tataatgtgtgttg

SEQ ID NO: 5306608 - DNA, 17 bp, Homo sapiens
tataatgttggtgtgga

SEQ ID NO: 5306609 - DNA, 19 bp, Homo sapiens
tataatgttgttatttaaa

SEQ ID NO: 5306610 - DNA, 16 bp, Homo sapiens
tataatgtttaaatca

SEQ ID NO: 5306611 - DNA, 13 bp, Homo sapiens
tataattaaagaa

SEQ ID NO: 5306612 - DNA, 21 bp, Homo sapiens
tataattaaagaaaattgcca

SEQ ID NO: 5306613 - DNA, 22 bp, Homo sapiens
tataattaaagaaaattgccaa

SEQ ID NO: 5306614 - DNA, 12 bp, Homo sapiens
tataattaacat

SEQ ID NO: 5306615 - DNA, 15 bp, Homo sapiens
tataattaacatgtt

SEQ ID NO: 5306616 - DNA, 14 bp, Homo sapiens
tataattaatgctt

SEQ ID NO: 5306617 - DNA, 19 bp, Homo sapiens
tataattaatgtttgtggg

SEQ ID NO: 5306618 - DNA, 17 bp, Homo sapiens
tataattacaatgcaca

SEQ ID NO: 5306619 - DNA, 21 bp, Homo sapiens
tatagaatatttattacctct

SEQ ID NO: 5306620 - DNA, 20 bp, Homo sapiens
tatagaattagctttttcat

SEQ ID NO: 5306621 - DNA, 14 bp, Homo sapiens
tatagaatttcctg

SEQ ID NO: 5306622 - DNA, 15 bp, Homo sapiens
tatagaatttcctgt

SEQ ID NO: 5306623 - DNA, 16 bp, Homo sapiens
tatagaatttcctgta

SEQ ID NO: 5306624 - DNA, 18 bp, Homo sapiens
tatagaatttttaatgtt

SEQ ID NO: 5306625 - DNA, 18 bp, Homo sapiens
tatagacaaaagaataag

SEQ ID NO: 5306626 - DNA, 20 bp, Homo sapiens
tatagacaaaagaataagac

SEQ ID NO: 5306627 - DNA, 21 bp, Homo sapiens
tatagacaaaagaataagaca

SEQ ID NO: 5306628 - DNA, 14 bp, Homo sapiens
tatagacagtttgt

SEQ ID NO: 5306629 - DNA, 16 bp, Homo sapiens
tatagacagtttgtaa

SEQ ID NO: 5306630 - DNA, 14 bp, Homo sapiens
tatagaccaaagca

SEQ ID NO: 5306631 - DNA, 21 bp, Homo sapiens
tatagacttggagaatactgc

SEQ ID NO: 5306632 - DNA, 22 bp, Homo sapiens
tatagagatgtttttaaaagtt

SEQ ID NO: 5306633 - DNA, 17 bp, Homo sapiens
tatagagcagaaattct

SEQ ID NO: 5306634 - DNA, 18 bp, Homo sapiens
tatagagcagaaattctg

SEQ ID NO: 5306635 - DNA, 20 bp, Homo sapiens
tatagaggtaaaatttgcac

SEQ ID NO: 5306636 - DNA, 19 bp, Homo sapiens
tatagagttcatagaaata

SEQ ID NO: 5306637 - DNA, 22 bp, Homo sapiens
tatagataaatccaatagtctg

SEQ ID NO: 5306638 - DNA, 16 bp, Homo sapiens
tatagataacggctct

SEQ ID NO: 5306639 - DNA, 15 bp, Homo sapiens
tatagataggtagaa

SEQ ID NO: 5306640 - DNA, 20 bp, Homo sapiens
tatagatataatgaacaaaa

SEQ ID NO: 5306641 - DNA, 21 bp, Homo sapiens
tatagatataatgaacaaaat

SEQ ID NO: 5306642 - DNA, 23 bp, Homo sapiens
tatagatataatgaacaaaatta

SEQ ID NO: 5306643 - DNA, 15 bp, Homo sapiens
tatagatcatttcta

SEQ ID NO: 5306644 - DNA, 20 bp, Homo sapiens
tatagatgagtttttcatta

SEQ ID NO: 5306645 - DNA, 16 bp, Homo sapiens
tatagatgatgatgtg

SEQ ID NO: 5306646 - DNA, 19 bp, Homo sapiens
tatagatgcctcttaggac

SEQ ID NO: 5306647 - DNA, 23 bp, Homo sapiens
tatagatgggggaaagcaaagca

SEQ ID NO: 5306648 - DNA, 13 bp, Homo sapiens
tatagatgtctgt

SEQ ID NO: 5306649 - DNA, 17 bp, Homo sapiens
tatagatgtctgtgtat

SEQ ID NO: 5306650 - DNA, 15 bp, Homo sapiens
tatagatgtcttttc

SEQ ID NO: 5306651 - DNA, 15 bp, Homo sapiens
tatagattaaatcat

SEQ ID NO: 5306652 - DNA, 17 bp, Homo sapiens
tatagattagaaaaatt

SEQ ID NO: 5306653 - DNA, 12 bp, Homo sapiens
tatagattctaa

SEQ ID NO: 5306654 - DNA, 17 bp, Homo sapiens
tatagattctaaagatt

SEQ ID NO: 5306655 - DNA, 13 bp, Homo sapiens
tatagattcttta

SEQ ID NO: 5306656 - DNA, 14 bp, Homo sapiens
tatagattgattta

SEQ ID NO: 5306657 - DNA, 23 bp, Homo sapiens
tatagattgatttacctttggaa

SEQ ID NO: 5306658 - DNA, 14 bp, Homo sapiens
tatagattgtctta

SEQ ID NO: 5306659 - DNA, 13 bp, Homo sapiens
tatagatttagtt

SEQ ID NO: 5306660 - DNA, 22 bp, Homo sapiens
tatagatttagttttgtaactt

SEQ ID NO: 5306661 - DNA, 22 bp, Homo sapiens
tatagattttttaaaaaaaatg

SEQ ID NO: 5306662 - DNA, 23 bp, Homo sapiens
tatagattttttaaaaaaaatgt

SEQ ID NO: 5306663 - DNA, 19 bp, Homo sapiens
tatagcaaaacttttaaac

SEQ ID NO: 5306664 - DNA, 21 bp, Homo sapiens
tatagcaaaacttttaaacta

SEQ ID NO: 5306665 - DNA, 22 bp, Homo sapiens
tatagcaaaacttttaaactac

SEQ ID NO: 5306666 - DNA, 15 bp, Homo sapiens
tatagcaaagatata

SEQ ID NO: 5306667 - DNA, 14 bp, Homo sapiens
tatagcaaatgcag

SEQ ID NO: 5306668 - DNA, 17 bp, Homo sapiens
tatagcaaatgcagaac

SEQ ID NO: 5306669 - DNA, 16 bp, Homo sapiens
tatagcaagatattga

SEQ ID NO: 5306670 - DNA, 17 bp, Homo sapiens
tatagcaatgtaacatt

SEQ ID NO: 5306671 - DNA, 15 bp, Homo sapiens
tatagcactgagctc

SEQ ID NO: 5306672 - DNA, 20 bp, Homo sapiens
tatagcactttgaaatacct

SEQ ID NO: 5306673 - DNA, 11 bp, Homo sapiens
tatagcagaag

SEQ ID NO: 5306674 - DNA, 21 bp, Homo sapiens
tatagcagcaaaaatataaaa

SEQ ID NO: 5306675 - DNA, 14 bp, Homo sapiens
tatagcatcactta

SEQ ID NO: 5306676 - DNA, 18 bp, Homo sapiens
tatagcatcacttaaaac

SEQ ID NO: 5306677 - DNA, 14 bp, Homo sapiens
tatagcatcttctc

SEQ ID NO: 5306678 - DNA, 16 bp, Homo sapiens
tatagcatctttcata

SEQ ID NO: 5306679 - DNA, 19 bp, Homo sapiens
tatagcatctttcatatgg

SEQ ID NO: 5306680 - DNA, 16 bp, Homo sapiens
tatagcatgaaataaa

SEQ ID NO: 5306681 - DNA, 20 bp, Homo sapiens
tatagcatgaaataaaatat

SEQ ID NO: 5306682 - DNA, 10 bp, Homo sapiens
tatagcatta

SEQ ID NO: 5306683 - DNA, 17 bp, Homo sapiens
tatagcattaataaaac

SEQ ID NO: 5306684 - DNA, 18 bp, Homo sapiens
tatagcattaataaaact

SEQ ID NO: 5306685 - DNA, 20 bp, Homo sapiens
tatagcattaataaaactgt

SEQ ID NO: 5306686 - DNA, 18 bp, Homo sapiens
tatagcatttaaagatac

SEQ ID NO: 5306687 - DNA, 14 bp, Homo sapiens
tatagccaatataa

SEQ ID NO: 5306688 - DNA, 17 bp, Homo sapiens
tatagccaatataacta

SEQ ID NO: 5306689 - DNA, 18 bp, Homo sapiens
tatagccatttgccccaa

SEQ ID NO: 5306690 - DNA, 22 bp, Homo sapiens
tatagcccagccaggccccagg

SEQ ID NO: 5306691 - DNA, 16 bp, Homo sapiens
tatagccctgtgaagt

SEQ ID NO: 5306692 - DNA, 18 bp, Homo sapiens
tatagccctttccccact

SEQ ID NO: 5306693 - DNA, 18 bp, Homo sapiens
tatagcctaggtgacaga

SEQ ID NO: 5306694 - DNA, 14 bp, Homo sapiens
tatagcctgcctca

SEQ ID NO: 5306695 - DNA, 22 bp, Homo sapiens
tatagcctgcctcagtggcagc

SEQ ID NO: 5306696 - DNA, 16 bp, Homo sapiens
tatagcgcctgtataa

SEQ ID NO: 5306697 - DNA, 21 bp, Homo sapiens
tatagctagctatttctatgt

SEQ ID NO: 5306698 - DNA, 17 bp, Homo sapiens
tatagctatcatttctt

SEQ ID NO: 5306699 - DNA, 15 bp, Homo sapiens
tatagctcatcactg

SEQ ID NO: 5306700 - DNA, 17 bp, Homo sapiens
tatagctcccaaaagaa

SEQ ID NO: 5306701 - DNA, 18 bp, Homo sapiens
tatagctcccaaaagaat

SEQ ID NO: 5306702 - DNA, 23 bp, Homo sapiens
tatagctctaatgtttgcatata

SEQ ID NO: 5306703 - DNA, 17 bp, Homo sapiens
tatagctcttctattta

SEQ ID NO: 5306704 - DNA, 21 bp, Homo sapiens
tatagctgagactacaagtgt

SEQ ID NO: 5306705 - DNA, 21 bp, Homo sapiens
tatagctgcaagtgtatctcc

SEQ ID NO: 5306706 - DNA, 22 bp, Homo sapiens
tatagctgcttccagtgtagac

SEQ ID NO: 5306707 - DNA, 16 bp, Homo sapiens
tatagctgtacaaata

SEQ ID NO: 5306708 - DNA, 13 bp, Homo sapiens
tatagctgtattg

SEQ ID NO: 5306709 - DNA, 21 bp, Homo sapiens
tatagctgtattgaatcatgt

SEQ ID NO: 5306710 - DNA, 17 bp, Homo sapiens
tatagcttccagattac

SEQ ID NO: 5306711 - DNA, 16 bp, Homo sapiens
tatagcttgaaacata

SEQ ID NO: 5306712 - DNA, 15 bp, Homo sapiens
tatagcttgcagaac

SEQ ID NO: 5306713 - DNA, 13 bp, Homo sapiens
tatagctttattt

SEQ ID NO: 5306714 - DNA, 12 bp, Homo sapiens
tataggaaaaaa

SEQ ID NO: 5306715 - DNA, 12 bp, Homo sapiens
tataggaaaata

SEQ ID NO: 5306716 - DNA, 18 bp, Homo sapiens
tataggaaataaatctaa

SEQ ID NO: 5306717 - DNA, 19 bp, Homo sapiens
tataggaattgacccacaa

SEQ ID NO: 5306718 - DNA, 15 bp, Homo sapiens
tataggaatttgtat

SEQ ID NO: 5306719 - DNA, 18 bp, Homo sapiens
tataggaatttgtatttt

SEQ ID NO: 5306720 - DNA, 13 bp, Homo sapiens
tataggacaaggg

SEQ ID NO: 5306721 - DNA, 15 bp, Homo sapiens
tataggacttaattt

SEQ ID NO: 5306722 - DNA, 24 bp, Homo sapiens
tataggagaaagcaaaatacatca

SEQ ID NO: 5306723 - DNA, 16 bp, Homo sapiens
tataggagacttgtag

SEQ ID NO: 5306724 - DNA, 13 bp, Homo sapiens
tataggataaaat

SEQ ID NO: 5306725 - DNA, 13 bp, Homo sapiens
tataggataaatt

SEQ ID NO: 5306726 - DNA, 20 bp, Homo sapiens
tataggataaattacattaa

SEQ ID NO: 5306727 - DNA, 19 bp, Homo sapiens
tataggatagacactggac

SEQ ID NO: 5306728 - DNA, 23 bp, Homo sapiens
tataggccagggcatgtgtatgt

SEQ ID NO: 5306729 - DNA, 22 bp, Homo sapiens
tataggcctgtcccttgcctct

SEQ ID NO: 5306730 - DNA, 23 bp, Homo sapiens
tataggcctgtcccttgcctctg

SEQ ID NO: 5306731 - DNA, 21 bp, Homo sapiens
tataggctattttctaaagac

SEQ ID NO: 5306732 - DNA, 19 bp, Homo sapiens
tatagggaattttcatttt

SEQ ID NO: 5306733 - DNA, 23 bp, Homo sapiens
tatagggcttttattttttaagt

SEQ ID NO: 5306734 - DNA, 15 bp, Homo sapiens
tataggggatacttg

SEQ ID NO: 5306735 - DNA, 19 bp, Homo sapiens
tatagggttttttttaatg

SEQ ID NO: 5306736 - DNA, 19 bp, Homo sapiens
tataggtaaaatctctgaa

SEQ ID NO: 5306737 - DNA, 17 bp, Homo sapiens
tataggtagatccagat

SEQ ID NO: 5306738 - DNA, 23 bp, Homo sapiens
tataggtcacatatgtctgtatc

SEQ ID NO: 5306739 - DNA, 14 bp, Homo sapiens
tataggtcactcct

SEQ ID NO: 5306740 - DNA, 20 bp, Homo sapiens
tataggtcctgtgttaaaca

SEQ ID NO: 5306741 - DNA, 13 bp, Homo sapiens
tataggtgaagga

SEQ ID NO: 5306742 - DNA, 16 bp, Homo sapiens
tataggtgctacaaaa

SEQ ID NO: 5306743 - DNA, 21 bp, Homo sapiens
tataggtgttggttttggggg

SEQ ID NO: 5306744 - DNA, 21 bp, Homo sapiens
tataggttactcataaggcat

SEQ ID NO: 5306745 - DNA, 14 bp, Homo sapiens
tataggtttaattt

SEQ ID NO: 5306746 - DNA, 18 bp, Homo sapiens
tataggttttaaagacct

SEQ ID NO: 5306747 - DNA, 22 bp, Homo sapiens
tatagtaactactttttatact

SEQ ID NO: 5306748 - DNA, 17 bp, Homo sapiens
tatagtactgctttact

SEQ ID NO: 5306749 - DNA, 23 bp, Homo sapiens
tatagtagaaagacatctgcctg

SEQ ID NO: 5306750 - DNA, 13 bp, Homo sapiens
tatagtagatttt

SEQ ID NO: 5306751 - DNA, 20 bp, Homo sapiens
tatagtagtcaattagtaca

SEQ ID NO: 5306752 - DNA, 18 bp, Homo sapiens
tatagtagttacttgtga

SEQ ID NO: 5306753 - DNA, 13 bp, Homo sapiens
tatagtatctgta

SEQ ID NO: 5306754 - DNA, 15 bp, Homo sapiens
tatagtcaatggctt

SEQ ID NO: 5306755 - DNA, 22 bp, Homo sapiens
tatagtcatttattttaaaaaa

SEQ ID NO: 5306756 - DNA, 13 bp, Homo sapiens
tatagtccaacat

SEQ ID NO: 5306757 - DNA, 19 bp, Homo sapiens
tatagtctaagactatata

SEQ ID NO: 5306758 - DNA, 20 bp, Homo sapiens
tatagtctaagactatatat

SEQ ID NO: 5306759 - DNA, 13 bp, Homo sapiens
tatagtgaagaat

SEQ ID NO: 5306760 - DNA, 12 bp, Homo sapiens
tatagtgaagca

SEQ ID NO: 5306761 - DNA, 17 bp, Homo sapiens
tatagtgaagtgttaat

SEQ ID NO: 5306762 - DNA, 12 bp, Homo sapiens
tatagtgacatg

SEQ ID NO: 5306763 - DNA, 18 bp, Homo sapiens
tatagtgatgtaatcttg

SEQ ID NO: 5306764 - DNA, 16 bp, Homo sapiens
tatagtgcaatatatt

SEQ ID NO: 5306765 - DNA, 19 bp, Homo sapiens
tatagtgcaatatattttg

SEQ ID NO: 5306766 - DNA, 17 bp, Homo sapiens
tatagtgcacaaaatga

SEQ ID NO: 5306767 - DNA, 13 bp, Homo sapiens
tatagtgcagaaa

SEQ ID NO: 5306768 - DNA, 19 bp, Homo sapiens
tatagtgcagaaaacgtgg

SEQ ID NO: 5306769 - DNA, 20 bp, Homo sapiens
tatagtgctatatatataaa

SEQ ID NO: 5306770 - DNA, 15 bp, Homo sapiens
tatagtgctgtttaa

SEQ ID NO: 5306771 - DNA, 15 bp, Homo sapiens
tatagtggaaaaaca

SEQ ID NO: 5306772 - DNA, 20 bp, Homo sapiens
tatagtggatgatatacaca

SEQ ID NO: 5306773 - DNA, 13 bp, Homo sapiens
tatagtgtaaaat

SEQ ID NO: 5306774 - DNA, 15 bp, Homo sapiens
tatagtgtccaggct

SEQ ID NO: 5306775 - DNA, 19 bp, Homo sapiens
tatagtgttcacaaactgt

SEQ ID NO: 5306776 - DNA, 14 bp, Homo sapiens
tatagtgtttaact

SEQ ID NO: 5306777 - DNA, 18 bp, Homo sapiens
tatagtgtttaactggca

SEQ ID NO: 5306778 - DNA, 14 bp, Homo sapiens
tatagttaaactga

SEQ ID NO: 5306779 - DNA, 23 bp, Homo sapiens
tatagttaaactgagagtaattc

SEQ ID NO: 5306780 - DNA, 13 bp, Homo sapiens
tatagttaacaca

SEQ ID NO: 5306781 - DNA, 15 bp, Homo sapiens
tatagttaacacact

SEQ ID NO: 5306782 - DNA, 20 bp, Homo sapiens
tatagttaatattttgttct

SEQ ID NO: 5306783 - DNA, 15 bp, Homo sapiens
tatagttactgtgta

SEQ ID NO: 5306784 - DNA, 18 bp, Homo sapiens
tatagttactgtgtaatt

SEQ ID NO: 5306785 - DNA, 17 bp, Homo sapiens
tatagttaggatagcat

SEQ ID NO: 5306786 - DNA, 20 bp, Homo sapiens
tatagttatacatcttcatt

SEQ ID NO: 5306787 - DNA, 20 bp, Homo sapiens
tatagttatgtaaataattc

SEQ ID NO: 5306788 - DNA, 22 bp, Homo sapiens
tatagttatgtaaataattctt

SEQ ID NO: 5306789 - DNA, 14 bp, Homo sapiens
tatagttattaaat

SEQ ID NO: 5306790 - DNA, 16 bp, Homo sapiens
tatagttattaaatgt

SEQ ID NO: 5306791 - DNA, 17 bp, Homo sapiens
tatagttattaaatgtt

SEQ ID NO: 5306792 - DNA, 22 bp, Homo sapiens
tatagttattaaatgtttcaaa

SEQ ID NO: 5306793 - DNA, 21 bp, Homo sapiens
tatagttcatgtctgctatca

SEQ ID NO: 5306794 - DNA, 23 bp, Homo sapiens
tatagttcctaagaagcttctaa

SEQ ID NO: 5306795 - DNA, 23 bp, Homo sapiens
tatagttccttgccttaataaat

SEQ ID NO: 5306796 - DNA, 15 bp, Homo sapiens
tatattctaaagagc

SEQ ID NO: 5306797 - DNA, 12 bp, Homo sapiens
tatattctaatt

SEQ ID NO: 5306798 - DNA, 17 bp, Homo sapiens
tatattctattttacaa

SEQ ID NO: 5306799 - DNA, 19 bp, Homo sapiens
tatattctcagcagagtgc

SEQ ID NO: 5306800 - DNA, 17 bp, Homo sapiens
tatattctctaataaaa

SEQ ID NO: 5306801 - DNA, 18 bp, Homo sapiens
tatattctctaataaaat

SEQ ID NO: 5306802 - DNA, 19 bp, Homo sapiens
tatattctctaataaaatt

SEQ ID NO: 5306803 - DNA, 17 bp, Homo sapiens
tatattctgaaaggaaa

SEQ ID NO: 5306804 - DNA, 17 bp, Homo sapiens
tatattctgtggaaaaa

SEQ ID NO: 5306805 - DNA, 19 bp, Homo sapiens
tatattctgtttattatga

SEQ ID NO: 5306806 - DNA, 13 bp, Homo sapiens
tatattctttaaa

SEQ ID NO: 5306807 - DNA, 24 bp, Homo sapiens
tatattctttccatgcagttatta

SEQ ID NO: 5306808 - DNA, 23 bp, Homo sapiens
tatattgaaagttgcttttattg

SEQ ID NO: 5306809 - DNA, 18 bp, Homo sapiens
tatattgaaatttattta

SEQ ID NO: 5306810 - DNA, 12 bp, Homo sapiens
tatattgaactt

SEQ ID NO: 5306811 - DNA, 22 bp, Homo sapiens
tatattgaacttttgtactgaa

SEQ ID NO: 5306812 - DNA, 19 bp, Homo sapiens
tatattgaagtaagttcat

SEQ ID NO: 5306813 - DNA, 22 bp, Homo sapiens
tatattgaataaaaaatagaca

SEQ ID NO: 5306814 - DNA, 19 bp, Homo sapiens
tatattgaatatatcagaa

SEQ ID NO: 5306815 - DNA, 23 bp, Homo sapiens
tatattgataacagcactgacta

SEQ ID NO: 5306816 - DNA, 13 bp, Homo sapiens
tatattgatttaa

SEQ ID NO: 5306817 - DNA, 16 bp, Homo sapiens
tatattgcaaaaacat

SEQ ID NO: 5306818 - DNA, 15 bp, Homo sapiens
tatattgcatttctg

SEQ ID NO: 5306819 - DNA, 17 bp, Homo sapiens
tatattgcatttctgta

SEQ ID NO: 5306820 - DNA, 16 bp, Homo sapiens
tatattgccaaatatt

SEQ ID NO: 5306821 - DNA, 21 bp, Homo sapiens
tatattgccaaatattaagaa

SEQ ID NO: 5306822 - DNA, 18 bp, Homo sapiens
tatattgccagtatataa

SEQ ID NO: 5306823 - DNA, 20 bp, Homo sapiens
tatattgcccaggctggtct

SEQ ID NO: 5306824 - DNA, 16 bp, Homo sapiens
tatattgctgcatttt

SEQ ID NO: 5306825 - DNA, 14 bp, Homo sapiens
tatattgcttcctg

SEQ ID NO: 5306826 - DNA, 17 bp, Homo sapiens
tatattgggctcagaga

SEQ ID NO: 5306827 - DNA, 18 bp, Homo sapiens
tatattggtaacatcctt

SEQ ID NO: 5306828 - DNA, 22 bp, Homo sapiens
tatattggtttgcacaagttcc

SEQ ID NO: 5306829 - DNA, 15 bp, Homo sapiens
tatattgtaaagaag

SEQ ID NO: 5306830 - DNA, 19 bp, Homo sapiens
tatattgtaagaaatactg

SEQ ID NO: 5306831 - DNA, 22 bp, Homo sapiens
tatattgtaagaaatactgtac

SEQ ID NO: 5306832 - DNA, 14 bp, Homo sapiens
tatattgtaattta

SEQ ID NO: 5306833 - DNA, 13 bp, Homo sapiens
tatattgtacaaa

SEQ ID NO: 5306834 - DNA, 13 bp, Homo sapiens
tatattgtggaat

SEQ ID NO: 5306835 - DNA, 17 bp, Homo sapiens
tatattgtggaataaat

SEQ ID NO: 5306836 - DNA, 18 bp, Homo sapiens
tatattgtgtaaatatta

SEQ ID NO: 5306837 - DNA, 21 bp, Homo sapiens
tatattgtgttttaacaccaa

SEQ ID NO: 5306838 - DNA, 15 bp, Homo sapiens
tatattgttgaagag

SEQ ID NO: 5306839 - DNA, 23 bp, Homo sapiens
tatattgttgttactttttcttg

SEQ ID NO: 5306840 - DNA, 13 bp, Homo sapiens
tatattgttttat

SEQ ID NO: 5306841 - DNA, 17 bp, Homo sapiens
tatattgttttataaat

SEQ ID NO: 5306842 - DNA, 19 bp, Homo sapiens
tatattgttttataaatgg

SEQ ID NO: 5306843 - DNA, 20 bp, Homo sapiens
tatattgtttttatatatta

SEQ ID NO: 5306844 - DNA, 16 bp, Homo sapiens
tatattgtttttgtat

SEQ ID NO: 5306845 - DNA, 18 bp, Homo sapiens
tatatttaaaaaattatg

SEQ ID NO: 5306846 - DNA, 22 bp, Homo sapiens
tatatttaaaaaattatggaat

SEQ ID NO: 5306847 - DNA, 13 bp, Homo sapiens
tatatttaaactc

SEQ ID NO: 5306848 - DNA, 14 bp, Homo sapiens
tatatttaaactca

SEQ ID NO: 5306849 - DNA, 19 bp, Homo sapiens
tatatttaaagggaaattg

SEQ ID NO: 5306850 - DNA, 13 bp, Homo sapiens
tatatttaaatta

SEQ ID NO: 5306851 - DNA, 14 bp, Homo sapiens
tatatttaacaatg

SEQ ID NO: 5306852 - DNA, 19 bp, Homo sapiens
tatatttaactctctttat

SEQ ID NO: 5306853 - DNA, 13 bp, Homo sapiens
tatatttaacttt

SEQ ID NO: 5306854 - DNA, 13 bp, Homo sapiens
tatatttaagcct

SEQ ID NO: 5306855 - DNA, 14 bp, Homo sapiens
tatatttaattgtg

SEQ ID NO: 5306856 - DNA, 11 bp, Homo sapiens
tatatttacaa

SEQ ID NO: 5306857 - DNA, 18 bp, Homo sapiens
tatatttacaacacttta

SEQ ID NO: 5306858 - DNA, 24 bp, Homo sapiens
tatatttacagtgaaaatgtaagc

SEQ ID NO: 5306859 - DNA, 18 bp, Homo sapiens
tatatttactaaaagaat

SEQ ID NO: 5306860 - DNA, 19 bp, Homo sapiens
tatatttactaaaatggac

SEQ ID NO: 5306861 - DNA, 20 bp, Homo sapiens
tatatttactaaaatggact

SEQ ID NO: 5306862 - DNA, 19 bp, Homo sapiens
tatatttaggatttgtgtt

SEQ ID NO: 5306863 - DNA, 16 bp, Homo sapiens
tatatttagttatagt

SEQ ID NO: 5306864 - DNA, 14 bp, Homo sapiens
tatatttataactc

SEQ ID NO: 5306865 - DNA, 15 bp, Homo sapiens
tatatttataactca

SEQ ID NO: 5306866 - DNA, 21 bp, Homo sapiens
tatatttataactcatcataa

SEQ ID NO: 5306867 - DNA, 22 bp, Homo sapiens
tatatttataactcatcataaa

SEQ ID NO: 5306868 - DNA, 24 bp, Homo sapiens
tatatttataactcatcataaaat

SEQ ID NO: 5306869 - DNA, 16 bp, Homo sapiens
tatatttatactgtat

SEQ ID NO: 5306870 - DNA, 19 bp, Homo sapiens
tatatttatgaatgtgcat

SEQ ID NO: 5306871 - DNA, 15 bp, Homo sapiens
tatatttattactgt

SEQ ID NO: 5306872 - DNA, 20 bp, Homo sapiens
tatatttattactgtaagaa

SEQ ID NO: 5306873 - DNA, 23 bp, Homo sapiens
tatatttattactgtaagaaaat

SEQ ID NO: 5306874 - DNA, 15 bp, Homo sapiens
tatatttattatttt

SEQ ID NO: 5306875 - DNA, 18 bp, Homo sapiens
tatatttattattttcat

SEQ ID NO: 5306876 - DNA, 12 bp, Homo sapiens
tatatttattca

SEQ ID NO: 5306877 - DNA, 13 bp, Homo sapiens
tatatttattgac

SEQ ID NO: 5306878 - DNA, 13 bp, Homo sapiens
tatatttattgtt

SEQ ID NO: 5306879 - DNA, 12 bp, Homo sapiens
tatatttattta

SEQ ID NO: 5306880 - DNA, 16 bp, Homo sapiens
tatatttatttaaagc

SEQ ID NO: 5306881 - DNA, 22 bp, Homo sapiens
tatatttatttaaagcattgct

SEQ ID NO: 5306882 - DNA, 15 bp, Homo sapiens
tatatttcaataaat

SEQ ID NO: 5306883 - DNA, 23 bp, Homo sapiens
tatatttcacaggctgtaaattg

SEQ ID NO: 5306884 - DNA, 16 bp, Homo sapiens
tatatttcactatttt

SEQ ID NO: 5306885 - DNA, 12 bp, Homo sapiens
tatatttcagac

SEQ ID NO: 5306886 - DNA, 12 bp, Homo sapiens
tatatttcagtg

SEQ ID NO: 5306887 - DNA, 23 bp, Homo sapiens
tatatttccaaatattctaaaaa

SEQ ID NO: 5306888 - DNA, 16 bp, Homo sapiens
tatatttccacttctt

SEQ ID NO: 5306889 - DNA, 16 bp, Homo sapiens
tatatttccattcaga

SEQ ID NO: 5306890 - DNA, 20 bp, Homo sapiens
tatatttccctaaaatacat

SEQ ID NO: 5306891 - DNA, 18 bp, Homo sapiens
tatatttcctataccatt

SEQ ID NO: 5306892 - DNA, 21 bp, Homo sapiens
tatatttcctataccatttcc

SEQ ID NO: 5306893 - DNA, 22 bp, Homo sapiens
tatatttcctataccatttccg

SEQ ID NO: 5306894 - DNA, 12 bp, Homo sapiens
tatatttcctgt

SEQ ID NO: 5306895 - DNA, 18 bp, Homo sapiens
tatatttcctgtattgct

SEQ ID NO: 5306896 - DNA, 13 bp, Homo sapiens
tatatttccttta

SEQ ID NO: 5306897 - DNA, 16 bp, Homo sapiens
tatatttcctttatgt

SEQ ID NO: 5306898 - DNA, 17 bp, Homo sapiens
tatatttcctttatgtg

SEQ ID NO: 5306899 - DNA, 20 bp, Homo sapiens
tatatttccttttgtaaagt

SEQ ID NO: 5306900 - DNA, 22 bp, Homo sapiens
tatatttccttttgtaaagtaa

SEQ ID NO: 5306901 - DNA, 16 bp, Homo sapiens
tatatttctacagaga

SEQ ID NO: 5306902 - DNA, 22 bp, Homo sapiens
tatatttctacagagaaaatga

SEQ ID NO: 5306903 - DNA, 23 bp, Homo sapiens
tatatttctattttattatgaag

SEQ ID NO: 5306904 - DNA, 13 bp, Homo sapiens
tatatttctcata

SEQ ID NO: 5306905 - DNA, 19 bp, Homo sapiens
tatatttcttcttctaaga

SEQ ID NO: 5306906 - DNA, 14 bp, Homo sapiens
tatatttctttgtt

SEQ ID NO: 5306907 - DNA, 16 bp, Homo sapiens
tatatttgaaactgct

SEQ ID NO: 5306908 - DNA, 16 bp, Homo sapiens
tatatttgaaatagta

SEQ ID NO: 5306909 - DNA, 21 bp, Homo sapiens
tatatttgaaatagtatacat

SEQ ID NO: 5306910 - DNA, 22 bp, Homo sapiens
tatatttgaaatagtatacatt

SEQ ID NO: 5306911 - DNA, 14 bp, Homo sapiens
tatatttgaaatat

SEQ ID NO: 5306912 - DNA, 20 bp, Homo sapiens
tatatttgaaatattgactt

SEQ ID NO: 5306913 - DNA, 12 bp, Homo sapiens
tatatttgacat

SEQ ID NO: 5306914 - DNA, 13 bp, Homo sapiens
tatatttgagttg

SEQ ID NO: 5306915 - DNA, 14 bp, Homo sapiens
tatatttgagttgt

SEQ ID NO: 5306916 - DNA, 21 bp, Homo sapiens
tatatttgattatgtatggat

SEQ ID NO: 5306917 - DNA, 20 bp, Homo sapiens
tatatttgcattatgtattt

SEQ ID NO: 5306918 - DNA, 13 bp, Homo sapiens
tatatttgctgca

SEQ ID NO: 5306919 - DNA, 14 bp, Homo sapiens
tatatttgctgcaa

SEQ ID NO: 5306920 - DNA, 21 bp, Homo sapiens
tatatttgctgcaaagagaaa

SEQ ID NO: 5306921 - DNA, 18 bp, Homo sapiens
tatatttggaaagagacc

SEQ ID NO: 5306922 - DNA, 16 bp, Homo sapiens
tatatttggcttatat

SEQ ID NO: 5306923 - DNA, 22 bp, Homo sapiens
tatatttggtttctagatcact

SEQ ID NO: 5306924 - DNA, 12 bp, Homo sapiens
tatatttgtaaa

SEQ ID NO: 5306925 - DNA, 15 bp, Homo sapiens
tatatttgtaaaagc

SEQ ID NO: 5306926 - DNA, 17 bp, Homo sapiens
tatatttgtaaagctat

SEQ ID NO: 5306927 - DNA, 14 bp, Homo sapiens
tatatttgtaacat

SEQ ID NO: 5306928 - DNA, 18 bp, Homo sapiens
tatatttgtaacattgta

SEQ ID NO: 5306929 - DNA, 12 bp, Homo sapiens
tatatttgtaca

SEQ ID NO: 5306930 - DNA, 23 bp, Homo sapiens
tatatttgtaggtatactatgta

SEQ ID NO: 5306931 - DNA, 13 bp, Homo sapiens
tatatttgtatcg

SEQ ID NO: 5306932 - DNA, 14 bp, Homo sapiens
tatatttgtcatga

SEQ ID NO: 5306933 - DNA, 13 bp, Homo sapiens
tatatttgtctca

SEQ ID NO: 5306934 - DNA, 18 bp, Homo sapiens
tatatttgtgtatgtgta

SEQ ID NO: 5306935 - DNA, 16 bp, Homo sapiens
tatatttgtgtattta

SEQ ID NO: 5306936 - DNA, 20 bp, Homo sapiens
tatatttgtttatgaaatgt

SEQ ID NO: 5306937 - DNA, 15 bp, Homo sapiens
tatatttgtttcaaa

SEQ ID NO: 5306938 - DNA, 13 bp, Homo sapiens
tatattttaaaaa

SEQ ID NO: 5306939 - DNA, 13 bp, Homo sapiens
tatattttaagaa

SEQ ID NO: 5306940 - DNA, 21 bp, Homo sapiens
tatattttaagccttcatttg

SEQ ID NO: 5306941 - DNA, 16 bp, Homo sapiens
tatattttaatagaat

SEQ ID NO: 5306942 - DNA, 13 bp, Homo sapiens
tatattttatata

SEQ ID NO: 5306943 - DNA, 18 bp, Homo sapiens
tatattttatataaagta

SEQ ID NO: 5306944 - DNA, 15 bp, Homo sapiens
tatattttatatgtt

SEQ ID NO: 5306945 - DNA, 13 bp, Homo sapiens
tatattttatctt

SEQ ID NO: 5306946 - DNA, 13 bp, Homo sapiens
tatattttatgaa

SEQ ID NO: 5306947 - DNA, 14 bp, Homo sapiens
tatattttatgaac

SEQ ID NO: 5306948 - DNA, 17 bp, Homo sapiens
tatattttatgaacatt

SEQ ID NO: 5306949 - DNA, 21 bp, Homo sapiens
tatattttatgaacattgtac

SEQ ID NO: 5306950 - DNA, 22 bp, Homo sapiens
tatattttatgaacattgtact

SEQ ID NO: 5306951 - DNA, 23 bp, Homo sapiens
tatattttatgaacattgtactg

SEQ ID NO: 5306952 - DNA, 17 bp, Homo sapiens
tatattttatttcaatg

SEQ ID NO: 5306953 - DNA, 15 bp, Homo sapiens
tatattttatttctg

SEQ ID NO: 5306954 - DNA, 18 bp, Homo sapiens
tatattttatttttagaa

SEQ ID NO: 5306955 - DNA, 18 bp, Homo sapiens
tatattttcaattcaaaa

SEQ ID NO: 5306956 - DNA, 14 bp, Homo sapiens
tatattttcagagc

SEQ ID NO: 5306957 - DNA, 20 bp, Homo sapiens
tatattttcccttattactg

SEQ ID NO: 5306958 - DNA, 18 bp, Homo sapiens
tatattttcgtatgaaaa

SEQ ID NO: 5306959 - DNA, 14 bp, Homo sapiens
tatattttctattt

SEQ ID NO: 5306960 - DNA, 15 bp, Homo sapiens
tatattttctgtatt

SEQ ID NO: 5306961 - DNA, 14 bp, Homo sapiens
tatattttctgttt

SEQ ID NO: 5306962 - DNA, 15 bp, Homo sapiens
tatattttctttctc

SEQ ID NO: 5306963 - DNA, 15 bp, Homo sapiens
tatattttgaaagga

SEQ ID NO: 5306964 - DNA, 11 bp, Homo sapiens
tatattttgac

SEQ ID NO: 5306965 - DNA, 14 bp, Homo sapiens
tatattttgcctgt

SEQ ID NO: 5306966 - DNA, 23 bp, Homo sapiens
tatattttgctgtttatgatcta

SEQ ID NO: 5306967 - DNA, 13 bp, Homo sapiens
tatattttgggaa

SEQ ID NO: 5306968 - DNA, 18 bp, Homo sapiens
tatattttgtactttgtg

SEQ ID NO: 5306969 - DNA, 14 bp, Homo sapiens
tatattttgtcata

SEQ ID NO: 5306970 - DNA, 21 bp, Homo sapiens
tatattttgtgggcttaattg

SEQ ID NO: 5306971 - DNA, 22 bp, Homo sapiens
tatattttgtgtataatgtgct

SEQ ID NO: 5306972 - DNA, 18 bp, Homo sapiens
tatattttgtgtgaaatt

SEQ ID NO: 5306973 - DNA, 21 bp, Homo sapiens
tatattttgtgttattcgtga

SEQ ID NO: 5306974 - DNA, 15 bp, Homo sapiens
tatattttgttacct

SEQ ID NO: 5306975 - DNA, 19 bp, Homo sapiens
tatcctgctagctgtagaa

SEQ ID NO: 5306976 - DNA, 13 bp, Homo sapiens
tatcctgctgaaa

SEQ ID NO: 5306977 - DNA, 21 bp, Homo sapiens
tatcctgctgaaagtcctgct

SEQ ID NO: 5306978 - DNA, 22 bp, Homo sapiens
tatcctgctgaaagtcctgctt

SEQ ID NO: 5306979 - DNA, 22 bp, Homo sapiens
tatcctgcttctgatatgcagt

SEQ ID NO: 5306980 - DNA, 19 bp, Homo sapiens
tatcctggagacttaatag

SEQ ID NO: 5306981 - DNA, 14 bp, Homo sapiens
tatcctggccctgg

SEQ ID NO: 5306982 - DNA, 19 bp, Homo sapiens
tatcctggctttgcccaac

SEQ ID NO: 5306983 - DNA, 13 bp, Homo sapiens
tatcctgggacct

SEQ ID NO: 5306984 - DNA, 18 bp, Homo sapiens
tatcctgggcttttgttt

SEQ ID NO: 5306985 - DNA, 23 bp, Homo sapiens
tatcctgggcttttgttttgctt

SEQ ID NO: 5306986 - DNA, 22 bp, Homo sapiens
tatcctggggctcccttcatct

SEQ ID NO: 5306987 - DNA, 12 bp, Homo sapiens
tatcctggggga

SEQ ID NO: 5306988 - DNA, 16 bp, Homo sapiens
tatcctgggggaagag

SEQ ID NO: 5306989 - DNA, 14 bp, Homo sapiens
tatcctggtctttt

SEQ ID NO: 5306990 - DNA, 18 bp, Homo sapiens
tatcctggtgtctagttt

SEQ ID NO: 5306991 - DNA, 13 bp, Homo sapiens
tatcctgtgactg

SEQ ID NO: 5306992 - DNA, 14 bp, Homo sapiens
tatcctgtgactgt

SEQ ID NO: 5306993 - DNA, 12 bp, Homo sapiens
tatcctgtgcat

SEQ ID NO: 5306994 - DNA, 18 bp, Homo sapiens
tatcctgtgctacagaga

SEQ ID NO: 5306995 - DNA, 17 bp, Homo sapiens
tatcctgtgtgtgtcta

SEQ ID NO: 5306996 - DNA, 15 bp, Homo sapiens
tatcctgttactgaa

SEQ ID NO: 5306997 - DNA, 13 bp, Homo sapiens
tatcctgtttgaa

SEQ ID NO: 5306998 - DNA, 19 bp, Homo sapiens
tatccttaaccattctgtc

SEQ ID NO: 5306999 - DNA, 18 bp, Homo sapiens
tatccttacaatgtgaat

SEQ ID NO: 5307000 - DNA, 19 bp, Homo sapiens
tatccttaggaaaatgctt

SEQ ID NO: 5307001 - DNA, 21 bp, Homo sapiens
tatccttaggaaaatgcttct

SEQ ID NO: 5307002 - DNA, 20 bp, Homo sapiens
tatccttataggcctgtccc

SEQ ID NO: 5307003 - DNA, 21 bp, Homo sapiens
tatccttataggcctgtccct

SEQ ID NO: 5307004 - DNA, 14 bp, Homo sapiens
tatccttcacaatt

SEQ ID NO: 5307005 - DNA, 14 bp, Homo sapiens
tatccttcagcctg

SEQ ID NO: 5307006 - DNA, 15 bp, Homo sapiens
tatccttcagcctga

SEQ ID NO: 5307007 - DNA, 18 bp, Homo sapiens
tatccttgcacctcagcc

SEQ ID NO: 5307008 - DNA, 18 bp, Homo sapiens
tatccttggagagcagct

SEQ ID NO: 5307009 - DNA, 20 bp, Homo sapiens
tatccttggagagcagctgg

SEQ ID NO: 5307010 - DNA, 19 bp, Homo sapiens
tatccttgggggctcccag

SEQ ID NO: 5307011 - DNA, 22 bp, Homo sapiens
tatcctttattttaaatgatct

SEQ ID NO: 5307012 - DNA, 22 bp, Homo sapiens
tatcctttattttattgaaatg

SEQ ID NO: 5307013 - DNA, 16 bp, Homo sapiens
tatcctttgccccaag

SEQ ID NO: 5307014 - DNA, 21 bp, Homo sapiens
tatcctttgtgagcctatgat

SEQ ID NO: 5307015 - DNA, 16 bp, Homo sapiens
tatccttttctgtgtt

SEQ ID NO: 5307016 - DNA, 14 bp, Homo sapiens
tatcgaaataacaa

SEQ ID NO: 5307017 - DNA, 18 bp, Homo sapiens
tatcgaaataacaatgtt

SEQ ID NO: 5307018 - DNA, 21 bp, Homo sapiens
tatcgaaataacaatgttaag

SEQ ID NO: 5307019 - DNA, 17 bp, Homo sapiens
tatcgaatatagttctg

SEQ ID NO: 5307020 - DNA, 14 bp, Homo sapiens
tatcgatataaatt

SEQ ID NO: 5307021 - DNA, 15 bp, Homo sapiens
tatcgatataaattg

SEQ ID NO: 5307022 - DNA, 16 bp, Homo sapiens
tatcgatctggaaaga

SEQ ID NO: 5307023 - DNA, 14 bp, Homo sapiens
tatcgcaacatgaa

SEQ ID NO: 5307024 - DNA, 20 bp, Homo sapiens
tatcgcattgctgtccttgg

SEQ ID NO: 5307025 - DNA, 14 bp, Homo sapiens
tatcgccctccttt

SEQ ID NO: 5307026 - DNA, 19 bp, Homo sapiens
tatcgccctggcaggcagg

SEQ ID NO: 5307027 - DNA, 17 bp, Homo sapiens
tatcgccttttgacagc

SEQ ID NO: 5307028 - DNA, 16 bp, Homo sapiens
tatcgctaaatgactt

SEQ ID NO: 5307029 - DNA, 19 bp, Homo sapiens
tatcgctgatgcagacaca

SEQ ID NO: 5307030 - DNA, 18 bp, Homo sapiens
tatcgcttcatgtaacta

SEQ ID NO: 5307031 - DNA, 17 bp, Homo sapiens
tatcggaagaacatgaa

SEQ ID NO: 5307032 - DNA, 23 bp, Homo sapiens
tatcggacattctaatgcatatt

SEQ ID NO: 5307033 - DNA, 16 bp, Homo sapiens
tatcggagacagtgat

SEQ ID NO: 5307034 - DNA, 19 bp, Homo sapiens
tatcggaggtggtggagga

SEQ ID NO: 5307035 - DNA, 17 bp, Homo sapiens
tatcggcactgtacaaa

SEQ ID NO: 5307036 - DNA, 19 bp, Homo sapiens
tatcggctctattctctaa

SEQ ID NO: 5307037 - DNA, 16 bp, Homo sapiens
tatcgggaacagtgtt

SEQ ID NO: 5307038 - DNA, 14 bp, Homo sapiens
tatcgggagcagtg

SEQ ID NO: 5307039 - DNA, 12 bp, Homo sapiens
tatcgggggctg

SEQ ID NO: 5307040 - DNA, 16 bp, Homo sapiens
tatcgggggctggggc

SEQ ID NO: 5307041 - DNA, 15 bp, Homo sapiens
tatcgtaaaattaag

SEQ ID NO: 5307042 - DNA, 18 bp, Homo sapiens
tatcgtaaaattaagaaa

SEQ ID NO: 5307043 - DNA, 18 bp, Homo sapiens
tatcgtattcaccttcag

SEQ ID NO: 5307044 - DNA, 15 bp, Homo sapiens
tatcgttatcactgt

SEQ ID NO: 5307045 - DNA, 18 bp, Homo sapiens
tatcgttatcactgtgca

SEQ ID NO: 5307046 - DNA, 17 bp, Homo sapiens
tatcgttattataaatg

SEQ ID NO: 5307047 - DNA, 15 bp, Homo sapiens
tatctaaaaaataac

SEQ ID NO: 5307048 - DNA, 16 bp, Homo sapiens
tatctaaaaaataact

SEQ ID NO: 5307049 - DNA, 18 bp, Homo sapiens
tatctaaaaaataactgt

SEQ ID NO: 5307050 - DNA, 19 bp, Homo sapiens
tatctaaaaaataactgtg

SEQ ID NO: 5307051 - DNA, 21 bp, Homo sapiens
tatctaaaaatagttaacaca

SEQ ID NO: 5307052 - DNA, 14 bp, Homo sapiens
tatctaaaagaaat

SEQ ID NO: 5307053 - DNA, 22 bp, Homo sapiens
tatctaaaagaatttaaattct

SEQ ID NO: 5307054 - DNA, 23 bp, Homo sapiens
tatctaaactggattcacagctc

SEQ ID NO: 5307055 - DNA, 22 bp, Homo sapiens
tatctaaaggatggaaaaataa

SEQ ID NO: 5307056 - DNA, 12 bp, Homo sapiens
tatctaaagtca

SEQ ID NO: 5307057 - DNA, 12 bp, Homo sapiens
tatctaaagtta

SEQ ID NO: 5307058 - DNA, 14 bp, Homo sapiens
tatctaaagttata

SEQ ID NO: 5307059 - DNA, 19 bp, Homo sapiens
tatctaaagttatatttca

SEQ ID NO: 5307060 - DNA, 13 bp, Homo sapiens
tatctaaataatg

SEQ ID NO: 5307061 - DNA, 15 bp, Homo sapiens
tatctaaataatggc

SEQ ID NO: 5307062 - DNA, 15 bp, Homo sapiens
tatctaaatgttgaa

SEQ ID NO: 5307063 - DNA, 16 bp, Homo sapiens
tatctaaatgttgaaa

SEQ ID NO: 5307064 - DNA, 16 bp, Homo sapiens
tatctaaattgaataa

SEQ ID NO: 5307065 - DNA, 21 bp, Homo sapiens
tatctaaattgaataatggta

SEQ ID NO: 5307066 - DNA, 19 bp, Homo sapiens
tatctaaatttggaactta

SEQ ID NO: 5307067 - DNA, 15 bp, Homo sapiens
tatctaacacttttg

SEQ ID NO: 5307068 - DNA, 15 bp, Homo sapiens
tatctaaccagtgat

SEQ ID NO: 5307069 - DNA, 19 bp, Homo sapiens
tatctaaccagtgattcga

SEQ ID NO: 5307070 - DNA, 14 bp, Homo sapiens
tatctaactcttct

SEQ ID NO: 5307071 - DNA, 19 bp, Homo sapiens
tatctaacttcgaatatat

SEQ ID NO: 5307072 - DNA, 13 bp, Homo sapiens
tatctaactttgt

SEQ ID NO: 5307073 - DNA, 19 bp, Homo sapiens
tatctaagaatacagcttt

SEQ ID NO: 5307074 - DNA, 20 bp, Homo sapiens
tatctaagaatacagctttc

SEQ ID NO: 5307075 - DNA, 20 bp, Homo sapiens
tatctaatacctctgtgtgc

SEQ ID NO: 5307076 - DNA, 18 bp, Homo sapiens
tatctaatatatatgaat

SEQ ID NO: 5307077 - DNA, 21 bp, Homo sapiens
tatctaatatgtaacaagcca

SEQ ID NO: 5307078 - DNA, 13 bp, Homo sapiens
tatctaatgacat

SEQ ID NO: 5307079 - DNA, 21 bp, Homo sapiens
tatctaatgagttgctggaaa

SEQ ID NO: 5307080 - DNA, 14 bp, Homo sapiens
tatctaatttacca

SEQ ID NO: 5307081 - DNA, 18 bp, Homo sapiens
tatctaatttatacaaaa

SEQ ID NO: 5307082 - DNA, 21 bp, Homo sapiens
tatctaatttatacaaaataa

SEQ ID NO: 5307083 - DNA, 15 bp, Homo sapiens
tatctaatttggatt

SEQ ID NO: 5307084 - DNA, 13 bp, Homo sapiens
tatctaattttta

SEQ ID NO: 5307085 - DNA, 12 bp, Homo sapiens
tatctacaaaga

SEQ ID NO: 5307086 - DNA, 17 bp, Homo sapiens
tatctacagtaatgaaa

SEQ ID NO: 5307087 - DNA, 21 bp, Homo sapiens
tatctacatcttttttcacaa

SEQ ID NO: 5307088 - DNA, 18 bp, Homo sapiens
tatctacattaaaatgac

SEQ ID NO: 5307089 - DNA, 20 bp, Homo sapiens
tatctacattataccgcaga

SEQ ID NO: 5307090 - DNA, 17 bp, Homo sapiens
tatctaccaactttcaa

SEQ ID NO: 5307091 - DNA, 18 bp, Homo sapiens
tatctaccaactttcaag

SEQ ID NO: 5307092 - DNA, 17 bp, Homo sapiens
tatctaccattgaagga

SEQ ID NO: 5307093 - DNA, 22 bp, Homo sapiens
tatctacccaagggcagaaagt

SEQ ID NO: 5307094 - DNA, 16 bp, Homo sapiens
tatctacctcaaggta

SEQ ID NO: 5307095 - DNA, 21 bp, Homo sapiens
tatctacctgccctctctcag

SEQ ID NO: 5307096 - DNA, 15 bp, Homo sapiens
tatctacctggaaac

SEQ ID NO: 5307097 - DNA, 21 bp, Homo sapiens
tatctacctggaaacagcttt

SEQ ID NO: 5307098 - DNA, 14 bp, Homo sapiens
tatctacctgttct

SEQ ID NO: 5307099 - DNA, 17 bp, Homo sapiens
tatctacctgttctgta

SEQ ID NO: 5307100 - DNA, 14 bp, Homo sapiens
tatctactaagttt

SEQ ID NO: 5307101 - DNA, 20 bp, Homo sapiens
tatctactaagtttcctttt

SEQ ID NO: 5307102 - DNA, 22 bp, Homo sapiens
tatctactaagtttccttttaa

SEQ ID NO: 5307103 - DNA, 14 bp, Homo sapiens
tatctactaccaga

SEQ ID NO: 5307104 - DNA, 15 bp, Homo sapiens
tatctactaccagaa

SEQ ID NO: 5307105 - DNA, 18 bp, Homo sapiens
tatctactagtaataatg

SEQ ID NO: 5307106 - DNA, 23 bp, Homo sapiens
tatctactatttgaaaaaagaag

SEQ ID NO: 5307107 - DNA, 21 bp, Homo sapiens
tatctactctcctcatctcta

SEQ ID NO: 5307108 - DNA, 20 bp, Homo sapiens
tatctactgataaagaaaga

SEQ ID NO: 5307109 - DNA, 17 bp, Homo sapiens
tatctacttccaaacta

SEQ ID NO: 5307110 - DNA, 13 bp, Homo sapiens
tatctacttgtgt

SEQ ID NO: 5307111 - DNA, 21 bp, Homo sapiens
tatctagaactatcattttta

SEQ ID NO: 5307112 - DNA, 15 bp, Homo sapiens
tatctagatactgta

SEQ ID NO: 5307113 - DNA, 14 bp, Homo sapiens
tatctagatttcta

SEQ ID NO: 5307114 - DNA, 15 bp, Homo sapiens
tatctagcaagaaga

SEQ ID NO: 5307115 - DNA, 17 bp, Homo sapiens
tatctagcagtaaaaga

SEQ ID NO: 5307116 - DNA, 17 bp, Homo sapiens
tatctaggcaacatagt

SEQ ID NO: 5307117 - DNA, 14 bp, Homo sapiens
tatctagtaatata

SEQ ID NO: 5307118 - DNA, 16 bp, Homo sapiens
tatctagtatgaaatt

SEQ ID NO: 5307119 - DNA, 23 bp, Homo sapiens
tatctagtgcagctgattttaac

SEQ ID NO: 5307120 - DNA, 22 bp, Homo sapiens
tatctagtgctaaacctatctg

SEQ ID NO: 5307121 - DNA, 12 bp, Homo sapiens
tatctataaaat

SEQ ID NO: 5307122 - DNA, 16 bp, Homo sapiens
tatctataaacactgt

SEQ ID NO: 5307123 - DNA, 14 bp, Homo sapiens
tatctataatttac

SEQ ID NO: 5307124 - DNA, 16 bp, Homo sapiens
tatctataatttacct

SEQ ID NO: 5307125 - DNA, 13 bp, Homo sapiens
tatctatataaaa

SEQ ID NO: 5307126 - DNA, 16 bp, Homo sapiens
tatctatatataattc

SEQ ID NO: 5307127 - DNA, 20 bp, Homo sapiens
tatctatatataattctgta

SEQ ID NO: 5307128 - DNA, 17 bp, Homo sapiens
tatctatatatgtgtat

SEQ ID NO: 5307129 - DNA, 13 bp, Homo sapiens
tatctatatcata

SEQ ID NO: 5307130 - DNA, 17 bp, Homo sapiens
tatctatatcatatttc

SEQ ID NO: 5307131 - DNA, 14 bp, Homo sapiens
tatctatatctcta

SEQ ID NO: 5307132 - DNA, 19 bp, Homo sapiens
tatctatatgtacttgtca

SEQ ID NO: 5307133 - DNA, 15 bp, Homo sapiens
tatctatatgtctat

SEQ ID NO: 5307134 - DNA, 14 bp, Homo sapiens
tatctatattctaa

SEQ ID NO: 5307135 - DNA, 19 bp, Homo sapiens
tatctatcggaagaacatg

SEQ ID NO: 5307136 - DNA, 23 bp, Homo sapiens
tatctatcttccaaatgcaattt

SEQ ID NO: 5307137 - DNA, 14 bp, Homo sapiens
tatctatgttttac

SEQ ID NO: 5307138 - DNA, 14 bp, Homo sapiens
tatctattaaccat

SEQ ID NO: 5307139 - DNA, 12 bp, Homo sapiens
tatctattagca

SEQ ID NO: 5307140 - DNA, 13 bp, Homo sapiens
tatctattagcag

SEQ ID NO: 5307141 - DNA, 20 bp, Homo sapiens
tatctattcttctgaccatc

SEQ ID NO: 5307142 - DNA, 13 bp, Homo sapiens
tatctattgtaag

SEQ ID NO: 5307143 - DNA, 18 bp, Homo sapiens
tatctattgtaagataaa

SEQ ID NO: 5307144 - DNA, 15 bp, Homo sapiens
tatctatttatctgt

SEQ ID NO: 5307145 - DNA, 21 bp, Homo sapiens
tatctatttatctgtctgagc

SEQ ID NO: 5307146 - DNA, 21 bp, Homo sapiens
tatctatttgaataaattatg

SEQ ID NO: 5307147 - DNA, 16 bp, Homo sapiens
tatctatttgagagca

SEQ ID NO: 5307148 - DNA, 18 bp, Homo sapiens
tatctatttgtacaattt

SEQ ID NO: 5307149 - DNA, 19 bp, Homo sapiens
tatctatttgtatatatac

SEQ ID NO: 5307150 - DNA, 20 bp, Homo sapiens
tatctatttttttttctttt

SEQ ID NO: 5307151 - DNA, 17 bp, Homo sapiens
tatctcaacaacatgtc

SEQ ID NO: 5307152 - DNA, 13 bp, Homo sapiens
tatctcaagatag

SEQ ID NO: 5307153 - DNA, 14 bp, Homo sapiens
tatctcaagtaaaa

SEQ ID NO: 5307154 - DNA, 16 bp, Homo sapiens
tatgaaccctttgttt

SEQ ID NO: 5307155 - DNA, 18 bp, Homo sapiens
tatgaaccctttgtttct

SEQ ID NO: 5307156 - DNA, 14 bp, Homo sapiens
tatgaacctatttt

SEQ ID NO: 5307157 - DNA, 17 bp, Homo sapiens
tatgaacctattttcat

SEQ ID NO: 5307158 - DNA, 22 bp, Homo sapiens
tatgaactagagactctgtgat

SEQ ID NO: 5307159 - DNA, 20 bp, Homo sapiens
tatgaactctttaagttgaa

SEQ ID NO: 5307160 - DNA, 23 bp, Homo sapiens
tatgaactgcatcaagacttcaa

SEQ ID NO: 5307161 - DNA, 19 bp, Homo sapiens
tatgaacttaacatgctgt

SEQ ID NO: 5307162 - DNA, 16 bp, Homo sapiens
tatgaacttgaggaca

SEQ ID NO: 5307163 - DNA, 19 bp, Homo sapiens
tatgaacttgaggacacat

SEQ ID NO: 5307164 - DNA, 13 bp, Homo sapiens
tatgaagaaaaaa

SEQ ID NO: 5307165 - DNA, 16 bp, Homo sapiens
tatgaagaaaaaatac

SEQ ID NO: 5307166 - DNA, 15 bp, Homo sapiens
tatgaagaagagagt

SEQ ID NO: 5307167 - DNA, 18 bp, Homo sapiens
tatgaagaattgccaatc

SEQ ID NO: 5307168 - DNA, 19 bp, Homo sapiens
tatgaagaattgccaatct

SEQ ID NO: 5307169 - DNA, 23 bp, Homo sapiens
tatgaagaattgccaatcttgtt

SEQ ID NO: 5307170 - DNA, 24 bp, Homo sapiens
tatgaagaattgccaatcttgttt

SEQ ID NO: 5307171 - DNA, 13 bp, Homo sapiens
tatgaagacactg

SEQ ID NO: 5307172 - DNA, 14 bp, Homo sapiens
tatgaagacataaa

SEQ ID NO: 5307173 - DNA, 21 bp, Homo sapiens
tatgaagacttaaaagagctc

SEQ ID NO: 5307174 - DNA, 15 bp, Homo sapiens
tatgaagagctgtct

SEQ ID NO: 5307175 - DNA, 17 bp, Homo sapiens
tatgaagagtattaatg

SEQ ID NO: 5307176 - DNA, 20 bp, Homo sapiens
tatgaagagtattaatgtaa

SEQ ID NO: 5307177 - DNA, 18 bp, Homo sapiens
tatgaagcaagctgtgtt

SEQ ID NO: 5307178 - DNA, 22 bp, Homo sapiens
tatgaagcaagctgtgttactt

SEQ ID NO: 5307179 - DNA, 21 bp, Homo sapiens
tatgaagcagatttatttttg

SEQ ID NO: 5307180 - DNA, 19 bp, Homo sapiens
tatgaagccaactgacaaa

SEQ ID NO: 5307181 - DNA, 13 bp, Homo sapiens
tatgaagcctttg

SEQ ID NO: 5307182 - DNA, 24 bp, Homo sapiens
tatgaagctcacctgttgcttaca

SEQ ID NO: 5307183 - DNA, 20 bp, Homo sapiens
tatgaagggacagctgctgg

SEQ ID NO: 5307184 - DNA, 23 bp, Homo sapiens
tatgaagggccttgagcatctgg

SEQ ID NO: 5307185 - DNA, 23 bp, Homo sapiens
tatgaagtaaagaactgcacatg

SEQ ID NO: 5307186 - DNA, 18 bp, Homo sapiens
tatgaagtaaagtttctg

SEQ ID NO: 5307187 - DNA, 13 bp, Homo sapiens
tatgaagtaagtt

SEQ ID NO: 5307188 - DNA, 16 bp, Homo sapiens
tatgaagtacttttaa

SEQ ID NO: 5307189 - DNA, 17 bp, Homo sapiens
tatgaagtataaatctg

SEQ ID NO: 5307190 - DNA, 17 bp, Homo sapiens
tatgaagttaacagtct

SEQ ID NO: 5307191 - DNA, 21 bp, Homo sapiens
tatgaagttactttcttaatg

SEQ ID NO: 5307192 - DNA, 19 bp, Homo sapiens
tatgaagttgaaaaataaa

SEQ ID NO: 5307193 - DNA, 16 bp, Homo sapiens
tatgaagtttttaaaa

SEQ ID NO: 5307194 - DNA, 21 bp, Homo sapiens
tatgaagtttttaaaaataaa

SEQ ID NO: 5307195 - DNA, 20 bp, Homo sapiens
tatgaagttttttttataca

SEQ ID NO: 5307196 - DNA, 14 bp, Homo sapiens
tatgaataaaattg

SEQ ID NO: 5307197 - DNA, 22 bp, Homo sapiens
tatgaataaaattgttatttca

SEQ ID NO: 5307198 - DNA, 18 bp, Homo sapiens
tatgaataattatgttta

SEQ ID NO: 5307199 - DNA, 19 bp, Homo sapiens
tatgaataattatgtttac

SEQ ID NO: 5307200 - DNA, 17 bp, Homo sapiens
tatgaatacagcagcaa

SEQ ID NO: 5307201 - DNA, 22 bp, Homo sapiens
tatgaataccaggatagcttta

SEQ ID NO: 5307202 - DNA, 15 bp, Homo sapiens
tatgaatactttgca

SEQ ID NO: 5307203 - DNA, 13 bp, Homo sapiens
tatgaatatcatt

SEQ ID NO: 5307204 - DNA, 12 bp, Homo sapiens
tatgaatatttc

SEQ ID NO: 5307205 - DNA, 23 bp, Homo sapiens
tatgaatcagtgggcaggataaa

SEQ ID NO: 5307206 - DNA, 17 bp, Homo sapiens
tatgaatcgcagacgca

SEQ ID NO: 5307207 - DNA, 20 bp, Homo sapiens
tatgaatctatttgtgggtg

SEQ ID NO: 5307208 - DNA, 14 bp, Homo sapiens
tatgaatgaacaaa

SEQ ID NO: 5307209 - DNA, 16 bp, Homo sapiens
tatgaatgagttttac

SEQ ID NO: 5307210 - DNA, 21 bp, Homo sapiens
tatgaatgagttttacaaatt

SEQ ID NO: 5307211 - DNA, 16 bp, Homo sapiens
tatgaatgatttgcat

SEQ ID NO: 5307212 - DNA, 23 bp, Homo sapiens
tatgaatgcagcactgctgcctc

SEQ ID NO: 5307213 - DNA, 19 bp, Homo sapiens
tatgaatgcccccagctgg

SEQ ID NO: 5307214 - DNA, 22 bp, Homo sapiens
tatgaatgctattttttccctt

SEQ ID NO: 5307215 - DNA, 19 bp, Homo sapiens
tatgaatggtctagaaaca

SEQ ID NO: 5307216 - DNA, 15 bp, Homo sapiens
tatgaatgtgaagcc

SEQ ID NO: 5307217 - DNA, 17 bp, Homo sapiens
tatgaatgtgaagcctt

SEQ ID NO: 5307218 - DNA, 14 bp, Homo sapiens
tatgaatgttcttg

SEQ ID NO: 5307219 - DNA, 17 bp, Homo sapiens
tatgaattacatttgta

SEQ ID NO: 5307220 - DNA, 18 bp, Homo sapiens
tatgaattagccaaaaga

SEQ ID NO: 5307221 - DNA, 19 bp, Homo sapiens
tatgaattattttgataaa

SEQ ID NO: 5307222 - DNA, 21 bp, Homo sapiens
tatgaattcaagaaaggaaat

SEQ ID NO: 5307223 - DNA, 15 bp, Homo sapiens
tatgaattgctgtct

SEQ ID NO: 5307224 - DNA, 13 bp, Homo sapiens
tatgaattgtcta

SEQ ID NO: 5307225 - DNA, 20 bp, Homo sapiens
tatgaatttaaatataattc

SEQ ID NO: 5307226 - DNA, 23 bp, Homo sapiens
tatgaatttaaatataattctgt

SEQ ID NO: 5307227 - DNA, 17 bp, Homo sapiens
tatgaattttgtaagta

SEQ ID NO: 5307228 - DNA, 20 bp, Homo sapiens
tatgaattttgtaagtataa

SEQ ID NO: 5307229 - DNA, 17 bp, Homo sapiens
tatgacaaattcaagag

SEQ ID NO: 5307230 - DNA, 18 bp, Homo sapiens
tatgacaatcctgaagaa

SEQ ID NO: 5307231 - DNA, 15 bp, Homo sapiens
tatgacaatttcaaa

SEQ ID NO: 5307232 - DNA, 16 bp, Homo sapiens
tatgacaatttttgct

SEQ ID NO: 5307233 - DNA, 20 bp, Homo sapiens
tatgacacaaaggtggaata

SEQ ID NO: 5307234 - DNA, 22 bp, Homo sapiens
tatgacactgttaatagtacta

SEQ ID NO: 5307235 - DNA, 17 bp, Homo sapiens
tatgacagataacctaa

SEQ ID NO: 5307236 - DNA, 21 bp, Homo sapiens
tatgacagataacctaataat

SEQ ID NO: 5307237 - DNA, 23 bp, Homo sapiens
tatgacagataacctaataattg

SEQ ID NO: 5307238 - DNA, 13 bp, Homo sapiens
tatgacagccatt

SEQ ID NO: 5307239 - DNA, 20 bp, Homo sapiens
tatgacagctgtccctgtca

SEQ ID NO: 5307240 - DNA, 18 bp, Homo sapiens
tatgacagtaattgtgtt

SEQ ID NO: 5307241 - DNA, 23 bp, Homo sapiens
tatgacagtaattgtgtttacat

SEQ ID NO: 5307242 - DNA, 21 bp, Homo sapiens
tatgacagtgaattttgcaca

SEQ ID NO: 5307243 - DNA, 21 bp, Homo sapiens
tatgacataagcaatcatttt

SEQ ID NO: 5307244 - DNA, 22 bp, Homo sapiens
tatgacataagcaatcatttta

SEQ ID NO: 5307245 - DNA, 20 bp, Homo sapiens
tatgacatcacttgtacaaa

SEQ ID NO: 5307246 - DNA, 13 bp, Homo sapiens
tatgacatctaag

SEQ ID NO: 5307247 - DNA, 21 bp, Homo sapiens
tatgacatgaaaagttattta

SEQ ID NO: 5307248 - DNA, 13 bp, Homo sapiens
tatgacatgccac

SEQ ID NO: 5307249 - DNA, 15 bp, Homo sapiens
tatgacatgccaccc

SEQ ID NO: 5307250 - DNA, 22 bp, Homo sapiens
tatgacatgccaccctctccat

SEQ ID NO: 5307251 - DNA, 21 bp, Homo sapiens
tatgacattggatagaacatg

SEQ ID NO: 5307252 - DNA, 13 bp, Homo sapiens
tatgacatttcta

SEQ ID NO: 5307253 - DNA, 23 bp, Homo sapiens
tatgacatttcttaaaactttat

SEQ ID NO: 5307254 - DNA, 22 bp, Homo sapiens
tatgaccaaaattttaagtagg

SEQ ID NO: 5307255 - DNA, 19 bp, Homo sapiens
tatgaccacagagttatat

SEQ ID NO: 5307256 - DNA, 18 bp, Homo sapiens
tatgaccagaagccttgg

SEQ ID NO: 5307257 - DNA, 17 bp, Homo sapiens
tatgaccattgaaaaag

SEQ ID NO: 5307258 - DNA, 23 bp, Homo sapiens
tatgacccacactgccagaagag

SEQ ID NO: 5307259 - DNA, 21 bp, Homo sapiens
tatgacccctggccacagcct

SEQ ID NO: 5307260 - DNA, 13 bp, Homo sapiens
tatgaccctgtgc

SEQ ID NO: 5307261 - DNA, 14 bp, Homo sapiens
tatgaccctgtgcc

SEQ ID NO: 5307262 - DNA, 18 bp, Homo sapiens
tatgaccctgtgcctgtg

SEQ ID NO: 5307263 - DNA, 14 bp, Homo sapiens
tatgaccctgttta

SEQ ID NO: 5307264 - DNA, 17 bp, Homo sapiens
tatgaccttccaagttt

SEQ ID NO: 5307265 - DNA, 20 bp, Homo sapiens
tatgacgcggctcaaaagga

SEQ ID NO: 5307266 - DNA, 19 bp, Homo sapiens
tatgacggaagaacataga

SEQ ID NO: 5307267 - DNA, 13 bp, Homo sapiens
tatgactaaagag

SEQ ID NO: 5307268 - DNA, 18 bp, Homo sapiens
tatgactaaagagagaat

SEQ ID NO: 5307269 - DNA, 14 bp, Homo sapiens
tatgactaatcctt

SEQ ID NO: 5307270 - DNA, 20 bp, Homo sapiens
tatgactaatccttaataac

SEQ ID NO: 5307271 - DNA, 22 bp, Homo sapiens
tatgactagcaaacaaaaatag

SEQ ID NO: 5307272 - DNA, 14 bp, Homo sapiens
tatgactcaggagc

SEQ ID NO: 5307273 - DNA, 23 bp, Homo sapiens
tatgactccactgtggaaaatgc

SEQ ID NO: 5307274 - DNA, 19 bp, Homo sapiens
tatgactgaagtaataact

SEQ ID NO: 5307275 - DNA, 21 bp, Homo sapiens
tatgactgaagtaataactga

SEQ ID NO: 5307276 - DNA, 17 bp, Homo sapiens
tatgactgcttcatgac

SEQ ID NO: 5307277 - DNA, 23 bp, Homo sapiens
tatgactgcttcatgacattcct

SEQ ID NO: 5307278 - DNA, 12 bp, Homo sapiens
tatgactggagt

SEQ ID NO: 5307279 - DNA, 12 bp, Homo sapiens
tatgactgtgaa

SEQ ID NO: 5307280 - DNA, 16 bp, Homo sapiens
tatgactgtgaaatga

SEQ ID NO: 5307281 - DNA, 14 bp, Homo sapiens
tatgacttaaaatt

SEQ ID NO: 5307282 - DNA, 16 bp, Homo sapiens
tatgacttcattaata

SEQ ID NO: 5307283 - DNA, 13 bp, Homo sapiens
tatgacttctgct

SEQ ID NO: 5307284 - DNA, 13 bp, Homo sapiens
tatgacttcttgt

SEQ ID NO: 5307285 - DNA, 15 bp, Homo sapiens
tatgagaaaaatatt

SEQ ID NO: 5307286 - DNA, 21 bp, Homo sapiens
tatgagaaactggcaaagcag

SEQ ID NO: 5307287 - DNA, 13 bp, Homo sapiens
tatgagaaatgta

SEQ ID NO: 5307288 - DNA, 16 bp, Homo sapiens
tatgagaaatgtaatg

SEQ ID NO: 5307289 - DNA, 21 bp, Homo sapiens
tatgagaagaaaaatggaaaa

SEQ ID NO: 5307290 - DNA, 14 bp, Homo sapiens
tatgagaagaatag

SEQ ID NO: 5307291 - DNA, 15 bp, Homo sapiens
tatgagaagatcctg

SEQ ID NO: 5307292 - DNA, 21 bp, Homo sapiens
tatgagaagtactttgtgctg

SEQ ID NO: 5307293 - DNA, 21 bp, Homo sapiens
tatgagaatataccttattta

SEQ ID NO: 5307294 - DNA, 15 bp, Homo sapiens
tatgagactcttaaa

SEQ ID NO: 5307295 - DNA, 18 bp, Homo sapiens
tatgagactgtgtttcta

SEQ ID NO: 5307296 - DNA, 15 bp, Homo sapiens
tatgagagctaattt

SEQ ID NO: 5307297 - DNA, 18 bp, Homo sapiens
tatgagagtttggaatta

SEQ ID NO: 5307298 - DNA, 16 bp, Homo sapiens
tatgagatactttgca

SEQ ID NO: 5307299 - DNA, 18 bp, Homo sapiens
tatgagatggccatgctc

SEQ ID NO: 5307300 - DNA, 19 bp, Homo sapiens
tatgagatggccatgctca

SEQ ID NO: 5307301 - DNA, 22 bp, Homo sapiens
tatgagatgtagcaaattccaa

SEQ ID NO: 5307302 - DNA, 11 bp, Homo sapiens
tatgagcacaa

SEQ ID NO: 5307303 - DNA, 15 bp, Homo sapiens
tatgagcagaaggaa

SEQ ID NO: 5307304 - DNA, 16 bp, Homo sapiens
tatgagcagcaagatt

SEQ ID NO: 5307305 - DNA, 18 bp, Homo sapiens
tatgagcatcctgagccc

SEQ ID NO: 5307306 - DNA, 18 bp, Homo sapiens
tatgagcatgctccctca

SEQ ID NO: 5307307 - DNA, 20 bp, Homo sapiens
tatgagcatgctccctcatg

SEQ ID NO: 5307308 - DNA, 16 bp, Homo sapiens
tatgagccagacaaat

SEQ ID NO: 5307309 - DNA, 21 bp, Homo sapiens
tatgagcctgccctcactccc

SEQ ID NO: 5307310 - DNA, 22 bp, Homo sapiens
tatgagcctgccctcactccct

SEQ ID NO: 5307311 - DNA, 15 bp, Homo sapiens
tatgagctaaaaata

SEQ ID NO: 5307312 - DNA, 16 bp, Homo sapiens
tatgagctcttcatgt

SEQ ID NO: 5307313 - DNA, 12 bp, Homo sapiens
tatgagctgagg

SEQ ID NO: 5307314 - DNA, 20 bp, Homo sapiens
tatgagctggagctaaggcc

SEQ ID NO: 5307315 - DNA, 13 bp, Homo sapiens
tatgagcttcaat

SEQ ID NO: 5307316 - DNA, 14 bp, Homo sapiens
tatgagcttcaata

SEQ ID NO: 5307317 - DNA, 23 bp, Homo sapiens
tatgagcttcaatataagaagca

SEQ ID NO: 5307318 - DNA, 17 bp, Homo sapiens
tatgaggacaaggtata

SEQ ID NO: 5307319 - DNA, 20 bp, Homo sapiens
tatgaggacaaggtatacac

SEQ ID NO: 5307320 - DNA, 17 bp, Homo sapiens
tatgaggacttgtgtct

SEQ ID NO: 5307321 - DNA, 15 bp, Homo sapiens
tatgaggagacattc

SEQ ID NO: 5307322 - DNA, 13 bp, Homo sapiens
tatgaggagggga

SEQ ID NO: 5307323 - DNA, 14 bp, Homo sapiens
tatgaggaggggag

SEQ ID NO: 5307324 - DNA, 22 bp, Homo sapiens
tatgaggatataatgtgtgctt

SEQ ID NO: 5307325 - DNA, 19 bp, Homo sapiens
tatgaggcaacctgattgt

SEQ ID NO: 5307326 - DNA, 13 bp, Homo sapiens
tatgaggcattga

SEQ ID NO: 5307327 - DNA, 14 bp, Homo sapiens
tatgaggcatttgt

SEQ ID NO: 5307328 - DNA, 15 bp, Homo sapiens
tatgaggcatttgtt

SEQ ID NO: 5307329 - DNA, 21 bp, Homo sapiens
tatgaggcatttgtttgaact

SEQ ID NO: 5307330 - DNA, 15 bp, Homo sapiens
tatggtcatagccca

SEQ ID NO: 5307331 - DNA, 16 bp, Homo sapiens
tatggtccagaaactc

SEQ ID NO: 5307332 - DNA, 21 bp, Homo sapiens
tatggtccagaaactcctgtt

SEQ ID NO: 5307333 - DNA, 13 bp, Homo sapiens
tatggtctaatgt

SEQ ID NO: 5307334 - DNA, 17 bp, Homo sapiens
tatggtctaatgtttaa

SEQ ID NO: 5307335 - DNA, 22 bp, Homo sapiens
tatggtcttgagccagtaatct

SEQ ID NO: 5307336 - DNA, 22 bp, Homo sapiens
tatggtcttgatcctccaatgt

SEQ ID NO: 5307337 - DNA, 15 bp, Homo sapiens
tatggtgaagggaag

SEQ ID NO: 5307338 - DNA, 19 bp, Homo sapiens
tatggtgacctctccggcc

SEQ ID NO: 5307339 - DNA, 14 bp, Homo sapiens
tatggtgagatgca

SEQ ID NO: 5307340 - DNA, 16 bp, Homo sapiens
tatggtgatactccaa

SEQ ID NO: 5307341 - DNA, 17 bp, Homo sapiens
tatggtgatactccaag

SEQ ID NO: 5307342 - DNA, 13 bp, Homo sapiens
tatggtgcaaaaa

SEQ ID NO: 5307343 - DNA, 19 bp, Homo sapiens
tatggtgcagagaagctgg

SEQ ID NO: 5307344 - DNA, 13 bp, Homo sapiens
tatggtgccaatg

SEQ ID NO: 5307345 - DNA, 22 bp, Homo sapiens
tatggtgcctagtattgacaaa

SEQ ID NO: 5307346 - DNA, 17 bp, Homo sapiens
tatggtgctaatatttt

SEQ ID NO: 5307347 - DNA, 18 bp, Homo sapiens
tatggtgctgctctgtgt

SEQ ID NO: 5307348 - DNA, 20 bp, Homo sapiens
tatggtgctgggtccttaaa

SEQ ID NO: 5307349 - DNA, 17 bp, Homo sapiens
tatggtgtaatgcacaa

SEQ ID NO: 5307350 - DNA, 18 bp, Homo sapiens
tatggtgtaatgcacaat

SEQ ID NO: 5307351 - DNA, 19 bp, Homo sapiens
tatggtgtagttctgagtc

SEQ ID NO: 5307352 - DNA, 14 bp, Homo sapiens
tatggtgtgcttat

SEQ ID NO: 5307353 - DNA, 19 bp, Homo sapiens
tatggttactaaaaagtac

SEQ ID NO: 5307354 - DNA, 20 bp, Homo sapiens
tatggttacttcttctctta

SEQ ID NO: 5307355 - DNA, 13 bp, Homo sapiens
tatggttatgttt

SEQ ID NO: 5307356 - DNA, 21 bp, Homo sapiens
tatggttcccaataaaagtga

SEQ ID NO: 5307357 - DNA, 22 bp, Homo sapiens
tatggttcccaataaaagtgac

SEQ ID NO: 5307358 - DNA, 13 bp, Homo sapiens
tatggttctaaat

SEQ ID NO: 5307359 - DNA, 18 bp, Homo sapiens
tatggttctacttcctgt

SEQ ID NO: 5307360 - DNA, 22 bp, Homo sapiens
tatggttctccaagaaactgaa

SEQ ID NO: 5307361 - DNA, 22 bp, Homo sapiens
tatggttgatagtttacctgaa

SEQ ID NO: 5307362 - DNA, 14 bp, Homo sapiens
tatggttgattccc

SEQ ID NO: 5307363 - DNA, 15 bp, Homo sapiens
tatggttggagagcc

SEQ ID NO: 5307364 - DNA, 17 bp, Homo sapiens
tatggttggagagccct

SEQ ID NO: 5307365 - DNA, 18 bp, Homo sapiens
tatggttggagagccctg

SEQ ID NO: 5307366 - DNA, 20 bp, Homo sapiens
tatggttgtaacatatgtat

SEQ ID NO: 5307367 - DNA, 15 bp, Homo sapiens
tatggttgtatacac

SEQ ID NO: 5307368 - DNA, 19 bp, Homo sapiens
tatggttttgttttcaatg

SEQ ID NO: 5307369 - DNA, 10 bp, Homo sapiens
tatgtaaaaa

SEQ ID NO: 5307370 - DNA, 17 bp, Homo sapiens
tatgtaaaactcgcttt

SEQ ID NO: 5307371 - DNA, 21 bp, Homo sapiens
tatgtaaaaggattattacta

SEQ ID NO: 5307372 - DNA, 15 bp, Homo sapiens
tatgtaaaatgtttt

SEQ ID NO: 5307373 - DNA, 16 bp, Homo sapiens
tatgtaaacaaatctt

SEQ ID NO: 5307374 - DNA, 23 bp, Homo sapiens
tatgtaaacaaatctttccatat

SEQ ID NO: 5307375 - DNA, 14 bp, Homo sapiens
tatgtaaacataat

SEQ ID NO: 5307376 - DNA, 18 bp, Homo sapiens
tatgtaaactttaacttc

SEQ ID NO: 5307377 - DNA, 18 bp, Homo sapiens
tatgtaaagtatgtaaac

SEQ ID NO: 5307378 - DNA, 16 bp, Homo sapiens
tatgtaaagtatgttt

SEQ ID NO: 5307379 - DNA, 17 bp, Homo sapiens
tatgtaaataattcttt

SEQ ID NO: 5307380 - DNA, 15 bp, Homo sapiens
tatgtaaatagattt

SEQ ID NO: 5307381 - DNA, 14 bp, Homo sapiens
tatgtaaatataca

SEQ ID NO: 5307382 - DNA, 21 bp, Homo sapiens
tatgtaaatggtatgtcattc

SEQ ID NO: 5307383 - DNA, 14 bp, Homo sapiens
tatgtaaatgtgaa

SEQ ID NO: 5307384 - DNA, 13 bp, Homo sapiens
tatgtaaatgtgc

SEQ ID NO: 5307385 - DNA, 13 bp, Homo sapiens
tatgtaaatgtgt

SEQ ID NO: 5307386 - DNA, 14 bp, Homo sapiens
tatgtaaattataa

SEQ ID NO: 5307387 - DNA, 16 bp, Homo sapiens
tatgtaacaacaatta

SEQ ID NO: 5307388 - DNA, 23 bp, Homo sapiens
tatgtaacagtttaaaaaaaaag

SEQ ID NO: 5307389 - DNA, 12 bp, Homo sapiens
tatgtaacatgt

SEQ ID NO: 5307390 - DNA, 13 bp, Homo sapiens
tatgtaacatgtc

SEQ ID NO: 5307391 - DNA, 14 bp, Homo sapiens
tatgtaacatgtct

SEQ ID NO: 5307392 - DNA, 21 bp, Homo sapiens
tatgtaactcctccatccatg

SEQ ID NO: 5307393 - DNA, 17 bp, Homo sapiens
tatgtaacttcagatgt

SEQ ID NO: 5307394 - DNA, 20 bp, Homo sapiens
tatgtaacttcagatgtttc

SEQ ID NO: 5307395 - DNA, 15 bp, Homo sapiens
tatgtaacttcctgt

SEQ ID NO: 5307396 - DNA, 13 bp, Homo sapiens
tatgtaacttgca

SEQ ID NO: 5307397 - DNA, 14 bp, Homo sapiens
tatgtaagaagaaa

SEQ ID NO: 5307398 - DNA, 17 bp, Homo sapiens
tatgtaagggctttaaa

SEQ ID NO: 5307399 - DNA, 21 bp, Homo sapiens
tatgtaagggctttaaataaa

SEQ ID NO: 5307400 - DNA, 17 bp, Homo sapiens
tatgtaataatgtacag

SEQ ID NO: 5307401 - DNA, 18 bp, Homo sapiens
tatgtaataatgtacaga

SEQ ID NO: 5307402 - DNA, 15 bp, Homo sapiens
tatgtaataatgtga

SEQ ID NO: 5307403 - DNA, 17 bp, Homo sapiens
tatgtaatataaattta

SEQ ID NO: 5307404 - DNA, 16 bp, Homo sapiens
tatgtaatatatacat

SEQ ID NO: 5307405 - DNA, 17 bp, Homo sapiens
tatgtaatatattgtac

SEQ ID NO: 5307406 - DNA, 16 bp, Homo sapiens
tatgtaatgaagtaaa

SEQ ID NO: 5307407 - DNA, 21 bp, Homo sapiens
tatgtaatgtaaaccagaaaa

SEQ ID NO: 5307408 - DNA, 21 bp, Homo sapiens
tatgtaattattttctttttg

SEQ ID NO: 5307409 - DNA, 17 bp, Homo sapiens
tatgtaatttatgcaag

SEQ ID NO: 5307410 - DNA, 14 bp, Homo sapiens
tatgtaatttcttt

SEQ ID NO: 5307411 - DNA, 15 bp, Homo sapiens
tatgtaatttgtaca

SEQ ID NO: 5307412 - DNA, 21 bp, Homo sapiens
tatgtaatttgtacaggggcc

SEQ ID NO: 5307413 - DNA, 12 bp, Homo sapiens
tatgtacaaaat

SEQ ID NO: 5307414 - DNA, 16 bp, Homo sapiens
tatgtacaaacatgtt

SEQ ID NO: 5307415 - DNA, 13 bp, Homo sapiens
tatgtacaaacta

SEQ ID NO: 5307416 - DNA, 15 bp, Homo sapiens
tatgtacaaactagt

SEQ ID NO: 5307417 - DNA, 14 bp, Homo sapiens
tatgtacaaccctg

SEQ ID NO: 5307418 - DNA, 16 bp, Homo sapiens
tatgtacaaccctgac

SEQ ID NO: 5307419 - DNA, 17 bp, Homo sapiens
tatgtacaatacaatgt

SEQ ID NO: 5307420 - DNA, 20 bp, Homo sapiens
tatgtacaatacaatgtaca

SEQ ID NO: 5307421 - DNA, 21 bp, Homo sapiens
tatgtacaatacaatgtacaa

SEQ ID NO: 5307422 - DNA, 18 bp, Homo sapiens
tatgtacaatattttaag

SEQ ID NO: 5307423 - DNA, 22 bp, Homo sapiens
tatgtacagagctttcttttgt

SEQ ID NO: 5307424 - DNA, 18 bp, Homo sapiens
tatgtacaggatgctttg

SEQ ID NO: 5307425 - DNA, 18 bp, Homo sapiens
tatgtacagttcataaat

SEQ ID NO: 5307426 - DNA, 23 bp, Homo sapiens
tatgtacagttcataaatttgtt

SEQ ID NO: 5307427 - DNA, 14 bp, Homo sapiens
tatgtacatatata

SEQ ID NO: 5307428 - DNA, 13 bp, Homo sapiens
tatgtacatttct

SEQ ID NO: 5307429 - DNA, 14 bp, Homo sapiens
tatgtacatttcta

SEQ ID NO: 5307430 - DNA, 21 bp, Homo sapiens
tatgtacatttctaagtcaaa

SEQ ID NO: 5307431 - DNA, 14 bp, Homo sapiens
tatgtacatttctc

SEQ ID NO: 5307432 - DNA, 17 bp, Homo sapiens
tatgtacatttgtcttt

SEQ ID NO: 5307433 - DNA, 22 bp, Homo sapiens
tatgtaccatatgatctgtttt

SEQ ID NO: 5307434 - DNA, 15 bp, Homo sapiens
tatgtaccatgaata

SEQ ID NO: 5307435 - DNA, 18 bp, Homo sapiens
tatgtaccatgaatattt

SEQ ID NO: 5307436 - DNA, 16 bp, Homo sapiens
tatgtaccctctgaaa

SEQ ID NO: 5307437 - DNA, 22 bp, Homo sapiens
tatgtacctctagctgttcttt

SEQ ID NO: 5307438 - DNA, 17 bp, Homo sapiens
tatgtactagtactgtg

SEQ ID NO: 5307439 - DNA, 19 bp, Homo sapiens
tatgtactagtactgtgta

SEQ ID NO: 5307440 - DNA, 16 bp, Homo sapiens
tatgtactgtaaacag

SEQ ID NO: 5307441 - DNA, 13 bp, Homo sapiens
tatgtacttcatg

SEQ ID NO: 5307442 - DNA, 17 bp, Homo sapiens
tatgtacttgatactga

SEQ ID NO: 5307443 - DNA, 23 bp, Homo sapiens
tatgtacttgatactgaatgcat

SEQ ID NO: 5307444 - DNA, 16 bp, Homo sapiens
tatgtacttgtcaaag

SEQ ID NO: 5307445 - DNA, 19 bp, Homo sapiens
tatgtacttgtcaaagaag

SEQ ID NO: 5307446 - DNA, 16 bp, Homo sapiens
tatgtacttgtttgct

SEQ ID NO: 5307447 - DNA, 19 bp, Homo sapiens
tatgtacttttattttttg

SEQ ID NO: 5307448 - DNA, 18 bp, Homo sapiens
tatgtacttttccattta

SEQ ID NO: 5307449 - DNA, 17 bp, Homo sapiens
tatgtagaaacatttag

SEQ ID NO: 5307450 - DNA, 15 bp, Homo sapiens
tatgtagaactgttc

SEQ ID NO: 5307451 - DNA, 14 bp, Homo sapiens
tatgtagaatgtct

SEQ ID NO: 5307452 - DNA, 17 bp, Homo sapiens
tatgtagacattgtaaa

SEQ ID NO: 5307453 - DNA, 16 bp, Homo sapiens
tatgtagatatttggc

SEQ ID NO: 5307454 - DNA, 23 bp, Homo sapiens
tatgtagatatttggcttaaata

SEQ ID NO: 5307455 - DNA, 15 bp, Homo sapiens
tatgtagcaaaatac

SEQ ID NO: 5307456 - DNA, 21 bp, Homo sapiens
tatgtagcccggccagggcct

SEQ ID NO: 5307457 - DNA, 18 bp, Homo sapiens
tatgtagtatctatatga

SEQ ID NO: 5307458 - DNA, 21 bp, Homo sapiens
tatgtagtgcatttttaaact

SEQ ID NO: 5307459 - DNA, 19 bp, Homo sapiens
tatgtagtggttttaggat

SEQ ID NO: 5307460 - DNA, 22 bp, Homo sapiens
tatgtagtggttttaggatact

SEQ ID NO: 5307461 - DNA, 21 bp, Homo sapiens
tatgtataaacataagttgca

SEQ ID NO: 5307462 - DNA, 23 bp, Homo sapiens
tatgtataaattatgaaggacct

SEQ ID NO: 5307463 - DNA, 18 bp, Homo sapiens
tatgtataactttaactt

SEQ ID NO: 5307464 - DNA, 20 bp, Homo sapiens
tatgtatacacaaatatata

SEQ ID NO: 5307465 - DNA, 16 bp, Homo sapiens
tatgtatacacacaca

SEQ ID NO: 5307466 - DNA, 16 bp, Homo sapiens
tatgtatacacacata

SEQ ID NO: 5307467 - DNA, 23 bp, Homo sapiens
tatgtatagaaaataaaataaat

SEQ ID NO: 5307468 - DNA, 18 bp, Homo sapiens
tatgtatataatcatgct

SEQ ID NO: 5307469 - DNA, 23 bp, Homo sapiens
tatgtatatactatacaacaatg

SEQ ID NO: 5307470 - DNA, 17 bp, Homo sapiens
tatgtatatagatgtgc

SEQ ID NO: 5307471 - DNA, 16 bp, Homo sapiens
tatgtatatctgtgta

SEQ ID NO: 5307472 - DNA, 17 bp, Homo sapiens
tatgtatatcttctaca

SEQ ID NO: 5307473 - DNA, 17 bp, Homo sapiens
tatgtatatgtatatat

SEQ ID NO: 5307474 - DNA, 19 bp, Homo sapiens
tatgtatatttaaaagaaa

SEQ ID NO: 5307475 - DNA, 22 bp, Homo sapiens
tatgtatatttttgatctttga

SEQ ID NO: 5307476 - DNA, 19 bp, Homo sapiens
tatgtatatttttttaatt

SEQ ID NO: 5307477 - DNA, 15 bp, Homo sapiens
tatgtatcagctctc

SEQ ID NO: 5307478 - DNA, 17 bp, Homo sapiens
tatgtatctaaatgaaa

SEQ ID NO: 5307479 - DNA, 19 bp, Homo sapiens
tatgtatctaatttcattc

SEQ ID NO: 5307480 - DNA, 13 bp, Homo sapiens
tatgtatctttgg

SEQ ID NO: 5307481 - DNA, 12 bp, Homo sapiens
tatgtatgaagg

SEQ ID NO: 5307482 - DNA, 13 bp, Homo sapiens
tatgtatgaagga

SEQ ID NO: 5307483 - DNA, 19 bp, Homo sapiens
tatgtatgctgatttacta

SEQ ID NO: 5307484 - DNA, 20 bp, Homo sapiens
tatgtatggaatacagtgtt

SEQ ID NO: 5307485 - DNA, 17 bp, Homo sapiens
tatgtatggtatccaag

SEQ ID NO: 5307486 - DNA, 12 bp, Homo sapiens
tatgtatgtgta

SEQ ID NO: 5307487 - DNA, 16 bp, Homo sapiens
tatgtatgtttacata

SEQ ID NO: 5307488 - DNA, 17 bp, Homo sapiens
tatgtatgtttacatat

SEQ ID NO: 5307489 - DNA, 14 bp, Homo sapiens
tatgtattaaactt

SEQ ID NO: 5307490 - DNA, 16 bp, Homo sapiens
tatgtattaaactttt

SEQ ID NO: 5307491 - DNA, 20 bp, Homo sapiens
tatgtattaagccaaacatg

SEQ ID NO: 5307492 - DNA, 22 bp, Homo sapiens
tatgtattaataaatagagcaa

SEQ ID NO: 5307493 - DNA, 19 bp, Homo sapiens
tatgtattaatattcattg

SEQ ID NO: 5307494 - DNA, 17 bp, Homo sapiens
tatgtattaccagcccc

SEQ ID NO: 5307495 - DNA, 20 bp, Homo sapiens
tatgtattagtgatatttct

SEQ ID NO: 5307496 - DNA, 22 bp, Homo sapiens
tatgtattagtgatatttctct

SEQ ID NO: 5307497 - DNA, 13 bp, Homo sapiens
tatgtattattta

SEQ ID NO: 5307498 - DNA, 19 bp, Homo sapiens
tatgtattatttacattta

SEQ ID NO: 5307499 - DNA, 21 bp, Homo sapiens
tatgtattatttacatttaat

SEQ ID NO: 5307500 - DNA, 16 bp, Homo sapiens
tatgtattattttcta

SEQ ID NO: 5307501 - DNA, 17 bp, Homo sapiens
tatgtattcccttgtat

SEQ ID NO: 5307502 - DNA, 18 bp, Homo sapiens
tatgtattcccttgtatt

SEQ ID NO: 5307503 - DNA, 19 bp, Homo sapiens
tatgtattctttctgcctt

SEQ ID NO: 5307504 - DNA, 17 bp, Homo sapiens
tatgtattggcatttat

SEQ ID NO: 5307505 - DNA, 17 bp, Homo sapiens
tatgtattgggcagcag

SEQ ID NO: 5307506 - DNA, 17 bp, Homo sapiens
tatgtattgtgcaatgt

SEQ ID NO: 5307507 - DNA, 13 bp, Homo sapiens
tatgtatttaaaa

SEQ ID NO: 5307508 - DNA, 16 bp, Homo sapiens
tattacaatgtatctt

SEQ ID NO: 5307509 - DNA, 17 bp, Homo sapiens
tattacaatgtatcttt

SEQ ID NO: 5307510 - DNA, 14 bp, Homo sapiens
tattacaatttgta

SEQ ID NO: 5307511 - DNA, 16 bp, Homo sapiens
tattacaatttttaat

SEQ ID NO: 5307512 - DNA, 21 bp, Homo sapiens
tattacacaaatacttattca

SEQ ID NO: 5307513 - DNA, 23 bp, Homo sapiens
tattacacaaatacttattcatt

SEQ ID NO: 5307514 - DNA, 18 bp, Homo sapiens
tattacacatttgtacag

SEQ ID NO: 5307515 - DNA, 18 bp, Homo sapiens
tattacacctcagaaatt

SEQ ID NO: 5307516 - DNA, 19 bp, Homo sapiens
tattacactctgtaattga

SEQ ID NO: 5307517 - DNA, 17 bp, Homo sapiens
tattacactgtatttgt

SEQ ID NO: 5307518 - DNA, 19 bp, Homo sapiens
tattacactgtatttgtat

SEQ ID NO: 5307519 - DNA, 19 bp, Homo sapiens
tattacagataaaatgtaa

SEQ ID NO: 5307520 - DNA, 15 bp, Homo sapiens
tattacagtagtgca

SEQ ID NO: 5307521 - DNA, 16 bp, Homo sapiens
tattacagtataatta

SEQ ID NO: 5307522 - DNA, 21 bp, Homo sapiens
tattacagtataattaacatg

SEQ ID NO: 5307523 - DNA, 23 bp, Homo sapiens
tattacagtattgctatttatat

SEQ ID NO: 5307524 - DNA, 13 bp, Homo sapiens
tattacagtgttg

SEQ ID NO: 5307525 - DNA, 15 bp, Homo sapiens
tattacagtgtttat

SEQ ID NO: 5307526 - DNA, 14 bp, Homo sapiens
tattacataaaaca

SEQ ID NO: 5307527 - DNA, 21 bp, Homo sapiens
tattacatagtttgaaaaata

SEQ ID NO: 5307528 - DNA, 17 bp, Homo sapiens
tattacatatatcatta

SEQ ID NO: 5307529 - DNA, 15 bp, Homo sapiens
tattacatctaatgc

SEQ ID NO: 5307530 - DNA, 18 bp, Homo sapiens
tattacatgactgtttct

SEQ ID NO: 5307531 - DNA, 16 bp, Homo sapiens
tattacatgtaaagct

SEQ ID NO: 5307532 - DNA, 13 bp, Homo sapiens
tattacatgtgtt

SEQ ID NO: 5307533 - DNA, 22 bp, Homo sapiens
tattacattgcattcaaaatct

SEQ ID NO: 5307534 - DNA, 13 bp, Homo sapiens
tattacatttcat

SEQ ID NO: 5307535 - DNA, 17 bp, Homo sapiens
tattacatttcatttat

SEQ ID NO: 5307536 - DNA, 20 bp, Homo sapiens
tattaccagcaagaataaaa

SEQ ID NO: 5307537 - DNA, 13 bp, Homo sapiens
tattaccatgtaa

SEQ ID NO: 5307538 - DNA, 15 bp, Homo sapiens
tattaccatgtaaat

SEQ ID NO: 5307539 - DNA, 21 bp, Homo sapiens
tattaccatgtaaataatctg

SEQ ID NO: 5307540 - DNA, 22 bp, Homo sapiens
tattacccaagaagtaaagatg

SEQ ID NO: 5307541 - DNA, 22 bp, Homo sapiens
tattacccaatggaaaatataa

SEQ ID NO: 5307542 - DNA, 21 bp, Homo sapiens
tattaccccctccttcagaca

SEQ ID NO: 5307543 - DNA, 22 bp, Homo sapiens
tattaccccctccttcagacac

SEQ ID NO: 5307544 - DNA, 14 bp, Homo sapiens
tattacccctcatt

SEQ ID NO: 5307545 - DNA, 20 bp, Homo sapiens
tattaccgataaatgaacat

SEQ ID NO: 5307546 - DNA, 19 bp, Homo sapiens
tattacctctgatacctca

SEQ ID NO: 5307547 - DNA, 23 bp, Homo sapiens
tattaccttaagatttttctttt

SEQ ID NO: 5307548 - DNA, 17 bp, Homo sapiens
tattacctttacatatt

SEQ ID NO: 5307549 - DNA, 18 bp, Homo sapiens
tattacctttacatatta

SEQ ID NO: 5307550 - DNA, 16 bp, Homo sapiens
tattacggtttgcccc

SEQ ID NO: 5307551 - DNA, 17 bp, Homo sapiens
tattacgttgtttctta

SEQ ID NO: 5307552 - DNA, 18 bp, Homo sapiens
tattactaatgatgcttt

SEQ ID NO: 5307553 - DNA, 14 bp, Homo sapiens
tattactaattcta

SEQ ID NO: 5307554 - DNA, 19 bp, Homo sapiens
tattactaattctatttct

SEQ ID NO: 5307555 - DNA, 15 bp, Homo sapiens
tattactactccttt

SEQ ID NO: 5307556 - DNA, 16 bp, Homo sapiens
tattactactcctttg

SEQ ID NO: 5307557 - DNA, 22 bp, Homo sapiens
tattactagactgccacaagga

SEQ ID NO: 5307558 - DNA, 13 bp, Homo sapiens
tattactagtact

SEQ ID NO: 5307559 - DNA, 23 bp, Homo sapiens
tattactagtgtttaagtcattt

SEQ ID NO: 5307560 - DNA, 16 bp, Homo sapiens
tattactagttagcat

SEQ ID NO: 5307561 - DNA, 22 bp, Homo sapiens
tattactatgactgctccccag

SEQ ID NO: 5307562 - DNA, 14 bp, Homo sapiens
tattactctacact

SEQ ID NO: 5307563 - DNA, 12 bp, Homo sapiens
tattactctatg

SEQ ID NO: 5307564 - DNA, 22 bp, Homo sapiens
tattactgaataatatcaaata

SEQ ID NO: 5307565 - DNA, 18 bp, Homo sapiens
tattactgaggaaaggga

SEQ ID NO: 5307566 - DNA, 19 bp, Homo sapiens
tattactgctgctgtgctt

SEQ ID NO: 5307567 - DNA, 21 bp, Homo sapiens
tattactggcgtggattaaac

SEQ ID NO: 5307568 - DNA, 23 bp, Homo sapiens
tattactggtattagttaaaaca

SEQ ID NO: 5307569 - DNA, 13 bp, Homo sapiens
tattactgtaata

SEQ ID NO: 5307570 - DNA, 14 bp, Homo sapiens
tattactgtcttta

SEQ ID NO: 5307571 - DNA, 13 bp, Homo sapiens
tattactgttctt

SEQ ID NO: 5307572 - DNA, 21 bp, Homo sapiens
tattactgttgataattctta

SEQ ID NO: 5307573 - DNA, 22 bp, Homo sapiens
tattactgttgcatttactttt

SEQ ID NO: 5307574 - DNA, 18 bp, Homo sapiens
tattactgtttatttctg

SEQ ID NO: 5307575 - DNA, 18 bp, Homo sapiens
tattactgttttgggcct

SEQ ID NO: 5307576 - DNA, 17 bp, Homo sapiens
tattactgtttttgcta

SEQ ID NO: 5307577 - DNA, 22 bp, Homo sapiens
tattacttaggttattttgctt

SEQ ID NO: 5307578 - DNA, 13 bp, Homo sapiens
tattacttccatg

SEQ ID NO: 5307579 - DNA, 14 bp, Homo sapiens
tattacttccatga

SEQ ID NO: 5307580 - DNA, 15 bp, Homo sapiens
tattacttccatgaa

SEQ ID NO: 5307581 - DNA, 19 bp, Homo sapiens
tattacttccatgaatttt

SEQ ID NO: 5307582 - DNA, 12 bp, Homo sapiens
tattacttctgt

SEQ ID NO: 5307583 - DNA, 18 bp, Homo sapiens
tattacttgtaaatataa

SEQ ID NO: 5307584 - DNA, 22 bp, Homo sapiens
tattacttgtaaatataaagac

SEQ ID NO: 5307585 - DNA, 14 bp, Homo sapiens
tattacttgtgcac

SEQ ID NO: 5307586 - DNA, 15 bp, Homo sapiens
tattacttgtgcact

SEQ ID NO: 5307587 - DNA, 23 bp, Homo sapiens
tattacttgtgcacttagtagtt

SEQ ID NO: 5307588 - DNA, 14 bp, Homo sapiens
tattacttgttgca

SEQ ID NO: 5307589 - DNA, 18 bp, Homo sapiens
tattactttatcactttt

SEQ ID NO: 5307590 - DNA, 18 bp, Homo sapiens
tattactttctctgtagt

SEQ ID NO: 5307591 - DNA, 14 bp, Homo sapiens
tattacttttcatc

SEQ ID NO: 5307592 - DNA, 19 bp, Homo sapiens
tattacttttgtaaatatt

SEQ ID NO: 5307593 - DNA, 19 bp, Homo sapiens
tattagaaaactttgttag

SEQ ID NO: 5307594 - DNA, 17 bp, Homo sapiens
tattagaacattcactt

SEQ ID NO: 5307595 - DNA, 17 bp, Homo sapiens
tattagaatcaaacatt

SEQ ID NO: 5307596 - DNA, 21 bp, Homo sapiens
tattagaatcaaacattttga

SEQ ID NO: 5307597 - DNA, 16 bp, Homo sapiens
tattagacattctctt

SEQ ID NO: 5307598 - DNA, 21 bp, Homo sapiens
tattagacttctgttttcaat

SEQ ID NO: 5307599 - DNA, 17 bp, Homo sapiens
tattagagcgccagctc

SEQ ID NO: 5307600 - DNA, 18 bp, Homo sapiens
tattagagcgccagctcc

SEQ ID NO: 5307601 - DNA, 15 bp, Homo sapiens
tattagagtatttcc

SEQ ID NO: 5307602 - DNA, 16 bp, Homo sapiens
tattagagtatttccc

SEQ ID NO: 5307603 - DNA, 24 bp, Homo sapiens
tattagagtgcccttaaaataatg

SEQ ID NO: 5307604 - DNA, 12 bp, Homo sapiens
tattagatgaat

SEQ ID NO: 5307605 - DNA, 19 bp, Homo sapiens
tattagatgctctgagaaa

SEQ ID NO: 5307606 - DNA, 14 bp, Homo sapiens
tattagatgtgatt

SEQ ID NO: 5307607 - DNA, 20 bp, Homo sapiens
tattagatgtgatttaatag

SEQ ID NO: 5307608 - DNA, 14 bp, Homo sapiens
tattagatgtggtt

SEQ ID NO: 5307609 - DNA, 12 bp, Homo sapiens
tattagatgttc

SEQ ID NO: 5307610 - DNA, 22 bp, Homo sapiens
tattagatgttctctatcattt

SEQ ID NO: 5307611 - DNA, 14 bp, Homo sapiens
tattagcaccagct

SEQ ID NO: 5307612 - DNA, 18 bp, Homo sapiens
tattagcagcaaaacaaa

SEQ ID NO: 5307613 - DNA, 23 bp, Homo sapiens
tattagcagctgactttcaaagt

SEQ ID NO: 5307614 - DNA, 16 bp, Homo sapiens
tattagcatgagcttt

SEQ ID NO: 5307615 - DNA, 21 bp, Homo sapiens
tattagcatgagctttccagt

SEQ ID NO: 5307616 - DNA, 18 bp, Homo sapiens
tattagcatttgttttag

SEQ ID NO: 5307617 - DNA, 19 bp, Homo sapiens
tattagccaaagaggcatt

SEQ ID NO: 5307618 - DNA, 19 bp, Homo sapiens
tattagccaggatcatggt

SEQ ID NO: 5307619 - DNA, 18 bp, Homo sapiens
tattagccagtcattgta

SEQ ID NO: 5307620 - DNA, 19 bp, Homo sapiens
tattagccagtcattgtaa

SEQ ID NO: 5307621 - DNA, 16 bp, Homo sapiens
tattagccagtcttta

SEQ ID NO: 5307622 - DNA, 16 bp, Homo sapiens
tattagccctgcattt

SEQ ID NO: 5307623 - DNA, 15 bp, Homo sapiens
tattagcggctcctc

SEQ ID NO: 5307624 - DNA, 15 bp, Homo sapiens
tattagctgggttcc

SEQ ID NO: 5307625 - DNA, 14 bp, Homo sapiens
tattagctttactg

SEQ ID NO: 5307626 - DNA, 15 bp, Homo sapiens
tattagctttctcct

SEQ ID NO: 5307627 - DNA, 17 bp, Homo sapiens
tattaggaaaagatatt

SEQ ID NO: 5307628 - DNA, 19 bp, Homo sapiens
tattaggaaaataaacaga

SEQ ID NO: 5307629 - DNA, 16 bp, Homo sapiens
tattaggatctgcaaa

SEQ ID NO: 5307630 - DNA, 17 bp, Homo sapiens
tattaggcataaattaa

SEQ ID NO: 5307631 - DNA, 16 bp, Homo sapiens
tattagggagaaaatt

SEQ ID NO: 5307632 - DNA, 16 bp, Homo sapiens
tattaggtcttaaagt

SEQ ID NO: 5307633 - DNA, 21 bp, Homo sapiens
tattaggtgcaatttcaaggt

SEQ ID NO: 5307634 - DNA, 16 bp, Homo sapiens
tattaggtggaaattt

SEQ ID NO: 5307635 - DNA, 13 bp, Homo sapiens
tattagtaattta

SEQ ID NO: 5307636 - DNA, 15 bp, Homo sapiens
tattagtacaaacta

SEQ ID NO: 5307637 - DNA, 20 bp, Homo sapiens
tattagtattgttgtccttt

SEQ ID NO: 5307638 - DNA, 14 bp, Homo sapiens
tattagtgatattt

SEQ ID NO: 5307639 - DNA, 22 bp, Homo sapiens
tattagtgattctgatttcagt

SEQ ID NO: 5307640 - DNA, 23 bp, Homo sapiens
tattagtgccaagtttttcagaa

SEQ ID NO: 5307641 - DNA, 18 bp, Homo sapiens
tattagtgctagtctcag

SEQ ID NO: 5307642 - DNA, 19 bp, Homo sapiens
tattagtggaaagtgattt

SEQ ID NO: 5307643 - DNA, 13 bp, Homo sapiens
tattagtgttata

SEQ ID NO: 5307644 - DNA, 17 bp, Homo sapiens
tattagtgttatatgaa

SEQ ID NO: 5307645 - DNA, 18 bp, Homo sapiens
tattagttacttgctata

SEQ ID NO: 5307646 - DNA, 22 bp, Homo sapiens
tattagttccctgtctcttgaa

SEQ ID NO: 5307647 - DNA, 19 bp, Homo sapiens
tattagttgccaatatgcc

SEQ ID NO: 5307648 - DNA, 12 bp, Homo sapiens
tattagttgctt

SEQ ID NO: 5307649 - DNA, 15 bp, Homo sapiens
tattagttttctgta

SEQ ID NO: 5307650 - DNA, 18 bp, Homo sapiens
tattagttttctgtatat

SEQ ID NO: 5307651 - DNA, 18 bp, Homo sapiens
tattagttttctttgtaa

SEQ ID NO: 5307652 - DNA, 15 bp, Homo sapiens
tattagttttgcata

SEQ ID NO: 5307653 - DNA, 17 bp, Homo sapiens
tattataaaaatatcaa

SEQ ID NO: 5307654 - DNA, 15 bp, Homo sapiens
tattataaaaccatg

SEQ ID NO: 5307655 - DNA, 22 bp, Homo sapiens
tattataaaagctcagatgaca

SEQ ID NO: 5307656 - DNA, 24 bp, Homo sapiens
tattataaaagggggtccgtggaa

SEQ ID NO: 5307657 - DNA, 21 bp, Homo sapiens
tattataaagccaattatctg

SEQ ID NO: 5307658 - DNA, 13 bp, Homo sapiens
tattataaagctt

SEQ ID NO: 5307659 - DNA, 14 bp, Homo sapiens
tattataaagctta

SEQ ID NO: 5307660 - DNA, 12 bp, Homo sapiens
tattataaataa

SEQ ID NO: 5307661 - DNA, 16 bp, Homo sapiens
tattataaatgttagt

SEQ ID NO: 5307662 - DNA, 18 bp, Homo sapiens
tattataaatgttagttc

SEQ ID NO: 5307663 - DNA, 15 bp, Homo sapiens
tattataaattatgt

SEQ ID NO: 5307664 - DNA, 20 bp, Homo sapiens
tattataaattctactaagt

SEQ ID NO: 5307665 - DNA, 13 bp, Homo sapiens
tattataactgca

SEQ ID NO: 5307666 - DNA, 13 bp, Homo sapiens
tattataagcatt

SEQ ID NO: 5307667 - DNA, 22 bp, Homo sapiens
tattataagggagagctgagcc

SEQ ID NO: 5307668 - DNA, 21 bp, Homo sapiens
tattataagttgacctttatt

SEQ ID NO: 5307669 - DNA, 12 bp, Homo sapiens
tattataattgt

SEQ ID NO: 5307670 - DNA, 18 bp, Homo sapiens
tattataattgtcatgac

SEQ ID NO: 5307671 - DNA, 17 bp, Homo sapiens
tattataattgttgata

SEQ ID NO: 5307672 - DNA, 12 bp, Homo sapiens
tattataattta

SEQ ID NO: 5307673 - DNA, 20 bp, Homo sapiens
tattatacagtaataggagt

SEQ ID NO: 5307674 - DNA, 14 bp, Homo sapiens
tattatacatgtga

SEQ ID NO: 5307675 - DNA, 19 bp, Homo sapiens
tattatacatgtgatacat

SEQ ID NO: 5307676 - DNA, 21 bp, Homo sapiens
tattatacatgtgatacattt

SEQ ID NO: 5307677 - DNA, 13 bp, Homo sapiens
tattatacctttt

SEQ ID NO: 5307678 - DNA, 14 bp, Homo sapiens
tattatagaaaatt

SEQ ID NO: 5307679 - DNA, 14 bp, Homo sapiens
tattatagaaattc

SEQ ID NO: 5307680 - DNA, 20 bp, Homo sapiens
tattatagacaaaagaataa

SEQ ID NO: 5307681 - DNA, 20 bp, Homo sapiens
tattatagagagttatgaac

SEQ ID NO: 5307682 - DNA, 18 bp, Homo sapiens
tattatagagcagaaatt

SEQ ID NO: 5307683 - DNA, 20 bp, Homo sapiens
tattataggtaatcaatgaa

SEQ ID NO: 5307684 - DNA, 15 bp, Homo sapiens
tattatagtgaaaca

SEQ ID NO: 5307685 - DNA, 23 bp, Homo sapiens
tattatataacccactgctgaaa

SEQ ID NO: 5307686 - DNA, 15 bp, Homo sapiens
tattctaataaatat

SEQ ID NO: 5307687 - DNA, 13 bp, Homo sapiens
tattctaataagc

SEQ ID NO: 5307688 - DNA, 17 bp, Homo sapiens
tattctaataagctagt

SEQ ID NO: 5307689 - DNA, 23 bp, Homo sapiens
tattctaatagtttttcactttg

SEQ ID NO: 5307690 - DNA, 18 bp, Homo sapiens
tattctacacatatatgt

SEQ ID NO: 5307691 - DNA, 22 bp, Homo sapiens
tattctacacatatatgtatat

SEQ ID NO: 5307692 - DNA, 15 bp, Homo sapiens
tattctacctttgta

SEQ ID NO: 5307693 - DNA, 17 bp, Homo sapiens
tattctacctttgtaaa

SEQ ID NO: 5307694 - DNA, 14 bp, Homo sapiens
tattctagagcttt

SEQ ID NO: 5307695 - DNA, 21 bp, Homo sapiens
tattctagcctgcattgagct

SEQ ID NO: 5307696 - DNA, 17 bp, Homo sapiens
tattctagttaaggaaa

SEQ ID NO: 5307697 - DNA, 20 bp, Homo sapiens
tattctatacacaccctgcc

SEQ ID NO: 5307698 - DNA, 22 bp, Homo sapiens
tattctatccatctcctggtgt

SEQ ID NO: 5307699 - DNA, 16 bp, Homo sapiens
tattctatgagaacaa

SEQ ID NO: 5307700 - DNA, 23 bp, Homo sapiens
tattctatgtagtggttttagga

SEQ ID NO: 5307701 - DNA, 19 bp, Homo sapiens
tattctattaactttaatt

SEQ ID NO: 5307702 - DNA, 22 bp, Homo sapiens
tattctattgtattatttggag

SEQ ID NO: 5307703 - DNA, 17 bp, Homo sapiens
tattctattttacaact

SEQ ID NO: 5307704 - DNA, 22 bp, Homo sapiens
tattctcaaacacagttacact

SEQ ID NO: 5307705 - DNA, 16 bp, Homo sapiens
tattctcaaagatgca

SEQ ID NO: 5307706 - DNA, 16 bp, Homo sapiens
tattctcaaagcagga

SEQ ID NO: 5307707 - DNA, 15 bp, Homo sapiens
tattctcaaagttaa

SEQ ID NO: 5307708 - DNA, 14 bp, Homo sapiens
tattctcactccac

SEQ ID NO: 5307709 - DNA, 15 bp, Homo sapiens
tattctcactccacc

SEQ ID NO: 5307710 - DNA, 17 bp, Homo sapiens
tattctcagagcatgtg

SEQ ID NO: 5307711 - DNA, 17 bp, Homo sapiens
tattctcagcagagtgc

SEQ ID NO: 5307712 - DNA, 23 bp, Homo sapiens
tattctcataggagactgcgtca

SEQ ID NO: 5307713 - DNA, 13 bp, Homo sapiens
tattctcattctt

SEQ ID NO: 5307714 - DNA, 22 bp, Homo sapiens
tattctcattggggttgcaaca

SEQ ID NO: 5307715 - DNA, 23 bp, Homo sapiens
tattctccagaaaaatcaatcat

SEQ ID NO: 5307716 - DNA, 13 bp, Homo sapiens
tattctccagaca

SEQ ID NO: 5307717 - DNA, 13 bp, Homo sapiens
tattctcctccga

SEQ ID NO: 5307718 - DNA, 16 bp, Homo sapiens
tattctcctcctccct

SEQ ID NO: 5307719 - DNA, 19 bp, Homo sapiens
tattctctaaactggcatc

SEQ ID NO: 5307720 - DNA, 15 bp, Homo sapiens
tattctctaataaaa

SEQ ID NO: 5307721 - DNA, 17 bp, Homo sapiens
tattctctaataaaatt

SEQ ID NO: 5307722 - DNA, 18 bp, Homo sapiens
tattctctaataaaattc

SEQ ID NO: 5307723 - DNA, 13 bp, Homo sapiens
tattctctattta

SEQ ID NO: 5307724 - DNA, 11 bp, Homo sapiens
tattctctcat

SEQ ID NO: 5307725 - DNA, 20 bp, Homo sapiens
tattctctcctgtacctctt

SEQ ID NO: 5307726 - DNA, 23 bp, Homo sapiens
tattctctcttattgttctttca

SEQ ID NO: 5307727 - DNA, 15 bp, Homo sapiens
tattctctgcaattt

SEQ ID NO: 5307728 - DNA, 17 bp, Homo sapiens
tattctctgcaatttgt

SEQ ID NO: 5307729 - DNA, 17 bp, Homo sapiens
tattctctgcaatttta

SEQ ID NO: 5307730 - DNA, 21 bp, Homo sapiens
tattctctgcaattttactgt

SEQ ID NO: 5307731 - DNA, 16 bp, Homo sapiens
tattctctgtacatat

SEQ ID NO: 5307732 - DNA, 12 bp, Homo sapiens
tattctctgttt

SEQ ID NO: 5307733 - DNA, 13 bp, Homo sapiens
tattctctgtttg

SEQ ID NO: 5307734 - DNA, 20 bp, Homo sapiens
tattctctgtttgcttttga

SEQ ID NO: 5307735 - DNA, 19 bp, Homo sapiens
tattctcttgtctggctgc

SEQ ID NO: 5307736 - DNA, 12 bp, Homo sapiens
tattctgaaaaa

SEQ ID NO: 5307737 - DNA, 16 bp, Homo sapiens
tattctgaaaaagaca

SEQ ID NO: 5307738 - DNA, 20 bp, Homo sapiens
tattctgaaaaagacataaa

SEQ ID NO: 5307739 - DNA, 23 bp, Homo sapiens
tattctgaaaaagacataaaaca

SEQ ID NO: 5307740 - DNA, 15 bp, Homo sapiens
tattctgaaaggaaa

SEQ ID NO: 5307741 - DNA, 17 bp, Homo sapiens
tattctgacatgtaaga

SEQ ID NO: 5307742 - DNA, 20 bp, Homo sapiens
tattctgacatgtaagaaaa

SEQ ID NO: 5307743 - DNA, 17 bp, Homo sapiens
tattctgagaaaacaag

SEQ ID NO: 5307744 - DNA, 23 bp, Homo sapiens
tattctgagcatactcaacaaaa

SEQ ID NO: 5307745 - DNA, 13 bp, Homo sapiens
tattctgagcctt

SEQ ID NO: 5307746 - DNA, 22 bp, Homo sapiens
tattctgattacacaaaacaaa

SEQ ID NO: 5307747 - DNA, 11 bp, Homo sapiens
tattctgattg

SEQ ID NO: 5307748 - DNA, 19 bp, Homo sapiens
tattctgcagaaaattaat

SEQ ID NO: 5307749 - DNA, 22 bp, Homo sapiens
tattctgccatgggagagtcca

SEQ ID NO: 5307750 - DNA, 18 bp, Homo sapiens
tattctgctgaagattca

SEQ ID NO: 5307751 - DNA, 12 bp, Homo sapiens
tattctggaaaa

SEQ ID NO: 5307752 - DNA, 20 bp, Homo sapiens
tattctggaaaaaaaatata

SEQ ID NO: 5307753 - DNA, 23 bp, Homo sapiens
tattctggaaaaaaaatatatat

SEQ ID NO: 5307754 - DNA, 12 bp, Homo sapiens
tattctggagtt

SEQ ID NO: 5307755 - DNA, 23 bp, Homo sapiens
tattctgggaaatgttttaatgc

SEQ ID NO: 5307756 - DNA, 16 bp, Homo sapiens
tattctgggaatgtat

SEQ ID NO: 5307757 - DNA, 21 bp, Homo sapiens
tattctgggaatgtatagtat

SEQ ID NO: 5307758 - DNA, 22 bp, Homo sapiens
tattctgggctcctggaaccaa

SEQ ID NO: 5307759 - DNA, 19 bp, Homo sapiens
tattctgggggctgcagtt

SEQ ID NO: 5307760 - DNA, 15 bp, Homo sapiens
tattctgtacatttt

SEQ ID NO: 5307761 - DNA, 19 bp, Homo sapiens
tattctgtagccaacttaa

SEQ ID NO: 5307762 - DNA, 23 bp, Homo sapiens
tattctgtagccaacttaaacct

SEQ ID NO: 5307763 - DNA, 13 bp, Homo sapiens
tattctgtatccg

SEQ ID NO: 5307764 - DNA, 15 bp, Homo sapiens
tattctgtcatttac

SEQ ID NO: 5307765 - DNA, 13 bp, Homo sapiens
tattctgtcccta

SEQ ID NO: 5307766 - DNA, 15 bp, Homo sapiens
tattctgtccctagg

SEQ ID NO: 5307767 - DNA, 17 bp, Homo sapiens
tattctgtgaaactaat

SEQ ID NO: 5307768 - DNA, 20 bp, Homo sapiens
tattctgtggattctatatt

SEQ ID NO: 5307769 - DNA, 17 bp, Homo sapiens
tattctgtggttctata

SEQ ID NO: 5307770 - DNA, 11 bp, Homo sapiens
tattctgttcc

SEQ ID NO: 5307771 - DNA, 20 bp, Homo sapiens
tattctgtttattatgacaa

SEQ ID NO: 5307772 - DNA, 16 bp, Homo sapiens
tattctgtttctaggc

SEQ ID NO: 5307773 - DNA, 13 bp, Homo sapiens
tattctgttttct

SEQ ID NO: 5307774 - DNA, 17 bp, Homo sapiens
tattctgttttcttgtt

SEQ ID NO: 5307775 - DNA, 21 bp, Homo sapiens
tattctgttttgttaatatac

SEQ ID NO: 5307776 - DNA, 17 bp, Homo sapiens
tattcttaaaatgcaat

SEQ ID NO: 5307777 - DNA, 18 bp, Homo sapiens
tattcttaaaatgcaata

SEQ ID NO: 5307778 - DNA, 19 bp, Homo sapiens
tattcttaaaatgcaatat

SEQ ID NO: 5307779 - DNA, 21 bp, Homo sapiens
tattcttaagcactttgaaaa

SEQ ID NO: 5307780 - DNA, 22 bp, Homo sapiens
tattcttaagggaacttccaca

SEQ ID NO: 5307781 - DNA, 15 bp, Homo sapiens
tattcttaataaaac

SEQ ID NO: 5307782 - DNA, 20 bp, Homo sapiens
tattcttaataaaactcact

SEQ ID NO: 5307783 - DNA, 15 bp, Homo sapiens
tattcttataaaaat

SEQ ID NO: 5307784 - DNA, 20 bp, Homo sapiens
tattcttattggaaatgtac

SEQ ID NO: 5307785 - DNA, 16 bp, Homo sapiens
tattcttcaaatgtat

SEQ ID NO: 5307786 - DNA, 16 bp, Homo sapiens
tattcttcatcagcat

SEQ ID NO: 5307787 - DNA, 13 bp, Homo sapiens
tattcttcatgaa

SEQ ID NO: 5307788 - DNA, 14 bp, Homo sapiens
tattcttcatgaaa

SEQ ID NO: 5307789 - DNA, 18 bp, Homo sapiens
tattcttcatgaaatgtg

SEQ ID NO: 5307790 - DNA, 17 bp, Homo sapiens
tattcttccaagttcat

SEQ ID NO: 5307791 - DNA, 20 bp, Homo sapiens
tattcttcggaggaggtgga

SEQ ID NO: 5307792 - DNA, 14 bp, Homo sapiens
tattcttctagagt

SEQ ID NO: 5307793 - DNA, 18 bp, Homo sapiens
tattcttctagagttcag

SEQ ID NO: 5307794 - DNA, 13 bp, Homo sapiens
tattcttctcttc

SEQ ID NO: 5307795 - DNA, 17 bp, Homo sapiens
tattcttctcttgcttt

SEQ ID NO: 5307796 - DNA, 13 bp, Homo sapiens
tattcttctttga

SEQ ID NO: 5307797 - DNA, 17 bp, Homo sapiens
tattcttctttgatagt

SEQ ID NO: 5307798 - DNA, 20 bp, Homo sapiens
tattcttgaaagtattgtgt

SEQ ID NO: 5307799 - DNA, 14 bp, Homo sapiens
tattcttgatgaaa

SEQ ID NO: 5307800 - DNA, 16 bp, Homo sapiens
tattcttgctttcaca

SEQ ID NO: 5307801 - DNA, 17 bp, Homo sapiens
tattcttggagaacttt

SEQ ID NO: 5307802 - DNA, 21 bp, Homo sapiens
tattcttggagaactttccat

SEQ ID NO: 5307803 - DNA, 14 bp, Homo sapiens
tattcttgtaaata

SEQ ID NO: 5307804 - DNA, 18 bp, Homo sapiens
tattcttgtcattttgaa

SEQ ID NO: 5307805 - DNA, 12 bp, Homo sapiens
tattcttgtgaa

SEQ ID NO: 5307806 - DNA, 18 bp, Homo sapiens
tattcttgtggttaaaaa

SEQ ID NO: 5307807 - DNA, 20 bp, Homo sapiens
tattctttaaacaaatatga

SEQ ID NO: 5307808 - DNA, 22 bp, Homo sapiens
tattctttaattgttgctttta

SEQ ID NO: 5307809 - DNA, 20 bp, Homo sapiens
tattctttagcttacctggg

SEQ ID NO: 5307810 - DNA, 13 bp, Homo sapiens
tattctttattct

SEQ ID NO: 5307811 - DNA, 12 bp, Homo sapiens
tattctttccat

SEQ ID NO: 5307812 - DNA, 15 bp, Homo sapiens
tattctttccatgca

SEQ ID NO: 5307813 - DNA, 18 bp, Homo sapiens
tattctttccatgcagtt

SEQ ID NO: 5307814 - DNA, 22 bp, Homo sapiens
tattctttcgaaagaagaaaat

SEQ ID NO: 5307815 - DNA, 21 bp, Homo sapiens
tattctttctcataaaactgt

SEQ ID NO: 5307816 - DNA, 16 bp, Homo sapiens
tattctttctcctttt

SEQ ID NO: 5307817 - DNA, 20 bp, Homo sapiens
tattctttgaccaaactgtg

SEQ ID NO: 5307818 - DNA, 22 bp, Homo sapiens
tattctttgcactttttcttaa

SEQ ID NO: 5307819 - DNA, 18 bp, Homo sapiens
tattctttggttgtgaat

SEQ ID NO: 5307820 - DNA, 12 bp, Homo sapiens
tattctttgtta

SEQ ID NO: 5307821 - DNA, 16 bp, Homo sapiens
tattcttttatgaaat

SEQ ID NO: 5307822 - DNA, 14 bp, Homo sapiens
tattcttttcaatt

SEQ ID NO: 5307823 - DNA, 15 bp, Homo sapiens
tattcttttcaatta

SEQ ID NO: 5307824 - DNA, 18 bp, Homo sapiens
tattcttttcaattatat

SEQ ID NO: 5307825 - DNA, 19 bp, Homo sapiens
tattcttttccaagctcct

SEQ ID NO: 5307826 - DNA, 20 bp, Homo sapiens
tattcttttccagaaagaaa

SEQ ID NO: 5307827 - DNA, 17 bp, Homo sapiens
tattcttttgatcacat

SEQ ID NO: 5307828 - DNA, 20 bp, Homo sapiens
tattcttttgatcacattgt

SEQ ID NO: 5307829 - DNA, 16 bp, Homo sapiens
tattgaaaaaaaaaat

SEQ ID NO: 5307830 - DNA, 12 bp, Homo sapiens
tattgaaaaatc

SEQ ID NO: 5307831 - DNA, 14 bp, Homo sapiens
tattgaaaaatcag

SEQ ID NO: 5307832 - DNA, 15 bp, Homo sapiens
tattgaaaacactta

SEQ ID NO: 5307833 - DNA, 17 bp, Homo sapiens
tattgaaaacagtgtct

SEQ ID NO: 5307834 - DNA, 22 bp, Homo sapiens
tattgaaaagaaaaagaagagc

SEQ ID NO: 5307835 - DNA, 22 bp, Homo sapiens
tattgaaaaggttaacagatac

SEQ ID NO: 5307836 - DNA, 20 bp, Homo sapiens
tattgaaaattgaaaagtac

SEQ ID NO: 5307837 - DNA, 18 bp, Homo sapiens
tattgaaagaattatcct

SEQ ID NO: 5307838 - DNA, 14 bp, Homo sapiens
tattgaaagaccag

SEQ ID NO: 5307839 - DNA, 21 bp, Homo sapiens
tattgaaatattatagagagt

SEQ ID NO: 5307840 - DNA, 19 bp, Homo sapiens
tattgaaattactgaaaac

SEQ ID NO: 5307841 - DNA, 21 bp, Homo sapiens
tattgaactgtattctagtgg

SEQ ID NO: 5307842 - DNA, 20 bp, Homo sapiens
tattgaagaaaagcactttt

SEQ ID NO: 5307843 - DNA, 17 bp, Homo sapiens
tattgaagacaatttga

SEQ ID NO: 5307844 - DNA, 15 bp, Homo sapiens
tattgaagcatttta

SEQ ID NO: 5307845 - DNA, 20 bp, Homo sapiens
tattgaagggtctgtttaaa

SEQ ID NO: 5307846 - DNA, 24 bp, Homo sapiens
tattgaagtaagttcatcaaacat

SEQ ID NO: 5307847 - DNA, 21 bp, Homo sapiens
tattgaagtcttcttatctaa

SEQ ID NO: 5307848 - DNA, 17 bp, Homo sapiens
tattgaataagtattct

SEQ ID NO: 5307849 - DNA, 17 bp, Homo sapiens
tattgaatacttacatt

SEQ ID NO: 5307850 - DNA, 23 bp, Homo sapiens
tattgaataggcattaaatgcaa

SEQ ID NO: 5307851 - DNA, 22 bp, Homo sapiens
tattgaatataatatatttgtg

SEQ ID NO: 5307852 - DNA, 15 bp, Homo sapiens
tattgaatattgtgt

SEQ ID NO: 5307853 - DNA, 18 bp, Homo sapiens
tattgaatattttatatt

SEQ ID NO: 5307854 - DNA, 18 bp, Homo sapiens
tattgaatgccttatttt

SEQ ID NO: 5307855 - DNA, 20 bp, Homo sapiens
tattgaatgccttatttttg

SEQ ID NO: 5307856 - DNA, 18 bp, Homo sapiens
tattgaattcatttcact

SEQ ID NO: 5307857 - DNA, 18 bp, Homo sapiens
tattgaatttttcctatg

SEQ ID NO: 5307858 - DNA, 12 bp, Homo sapiens
tattgacaaaat

SEQ ID NO: 5307859 - DNA, 21 bp, Homo sapiens
tattgacaaaatgttatttcc

SEQ ID NO: 5307860 - DNA, 14 bp, Homo sapiens
tattgacaaactct

SEQ ID NO: 5307861 - DNA, 17 bp, Homo sapiens
tattgacaacagtttta

SEQ ID NO: 5307862 - DNA, 13 bp, Homo sapiens
tattgacaataaa

SEQ ID NO: 5307863 - DNA, 20 bp, Homo sapiens
tatttaaaaagaaacagaaa

SEQ ID NO: 5307864 - DNA, 17 bp, Homo sapiens
tatttaaaaagctcttt

SEQ ID NO: 5307865 - DNA, 16 bp, Homo sapiens
tatttaaaaatagaaa

SEQ ID NO: 5307866 - DNA, 16 bp, Homo sapiens
tatttaaaaatatttc

SEQ ID NO: 5307867 - DNA, 13 bp, Homo sapiens
tatttaaaaatgt

SEQ ID NO: 5307868 - DNA, 16 bp, Homo sapiens
tatttaaaaatgtctt

SEQ ID NO: 5307869 - DNA, 15 bp, Homo sapiens
tatttaaaaattgtt

SEQ ID NO: 5307870 - DNA, 22 bp, Homo sapiens
tatttaaaacatttcatgtatt

SEQ ID NO: 5307871 - DNA, 23 bp, Homo sapiens
tatttaaaaccattatttaataa

SEQ ID NO: 5307872 - DNA, 14 bp, Homo sapiens
tatttaaaactctg

SEQ ID NO: 5307873 - DNA, 13 bp, Homo sapiens
tatttaaaagaca

SEQ ID NO: 5307874 - DNA, 14 bp, Homo sapiens
tatttaaaagacaa

SEQ ID NO: 5307875 - DNA, 17 bp, Homo sapiens
tatttaaaagacaaaca

SEQ ID NO: 5307876 - DNA, 23 bp, Homo sapiens
tatttaaaagtataaaactgctt

SEQ ID NO: 5307877 - DNA, 12 bp, Homo sapiens
tatttaaaataa

SEQ ID NO: 5307878 - DNA, 16 bp, Homo sapiens
tatttaaaataaattc

SEQ ID NO: 5307879 - DNA, 15 bp, Homo sapiens
tatttaaaatagcaa

SEQ ID NO: 5307880 - DNA, 16 bp, Homo sapiens
tatttaaaatgatttt

SEQ ID NO: 5307881 - DNA, 23 bp, Homo sapiens
tatttaaaatggtgaatgacact

SEQ ID NO: 5307882 - DNA, 13 bp, Homo sapiens
tatttaaaatgta

SEQ ID NO: 5307883 - DNA, 14 bp, Homo sapiens
tatttaaaattggc

SEQ ID NO: 5307884 - DNA, 15 bp, Homo sapiens
tatttaaaattggca

SEQ ID NO: 5307885 - DNA, 24 bp, Homo sapiens
tatttaaaatttcgttgtccaatt

SEQ ID NO: 5307886 - DNA, 14 bp, Homo sapiens
tatttaaaatttct

SEQ ID NO: 5307887 - DNA, 19 bp, Homo sapiens
tatttaaaccgctaaaaga

SEQ ID NO: 5307888 - DNA, 20 bp, Homo sapiens
tatttaaacctttttcttga

SEQ ID NO: 5307889 - DNA, 17 bp, Homo sapiens
tatttaaactcaagaca

SEQ ID NO: 5307890 - DNA, 24 bp, Homo sapiens
tatttaaactctgttgcaagtgca

SEQ ID NO: 5307891 - DNA, 19 bp, Homo sapiens
tatttaaactgttctgtgt

SEQ ID NO: 5307892 - DNA, 21 bp, Homo sapiens
tatttaaactttcaatatttt

SEQ ID NO: 5307893 - DNA, 19 bp, Homo sapiens
tatttaaagaaagtgaaaa

SEQ ID NO: 5307894 - DNA, 20 bp, Homo sapiens
tatttaaagaatgagaaaca

SEQ ID NO: 5307895 - DNA, 12 bp, Homo sapiens
tatttaaagaca

SEQ ID NO: 5307896 - DNA, 13 bp, Homo sapiens
tatttaaagacaa

SEQ ID NO: 5307897 - DNA, 13 bp, Homo sapiens
tatttaaagcatt

SEQ ID NO: 5307898 - DNA, 14 bp, Homo sapiens
tatttaaagccaaa

SEQ ID NO: 5307899 - DNA, 16 bp, Homo sapiens
tatttaaagccaaatg

SEQ ID NO: 5307900 - DNA, 14 bp, Homo sapiens
tatttaaagggaat

SEQ ID NO: 5307901 - DNA, 15 bp, Homo sapiens
tatttaaagggaatg

SEQ ID NO: 5307902 - DNA, 15 bp, Homo sapiens
tatttaaataaaatc

SEQ ID NO: 5307903 - DNA, 12 bp, Homo sapiens
tatttaaatgca

SEQ ID NO: 5307904 - DNA, 20 bp, Homo sapiens
tatttaaatgcatgtcttaa

SEQ ID NO: 5307905 - DNA, 16 bp, Homo sapiens
tatttaaatgggaata

SEQ ID NO: 5307906 - DNA, 18 bp, Homo sapiens
tatttaaatgtgaatttc

SEQ ID NO: 5307907 - DNA, 16 bp, Homo sapiens
tatttaaatgttgaaa

SEQ ID NO: 5307908 - DNA, 20 bp, Homo sapiens
tatttaaatgttgaaatctt

SEQ ID NO: 5307909 - DNA, 23 bp, Homo sapiens
tatttaaatgtttaacatcattg

SEQ ID NO: 5307910 - DNA, 18 bp, Homo sapiens
tatttaaattacaatttt

SEQ ID NO: 5307911 - DNA, 14 bp, Homo sapiens
tatttaaattcttt

SEQ ID NO: 5307912 - DNA, 15 bp, Homo sapiens
tatttaaattctttt

SEQ ID NO: 5307913 - DNA, 12 bp, Homo sapiens
tatttaaattta

SEQ ID NO: 5307914 - DNA, 16 bp, Homo sapiens
tatttaaatttagtgc

SEQ ID NO: 5307915 - DNA, 17 bp, Homo sapiens
tatttaacaaaaaatgt

SEQ ID NO: 5307916 - DNA, 14 bp, Homo sapiens
tatttaacaaaatt

SEQ ID NO: 5307917 - DNA, 10 bp, Homo sapiens
tatttaacag

SEQ ID NO: 5307918 - DNA, 14 bp, Homo sapiens
tatttaacagaaat

SEQ ID NO: 5307919 - DNA, 16 bp, Homo sapiens
tatttaacagaaattg

SEQ ID NO: 5307920 - DNA, 19 bp, Homo sapiens
tatttaacagaaattgtat

SEQ ID NO: 5307921 - DNA, 13 bp, Homo sapiens
tatttaaccaaag

SEQ ID NO: 5307922 - DNA, 13 bp, Homo sapiens
tatttaactaatt

SEQ ID NO: 5307923 - DNA, 16 bp, Homo sapiens
tatttaactctcttta

SEQ ID NO: 5307924 - DNA, 11 bp, Homo sapiens
tatttaactga

SEQ ID NO: 5307925 - DNA, 21 bp, Homo sapiens
tatttaactgattaaaaatac

SEQ ID NO: 5307926 - DNA, 23 bp, Homo sapiens
tatttaacttaacccagatttta

SEQ ID NO: 5307927 - DNA, 13 bp, Homo sapiens
tatttaacttttt

SEQ ID NO: 5307928 - DNA, 17 bp, Homo sapiens
tatttaagaaaagcact

SEQ ID NO: 5307929 - DNA, 20 bp, Homo sapiens
tatttaagaaaatacaataa

SEQ ID NO: 5307930 - DNA, 21 bp, Homo sapiens
tatttaagaaaatacaataaa

SEQ ID NO: 5307931 - DNA, 22 bp, Homo sapiens
tatttaagaaaatacaataaac

SEQ ID NO: 5307932 - DNA, 19 bp, Homo sapiens
tatttaagaaagggaaagc

SEQ ID NO: 5307933 - DNA, 14 bp, Homo sapiens
tatttaagaagaat

SEQ ID NO: 5307934 - DNA, 16 bp, Homo sapiens
tatttaagaagaatga

SEQ ID NO: 5307935 - DNA, 18 bp, Homo sapiens
tatttaagaagccaaggg

SEQ ID NO: 5307936 - DNA, 12 bp, Homo sapiens
tatttaagacat

SEQ ID NO: 5307937 - DNA, 13 bp, Homo sapiens
tatttaagacata

SEQ ID NO: 5307938 - DNA, 19 bp, Homo sapiens
tatttaagacataaacaaa

SEQ ID NO: 5307939 - DNA, 13 bp, Homo sapiens
tatttaagactga

SEQ ID NO: 5307940 - DNA, 17 bp, Homo sapiens
tatttaagactgataat

SEQ ID NO: 5307941 - DNA, 20 bp, Homo sapiens
tatttaagatagttttgcca

SEQ ID NO: 5307942 - DNA, 19 bp, Homo sapiens
tatttaagatgtacattta

SEQ ID NO: 5307943 - DNA, 21 bp, Homo sapiens
tatttaagatgtacatttaat

SEQ ID NO: 5307944 - DNA, 13 bp, Homo sapiens
tatttaagcaaat

SEQ ID NO: 5307945 - DNA, 17 bp, Homo sapiens
tatttaagcaaatactt

SEQ ID NO: 5307946 - DNA, 17 bp, Homo sapiens
tatttaagcaacatctt

SEQ ID NO: 5307947 - DNA, 18 bp, Homo sapiens
tatttaagcaacatcttt

SEQ ID NO: 5307948 - DNA, 21 bp, Homo sapiens
tatttaagcaacatcttttta

SEQ ID NO: 5307949 - DNA, 12 bp, Homo sapiens
tatttaagcaat

SEQ ID NO: 5307950 - DNA, 15 bp, Homo sapiens
tatttaagcaataaa

SEQ ID NO: 5307951 - DNA, 16 bp, Homo sapiens
tatttaagccccctct

SEQ ID NO: 5307952 - DNA, 18 bp, Homo sapiens
tatttaagcctaaagatt

SEQ ID NO: 5307953 - DNA, 22 bp, Homo sapiens
tatttaagcctaaagattttga

SEQ ID NO: 5307954 - DNA, 24 bp, Homo sapiens
tatttaagcctaaagattttgatc

SEQ ID NO: 5307955 - DNA, 18 bp, Homo sapiens
tatttaagcctcatattt

SEQ ID NO: 5307956 - DNA, 16 bp, Homo sapiens
tatttaagcttatgtc

SEQ ID NO: 5307957 - DNA, 22 bp, Homo sapiens
tatttaagctttaaatgacagt

SEQ ID NO: 5307958 - DNA, 16 bp, Homo sapiens
tatttaaggaatcaaa

SEQ ID NO: 5307959 - DNA, 17 bp, Homo sapiens
tatttaaggaatcaaat

SEQ ID NO: 5307960 - DNA, 16 bp, Homo sapiens
tatttaaggatggatg

SEQ ID NO: 5307961 - DNA, 17 bp, Homo sapiens
tatttaaggatggatgg

SEQ ID NO: 5307962 - DNA, 18 bp, Homo sapiens
tatttaaggtagcttcag

SEQ ID NO: 5307963 - DNA, 20 bp, Homo sapiens
tatttaagtaactttaaatt

SEQ ID NO: 5307964 - DNA, 16 bp, Homo sapiens
tatttaagtatatagt

SEQ ID NO: 5307965 - DNA, 19 bp, Homo sapiens
tatttaagtatatagtata

SEQ ID NO: 5307966 - DNA, 22 bp, Homo sapiens
tatttaagtatatagtatattt

SEQ ID NO: 5307967 - DNA, 16 bp, Homo sapiens
tatttaagtatggaat

SEQ ID NO: 5307968 - DNA, 15 bp, Homo sapiens
tatttaagtattcaa

SEQ ID NO: 5307969 - DNA, 19 bp, Homo sapiens
tatttaagttatcaacttt

SEQ ID NO: 5307970 - DNA, 20 bp, Homo sapiens
tatttaagttatcaacttta

SEQ ID NO: 5307971 - DNA, 11 bp, Homo sapiens
tatttaataac

SEQ ID NO: 5307972 - DNA, 17 bp, Homo sapiens
tatttaataacaattgt

SEQ ID NO: 5307973 - DNA, 15 bp, Homo sapiens
tatttaataacatta

SEQ ID NO: 5307974 - DNA, 23 bp, Homo sapiens
tatttaatacagctgaagtcaaa

SEQ ID NO: 5307975 - DNA, 22 bp, Homo sapiens
tatttaataccaccaacaaata

SEQ ID NO: 5307976 - DNA, 13 bp, Homo sapiens
tatttaatagcaa

SEQ ID NO: 5307977 - DNA, 14 bp, Homo sapiens
tatttaataggttt

SEQ ID NO: 5307978 - DNA, 13 bp, Homo sapiens
tatttaatatcaa

SEQ ID NO: 5307979 - DNA, 14 bp, Homo sapiens
tatttaatatgtca

SEQ ID NO: 5307980 - DNA, 21 bp, Homo sapiens
tatttaatgaaagactgtaca

SEQ ID NO: 5307981 - DNA, 17 bp, Homo sapiens
tatttaatgatttttgt

SEQ ID NO: 5307982 - DNA, 12 bp, Homo sapiens
tatttaatgttg

SEQ ID NO: 5307983 - DNA, 13 bp, Homo sapiens
tatttaatgttga

SEQ ID NO: 5307984 - DNA, 18 bp, Homo sapiens
tatttaatgttgaacaaa

SEQ ID NO: 5307985 - DNA, 23 bp, Homo sapiens
tatttaatgttgaacaaaataaa

SEQ ID NO: 5307986 - DNA, 12 bp, Homo sapiens
tatttaatgttt

SEQ ID NO: 5307987 - DNA, 15 bp, Homo sapiens
tatttaatgttttaa

SEQ ID NO: 5307988 - DNA, 22 bp, Homo sapiens
tatttaatgttttaaatgtaca

SEQ ID NO: 5307989 - DNA, 13 bp, Homo sapiens
tatttaattaaaa

SEQ ID NO: 5307990 - DNA, 15 bp, Homo sapiens
tatttaattaaagca

SEQ ID NO: 5307991 - DNA, 16 bp, Homo sapiens
tatttaattagtgcta

SEQ ID NO: 5307992 - DNA, 16 bp, Homo sapiens
tatttaattataaaaa

SEQ ID NO: 5307993 - DNA, 18 bp, Homo sapiens
tatttaattatattatga

SEQ ID NO: 5307994 - DNA, 22 bp, Homo sapiens
tatttaattctttctattttca

SEQ ID NO: 5307995 - DNA, 15 bp, Homo sapiens
tatttaattgtaaac

SEQ ID NO: 5307996 - DNA, 19 bp, Homo sapiens
tatttaatttcataaattg

SEQ ID NO: 5307997 - DNA, 20 bp, Homo sapiens
tatttaatttcataaattgg

SEQ ID NO: 5307998 - DNA, 16 bp, Homo sapiens
tatttaatttgaaggt

SEQ ID NO: 5307999 - DNA, 23 bp, Homo sapiens
tatttaatttgaaggtagaatgt

SEQ ID NO: 5308000 - DNA, 14 bp, Homo sapiens
tatttaatttgtat

SEQ ID NO: 5308001 - DNA, 20 bp, Homo sapiens
tatttaatttttacatgacc

SEQ ID NO: 5308002 - DNA, 14 bp, Homo sapiens
tatttacaaatgtt

SEQ ID NO: 5308003 - DNA, 21 bp, Homo sapiens
tatttacaaatgttttgctca

SEQ ID NO: 5308004 - DNA, 20 bp, Homo sapiens
tatttacaagctatttttgc

SEQ ID NO: 5308005 - DNA, 14 bp, Homo sapiens
tatttacaatgtat

SEQ ID NO: 5308006 - DNA, 15 bp, Homo sapiens
tatttacaatgtatt

SEQ ID NO: 5308007 - DNA, 16 bp, Homo sapiens
tatttacaatgtatta

SEQ ID NO: 5308008 - DNA, 17 bp, Homo sapiens
tatttacaatgtattaa

SEQ ID NO: 5308009 - DNA, 15 bp, Homo sapiens
tatttacagaagaaa

SEQ ID NO: 5308010 - DNA, 23 bp, Homo sapiens
tatttacagaagaaaagcatgca

SEQ ID NO: 5308011 - DNA, 20 bp, Homo sapiens
tatttacagtgaaaatgtaa

SEQ ID NO: 5308012 - DNA, 13 bp, Homo sapiens
tatttacatataa

SEQ ID NO: 5308013 - DNA, 17 bp, Homo sapiens
tatttacatatgaaatt

SEQ ID NO: 5308014 - DNA, 21 bp, Homo sapiens
tatttacatatgaaatttaat

SEQ ID NO: 5308015 - DNA, 21 bp, Homo sapiens
tatttacatgaattgcatttt

SEQ ID NO: 5308016 - DNA, 19 bp, Homo sapiens
tatttacatgctactaaat

SEQ ID NO: 5308017 - DNA, 10 bp, Homo sapiens
tatttacatt

SEQ ID NO: 5308018 - DNA, 14 bp, Homo sapiens
tatttacctcagcc

SEQ ID NO: 5308019 - DNA, 18 bp, Homo sapiens
tatttacctgtatttaag

SEQ ID NO: 5308020 - DNA, 15 bp, Homo sapiens
tatttaccttgaaaa

SEQ ID NO: 5308021 - DNA, 22 bp, Homo sapiens
tatttaccttttaagacatttt

SEQ ID NO: 5308022 - DNA, 19 bp, Homo sapiens
tatttacgctttgattcat

SEQ ID NO: 5308023 - DNA, 16 bp, Homo sapiens
tatttactaaaagaat

SEQ ID NO: 5308024 - DNA, 14 bp, Homo sapiens
tatttactacctta

SEQ ID NO: 5308025 - DNA, 16 bp, Homo sapiens
tatttactctttgcaa

SEQ ID NO: 5308026 - DNA, 16 bp, Homo sapiens
tatttactgagcttct

SEQ ID NO: 5308027 - DNA, 22 bp, Homo sapiens
tatttactgagcttctctgtga

SEQ ID NO: 5308028 - DNA, 15 bp, Homo sapiens
tatttactgcaatgt

SEQ ID NO: 5308029 - DNA, 16 bp, Homo sapiens
tatttactgcaatgtc

SEQ ID NO: 5308030 - DNA, 19 bp, Homo sapiens
tatttactgcaatgtctgt

SEQ ID NO: 5308031 - DNA, 14 bp, Homo sapiens
tatttactgtacta

SEQ ID NO: 5308032 - DNA, 12 bp, Homo sapiens
tatttactgttt

SEQ ID NO: 5308033 - DNA, 16 bp, Homo sapiens
tatttacttactgcta

SEQ ID NO: 5308034 - DNA, 19 bp, Homo sapiens
tatttacttgtagaaatct

SEQ ID NO: 5308035 - DNA, 23 bp, Homo sapiens
tatttacttttaccactatttaa

SEQ ID NO: 5308036 - DNA, 17 bp, Homo sapiens
tatttactttttaaaaa

SEQ ID NO: 5308037 - DNA, 22 bp, Homo sapiens
tatttactttttcggtttcaaa

SEQ ID NO: 5308038 - DNA, 15 bp, Homo sapiens
tatttagaactttgt

SEQ ID NO: 5308039 - DNA, 17 bp, Homo sapiens
tatttagaactttgtat

SEQ ID NO: 5308040 - DNA, 13 bp, Homo sapiens
tatttagaagcag

SEQ ID NO: 5308041 - DNA, 15 bp, Homo sapiens
tatttagacaagaga

SEQ ID NO: 5308042 - DNA, 23 bp, Homo sapiens
tatttagatgataaagagacagt

SEQ ID NO: 5308043 - DNA, 18 bp, Homo sapiens
tcaagacagggaaggatg

SEQ ID NO: 5308044 - DNA, 17 bp, Homo sapiens
tcaagacattaaatcta

SEQ ID NO: 5308045 - DNA, 17 bp, Homo sapiens
tcaagacatttgctgaa

SEQ ID NO: 5308046 - DNA, 14 bp, Homo sapiens
tcaagaccaaagag

SEQ ID NO: 5308047 - DNA, 19 bp, Homo sapiens
tcaagaccaaatggaaaca

SEQ ID NO: 5308048 - DNA, 14 bp, Homo sapiens
tcaagaccagcctg

SEQ ID NO: 5308049 - DNA, 15 bp, Homo sapiens
tcaagaccagcctgg

SEQ ID NO: 5308050 - DNA, 16 bp, Homo sapiens
tcaagaccagcctggg

SEQ ID NO: 5308051 - DNA, 18 bp, Homo sapiens
tcaagaccagcctggtca

SEQ ID NO: 5308052 - DNA, 16 bp, Homo sapiens
tcaagacccctgtctt

SEQ ID NO: 5308053 - DNA, 12 bp, Homo sapiens
tcaagacctgag

SEQ ID NO: 5308054 - DNA, 16 bp, Homo sapiens
tcaagacgaggggcag

SEQ ID NO: 5308055 - DNA, 18 bp, Homo sapiens
tcaagacgaggggcaggg

SEQ ID NO: 5308056 - DNA, 18 bp, Homo sapiens
tcaagacggatccacagt

SEQ ID NO: 5308057 - DNA, 17 bp, Homo sapiens
tcaagactcaatgtgga

SEQ ID NO: 5308058 - DNA, 17 bp, Homo sapiens
tcaagactgaattccaa

SEQ ID NO: 5308059 - DNA, 20 bp, Homo sapiens
tcaagactggaaggtgggga

SEQ ID NO: 5308060 - DNA, 13 bp, Homo sapiens
tcaagacttctcc

SEQ ID NO: 5308061 - DNA, 14 bp, Homo sapiens
tcaagactttagct

SEQ ID NO: 5308062 - DNA, 15 bp, Homo sapiens
tcaagagaaacttca

SEQ ID NO: 5308063 - DNA, 14 bp, Homo sapiens
tcaagagaatcaac

SEQ ID NO: 5308064 - DNA, 16 bp, Homo sapiens
tcaagagacactcccc

SEQ ID NO: 5308065 - DNA, 16 bp, Homo sapiens
tcaagagactcctgaa

SEQ ID NO: 5308066 - DNA, 15 bp, Homo sapiens
tcaagagagacaaaa

SEQ ID NO: 5308067 - DNA, 19 bp, Homo sapiens
tcaagagagtaatgggttt

SEQ ID NO: 5308068 - DNA, 21 bp, Homo sapiens
tcaagagcattgcttttgttt

SEQ ID NO: 5308069 - DNA, 21 bp, Homo sapiens
tcaagagccaagacacaggta

SEQ ID NO: 5308070 - DNA, 11 bp, Homo sapiens
tcaagagcctt

SEQ ID NO: 5308071 - DNA, 17 bp, Homo sapiens
tcaagagccttaaaaca

SEQ ID NO: 5308072 - DNA, 18 bp, Homo sapiens
tcaagagccttaaaacat

SEQ ID NO: 5308073 - DNA, 21 bp, Homo sapiens
tcaagagccttaaaacatcat

SEQ ID NO: 5308074 - DNA, 20 bp, Homo sapiens
tcaagagctagaaaaataaa

SEQ ID NO: 5308075 - DNA, 22 bp, Homo sapiens
tcaagaggacaatctagctctc

SEQ ID NO: 5308076 - DNA, 13 bp, Homo sapiens
tcaagaggagccc

SEQ ID NO: 5308077 - DNA, 20 bp, Homo sapiens
tcaagaggagcccccaccct

SEQ ID NO: 5308078 - DNA, 18 bp, Homo sapiens
tcaagaggataaatttta

SEQ ID NO: 5308079 - DNA, 22 bp, Homo sapiens
tcaagaggcaggttagaagaac

SEQ ID NO: 5308080 - DNA, 11 bp, Homo sapiens
tcaagaggccc

SEQ ID NO: 5308081 - DNA, 14 bp, Homo sapiens
tcaagaggcccagg

SEQ ID NO: 5308082 - DNA, 18 bp, Homo sapiens
tcaagaggcgtgtgcagg

SEQ ID NO: 5308083 - DNA, 22 bp, Homo sapiens
tcaagaggcgtgtgcaggccga

SEQ ID NO: 5308084 - DNA, 23 bp, Homo sapiens
tcaagagggaggaaggggcccca

SEQ ID NO: 5308085 - DNA, 19 bp, Homo sapiens
tcaagaggtgggagggccc

SEQ ID NO: 5308086 - DNA, 16 bp, Homo sapiens
tcaagagtctctccag

SEQ ID NO: 5308087 - DNA, 17 bp, Homo sapiens
tcaagagtctctccagc

SEQ ID NO: 5308088 - DNA, 20 bp, Homo sapiens
tcaagagtctctccagcctc

SEQ ID NO: 5308089 - DNA, 19 bp, Homo sapiens
tcaagagtgaattccctca

SEQ ID NO: 5308090 - DNA, 22 bp, Homo sapiens
tcaagagtgcagttgattctga

SEQ ID NO: 5308091 - DNA, 16 bp, Homo sapiens
tcaagagtggggggag

SEQ ID NO: 5308092 - DNA, 23 bp, Homo sapiens
tcaagagtggggggaggaagcag

SEQ ID NO: 5308093 - DNA, 13 bp, Homo sapiens
tcaagataaagga

SEQ ID NO: 5308094 - DNA, 17 bp, Homo sapiens
tcaagataaaggacagt

SEQ ID NO: 5308095 - DNA, 19 bp, Homo sapiens
tcaagatacatttcatctg

SEQ ID NO: 5308096 - DNA, 15 bp, Homo sapiens
tcaagatacctttgc

SEQ ID NO: 5308097 - DNA, 21 bp, Homo sapiens
tcaagatactgctactgtaat

SEQ ID NO: 5308098 - DNA, 20 bp, Homo sapiens
tcaagatatatgtgtataca

SEQ ID NO: 5308099 - DNA, 16 bp, Homo sapiens
tcaagatattaaaatg

SEQ ID NO: 5308100 - DNA, 17 bp, Homo sapiens
tcaagatcaaaaaggct

SEQ ID NO: 5308101 - DNA, 23 bp, Homo sapiens
tcaagatcaaaaaggcttataaa

SEQ ID NO: 5308102 - DNA, 16 bp, Homo sapiens
tcaagatcaacattcc

SEQ ID NO: 5308103 - DNA, 23 bp, Homo sapiens
tcaagatccaaatgctgtgcaaa

SEQ ID NO: 5308104 - DNA, 13 bp, Homo sapiens
tcaagatcttcaa

SEQ ID NO: 5308105 - DNA, 19 bp, Homo sapiens
tcaagatcttcaaccatga

SEQ ID NO: 5308106 - DNA, 15 bp, Homo sapiens
tcaagatgacagctc

SEQ ID NO: 5308107 - DNA, 14 bp, Homo sapiens
tcaagatgagatat

SEQ ID NO: 5308108 - DNA, 15 bp, Homo sapiens
tcaagatgagcctgg

SEQ ID NO: 5308109 - DNA, 22 bp, Homo sapiens
tcaagatgatgatgatctttaa

SEQ ID NO: 5308110 - DNA, 20 bp, Homo sapiens
tcaagatgcctcctgtcaga

SEQ ID NO: 5308111 - DNA, 20 bp, Homo sapiens
tcaagatgggtgattatgaa

SEQ ID NO: 5308112 - DNA, 18 bp, Homo sapiens
tcaagatgtcagactggc

SEQ ID NO: 5308113 - DNA, 20 bp, Homo sapiens
tcaagatgtcctccttgttc

SEQ ID NO: 5308114 - DNA, 16 bp, Homo sapiens
tcaagatgttatatta

SEQ ID NO: 5308115 - DNA, 22 bp, Homo sapiens
tcaagattaagttataccagca

SEQ ID NO: 5308116 - DNA, 20 bp, Homo sapiens
tcaagattatattataataa

SEQ ID NO: 5308117 - DNA, 15 bp, Homo sapiens
tcaagattcagctag

SEQ ID NO: 5308118 - DNA, 17 bp, Homo sapiens
tcaagattcccaggagt

SEQ ID NO: 5308119 - DNA, 21 bp, Homo sapiens
tcaagattcccggctggactt

SEQ ID NO: 5308120 - DNA, 22 bp, Homo sapiens
tcaagattcccggctggacttt

SEQ ID NO: 5308121 - DNA, 19 bp, Homo sapiens
tcaagattctaaagctcaa

SEQ ID NO: 5308122 - DNA, 20 bp, Homo sapiens
tcaagattctaaagctcaat

SEQ ID NO: 5308123 - DNA, 15 bp, Homo sapiens
tcaagattctacttg

SEQ ID NO: 5308124 - DNA, 16 bp, Homo sapiens
tcaagattgttcctgc

SEQ ID NO: 5308125 - DNA, 19 bp, Homo sapiens
tcaagattgttcctgcttt

SEQ ID NO: 5308126 - DNA, 15 bp, Homo sapiens
tcaagatttgaccaa

SEQ ID NO: 5308127 - DNA, 16 bp, Homo sapiens
tcaagatttggcagga

SEQ ID NO: 5308128 - DNA, 20 bp, Homo sapiens
tcaagcaaaatttctgtata

SEQ ID NO: 5308129 - DNA, 23 bp, Homo sapiens
tcaagcaaagtattgtgaaagta

SEQ ID NO: 5308130 - DNA, 14 bp, Homo sapiens
tcaagcaaggaagc

SEQ ID NO: 5308131 - DNA, 18 bp, Homo sapiens
tcaagcaaggaagcagag

SEQ ID NO: 5308132 - DNA, 18 bp, Homo sapiens
tcaagcaagtttaatcaa

SEQ ID NO: 5308133 - DNA, 18 bp, Homo sapiens
tcaagcaataattgtttc

SEQ ID NO: 5308134 - DNA, 20 bp, Homo sapiens
tcaagcaataattgtttcca

SEQ ID NO: 5308135 - DNA, 19 bp, Homo sapiens
tcaagcaatccacctgcct

SEQ ID NO: 5308136 - DNA, 14 bp, Homo sapiens
tcaagcaatcctcc

SEQ ID NO: 5308137 - DNA, 18 bp, Homo sapiens
tcaagcaatcctcctgag

SEQ ID NO: 5308138 - DNA, 19 bp, Homo sapiens
tcaagcaatcctcctgagt

SEQ ID NO: 5308139 - DNA, 22 bp, Homo sapiens
tcaagcaatcctcctgcctcag

SEQ ID NO: 5308140 - DNA, 19 bp, Homo sapiens
tcaagcaatcgagatttgg

SEQ ID NO: 5308141 - DNA, 17 bp, Homo sapiens
tcaagcacactggaata

SEQ ID NO: 5308142 - DNA, 13 bp, Homo sapiens
tcaagcacatgta

SEQ ID NO: 5308143 - DNA, 17 bp, Homo sapiens
tcaagcaccctgttccc

SEQ ID NO: 5308144 - DNA, 23 bp, Homo sapiens
tcaagcactaaaaagttgaacca

SEQ ID NO: 5308145 - DNA, 12 bp, Homo sapiens
tcaagcactgat

SEQ ID NO: 5308146 - DNA, 19 bp, Homo sapiens
tcaagcacttcccaggatc

SEQ ID NO: 5308147 - DNA, 21 bp, Homo sapiens
tcaagcacttcccaggatctg

SEQ ID NO: 5308148 - DNA, 19 bp, Homo sapiens
tcaagcagaaaaacaggca

SEQ ID NO: 5308149 - DNA, 21 bp, Homo sapiens
tcaagcagacatagaagagcc

SEQ ID NO: 5308150 - DNA, 17 bp, Homo sapiens
tcaagcagattggagaa

SEQ ID NO: 5308151 - DNA, 19 bp, Homo sapiens
tcaagcaggtttcttgctt

SEQ ID NO: 5308152 - DNA, 14 bp, Homo sapiens
tcaagcagtcctcc

SEQ ID NO: 5308153 - DNA, 16 bp, Homo sapiens
tcaagcagtcgtgcct

SEQ ID NO: 5308154 - DNA, 17 bp, Homo sapiens
tcaagcagtcgtgcctg

SEQ ID NO: 5308155 - DNA, 20 bp, Homo sapiens
tcaagcagtcgtgcctgtgt

SEQ ID NO: 5308156 - DNA, 18 bp, Homo sapiens
tcaagcatctcctgagga

SEQ ID NO: 5308157 - DNA, 14 bp, Homo sapiens
tcaagcatgaagat

SEQ ID NO: 5308158 - DNA, 16 bp, Homo sapiens
tcaagcatgaagataa

SEQ ID NO: 5308159 - DNA, 13 bp, Homo sapiens
tcaagcatgcaat

SEQ ID NO: 5308160 - DNA, 20 bp, Homo sapiens
tcaagcatgcaataatgtgc

SEQ ID NO: 5308161 - DNA, 15 bp, Homo sapiens
tcaagcatgtatttt

SEQ ID NO: 5308162 - DNA, 18 bp, Homo sapiens
tcaagcatgtttaaaaca

SEQ ID NO: 5308163 - DNA, 15 bp, Homo sapiens
tcaagcattctgttt

SEQ ID NO: 5308164 - DNA, 15 bp, Homo sapiens
tcaagcatttaggaa

SEQ ID NO: 5308165 - DNA, 18 bp, Homo sapiens
tcaagccaatcccctcct

SEQ ID NO: 5308166 - DNA, 20 bp, Homo sapiens
tcaagccaatcccctccttg

SEQ ID NO: 5308167 - DNA, 21 bp, Homo sapiens
tcaagccaatcccctccttgg

SEQ ID NO: 5308168 - DNA, 20 bp, Homo sapiens
tcaagccagccccctccagc

SEQ ID NO: 5308169 - DNA, 17 bp, Homo sapiens
tcaagccagctctaggc

SEQ ID NO: 5308170 - DNA, 21 bp, Homo sapiens
tcaagccagctctaggcttca

SEQ ID NO: 5308171 - DNA, 15 bp, Homo sapiens
tcaagccaggagacc

SEQ ID NO: 5308172 - DNA, 18 bp, Homo sapiens
tcaagccaggagaccctg

SEQ ID NO: 5308173 - DNA, 19 bp, Homo sapiens
tcaagccaggagaccctgt

SEQ ID NO: 5308174 - DNA, 17 bp, Homo sapiens
tcaagccattctgcctc

SEQ ID NO: 5308175 - DNA, 14 bp, Homo sapiens
tcaagcccaggagg

SEQ ID NO: 5308176 - DNA, 19 bp, Homo sapiens
tcaagcccaggaggactgc

SEQ ID NO: 5308177 - DNA, 15 bp, Homo sapiens
tcaagcccaggaggg

SEQ ID NO: 5308178 - DNA, 22 bp, Homo sapiens
tcaagcccaggcttcctgggtc

SEQ ID NO: 5308179 - DNA, 24 bp, Homo sapiens
tcaagccccagcagccctcaacag

SEQ ID NO: 5308180 - DNA, 16 bp, Homo sapiens
tcaagccccggactca

SEQ ID NO: 5308181 - DNA, 16 bp, Homo sapiens
tcaagccctgaggggc

SEQ ID NO: 5308182 - DNA, 13 bp, Homo sapiens
tcaagccctgcag

SEQ ID NO: 5308183 - DNA, 16 bp, Homo sapiens
tcaagccgcaagctct

SEQ ID NO: 5308184 - DNA, 13 bp, Homo sapiens
tcaagcctctaaa

SEQ ID NO: 5308185 - DNA, 12 bp, Homo sapiens
tcaagcctgaga

SEQ ID NO: 5308186 - DNA, 17 bp, Homo sapiens
tcaagcctgcagcgagc

SEQ ID NO: 5308187 - DNA, 15 bp, Homo sapiens
tcaagcctgtgaata

SEQ ID NO: 5308188 - DNA, 19 bp, Homo sapiens
tcaagcctgtgcaaaaaaa

SEQ ID NO: 5308189 - DNA, 13 bp, Homo sapiens
tcaagcctgtggg

SEQ ID NO: 5308190 - DNA, 20 bp, Homo sapiens
tcaagcctgtgggagtagaa

SEQ ID NO: 5308191 - DNA, 16 bp, Homo sapiens
tcaagcctgtgggcag

SEQ ID NO: 5308192 - DNA, 19 bp, Homo sapiens
tcaagcctttatggctgct

SEQ ID NO: 5308193 - DNA, 21 bp, Homo sapiens
tcaagcgattctcctgcctca

SEQ ID NO: 5308194 - DNA, 19 bp, Homo sapiens
tcaagcgattcttctgctt

SEQ ID NO: 5308195 - DNA, 20 bp, Homo sapiens
tcaagcgattcttgtgcctc

SEQ ID NO: 5308196 - DNA, 23 bp, Homo sapiens
tcaagctaaatattgtttacatt

SEQ ID NO: 5308197 - DNA, 16 bp, Homo sapiens
tcaagctagaaggcca

SEQ ID NO: 5308198 - DNA, 16 bp, Homo sapiens
tcaagctagtgtttct

SEQ ID NO: 5308199 - DNA, 15 bp, Homo sapiens
tcaagctatttaata

SEQ ID NO: 5308200 - DNA, 18 bp, Homo sapiens
tcaagctcatgtcattat

SEQ ID NO: 5308201 - DNA, 13 bp, Homo sapiens
tcaagctcctcct

SEQ ID NO: 5308202 - DNA, 14 bp, Homo sapiens
tcaagctcctcctc

SEQ ID NO: 5308203 - DNA, 16 bp, Homo sapiens
tcaagctcctcctccc

SEQ ID NO: 5308204 - DNA, 18 bp, Homo sapiens
tcaagctcctcctccctg

SEQ ID NO: 5308205 - DNA, 20 bp, Homo sapiens
tcaagctcctcctccctgca

SEQ ID NO: 5308206 - DNA, 11 bp, Homo sapiens
tcaagctctga

SEQ ID NO: 5308207 - DNA, 13 bp, Homo sapiens
tcaagctgagaaa

SEQ ID NO: 5308208 - DNA, 16 bp, Homo sapiens
tcaagctgagctggct

SEQ ID NO: 5308209 - DNA, 21 bp, Homo sapiens
tcaagctgagtattaaaatgt

SEQ ID NO: 5308210 - DNA, 14 bp, Homo sapiens
tcaagctgcttgga

SEQ ID NO: 5308211 - DNA, 18 bp, Homo sapiens
tcaagctgtcccctctgt

SEQ ID NO: 5308212 - DNA, 19 bp, Homo sapiens
tcaagctgtcccctctgtc

SEQ ID NO: 5308213 - DNA, 22 bp, Homo sapiens
tcaagctgttatttcttccctg

SEQ ID NO: 5308214 - DNA, 18 bp, Homo sapiens
tcaagcttagtgagcagt

SEQ ID NO: 5308215 - DNA, 19 bp, Homo sapiens
tcaagcttcagtttcctgg

SEQ ID NO: 5308216 - DNA, 14 bp, Homo sapiens
tcaagcttcatata

SEQ ID NO: 5308217 - DNA, 11 bp, Homo sapiens
tcaagcttgtg

SEQ ID NO: 5308218 - DNA, 12 bp, Homo sapiens
tcaagctttccc

SEQ ID NO: 5308219 - DNA, 13 bp, Homo sapiens
tcaagcttttcct

SEQ ID NO: 5308220 - DNA, 17 bp, Homo sapiens
tcaagcttttcctttct

SEQ ID NO: 5308221 - DNA, 18 bp, Homo sapiens
tcaatccagatggtggga

SEQ ID NO: 5308222 - DNA, 19 bp, Homo sapiens
tcaatccagcggttctcaa

SEQ ID NO: 5308223 - DNA, 18 bp, Homo sapiens
tcaatccaggatgttatt

SEQ ID NO: 5308224 - DNA, 24 bp, Homo sapiens
tcaatccatcagcaatgcttctct

SEQ ID NO: 5308225 - DNA, 20 bp, Homo sapiens
tcaatccatccatgtacttc

SEQ ID NO: 5308226 - DNA, 13 bp, Homo sapiens
tcaatcccaaaag

SEQ ID NO: 5308227 - DNA, 12 bp, Homo sapiens
tcaatccccata

SEQ ID NO: 5308228 - DNA, 21 bp, Homo sapiens
tcaatcctaatttctcctccc

SEQ ID NO: 5308229 - DNA, 14 bp, Homo sapiens
tcaatcctggtaac

SEQ ID NO: 5308230 - DNA, 13 bp, Homo sapiens
tcaatcctgtcaa

SEQ ID NO: 5308231 - DNA, 16 bp, Homo sapiens
tcaatcctgttaagag

SEQ ID NO: 5308232 - DNA, 17 bp, Homo sapiens
tcaatcctgttaagaga

SEQ ID NO: 5308233 - DNA, 21 bp, Homo sapiens
tcaatctaggcgaggcgaagc

SEQ ID NO: 5308234 - DNA, 16 bp, Homo sapiens
tcaatctatcaattac

SEQ ID NO: 5308235 - DNA, 24 bp, Homo sapiens
tcaatctcgtatagaagtcttcat

SEQ ID NO: 5308236 - DNA, 15 bp, Homo sapiens
tcaatctctcttaga

SEQ ID NO: 5308237 - DNA, 11 bp, Homo sapiens
tcaatctctgt

SEQ ID NO: 5308238 - DNA, 19 bp, Homo sapiens
tcaatctggattcatattt

SEQ ID NO: 5308239 - DNA, 16 bp, Homo sapiens
tcaatctgtttttcat

SEQ ID NO: 5308240 - DNA, 15 bp, Homo sapiens
tcaatcttctacttt

SEQ ID NO: 5308241 - DNA, 20 bp, Homo sapiens
tcaatcttgcatgtaacgca

SEQ ID NO: 5308242 - DNA, 15 bp, Homo sapiens
tcaatcttgttactg

SEQ ID NO: 5308243 - DNA, 15 bp, Homo sapiens
tcaatcttttaaatt

SEQ ID NO: 5308244 - DNA, 12 bp, Homo sapiens
tcaatgaaaaat

SEQ ID NO: 5308245 - DNA, 15 bp, Homo sapiens
tcaatgaaacaaaga

SEQ ID NO: 5308246 - DNA, 17 bp, Homo sapiens
tcaatgaacaagcattc

SEQ ID NO: 5308247 - DNA, 15 bp, Homo sapiens
tcaatgaagccagct

SEQ ID NO: 5308248 - DNA, 16 bp, Homo sapiens
tcaatgaatccccgac

SEQ ID NO: 5308249 - DNA, 16 bp, Homo sapiens
tcaatgaattaagaaa

SEQ ID NO: 5308250 - DNA, 18 bp, Homo sapiens
tcaatgaattaagaaaga

SEQ ID NO: 5308251 - DNA, 18 bp, Homo sapiens
tcaatgaattaattcaga

SEQ ID NO: 5308252 - DNA, 20 bp, Homo sapiens
tcaatgaccattcaattagt

SEQ ID NO: 5308253 - DNA, 13 bp, Homo sapiens
tcaatgagcatgt

SEQ ID NO: 5308254 - DNA, 14 bp, Homo sapiens
tcaatgagcatgtt

SEQ ID NO: 5308255 - DNA, 19 bp, Homo sapiens
tcaatgagcatgtttagac

SEQ ID NO: 5308256 - DNA, 16 bp, Homo sapiens
tcaatgaggtgtccaa

SEQ ID NO: 5308257 - DNA, 20 bp, Homo sapiens
tcaatgataaatttaaatga

SEQ ID NO: 5308258 - DNA, 15 bp, Homo sapiens
tcaatgatctaggtt

SEQ ID NO: 5308259 - DNA, 17 bp, Homo sapiens
tcaatgatctaggttta

SEQ ID NO: 5308260 - DNA, 22 bp, Homo sapiens
tcaatgatctaggtttaactca

SEQ ID NO: 5308261 - DNA, 13 bp, Homo sapiens
tcaatgcaatgca

SEQ ID NO: 5308262 - DNA, 18 bp, Homo sapiens
tcaatgcaatgcatctga

SEQ ID NO: 5308263 - DNA, 13 bp, Homo sapiens
tcaatgcagcccc

SEQ ID NO: 5308264 - DNA, 15 bp, Homo sapiens
tcaatgcagttctca

SEQ ID NO: 5308265 - DNA, 19 bp, Homo sapiens
tcaatgcagttgtctctgt

SEQ ID NO: 5308266 - DNA, 17 bp, Homo sapiens
tcaatgcatacaataaa

SEQ ID NO: 5308267 - DNA, 23 bp, Homo sapiens
tcaatgcatacaataaaagagct

SEQ ID NO: 5308268 - DNA, 17 bp, Homo sapiens
tcaatgcatgatgactc

SEQ ID NO: 5308269 - DNA, 22 bp, Homo sapiens
tcaatgcatgatgactcttctt

SEQ ID NO: 5308270 - DNA, 21 bp, Homo sapiens
tcaatgcattgtcttgtggag

SEQ ID NO: 5308271 - DNA, 19 bp, Homo sapiens
tcaatgcatttaaaatacc

SEQ ID NO: 5308272 - DNA, 20 bp, Homo sapiens
tcaatgcccagtaaaatttc

SEQ ID NO: 5308273 - DNA, 17 bp, Homo sapiens
tcaatgcccctgaattt

SEQ ID NO: 5308274 - DNA, 22 bp, Homo sapiens
tcaatgcccctgaatttaaata

SEQ ID NO: 5308275 - DNA, 15 bp, Homo sapiens
tcaatgccctgccat

SEQ ID NO: 5308276 - DNA, 18 bp, Homo sapiens
tcaatgctatggactgca

SEQ ID NO: 5308277 - DNA, 15 bp, Homo sapiens
tcaatgctatttttg

SEQ ID NO: 5308278 - DNA, 12 bp, Homo sapiens
tcaatgctcata

SEQ ID NO: 5308279 - DNA, 17 bp, Homo sapiens
tcaatgctggagaaaaa

SEQ ID NO: 5308280 - DNA, 16 bp, Homo sapiens
tcaatgctgggccctc

SEQ ID NO: 5308281 - DNA, 15 bp, Homo sapiens
tcaatgctgtttggg

SEQ ID NO: 5308282 - DNA, 22 bp, Homo sapiens
tcaatgctgtttgggtttccaa

SEQ ID NO: 5308283 - DNA, 14 bp, Homo sapiens
tcaatgcttgatgt

SEQ ID NO: 5308284 - DNA, 15 bp, Homo sapiens
tcaatgcttgatgtt

SEQ ID NO: 5308285 - DNA, 16 bp, Homo sapiens
tcaatgctttatttgt

SEQ ID NO: 5308286 - DNA, 13 bp, Homo sapiens
tcaatgcttttct

SEQ ID NO: 5308287 - DNA, 18 bp, Homo sapiens
tcaatggaaacagggcag

SEQ ID NO: 5308288 - DNA, 15 bp, Homo sapiens
tcaatggaataataa

SEQ ID NO: 5308289 - DNA, 23 bp, Homo sapiens
tcaatggcctaaaactggcctga

SEQ ID NO: 5308290 - DNA, 18 bp, Homo sapiens
tcaatggcgcagtgcctc

SEQ ID NO: 5308291 - DNA, 14 bp, Homo sapiens
tcaatggctttgta

SEQ ID NO: 5308292 - DNA, 23 bp, Homo sapiens
tcaatggctttgtacttgtgatg

SEQ ID NO: 5308293 - DNA, 22 bp, Homo sapiens
tcaatgggaaatactactcctg

SEQ ID NO: 5308294 - DNA, 18 bp, Homo sapiens
tcaatgggaagactcagg

SEQ ID NO: 5308295 - DNA, 22 bp, Homo sapiens
tcaatgggagaatcagcagaac

SEQ ID NO: 5308296 - DNA, 20 bp, Homo sapiens
tcaatgggagtgaacatttc

SEQ ID NO: 5308297 - DNA, 20 bp, Homo sapiens
tcaatgggattttctagttt

SEQ ID NO: 5308298 - DNA, 17 bp, Homo sapiens
tcaatgggctcttccaa

SEQ ID NO: 5308299 - DNA, 20 bp, Homo sapiens
tcaatggtagattcgctgtc

SEQ ID NO: 5308300 - DNA, 17 bp, Homo sapiens
tcaatggtttgcaagga

SEQ ID NO: 5308301 - DNA, 22 bp, Homo sapiens
tcaatgtacttgtttgaatatt

SEQ ID NO: 5308302 - DNA, 17 bp, Homo sapiens
tcaatgtattaatatct

SEQ ID NO: 5308303 - DNA, 18 bp, Homo sapiens
tcaatgtcagcctttgtt

SEQ ID NO: 5308304 - DNA, 16 bp, Homo sapiens
tcaatgtcataaatgt

SEQ ID NO: 5308305 - DNA, 16 bp, Homo sapiens
tcaatgtccagtgagt

SEQ ID NO: 5308306 - DNA, 17 bp, Homo sapiens
tcaatgtctaaaaacat

SEQ ID NO: 5308307 - DNA, 19 bp, Homo sapiens
tcaatgtctaaaaacattt

SEQ ID NO: 5308308 - DNA, 12 bp, Homo sapiens
tcaatgtgaaaa

SEQ ID NO: 5308309 - DNA, 13 bp, Homo sapiens
tcaatgtgaaact

SEQ ID NO: 5308310 - DNA, 22 bp, Homo sapiens
tcaatgtgaaactgagaccaag

SEQ ID NO: 5308311 - DNA, 13 bp, Homo sapiens
tcaatgtgaaata

SEQ ID NO: 5308312 - DNA, 14 bp, Homo sapiens
tcaatgtgaaataa

SEQ ID NO: 5308313 - DNA, 19 bp, Homo sapiens
tcaatgtgaaataaagagt

SEQ ID NO: 5308314 - DNA, 21 bp, Homo sapiens
tcaatgtgaaataaagagttc

SEQ ID NO: 5308315 - DNA, 15 bp, Homo sapiens
tcaatgtgacatgtt

SEQ ID NO: 5308316 - DNA, 15 bp, Homo sapiens
tcaatgtgacattta

SEQ ID NO: 5308317 - DNA, 21 bp, Homo sapiens
tcaatgtgatataaacagctt

SEQ ID NO: 5308318 - DNA, 16 bp, Homo sapiens
tcaatgtgattctaat

SEQ ID NO: 5308319 - DNA, 17 bp, Homo sapiens
tcaatgtgattctaatg

SEQ ID NO: 5308320 - DNA, 22 bp, Homo sapiens
tcaatgtgattctaatgtcttc

SEQ ID NO: 5308321 - DNA, 21 bp, Homo sapiens
tcaatgtgcaagttgtactgt

SEQ ID NO: 5308322 - DNA, 14 bp, Homo sapiens
tcaatgtgctctgt

SEQ ID NO: 5308323 - DNA, 18 bp, Homo sapiens
tcaatgtgctctgtaaca

SEQ ID NO: 5308324 - DNA, 17 bp, Homo sapiens
tcaatgtgtataaattg

SEQ ID NO: 5308325 - DNA, 22 bp, Homo sapiens
tcaatgtgtataaattgtcttt

SEQ ID NO: 5308326 - DNA, 16 bp, Homo sapiens
tcaatgttaaatctac

SEQ ID NO: 5308327 - DNA, 20 bp, Homo sapiens
tcaatgttaaatctacaaac

SEQ ID NO: 5308328 - DNA, 22 bp, Homo sapiens
tcaatgttcacgcaacttgaaa

SEQ ID NO: 5308329 - DNA, 18 bp, Homo sapiens
tcaatgttcagttttcct

SEQ ID NO: 5308330 - DNA, 12 bp, Homo sapiens
tcaatgttcatt

SEQ ID NO: 5308331 - DNA, 21 bp, Homo sapiens
tcaatgtttatgcaaggaagg

SEQ ID NO: 5308332 - DNA, 21 bp, Homo sapiens
tcaatgtttctggacattctc

SEQ ID NO: 5308333 - DNA, 24 bp, Homo sapiens
tcaatgtttctggacattctcttt

SEQ ID NO: 5308334 - DNA, 18 bp, Homo sapiens
tcaatgtttcttctaggt

SEQ ID NO: 5308335 - DNA, 23 bp, Homo sapiens
tcaatgtttgaaatagttcaaac

SEQ ID NO: 5308336 - DNA, 22 bp, Homo sapiens
tcaatgtttgaggagcatgttt

SEQ ID NO: 5308337 - DNA, 23 bp, Homo sapiens
tcaatgttttcttttctgtggtt

SEQ ID NO: 5308338 - DNA, 14 bp, Homo sapiens
tcaattaaaattac

SEQ ID NO: 5308339 - DNA, 14 bp, Homo sapiens
tcaattaaacggat

SEQ ID NO: 5308340 - DNA, 16 bp, Homo sapiens
tcaattaaacggatta

SEQ ID NO: 5308341 - DNA, 17 bp, Homo sapiens
tcaattaaacggattat

SEQ ID NO: 5308342 - DNA, 21 bp, Homo sapiens
tcaattaaacggattattttt

SEQ ID NO: 5308343 - DNA, 19 bp, Homo sapiens
tcaattaaagaaataattt

SEQ ID NO: 5308344 - DNA, 13 bp, Homo sapiens
tcaattaaagtct

SEQ ID NO: 5308345 - DNA, 21 bp, Homo sapiens
tcaattaaagtctattcaaaa

SEQ ID NO: 5308346 - DNA, 16 bp, Homo sapiens
tcaattaaatgtaggt

SEQ ID NO: 5308347 - DNA, 13 bp, Homo sapiens
tcaattaacaata

SEQ ID NO: 5308348 - DNA, 16 bp, Homo sapiens
tcaattaacatcgtgg

SEQ ID NO: 5308349 - DNA, 11 bp, Homo sapiens
tcaattaataa

SEQ ID NO: 5308350 - DNA, 14 bp, Homo sapiens
tcaattaatggaaa

SEQ ID NO: 5308351 - DNA, 21 bp, Homo sapiens
tcaattacaggaagtactgga

SEQ ID NO: 5308352 - DNA, 23 bp, Homo sapiens
tcaattacaggaagtactggaga

SEQ ID NO: 5308353 - DNA, 20 bp, Homo sapiens
tcaattacggactctggata

SEQ ID NO: 5308354 - DNA, 13 bp, Homo sapiens
tcaattactggtc

SEQ ID NO: 5308355 - DNA, 20 bp, Homo sapiens
tcaattactggtccaaaaga

SEQ ID NO: 5308356 - DNA, 22 bp, Homo sapiens
tcaattacttattttaggaaat

SEQ ID NO: 5308357 - DNA, 15 bp, Homo sapiens
tcaattagtacagta

SEQ ID NO: 5308358 - DNA, 22 bp, Homo sapiens
tcaattatactacttctaaggt

SEQ ID NO: 5308359 - DNA, 17 bp, Homo sapiens
tcaattatagtttctga

SEQ ID NO: 5308360 - DNA, 14 bp, Homo sapiens
tcaattatcttgga

SEQ ID NO: 5308361 - DNA, 19 bp, Homo sapiens
tcaattatgtttgaaaata

SEQ ID NO: 5308362 - DNA, 20 bp, Homo sapiens
tcaattatgtttgaaaatag

SEQ ID NO: 5308363 - DNA, 16 bp, Homo sapiens
tcaattattacattta

SEQ ID NO: 5308364 - DNA, 13 bp, Homo sapiens
tcaattatttcaa

SEQ ID NO: 5308365 - DNA, 15 bp, Homo sapiens
tcaattatttccccc

SEQ ID NO: 5308366 - DNA, 15 bp, Homo sapiens
tcaattatttgcata

SEQ ID NO: 5308367 - DNA, 17 bp, Homo sapiens
tcaattcaacactccct

SEQ ID NO: 5308368 - DNA, 15 bp, Homo sapiens
tcaattcagtgatgg

SEQ ID NO: 5308369 - DNA, 12 bp, Homo sapiens
tcaattcatcta

SEQ ID NO: 5308370 - DNA, 13 bp, Homo sapiens
tcaattcatgtaa

SEQ ID NO: 5308371 - DNA, 19 bp, Homo sapiens
tcaattcattaataaaata

SEQ ID NO: 5308372 - DNA, 23 bp, Homo sapiens
tcaattccaacactgatttcccc

SEQ ID NO: 5308373 - DNA, 18 bp, Homo sapiens
tcaattccaacagtttaa

SEQ ID NO: 5308374 - DNA, 18 bp, Homo sapiens
tcaattccaccagggcca

SEQ ID NO: 5308375 - DNA, 23 bp, Homo sapiens
tcaattccaccagggccagagca

SEQ ID NO: 5308376 - DNA, 18 bp, Homo sapiens
tcaattccacccctcctc

SEQ ID NO: 5308377 - DNA, 14 bp, Homo sapiens
tcaattccacctgc

SEQ ID NO: 5308378 - DNA, 18 bp, Homo sapiens
tcaattcccacctatgag

SEQ ID NO: 5308379 - DNA, 22 bp, Homo sapiens
tcaattccctctctcagcacag

SEQ ID NO: 5308380 - DNA, 14 bp, Homo sapiens
tcaattcctctggg

SEQ ID NO: 5308381 - DNA, 13 bp, Homo sapiens
tcaattcctgggc

SEQ ID NO: 5308382 - DNA, 12 bp, Homo sapiens
tcaattctcaaa

SEQ ID NO: 5308383 - DNA, 13 bp, Homo sapiens
tcaattctgtata

SEQ ID NO: 5308384 - DNA, 14 bp, Homo sapiens
tcaattctgtgtgg

SEQ ID NO: 5308385 - DNA, 18 bp, Homo sapiens
tcaattcttaaatttctt

SEQ ID NO: 5308386 - DNA, 17 bp, Homo sapiens
tcaattcttccctatct

SEQ ID NO: 5308387 - DNA, 23 bp, Homo sapiens
tcaattcttccctatctttgcca

SEQ ID NO: 5308388 - DNA, 15 bp, Homo sapiens
tcaattgaatggtca

SEQ ID NO: 5308389 - DNA, 14 bp, Homo sapiens
tcaattgacaaatg

SEQ ID NO: 5308390 - DNA, 17 bp, Homo sapiens
tcaattgcaaaatgcgt

SEQ ID NO: 5308391 - DNA, 16 bp, Homo sapiens
tcaattgcagatgcca

SEQ ID NO: 5308392 - DNA, 18 bp, Homo sapiens
tcaattgcagatgccaaa

SEQ ID NO: 5308393 - DNA, 19 bp, Homo sapiens
tcaattgcagatgccaaaa

SEQ ID NO: 5308394 - DNA, 22 bp, Homo sapiens
tcaattgcatctcccagataat

SEQ ID NO: 5308395 - DNA, 24 bp, Homo sapiens
tcaattgcttgagcatgcccaaat

SEQ ID NO: 5308396 - DNA, 13 bp, Homo sapiens
tcaattgctttgt

SEQ ID NO: 5308397 - DNA, 19 bp, Homo sapiens
tcaattggcagtgactttg

SEQ ID NO: 5308398 - DNA, 22 bp, Homo sapiens
tcaattggcagtgactttgtat

SEQ ID NO: 5308399 - DNA, 13 bp, Homo sapiens
tcacataggctct

SEQ ID NO: 5308400 - DNA, 14 bp, Homo sapiens
tcacatagtattat

SEQ ID NO: 5308401 - DNA, 15 bp, Homo sapiens
tcacatataacatgc

SEQ ID NO: 5308402 - DNA, 20 bp, Homo sapiens
tcacatataacatgcaaaca

SEQ ID NO: 5308403 - DNA, 18 bp, Homo sapiens
tcacatatacaaaagcaa

SEQ ID NO: 5308404 - DNA, 14 bp, Homo sapiens
tcacatatctgctt

SEQ ID NO: 5308405 - DNA, 20 bp, Homo sapiens
tcacatatgattctcttaga

SEQ ID NO: 5308406 - DNA, 19 bp, Homo sapiens
tcacatatgtctgtatcta

SEQ ID NO: 5308407 - DNA, 13 bp, Homo sapiens
tcacatatgtctt

SEQ ID NO: 5308408 - DNA, 20 bp, Homo sapiens
tcacatattcatcagcagga

SEQ ID NO: 5308409 - DNA, 14 bp, Homo sapiens
tcacatattctagt

SEQ ID NO: 5308410 - DNA, 12 bp, Homo sapiens
tcacatatttgt

SEQ ID NO: 5308411 - DNA, 22 bp, Homo sapiens
tcacatattttaaaatttgttc

SEQ ID NO: 5308412 - DNA, 13 bp, Homo sapiens
tcacatcacaata

SEQ ID NO: 5308413 - DNA, 17 bp, Homo sapiens
tcacatcagataagaca

SEQ ID NO: 5308414 - DNA, 19 bp, Homo sapiens
tcacatcagtgaggaggga

SEQ ID NO: 5308415 - DNA, 20 bp, Homo sapiens
tcacatcagtgaggagggat

SEQ ID NO: 5308416 - DNA, 14 bp, Homo sapiens
tcacatcatttggg

SEQ ID NO: 5308417 - DNA, 17 bp, Homo sapiens
tcacatccatctacttt

SEQ ID NO: 5308418 - DNA, 19 bp, Homo sapiens
tcacatccattgtctcttc

SEQ ID NO: 5308419 - DNA, 16 bp, Homo sapiens
tcacatcccctgtcta

SEQ ID NO: 5308420 - DNA, 17 bp, Homo sapiens
tcacatcctcagaaagt

SEQ ID NO: 5308421 - DNA, 22 bp, Homo sapiens
tcacatcctcagaaagtgcagc

SEQ ID NO: 5308422 - DNA, 23 bp, Homo sapiens
tcacatcctcagaaagtgcagca

SEQ ID NO: 5308423 - DNA, 13 bp, Homo sapiens
tcacatcctcctg

SEQ ID NO: 5308424 - DNA, 15 bp, Homo sapiens
tcacatcctcctgcc

SEQ ID NO: 5308425 - DNA, 16 bp, Homo sapiens
tcacatcctcctgccc

SEQ ID NO: 5308426 - DNA, 14 bp, Homo sapiens
tcacatcctctcca

SEQ ID NO: 5308427 - DNA, 23 bp, Homo sapiens
tcacatcctggcctggcacatca

SEQ ID NO: 5308428 - DNA, 22 bp, Homo sapiens
tcacatcctgggatccagtgta

SEQ ID NO: 5308429 - DNA, 18 bp, Homo sapiens
tcacatcctgtgtttcta

SEQ ID NO: 5308430 - DNA, 19 bp, Homo sapiens
tcacatcctgtgtttctag

SEQ ID NO: 5308431 - DNA, 17 bp, Homo sapiens
tcacatctaaagcttta

SEQ ID NO: 5308432 - DNA, 20 bp, Homo sapiens
tcacatctatccacactgtc

SEQ ID NO: 5308433 - DNA, 18 bp, Homo sapiens
tcacatctcacctccgaa

SEQ ID NO: 5308434 - DNA, 21 bp, Homo sapiens
tcacatctcccttccacctca

SEQ ID NO: 5308435 - DNA, 16 bp, Homo sapiens
tcacatctctgtagat

SEQ ID NO: 5308436 - DNA, 17 bp, Homo sapiens
tcacatctgaatctcct

SEQ ID NO: 5308437 - DNA, 18 bp, Homo sapiens
tcacatctgaatctcctt

SEQ ID NO: 5308438 - DNA, 17 bp, Homo sapiens
tcacatcttaaattcat

SEQ ID NO: 5308439 - DNA, 17 bp, Homo sapiens
tcacatctttcacactt

SEQ ID NO: 5308440 - DNA, 20 bp, Homo sapiens
tcacatctttcacacttcca

SEQ ID NO: 5308441 - DNA, 13 bp, Homo sapiens
tcacatcttttaa

SEQ ID NO: 5308442 - DNA, 18 bp, Homo sapiens
tcacatgaattattacag

SEQ ID NO: 5308443 - DNA, 21 bp, Homo sapiens
tcacatgacatccacatgcac

SEQ ID NO: 5308444 - DNA, 23 bp, Homo sapiens
tcacatgagctatttccattcca

SEQ ID NO: 5308445 - DNA, 18 bp, Homo sapiens
tcacatgcccctcttaga

SEQ ID NO: 5308446 - DNA, 20 bp, Homo sapiens
tcacatgcccctcttagaag

SEQ ID NO: 5308447 - DNA, 14 bp, Homo sapiens
tcacatgcccgctg

SEQ ID NO: 5308448 - DNA, 15 bp, Homo sapiens
tcacatgctggctcc

SEQ ID NO: 5308449 - DNA, 23 bp, Homo sapiens
tcacatggaatctacatgtgttt

SEQ ID NO: 5308450 - DNA, 16 bp, Homo sapiens
tcacatggcatgtttt

SEQ ID NO: 5308451 - DNA, 17 bp, Homo sapiens
tcacatggcatgttttg

SEQ ID NO: 5308452 - DNA, 19 bp, Homo sapiens
tcacatggcatgttttgtc

SEQ ID NO: 5308453 - DNA, 15 bp, Homo sapiens
tcacatgggacaaag

SEQ ID NO: 5308454 - DNA, 19 bp, Homo sapiens
tcacatggggcctggccca

SEQ ID NO: 5308455 - DNA, 23 bp, Homo sapiens
tcacatgtatggacgtgtgtgaa

SEQ ID NO: 5308456 - DNA, 16 bp, Homo sapiens
tcacatgtatgttttg

SEQ ID NO: 5308457 - DNA, 17 bp, Homo sapiens
tcacatgtgccctgcct

SEQ ID NO: 5308458 - DNA, 18 bp, Homo sapiens
tcacatgtggctccccct

SEQ ID NO: 5308459 - DNA, 19 bp, Homo sapiens
tcacatgtggctccccctg

SEQ ID NO: 5308460 - DNA, 14 bp, Homo sapiens
tcacatgttctaat

SEQ ID NO: 5308461 - DNA, 16 bp, Homo sapiens
tcacatgttggtgctg

SEQ ID NO: 5308462 - DNA, 21 bp, Homo sapiens
tcacattaaaaaatgaaatat

SEQ ID NO: 5308463 - DNA, 22 bp, Homo sapiens
tcacattaaaaaatgaaatatt

SEQ ID NO: 5308464 - DNA, 17 bp, Homo sapiens
tcacattaacattttga

SEQ ID NO: 5308465 - DNA, 19 bp, Homo sapiens
tcacattaacattttgagc

SEQ ID NO: 5308466 - DNA, 12 bp, Homo sapiens
tcacattagaag

SEQ ID NO: 5308467 - DNA, 22 bp, Homo sapiens
tcacattagaagacaattgaca

SEQ ID NO: 5308468 - DNA, 15 bp, Homo sapiens
tcacattagaattag

SEQ ID NO: 5308469 - DNA, 15 bp, Homo sapiens
tcacattagataaat

SEQ ID NO: 5308470 - DNA, 12 bp, Homo sapiens
tcacattagtgt

SEQ ID NO: 5308471 - DNA, 16 bp, Homo sapiens
tcacattagtgtgttg

SEQ ID NO: 5308472 - DNA, 21 bp, Homo sapiens
tcacattatttattaaaaatg

SEQ ID NO: 5308473 - DNA, 15 bp, Homo sapiens
tcacattatttgcat

SEQ ID NO: 5308474 - DNA, 17 bp, Homo sapiens
tcacattccacatctgt

SEQ ID NO: 5308475 - DNA, 14 bp, Homo sapiens
tcacattccctctc

SEQ ID NO: 5308476 - DNA, 19 bp, Homo sapiens
tcacattccctctcatcca

SEQ ID NO: 5308477 - DNA, 17 bp, Homo sapiens
tcacattcctgaacagg

SEQ ID NO: 5308478 - DNA, 19 bp, Homo sapiens
tcacattcctgaacaggat

SEQ ID NO: 5308479 - DNA, 13 bp, Homo sapiens
tcacattcctgac

SEQ ID NO: 5308480 - DNA, 14 bp, Homo sapiens
tcacattcctgacc

SEQ ID NO: 5308481 - DNA, 19 bp, Homo sapiens
tcacattcgacatacccca

SEQ ID NO: 5308482 - DNA, 16 bp, Homo sapiens
tcacattctgttgttc

SEQ ID NO: 5308483 - DNA, 20 bp, Homo sapiens
tcacattcttataaatatga

SEQ ID NO: 5308484 - DNA, 14 bp, Homo sapiens
tcacattcttggct

SEQ ID NO: 5308485 - DNA, 19 bp, Homo sapiens
tcacattgatgtaaggact

SEQ ID NO: 5308486 - DNA, 22 bp, Homo sapiens
tcacattgcattctattgcctt

SEQ ID NO: 5308487 - DNA, 17 bp, Homo sapiens
tcacattgctgtatttt

SEQ ID NO: 5308488 - DNA, 18 bp, Homo sapiens
tcacattggtgttgtact

SEQ ID NO: 5308489 - DNA, 16 bp, Homo sapiens
tcacattgttaagaaa

SEQ ID NO: 5308490 - DNA, 19 bp, Homo sapiens
tcacattgtttgctgctat

SEQ ID NO: 5308491 - DNA, 12 bp, Homo sapiens
tcacatttaaat

SEQ ID NO: 5308492 - DNA, 23 bp, Homo sapiens
tcacatttaatatcctgcctttt

SEQ ID NO: 5308493 - DNA, 19 bp, Homo sapiens
tcacatttattctgctcac

SEQ ID NO: 5308494 - DNA, 21 bp, Homo sapiens
tcacatttcaagatccaaatg

SEQ ID NO: 5308495 - DNA, 19 bp, Homo sapiens
tcacatttccagggcagca

SEQ ID NO: 5308496 - DNA, 13 bp, Homo sapiens
tcacatttctact

SEQ ID NO: 5308497 - DNA, 18 bp, Homo sapiens
tcacatttgatgtacatg

SEQ ID NO: 5308498 - DNA, 17 bp, Homo sapiens
tcacatttgcatcatag

SEQ ID NO: 5308499 - DNA, 23 bp, Homo sapiens
tcacattttaagtgcttcacatt

SEQ ID NO: 5308500 - DNA, 14 bp, Homo sapiens
tcacattttccttt

SEQ ID NO: 5308501 - DNA, 17 bp, Homo sapiens
tcacattttccttttca

SEQ ID NO: 5308502 - DNA, 15 bp, Homo sapiens
tcacattttgttaag

SEQ ID NO: 5308503 - DNA, 20 bp, Homo sapiens
tcacatttttttatgctctt

SEQ ID NO: 5308504 - DNA, 15 bp, Homo sapiens
tcacatttttttcta

SEQ ID NO: 5308505 - DNA, 13 bp, Homo sapiens
tcaccaaaaaatc

SEQ ID NO: 5308506 - DNA, 23 bp, Homo sapiens
tcaccaaaaccaaacttgttcat

SEQ ID NO: 5308507 - DNA, 15 bp, Homo sapiens
tcaccaaaagacact

SEQ ID NO: 5308508 - DNA, 12 bp, Homo sapiens
tcaccaaaatat

SEQ ID NO: 5308509 - DNA, 17 bp, Homo sapiens
tcaccaaaatttctaca

SEQ ID NO: 5308510 - DNA, 14 bp, Homo sapiens
tcaccaaagtatta

SEQ ID NO: 5308511 - DNA, 21 bp, Homo sapiens
tcaccaaatcagctgctacta

SEQ ID NO: 5308512 - DNA, 19 bp, Homo sapiens
tcaccaaatgatgccactt

SEQ ID NO: 5308513 - DNA, 23 bp, Homo sapiens
tcaccaacaacagtcagccagct

SEQ ID NO: 5308514 - DNA, 22 bp, Homo sapiens
tcaccaacacagttgggaccca

SEQ ID NO: 5308515 - DNA, 16 bp, Homo sapiens
tcaccaacttgccaca

SEQ ID NO: 5308516 - DNA, 13 bp, Homo sapiens
tcaccaactttta

SEQ ID NO: 5308517 - DNA, 17 bp, Homo sapiens
tcaccaagcaagtccct

SEQ ID NO: 5308518 - DNA, 14 bp, Homo sapiens
tcaccaagcagtgg

SEQ ID NO: 5308519 - DNA, 16 bp, Homo sapiens
tcaccaagctcacagt

SEQ ID NO: 5308520 - DNA, 14 bp, Homo sapiens
tcaccaaggaaata

SEQ ID NO: 5308521 - DNA, 18 bp, Homo sapiens
tcaccaaggcagtgcatg

SEQ ID NO: 5308522 - DNA, 21 bp, Homo sapiens
tcaccaaggcagtgcatgcat

SEQ ID NO: 5308523 - DNA, 12 bp, Homo sapiens
tcaccaaggtga

SEQ ID NO: 5308524 - DNA, 21 bp, Homo sapiens
tcaccaaggtggcttctcctt

SEQ ID NO: 5308525 - DNA, 20 bp, Homo sapiens
tcaccaataacttcagagaa

SEQ ID NO: 5308526 - DNA, 21 bp, Homo sapiens
tcaccaataacttcagagaag

SEQ ID NO: 5308527 - DNA, 20 bp, Homo sapiens
tcaccaatgttgtacagaga

SEQ ID NO: 5308528 - DNA, 23 bp, Homo sapiens
tcaccaatgttgtacagagaaga

SEQ ID NO: 5308529 - DNA, 23 bp, Homo sapiens
tcaccacaacaaagtgcttcctt

SEQ ID NO: 5308530 - DNA, 19 bp, Homo sapiens
tcaccacaacctccacctc

SEQ ID NO: 5308531 - DNA, 15 bp, Homo sapiens
tcaccacacataata

SEQ ID NO: 5308532 - DNA, 13 bp, Homo sapiens
tcaccacagcctt

SEQ ID NO: 5308533 - DNA, 19 bp, Homo sapiens
tcaccacagtaagttccta

SEQ ID NO: 5308534 - DNA, 16 bp, Homo sapiens
tcaccacatgtgcaca

SEQ ID NO: 5308535 - DNA, 10 bp, Homo sapiens
tcaccaccac

SEQ ID NO: 5308536 - DNA, 15 bp, Homo sapiens
tcaccaccacacccc

SEQ ID NO: 5308537 - DNA, 22 bp, Homo sapiens
tcaccaccacacccctgccggc

SEQ ID NO: 5308538 - DNA, 13 bp, Homo sapiens
tcaccaccacccc

SEQ ID NO: 5308539 - DNA, 21 bp, Homo sapiens
tcaccaccacccgaaatgcca

SEQ ID NO: 5308540 - DNA, 22 bp, Homo sapiens
tcaccaccacccgaaatgccac

SEQ ID NO: 5308541 - DNA, 18 bp, Homo sapiens
tcaccacccagcccttcc

SEQ ID NO: 5308542 - DNA, 13 bp, Homo sapiens
tcaccaccctccc

SEQ ID NO: 5308543 - DNA, 12 bp, Homo sapiens
tcaccaccctgg

SEQ ID NO: 5308544 - DNA, 14 bp, Homo sapiens
tcaccacccttcca

SEQ ID NO: 5308545 - DNA, 13 bp, Homo sapiens
tcaccaccgcctc

SEQ ID NO: 5308546 - DNA, 18 bp, Homo sapiens
tcaccacctcatgtcatt

SEQ ID NO: 5308547 - DNA, 21 bp, Homo sapiens
tcaccacctcatgtcatttct

SEQ ID NO: 5308548 - DNA, 12 bp, Homo sapiens
tcaccacctgcc

SEQ ID NO: 5308549 - DNA, 15 bp, Homo sapiens
tcaccacctgcctct

SEQ ID NO: 5308550 - DNA, 14 bp, Homo sapiens
tcaccaccttccca

SEQ ID NO: 5308551 - DNA, 21 bp, Homo sapiens
tcaccacgtggggctcacttt

SEQ ID NO: 5308552 - DNA, 20 bp, Homo sapiens
tcaccactaccagccagcct

SEQ ID NO: 5308553 - DNA, 23 bp, Homo sapiens
tcaccactcaaaggccagacctg

SEQ ID NO: 5308554 - DNA, 16 bp, Homo sapiens
tcaccactccattccc

SEQ ID NO: 5308555 - DNA, 12 bp, Homo sapiens
tcaccactcctc

SEQ ID NO: 5308556 - DNA, 23 bp, Homo sapiens
tcaccagaaccagttaagagaca

SEQ ID NO: 5308557 - DNA, 15 bp, Homo sapiens
tcaccagacggggct

SEQ ID NO: 5308558 - DNA, 15 bp, Homo sapiens
tcaccagacttttct

SEQ ID NO: 5308559 - DNA, 17 bp, Homo sapiens
tcaccagagaccaggag

SEQ ID NO: 5308560 - DNA, 15 bp, Homo sapiens
tcaccagagacttta

SEQ ID NO: 5308561 - DNA, 16 bp, Homo sapiens
tcaccagagagggact

SEQ ID NO: 5308562 - DNA, 19 bp, Homo sapiens
tcaccagagcccatgctca

SEQ ID NO: 5308563 - DNA, 20 bp, Homo sapiens
tcaccagagcccatgctcaa

SEQ ID NO: 5308564 - DNA, 20 bp, Homo sapiens
tcaccagagcttctctgggc

SEQ ID NO: 5308565 - DNA, 23 bp, Homo sapiens
tcaccagagcttctctgggctga

SEQ ID NO: 5308566 - DNA, 18 bp, Homo sapiens
tcaccagaggaatcactc

SEQ ID NO: 5308567 - DNA, 21 bp, Homo sapiens
tcaccagatttgctaatttat

SEQ ID NO: 5308568 - DNA, 21 bp, Homo sapiens
tcaccagcaacatctcgagcc

SEQ ID NO: 5308569 - DNA, 19 bp, Homo sapiens
tcaccagcaccaacaccac

SEQ ID NO: 5308570 - DNA, 16 bp, Homo sapiens
tcaccagcagcataga

SEQ ID NO: 5308571 - DNA, 15 bp, Homo sapiens
tcaccagccccactg

SEQ ID NO: 5308572 - DNA, 21 bp, Homo sapiens
tcaccagccccactgccagca

SEQ ID NO: 5308573 - DNA, 23 bp, Homo sapiens
tcaccagccccactgccagcagc

SEQ ID NO: 5308574 - DNA, 13 bp, Homo sapiens
tcaccagccccag

SEQ ID NO: 5308575 - DNA, 11 bp, Homo sapiens
tcaccagccct

SEQ ID NO: 5308576 - DNA, 13 bp, Homo sapiens
tcaccagccctga

SEQ ID NO: 5308577 - DNA, 14 bp, Homo sapiens
tcacctgccaccac

SEQ ID NO: 5308578 - DNA, 15 bp, Homo sapiens
tcacctgccaccaca

SEQ ID NO: 5308579 - DNA, 18 bp, Homo sapiens
tcacctgccaccacacac

SEQ ID NO: 5308580 - DNA, 19 bp, Homo sapiens
tcacctgccccagcactca

SEQ ID NO: 5308581 - DNA, 21 bp, Homo sapiens
tcacctgccccagcactcaca

SEQ ID NO: 5308582 - DNA, 22 bp, Homo sapiens
tcacctgccccgtagagaatgt

SEQ ID NO: 5308583 - DNA, 23 bp, Homo sapiens
tcacctgccccgtagagaatgtg

SEQ ID NO: 5308584 - DNA, 16 bp, Homo sapiens
tcacctgcccctctgt

SEQ ID NO: 5308585 - DNA, 17 bp, Homo sapiens
tcacctgcccctctgtt

SEQ ID NO: 5308586 - DNA, 16 bp, Homo sapiens
tcacctgccgccctgt

SEQ ID NO: 5308587 - DNA, 18 bp, Homo sapiens
tcacctgccgccctgtgg

SEQ ID NO: 5308588 - DNA, 18 bp, Homo sapiens
tcacctgccggctctggg

SEQ ID NO: 5308589 - DNA, 23 bp, Homo sapiens
tcacctgccggctctgggctggc

SEQ ID NO: 5308590 - DNA, 20 bp, Homo sapiens
tcacctgcctgccctcccct

SEQ ID NO: 5308591 - DNA, 13 bp, Homo sapiens
tcacctgctcaca

SEQ ID NO: 5308592 - DNA, 12 bp, Homo sapiens
tcacctgctcca

SEQ ID NO: 5308593 - DNA, 13 bp, Homo sapiens
tcacctgctccag

SEQ ID NO: 5308594 - DNA, 12 bp, Homo sapiens
tcacctgctccc

SEQ ID NO: 5308595 - DNA, 14 bp, Homo sapiens
tcacctgctcccag

SEQ ID NO: 5308596 - DNA, 18 bp, Homo sapiens
tcacctgctcccagtcct

SEQ ID NO: 5308597 - DNA, 22 bp, Homo sapiens
tcacctgctcccagtcctgcct

SEQ ID NO: 5308598 - DNA, 11 bp, Homo sapiens
tcacctgctgg

SEQ ID NO: 5308599 - DNA, 16 bp, Homo sapiens
tcacctgctggcccct

SEQ ID NO: 5308600 - DNA, 19 bp, Homo sapiens
tcacctgctggcccctcac

SEQ ID NO: 5308601 - DNA, 19 bp, Homo sapiens
tcacctggaagcatttgtt

SEQ ID NO: 5308602 - DNA, 22 bp, Homo sapiens
tcacctggacttaagcatctgg

SEQ ID NO: 5308603 - DNA, 12 bp, Homo sapiens
tcacctggccct

SEQ ID NO: 5308604 - DNA, 14 bp, Homo sapiens
tcacctggcctgcc

SEQ ID NO: 5308605 - DNA, 16 bp, Homo sapiens
tcacctggctgctagg

SEQ ID NO: 5308606 - DNA, 18 bp, Homo sapiens
tcacctggcttgtttatt

SEQ ID NO: 5308607 - DNA, 23 bp, Homo sapiens
tcacctggcttgtttattttgtg

SEQ ID NO: 5308608 - DNA, 20 bp, Homo sapiens
tcacctgggcacctggggag

SEQ ID NO: 5308609 - DNA, 16 bp, Homo sapiens
tcacctgggcctttcc

SEQ ID NO: 5308610 - DNA, 17 bp, Homo sapiens
tcacctgggcctttcct

SEQ ID NO: 5308611 - DNA, 21 bp, Homo sapiens
tcacctgggcctttcctgtgc

SEQ ID NO: 5308612 - DNA, 22 bp, Homo sapiens
tcacctggggctgctggcctga

SEQ ID NO: 5308613 - DNA, 22 bp, Homo sapiens
tcacctggggtgctgcctctca

SEQ ID NO: 5308614 - DNA, 18 bp, Homo sapiens
tcacctggttatgagccg

SEQ ID NO: 5308615 - DNA, 19 bp, Homo sapiens
tcacctggttatgagccga

SEQ ID NO: 5308616 - DNA, 15 bp, Homo sapiens
tcacctgtactcttc

SEQ ID NO: 5308617 - DNA, 17 bp, Homo sapiens
tcacctgtactcttccg

SEQ ID NO: 5308618 - DNA, 18 bp, Homo sapiens
tcacctgtactcttccga

SEQ ID NO: 5308619 - DNA, 19 bp, Homo sapiens
tcacctgtcttgccttttt

SEQ ID NO: 5308620 - DNA, 20 bp, Homo sapiens
tcacctgtcttgcctttttc

SEQ ID NO: 5308621 - DNA, 17 bp, Homo sapiens
tcacctgtgacaaagga

SEQ ID NO: 5308622 - DNA, 19 bp, Homo sapiens
tcacctgtgactcctgttg

SEQ ID NO: 5308623 - DNA, 15 bp, Homo sapiens
tcacctgtgagacca

SEQ ID NO: 5308624 - DNA, 22 bp, Homo sapiens
tcacctgtgcagggccctctgg

SEQ ID NO: 5308625 - DNA, 20 bp, Homo sapiens
tcacctgtgcttcgggccct

SEQ ID NO: 5308626 - DNA, 16 bp, Homo sapiens
tcacctgtgtgcccag

SEQ ID NO: 5308627 - DNA, 14 bp, Homo sapiens
tcacctgttgctta

SEQ ID NO: 5308628 - DNA, 21 bp, Homo sapiens
tcacctgtttttaagctgttt

SEQ ID NO: 5308629 - DNA, 21 bp, Homo sapiens
tcaccttagaccaccaagcct

SEQ ID NO: 5308630 - DNA, 22 bp, Homo sapiens
tcaccttagaccaccaagcctt

SEQ ID NO: 5308631 - DNA, 15 bp, Homo sapiens
tcaccttaggcaggg

SEQ ID NO: 5308632 - DNA, 18 bp, Homo sapiens
tcaccttaggcagggaag

SEQ ID NO: 5308633 - DNA, 20 bp, Homo sapiens
tcaccttaggcagggaagtg

SEQ ID NO: 5308634 - DNA, 15 bp, Homo sapiens
tcaccttagggaaga

SEQ ID NO: 5308635 - DNA, 17 bp, Homo sapiens
tcaccttatgtattatt

SEQ ID NO: 5308636 - DNA, 15 bp, Homo sapiens
tcaccttcaaaatgt

SEQ ID NO: 5308637 - DNA, 16 bp, Homo sapiens
tcaccttcaaaatgtt

SEQ ID NO: 5308638 - DNA, 18 bp, Homo sapiens
tcaccttcaccttcatcc

SEQ ID NO: 5308639 - DNA, 16 bp, Homo sapiens
tcaccttcagtaaccc

SEQ ID NO: 5308640 - DNA, 17 bp, Homo sapiens
tcaccttccaaacaaaa

SEQ ID NO: 5308641 - DNA, 19 bp, Homo sapiens
tcaccttccatgtcaggcc

SEQ ID NO: 5308642 - DNA, 12 bp, Homo sapiens
tcaccttccctt

SEQ ID NO: 5308643 - DNA, 17 bp, Homo sapiens
tcaccttcctctgcctt

SEQ ID NO: 5308644 - DNA, 20 bp, Homo sapiens
tcaccttcctgggcagccca

SEQ ID NO: 5308645 - DNA, 14 bp, Homo sapiens
tcaccttcctgtgg

SEQ ID NO: 5308646 - DNA, 14 bp, Homo sapiens
tcaccttccttgaa

SEQ ID NO: 5308647 - DNA, 18 bp, Homo sapiens
tcaccttcggagaggaca

SEQ ID NO: 5308648 - DNA, 14 bp, Homo sapiens
tcaccttctgtgca

SEQ ID NO: 5308649 - DNA, 16 bp, Homo sapiens
tcaccttctgtgcatc

SEQ ID NO: 5308650 - DNA, 17 bp, Homo sapiens
tcaccttcttggttgaa

SEQ ID NO: 5308651 - DNA, 15 bp, Homo sapiens
tcaccttctttgtaa

SEQ ID NO: 5308652 - DNA, 23 bp, Homo sapiens
tcaccttgagaggcatgacagct

SEQ ID NO: 5308653 - DNA, 20 bp, Homo sapiens
tcaccttgccgagagaggcg

SEQ ID NO: 5308654 - DNA, 21 bp, Homo sapiens
tcaccttgccgagagaggcgc

SEQ ID NO: 5308655 - DNA, 14 bp, Homo sapiens
tcaccttggagcct

SEQ ID NO: 5308656 - DNA, 17 bp, Homo sapiens
tcaccttggttcctggg

SEQ ID NO: 5308657 - DNA, 15 bp, Homo sapiens
tcaccttggtttatg

SEQ ID NO: 5308658 - DNA, 15 bp, Homo sapiens
tcacctttactttag

SEQ ID NO: 5308659 - DNA, 15 bp, Homo sapiens
tcacctttcctctcc

SEQ ID NO: 5308660 - DNA, 22 bp, Homo sapiens
tcacctttcctgccgtccctcc

SEQ ID NO: 5308661 - DNA, 18 bp, Homo sapiens
tcacctttctccactggg

SEQ ID NO: 5308662 - DNA, 19 bp, Homo sapiens
tcacctttctccactgggt

SEQ ID NO: 5308663 - DNA, 23 bp, Homo sapiens
tcacctttctgggctttctcctg

SEQ ID NO: 5308664 - DNA, 21 bp, Homo sapiens
tcacctttgtaagacatttgt

SEQ ID NO: 5308665 - DNA, 17 bp, Homo sapiens
tcacctttgtccccacc

SEQ ID NO: 5308666 - DNA, 16 bp, Homo sapiens
tcacctttgtgtattt

SEQ ID NO: 5308667 - DNA, 13 bp, Homo sapiens
tcaccttttctaa

SEQ ID NO: 5308668 - DNA, 15 bp, Homo sapiens
tcaccttttctaaaa

SEQ ID NO: 5308669 - DNA, 14 bp, Homo sapiens
tcaccttttcttca

SEQ ID NO: 5308670 - DNA, 17 bp, Homo sapiens
tcaccttttcttgcctg

SEQ ID NO: 5308671 - DNA, 14 bp, Homo sapiens
tcacctttttaata

SEQ ID NO: 5308672 - DNA, 21 bp, Homo sapiens
tcacgaattccatcttgtaaa

SEQ ID NO: 5308673 - DNA, 13 bp, Homo sapiens
tcacgacgctgca

SEQ ID NO: 5308674 - DNA, 16 bp, Homo sapiens
tcacgacgctgcagag

SEQ ID NO: 5308675 - DNA, 13 bp, Homo sapiens
tcacgactcttcc

SEQ ID NO: 5308676 - DNA, 14 bp, Homo sapiens
tcacgactcttcct

SEQ ID NO: 5308677 - DNA, 17 bp, Homo sapiens
tcacgagatcttccttc

SEQ ID NO: 5308678 - DNA, 16 bp, Homo sapiens
tcacgagatttgccag

SEQ ID NO: 5308679 - DNA, 13 bp, Homo sapiens
tcacgagccttgc

SEQ ID NO: 5308680 - DNA, 15 bp, Homo sapiens
tcacgagtgttcctg

SEQ ID NO: 5308681 - DNA, 16 bp, Homo sapiens
tcacgattatgactaa

SEQ ID NO: 5308682 - DNA, 13 bp, Homo sapiens
tcacgattcattt

SEQ ID NO: 5308683 - DNA, 20 bp, Homo sapiens
tcacgattcttaccctttct

SEQ ID NO: 5308684 - DNA, 18 bp, Homo sapiens
tcacgattgtcatcagga

SEQ ID NO: 5308685 - DNA, 20 bp, Homo sapiens
tcacgcaagtgccagggctg

SEQ ID NO: 5308686 - DNA, 16 bp, Homo sapiens
tcacgcacctcccatc

SEQ ID NO: 5308687 - DNA, 14 bp, Homo sapiens
tcacgcacctgggt

SEQ ID NO: 5308688 - DNA, 21 bp, Homo sapiens
tcacgcaggctgagtccagag

SEQ ID NO: 5308689 - DNA, 18 bp, Homo sapiens
tcacgccacccccgcccc

SEQ ID NO: 5308690 - DNA, 16 bp, Homo sapiens
tcacgccactgcacta

SEQ ID NO: 5308691 - DNA, 21 bp, Homo sapiens
tcacgccattctcctgcctca

SEQ ID NO: 5308692 - DNA, 20 bp, Homo sapiens
tcacgccattgcactccagc

SEQ ID NO: 5308693 - DNA, 13 bp, Homo sapiens
tcacgcccagcct

SEQ ID NO: 5308694 - DNA, 14 bp, Homo sapiens
tcacgcccagcctc

SEQ ID NO: 5308695 - DNA, 23 bp, Homo sapiens
tcacgcccagcctcctcccacca

SEQ ID NO: 5308696 - DNA, 15 bp, Homo sapiens
tcacgccctcttgtt

SEQ ID NO: 5308697 - DNA, 21 bp, Homo sapiens
tcacgccgggagaagccacct

SEQ ID NO: 5308698 - DNA, 18 bp, Homo sapiens
tcacgccgtaattctttc

SEQ ID NO: 5308699 - DNA, 22 bp, Homo sapiens
tcacgccgtaattctttctgtc

SEQ ID NO: 5308700 - DNA, 12 bp, Homo sapiens
tcacgcctgaaa

SEQ ID NO: 5308701 - DNA, 16 bp, Homo sapiens
tcacgcctgaaacttt

SEQ ID NO: 5308702 - DNA, 14 bp, Homo sapiens
tcacgcctgtaatc

SEQ ID NO: 5308703 - DNA, 21 bp, Homo sapiens
tcacgcctgtaatcccagcac

SEQ ID NO: 5308704 - DNA, 21 bp, Homo sapiens
tcacgcctgtaatcccagcag

SEQ ID NO: 5308705 - DNA, 18 bp, Homo sapiens
tcacgccttggcctccca

SEQ ID NO: 5308706 - DNA, 15 bp, Homo sapiens
tcacgcggcagcttc

SEQ ID NO: 5308707 - DNA, 14 bp, Homo sapiens
tcacgctcacccag

SEQ ID NO: 5308708 - DNA, 16 bp, Homo sapiens
tcacgctccccgcctg

SEQ ID NO: 5308709 - DNA, 21 bp, Homo sapiens
tcacgctccccgcctgttccc

SEQ ID NO: 5308710 - DNA, 18 bp, Homo sapiens
tcacgctccctgacttct

SEQ ID NO: 5308711 - DNA, 22 bp, Homo sapiens
tcacgctccctgacttctcccc

SEQ ID NO: 5308712 - DNA, 16 bp, Homo sapiens
tcacgctcctttctga

SEQ ID NO: 5308713 - DNA, 16 bp, Homo sapiens
tcacgctgaaacatgc

SEQ ID NO: 5308714 - DNA, 15 bp, Homo sapiens
tcacgctgacagcct

SEQ ID NO: 5308715 - DNA, 17 bp, Homo sapiens
tcacgctgacagcctcc

SEQ ID NO: 5308716 - DNA, 18 bp, Homo sapiens
tcacgctgacagcctcct

SEQ ID NO: 5308717 - DNA, 14 bp, Homo sapiens
tcacgcttcacagt

SEQ ID NO: 5308718 - DNA, 15 bp, Homo sapiens
tcacgcttcacagtg

SEQ ID NO: 5308719 - DNA, 14 bp, Homo sapiens
tcacgcttcttctt

SEQ ID NO: 5308720 - DNA, 13 bp, Homo sapiens
tcacgctttgttt

SEQ ID NO: 5308721 - DNA, 17 bp, Homo sapiens
tcacgctttgtttactc

SEQ ID NO: 5308722 - DNA, 16 bp, Homo sapiens
tcacgctttttgaaaa

SEQ ID NO: 5308723 - DNA, 14 bp, Homo sapiens
tcacggaagagcct

SEQ ID NO: 5308724 - DNA, 15 bp, Homo sapiens
tcacggaagttttca

SEQ ID NO: 5308725 - DNA, 19 bp, Homo sapiens
tcacggacaggaagcacag

SEQ ID NO: 5308726 - DNA, 15 bp, Homo sapiens
tcacggagacagcaa

SEQ ID NO: 5308727 - DNA, 22 bp, Homo sapiens
tcacggcaggacaacgaggaag

SEQ ID NO: 5308728 - DNA, 23 bp, Homo sapiens
tcacggcaggacaacgaggaagc

SEQ ID NO: 5308729 - DNA, 12 bp, Homo sapiens
tcacggccaggc

SEQ ID NO: 5308730 - DNA, 15 bp, Homo sapiens
tcacggccaggcaga

SEQ ID NO: 5308731 - DNA, 12 bp, Homo sapiens
tcacggcctggc

SEQ ID NO: 5308732 - DNA, 17 bp, Homo sapiens
tcacggctactctatat

SEQ ID NO: 5308733 - DNA, 20 bp, Homo sapiens
tcacggctcactgcagcctc

SEQ ID NO: 5308734 - DNA, 13 bp, Homo sapiens
tcacggctgcacc

SEQ ID NO: 5308735 - DNA, 20 bp, Homo sapiens
tcacgggcatgggcactccc

SEQ ID NO: 5308736 - DNA, 14 bp, Homo sapiens
tcacgggccctgcc

SEQ ID NO: 5308737 - DNA, 22 bp, Homo sapiens
tcacgggccctgccccagcccc

SEQ ID NO: 5308738 - DNA, 13 bp, Homo sapiens
tcacggggcctcc

SEQ ID NO: 5308739 - DNA, 22 bp, Homo sapiens
tcacggtgacacaggtcagggc

SEQ ID NO: 5308740 - DNA, 20 bp, Homo sapiens
tcacgtaaagctagaaatga

SEQ ID NO: 5308741 - DNA, 20 bp, Homo sapiens
tcacgtaaatattcatatta

SEQ ID NO: 5308742 - DNA, 23 bp, Homo sapiens
tcacgtacaaaactctgtataag

SEQ ID NO: 5308743 - DNA, 18 bp, Homo sapiens
tcacgtatttcacagagc

SEQ ID NO: 5308744 - DNA, 16 bp, Homo sapiens
tcacgtcactgccaga

SEQ ID NO: 5308745 - DNA, 12 bp, Homo sapiens
tcacgtcatttg

SEQ ID NO: 5308746 - DNA, 17 bp, Homo sapiens
tcacgtccatcactggc

SEQ ID NO: 5308747 - DNA, 14 bp, Homo sapiens
tcacgtctgtgagt

SEQ ID NO: 5308748 - DNA, 22 bp, Homo sapiens
tcacgtctgtgagtctgtcctt

SEQ ID NO: 5308749 - DNA, 14 bp, Homo sapiens
tcacgtgaaatatt

SEQ ID NO: 5308750 - DNA, 15 bp, Homo sapiens
tcacgtgaccctgtg

SEQ ID NO: 5308751 - DNA, 21 bp, Homo sapiens
tcacgtgaccctgtgccccgc

SEQ ID NO: 5308752 - DNA, 17 bp, Homo sapiens
tcacgtgaggcccctgt

SEQ ID NO: 5308753 - DNA, 22 bp, Homo sapiens
tcacgtgcgctgggcacttccc

SEQ ID NO: 5308754 - DNA, 16 bp, Homo sapiens
tcacgtggaggagcag

SEQ ID NO: 5308755 - DNA, 16 bp, Homo sapiens
tcacttccccaagatc

SEQ ID NO: 5308756 - DNA, 19 bp, Homo sapiens
tcacttcccgagcgctggt

SEQ ID NO: 5308757 - DNA, 15 bp, Homo sapiens
tcacttccctgggaa

SEQ ID NO: 5308758 - DNA, 16 bp, Homo sapiens
tcacttccctgggaac

SEQ ID NO: 5308759 - DNA, 22 bp, Homo sapiens
tcacttcctagagcatctgtcc

SEQ ID NO: 5308760 - DNA, 14 bp, Homo sapiens
tcacttcctagggt

SEQ ID NO: 5308761 - DNA, 13 bp, Homo sapiens
tcacttcctccag

SEQ ID NO: 5308762 - DNA, 18 bp, Homo sapiens
tcacttcctccagaagcc

SEQ ID NO: 5308763 - DNA, 20 bp, Homo sapiens
tcacttcctcgctctcctaa

SEQ ID NO: 5308764 - DNA, 14 bp, Homo sapiens
tcacttcctctcca

SEQ ID NO: 5308765 - DNA, 20 bp, Homo sapiens
tcacttcctctccacaggag

SEQ ID NO: 5308766 - DNA, 21 bp, Homo sapiens
tcacttcctttgcccttcctc

SEQ ID NO: 5308767 - DNA, 20 bp, Homo sapiens
tcacttcgaaattctgagtt

SEQ ID NO: 5308768 - DNA, 22 bp, Homo sapiens
tcacttcgttggtgaccagttt

SEQ ID NO: 5308769 - DNA, 16 bp, Homo sapiens
tcacttctaaaccaaa

SEQ ID NO: 5308770 - DNA, 17 bp, Homo sapiens
tcacttctatttattta

SEQ ID NO: 5308771 - DNA, 12 bp, Homo sapiens
tcacttctccca

SEQ ID NO: 5308772 - DNA, 13 bp, Homo sapiens
tcacttctccccg

SEQ ID NO: 5308773 - DNA, 17 bp, Homo sapiens
tcacttctccccgcagc

SEQ ID NO: 5308774 - DNA, 12 bp, Homo sapiens
tcacttctcctg

SEQ ID NO: 5308775 - DNA, 18 bp, Homo sapiens
tcacttctgaccacactt

SEQ ID NO: 5308776 - DNA, 13 bp, Homo sapiens
tcacttctgggaa

SEQ ID NO: 5308777 - DNA, 12 bp, Homo sapiens
tcacttcttaag

SEQ ID NO: 5308778 - DNA, 16 bp, Homo sapiens
tcacttcttccactgt

SEQ ID NO: 5308779 - DNA, 12 bp, Homo sapiens
tcacttcttcct

SEQ ID NO: 5308780 - DNA, 14 bp, Homo sapiens
tcacttctttccct

SEQ ID NO: 5308781 - DNA, 22 bp, Homo sapiens
tcacttctttcccttcctccat

SEQ ID NO: 5308782 - DNA, 18 bp, Homo sapiens
tcacttctttgcagagcc

SEQ ID NO: 5308783 - DNA, 23 bp, Homo sapiens
tcacttgaggccaggactttgag

SEQ ID NO: 5308784 - DNA, 18 bp, Homo sapiens
tcacttgaggtcaggagt

SEQ ID NO: 5308785 - DNA, 14 bp, Homo sapiens
tcacttgatgatac

SEQ ID NO: 5308786 - DNA, 19 bp, Homo sapiens
tcacttgatgtgccatttt

SEQ ID NO: 5308787 - DNA, 19 bp, Homo sapiens
tcacttgatgtttcctgga

SEQ ID NO: 5308788 - DNA, 16 bp, Homo sapiens
tcacttgattcatctc

SEQ ID NO: 5308789 - DNA, 17 bp, Homo sapiens
tcacttgcactggggga

SEQ ID NO: 5308790 - DNA, 11 bp, Homo sapiens
tcacttgcagt

SEQ ID NO: 5308791 - DNA, 21 bp, Homo sapiens
tcacttgccaaattctggctt

SEQ ID NO: 5308792 - DNA, 11 bp, Homo sapiens
tcacttgccac

SEQ ID NO: 5308793 - DNA, 14 bp, Homo sapiens
tcacttgccacatg

SEQ ID NO: 5308794 - DNA, 20 bp, Homo sapiens
tcacttgccattgccaggag

SEQ ID NO: 5308795 - DNA, 22 bp, Homo sapiens
tcacttgccattgccaggagat

SEQ ID NO: 5308796 - DNA, 14 bp, Homo sapiens
tcacttgctgcttt

SEQ ID NO: 5308797 - DNA, 19 bp, Homo sapiens
tcacttgctgctttttctg

SEQ ID NO: 5308798 - DNA, 11 bp, Homo sapiens
tcacttgctgg

SEQ ID NO: 5308799 - DNA, 18 bp, Homo sapiens
tcacttgctggctgtgaa

SEQ ID NO: 5308800 - DNA, 23 bp, Homo sapiens
tcacttggctgtctgaccagaga

SEQ ID NO: 5308801 - DNA, 18 bp, Homo sapiens
tcacttgggcccaggagg

SEQ ID NO: 5308802 - DNA, 21 bp, Homo sapiens
tcacttgggcccaggaggtca

SEQ ID NO: 5308803 - DNA, 21 bp, Homo sapiens
tcacttgggctctctctagct

SEQ ID NO: 5308804 - DNA, 15 bp, Homo sapiens
tcacttgggtctctg

SEQ ID NO: 5308805 - DNA, 14 bp, Homo sapiens
tcacttgtaaataa

SEQ ID NO: 5308806 - DNA, 17 bp, Homo sapiens
tcacttgtaaataaata

SEQ ID NO: 5308807 - DNA, 13 bp, Homo sapiens
tcacttgtaaggg

SEQ ID NO: 5308808 - DNA, 20 bp, Homo sapiens
tcacttgtaggtttctctgc

SEQ ID NO: 5308809 - DNA, 23 bp, Homo sapiens
tcacttgtaggtttctctgcctc

SEQ ID NO: 5308810 - DNA, 20 bp, Homo sapiens
tcacttgtattgactttatg

SEQ ID NO: 5308811 - DNA, 16 bp, Homo sapiens
tcacttgtcgggggcc

SEQ ID NO: 5308812 - DNA, 16 bp, Homo sapiens
tcacttgtctcctttc

SEQ ID NO: 5308813 - DNA, 17 bp, Homo sapiens
tcacttgtgcagtgttg

SEQ ID NO: 5308814 - DNA, 21 bp, Homo sapiens
tcacttgtgccaacactcaag

SEQ ID NO: 5308815 - DNA, 13 bp, Homo sapiens
tcacttgtgcttt

SEQ ID NO: 5308816 - DNA, 18 bp, Homo sapiens
tcacttgtgctttgctct

SEQ ID NO: 5308817 - DNA, 12 bp, Homo sapiens
tcacttgtgggg

SEQ ID NO: 5308818 - DNA, 15 bp, Homo sapiens
tcacttgttgtttta

SEQ ID NO: 5308819 - DNA, 15 bp, Homo sapiens
tcacttgttttattg

SEQ ID NO: 5308820 - DNA, 22 bp, Homo sapiens
tcactttaattctcatgtgatc

SEQ ID NO: 5308821 - DNA, 21 bp, Homo sapiens
tcactttacacaatagaatta

SEQ ID NO: 5308822 - DNA, 20 bp, Homo sapiens
tcactttacataagaaatgt

SEQ ID NO: 5308823 - DNA, 21 bp, Homo sapiens
tcactttacataagaaatgta

SEQ ID NO: 5308824 - DNA, 21 bp, Homo sapiens
tcactttaccttcagcagtta

SEQ ID NO: 5308825 - DNA, 14 bp, Homo sapiens
tcactttactttca

SEQ ID NO: 5308826 - DNA, 16 bp, Homo sapiens
tcactttactttcaag

SEQ ID NO: 5308827 - DNA, 14 bp, Homo sapiens
tcactttagatgct

SEQ ID NO: 5308828 - DNA, 14 bp, Homo sapiens
tcactttattattt

SEQ ID NO: 5308829 - DNA, 13 bp, Homo sapiens
tcactttattgct

SEQ ID NO: 5308830 - DNA, 13 bp, Homo sapiens
tcactttcaattc

SEQ ID NO: 5308831 - DNA, 14 bp, Homo sapiens
tcactttcatctga

SEQ ID NO: 5308832 - DNA, 18 bp, Homo sapiens
tcactttccaccaagtgt

SEQ ID NO: 5308833 - DNA, 15 bp, Homo sapiens
tcactttccctgatc

SEQ ID NO: 5308834 - DNA, 13 bp, Homo sapiens
tcactttcctcag

SEQ ID NO: 5308835 - DNA, 14 bp, Homo sapiens
tcactttcctcagt

SEQ ID NO: 5308836 - DNA, 14 bp, Homo sapiens
tcactttcctggat

SEQ ID NO: 5308837 - DNA, 14 bp, Homo sapiens
tcactttctagatt

SEQ ID NO: 5308838 - DNA, 16 bp, Homo sapiens
tcactttctcctggtg

SEQ ID NO: 5308839 - DNA, 15 bp, Homo sapiens
tcactttctctctta

SEQ ID NO: 5308840 - DNA, 17 bp, Homo sapiens
tcactttgacacccagg

SEQ ID NO: 5308841 - DNA, 19 bp, Homo sapiens
tcactttgacacttttcat

SEQ ID NO: 5308842 - DNA, 16 bp, Homo sapiens
tcactttgacaggttc

SEQ ID NO: 5308843 - DNA, 17 bp, Homo sapiens
tcactttgcaaagacag

SEQ ID NO: 5308844 - DNA, 20 bp, Homo sapiens
tcactttgccattatgcaaa

SEQ ID NO: 5308845 - DNA, 13 bp, Homo sapiens
tcactttgcgtgt

SEQ ID NO: 5308846 - DNA, 18 bp, Homo sapiens
tcactttgcgtgtgtcat

SEQ ID NO: 5308847 - DNA, 15 bp, Homo sapiens
tcactttggtctcca

SEQ ID NO: 5308848 - DNA, 17 bp, Homo sapiens
tcactttggttggaact

SEQ ID NO: 5308849 - DNA, 20 bp, Homo sapiens
tcactttgtaaataaaaaca

SEQ ID NO: 5308850 - DNA, 13 bp, Homo sapiens
tcactttgtgaat

SEQ ID NO: 5308851 - DNA, 18 bp, Homo sapiens
tcactttgtttatgcata

SEQ ID NO: 5308852 - DNA, 22 bp, Homo sapiens
tcacttttagggagagtcatat

SEQ ID NO: 5308853 - DNA, 16 bp, Homo sapiens
tcacttttagttggca

SEQ ID NO: 5308854 - DNA, 22 bp, Homo sapiens
tcacttttcaatttgtcatgtt

SEQ ID NO: 5308855 - DNA, 13 bp, Homo sapiens
tcacttttcactt

SEQ ID NO: 5308856 - DNA, 14 bp, Homo sapiens
tcacttttcacttg

SEQ ID NO: 5308857 - DNA, 13 bp, Homo sapiens
tcacttttcagtg

SEQ ID NO: 5308858 - DNA, 15 bp, Homo sapiens
tcacttttcatcctt

SEQ ID NO: 5308859 - DNA, 19 bp, Homo sapiens
tcacttttcatccttcccc

SEQ ID NO: 5308860 - DNA, 15 bp, Homo sapiens
tcacttttccttttc

SEQ ID NO: 5308861 - DNA, 13 bp, Homo sapiens
tcacttttgttct

SEQ ID NO: 5308862 - DNA, 14 bp, Homo sapiens
tcacttttgttctg

SEQ ID NO: 5308863 - DNA, 23 bp, Homo sapiens
tcacttttgttgcccaggctgga

SEQ ID NO: 5308864 - DNA, 14 bp, Homo sapiens
tcactttttccaaa

SEQ ID NO: 5308865 - DNA, 18 bp, Homo sapiens
tcactttttcccctgcaa

SEQ ID NO: 5308866 - DNA, 16 bp, Homo sapiens
tcactttttctgataa

SEQ ID NO: 5308867 - DNA, 15 bp, Homo sapiens
tcactttttgaacta

SEQ ID NO: 5308868 - DNA, 20 bp, Homo sapiens
tcactttttggaattgtctt

SEQ ID NO: 5308869 - DNA, 14 bp, Homo sapiens
tcacttttttacaa

SEQ ID NO: 5308870 - DNA, 13 bp, Homo sapiens
tcacttttttcct

SEQ ID NO: 5308871 - DNA, 15 bp, Homo sapiens
tcacttttttcctgt

SEQ ID NO: 5308872 - DNA, 18 bp, Homo sapiens
tcacttttttcctgtcaa

SEQ ID NO: 5308873 - DNA, 22 bp, Homo sapiens
tcacttttttcctgtcaatata

SEQ ID NO: 5308874 - DNA, 15 bp, Homo sapiens
tcactttttttttcc

SEQ ID NO: 5308875 - DNA, 22 bp, Homo sapiens
tcactttttttttttgtttgat

SEQ ID NO: 5308876 - DNA, 19 bp, Homo sapiens
tcactttttttttttttcc

SEQ ID NO: 5308877 - DNA, 10 bp, Homo sapiens
tcagaaaaaa

SEQ ID NO: 5308878 - DNA, 23 bp, Homo sapiens
tcagaaaaaaggttctttgtgta

SEQ ID NO: 5308879 - DNA, 17 bp, Homo sapiens
tcagaaaaatggagcaa

SEQ ID NO: 5308880 - DNA, 15 bp, Homo sapiens
tcagaaaaattaatt

SEQ ID NO: 5308881 - DNA, 22 bp, Homo sapiens
tcagaaaacagggtccaggaat

SEQ ID NO: 5308882 - DNA, 22 bp, Homo sapiens
tcagaaaacataatataagaat

SEQ ID NO: 5308883 - DNA, 16 bp, Homo sapiens
tcagaaaaccaaaggg

SEQ ID NO: 5308884 - DNA, 20 bp, Homo sapiens
tcagaaaagctattaaagtt

SEQ ID NO: 5308885 - DNA, 10 bp, Homo sapiens
tcagaaaagt

SEQ ID NO: 5308886 - DNA, 17 bp, Homo sapiens
tcagaaaagtaattttg

SEQ ID NO: 5308887 - DNA, 13 bp, Homo sapiens
tcagaaaagtaga

SEQ ID NO: 5308888 - DNA, 17 bp, Homo sapiens
tcagaaaagtagaatta

SEQ ID NO: 5308889 - DNA, 21 bp, Homo sapiens
tcagaaaagtagaattatatc

SEQ ID NO: 5308890 - DNA, 12 bp, Homo sapiens
tcagaaaataaa

SEQ ID NO: 5308891 - DNA, 19 bp, Homo sapiens
tcagaaaataaaatattca

SEQ ID NO: 5308892 - DNA, 15 bp, Homo sapiens
tcagaaaatacctta

SEQ ID NO: 5308893 - DNA, 17 bp, Homo sapiens
tcagaaaatattatgtg

SEQ ID NO: 5308894 - DNA, 19 bp, Homo sapiens
tcagaaaatattatgtgtt

SEQ ID NO: 5308895 - DNA, 15 bp, Homo sapiens
tcagaaaatgttctg

SEQ ID NO: 5308896 - DNA, 16 bp, Homo sapiens
tcagaaaattggcagt

SEQ ID NO: 5308897 - DNA, 16 bp, Homo sapiens
tcagaaaatttctcaa

SEQ ID NO: 5308898 - DNA, 24 bp, Homo sapiens
tcagaaacaaagcatttgactttc

SEQ ID NO: 5308899 - DNA, 21 bp, Homo sapiens
tcagaaacactggggctggca

SEQ ID NO: 5308900 - DNA, 14 bp, Homo sapiens
tcagaaacaggacc

SEQ ID NO: 5308901 - DNA, 14 bp, Homo sapiens
tcagaaacagggca

SEQ ID NO: 5308902 - DNA, 15 bp, Homo sapiens
tcagaaacagggcag

SEQ ID NO: 5308903 - DNA, 16 bp, Homo sapiens
tcagaaacagggcagc

SEQ ID NO: 5308904 - DNA, 17 bp, Homo sapiens
tcagaaacagggcagca

SEQ ID NO: 5308905 - DNA, 18 bp, Homo sapiens
tcagaaacagggcagcag

SEQ ID NO: 5308906 - DNA, 22 bp, Homo sapiens
tcagaaacagggcagcagtggg

SEQ ID NO: 5308907 - DNA, 19 bp, Homo sapiens
tcagaaacatgaaatgctt

SEQ ID NO: 5308908 - DNA, 15 bp, Homo sapiens
tcagaaaccagactc

SEQ ID NO: 5308909 - DNA, 22 bp, Homo sapiens
tcagaaaccagttatgtgaatg

SEQ ID NO: 5308910 - DNA, 20 bp, Homo sapiens
tcagaaaccctcattgtgtt

SEQ ID NO: 5308911 - DNA, 16 bp, Homo sapiens
tcagaaactaaaacaa

SEQ ID NO: 5308912 - DNA, 15 bp, Homo sapiens
tcagaaactcccctg

SEQ ID NO: 5308913 - DNA, 22 bp, Homo sapiens
tcagaaactgaattctggacag

SEQ ID NO: 5308914 - DNA, 15 bp, Homo sapiens
tcagaaacttgtgaa

SEQ ID NO: 5308915 - DNA, 16 bp, Homo sapiens
tcagaaacttgtgaag

SEQ ID NO: 5308916 - DNA, 20 bp, Homo sapiens
tcagaaagaaaaaattttat

SEQ ID NO: 5308917 - DNA, 22 bp, Homo sapiens
tcagaaagaattgatcagaatc

SEQ ID NO: 5308918 - DNA, 20 bp, Homo sapiens
tcagaaagacattcttagtt

SEQ ID NO: 5308919 - DNA, 13 bp, Homo sapiens
tcagaaagacttg

SEQ ID NO: 5308920 - DNA, 13 bp, Homo sapiens
tcagaaagagctc

SEQ ID NO: 5308921 - DNA, 17 bp, Homo sapiens
tcagaaagatcaaatta

SEQ ID NO: 5308922 - DNA, 23 bp, Homo sapiens
tcagaaagcctttcattttgctt

SEQ ID NO: 5308923 - DNA, 19 bp, Homo sapiens
tcagaaagcttcaaattat

SEQ ID NO: 5308924 - DNA, 16 bp, Homo sapiens
tcagaaagctttattt

SEQ ID NO: 5308925 - DNA, 17 bp, Homo sapiens
tcagaaaggaaaaacaa

SEQ ID NO: 5308926 - DNA, 13 bp, Homo sapiens
tcagaaaggattt

SEQ ID NO: 5308927 - DNA, 17 bp, Homo sapiens
tcagaaagggagggctc

SEQ ID NO: 5308928 - DNA, 19 bp, Homo sapiens
tcagaaagggagggctctg

SEQ ID NO: 5308929 - DNA, 20 bp, Homo sapiens
tcagaaagggcagcccctcc

SEQ ID NO: 5308930 - DNA, 22 bp, Homo sapiens
tcagaaagggcagcccctcccc

SEQ ID NO: 5308931 - DNA, 23 bp, Homo sapiens
tcagaaagggcagcccctcccca

SEQ ID NO: 5308932 - DNA, 13 bp, Homo sapiens
tcagaaagtaaca

SEQ ID NO: 5308933 - DNA, 18 bp, Homo sapiens
tcagaaagtaacaatcta

SEQ ID NO: 5308934 - DNA, 18 bp, Homo sapiens
tcagcactgtggacacct

SEQ ID NO: 5308935 - DNA, 20 bp, Homo sapiens
tcagcacttaactatgagcc

SEQ ID NO: 5308936 - DNA, 19 bp, Homo sapiens
tcagcacttggcccttcta

SEQ ID NO: 5308937 - DNA, 23 bp, Homo sapiens
tcagcacttgggggatctgttgt

SEQ ID NO: 5308938 - DNA, 23 bp, Homo sapiens
tcagcagaaacacacagtcacat

SEQ ID NO: 5308939 - DNA, 13 bp, Homo sapiens
tcagcagaaaccc

SEQ ID NO: 5308940 - DNA, 13 bp, Homo sapiens
tcagcagaacctg

SEQ ID NO: 5308941 - DNA, 14 bp, Homo sapiens
tcagcagacactcc

SEQ ID NO: 5308942 - DNA, 13 bp, Homo sapiens
tcagcagactgat

SEQ ID NO: 5308943 - DNA, 21 bp, Homo sapiens
tcagcagagaaggtaaggtgt

SEQ ID NO: 5308944 - DNA, 16 bp, Homo sapiens
tcagcagaggcagtgg

SEQ ID NO: 5308945 - DNA, 14 bp, Homo sapiens
tcagcagagtgagg

SEQ ID NO: 5308946 - DNA, 22 bp, Homo sapiens
tcagcagagttattgaatctta

SEQ ID NO: 5308947 - DNA, 21 bp, Homo sapiens
tcagcagatgttgaagacagg

SEQ ID NO: 5308948 - DNA, 13 bp, Homo sapiens
tcagcagcagctc

SEQ ID NO: 5308949 - DNA, 14 bp, Homo sapiens
tcagcagcagctca

SEQ ID NO: 5308950 - DNA, 20 bp, Homo sapiens
tcagcagccagtctcagaga

SEQ ID NO: 5308951 - DNA, 22 bp, Homo sapiens
tcagcagccagtctcagagacc

SEQ ID NO: 5308952 - DNA, 12 bp, Homo sapiens
tcagcagcccca

SEQ ID NO: 5308953 - DNA, 14 bp, Homo sapiens
tcagcagccccctg

SEQ ID NO: 5308954 - DNA, 21 bp, Homo sapiens
tcagcagccctagcggctgct

SEQ ID NO: 5308955 - DNA, 12 bp, Homo sapiens
tcagcagccctc

SEQ ID NO: 5308956 - DNA, 22 bp, Homo sapiens
tcagcagcctgcgctcggcagg

SEQ ID NO: 5308957 - DNA, 19 bp, Homo sapiens
tcagcagcggcagcagcag

SEQ ID NO: 5308958 - DNA, 17 bp, Homo sapiens
tcagcagctctggctct

SEQ ID NO: 5308959 - DNA, 21 bp, Homo sapiens
tcagcagctctggctctgcct

SEQ ID NO: 5308960 - DNA, 15 bp, Homo sapiens
tcagcaggaacctgt

SEQ ID NO: 5308961 - DNA, 14 bp, Homo sapiens
tcagcaggaagcaa

SEQ ID NO: 5308962 - DNA, 19 bp, Homo sapiens
tcagcaggaagggtgggaa

SEQ ID NO: 5308963 - DNA, 13 bp, Homo sapiens
tcagcaggcagcc

SEQ ID NO: 5308964 - DNA, 16 bp, Homo sapiens
tcagcaggcagccttg

SEQ ID NO: 5308965 - DNA, 13 bp, Homo sapiens
tcagcaggcaggc

SEQ ID NO: 5308966 - DNA, 14 bp, Homo sapiens
tcagcaggcaggct

SEQ ID NO: 5308967 - DNA, 18 bp, Homo sapiens
tcagcaggcaggctgggg

SEQ ID NO: 5308968 - DNA, 14 bp, Homo sapiens
tcagcaggcccagg

SEQ ID NO: 5308969 - DNA, 13 bp, Homo sapiens
tcagcaggcccta

SEQ ID NO: 5308970 - DNA, 20 bp, Homo sapiens
tcagcaggcccttcccattc

SEQ ID NO: 5308971 - DNA, 17 bp, Homo sapiens
tcagcaggctagacaga

SEQ ID NO: 5308972 - DNA, 18 bp, Homo sapiens
tcagcaggctagacagaa

SEQ ID NO: 5308973 - DNA, 20 bp, Homo sapiens
tcagcagggctggtcacctc

SEQ ID NO: 5308974 - DNA, 23 bp, Homo sapiens
tcagcagggctggtcacctccca

SEQ ID NO: 5308975 - DNA, 23 bp, Homo sapiens
tcagcaggggggttgggttccag

SEQ ID NO: 5308976 - DNA, 21 bp, Homo sapiens
tcagcaggttccagtgcctga

SEQ ID NO: 5308977 - DNA, 13 bp, Homo sapiens
tcagcagtcatgc

SEQ ID NO: 5308978 - DNA, 19 bp, Homo sapiens
tcagcagtctaaattttct

SEQ ID NO: 5308979 - DNA, 12 bp, Homo sapiens
tcagcagtctag

SEQ ID NO: 5308980 - DNA, 13 bp, Homo sapiens
tcagcagtgacca

SEQ ID NO: 5308981 - DNA, 21 bp, Homo sapiens
tcagcagtggagtttaaaaat

SEQ ID NO: 5308982 - DNA, 14 bp, Homo sapiens
tcagcagtgtctgt

SEQ ID NO: 5308983 - DNA, 14 bp, Homo sapiens
tcagcagttgacat

SEQ ID NO: 5308984 - DNA, 17 bp, Homo sapiens
tcagcagttgacatcca

SEQ ID NO: 5308985 - DNA, 18 bp, Homo sapiens
tcagcagttgctggtaaa

SEQ ID NO: 5308986 - DNA, 16 bp, Homo sapiens
tcagcataaatgggaa

SEQ ID NO: 5308987 - DNA, 20 bp, Homo sapiens
tcagcataagtaaacaacat

SEQ ID NO: 5308988 - DNA, 17 bp, Homo sapiens
tcagcatagcctgcctg

SEQ ID NO: 5308989 - DNA, 21 bp, Homo sapiens
tcagcatatatataaaataca

SEQ ID NO: 5308990 - DNA, 11 bp, Homo sapiens
tcagcatatga

SEQ ID NO: 5308991 - DNA, 13 bp, Homo sapiens
tcagcatatttgt

SEQ ID NO: 5308992 - DNA, 22 bp, Homo sapiens
tcagcatatttgtatagttgct

SEQ ID NO: 5308993 - DNA, 15 bp, Homo sapiens
tcagcatcaaacatg

SEQ ID NO: 5308994 - DNA, 14 bp, Homo sapiens
tcagcatcactgat

SEQ ID NO: 5308995 - DNA, 17 bp, Homo sapiens
tcagcatcactgatggg

SEQ ID NO: 5308996 - DNA, 18 bp, Homo sapiens
tcagcatcactgatggga

SEQ ID NO: 5308997 - DNA, 14 bp, Homo sapiens
tcagcatccagtgt

SEQ ID NO: 5308998 - DNA, 22 bp, Homo sapiens
tcagcatcccacgatcggcctt

SEQ ID NO: 5308999 - DNA, 18 bp, Homo sapiens
tcagcatcctcagttcct

SEQ ID NO: 5309000 - DNA, 18 bp, Homo sapiens
tcagcatcctggaaattt

SEQ ID NO: 5309001 - DNA, 17 bp, Homo sapiens
tcagcatcctggcaccc

SEQ ID NO: 5309002 - DNA, 15 bp, Homo sapiens
tcagcatctgaccat

SEQ ID NO: 5309003 - DNA, 17 bp, Homo sapiens
tcagcatctgaccatct

SEQ ID NO: 5309004 - DNA, 20 bp, Homo sapiens
tcagcatctgaccatctgtg

SEQ ID NO: 5309005 - DNA, 21 bp, Homo sapiens
tcagcatctgaccatctgtga

SEQ ID NO: 5309006 - DNA, 23 bp, Homo sapiens
tcagcatctgaccatctgtgact

SEQ ID NO: 5309007 - DNA, 15 bp, Homo sapiens
tcagcatctggctgt

SEQ ID NO: 5309008 - DNA, 22 bp, Homo sapiens
tcagcatctggctgtctagaat

SEQ ID NO: 5309009 - DNA, 17 bp, Homo sapiens
tcagcatctgtgatggg

SEQ ID NO: 5309010 - DNA, 23 bp, Homo sapiens
tcagcatgaagaattttttctca

SEQ ID NO: 5309011 - DNA, 12 bp, Homo sapiens
tcagcatgacaa

SEQ ID NO: 5309012 - DNA, 13 bp, Homo sapiens
tcagcatgacaaa

SEQ ID NO: 5309013 - DNA, 24 bp, Homo sapiens
tcagcatgacaaaaataacactgt

SEQ ID NO: 5309014 - DNA, 20 bp, Homo sapiens
tcagcatgcctgtcctttca

SEQ ID NO: 5309015 - DNA, 22 bp, Homo sapiens
tcagcatgcttcccagagggag

SEQ ID NO: 5309016 - DNA, 12 bp, Homo sapiens
tcagcatgtcta

SEQ ID NO: 5309017 - DNA, 21 bp, Homo sapiens
tcagcatgtctattcagcttc

SEQ ID NO: 5309018 - DNA, 15 bp, Homo sapiens
tcagcatgttttctg

SEQ ID NO: 5309019 - DNA, 18 bp, Homo sapiens
tcagcattagagaaatga

SEQ ID NO: 5309020 - DNA, 23 bp, Homo sapiens
tcagcattagtgggaaaaagtgg

SEQ ID NO: 5309021 - DNA, 18 bp, Homo sapiens
tcagcattattcttcaga

SEQ ID NO: 5309022 - DNA, 14 bp, Homo sapiens
tcagcattcccaat

SEQ ID NO: 5309023 - DNA, 23 bp, Homo sapiens
tcagcattctcactcctacctgg

SEQ ID NO: 5309024 - DNA, 18 bp, Homo sapiens
tcagcattgtcagcctga

SEQ ID NO: 5309025 - DNA, 19 bp, Homo sapiens
tcagcatttaataaatgta

SEQ ID NO: 5309026 - DNA, 19 bp, Homo sapiens
tcagcatttccacaccaag

SEQ ID NO: 5309027 - DNA, 16 bp, Homo sapiens
tcagcatttccttcca

SEQ ID NO: 5309028 - DNA, 20 bp, Homo sapiens
tcagcatttccttccagccc

SEQ ID NO: 5309029 - DNA, 21 bp, Homo sapiens
tcagcatttccttccagccca

SEQ ID NO: 5309030 - DNA, 22 bp, Homo sapiens
tcagcatttccttccagcccat

SEQ ID NO: 5309031 - DNA, 21 bp, Homo sapiens
tcagcattttagaaactacaa

SEQ ID NO: 5309032 - DNA, 15 bp, Homo sapiens
tcagccaaagtccta

SEQ ID NO: 5309033 - DNA, 21 bp, Homo sapiens
tcagccaaatgacttcatttc

SEQ ID NO: 5309034 - DNA, 22 bp, Homo sapiens
tcagccaagaattcttaaatat

SEQ ID NO: 5309035 - DNA, 16 bp, Homo sapiens
tcagccaaggctcccg

SEQ ID NO: 5309036 - DNA, 15 bp, Homo sapiens
tcagccaaggggctg

SEQ ID NO: 5309037 - DNA, 18 bp, Homo sapiens
tcagccaatctggacact

SEQ ID NO: 5309038 - DNA, 20 bp, Homo sapiens
tcagccaatctggacacttc

SEQ ID NO: 5309039 - DNA, 15 bp, Homo sapiens
tcagccaattatgtt

SEQ ID NO: 5309040 - DNA, 19 bp, Homo sapiens
tcagccacaaagcccccca

SEQ ID NO: 5309041 - DNA, 21 bp, Homo sapiens
tcagccacaaagccccccagc

SEQ ID NO: 5309042 - DNA, 15 bp, Homo sapiens
tcagccacacccagg

SEQ ID NO: 5309043 - DNA, 17 bp, Homo sapiens
tcagccacacccaggca

SEQ ID NO: 5309044 - DNA, 18 bp, Homo sapiens
tcagccacactgggcctg

SEQ ID NO: 5309045 - DNA, 15 bp, Homo sapiens
tcagccacagcctga

SEQ ID NO: 5309046 - DNA, 23 bp, Homo sapiens
tcagccacagggagccacacaga

SEQ ID NO: 5309047 - DNA, 19 bp, Homo sapiens
tcagccaccctgaggcctc

SEQ ID NO: 5309048 - DNA, 13 bp, Homo sapiens
tcagccacctccc

SEQ ID NO: 5309049 - DNA, 15 bp, Homo sapiens
tcagccacctgggaa

SEQ ID NO: 5309050 - DNA, 18 bp, Homo sapiens
tcagccacgaccagcccc

SEQ ID NO: 5309051 - DNA, 18 bp, Homo sapiens
tcagccacgcctctctca

SEQ ID NO: 5309052 - DNA, 15 bp, Homo sapiens
tcagccactcccagg

SEQ ID NO: 5309053 - DNA, 15 bp, Homo sapiens
tcagccactgggacc

SEQ ID NO: 5309054 - DNA, 16 bp, Homo sapiens
tcagccactgtcacag

SEQ ID NO: 5309055 - DNA, 20 bp, Homo sapiens
tcagccactgtcacaggcat

SEQ ID NO: 5309056 - DNA, 16 bp, Homo sapiens
tcagccactgtgtctt

SEQ ID NO: 5309057 - DNA, 21 bp, Homo sapiens
tcagccagaagccacccaaag

SEQ ID NO: 5309058 - DNA, 23 bp, Homo sapiens
tcagccagaatcttcgtcctgcc

SEQ ID NO: 5309059 - DNA, 15 bp, Homo sapiens
tcagccagccccatc

SEQ ID NO: 5309060 - DNA, 14 bp, Homo sapiens
tcagccagccctct

SEQ ID NO: 5309061 - DNA, 14 bp, Homo sapiens
tcagccagccctgg

SEQ ID NO: 5309062 - DNA, 15 bp, Homo sapiens
tcagccagccgccct

SEQ ID NO: 5309063 - DNA, 23 bp, Homo sapiens
tcagccagccgccctgggctgtc

SEQ ID NO: 5309064 - DNA, 13 bp, Homo sapiens
tcagccagcctcg

SEQ ID NO: 5309065 - DNA, 18 bp, Homo sapiens
tcagccagccttccccac

SEQ ID NO: 5309066 - DNA, 18 bp, Homo sapiens
tcagccagctaccccttg

SEQ ID NO: 5309067 - DNA, 22 bp, Homo sapiens
tcagccagctgccctaaataac

SEQ ID NO: 5309068 - DNA, 13 bp, Homo sapiens
tcagccagctgtt

SEQ ID NO: 5309069 - DNA, 15 bp, Homo sapiens
tcagccagcttaaac

SEQ ID NO: 5309070 - DNA, 18 bp, Homo sapiens
tcagccaggagctgtcac

SEQ ID NO: 5309071 - DNA, 12 bp, Homo sapiens
tcagccagggcc

SEQ ID NO: 5309072 - DNA, 13 bp, Homo sapiens
tcagccagggcca

SEQ ID NO: 5309073 - DNA, 18 bp, Homo sapiens
tcagccagggccaggggt

SEQ ID NO: 5309074 - DNA, 14 bp, Homo sapiens
tcagccagggcctg

SEQ ID NO: 5309075 - DNA, 14 bp, Homo sapiens
tcagccaggtctga

SEQ ID NO: 5309076 - DNA, 21 bp, Homo sapiens
tcagccaggtctgactccaaa

SEQ ID NO: 5309077 - DNA, 20 bp, Homo sapiens
tcagccaggtgctgtgacac

SEQ ID NO: 5309078 - DNA, 20 bp, Homo sapiens
tcagccagtgaatctgtttc

SEQ ID NO: 5309079 - DNA, 20 bp, Homo sapiens
tcagccagtgaccaaccttt

SEQ ID NO: 5309080 - DNA, 18 bp, Homo sapiens
tcagccagtggcacagga

SEQ ID NO: 5309081 - DNA, 18 bp, Homo sapiens
tcagccatcgccaacttg

SEQ ID NO: 5309082 - DNA, 21 bp, Homo sapiens
tcagccatgaggagttgctgt

SEQ ID NO: 5309083 - DNA, 23 bp, Homo sapiens
tcagccatgaggagttgctgttt

SEQ ID NO: 5309084 - DNA, 20 bp, Homo sapiens
tcagccatgataagaacaga

SEQ ID NO: 5309085 - DNA, 14 bp, Homo sapiens
tcagccatggccct

SEQ ID NO: 5309086 - DNA, 21 bp, Homo sapiens
tcagccatgggaacctcatat

SEQ ID NO: 5309087 - DNA, 22 bp, Homo sapiens
tcagccatgggaacctcatatg

SEQ ID NO: 5309088 - DNA, 14 bp, Homo sapiens
tcagccatgtgctg

SEQ ID NO: 5309089 - DNA, 17 bp, Homo sapiens
tcagccattaaaataaa

SEQ ID NO: 5309090 - DNA, 18 bp, Homo sapiens
tcagccattaaaataaaa

SEQ ID NO: 5309091 - DNA, 21 bp, Homo sapiens
tcagccattaaaataaaacaa

SEQ ID NO: 5309092 - DNA, 23 bp, Homo sapiens
tcagccattaaaataaaacaagc

SEQ ID NO: 5309093 - DNA, 18 bp, Homo sapiens
tcagccattcctgttctc

SEQ ID NO: 5309094 - DNA, 19 bp, Homo sapiens
tcagccattgtggaagaca

SEQ ID NO: 5309095 - DNA, 18 bp, Homo sapiens
tcagccatttccccctcc

SEQ ID NO: 5309096 - DNA, 17 bp, Homo sapiens
tcagccatttttaatga

SEQ ID NO: 5309097 - DNA, 21 bp, Homo sapiens
tcagcccaaaccaccagaagc

SEQ ID NO: 5309098 - DNA, 16 bp, Homo sapiens
tcagcccaagatgctt

SEQ ID NO: 5309099 - DNA, 17 bp, Homo sapiens
tcagcccaagattcttc

SEQ ID NO: 5309100 - DNA, 18 bp, Homo sapiens
tcagcccaagattcttca

SEQ ID NO: 5309101 - DNA, 13 bp, Homo sapiens
tcagcccaccctc

SEQ ID NO: 5309102 - DNA, 13 bp, Homo sapiens
tcagcccacctgc

SEQ ID NO: 5309103 - DNA, 19 bp, Homo sapiens
tcagcccacctgcacccag

SEQ ID NO: 5309104 - DNA, 12 bp, Homo sapiens
tcagcccagaag

SEQ ID NO: 5309105 - DNA, 16 bp, Homo sapiens
tcagcccagaagaaaa

SEQ ID NO: 5309106 - DNA, 24 bp, Homo sapiens
tcagcccagaagaaaattctcctg

SEQ ID NO: 5309107 - DNA, 10 bp, Homo sapiens
tcagcccagc

SEQ ID NO: 5309108 - DNA, 17 bp, Homo sapiens
tcagcccagcacctgct

SEQ ID NO: 5309109 - DNA, 11 bp, Homo sapiens
tcagcccagct

SEQ ID NO: 5309110 - DNA, 14 bp, Homo sapiens
tcagcccagctggc

SEQ ID NO: 5309111 - DNA, 16 bp, Homo sapiens
tcagcttcatttgtgt

SEQ ID NO: 5309112 - DNA, 13 bp, Homo sapiens
tcagcttcccaac

SEQ ID NO: 5309113 - DNA, 22 bp, Homo sapiens
tcagcttcccaagtagctgaga

SEQ ID NO: 5309114 - DNA, 19 bp, Homo sapiens
tcagcttcccagccatgcc

SEQ ID NO: 5309115 - DNA, 19 bp, Homo sapiens
tcagcttcctacccacacc

SEQ ID NO: 5309116 - DNA, 23 bp, Homo sapiens
tcagcttcctacccacacctctg

SEQ ID NO: 5309117 - DNA, 19 bp, Homo sapiens
tcagcttcgtttattttca

SEQ ID NO: 5309118 - DNA, 22 bp, Homo sapiens
tcagcttctaattttgtgctct

SEQ ID NO: 5309119 - DNA, 19 bp, Homo sapiens
tcagcttctataagtgtga

SEQ ID NO: 5309120 - DNA, 14 bp, Homo sapiens
tcagcttctcccaa

SEQ ID NO: 5309121 - DNA, 18 bp, Homo sapiens
tcagcttctgctgggctg

SEQ ID NO: 5309122 - DNA, 19 bp, Homo sapiens
tcagcttctgctgggctgg

SEQ ID NO: 5309123 - DNA, 21 bp, Homo sapiens
tcagcttctgctgggctgggg

SEQ ID NO: 5309124 - DNA, 14 bp, Homo sapiens
tcagcttcttaata

SEQ ID NO: 5309125 - DNA, 21 bp, Homo sapiens
tcagcttcttcacaggcactc

SEQ ID NO: 5309126 - DNA, 21 bp, Homo sapiens
tcagcttcttgcactccttcc

SEQ ID NO: 5309127 - DNA, 17 bp, Homo sapiens
tcagcttgaacctgctt

SEQ ID NO: 5309128 - DNA, 19 bp, Homo sapiens
tcagcttgaacctgcttcc

SEQ ID NO: 5309129 - DNA, 22 bp, Homo sapiens
tcagcttgaacctgcttcctgg

SEQ ID NO: 5309130 - DNA, 16 bp, Homo sapiens
tcagcttgcacatttg

SEQ ID NO: 5309131 - DNA, 17 bp, Homo sapiens
tcagcttgcttagatgt

SEQ ID NO: 5309132 - DNA, 21 bp, Homo sapiens
tcagcttgcttagatgttcca

SEQ ID NO: 5309133 - DNA, 20 bp, Homo sapiens
tcagcttgtaaatagctcag

SEQ ID NO: 5309134 - DNA, 14 bp, Homo sapiens
tcagcttgtgcctt

SEQ ID NO: 5309135 - DNA, 22 bp, Homo sapiens
tcagctttaagatatctttgga

SEQ ID NO: 5309136 - DNA, 21 bp, Homo sapiens
tcagctttagaaattaatacc

SEQ ID NO: 5309137 - DNA, 23 bp, Homo sapiens
tcagctttagaaattaataccac

SEQ ID NO: 5309138 - DNA, 21 bp, Homo sapiens
tcagctttatttttctttaaa

SEQ ID NO: 5309139 - DNA, 16 bp, Homo sapiens
tcagctttcaaagcat

SEQ ID NO: 5309140 - DNA, 17 bp, Homo sapiens
tcagctttcaaagcatt

SEQ ID NO: 5309141 - DNA, 22 bp, Homo sapiens
tcagctttcagagccagtgaag

SEQ ID NO: 5309142 - DNA, 15 bp, Homo sapiens
tcagctttcagggcc

SEQ ID NO: 5309143 - DNA, 21 bp, Homo sapiens
tcagctttccctggctcaggg

SEQ ID NO: 5309144 - DNA, 23 bp, Homo sapiens
tcagctttgaaggctggattcta

SEQ ID NO: 5309145 - DNA, 22 bp, Homo sapiens
tcagctttgagaagccttcagc

SEQ ID NO: 5309146 - DNA, 21 bp, Homo sapiens
tcagctttggattgctggggc

SEQ ID NO: 5309147 - DNA, 16 bp, Homo sapiens
tcagctttggctctgg

SEQ ID NO: 5309148 - DNA, 16 bp, Homo sapiens
tcagcttttaataaaa

SEQ ID NO: 5309149 - DNA, 17 bp, Homo sapiens
tcagcttttaataaaat

SEQ ID NO: 5309150 - DNA, 18 bp, Homo sapiens
tcagcttttaataaaatt

SEQ ID NO: 5309151 - DNA, 14 bp, Homo sapiens
tcagcttttctgat

SEQ ID NO: 5309152 - DNA, 17 bp, Homo sapiens
tcagcttttgttctaga

SEQ ID NO: 5309153 - DNA, 19 bp, Homo sapiens
tcagcttttgttctagact

SEQ ID NO: 5309154 - DNA, 18 bp, Homo sapiens
tcagcttttgttgtttat

SEQ ID NO: 5309155 - DNA, 13 bp, Homo sapiens
tcagctttttgta

SEQ ID NO: 5309156 - DNA, 18 bp, Homo sapiens
tcagctttttgtcttttc

SEQ ID NO: 5309157 - DNA, 23 bp, Homo sapiens
tcaggaaaaatgaggaatccaaa

SEQ ID NO: 5309158 - DNA, 20 bp, Homo sapiens
tcaggaaaacagctagtaga

SEQ ID NO: 5309159 - DNA, 20 bp, Homo sapiens
tcaggaaaactgacagagga

SEQ ID NO: 5309160 - DNA, 21 bp, Homo sapiens
tcaggaaaactgacagaggag

SEQ ID NO: 5309161 - DNA, 15 bp, Homo sapiens
tcaggaaaaggcctg

SEQ ID NO: 5309162 - DNA, 16 bp, Homo sapiens
tcaggaaaaggcctgg

SEQ ID NO: 5309163 - DNA, 19 bp, Homo sapiens
tcaggaaaaggttgaataa

SEQ ID NO: 5309164 - DNA, 9 bp, Homo sapiens
tcaggaaac

SEQ ID NO: 5309165 - DNA, 20 bp, Homo sapiens
tcaggaaagaatagaaagaa

SEQ ID NO: 5309166 - DNA, 13 bp, Homo sapiens
tcaggaaagagaa

SEQ ID NO: 5309167 - DNA, 19 bp, Homo sapiens
tcaggaaagagaacttcca

SEQ ID NO: 5309168 - DNA, 23 bp, Homo sapiens
tcaggaaagagattagaacattt

SEQ ID NO: 5309169 - DNA, 22 bp, Homo sapiens
tcaggaaaggaagatgtaagaa

SEQ ID NO: 5309170 - DNA, 14 bp, Homo sapiens
tcaggaaaggctgt

SEQ ID NO: 5309171 - DNA, 15 bp, Homo sapiens
tcaggaaaggctgta

SEQ ID NO: 5309172 - DNA, 21 bp, Homo sapiens
tcaggaaatatatatgtgtgt

SEQ ID NO: 5309173 - DNA, 18 bp, Homo sapiens
tcaggaaatatctgtgaa

SEQ ID NO: 5309174 - DNA, 23 bp, Homo sapiens
tcaggaaatcaaatatgcaaagc

SEQ ID NO: 5309175 - DNA, 22 bp, Homo sapiens
tcaggaaatgttcactgaataa

SEQ ID NO: 5309176 - DNA, 14 bp, Homo sapiens
tcaggaaatttttg

SEQ ID NO: 5309177 - DNA, 18 bp, Homo sapiens
tcaggaacaagtaatgta

SEQ ID NO: 5309178 - DNA, 13 bp, Homo sapiens
tcaggaacactct

SEQ ID NO: 5309179 - DNA, 16 bp, Homo sapiens
tcaggaacagaaggat

SEQ ID NO: 5309180 - DNA, 17 bp, Homo sapiens
tcaggaacagtggctgg

SEQ ID NO: 5309181 - DNA, 14 bp, Homo sapiens
tcaggaaccagggc

SEQ ID NO: 5309182 - DNA, 15 bp, Homo sapiens
tcaggaaccagggcc

SEQ ID NO: 5309183 - DNA, 16 bp, Homo sapiens
tcaggaaccagggcct

SEQ ID NO: 5309184 - DNA, 17 bp, Homo sapiens
tcaggaaccagggcctc

SEQ ID NO: 5309185 - DNA, 23 bp, Homo sapiens
tcaggaaccagggcctccctgtt

SEQ ID NO: 5309186 - DNA, 21 bp, Homo sapiens
tcaggaacccaccctctccac

SEQ ID NO: 5309187 - DNA, 17 bp, Homo sapiens
tcaggaaccgaggcagg

SEQ ID NO: 5309188 - DNA, 18 bp, Homo sapiens
tcaggaaccgaggcaggg

SEQ ID NO: 5309189 - DNA, 21 bp, Homo sapiens
tcaggaacctcgagtactgtg

SEQ ID NO: 5309190 - DNA, 13 bp, Homo sapiens
tcaggaacctgga

SEQ ID NO: 5309191 - DNA, 16 bp, Homo sapiens
tcaggaacctggacca

SEQ ID NO: 5309192 - DNA, 22 bp, Homo sapiens
tcaggaacctggaccaaagctg

SEQ ID NO: 5309193 - DNA, 22 bp, Homo sapiens
tcaggaacgtttagctgacaaa

SEQ ID NO: 5309194 - DNA, 19 bp, Homo sapiens
tcaggaagaaaccccaagc

SEQ ID NO: 5309195 - DNA, 13 bp, Homo sapiens
tcaggaagaacac

SEQ ID NO: 5309196 - DNA, 20 bp, Homo sapiens
tcaggaagagaaggagcaga

SEQ ID NO: 5309197 - DNA, 18 bp, Homo sapiens
tcaggaagcctcctgctg

SEQ ID NO: 5309198 - DNA, 20 bp, Homo sapiens
tcaggaagcctcctgctgag

SEQ ID NO: 5309199 - DNA, 13 bp, Homo sapiens
tcaggaagctcag

SEQ ID NO: 5309200 - DNA, 17 bp, Homo sapiens
tcaggaaggatgagcat

SEQ ID NO: 5309201 - DNA, 18 bp, Homo sapiens
tcaggaaggatgagcatt

SEQ ID NO: 5309202 - DNA, 19 bp, Homo sapiens
tcaggaagggagaggaggg

SEQ ID NO: 5309203 - DNA, 23 bp, Homo sapiens
tcaggaagggggccgccaccctc

SEQ ID NO: 5309204 - DNA, 22 bp, Homo sapiens
tcaggaaggtaaaaacccagcg

SEQ ID NO: 5309205 - DNA, 18 bp, Homo sapiens
tcaggaagtaaaataaat

SEQ ID NO: 5309206 - DNA, 20 bp, Homo sapiens
tcaggaagttgctgagaaat

SEQ ID NO: 5309207 - DNA, 17 bp, Homo sapiens
tcaggaatattttccaa

SEQ ID NO: 5309208 - DNA, 22 bp, Homo sapiens
tcaggaatgagtcaatcagcct

SEQ ID NO: 5309209 - DNA, 23 bp, Homo sapiens
tcaggaatgagtcaatcagcctt

SEQ ID NO: 5309210 - DNA, 22 bp, Homo sapiens
tcaggaatgggccaagccaggg

SEQ ID NO: 5309211 - DNA, 14 bp, Homo sapiens
tcaggaatgggctg

SEQ ID NO: 5309212 - DNA, 20 bp, Homo sapiens
tcaggaattccaattaaatt

SEQ ID NO: 5309213 - DNA, 16 bp, Homo sapiens
tcaggaattccctgga

SEQ ID NO: 5309214 - DNA, 18 bp, Homo sapiens
tcaggaattctaaataaa

SEQ ID NO: 5309215 - DNA, 13 bp, Homo sapiens
tcaggaatttaaa

SEQ ID NO: 5309216 - DNA, 20 bp, Homo sapiens
tcaggaatttaagaatttgt

SEQ ID NO: 5309217 - DNA, 16 bp, Homo sapiens
tcaggaatttaattta

SEQ ID NO: 5309218 - DNA, 19 bp, Homo sapiens
tcaggacaaggccttgctc

SEQ ID NO: 5309219 - DNA, 12 bp, Homo sapiens
tcaggacactaa

SEQ ID NO: 5309220 - DNA, 13 bp, Homo sapiens
tcaggacactaat

SEQ ID NO: 5309221 - DNA, 15 bp, Homo sapiens
tcaggacagatgcca

SEQ ID NO: 5309222 - DNA, 22 bp, Homo sapiens
tcaggacagcatcccttcccac

SEQ ID NO: 5309223 - DNA, 13 bp, Homo sapiens
tcaggacagctgc

SEQ ID NO: 5309224 - DNA, 17 bp, Homo sapiens
tcaggacagctgcttct

SEQ ID NO: 5309225 - DNA, 13 bp, Homo sapiens
tcaggaccaccct

SEQ ID NO: 5309226 - DNA, 18 bp, Homo sapiens
tcaggaccaccctgccaa

SEQ ID NO: 5309227 - DNA, 21 bp, Homo sapiens
tcaggaccaggacccagggag

SEQ ID NO: 5309228 - DNA, 14 bp, Homo sapiens
tcaggaccaggcaa

SEQ ID NO: 5309229 - DNA, 19 bp, Homo sapiens
tcaggacccaggccctcca

SEQ ID NO: 5309230 - DNA, 23 bp, Homo sapiens
tcaggacccaggccctccatggg

SEQ ID NO: 5309231 - DNA, 20 bp, Homo sapiens
tcaggacccaggccgcctgc

SEQ ID NO: 5309232 - DNA, 21 bp, Homo sapiens
tcaggacccaggccgcctgcc

SEQ ID NO: 5309233 - DNA, 15 bp, Homo sapiens
tcaggaccccatctg

SEQ ID NO: 5309234 - DNA, 19 bp, Homo sapiens
tcaggaccccatctgctga

SEQ ID NO: 5309235 - DNA, 17 bp, Homo sapiens
tcaggaccctcagccct

SEQ ID NO: 5309236 - DNA, 21 bp, Homo sapiens
tcaggaccctcgctggccccc

SEQ ID NO: 5309237 - DNA, 22 bp, Homo sapiens
tcaggaccctcgctggccccca

SEQ ID NO: 5309238 - DNA, 14 bp, Homo sapiens
tcaggacccttcta

SEQ ID NO: 5309239 - DNA, 19 bp, Homo sapiens
tcaggacctccggggagag

SEQ ID NO: 5309240 - DNA, 22 bp, Homo sapiens
tcaggacctccggggagagcag

SEQ ID NO: 5309241 - DNA, 21 bp, Homo sapiens
tcaggacctctgtaggcagca

SEQ ID NO: 5309242 - DNA, 19 bp, Homo sapiens
tcaggacgagaatgagggt

SEQ ID NO: 5309243 - DNA, 14 bp, Homo sapiens
tcaggacggctcct

SEQ ID NO: 5309244 - DNA, 15 bp, Homo sapiens
tcaggacggctcctc

SEQ ID NO: 5309245 - DNA, 14 bp, Homo sapiens
tcaggactcagaag

SEQ ID NO: 5309246 - DNA, 12 bp, Homo sapiens
tcaggactccag

SEQ ID NO: 5309247 - DNA, 14 bp, Homo sapiens
tcaggactcctctc

SEQ ID NO: 5309248 - DNA, 16 bp, Homo sapiens
tcaggactctctccag

SEQ ID NO: 5309249 - DNA, 18 bp, Homo sapiens
tcaggactctctccagga

SEQ ID NO: 5309250 - DNA, 14 bp, Homo sapiens
tcaggactctgaaa

SEQ ID NO: 5309251 - DNA, 16 bp, Homo sapiens
tcaggactctgaaaag

SEQ ID NO: 5309252 - DNA, 12 bp, Homo sapiens
tcaggactctgc

SEQ ID NO: 5309253 - DNA, 16 bp, Homo sapiens
tcaggactctgcggga

SEQ ID NO: 5309254 - DNA, 14 bp, Homo sapiens
tcaggactggctca

SEQ ID NO: 5309255 - DNA, 16 bp, Homo sapiens
tcaggacttgaaagaa

SEQ ID NO: 5309256 - DNA, 15 bp, Homo sapiens
tcaggagaaacccct

SEQ ID NO: 5309257 - DNA, 20 bp, Homo sapiens
tcaggagaaagtaccctctt

SEQ ID NO: 5309258 - DNA, 13 bp, Homo sapiens
tcaggagaagcca

SEQ ID NO: 5309259 - DNA, 15 bp, Homo sapiens
tcaggagaagccagt

SEQ ID NO: 5309260 - DNA, 22 bp, Homo sapiens
tcaggagaaggcctgcccccct

SEQ ID NO: 5309261 - DNA, 20 bp, Homo sapiens
tcaggagaaggtggtggcat

SEQ ID NO: 5309262 - DNA, 23 bp, Homo sapiens
tcaggagaatgtgcagtgtcttg

SEQ ID NO: 5309263 - DNA, 14 bp, Homo sapiens
tcaggagagggcct

SEQ ID NO: 5309264 - DNA, 18 bp, Homo sapiens
tcaggagaggggcagaac

SEQ ID NO: 5309265 - DNA, 20 bp, Homo sapiens
tcaggagaggggcagaacag

SEQ ID NO: 5309266 - DNA, 16 bp, Homo sapiens
tcaggagatgatgtga

SEQ ID NO: 5309267 - DNA, 20 bp, Homo sapiens
tcaggagatggaagagtcat

SEQ ID NO: 5309268 - DNA, 11 bp, Homo sapiens
tcaggagcaca

SEQ ID NO: 5309269 - DNA, 14 bp, Homo sapiens
tcaggagcacagcc

SEQ ID NO: 5309270 - DNA, 18 bp, Homo sapiens
tcaggagcacaggcagct

SEQ ID NO: 5309271 - DNA, 22 bp, Homo sapiens
tcaggagcaccctgtcttctta

SEQ ID NO: 5309272 - DNA, 12 bp, Homo sapiens
tcaggagcaggg

SEQ ID NO: 5309273 - DNA, 13 bp, Homo sapiens
tcaggagccagca

SEQ ID NO: 5309274 - DNA, 15 bp, Homo sapiens
tcaggagccagcagg

SEQ ID NO: 5309275 - DNA, 10 bp, Homo sapiens
tcaggagccc

SEQ ID NO: 5309276 - DNA, 12 bp, Homo sapiens
tcaggagccccc

SEQ ID NO: 5309277 - DNA, 19 bp, Homo sapiens
tcaggagcccccaacacag

SEQ ID NO: 5309278 - DNA, 12 bp, Homo sapiens
tcaggagccctg

SEQ ID NO: 5309279 - DNA, 13 bp, Homo sapiens
tcaggagcctgct

SEQ ID NO: 5309280 - DNA, 16 bp, Homo sapiens
tcaggagcctgctaag

SEQ ID NO: 5309281 - DNA, 14 bp, Homo sapiens
tcaggagcctgtga

SEQ ID NO: 5309282 - DNA, 21 bp, Homo sapiens
tcaggagctgacagagccaga

SEQ ID NO: 5309283 - DNA, 20 bp, Homo sapiens
tcaggagctgctcaggcttg

SEQ ID NO: 5309284 - DNA, 14 bp, Homo sapiens
tcaggaggaggctg

SEQ ID NO: 5309285 - DNA, 13 bp, Homo sapiens
tcaggaggagggc

SEQ ID NO: 5309286 - DNA, 23 bp, Homo sapiens
tcaggaggagggcgcatgtgtgt

SEQ ID NO: 5309287 - DNA, 17 bp, Homo sapiens
tcaggaggcaggacctt

SEQ ID NO: 5309288 - DNA, 15 bp, Homo sapiens
tcaggggtgcacagt

SEQ ID NO: 5309289 - DNA, 17 bp, Homo sapiens
tcaggggtgctggggca

SEQ ID NO: 5309290 - DNA, 23 bp, Homo sapiens
tcaggggtgtgcggcctttggct

SEQ ID NO: 5309291 - DNA, 22 bp, Homo sapiens
tcagggtacaggaaaaaacatt

SEQ ID NO: 5309292 - DNA, 22 bp, Homo sapiens
tcagggtagcagcagaggcagg

SEQ ID NO: 5309293 - DNA, 15 bp, Homo sapiens
tcagggtaggctgga

SEQ ID NO: 5309294 - DNA, 18 bp, Homo sapiens
tcagggtcaaagacagaa

SEQ ID NO: 5309295 - DNA, 22 bp, Homo sapiens
tcagggtccaggagagcctggg

SEQ ID NO: 5309296 - DNA, 14 bp, Homo sapiens
tcagggtccctggt

SEQ ID NO: 5309297 - DNA, 16 bp, Homo sapiens
tcagggtcctgccctc

SEQ ID NO: 5309298 - DNA, 17 bp, Homo sapiens
tcagggtctccttcctt

SEQ ID NO: 5309299 - DNA, 14 bp, Homo sapiens
tcagggtggagaag

SEQ ID NO: 5309300 - DNA, 19 bp, Homo sapiens
tcagggtgggaagaaagaa

SEQ ID NO: 5309301 - DNA, 13 bp, Homo sapiens
tcagggtgggcca

SEQ ID NO: 5309302 - DNA, 21 bp, Homo sapiens
tcagggtgggccactctcccc

SEQ ID NO: 5309303 - DNA, 16 bp, Homo sapiens
tcagggtgtcccagac

SEQ ID NO: 5309304 - DNA, 18 bp, Homo sapiens
tcagggttcatctgtcca

SEQ ID NO: 5309305 - DNA, 17 bp, Homo sapiens
tcagggttggcccctgc

SEQ ID NO: 5309306 - DNA, 18 bp, Homo sapiens
tcagggttggcccctgcc

SEQ ID NO: 5309307 - DNA, 14 bp, Homo sapiens
tcaggtaaaatatt

SEQ ID NO: 5309308 - DNA, 15 bp, Homo sapiens
tcaggtaaactgatg

SEQ ID NO: 5309309 - DNA, 13 bp, Homo sapiens
tcaggtaactttc

SEQ ID NO: 5309310 - DNA, 14 bp, Homo sapiens
tcaggtaatatacc

SEQ ID NO: 5309311 - DNA, 21 bp, Homo sapiens
tcaggtaatatacctggttta

SEQ ID NO: 5309312 - DNA, 18 bp, Homo sapiens
tcaggtaatcattttaat

SEQ ID NO: 5309313 - DNA, 20 bp, Homo sapiens
tcaggtaatcgacctgcctc

SEQ ID NO: 5309314 - DNA, 21 bp, Homo sapiens
tcaggtaatcgacctgcctcg

SEQ ID NO: 5309315 - DNA, 22 bp, Homo sapiens
tcaggtacagaaaacatgttta

SEQ ID NO: 5309316 - DNA, 17 bp, Homo sapiens
tcaggtacagagaagga

SEQ ID NO: 5309317 - DNA, 18 bp, Homo sapiens
tcaggtacagagaaggaa

SEQ ID NO: 5309318 - DNA, 15 bp, Homo sapiens
tcaggtacagcgggc

SEQ ID NO: 5309319 - DNA, 22 bp, Homo sapiens
tcaggtacagcgggctgtgccc

SEQ ID NO: 5309320 - DNA, 17 bp, Homo sapiens
tcaggtactgagttctt

SEQ ID NO: 5309321 - DNA, 19 bp, Homo sapiens
tcaggtagaccatattcta

SEQ ID NO: 5309322 - DNA, 13 bp, Homo sapiens
tcaggtaggccct

SEQ ID NO: 5309323 - DNA, 16 bp, Homo sapiens
tcaggtaggggggaaa

SEQ ID NO: 5309324 - DNA, 21 bp, Homo sapiens
tcaggtatgttgcctttatgg

SEQ ID NO: 5309325 - DNA, 23 bp, Homo sapiens
tcaggtcacataaaactttgtat

SEQ ID NO: 5309326 - DNA, 15 bp, Homo sapiens
tcaggtcagagccca

SEQ ID NO: 5309327 - DNA, 19 bp, Homo sapiens
tcaggtcagagcccaggaa

SEQ ID NO: 5309328 - DNA, 23 bp, Homo sapiens
tcaggtcagctcactgagctggg

SEQ ID NO: 5309329 - DNA, 16 bp, Homo sapiens
tcaggtcaggagttcg

SEQ ID NO: 5309330 - DNA, 15 bp, Homo sapiens
tcaggtcagggactt

SEQ ID NO: 5309331 - DNA, 20 bp, Homo sapiens
tcaggtccagctttactgtg

SEQ ID NO: 5309332 - DNA, 23 bp, Homo sapiens
tcaggtcccacgtctggccaggc

SEQ ID NO: 5309333 - DNA, 13 bp, Homo sapiens
tcaggtcccagtt

SEQ ID NO: 5309334 - DNA, 16 bp, Homo sapiens
tcaggtcccctggccc

SEQ ID NO: 5309335 - DNA, 15 bp, Homo sapiens
tcaggtcccctttca

SEQ ID NO: 5309336 - DNA, 16 bp, Homo sapiens
tcaggtcctgctcagc

SEQ ID NO: 5309337 - DNA, 15 bp, Homo sapiens
tcaggtcgtagcatt

SEQ ID NO: 5309338 - DNA, 19 bp, Homo sapiens
tcaggtctcccacgtggga

SEQ ID NO: 5309339 - DNA, 16 bp, Homo sapiens
tcaggtctgggcaagt

SEQ ID NO: 5309340 - DNA, 10 bp, Homo sapiens
tcaggtctgt

SEQ ID NO: 5309341 - DNA, 14 bp, Homo sapiens
tcaggtctgtaact

SEQ ID NO: 5309342 - DNA, 21 bp, Homo sapiens
tcaggtctttactgaatgtta

SEQ ID NO: 5309343 - DNA, 16 bp, Homo sapiens
tcaggtgacatgtgaa

SEQ ID NO: 5309344 - DNA, 22 bp, Homo sapiens
tcaggtgacgatttagctgtgg

SEQ ID NO: 5309345 - DNA, 21 bp, Homo sapiens
tcaggtgacggactcagactc

SEQ ID NO: 5309346 - DNA, 17 bp, Homo sapiens
tcaggtgacgtgattct

SEQ ID NO: 5309347 - DNA, 16 bp, Homo sapiens
tcaggtgactggagcc

SEQ ID NO: 5309348 - DNA, 15 bp, Homo sapiens
tcaggtgagaagcag

SEQ ID NO: 5309349 - DNA, 19 bp, Homo sapiens
tcaggtgatcaaaataaag

SEQ ID NO: 5309350 - DNA, 19 bp, Homo sapiens
tcaggtgatttgtatgctc

SEQ ID NO: 5309351 - DNA, 22 bp, Homo sapiens
tcaggtgcacacatcaccaggt

SEQ ID NO: 5309352 - DNA, 15 bp, Homo sapiens
tcaggtgcagtccca

SEQ ID NO: 5309353 - DNA, 21 bp, Homo sapiens
tcaggtgccactccctgagct

SEQ ID NO: 5309354 - DNA, 22 bp, Homo sapiens
tcaggtgcctccaattggtgct

SEQ ID NO: 5309355 - DNA, 21 bp, Homo sapiens
tcaggtgcctcccagccctgc

SEQ ID NO: 5309356 - DNA, 23 bp, Homo sapiens
tcaggtgcctcccagccctgccc

SEQ ID NO: 5309357 - DNA, 22 bp, Homo sapiens
tcaggtgccttacatcttttct

SEQ ID NO: 5309358 - DNA, 23 bp, Homo sapiens
tcaggtgccttacatcttttcta

SEQ ID NO: 5309359 - DNA, 15 bp, Homo sapiens
tcaggtgctgccatc

SEQ ID NO: 5309360 - DNA, 19 bp, Homo sapiens
tcaggtgcttttgatgtga

SEQ ID NO: 5309361 - DNA, 21 bp, Homo sapiens
tcaggtgcttttgatgtgaaa

SEQ ID NO: 5309362 - DNA, 18 bp, Homo sapiens
tcaggtggaacaggagga

SEQ ID NO: 5309363 - DNA, 18 bp, Homo sapiens
tcaggtggaccctgtaaa

SEQ ID NO: 5309364 - DNA, 19 bp, Homo sapiens
tcaggtggaccctgtaaat

SEQ ID NO: 5309365 - DNA, 17 bp, Homo sapiens
tcaggtggactctggga

SEQ ID NO: 5309366 - DNA, 19 bp, Homo sapiens
tcaggtgggagatttggaa

SEQ ID NO: 5309367 - DNA, 17 bp, Homo sapiens
tcaggtgggcgtggtca

SEQ ID NO: 5309368 - DNA, 16 bp, Homo sapiens
tcaggtggggcagctt

SEQ ID NO: 5309369 - DNA, 20 bp, Homo sapiens
tcaggtggggtcactctggc

SEQ ID NO: 5309370 - DNA, 21 bp, Homo sapiens
tcaggtggggtcactctggca

SEQ ID NO: 5309371 - DNA, 17 bp, Homo sapiens
tcaggtgtatggaattt

SEQ ID NO: 5309372 - DNA, 15 bp, Homo sapiens
tcaggtgtccctgca

SEQ ID NO: 5309373 - DNA, 13 bp, Homo sapiens
tcaggtgtgcctg

SEQ ID NO: 5309374 - DNA, 16 bp, Homo sapiens
tcaggtgtgctcaggg

SEQ ID NO: 5309375 - DNA, 17 bp, Homo sapiens
tcaggtgttttaagact

SEQ ID NO: 5309376 - DNA, 19 bp, Homo sapiens
tcaggtgttttcaagcaca

SEQ ID NO: 5309377 - DNA, 16 bp, Homo sapiens
tcaggttaaattattg

SEQ ID NO: 5309378 - DNA, 19 bp, Homo sapiens
tcaggttaggcagtataaa

SEQ ID NO: 5309379 - DNA, 23 bp, Homo sapiens
tcaggttaggcagtataaagaat

SEQ ID NO: 5309380 - DNA, 18 bp, Homo sapiens
tcaggttatcgaaataac

SEQ ID NO: 5309381 - DNA, 19 bp, Homo sapiens
tcaggttcactcattgaca

SEQ ID NO: 5309382 - DNA, 13 bp, Homo sapiens
tcaggttcctcct

SEQ ID NO: 5309383 - DNA, 22 bp, Homo sapiens
tcaggttcctcctaggcgctca

SEQ ID NO: 5309384 - DNA, 17 bp, Homo sapiens
tcaggttctattttctt

SEQ ID NO: 5309385 - DNA, 14 bp, Homo sapiens
tcaggttcttgcct

SEQ ID NO: 5309386 - DNA, 23 bp, Homo sapiens
tcaggttgacagtcccttgctga

SEQ ID NO: 5309387 - DNA, 13 bp, Homo sapiens
tcaggttgcattg

SEQ ID NO: 5309388 - DNA, 14 bp, Homo sapiens
tcaggttgcattgg

SEQ ID NO: 5309389 - DNA, 15 bp, Homo sapiens
tcaggttgctggttg

SEQ ID NO: 5309390 - DNA, 13 bp, Homo sapiens
tcaggttgtctgt

SEQ ID NO: 5309391 - DNA, 22 bp, Homo sapiens
tcaggttgtctgtagagaatga

SEQ ID NO: 5309392 - DNA, 23 bp, Homo sapiens
tcaggttgtctgtagagaatgaa

SEQ ID NO: 5309393 - DNA, 21 bp, Homo sapiens
tcaggttgtgcattttgtgtg

SEQ ID NO: 5309394 - DNA, 14 bp, Homo sapiens
tcaggttgttctgt

SEQ ID NO: 5309395 - DNA, 18 bp, Homo sapiens
tcaggttgttctgtataa

SEQ ID NO: 5309396 - DNA, 14 bp, Homo sapiens
tcaggttgttggtg

SEQ ID NO: 5309397 - DNA, 15 bp, Homo sapiens
tcaggtttaacattt

SEQ ID NO: 5309398 - DNA, 21 bp, Homo sapiens
tcaggtttccggctactgaca

SEQ ID NO: 5309399 - DNA, 14 bp, Homo sapiens
tcaggtttcttaaa

SEQ ID NO: 5309400 - DNA, 16 bp, Homo sapiens
tcaggtttgagaaaaa

SEQ ID NO: 5309401 - DNA, 23 bp, Homo sapiens
tcaggttttcttttaagaatcaa

SEQ ID NO: 5309402 - DNA, 16 bp, Homo sapiens
tcagtaaaaggacctc

SEQ ID NO: 5309403 - DNA, 15 bp, Homo sapiens
tcagtaaaagtcttc

SEQ ID NO: 5309404 - DNA, 16 bp, Homo sapiens
tcagtaaaagtcttct

SEQ ID NO: 5309405 - DNA, 16 bp, Homo sapiens
tcagtaaacctgtctg

SEQ ID NO: 5309406 - DNA, 23 bp, Homo sapiens
tcagtaaagtggttctctgcctt

SEQ ID NO: 5309407 - DNA, 20 bp, Homo sapiens
tcagtaaatagtgtcatata

SEQ ID NO: 5309408 - DNA, 21 bp, Homo sapiens
tcagtaacataactgcttctt

SEQ ID NO: 5309409 - DNA, 17 bp, Homo sapiens
tcagtaacatttctgtt

SEQ ID NO: 5309410 - DNA, 16 bp, Homo sapiens
tcagtaacccagctgc

SEQ ID NO: 5309411 - DNA, 22 bp, Homo sapiens
tcagtaacccccttaaatttaa

SEQ ID NO: 5309412 - DNA, 15 bp, Homo sapiens
tcagtaactgtcagg

SEQ ID NO: 5309413 - DNA, 14 bp, Homo sapiens
tcagtaagttctgt

SEQ ID NO: 5309414 - DNA, 12 bp, Homo sapiens
tcagtaataaaa

SEQ ID NO: 5309415 - DNA, 13 bp, Homo sapiens
tcagtaataaaac

SEQ ID NO: 5309416 - DNA, 15 bp, Homo sapiens
tcagtaataaaacat

SEQ ID NO: 5309417 - DNA, 13 bp, Homo sapiens
tcagtaatagctg

SEQ ID NO: 5309418 - DNA, 14 bp, Homo sapiens
tcagtaatagctga

SEQ ID NO: 5309419 - DNA, 15 bp, Homo sapiens
tcagtaatagctgaa

SEQ ID NO: 5309420 - DNA, 19 bp, Homo sapiens
tcagtaatataatttgcca

SEQ ID NO: 5309421 - DNA, 19 bp, Homo sapiens
tcagtaatgctaaatgtgt

SEQ ID NO: 5309422 - DNA, 13 bp, Homo sapiens
tcagtaatgttat

SEQ ID NO: 5309423 - DNA, 20 bp, Homo sapiens
tcagtaattaacatatcaag

SEQ ID NO: 5309424 - DNA, 13 bp, Homo sapiens
tcagtaatttata

SEQ ID NO: 5309425 - DNA, 17 bp, Homo sapiens
tcagtaatttgaggaca

SEQ ID NO: 5309426 - DNA, 17 bp, Homo sapiens
tcagtacacttcctgtg

SEQ ID NO: 5309427 - DNA, 22 bp, Homo sapiens
tcagtacacttggtgtactggg

SEQ ID NO: 5309428 - DNA, 14 bp, Homo sapiens
tcagtacagggcag

SEQ ID NO: 5309429 - DNA, 22 bp, Homo sapiens
tcagtacagggcaggagctgct

SEQ ID NO: 5309430 - DNA, 13 bp, Homo sapiens
tcagtaccaaaga

SEQ ID NO: 5309431 - DNA, 22 bp, Homo sapiens
tcagtacccctggtaaaccaag

SEQ ID NO: 5309432 - DNA, 21 bp, Homo sapiens
tcagtacctgtgttgagaaaa

SEQ ID NO: 5309433 - DNA, 24 bp, Homo sapiens
tcagtacgatcaagttgttgactg

SEQ ID NO: 5309434 - DNA, 21 bp, Homo sapiens
tcagtactaaggtgactttct

SEQ ID NO: 5309435 - DNA, 17 bp, Homo sapiens
tcagtactcaaattcaa

SEQ ID NO: 5309436 - DNA, 14 bp, Homo sapiens
tcagtactgcagcg

SEQ ID NO: 5309437 - DNA, 16 bp, Homo sapiens
tcagtacttcagcaag

SEQ ID NO: 5309438 - DNA, 17 bp, Homo sapiens
tcagtacttcagcaaga

SEQ ID NO: 5309439 - DNA, 23 bp, Homo sapiens
tcagtacttgtgaaacacagctg

SEQ ID NO: 5309440 - DNA, 24 bp, Homo sapiens
tcagtacttgtgaaacacagctgt

SEQ ID NO: 5309441 - DNA, 19 bp, Homo sapiens
tcagtacttttattaatat

SEQ ID NO: 5309442 - DNA, 23 bp, Homo sapiens
tcagtagaaactctacataattt

SEQ ID NO: 5309443 - DNA, 13 bp, Homo sapiens
tcagtagaaagag

SEQ ID NO: 5309444 - DNA, 13 bp, Homo sapiens
tcagtagaattac

SEQ ID NO: 5309445 - DNA, 18 bp, Homo sapiens
tcagtagaattttagtcc

SEQ ID NO: 5309446 - DNA, 19 bp, Homo sapiens
tcagtagactgtgattctt

SEQ ID NO: 5309447 - DNA, 19 bp, Homo sapiens
tcagtagagaattcatgtg

SEQ ID NO: 5309448 - DNA, 19 bp, Homo sapiens
tcagtagcattttaatagt

SEQ ID NO: 5309449 - DNA, 23 bp, Homo sapiens
tcagtagccagagttgttctcag

SEQ ID NO: 5309450 - DNA, 20 bp, Homo sapiens
tcagtagctccttggttttg

SEQ ID NO: 5309451 - DNA, 17 bp, Homo sapiens
tcagtagcttaagaaaa

SEQ ID NO: 5309452 - DNA, 18 bp, Homo sapiens
tcagtagcttatctcagt

SEQ ID NO: 5309453 - DNA, 13 bp, Homo sapiens
tcagtaggaccag

SEQ ID NO: 5309454 - DNA, 17 bp, Homo sapiens
tcagtaggcatcagtat

SEQ ID NO: 5309455 - DNA, 18 bp, Homo sapiens
tcagtaggctaatgtcaa

SEQ ID NO: 5309456 - DNA, 17 bp, Homo sapiens
tcagtaggtccaagggc

SEQ ID NO: 5309457 - DNA, 19 bp, Homo sapiens
tcagtaggtccaagggcca

SEQ ID NO: 5309458 - DNA, 20 bp, Homo sapiens
tcagtaggtccaagggccat

SEQ ID NO: 5309459 - DNA, 16 bp, Homo sapiens
tcagtagtgcctgtga

SEQ ID NO: 5309460 - DNA, 20 bp, Homo sapiens
tcagtagtttgagaccagcc

SEQ ID NO: 5309461 - DNA, 15 bp, Homo sapiens
tcagtagtttgatca

SEQ ID NO: 5309462 - DNA, 14 bp, Homo sapiens
tcagtagtttgcat

SEQ ID NO: 5309463 - DNA, 21 bp, Homo sapiens
tcagtagtttgcatttcagaa

SEQ ID NO: 5309464 - DNA, 23 bp, Homo sapiens
tcatacacaacgtaatcaaatat

SEQ ID NO: 5309465 - DNA, 11 bp, Homo sapiens
tcatacacaga

SEQ ID NO: 5309466 - DNA, 13 bp, Homo sapiens
tcatacacagaaa

SEQ ID NO: 5309467 - DNA, 20 bp, Homo sapiens
tcatacacagaaatcctaac

SEQ ID NO: 5309468 - DNA, 13 bp, Homo sapiens
tcatacacagtta

SEQ ID NO: 5309469 - DNA, 17 bp, Homo sapiens
tcatacacagttaaata

SEQ ID NO: 5309470 - DNA, 18 bp, Homo sapiens
tcatacacagttaaataa

SEQ ID NO: 5309471 - DNA, 16 bp, Homo sapiens
tcatacagagaagtca

SEQ ID NO: 5309472 - DNA, 23 bp, Homo sapiens
tcatacagagaagtcacagggca

SEQ ID NO: 5309473 - DNA, 21 bp, Homo sapiens
tcatacatatatatatttgta

SEQ ID NO: 5309474 - DNA, 23 bp, Homo sapiens
tcatacatatatatatttgtaac

SEQ ID NO: 5309475 - DNA, 16 bp, Homo sapiens
tcatacattgtacgaa

SEQ ID NO: 5309476 - DNA, 19 bp, Homo sapiens
tcatacatttgtggtctga

SEQ ID NO: 5309477 - DNA, 21 bp, Homo sapiens
tcatacattttctaagaaaca

SEQ ID NO: 5309478 - DNA, 15 bp, Homo sapiens
tcataccacaataaa

SEQ ID NO: 5309479 - DNA, 15 bp, Homo sapiens
tcataccatccatcc

SEQ ID NO: 5309480 - DNA, 21 bp, Homo sapiens
tcataccattattatgtaaat

SEQ ID NO: 5309481 - DNA, 14 bp, Homo sapiens
tcatacccaccccc

SEQ ID NO: 5309482 - DNA, 20 bp, Homo sapiens
tcatacccacccccacccaa

SEQ ID NO: 5309483 - DNA, 21 bp, Homo sapiens
tcatacccacccccacccaag

SEQ ID NO: 5309484 - DNA, 16 bp, Homo sapiens
tcatacccatgcacag

SEQ ID NO: 5309485 - DNA, 20 bp, Homo sapiens
tcatacccatgcacagtaca

SEQ ID NO: 5309486 - DNA, 22 bp, Homo sapiens
tcatacccatgcacagtacaat

SEQ ID NO: 5309487 - DNA, 18 bp, Homo sapiens
tcataccgcctcgtgcca

SEQ ID NO: 5309488 - DNA, 21 bp, Homo sapiens
tcataccgcctcgtgccagca

SEQ ID NO: 5309489 - DNA, 16 bp, Homo sapiens
tcatacctaagtactg

SEQ ID NO: 5309490 - DNA, 19 bp, Homo sapiens
tcatacctaagtactgtaa

SEQ ID NO: 5309491 - DNA, 19 bp, Homo sapiens
tcatacctacacccaaggt

SEQ ID NO: 5309492 - DNA, 18 bp, Homo sapiens
tcatacctatcatcttaa

SEQ ID NO: 5309493 - DNA, 18 bp, Homo sapiens
tcatacctcagaatgtaa

SEQ ID NO: 5309494 - DNA, 15 bp, Homo sapiens
tcatacctccctcct

SEQ ID NO: 5309495 - DNA, 23 bp, Homo sapiens
tcatacctgctcctcatctgcct

SEQ ID NO: 5309496 - DNA, 23 bp, Homo sapiens
tcataccttctgatgaagttgta

SEQ ID NO: 5309497 - DNA, 21 bp, Homo sapiens
tcataccttgaacccccctcc

SEQ ID NO: 5309498 - DNA, 17 bp, Homo sapiens
tcataccttgatggtaa

SEQ ID NO: 5309499 - DNA, 16 bp, Homo sapiens
tcatacgggtcagtag

SEQ ID NO: 5309500 - DNA, 22 bp, Homo sapiens
tcatacgttgatagtttacaaa

SEQ ID NO: 5309501 - DNA, 21 bp, Homo sapiens
tcatacgtttaaaataaaact

SEQ ID NO: 5309502 - DNA, 14 bp, Homo sapiens
tcatactaaataaa

SEQ ID NO: 5309503 - DNA, 17 bp, Homo sapiens
tcatactaaataaaaca

SEQ ID NO: 5309504 - DNA, 15 bp, Homo sapiens
tcatactcacctcac

SEQ ID NO: 5309505 - DNA, 20 bp, Homo sapiens
tcatactcacgggaggaatc

SEQ ID NO: 5309506 - DNA, 17 bp, Homo sapiens
tcatactcgagtctgag

SEQ ID NO: 5309507 - DNA, 21 bp, Homo sapiens
tcatactcttctaaaacttga

SEQ ID NO: 5309508 - DNA, 13 bp, Homo sapiens
tcatactgaagat

SEQ ID NO: 5309509 - DNA, 15 bp, Homo sapiens
tcatactgaagatgc

SEQ ID NO: 5309510 - DNA, 14 bp, Homo sapiens
tcatactgatgtgt

SEQ ID NO: 5309511 - DNA, 21 bp, Homo sapiens
tcatactgcctactgttactc

SEQ ID NO: 5309512 - DNA, 13 bp, Homo sapiens
tcatactgtacac

SEQ ID NO: 5309513 - DNA, 16 bp, Homo sapiens
tcatactgtacacatt

SEQ ID NO: 5309514 - DNA, 20 bp, Homo sapiens
tcatactgtacacatttctt

SEQ ID NO: 5309515 - DNA, 18 bp, Homo sapiens
tcatactgtgctggagcc

SEQ ID NO: 5309516 - DNA, 16 bp, Homo sapiens
tcatacttaagcaaaa

SEQ ID NO: 5309517 - DNA, 18 bp, Homo sapiens
tcatacttctaaatcaga

SEQ ID NO: 5309518 - DNA, 15 bp, Homo sapiens
tcatacttgaacgtt

SEQ ID NO: 5309519 - DNA, 19 bp, Homo sapiens
tcatacttgaacgttttct

SEQ ID NO: 5309520 - DNA, 21 bp, Homo sapiens
tcatacttgaacgttttctaa

SEQ ID NO: 5309521 - DNA, 23 bp, Homo sapiens
tcatacttgaacgttttctaatt

SEQ ID NO: 5309522 - DNA, 15 bp, Homo sapiens
tcatacttggacagt

SEQ ID NO: 5309523 - DNA, 13 bp, Homo sapiens
tcatacttttctt

SEQ ID NO: 5309524 - DNA, 16 bp, Homo sapiens
tcatacttttcttact

SEQ ID NO: 5309525 - DNA, 19 bp, Homo sapiens
tcatagaaagtgccagaaa

SEQ ID NO: 5309526 - DNA, 12 bp, Homo sapiens
tcatagaaatac

SEQ ID NO: 5309527 - DNA, 22 bp, Homo sapiens
tcatagaaatagtttgagaaat

SEQ ID NO: 5309528 - DNA, 13 bp, Homo sapiens
tcatagaaatgta

SEQ ID NO: 5309529 - DNA, 22 bp, Homo sapiens
tcatagaaatgtaacttttgta

SEQ ID NO: 5309530 - DNA, 23 bp, Homo sapiens
tcatagaaatgtaacttttgtaa

SEQ ID NO: 5309531 - DNA, 21 bp, Homo sapiens
tcatagaacattgatctgttt

SEQ ID NO: 5309532 - DNA, 13 bp, Homo sapiens
tcatagaataaca

SEQ ID NO: 5309533 - DNA, 21 bp, Homo sapiens
tcatagaataacaactgctgg

SEQ ID NO: 5309534 - DNA, 12 bp, Homo sapiens
tcatagaatagc

SEQ ID NO: 5309535 - DNA, 22 bp, Homo sapiens
tcatagaatagcatgttgtaga

SEQ ID NO: 5309536 - DNA, 23 bp, Homo sapiens
tcatagacaattcctccagagac

SEQ ID NO: 5309537 - DNA, 13 bp, Homo sapiens
tcatagagacttg

SEQ ID NO: 5309538 - DNA, 14 bp, Homo sapiens
tcatagagatttgt

SEQ ID NO: 5309539 - DNA, 18 bp, Homo sapiens
tcatagaggaaattcaaa

SEQ ID NO: 5309540 - DNA, 17 bp, Homo sapiens
tcatagaggtgagaaaa

SEQ ID NO: 5309541 - DNA, 18 bp, Homo sapiens
tcatagaggtgagaaaac

SEQ ID NO: 5309542 - DNA, 20 bp, Homo sapiens
tcatagaggtgagaaaactc

SEQ ID NO: 5309543 - DNA, 20 bp, Homo sapiens
tcatagataccattttgaaa

SEQ ID NO: 5309544 - DNA, 22 bp, Homo sapiens
tcatagataccattttgaaata

SEQ ID NO: 5309545 - DNA, 15 bp, Homo sapiens
tcatagatagataag

SEQ ID NO: 5309546 - DNA, 22 bp, Homo sapiens
tcatagatattggaagagagaa

SEQ ID NO: 5309547 - DNA, 22 bp, Homo sapiens
tcatagatgacccccaggtatt

SEQ ID NO: 5309548 - DNA, 20 bp, Homo sapiens
tcatagatgagaaaactgag

SEQ ID NO: 5309549 - DNA, 19 bp, Homo sapiens
tcatagattattataaact

SEQ ID NO: 5309550 - DNA, 21 bp, Homo sapiens
tcatagattattataaactat

SEQ ID NO: 5309551 - DNA, 20 bp, Homo sapiens
tcatagatttgaaaaacttt

SEQ ID NO: 5309552 - DNA, 22 bp, Homo sapiens
tcatagcaataacattcccact

SEQ ID NO: 5309553 - DNA, 14 bp, Homo sapiens
tcatagcacatgtt

SEQ ID NO: 5309554 - DNA, 15 bp, Homo sapiens
tcatagcacatgttt

SEQ ID NO: 5309555 - DNA, 20 bp, Homo sapiens
tcatagcacatgttttacaa

SEQ ID NO: 5309556 - DNA, 20 bp, Homo sapiens
tcatagcattgtctattttt

SEQ ID NO: 5309557 - DNA, 22 bp, Homo sapiens
tcatagcattgtctatttttct

SEQ ID NO: 5309558 - DNA, 15 bp, Homo sapiens
tcatagccactttta

SEQ ID NO: 5309559 - DNA, 18 bp, Homo sapiens
tcatagcccagatcagct

SEQ ID NO: 5309560 - DNA, 21 bp, Homo sapiens
tcatagcccagatcagctcct

SEQ ID NO: 5309561 - DNA, 14 bp, Homo sapiens
tcatagctaaaaaa

SEQ ID NO: 5309562 - DNA, 19 bp, Homo sapiens
tcatagctcactgcagcct

SEQ ID NO: 5309563 - DNA, 20 bp, Homo sapiens
tcatagctcactgcagcctc

SEQ ID NO: 5309564 - DNA, 17 bp, Homo sapiens
tcatagctcataagagt

SEQ ID NO: 5309565 - DNA, 21 bp, Homo sapiens
tcatagctggttcctgctaga

SEQ ID NO: 5309566 - DNA, 14 bp, Homo sapiens
tcatagctgtatat

SEQ ID NO: 5309567 - DNA, 16 bp, Homo sapiens
tcataggaagtggctg

SEQ ID NO: 5309568 - DNA, 17 bp, Homo sapiens
tcataggaagtggctgg

SEQ ID NO: 5309569 - DNA, 15 bp, Homo sapiens
tcataggaagttagc

SEQ ID NO: 5309570 - DNA, 16 bp, Homo sapiens
tcataggaagttagcc

SEQ ID NO: 5309571 - DNA, 16 bp, Homo sapiens
tcataggacctgcatc

SEQ ID NO: 5309572 - DNA, 21 bp, Homo sapiens
tcataggcaccttttactgtg

SEQ ID NO: 5309573 - DNA, 23 bp, Homo sapiens
tcataggcggtcatgtgtgcatg

SEQ ID NO: 5309574 - DNA, 15 bp, Homo sapiens
tcataggctgacacc

SEQ ID NO: 5309575 - DNA, 21 bp, Homo sapiens
tcatagggaaaggttttgtat

SEQ ID NO: 5309576 - DNA, 18 bp, Homo sapiens
tcatagggacctttaaaa

SEQ ID NO: 5309577 - DNA, 21 bp, Homo sapiens
tcatagggacctttaaaaagc

SEQ ID NO: 5309578 - DNA, 17 bp, Homo sapiens
tcatagggatgctgtga

SEQ ID NO: 5309579 - DNA, 16 bp, Homo sapiens
tcatagggctgataat

SEQ ID NO: 5309580 - DNA, 17 bp, Homo sapiens
tcatagggtctcttcag

SEQ ID NO: 5309581 - DNA, 18 bp, Homo sapiens
tcatagggtctcttcagg

SEQ ID NO: 5309582 - DNA, 21 bp, Homo sapiens
tcatagggtctcttcaggttc

SEQ ID NO: 5309583 - DNA, 21 bp, Homo sapiens
tcataggtaaggttttcaagg

SEQ ID NO: 5309584 - DNA, 12 bp, Homo sapiens
tcataggtacaa

SEQ ID NO: 5309585 - DNA, 17 bp, Homo sapiens
tcataggtatgattttt

SEQ ID NO: 5309586 - DNA, 15 bp, Homo sapiens
tcataggtctgaaat

SEQ ID NO: 5309587 - DNA, 16 bp, Homo sapiens
tcataggtctgaaatt

SEQ ID NO: 5309588 - DNA, 14 bp, Homo sapiens
tcataggttactac

SEQ ID NO: 5309589 - DNA, 17 bp, Homo sapiens
tcataggttactaccta

SEQ ID NO: 5309590 - DNA, 16 bp, Homo sapiens
tcataggttgccaata

SEQ ID NO: 5309591 - DNA, 17 bp, Homo sapiens
tcatagtaataagatgg

SEQ ID NO: 5309592 - DNA, 22 bp, Homo sapiens
tcatagtactctttgtagcaaa

SEQ ID NO: 5309593 - DNA, 14 bp, Homo sapiens
tcatagtagttttt

SEQ ID NO: 5309594 - DNA, 17 bp, Homo sapiens
tcatagtataaatctat

SEQ ID NO: 5309595 - DNA, 24 bp, Homo sapiens
tcatagtatccatattttattact

SEQ ID NO: 5309596 - DNA, 22 bp, Homo sapiens
tcatagtatcttcactgtgtta

SEQ ID NO: 5309597 - DNA, 15 bp, Homo sapiens
tcatagtatggtggc

SEQ ID NO: 5309598 - DNA, 21 bp, Homo sapiens
tcatagtatggtggctgggtt

SEQ ID NO: 5309599 - DNA, 22 bp, Homo sapiens
tcatagtcattgtggtttagat

SEQ ID NO: 5309600 - DNA, 22 bp, Homo sapiens
tcatagtcccaccttggagcat

SEQ ID NO: 5309601 - DNA, 18 bp, Homo sapiens
tcatagtcttgaaatgaa

SEQ ID NO: 5309602 - DNA, 21 bp, Homo sapiens
tcatagtgaacacagcagacc

SEQ ID NO: 5309603 - DNA, 21 bp, Homo sapiens
tcatagtgatagagtgcagtg

SEQ ID NO: 5309604 - DNA, 11 bp, Homo sapiens
tcatagtgcct

SEQ ID NO: 5309605 - DNA, 16 bp, Homo sapiens
tcatagtgcctttttc

SEQ ID NO: 5309606 - DNA, 18 bp, Homo sapiens
tcatagtgcctttttcct

SEQ ID NO: 5309607 - DNA, 21 bp, Homo sapiens
tcatagttactgtgtaaactc

SEQ ID NO: 5309608 - DNA, 17 bp, Homo sapiens
tcatagttattgtttct

SEQ ID NO: 5309609 - DNA, 13 bp, Homo sapiens
tcatagttcagaa

SEQ ID NO: 5309610 - DNA, 14 bp, Homo sapiens
tcatagttcagaat

SEQ ID NO: 5309611 - DNA, 16 bp, Homo sapiens
tcatagttcagaattt

SEQ ID NO: 5309612 - DNA, 16 bp, Homo sapiens
tcatagttggaaatat

SEQ ID NO: 5309613 - DNA, 22 bp, Homo sapiens
tcatagttggaaatatttgcgt

SEQ ID NO: 5309614 - DNA, 13 bp, Homo sapiens
tcatagtttaatt

SEQ ID NO: 5309615 - DNA, 12 bp, Homo sapiens
tcatagtttatt

SEQ ID NO: 5309616 - DNA, 14 bp, Homo sapiens
tcatagtttctgta

SEQ ID NO: 5309617 - DNA, 22 bp, Homo sapiens
tcatagtttctgtaattggctt

SEQ ID NO: 5309618 - DNA, 22 bp, Homo sapiens
tcatagtttcttggccactgaa

SEQ ID NO: 5309619 - DNA, 16 bp, Homo sapiens
tcatagttttctaaat

SEQ ID NO: 5309620 - DNA, 15 bp, Homo sapiens
tcatataaaaacaca

SEQ ID NO: 5309621 - DNA, 20 bp, Homo sapiens
tcatataaaagctatggtga

SEQ ID NO: 5309622 - DNA, 16 bp, Homo sapiens
tcatataaaatttcag

SEQ ID NO: 5309623 - DNA, 15 bp, Homo sapiens
tcatataaacatttt

SEQ ID NO: 5309624 - DNA, 18 bp, Homo sapiens
tcatataaacctgatgtt

SEQ ID NO: 5309625 - DNA, 15 bp, Homo sapiens
tcatataaactcatt

SEQ ID NO: 5309626 - DNA, 17 bp, Homo sapiens
tcatataaactcattta

SEQ ID NO: 5309627 - DNA, 16 bp, Homo sapiens
tcatataaatagaatg

SEQ ID NO: 5309628 - DNA, 18 bp, Homo sapiens
tcatataagattcatatt

SEQ ID NO: 5309629 - DNA, 18 bp, Homo sapiens
tcatataagcaagacagt

SEQ ID NO: 5309630 - DNA, 15 bp, Homo sapiens
tcatataataaatgt

SEQ ID NO: 5309631 - DNA, 18 bp, Homo sapiens
tcatataatttaaagaaa

SEQ ID NO: 5309632 - DNA, 21 bp, Homo sapiens
tcatatagcattgataatctt

SEQ ID NO: 5309633 - DNA, 19 bp, Homo sapiens
tcatatatactgtatcctg

SEQ ID NO: 5309634 - DNA, 14 bp, Homo sapiens
tcatatatatacat

SEQ ID NO: 5309635 - DNA, 14 bp, Homo sapiens
tcatatatcaagaa

SEQ ID NO: 5309636 - DNA, 18 bp, Homo sapiens
tcatatattaaaacaata

SEQ ID NO: 5309637 - DNA, 20 bp, Homo sapiens
tcatatattaaacatccaca

SEQ ID NO: 5309638 - DNA, 21 bp, Homo sapiens
tcatatattaaacatccacaa

SEQ ID NO: 5309639 - DNA, 15 bp, Homo sapiens
tcatatattataaga

SEQ ID NO: 5309640 - DNA, 18 bp, Homo sapiens
tcatctatttctgagaag

SEQ ID NO: 5309641 - DNA, 11 bp, Homo sapiens
tcatctatttt

SEQ ID NO: 5309642 - DNA, 22 bp, Homo sapiens
tcatctattttattttattgaa

SEQ ID NO: 5309643 - DNA, 23 bp, Homo sapiens
tcatctattttattttattgaat

SEQ ID NO: 5309644 - DNA, 14 bp, Homo sapiens
tcatctattttgat

SEQ ID NO: 5309645 - DNA, 17 bp, Homo sapiens
tcatctattttgatgca

SEQ ID NO: 5309646 - DNA, 20 bp, Homo sapiens
tcatctattttgatgcagca

SEQ ID NO: 5309647 - DNA, 11 bp, Homo sapiens
tcatctcacct

SEQ ID NO: 5309648 - DNA, 18 bp, Homo sapiens
tcatctcagctcactgca

SEQ ID NO: 5309649 - DNA, 19 bp, Homo sapiens
tcatctcagctcactgcaa

SEQ ID NO: 5309650 - DNA, 17 bp, Homo sapiens
tcatctcagcttttctg

SEQ ID NO: 5309651 - DNA, 16 bp, Homo sapiens
tcatctcaggtagaag

SEQ ID NO: 5309652 - DNA, 21 bp, Homo sapiens
tcatctcaggtggcatttgca

SEQ ID NO: 5309653 - DNA, 22 bp, Homo sapiens
tcatctcagtgaagaatacttc

SEQ ID NO: 5309654 - DNA, 23 bp, Homo sapiens
tcatctcatcaggcaaattgtac

SEQ ID NO: 5309655 - DNA, 20 bp, Homo sapiens
tcatctcattaattcaatta

SEQ ID NO: 5309656 - DNA, 21 bp, Homo sapiens
tcatctcatttaagggaaaaa

SEQ ID NO: 5309657 - DNA, 13 bp, Homo sapiens
tcatctcatttgt

SEQ ID NO: 5309658 - DNA, 14 bp, Homo sapiens
tcatctcatttgta

SEQ ID NO: 5309659 - DNA, 21 bp, Homo sapiens
tcatctccaaggatcctctcc

SEQ ID NO: 5309660 - DNA, 18 bp, Homo sapiens
tcatctccagcctcccca

SEQ ID NO: 5309661 - DNA, 20 bp, Homo sapiens
tcatctccagtatcctgctg

SEQ ID NO: 5309662 - DNA, 14 bp, Homo sapiens
tcatctcccatgtg

SEQ ID NO: 5309663 - DNA, 12 bp, Homo sapiens
tcatctccccac

SEQ ID NO: 5309664 - DNA, 13 bp, Homo sapiens
tcatctcccctcc

SEQ ID NO: 5309665 - DNA, 16 bp, Homo sapiens
tcatctccctcctcca

SEQ ID NO: 5309666 - DNA, 23 bp, Homo sapiens
tcatctccctgccatccccctct

SEQ ID NO: 5309667 - DNA, 22 bp, Homo sapiens
tcatctcctgccttcctcctgg

SEQ ID NO: 5309668 - DNA, 18 bp, Homo sapiens
tcatctcctttgcagaat

SEQ ID NO: 5309669 - DNA, 19 bp, Homo sapiens
tcatctcctttgcagaatg

SEQ ID NO: 5309670 - DNA, 19 bp, Homo sapiens
tcatctctaaggctaagga

SEQ ID NO: 5309671 - DNA, 14 bp, Homo sapiens
tcatctctacaaaa

SEQ ID NO: 5309672 - DNA, 22 bp, Homo sapiens
tcatctctagggaccagaacca

SEQ ID NO: 5309673 - DNA, 23 bp, Homo sapiens
tcatctctcctccaagacactgt

SEQ ID NO: 5309674 - DNA, 14 bp, Homo sapiens
tcatctctctgccc

SEQ ID NO: 5309675 - DNA, 21 bp, Homo sapiens
tcatctctctggggccctggg

SEQ ID NO: 5309676 - DNA, 15 bp, Homo sapiens
tcatctctcttgggc

SEQ ID NO: 5309677 - DNA, 16 bp, Homo sapiens
tcatctctctttaata

SEQ ID NO: 5309678 - DNA, 19 bp, Homo sapiens
tcatctctgaaaattctgg

SEQ ID NO: 5309679 - DNA, 12 bp, Homo sapiens
tcatctctgcct

SEQ ID NO: 5309680 - DNA, 15 bp, Homo sapiens
tcatctctgcctgac

SEQ ID NO: 5309681 - DNA, 22 bp, Homo sapiens
tcatctctgcctgacaaggcca

SEQ ID NO: 5309682 - DNA, 14 bp, Homo sapiens
tcatctctgccttt

SEQ ID NO: 5309683 - DNA, 17 bp, Homo sapiens
tcatctctgctgaacat

SEQ ID NO: 5309684 - DNA, 21 bp, Homo sapiens
tcatctctggaaggggcagcc

SEQ ID NO: 5309685 - DNA, 23 bp, Homo sapiens
tcatctctgttcttttcccgcct

SEQ ID NO: 5309686 - DNA, 19 bp, Homo sapiens
tcatctcttcaggttctca

SEQ ID NO: 5309687 - DNA, 12 bp, Homo sapiens
tcatctcttcct

SEQ ID NO: 5309688 - DNA, 16 bp, Homo sapiens
tcatctctttagagaa

SEQ ID NO: 5309689 - DNA, 13 bp, Homo sapiens
tcatctcttttcc

SEQ ID NO: 5309690 - DNA, 17 bp, Homo sapiens
tcatctgaaacccacag

SEQ ID NO: 5309691 - DNA, 13 bp, Homo sapiens
tcatctgaagggg

SEQ ID NO: 5309692 - DNA, 23 bp, Homo sapiens
tcatctgaatttgccctgggaaa

SEQ ID NO: 5309693 - DNA, 17 bp, Homo sapiens
tcatctgactatgacat

SEQ ID NO: 5309694 - DNA, 18 bp, Homo sapiens
tcatctgactatgacata

SEQ ID NO: 5309695 - DNA, 13 bp, Homo sapiens
tcatctgagaatg

SEQ ID NO: 5309696 - DNA, 16 bp, Homo sapiens
tcatctgagaggctct

SEQ ID NO: 5309697 - DNA, 19 bp, Homo sapiens
tcatctgagaggctctccg

SEQ ID NO: 5309698 - DNA, 11 bp, Homo sapiens
tcatctgagga

SEQ ID NO: 5309699 - DNA, 12 bp, Homo sapiens
tcatctgaggag

SEQ ID NO: 5309700 - DNA, 18 bp, Homo sapiens
tcatctgaggcatccagc

SEQ ID NO: 5309701 - DNA, 17 bp, Homo sapiens
tcatctgatgagaacaa

SEQ ID NO: 5309702 - DNA, 22 bp, Homo sapiens
tcatctgcacccttcttttctc

SEQ ID NO: 5309703 - DNA, 23 bp, Homo sapiens
tcatctgcacccttcttttctca

SEQ ID NO: 5309704 - DNA, 14 bp, Homo sapiens
tcatctgcagaatg

SEQ ID NO: 5309705 - DNA, 15 bp, Homo sapiens
tcatctgcagttctt

SEQ ID NO: 5309706 - DNA, 12 bp, Homo sapiens
tcatctgccagg

SEQ ID NO: 5309707 - DNA, 16 bp, Homo sapiens
tcatctgcctgcgctc

SEQ ID NO: 5309708 - DNA, 17 bp, Homo sapiens
tcatctgctcagcagct

SEQ ID NO: 5309709 - DNA, 12 bp, Homo sapiens
tcatctgctcct

SEQ ID NO: 5309710 - DNA, 14 bp, Homo sapiens
tcatctgctccttc

SEQ ID NO: 5309711 - DNA, 17 bp, Homo sapiens
tcatctgctccttcctg

SEQ ID NO: 5309712 - DNA, 18 bp, Homo sapiens
tcatctgctccttcctgt

SEQ ID NO: 5309713 - DNA, 16 bp, Homo sapiens
tcatctgctctccttc

SEQ ID NO: 5309714 - DNA, 21 bp, Homo sapiens
tcatctgctctccttcctgga

SEQ ID NO: 5309715 - DNA, 15 bp, Homo sapiens
tcatctgctgcacat

SEQ ID NO: 5309716 - DNA, 23 bp, Homo sapiens
tcatctgctgcacatagcagact

SEQ ID NO: 5309717 - DNA, 13 bp, Homo sapiens
tcatctgctggtc

SEQ ID NO: 5309718 - DNA, 14 bp, Homo sapiens
tcatctgctggtcc

SEQ ID NO: 5309719 - DNA, 12 bp, Homo sapiens
tcatctggaacc

SEQ ID NO: 5309720 - DNA, 15 bp, Homo sapiens
tcatctggagtccct

SEQ ID NO: 5309721 - DNA, 14 bp, Homo sapiens
tcatctggagttct

SEQ ID NO: 5309722 - DNA, 21 bp, Homo sapiens
tcatctggataggagcctgct

SEQ ID NO: 5309723 - DNA, 23 bp, Homo sapiens
tcatctggataggagcctgctgg

SEQ ID NO: 5309724 - DNA, 23 bp, Homo sapiens
tcatctggcaacatctttatccg

SEQ ID NO: 5309725 - DNA, 22 bp, Homo sapiens
tcatctggcggaggtctctggg

SEQ ID NO: 5309726 - DNA, 20 bp, Homo sapiens
tcatctggcttttcgcttgc

SEQ ID NO: 5309727 - DNA, 14 bp, Homo sapiens
tcatctgggaaaga

SEQ ID NO: 5309728 - DNA, 18 bp, Homo sapiens
tcatctgggaaagacatc

SEQ ID NO: 5309729 - DNA, 18 bp, Homo sapiens
tcatctggggacctggtt

SEQ ID NO: 5309730 - DNA, 18 bp, Homo sapiens
tcatctgggggagtggaa

SEQ ID NO: 5309731 - DNA, 23 bp, Homo sapiens
tcatctggggttggcaacaggac

SEQ ID NO: 5309732 - DNA, 15 bp, Homo sapiens
tcatctggttttatt

SEQ ID NO: 5309733 - DNA, 16 bp, Homo sapiens
tcatctggttttatta

SEQ ID NO: 5309734 - DNA, 18 bp, Homo sapiens
tcatctggttttattact

SEQ ID NO: 5309735 - DNA, 18 bp, Homo sapiens
tcatctgtaaaaccaggc

SEQ ID NO: 5309736 - DNA, 19 bp, Homo sapiens
tcatctgtaaaaccaggct

SEQ ID NO: 5309737 - DNA, 13 bp, Homo sapiens
tcatctgtagata

SEQ ID NO: 5309738 - DNA, 15 bp, Homo sapiens
tcatctgtcaagtgg

SEQ ID NO: 5309739 - DNA, 11 bp, Homo sapiens
tcatctgtcag

SEQ ID NO: 5309740 - DNA, 16 bp, Homo sapiens
tcatctgtcattatat

SEQ ID NO: 5309741 - DNA, 21 bp, Homo sapiens
tcatctgtcattatattctaa

SEQ ID NO: 5309742 - DNA, 14 bp, Homo sapiens
tcatctgtccatgg

SEQ ID NO: 5309743 - DNA, 12 bp, Homo sapiens
tcatctgtccct

SEQ ID NO: 5309744 - DNA, 18 bp, Homo sapiens
tcatctgtccctccggga

SEQ ID NO: 5309745 - DNA, 20 bp, Homo sapiens
tcatctgtctatattttatt

SEQ ID NO: 5309746 - DNA, 12 bp, Homo sapiens
tcatctgtctcg

SEQ ID NO: 5309747 - DNA, 22 bp, Homo sapiens
tcatctgtctttcactggaatg

SEQ ID NO: 5309748 - DNA, 19 bp, Homo sapiens
tcatctgtgcaccacttga

SEQ ID NO: 5309749 - DNA, 17 bp, Homo sapiens
tcatctgtgcctgtctg

SEQ ID NO: 5309750 - DNA, 14 bp, Homo sapiens
tcatctgtggagct

SEQ ID NO: 5309751 - DNA, 19 bp, Homo sapiens
tcatctgtggagctgccac

SEQ ID NO: 5309752 - DNA, 19 bp, Homo sapiens
tcatctgtgggatgctgaa

SEQ ID NO: 5309753 - DNA, 16 bp, Homo sapiens
tcatctgttagggcct

SEQ ID NO: 5309754 - DNA, 18 bp, Homo sapiens
tcatctgttatcctgcta

SEQ ID NO: 5309755 - DNA, 13 bp, Homo sapiens
tcatctgttgaca

SEQ ID NO: 5309756 - DNA, 17 bp, Homo sapiens
tcatctgtttttctttt

SEQ ID NO: 5309757 - DNA, 14 bp, Homo sapiens
tcatcttaaaaata

SEQ ID NO: 5309758 - DNA, 18 bp, Homo sapiens
tcatcttagactttgcaa

SEQ ID NO: 5309759 - DNA, 15 bp, Homo sapiens
tcatcttagctttcc

SEQ ID NO: 5309760 - DNA, 23 bp, Homo sapiens
tcatcttaggttggcaaaaaggc

SEQ ID NO: 5309761 - DNA, 15 bp, Homo sapiens
tcatcttagttctgt

SEQ ID NO: 5309762 - DNA, 18 bp, Homo sapiens
tcatcttagttctgtata

SEQ ID NO: 5309763 - DNA, 15 bp, Homo sapiens
tcatcttattcagca

SEQ ID NO: 5309764 - DNA, 22 bp, Homo sapiens
tcatcttcaaccttaaggactt

SEQ ID NO: 5309765 - DNA, 22 bp, Homo sapiens
tcatcttccccagccctcccca

SEQ ID NO: 5309766 - DNA, 12 bp, Homo sapiens
tcatcttccctg

SEQ ID NO: 5309767 - DNA, 13 bp, Homo sapiens
tcatcttccctgc

SEQ ID NO: 5309768 - DNA, 14 bp, Homo sapiens
tcatcttccctgcc

SEQ ID NO: 5309769 - DNA, 15 bp, Homo sapiens
tcatcttccctgccc

SEQ ID NO: 5309770 - DNA, 18 bp, Homo sapiens
tcatcttccctttcctcc

SEQ ID NO: 5309771 - DNA, 23 bp, Homo sapiens
tcatcttccctttcctcccttct

SEQ ID NO: 5309772 - DNA, 13 bp, Homo sapiens
tcatcttcctgtg

SEQ ID NO: 5309773 - DNA, 15 bp, Homo sapiens
tcatcttcctgtgtc

SEQ ID NO: 5309774 - DNA, 16 bp, Homo sapiens
tcatcttcctgtgtcc

SEQ ID NO: 5309775 - DNA, 18 bp, Homo sapiens
tcatcttctcagctccca

SEQ ID NO: 5309776 - DNA, 14 bp, Homo sapiens
tcatcttctggaat

SEQ ID NO: 5309777 - DNA, 18 bp, Homo sapiens
tcatcttgaagggcccag

SEQ ID NO: 5309778 - DNA, 23 bp, Homo sapiens
tcatcttgaccaagcaggaagct

SEQ ID NO: 5309779 - DNA, 18 bp, Homo sapiens
tcatcttgcacacacttt

SEQ ID NO: 5309780 - DNA, 15 bp, Homo sapiens
tcatcttgccccctc

SEQ ID NO: 5309781 - DNA, 18 bp, Homo sapiens
tcatcttgctaccagtat

SEQ ID NO: 5309782 - DNA, 21 bp, Homo sapiens
tcatcttgctaccagtattta

SEQ ID NO: 5309783 - DNA, 20 bp, Homo sapiens
tcatcttggccctcctcagc

SEQ ID NO: 5309784 - DNA, 22 bp, Homo sapiens
tcatcttggccctcctcagctc

SEQ ID NO: 5309785 - DNA, 22 bp, Homo sapiens
tcatcttgtacaaactttgttt

SEQ ID NO: 5309786 - DNA, 13 bp, Homo sapiens
tcatcttgtgaaa

SEQ ID NO: 5309787 - DNA, 13 bp, Homo sapiens
tcatctttaagaa

SEQ ID NO: 5309788 - DNA, 17 bp, Homo sapiens
tcatctttatctcctgg

SEQ ID NO: 5309789 - DNA, 19 bp, Homo sapiens
tcatctttattaagtagat

SEQ ID NO: 5309790 - DNA, 21 bp, Homo sapiens
tcatctttattaagtagatga

SEQ ID NO: 5309791 - DNA, 14 bp, Homo sapiens
tcatctttcttcca

SEQ ID NO: 5309792 - DNA, 13 bp, Homo sapiens
tcatctttcttga

SEQ ID NO: 5309793 - DNA, 21 bp, Homo sapiens
tcatctttgttggctcagaaa

SEQ ID NO: 5309794 - DNA, 22 bp, Homo sapiens
tcatcttttaatcatgagcctg

SEQ ID NO: 5309795 - DNA, 19 bp, Homo sapiens
tcatcttttagagtaaact

SEQ ID NO: 5309796 - DNA, 11 bp, Homo sapiens
tcatcttttat

SEQ ID NO: 5309797 - DNA, 17 bp, Homo sapiens
tcatcttttattttgga

SEQ ID NO: 5309798 - DNA, 11 bp, Homo sapiens
tcatcttttcc

SEQ ID NO: 5309799 - DNA, 21 bp, Homo sapiens
tcatctttttatatggggttg

SEQ ID NO: 5309800 - DNA, 14 bp, Homo sapiens
tcatctttttcccc

SEQ ID NO: 5309801 - DNA, 14 bp, Homo sapiens
tcatctttttctag

SEQ ID NO: 5309802 - DNA, 15 bp, Homo sapiens
tcatctttttctaga

SEQ ID NO: 5309803 - DNA, 13 bp, Homo sapiens
tcatctttttgtg

SEQ ID NO: 5309804 - DNA, 19 bp, Homo sapiens
tcatctttttgtgtgcagg

SEQ ID NO: 5309805 - DNA, 22 bp, Homo sapiens
tcatgaaaacagcccctttacc

SEQ ID NO: 5309806 - DNA, 14 bp, Homo sapiens
tcatgaaaagagga

SEQ ID NO: 5309807 - DNA, 14 bp, Homo sapiens
tcatgaaaatacca

SEQ ID NO: 5309808 - DNA, 15 bp, Homo sapiens
tcatgaaaccaaaaa

SEQ ID NO: 5309809 - DNA, 19 bp, Homo sapiens
tcatgaaagaataaataag

SEQ ID NO: 5309810 - DNA, 22 bp, Homo sapiens
tcatgaaagcagtgaagcaatt

SEQ ID NO: 5309811 - DNA, 23 bp, Homo sapiens
tcatgaaagcagtgaagcaattt

SEQ ID NO: 5309812 - DNA, 21 bp, Homo sapiens
tcatgaaatgctatgtcattt

SEQ ID NO: 5309813 - DNA, 13 bp, Homo sapiens
tcatgaaatgtgt

SEQ ID NO: 5309814 - DNA, 15 bp, Homo sapiens
tcatgaaattgttca

SEQ ID NO: 5309815 - DNA, 16 bp, Homo sapiens
tcatgaacacagcctg

SEQ ID NO: 5309816 - DNA, 22 bp, Homo sapiens
tcatgaacacatcagctagcaa

SEQ ID NO: 5309817 - DNA, 21 bp, Homo sapiens
tcatgaacagctctgagatcc

SEQ ID NO: 5309818 - DNA, 19 bp, Homo sapiens
tcattcatattacaatatt

SEQ ID NO: 5309819 - DNA, 22 bp, Homo sapiens
tcattcatattacaatatttgt

SEQ ID NO: 5309820 - DNA, 12 bp, Homo sapiens
tcattcatattt

SEQ ID NO: 5309821 - DNA, 14 bp, Homo sapiens
tcattcatccagga

SEQ ID NO: 5309822 - DNA, 13 bp, Homo sapiens
tcattcatcctga

SEQ ID NO: 5309823 - DNA, 20 bp, Homo sapiens
tcattcatgaatattttcaa

SEQ ID NO: 5309824 - DNA, 17 bp, Homo sapiens
tcattcattcagtattt

SEQ ID NO: 5309825 - DNA, 14 bp, Homo sapiens
tcattcattttata

SEQ ID NO: 5309826 - DNA, 19 bp, Homo sapiens
tcattcattttatattgaa

SEQ ID NO: 5309827 - DNA, 20 bp, Homo sapiens
tcattcattttatattgaaa

SEQ ID NO: 5309828 - DNA, 22 bp, Homo sapiens
tcattcattttatattgaaaaa

SEQ ID NO: 5309829 - DNA, 13 bp, Homo sapiens
tcattcattttgt

SEQ ID NO: 5309830 - DNA, 14 bp, Homo sapiens
tcattcattttgtg

SEQ ID NO: 5309831 - DNA, 21 bp, Homo sapiens
tcattccaacacctgccatag

SEQ ID NO: 5309832 - DNA, 21 bp, Homo sapiens
tcattccaacttcccagttca

SEQ ID NO: 5309833 - DNA, 15 bp, Homo sapiens
tcattccaagaacta

SEQ ID NO: 5309834 - DNA, 14 bp, Homo sapiens
tcattccaagcact

SEQ ID NO: 5309835 - DNA, 15 bp, Homo sapiens
tcattccaattctaa

SEQ ID NO: 5309836 - DNA, 14 bp, Homo sapiens
tcattccacactgt

SEQ ID NO: 5309837 - DNA, 16 bp, Homo sapiens
tcattccacactgttg

SEQ ID NO: 5309838 - DNA, 19 bp, Homo sapiens
tcattccacaggacgaatg

SEQ ID NO: 5309839 - DNA, 15 bp, Homo sapiens
tcattccactataca

SEQ ID NO: 5309840 - DNA, 11 bp, Homo sapiens
tcattccagag

SEQ ID NO: 5309841 - DNA, 14 bp, Homo sapiens
tcattccagaggaa

SEQ ID NO: 5309842 - DNA, 18 bp, Homo sapiens
tcattccagatcccaggc

SEQ ID NO: 5309843 - DNA, 20 bp, Homo sapiens
tcattccagcagctgcaccc

SEQ ID NO: 5309844 - DNA, 15 bp, Homo sapiens
tcattccatgactct

SEQ ID NO: 5309845 - DNA, 16 bp, Homo sapiens
tcattccatgtccata

SEQ ID NO: 5309846 - DNA, 17 bp, Homo sapiens
tcattccatgtgcccag

SEQ ID NO: 5309847 - DNA, 15 bp, Homo sapiens
tcattccattctgga

SEQ ID NO: 5309848 - DNA, 20 bp, Homo sapiens
tcattccattgcctagctct

SEQ ID NO: 5309849 - DNA, 15 bp, Homo sapiens
tcattcccactgcac

SEQ ID NO: 5309850 - DNA, 16 bp, Homo sapiens
tcattcccatgtggaa

SEQ ID NO: 5309851 - DNA, 23 bp, Homo sapiens
tcattccccaggtggctgaccca

SEQ ID NO: 5309852 - DNA, 17 bp, Homo sapiens
tcattcccccttcctag

SEQ ID NO: 5309853 - DNA, 20 bp, Homo sapiens
tcattcccccttcctagtga

SEQ ID NO: 5309854 - DNA, 15 bp, Homo sapiens
tcattcccctgccca

SEQ ID NO: 5309855 - DNA, 20 bp, Homo sapiens
tcattcccctttgcactgta

SEQ ID NO: 5309856 - DNA, 23 bp, Homo sapiens
tcattcccctttgcactgtaatg

SEQ ID NO: 5309857 - DNA, 22 bp, Homo sapiens
tcattcccttcgacagcatttt

SEQ ID NO: 5309858 - DNA, 23 bp, Homo sapiens
tcattcccttcgacagcattttc

SEQ ID NO: 5309859 - DNA, 22 bp, Homo sapiens
tcattccgaaaaaaaaatgttc

SEQ ID NO: 5309860 - DNA, 23 bp, Homo sapiens
tcattccggactggcagaagcat

SEQ ID NO: 5309861 - DNA, 16 bp, Homo sapiens
tcattccgttgtctgt

SEQ ID NO: 5309862 - DNA, 17 bp, Homo sapiens
tcattccgttgtctgtg

SEQ ID NO: 5309863 - DNA, 13 bp, Homo sapiens
tcattcctccagg

SEQ ID NO: 5309864 - DNA, 23 bp, Homo sapiens
tcattcctccagtgcatactgta

SEQ ID NO: 5309865 - DNA, 23 bp, Homo sapiens
tcattcctcccaccccaagcaaa

SEQ ID NO: 5309866 - DNA, 20 bp, Homo sapiens
tcattcctgaaagaaacagt

SEQ ID NO: 5309867 - DNA, 21 bp, Homo sapiens
tcattcctgaaagaaacagtt

SEQ ID NO: 5309868 - DNA, 19 bp, Homo sapiens
tcattcctgcctgtctcct

SEQ ID NO: 5309869 - DNA, 14 bp, Homo sapiens
tcattcctgtattc

SEQ ID NO: 5309870 - DNA, 13 bp, Homo sapiens
tcattcctgtcaa

SEQ ID NO: 5309871 - DNA, 16 bp, Homo sapiens
tcattcctgtcaacaa

SEQ ID NO: 5309872 - DNA, 14 bp, Homo sapiens
tcattcctgttctt

SEQ ID NO: 5309873 - DNA, 18 bp, Homo sapiens
tcattcctgttctttctt

SEQ ID NO: 5309874 - DNA, 15 bp, Homo sapiens
tcattccttccacta

SEQ ID NO: 5309875 - DNA, 15 bp, Homo sapiens
tcattccttctggcc

SEQ ID NO: 5309876 - DNA, 23 bp, Homo sapiens
tcattccttgagaaaaacaatga

SEQ ID NO: 5309877 - DNA, 14 bp, Homo sapiens
tcattccttgtctt

SEQ ID NO: 5309878 - DNA, 18 bp, Homo sapiens
tcattcctttttatttat

SEQ ID NO: 5309879 - DNA, 21 bp, Homo sapiens
tcattcgcctgtgggaagaga

SEQ ID NO: 5309880 - DNA, 16 bp, Homo sapiens
tcattcgcctttgtct

SEQ ID NO: 5309881 - DNA, 17 bp, Homo sapiens
tcattcgggctgggcgc

SEQ ID NO: 5309882 - DNA, 21 bp, Homo sapiens
tcattcggtgtgaacttttct

SEQ ID NO: 5309883 - DNA, 18 bp, Homo sapiens
tcattctaatgatggccc

SEQ ID NO: 5309884 - DNA, 22 bp, Homo sapiens
tcattctacagaataatccagt

SEQ ID NO: 5309885 - DNA, 17 bp, Homo sapiens
tcattctaccaagctgt

SEQ ID NO: 5309886 - DNA, 14 bp, Homo sapiens
tcattctagcacct

SEQ ID NO: 5309887 - DNA, 21 bp, Homo sapiens
tcattctagcaccttgttctt

SEQ ID NO: 5309888 - DNA, 14 bp, Homo sapiens
tcattctcatccaa

SEQ ID NO: 5309889 - DNA, 23 bp, Homo sapiens
tcattctcccgcttcctggcctc

SEQ ID NO: 5309890 - DNA, 23 bp, Homo sapiens
tcattctcctcctcctccctcct

SEQ ID NO: 5309891 - DNA, 16 bp, Homo sapiens
tcattctcctgcctgt

SEQ ID NO: 5309892 - DNA, 16 bp, Homo sapiens
tcattctcgtgagtca

SEQ ID NO: 5309893 - DNA, 15 bp, Homo sapiens
tcattctctagacaa

SEQ ID NO: 5309894 - DNA, 17 bp, Homo sapiens
tcattctctctgaacac

SEQ ID NO: 5309895 - DNA, 19 bp, Homo sapiens
tcattctgaaccctccaaa

SEQ ID NO: 5309896 - DNA, 14 bp, Homo sapiens
tcattctgaattaa

SEQ ID NO: 5309897 - DNA, 23 bp, Homo sapiens
tcattctgcaatgagccatgagt

SEQ ID NO: 5309898 - DNA, 13 bp, Homo sapiens
tcattctgcacct

SEQ ID NO: 5309899 - DNA, 18 bp, Homo sapiens
tcattctgcaccttgcca

SEQ ID NO: 5309900 - DNA, 13 bp, Homo sapiens
tcattctgcatta

SEQ ID NO: 5309901 - DNA, 22 bp, Homo sapiens
tcattctgcattgctagataaa

SEQ ID NO: 5309902 - DNA, 12 bp, Homo sapiens
tcattctgcctg

SEQ ID NO: 5309903 - DNA, 15 bp, Homo sapiens
tcattctgcctgctc

SEQ ID NO: 5309904 - DNA, 20 bp, Homo sapiens
tcattctggaaacttttgtt

SEQ ID NO: 5309905 - DNA, 18 bp, Homo sapiens
tcattctgggtgtgttct

SEQ ID NO: 5309906 - DNA, 15 bp, Homo sapiens
tcattctgttgccca

SEQ ID NO: 5309907 - DNA, 17 bp, Homo sapiens
tcattctgttgcccagg

SEQ ID NO: 5309908 - DNA, 19 bp, Homo sapiens
tcattcttaatttatgtaa

SEQ ID NO: 5309909 - DNA, 22 bp, Homo sapiens
tcattcttacaattgcactgct

SEQ ID NO: 5309910 - DNA, 23 bp, Homo sapiens
tcattcttataacattgtatgtt

SEQ ID NO: 5309911 - DNA, 20 bp, Homo sapiens
tcattcttctaaaactactg

SEQ ID NO: 5309912 - DNA, 16 bp, Homo sapiens
tcattcttgtgggaga

SEQ ID NO: 5309913 - DNA, 21 bp, Homo sapiens
tcattcttgtgggagacagca

SEQ ID NO: 5309914 - DNA, 19 bp, Homo sapiens
tcattctttactgcactca

SEQ ID NO: 5309915 - DNA, 21 bp, Homo sapiens
tcattctttcccctcagagct

SEQ ID NO: 5309916 - DNA, 22 bp, Homo sapiens
tcattctttcccctcagagctc

SEQ ID NO: 5309917 - DNA, 13 bp, Homo sapiens
tcattctttgaac

SEQ ID NO: 5309918 - DNA, 14 bp, Homo sapiens
tcattctttgcagg

SEQ ID NO: 5309919 - DNA, 16 bp, Homo sapiens
tcattctttgtatctt

SEQ ID NO: 5309920 - DNA, 13 bp, Homo sapiens
tcattgaaacatt

SEQ ID NO: 5309921 - DNA, 15 bp, Homo sapiens
tcattgaaacattta

SEQ ID NO: 5309922 - DNA, 16 bp, Homo sapiens
tcattgaaacatttat

SEQ ID NO: 5309923 - DNA, 12 bp, Homo sapiens
tcattgaaatct

SEQ ID NO: 5309924 - DNA, 23 bp, Homo sapiens
tcattgaaatgtaatttcagttc

SEQ ID NO: 5309925 - DNA, 17 bp, Homo sapiens
tcattgaagtcagatgt

SEQ ID NO: 5309926 - DNA, 14 bp, Homo sapiens
tcattgacatgata

SEQ ID NO: 5309927 - DNA, 15 bp, Homo sapiens
tcattgacctctcag

SEQ ID NO: 5309928 - DNA, 21 bp, Homo sapiens
tcattgacctctcagggcctg

SEQ ID NO: 5309929 - DNA, 12 bp, Homo sapiens
tcattgacctga

SEQ ID NO: 5309930 - DNA, 17 bp, Homo sapiens
tcattgactaaagccat

SEQ ID NO: 5309931 - DNA, 21 bp, Homo sapiens
tcattgactatcaaactgaag

SEQ ID NO: 5309932 - DNA, 18 bp, Homo sapiens
tcattgactcttgcgtgt

SEQ ID NO: 5309933 - DNA, 17 bp, Homo sapiens
tcattgactgaactgca

SEQ ID NO: 5309934 - DNA, 18 bp, Homo sapiens
tcattgactgaactgcac

SEQ ID NO: 5309935 - DNA, 14 bp, Homo sapiens
tcattgacttcatt

SEQ ID NO: 5309936 - DNA, 21 bp, Homo sapiens
tcattgacttcattttatatt

SEQ ID NO: 5309937 - DNA, 14 bp, Homo sapiens
tcattgacttttat

SEQ ID NO: 5309938 - DNA, 18 bp, Homo sapiens
tcattgagagttttgtct

SEQ ID NO: 5309939 - DNA, 20 bp, Homo sapiens
tcattgaggataaattgcca

SEQ ID NO: 5309940 - DNA, 12 bp, Homo sapiens
tcattgatagaa

SEQ ID NO: 5309941 - DNA, 19 bp, Homo sapiens
tcattgatatgaaaaatat

SEQ ID NO: 5309942 - DNA, 17 bp, Homo sapiens
tcattgatgatcactgt

SEQ ID NO: 5309943 - DNA, 20 bp, Homo sapiens
tcattgatgatcactgtgaa

SEQ ID NO: 5309944 - DNA, 22 bp, Homo sapiens
tcattgatgatcactgtgaaaa

SEQ ID NO: 5309945 - DNA, 16 bp, Homo sapiens
tcattgatgttaagaa

SEQ ID NO: 5309946 - DNA, 19 bp, Homo sapiens
tcattgatttcctgtgtca

SEQ ID NO: 5309947 - DNA, 17 bp, Homo sapiens
tcattgattttataatt

SEQ ID NO: 5309948 - DNA, 12 bp, Homo sapiens
tcattgcacaat

SEQ ID NO: 5309949 - DNA, 16 bp, Homo sapiens
tcattgcacaatatat

SEQ ID NO: 5309950 - DNA, 19 bp, Homo sapiens
tcattgcacctatctcagc

SEQ ID NO: 5309951 - DNA, 12 bp, Homo sapiens
tcattgcacttt

SEQ ID NO: 5309952 - DNA, 19 bp, Homo sapiens
tcattgcagcagataactt

SEQ ID NO: 5309953 - DNA, 20 bp, Homo sapiens
tcattgcagcagataacttt

SEQ ID NO: 5309954 - DNA, 22 bp, Homo sapiens
tcattgcaggccagtggacaga

SEQ ID NO: 5309955 - DNA, 11 bp, Homo sapiens
tcattgcattt

SEQ ID NO: 5309956 - DNA, 16 bp, Homo sapiens
tcattgcatttattgc

SEQ ID NO: 5309957 - DNA, 19 bp, Homo sapiens
tcattgccaagggcccaaa

SEQ ID NO: 5309958 - DNA, 23 bp, Homo sapiens
tcattgccagtgtctttctttgg

SEQ ID NO: 5309959 - DNA, 18 bp, Homo sapiens
tcattgcccacttctgtg

SEQ ID NO: 5309960 - DNA, 18 bp, Homo sapiens
tcattgcctcctgttctg

SEQ ID NO: 5309961 - DNA, 22 bp, Homo sapiens
tcattgcctgtgtatggaaaaa

SEQ ID NO: 5309962 - DNA, 17 bp, Homo sapiens
tcattgccttcgctcca

SEQ ID NO: 5309963 - DNA, 11 bp, Homo sapiens
tcattgccttg

SEQ ID NO: 5309964 - DNA, 15 bp, Homo sapiens
tcattgcctttccag

SEQ ID NO: 5309965 - DNA, 16 bp, Homo sapiens
tcattgctaaaaaata

SEQ ID NO: 5309966 - DNA, 18 bp, Homo sapiens
tcattgctaaaaaataaa

SEQ ID NO: 5309967 - DNA, 14 bp, Homo sapiens
tcattgctaccaca

SEQ ID NO: 5309968 - DNA, 17 bp, Homo sapiens
tcattgctctccagtca

SEQ ID NO: 5309969 - DNA, 21 bp, Homo sapiens
tcattgctggaggtagagagg

SEQ ID NO: 5309970 - DNA, 19 bp, Homo sapiens
tcattgctgtaccacatct

SEQ ID NO: 5309971 - DNA, 20 bp, Homo sapiens
tcattgctgtcttgccccag

SEQ ID NO: 5309972 - DNA, 14 bp, Homo sapiens
tcattgctgtgtca

SEQ ID NO: 5309973 - DNA, 15 bp, Homo sapiens
tcattgctgttgtat

SEQ ID NO: 5309974 - DNA, 21 bp, Homo sapiens
tcattgcttcacaacccatct

SEQ ID NO: 5309975 - DNA, 14 bp, Homo sapiens
tcattgcttctgac

SEQ ID NO: 5309976 - DNA, 16 bp, Homo sapiens
tcattgcttcttctga

SEQ ID NO: 5309977 - DNA, 11 bp, Homo sapiens
tcattgcttta

SEQ ID NO: 5309978 - DNA, 23 bp, Homo sapiens
tcattgctttgaagcagttgtgt

SEQ ID NO: 5309979 - DNA, 18 bp, Homo sapiens
tcattggaatacaggaag

SEQ ID NO: 5309980 - DNA, 13 bp, Homo sapiens
tcattggatgcag

SEQ ID NO: 5309981 - DNA, 12 bp, Homo sapiens
tcattggcaaag

SEQ ID NO: 5309982 - DNA, 13 bp, Homo sapiens
tcattggcaaagt

SEQ ID NO: 5309983 - DNA, 14 bp, Homo sapiens
tcattggcagctca

SEQ ID NO: 5309984 - DNA, 19 bp, Homo sapiens
tcattggcagctcaaagac

SEQ ID NO: 5309985 - DNA, 21 bp, Homo sapiens
tcattggcattctttgcaata

SEQ ID NO: 5309986 - DNA, 22 bp, Homo sapiens
tcattggcattctttgcaatac

SEQ ID NO: 5309987 - DNA, 18 bp, Homo sapiens
tcattggccctcattcca

SEQ ID NO: 5309988 - DNA, 12 bp, Homo sapiens
tcattggctcct

SEQ ID NO: 5309989 - DNA, 17 bp, Homo sapiens
tcattgggaagtatgat

SEQ ID NO: 5309990 - DNA, 22 bp, Homo sapiens
tcattgggccatgtttaagtgt

SEQ ID NO: 5309991 - DNA, 19 bp, Homo sapiens
tcattgggttttatcagtg

SEQ ID NO: 5309992 - DNA, 22 bp, Homo sapiens
tcattgggtttttcctctgtta

SEQ ID NO: 5309993 - DNA, 23 bp, Homo sapiens
tcattgggtttttcctctgttaa

SEQ ID NO: 5309994 - DNA, 17 bp, Homo sapiens
tcattggtctaatttat

SEQ ID NO: 5309995 - DNA, 12 bp, Homo sapiens
tccaaaatcatt

SEQ ID NO: 5309996 - DNA, 20 bp, Homo sapiens
tccaaaattccatccctaag

SEQ ID NO: 5309997 - DNA, 14 bp, Homo sapiens
tccaaaatttttca

SEQ ID NO: 5309998 - DNA, 15 bp, Homo sapiens
tccaaaatttttcaa

SEQ ID NO: 5309999 - DNA, 22 bp, Homo sapiens
tccaaacactgaggcagccttg

SEQ ID NO: 5310000 - DNA, 22 bp, Homo sapiens
tccaaacactgggctctgagga

SEQ ID NO: 5310001 - DNA, 22 bp, Homo sapiens
tccaaacaggtgctggcccagc

SEQ ID NO: 5310002 - DNA, 18 bp, Homo sapiens
tccaaacagtgtgttggt

SEQ ID NO: 5310003 - DNA, 15 bp, Homo sapiens
tccaaacatccaaaa

SEQ ID NO: 5310004 - DNA, 17 bp, Homo sapiens
tccaaaccaaattttaa

SEQ ID NO: 5310005 - DNA, 12 bp, Homo sapiens
tccaaaccactt

SEQ ID NO: 5310006 - DNA, 15 bp, Homo sapiens
tccaaaccaggacac

SEQ ID NO: 5310007 - DNA, 20 bp, Homo sapiens
tccaaaccagtttattctgt

SEQ ID NO: 5310008 - DNA, 21 bp, Homo sapiens
tccaaacccaagtcttgagca

SEQ ID NO: 5310009 - DNA, 13 bp, Homo sapiens
tccaaacccactc

SEQ ID NO: 5310010 - DNA, 15 bp, Homo sapiens
tccaaacccatcttc

SEQ ID NO: 5310011 - DNA, 15 bp, Homo sapiens
tccaaaccctcctgg

SEQ ID NO: 5310012 - DNA, 16 bp, Homo sapiens
tccaaaccctcctggg

SEQ ID NO: 5310013 - DNA, 22 bp, Homo sapiens
tccaaacccttcaactcctggc

SEQ ID NO: 5310014 - DNA, 23 bp, Homo sapiens
tccaaacccttcaactcctggct

SEQ ID NO: 5310015 - DNA, 21 bp, Homo sapiens
tccaaacctaccttatagagc

SEQ ID NO: 5310016 - DNA, 22 bp, Homo sapiens
tccaaacctaccttatagagca

SEQ ID NO: 5310017 - DNA, 13 bp, Homo sapiens
tccaaacctccag

SEQ ID NO: 5310018 - DNA, 14 bp, Homo sapiens
tccaaacctccagc

SEQ ID NO: 5310019 - DNA, 19 bp, Homo sapiens
tccaaacctccagcctccc

SEQ ID NO: 5310020 - DNA, 19 bp, Homo sapiens
tccaaacctgtaacctttc

SEQ ID NO: 5310021 - DNA, 14 bp, Homo sapiens
tccaaacctgtctt

SEQ ID NO: 5310022 - DNA, 23 bp, Homo sapiens
tccaaaccttactctgagctcat

SEQ ID NO: 5310023 - DNA, 15 bp, Homo sapiens
tccaaaccttatctc

SEQ ID NO: 5310024 - DNA, 11 bp, Homo sapiens
tccaaaccttc

SEQ ID NO: 5310025 - DNA, 22 bp, Homo sapiens
tccaaaccttctaccctgggtc

SEQ ID NO: 5310026 - DNA, 13 bp, Homo sapiens
tccaaactcctgc

SEQ ID NO: 5310027 - DNA, 23 bp, Homo sapiens
tccaaactgactcttaagaagac

SEQ ID NO: 5310028 - DNA, 19 bp, Homo sapiens
tccaaactgattaaatatt

SEQ ID NO: 5310029 - DNA, 16 bp, Homo sapiens
tccaaactgctgtctc

SEQ ID NO: 5310030 - DNA, 18 bp, Homo sapiens
tccaaacttaacagatca

SEQ ID NO: 5310031 - DNA, 22 bp, Homo sapiens
tccaaacttctaaatgttggaa

SEQ ID NO: 5310032 - DNA, 22 bp, Homo sapiens
tccaaacttggatttttgactc

SEQ ID NO: 5310033 - DNA, 13 bp, Homo sapiens
tccaaagaaagtt

SEQ ID NO: 5310034 - DNA, 17 bp, Homo sapiens
tccaaagaaatgtaagg

SEQ ID NO: 5310035 - DNA, 13 bp, Homo sapiens
tccaaagaatgtt

SEQ ID NO: 5310036 - DNA, 17 bp, Homo sapiens
tccaaagactcttggga

SEQ ID NO: 5310037 - DNA, 21 bp, Homo sapiens
tccaaagactgtactggccag

SEQ ID NO: 5310038 - DNA, 16 bp, Homo sapiens
tccaaagagaaaccta

SEQ ID NO: 5310039 - DNA, 19 bp, Homo sapiens
tccaaagagaaggcctggt

SEQ ID NO: 5310040 - DNA, 17 bp, Homo sapiens
tccaaagagccttcaga

SEQ ID NO: 5310041 - DNA, 13 bp, Homo sapiens
tccaaagaggctg

SEQ ID NO: 5310042 - DNA, 14 bp, Homo sapiens
tccaaagaggctgc

SEQ ID NO: 5310043 - DNA, 21 bp, Homo sapiens
tccaaagagggatgtttggaa

SEQ ID NO: 5310044 - DNA, 23 bp, Homo sapiens
tccaaagagtgctaagcattagc

SEQ ID NO: 5310045 - DNA, 15 bp, Homo sapiens
tccaaagcagacagc

SEQ ID NO: 5310046 - DNA, 22 bp, Homo sapiens
tccaaagcattgcagaacatga

SEQ ID NO: 5310047 - DNA, 16 bp, Homo sapiens
tccaaagccccacctt

SEQ ID NO: 5310048 - DNA, 12 bp, Homo sapiens
tccaaagcctgg

SEQ ID NO: 5310049 - DNA, 22 bp, Homo sapiens
tccaaagcctgggcagaaatgt

SEQ ID NO: 5310050 - DNA, 13 bp, Homo sapiens
tccaaagctttat

SEQ ID NO: 5310051 - DNA, 19 bp, Homo sapiens
tccaaagctttcctggaga

SEQ ID NO: 5310052 - DNA, 17 bp, Homo sapiens
tccaaaggaactctaga

SEQ ID NO: 5310053 - DNA, 15 bp, Homo sapiens
tccaaaggaggctgg

SEQ ID NO: 5310054 - DNA, 15 bp, Homo sapiens
tccaaaggcagcgtg

SEQ ID NO: 5310055 - DNA, 14 bp, Homo sapiens
tccaaaggccccct

SEQ ID NO: 5310056 - DNA, 20 bp, Homo sapiens
tccaaagggcagtaaagttt

SEQ ID NO: 5310057 - DNA, 17 bp, Homo sapiens
tccaaaggggctgctgg

SEQ ID NO: 5310058 - DNA, 16 bp, Homo sapiens
tccaaaggtttcaact

SEQ ID NO: 5310059 - DNA, 15 bp, Homo sapiens
tccaaagtaaaattg

SEQ ID NO: 5310060 - DNA, 14 bp, Homo sapiens
tccaaagtacactg

SEQ ID NO: 5310061 - DNA, 19 bp, Homo sapiens
tccaaagtcacaggaagaa

SEQ ID NO: 5310062 - DNA, 13 bp, Homo sapiens
tccaaagtctcta

SEQ ID NO: 5310063 - DNA, 19 bp, Homo sapiens
tccaaagtggagctgggag

SEQ ID NO: 5310064 - DNA, 17 bp, Homo sapiens
tccaaataaaaactaaa

SEQ ID NO: 5310065 - DNA, 23 bp, Homo sapiens
tccaaataaacattttttaagaa

SEQ ID NO: 5310066 - DNA, 17 bp, Homo sapiens
tccaaataagaaaccta

SEQ ID NO: 5310067 - DNA, 14 bp, Homo sapiens
tccaaataatgaat

SEQ ID NO: 5310068 - DNA, 17 bp, Homo sapiens
tccaaatacattccagt

SEQ ID NO: 5310069 - DNA, 23 bp, Homo sapiens
tccaaataggagtcttctgcctc

SEQ ID NO: 5310070 - DNA, 16 bp, Homo sapiens
tccaaatattattcaa

SEQ ID NO: 5310071 - DNA, 18 bp, Homo sapiens
tccaaatattctaaaaaa

SEQ ID NO: 5310072 - DNA, 14 bp, Homo sapiens
tccaaatctccaag

SEQ ID NO: 5310073 - DNA, 18 bp, Homo sapiens
tccaaatctgtcctctgt

SEQ ID NO: 5310074 - DNA, 19 bp, Homo sapiens
tccaaatctgtcctctgta

SEQ ID NO: 5310075 - DNA, 16 bp, Homo sapiens
tccaaatgaatgacct

SEQ ID NO: 5310076 - DNA, 22 bp, Homo sapiens
tccaaatgaggatatcatcttt

SEQ ID NO: 5310077 - DNA, 18 bp, Homo sapiens
tccaaatgatcctagtaa

SEQ ID NO: 5310078 - DNA, 19 bp, Homo sapiens
tccaaatgcagctttaaaa

SEQ ID NO: 5310079 - DNA, 13 bp, Homo sapiens
tccaaatgcattc

SEQ ID NO: 5310080 - DNA, 19 bp, Homo sapiens
tccaaatgcattcatgttt

SEQ ID NO: 5310081 - DNA, 13 bp, Homo sapiens
tccaaatgcccaa

SEQ ID NO: 5310082 - DNA, 13 bp, Homo sapiens
tccaaatgcttct

SEQ ID NO: 5310083 - DNA, 14 bp, Homo sapiens
tccaaatgcttcta

SEQ ID NO: 5310084 - DNA, 20 bp, Homo sapiens
tccaaatggagaagctgcag

SEQ ID NO: 5310085 - DNA, 13 bp, Homo sapiens
tccaaatgtccct

SEQ ID NO: 5310086 - DNA, 18 bp, Homo sapiens
tccaaatgtcctttctca

SEQ ID NO: 5310087 - DNA, 19 bp, Homo sapiens
tccaaatgtcctttctcag

SEQ ID NO: 5310088 - DNA, 20 bp, Homo sapiens
tccaaatgtcctttctcaga

SEQ ID NO: 5310089 - DNA, 22 bp, Homo sapiens
tccaaatgtgatcaactgttca

SEQ ID NO: 5310090 - DNA, 19 bp, Homo sapiens
tccaaatgtgtataatttt

SEQ ID NO: 5310091 - DNA, 14 bp, Homo sapiens
tccaaatgtttata

SEQ ID NO: 5310092 - DNA, 23 bp, Homo sapiens
tccaaatgtttataaaggtaaaa

SEQ ID NO: 5310093 - DNA, 18 bp, Homo sapiens
tccaaattaaaacaaata

SEQ ID NO: 5310094 - DNA, 13 bp, Homo sapiens
tccaaattattaa

SEQ ID NO: 5310095 - DNA, 15 bp, Homo sapiens
tccaaattatttctt

SEQ ID NO: 5310096 - DNA, 13 bp, Homo sapiens
tccaaattcacaa

SEQ ID NO: 5310097 - DNA, 17 bp, Homo sapiens
tccaaattccctctgga

SEQ ID NO: 5310098 - DNA, 19 bp, Homo sapiens
tccaaattccctctggagt

SEQ ID NO: 5310099 - DNA, 17 bp, Homo sapiens
tccaaattctcacagaa

SEQ ID NO: 5310100 - DNA, 16 bp, Homo sapiens
tccaaattctttattc

SEQ ID NO: 5310101 - DNA, 15 bp, Homo sapiens
tccaaattgatgggt

SEQ ID NO: 5310102 - DNA, 16 bp, Homo sapiens
tccaaattgtctgtct

SEQ ID NO: 5310103 - DNA, 18 bp, Homo sapiens
tccaaattgtctgtctgc

SEQ ID NO: 5310104 - DNA, 22 bp, Homo sapiens
tccaaattgtctgtctgctctt

SEQ ID NO: 5310105 - DNA, 22 bp, Homo sapiens
tccaaattgtgcttctccccag

SEQ ID NO: 5310106 - DNA, 23 bp, Homo sapiens
tccaaattgtttaaattcacaat

SEQ ID NO: 5310107 - DNA, 15 bp, Homo sapiens
tccaaattgtttgta

SEQ ID NO: 5310108 - DNA, 18 bp, Homo sapiens
tccaaattgtttgtacag

SEQ ID NO: 5310109 - DNA, 20 bp, Homo sapiens
tccaaattgtttgtacagta

SEQ ID NO: 5310110 - DNA, 14 bp, Homo sapiens
tccaaatttaaaat

SEQ ID NO: 5310111 - DNA, 17 bp, Homo sapiens
tccaaatttaaaatgtg

SEQ ID NO: 5310112 - DNA, 15 bp, Homo sapiens
tccaaatttctcatg

SEQ ID NO: 5310113 - DNA, 16 bp, Homo sapiens
tccaaatttgctttac

SEQ ID NO: 5310114 - DNA, 21 bp, Homo sapiens
tccaaatttttttttaaagca

SEQ ID NO: 5310115 - DNA, 20 bp, Homo sapiens
tccaacaactccaggaaaac

SEQ ID NO: 5310116 - DNA, 21 bp, Homo sapiens
tccaacaagaagaaatatgaa

SEQ ID NO: 5310117 - DNA, 23 bp, Homo sapiens
tccaacaagaagaaatatgaaat

SEQ ID NO: 5310118 - DNA, 16 bp, Homo sapiens
tccaacaagaatgcat

SEQ ID NO: 5310119 - DNA, 23 bp, Homo sapiens
tccaacaagaatgcattccctga

SEQ ID NO: 5310120 - DNA, 15 bp, Homo sapiens
tccaacaagcctcaa

SEQ ID NO: 5310121 - DNA, 19 bp, Homo sapiens
tccaacaataaagagctca

SEQ ID NO: 5310122 - DNA, 14 bp, Homo sapiens
tccaacacaagttg

SEQ ID NO: 5310123 - DNA, 16 bp, Homo sapiens
tccaacaccacagaca

SEQ ID NO: 5310124 - DNA, 17 bp, Homo sapiens
tccaacaccacagacac

SEQ ID NO: 5310125 - DNA, 22 bp, Homo sapiens
tccaacaccacagacacacaca

SEQ ID NO: 5310126 - DNA, 21 bp, Homo sapiens
tccaacactttgagcattttt

SEQ ID NO: 5310127 - DNA, 22 bp, Homo sapiens
tccaacactttgagcattttta

SEQ ID NO: 5310128 - DNA, 17 bp, Homo sapiens
tccaacagaactaaatg

SEQ ID NO: 5310129 - DNA, 19 bp, Homo sapiens
tccaacagacaccctccac

SEQ ID NO: 5310130 - DNA, 18 bp, Homo sapiens
tccaacagacagggccta

SEQ ID NO: 5310131 - DNA, 13 bp, Homo sapiens
tccaacagacctg

SEQ ID NO: 5310132 - DNA, 16 bp, Homo sapiens
tccaacaggagctggg

SEQ ID NO: 5310133 - DNA, 20 bp, Homo sapiens
tccaacaggcgtgggatcag

SEQ ID NO: 5310134 - DNA, 13 bp, Homo sapiens
tccaacagtgagt

SEQ ID NO: 5310135 - DNA, 23 bp, Homo sapiens
tccaacatctttctttttaagaa

SEQ ID NO: 5310136 - DNA, 17 bp, Homo sapiens
tccaacatgtgatgtgt

SEQ ID NO: 5310137 - DNA, 19 bp, Homo sapiens
tccaacattatcctgtgtg

SEQ ID NO: 5310138 - DNA, 21 bp, Homo sapiens
tccaacatttctcactgaaag

SEQ ID NO: 5310139 - DNA, 18 bp, Homo sapiens
tccaaccactgtgccact

SEQ ID NO: 5310140 - DNA, 19 bp, Homo sapiens
tccaaccactgtgccactg

SEQ ID NO: 5310141 - DNA, 14 bp, Homo sapiens
tccaaccagacctg

SEQ ID NO: 5310142 - DNA, 15 bp, Homo sapiens
tccaaccagacctgg

SEQ ID NO: 5310143 - DNA, 14 bp, Homo sapiens
tccaaccagacttt

SEQ ID NO: 5310144 - DNA, 21 bp, Homo sapiens
tccaaccagactttgagcctg

SEQ ID NO: 5310145 - DNA, 20 bp, Homo sapiens
tccaacccaacccaatccct

SEQ ID NO: 5310146 - DNA, 13 bp, Homo sapiens
tccaacccatgca

SEQ ID NO: 5310147 - DNA, 16 bp, Homo sapiens
tccaaccccaactcca

SEQ ID NO: 5310148 - DNA, 18 bp, Homo sapiens
tccaaccccaactccagt

SEQ ID NO: 5310149 - DNA, 12 bp, Homo sapiens
tccaaccccagc

SEQ ID NO: 5310150 - DNA, 17 bp, Homo sapiens
tccaaccccagctggcc

SEQ ID NO: 5310151 - DNA, 18 bp, Homo sapiens
tccaaccccagctggcct

SEQ ID NO: 5310152 - DNA, 19 bp, Homo sapiens
tccaaccccagctggcctc

SEQ ID NO: 5310153 - DNA, 20 bp, Homo sapiens
tccaaccccagctggcctct

SEQ ID NO: 5310154 - DNA, 19 bp, Homo sapiens
tccaaccccccagcactga

SEQ ID NO: 5310155 - DNA, 20 bp, Homo sapiens
tccaaccccccagcactgag

SEQ ID NO: 5310156 - DNA, 21 bp, Homo sapiens
tccaaccccccagcactgagg

SEQ ID NO: 5310157 - DNA, 22 bp, Homo sapiens
tccaacccccgccacctcaggg

SEQ ID NO: 5310158 - DNA, 13 bp, Homo sapiens
tccaacccctccc

SEQ ID NO: 5310159 - DNA, 13 bp, Homo sapiens
tccaacccctcgc

SEQ ID NO: 5310160 - DNA, 14 bp, Homo sapiens
tccaacccctcgcc

SEQ ID NO: 5310161 - DNA, 20 bp, Homo sapiens
tccaacctaacccctttcct

SEQ ID NO: 5310162 - DNA, 14 bp, Homo sapiens
tccaacctaacctg

SEQ ID NO: 5310163 - DNA, 21 bp, Homo sapiens
tccaacctaacctgtgtctgc

SEQ ID NO: 5310164 - DNA, 14 bp, Homo sapiens
tccaacctcctgct

SEQ ID NO: 5310165 - DNA, 20 bp, Homo sapiens
tccaacctctcggccccatc

SEQ ID NO: 5310166 - DNA, 20 bp, Homo sapiens
tccaacctgaaggtcccctg

SEQ ID NO: 5310167 - DNA, 23 bp, Homo sapiens
tccaacctgaaggtcccctggca

SEQ ID NO: 5310168 - DNA, 14 bp, Homo sapiens
tccaacctggacaa

SEQ ID NO: 5310169 - DNA, 16 bp, Homo sapiens
tccaaccttctgccct

SEQ ID NO: 5310170 - DNA, 23 bp, Homo sapiens
tccaaccttctgccctcctgcca

SEQ ID NO: 5310171 - DNA, 16 bp, Homo sapiens
tccaacgtggcccaga

SEQ ID NO: 5310172 - DNA, 14 bp, Homo sapiens
tccacccccaggtg

SEQ ID NO: 5310173 - DNA, 16 bp, Homo sapiens
tccacccccaggtgca

SEQ ID NO: 5310174 - DNA, 17 bp, Homo sapiens
tccacccccataagatt

SEQ ID NO: 5310175 - DNA, 18 bp, Homo sapiens
tccacccccatgtggcag

SEQ ID NO: 5310176 - DNA, 22 bp, Homo sapiens
tccacccccatgtggcagccca

SEQ ID NO: 5310177 - DNA, 23 bp, Homo sapiens
tccacccccatgtggcagcccat

SEQ ID NO: 5310178 - DNA, 17 bp, Homo sapiens
tccacccccattgtgaa

SEQ ID NO: 5310179 - DNA, 18 bp, Homo sapiens
tccaccccccacacacac

SEQ ID NO: 5310180 - DNA, 20 bp, Homo sapiens
tccaccccccacgtctgtcc

SEQ ID NO: 5310181 - DNA, 15 bp, Homo sapiens
tccaccccccactca

SEQ ID NO: 5310182 - DNA, 16 bp, Homo sapiens
tccaccccccactcag

SEQ ID NO: 5310183 - DNA, 22 bp, Homo sapiens
tccaccccccactcagtgcctc

SEQ ID NO: 5310184 - DNA, 23 bp, Homo sapiens
tccaccccccagaacctgtcctt

SEQ ID NO: 5310185 - DNA, 20 bp, Homo sapiens
tccacccccgccacggccac

SEQ ID NO: 5310186 - DNA, 22 bp, Homo sapiens
tccacccccgccacggccaccc

SEQ ID NO: 5310187 - DNA, 16 bp, Homo sapiens
tccaccccctccagct

SEQ ID NO: 5310188 - DNA, 21 bp, Homo sapiens
tccaccccctccagctccagt

SEQ ID NO: 5310189 - DNA, 13 bp, Homo sapiens
tccaccccctccc

SEQ ID NO: 5310190 - DNA, 15 bp, Homo sapiens
tccaccccctccctg

SEQ ID NO: 5310191 - DNA, 20 bp, Homo sapiens
tccaccccctccctggcctg

SEQ ID NO: 5310192 - DNA, 16 bp, Homo sapiens
tccaccccctcctgtc

SEQ ID NO: 5310193 - DNA, 23 bp, Homo sapiens
tccaccccggcccccgaactgtg

SEQ ID NO: 5310194 - DNA, 22 bp, Homo sapiens
tccaccccggctccccctgcca

SEQ ID NO: 5310195 - DNA, 15 bp, Homo sapiens
tccacccctcaagcc

SEQ ID NO: 5310196 - DNA, 21 bp, Homo sapiens
tccacccctcaagccaggaga

SEQ ID NO: 5310197 - DNA, 17 bp, Homo sapiens
tccacccctccttccct

SEQ ID NO: 5310198 - DNA, 18 bp, Homo sapiens
tccacccctccttccctg

SEQ ID NO: 5310199 - DNA, 21 bp, Homo sapiens
tccacccctccttccctggtc

SEQ ID NO: 5310200 - DNA, 19 bp, Homo sapiens
tccacccctctggcacctg

SEQ ID NO: 5310201 - DNA, 22 bp, Homo sapiens
tccacccctttctagaccaata

SEQ ID NO: 5310202 - DNA, 18 bp, Homo sapiens
tccacccgggggagccca

SEQ ID NO: 5310203 - DNA, 20 bp, Homo sapiens
tccaccctcatttctgccag

SEQ ID NO: 5310204 - DNA, 21 bp, Homo sapiens
tccaccctcatttctgccagc

SEQ ID NO: 5310205 - DNA, 22 bp, Homo sapiens
tccaccctcccagacctgcctc

SEQ ID NO: 5310206 - DNA, 14 bp, Homo sapiens
tccaccctcccctc

SEQ ID NO: 5310207 - DNA, 22 bp, Homo sapiens
tccaccctcctctagccatccc

SEQ ID NO: 5310208 - DNA, 17 bp, Homo sapiens
tccaccctgagctcggg

SEQ ID NO: 5310209 - DNA, 15 bp, Homo sapiens
tccaccctgaggagt

SEQ ID NO: 5310210 - DNA, 12 bp, Homo sapiens
tccaccctgcag

SEQ ID NO: 5310211 - DNA, 17 bp, Homo sapiens
tccaccctgcagccagg

SEQ ID NO: 5310212 - DNA, 16 bp, Homo sapiens
tccaccctgccctggc

SEQ ID NO: 5310213 - DNA, 22 bp, Homo sapiens
tccaccctggccgagtccaagc

SEQ ID NO: 5310214 - DNA, 12 bp, Homo sapiens
tccaccctgtcc

SEQ ID NO: 5310215 - DNA, 18 bp, Homo sapiens
tccaccctgtcccccagc

SEQ ID NO: 5310216 - DNA, 14 bp, Homo sapiens
tccaccctgttagt

SEQ ID NO: 5310217 - DNA, 21 bp, Homo sapiens
tccaccctgttagttttgtaa

SEQ ID NO: 5310218 - DNA, 16 bp, Homo sapiens
tccacccttccatcag

SEQ ID NO: 5310219 - DNA, 15 bp, Homo sapiens
tccacccttggcctg

SEQ ID NO: 5310220 - DNA, 19 bp, Homo sapiens
tccacccttggcctgtctc

SEQ ID NO: 5310221 - DNA, 17 bp, Homo sapiens
tccaccgaccaactgcc

SEQ ID NO: 5310222 - DNA, 15 bp, Homo sapiens
tccaccgcagaagga

SEQ ID NO: 5310223 - DNA, 17 bp, Homo sapiens
tccaccgccaccccact

SEQ ID NO: 5310224 - DNA, 18 bp, Homo sapiens
tccaccgccaccccactg

SEQ ID NO: 5310225 - DNA, 19 bp, Homo sapiens
tccaccgccaccccactga

SEQ ID NO: 5310226 - DNA, 14 bp, Homo sapiens
tccaccgctgctcc

SEQ ID NO: 5310227 - DNA, 16 bp, Homo sapiens
tccaccggcactcatg

SEQ ID NO: 5310228 - DNA, 17 bp, Homo sapiens
tccaccggcactcatga

SEQ ID NO: 5310229 - DNA, 22 bp, Homo sapiens
tccaccggcctcggcctcccaa

SEQ ID NO: 5310230 - DNA, 15 bp, Homo sapiens
tccaccgggcctgaa

SEQ ID NO: 5310231 - DNA, 17 bp, Homo sapiens
tccaccgggcgcatgcc

SEQ ID NO: 5310232 - DNA, 15 bp, Homo sapiens
tccaccggtgcctcc

SEQ ID NO: 5310233 - DNA, 17 bp, Homo sapiens
tccaccggtgcctcctc

SEQ ID NO: 5310234 - DNA, 23 bp, Homo sapiens
tccaccgtctttcttttatactg

SEQ ID NO: 5310235 - DNA, 21 bp, Homo sapiens
tccacctacacccctgtgctc

SEQ ID NO: 5310236 - DNA, 17 bp, Homo sapiens
tccacctagtggctgtc

SEQ ID NO: 5310237 - DNA, 20 bp, Homo sapiens
tccacctatccaccacccca

SEQ ID NO: 5310238 - DNA, 14 bp, Homo sapiens
tccacctcagcctc

SEQ ID NO: 5310239 - DNA, 14 bp, Homo sapiens
tccacctcagcctt

SEQ ID NO: 5310240 - DNA, 17 bp, Homo sapiens
tccacctcagccttgga

SEQ ID NO: 5310241 - DNA, 11 bp, Homo sapiens
tccacctcagg

SEQ ID NO: 5310242 - DNA, 14 bp, Homo sapiens
tccacctcagggga

SEQ ID NO: 5310243 - DNA, 19 bp, Homo sapiens
tccacctcatcactggact

SEQ ID NO: 5310244 - DNA, 21 bp, Homo sapiens
tccacctcatggattgccaca

SEQ ID NO: 5310245 - DNA, 23 bp, Homo sapiens
tccacctcatggattgccacagc

SEQ ID NO: 5310246 - DNA, 17 bp, Homo sapiens
tccacctccagcctctg

SEQ ID NO: 5310247 - DNA, 23 bp, Homo sapiens
tccacctccagcctctggtccta

SEQ ID NO: 5310248 - DNA, 14 bp, Homo sapiens
tccacctccctacc

SEQ ID NO: 5310249 - DNA, 13 bp, Homo sapiens
tccacctccctcc

SEQ ID NO: 5310250 - DNA, 13 bp, Homo sapiens
tccacctcctaga

SEQ ID NO: 5310251 - DNA, 20 bp, Homo sapiens
tccacctcctagaggtgggc

SEQ ID NO: 5310252 - DNA, 19 bp, Homo sapiens
tccacctctcacgggccct

SEQ ID NO: 5310253 - DNA, 13 bp, Homo sapiens
tccacctctggga

SEQ ID NO: 5310254 - DNA, 16 bp, Homo sapiens
tccacctctggtggct

SEQ ID NO: 5310255 - DNA, 19 bp, Homo sapiens
tccacctctggtggctcct

SEQ ID NO: 5310256 - DNA, 14 bp, Homo sapiens
tccacctctgtgca

SEQ ID NO: 5310257 - DNA, 17 bp, Homo sapiens
tccacctgagctgccat

SEQ ID NO: 5310258 - DNA, 22 bp, Homo sapiens
tccacctgcacaaacatagaca

SEQ ID NO: 5310259 - DNA, 21 bp, Homo sapiens
tccacctgcacattgggtggg

SEQ ID NO: 5310260 - DNA, 14 bp, Homo sapiens
tccacctgcagccc

SEQ ID NO: 5310261 - DNA, 18 bp, Homo sapiens
tccacctgcagccccagg

SEQ ID NO: 5310262 - DNA, 20 bp, Homo sapiens
tccacctgcagccccaggcc

SEQ ID NO: 5310263 - DNA, 21 bp, Homo sapiens
tccacctgcagccccaggcct

SEQ ID NO: 5310264 - DNA, 14 bp, Homo sapiens
tccacctgcagtta

SEQ ID NO: 5310265 - DNA, 13 bp, Homo sapiens
tccacctgccaca

SEQ ID NO: 5310266 - DNA, 23 bp, Homo sapiens
tccacctgcctatccatcctgcg

SEQ ID NO: 5310267 - DNA, 12 bp, Homo sapiens
tccacctgcctt

SEQ ID NO: 5310268 - DNA, 14 bp, Homo sapiens
tccacctgccttgg

SEQ ID NO: 5310269 - DNA, 13 bp, Homo sapiens
tccacctgctccc

SEQ ID NO: 5310270 - DNA, 18 bp, Homo sapiens
tccacctgctcccaggcc

SEQ ID NO: 5310271 - DNA, 16 bp, Homo sapiens
tccacctgctctgctg

SEQ ID NO: 5310272 - DNA, 17 bp, Homo sapiens
tccacctgctctgctga

SEQ ID NO: 5310273 - DNA, 13 bp, Homo sapiens
tccacctgcttgt

SEQ ID NO: 5310274 - DNA, 21 bp, Homo sapiens
tccacctggaaactgctcaga

SEQ ID NO: 5310275 - DNA, 19 bp, Homo sapiens
tccacctggaaagccaggt

SEQ ID NO: 5310276 - DNA, 22 bp, Homo sapiens
tccacctggccccttctccagc

SEQ ID NO: 5310277 - DNA, 16 bp, Homo sapiens
tccacctgtctcagcc

SEQ ID NO: 5310278 - DNA, 17 bp, Homo sapiens
tccacctgtctcagcct

SEQ ID NO: 5310279 - DNA, 17 bp, Homo sapiens
tccacctgtcttggcct

SEQ ID NO: 5310280 - DNA, 11 bp, Homo sapiens
tccacctgtga

SEQ ID NO: 5310281 - DNA, 19 bp, Homo sapiens
tccacctgtgagaaaggaa

SEQ ID NO: 5310282 - DNA, 12 bp, Homo sapiens
tccacctgtgct

SEQ ID NO: 5310283 - DNA, 14 bp, Homo sapiens
tccacctgtgctgc

SEQ ID NO: 5310284 - DNA, 22 bp, Homo sapiens
tccacctgttcaggagctgaag

SEQ ID NO: 5310285 - DNA, 15 bp, Homo sapiens
tccaccttcccactt

SEQ ID NO: 5310286 - DNA, 16 bp, Homo sapiens
tccaccttcccatgcc

SEQ ID NO: 5310287 - DNA, 20 bp, Homo sapiens
tccaccttccgttccccgct

SEQ ID NO: 5310288 - DNA, 21 bp, Homo sapiens
tccaccttccgttccccgcta

SEQ ID NO: 5310289 - DNA, 14 bp, Homo sapiens
tccaccttcctgcc

SEQ ID NO: 5310290 - DNA, 19 bp, Homo sapiens
tccaccttcctgcccaggg

SEQ ID NO: 5310291 - DNA, 13 bp, Homo sapiens
tccaccttgcacc

SEQ ID NO: 5310292 - DNA, 22 bp, Homo sapiens
tccaccttggcgcgcagcccgg

SEQ ID NO: 5310293 - DNA, 13 bp, Homo sapiens
tccaccttggctc

SEQ ID NO: 5310294 - DNA, 15 bp, Homo sapiens
tccaccttggctctg

SEQ ID NO: 5310295 - DNA, 18 bp, Homo sapiens
tccaccttggctctgcca

SEQ ID NO: 5310296 - DNA, 20 bp, Homo sapiens
tccacctttcagcccacgtc

SEQ ID NO: 5310297 - DNA, 18 bp, Homo sapiens
tccacctttctctgtttt

SEQ ID NO: 5310298 - DNA, 23 bp, Homo sapiens
tccaccttttaagttaatgaaat

SEQ ID NO: 5310299 - DNA, 15 bp, Homo sapiens
tccaccttttgtttt

SEQ ID NO: 5310300 - DNA, 18 bp, Homo sapiens
tccacgactgtctccatg

SEQ ID NO: 5310301 - DNA, 16 bp, Homo sapiens
tccacgatggtgcagt

SEQ ID NO: 5310302 - DNA, 16 bp, Homo sapiens
tccacgcaaggctgtg

SEQ ID NO: 5310303 - DNA, 20 bp, Homo sapiens
tccacgcaaggctgtgctct

SEQ ID NO: 5310304 - DNA, 16 bp, Homo sapiens
tccacgcacacatgga

SEQ ID NO: 5310305 - DNA, 19 bp, Homo sapiens
tccacgcccaccagccttg

SEQ ID NO: 5310306 - DNA, 13 bp, Homo sapiens
tccacgccctggg

SEQ ID NO: 5310307 - DNA, 14 bp, Homo sapiens
tccacgcctcctgg

SEQ ID NO: 5310308 - DNA, 19 bp, Homo sapiens
tccacgcctcctggccaga

SEQ ID NO: 5310309 - DNA, 20 bp, Homo sapiens
tccacgcctcctggccagac

SEQ ID NO: 5310310 - DNA, 21 bp, Homo sapiens
tccacgcgcttcgacttttct

SEQ ID NO: 5310311 - DNA, 22 bp, Homo sapiens
tccacgctgatgtttatgtact

SEQ ID NO: 5310312 - DNA, 13 bp, Homo sapiens
tccacgctgggcc

SEQ ID NO: 5310313 - DNA, 14 bp, Homo sapiens
tccacgctgggcct

SEQ ID NO: 5310314 - DNA, 12 bp, Homo sapiens
tccacgctgtct

SEQ ID NO: 5310315 - DNA, 18 bp, Homo sapiens
tccacggaaacagaactc

SEQ ID NO: 5310316 - DNA, 15 bp, Homo sapiens
tccacggagccactc

SEQ ID NO: 5310317 - DNA, 20 bp, Homo sapiens
tccacggagccactcctctg

SEQ ID NO: 5310318 - DNA, 22 bp, Homo sapiens
tccacggagccactcctctgac

SEQ ID NO: 5310319 - DNA, 22 bp, Homo sapiens
tccacggatgcgtgggcagagg

SEQ ID NO: 5310320 - DNA, 19 bp, Homo sapiens
tccacggtcagatttgctg

SEQ ID NO: 5310321 - DNA, 22 bp, Homo sapiens
tccacggtcagatttgctgttc

SEQ ID NO: 5310322 - DNA, 19 bp, Homo sapiens
tccacggtccgcggcctgc

SEQ ID NO: 5310323 - DNA, 20 bp, Homo sapiens
tccacggtgcgtggctgtgg

SEQ ID NO: 5310324 - DNA, 18 bp, Homo sapiens
tccacgtccccctggggc

SEQ ID NO: 5310325 - DNA, 18 bp, Homo sapiens
tccacgtgctcgcctctg

SEQ ID NO: 5310326 - DNA, 13 bp, Homo sapiens
tccacgtggagag

SEQ ID NO: 5310327 - DNA, 15 bp, Homo sapiens
tccacgtggcctctc

SEQ ID NO: 5310328 - DNA, 19 bp, Homo sapiens
tccacgtggcctctctctc

SEQ ID NO: 5310329 - DNA, 17 bp, Homo sapiens
tccacgtgtggcctccg

SEQ ID NO: 5310330 - DNA, 22 bp, Homo sapiens
tccacgtgtggcctccgtcctg

SEQ ID NO: 5310331 - DNA, 21 bp, Homo sapiens
tccacgtgtttcgggccaggg

SEQ ID NO: 5310332 - DNA, 22 bp, Homo sapiens
tccacgtgtttcgggccagggc

SEQ ID NO: 5310333 - DNA, 17 bp, Homo sapiens
tccacgttcacccctcc

SEQ ID NO: 5310334 - DNA, 19 bp, Homo sapiens
tccacgttctgctcatcat

SEQ ID NO: 5310335 - DNA, 21 bp, Homo sapiens
tccacgttctgctcatcattc

SEQ ID NO: 5310336 - DNA, 17 bp, Homo sapiens
tccactaaaaatattgt

SEQ ID NO: 5310337 - DNA, 20 bp, Homo sapiens
tccactaaatgagctcctgc

SEQ ID NO: 5310338 - DNA, 14 bp, Homo sapiens
tccactaatccatt

SEQ ID NO: 5310339 - DNA, 20 bp, Homo sapiens
tccactacaggttttatgag

SEQ ID NO: 5310340 - DNA, 15 bp, Homo sapiens
tccactaccaaaaga

SEQ ID NO: 5310341 - DNA, 18 bp, Homo sapiens
tccactaccaaaagacat

SEQ ID NO: 5310342 - DNA, 19 bp, Homo sapiens
tccactaccaaaagacatt

SEQ ID NO: 5310343 - DNA, 20 bp, Homo sapiens
tccactaccaaaagacatta

SEQ ID NO: 5310344 - DNA, 19 bp, Homo sapiens
tccactaccccacaccagc

SEQ ID NO: 5310345 - DNA, 20 bp, Homo sapiens
tccactaccccacaccagcc

SEQ ID NO: 5310346 - DNA, 17 bp, Homo sapiens
tccactaccctccctcg

SEQ ID NO: 5310347 - DNA, 19 bp, Homo sapiens
tccactaccctccctcgca

SEQ ID NO: 5310348 - DNA, 16 bp, Homo sapiens
tccactacgctcctgt

SEQ ID NO: 5310349 - DNA, 22 bp, Homo sapiens
tccagatagcctagggtgaggg

SEQ ID NO: 5310350 - DNA, 15 bp, Homo sapiens
tccagatagtgtagc

SEQ ID NO: 5310351 - DNA, 22 bp, Homo sapiens
tccagatagtgtagctgaggag

SEQ ID NO: 5310352 - DNA, 16 bp, Homo sapiens
tccagatcactgccac

SEQ ID NO: 5310353 - DNA, 13 bp, Homo sapiens
tccagatcccagg

SEQ ID NO: 5310354 - DNA, 16 bp, Homo sapiens
tccagatcccaggccc

SEQ ID NO: 5310355 - DNA, 16 bp, Homo sapiens
tccagatcctctctgg

SEQ ID NO: 5310356 - DNA, 17 bp, Homo sapiens
tccagatcctggaaatc

SEQ ID NO: 5310357 - DNA, 15 bp, Homo sapiens
tccagatctgcaccg

SEQ ID NO: 5310358 - DNA, 16 bp, Homo sapiens
tccagatgaaggaaag

SEQ ID NO: 5310359 - DNA, 21 bp, Homo sapiens
tccagatgatccttgcacaga

SEQ ID NO: 5310360 - DNA, 18 bp, Homo sapiens
tccagatgcagggcagtc

SEQ ID NO: 5310361 - DNA, 19 bp, Homo sapiens
tccagatgcagggcagtca

SEQ ID NO: 5310362 - DNA, 15 bp, Homo sapiens
tccagatgccttcct

SEQ ID NO: 5310363 - DNA, 21 bp, Homo sapiens
tccagatgccttcctgtcttt

SEQ ID NO: 5310364 - DNA, 14 bp, Homo sapiens
tccagatgtgatgc

SEQ ID NO: 5310365 - DNA, 13 bp, Homo sapiens
tccagatgtggct

SEQ ID NO: 5310366 - DNA, 17 bp, Homo sapiens
tccagattagagcctgt

SEQ ID NO: 5310367 - DNA, 19 bp, Homo sapiens
tccagattatctatttgtg

SEQ ID NO: 5310368 - DNA, 15 bp, Homo sapiens
tccagattattggct

SEQ ID NO: 5310369 - DNA, 15 bp, Homo sapiens
tccagattcccaggc

SEQ ID NO: 5310370 - DNA, 17 bp, Homo sapiens
tccagattcccaggcca

SEQ ID NO: 5310371 - DNA, 19 bp, Homo sapiens
tccagattcctatgatgga

SEQ ID NO: 5310372 - DNA, 16 bp, Homo sapiens
tccagattctgatgca

SEQ ID NO: 5310373 - DNA, 16 bp, Homo sapiens
tccagattgaaaagtg

SEQ ID NO: 5310374 - DNA, 22 bp, Homo sapiens
tccagattggcacccctttcta

SEQ ID NO: 5310375 - DNA, 19 bp, Homo sapiens
tccagattgggggccctgg

SEQ ID NO: 5310376 - DNA, 22 bp, Homo sapiens
tccagattgggggccctggggt

SEQ ID NO: 5310377 - DNA, 11 bp, Homo sapiens
tccagattgta

SEQ ID NO: 5310378 - DNA, 16 bp, Homo sapiens
tccagatttacactgg

SEQ ID NO: 5310379 - DNA, 22 bp, Homo sapiens
tccagattttttacagctgcct

SEQ ID NO: 5310380 - DNA, 11 bp, Homo sapiens
tccagcaaaat

SEQ ID NO: 5310381 - DNA, 15 bp, Homo sapiens
tccagcaaaatccaa

SEQ ID NO: 5310382 - DNA, 16 bp, Homo sapiens
tccagcaaaatccaaa

SEQ ID NO: 5310383 - DNA, 18 bp, Homo sapiens
tccagcaaaatccaaact

SEQ ID NO: 5310384 - DNA, 24 bp, Homo sapiens
tccagcaaaatggaagcaaagaca

SEQ ID NO: 5310385 - DNA, 20 bp, Homo sapiens
tccagcaacacagcctgggc

SEQ ID NO: 5310386 - DNA, 13 bp, Homo sapiens
tccagcaataaga

SEQ ID NO: 5310387 - DNA, 17 bp, Homo sapiens
tccagcaatgcctgcct

SEQ ID NO: 5310388 - DNA, 21 bp, Homo sapiens
tccagcaattctcctgcctca

SEQ ID NO: 5310389 - DNA, 18 bp, Homo sapiens
tccagcacaactcagtct

SEQ ID NO: 5310390 - DNA, 19 bp, Homo sapiens
tccagcacaactcagtctg

SEQ ID NO: 5310391 - DNA, 15 bp, Homo sapiens
tccagcacagactgt

SEQ ID NO: 5310392 - DNA, 14 bp, Homo sapiens
tccagcacagattt

SEQ ID NO: 5310393 - DNA, 18 bp, Homo sapiens
tccagcacagatttgctt

SEQ ID NO: 5310394 - DNA, 12 bp, Homo sapiens
tccagcacagcc

SEQ ID NO: 5310395 - DNA, 18 bp, Homo sapiens
tccagcaccttgtgcctg

SEQ ID NO: 5310396 - DNA, 19 bp, Homo sapiens
tccagcaccttgtgcctgg

SEQ ID NO: 5310397 - DNA, 22 bp, Homo sapiens
tccagcacgcgacttctcagga

SEQ ID NO: 5310398 - DNA, 17 bp, Homo sapiens
tccagcactcaataaag

SEQ ID NO: 5310399 - DNA, 22 bp, Homo sapiens
tccagcagatttccagccttct

SEQ ID NO: 5310400 - DNA, 12 bp, Homo sapiens
tccagcagcaca

SEQ ID NO: 5310401 - DNA, 14 bp, Homo sapiens
tccagcagcacacc

SEQ ID NO: 5310402 - DNA, 23 bp, Homo sapiens
tccagcagcacacctcagcccca

SEQ ID NO: 5310403 - DNA, 19 bp, Homo sapiens
tccagcagcagaatggaaa

SEQ ID NO: 5310404 - DNA, 13 bp, Homo sapiens
tccagcagctgca

SEQ ID NO: 5310405 - DNA, 15 bp, Homo sapiens
tccagcagctgcggg

SEQ ID NO: 5310406 - DNA, 23 bp, Homo sapiens
tccagcagctgcgggtctgaagg

SEQ ID NO: 5310407 - DNA, 22 bp, Homo sapiens
tccagcaggagggacagtctca

SEQ ID NO: 5310408 - DNA, 12 bp, Homo sapiens
tccagcaggccc

SEQ ID NO: 5310409 - DNA, 13 bp, Homo sapiens
tccagcaggccca

SEQ ID NO: 5310410 - DNA, 12 bp, Homo sapiens
tccagcagggaa

SEQ ID NO: 5310411 - DNA, 23 bp, Homo sapiens
tccagcagtcaattaactctcca

SEQ ID NO: 5310412 - DNA, 19 bp, Homo sapiens
tccagcagtctctgccttg

SEQ ID NO: 5310413 - DNA, 23 bp, Homo sapiens
tccagcagtctctgccttgcctt

SEQ ID NO: 5310414 - DNA, 20 bp, Homo sapiens
tccagcagtctgataaactg

SEQ ID NO: 5310415 - DNA, 15 bp, Homo sapiens
tccagcagtgaatgc

SEQ ID NO: 5310416 - DNA, 16 bp, Homo sapiens
tccagcatcccaagat

SEQ ID NO: 5310417 - DNA, 14 bp, Homo sapiens
tccagcatcccagc

SEQ ID NO: 5310418 - DNA, 20 bp, Homo sapiens
tccagcatcccagcctcaga

SEQ ID NO: 5310419 - DNA, 22 bp, Homo sapiens
tccagcatcgtctcatgtaaaa

SEQ ID NO: 5310420 - DNA, 15 bp, Homo sapiens
tccagcatgaaagat

SEQ ID NO: 5310421 - DNA, 19 bp, Homo sapiens
tccagcatgtgtgtgtctc

SEQ ID NO: 5310422 - DNA, 15 bp, Homo sapiens
tccagcattcccagg

SEQ ID NO: 5310423 - DNA, 17 bp, Homo sapiens
tccagcattcccaggta

SEQ ID NO: 5310424 - DNA, 17 bp, Homo sapiens
tccagcattctcagcca

SEQ ID NO: 5310425 - DNA, 16 bp, Homo sapiens
tccagccaaagcatgc

SEQ ID NO: 5310426 - DNA, 23 bp, Homo sapiens
tccagccaaagcctcctccagcc

SEQ ID NO: 5310427 - DNA, 19 bp, Homo sapiens
tccagccaagagctcttca

SEQ ID NO: 5310428 - DNA, 15 bp, Homo sapiens
tccagccaccaaggc

SEQ ID NO: 5310429 - DNA, 22 bp, Homo sapiens
tccagccaccaaggctgcctgc

SEQ ID NO: 5310430 - DNA, 15 bp, Homo sapiens
tccagccaccaccca

SEQ ID NO: 5310431 - DNA, 22 bp, Homo sapiens
tccagccacctcagtccctctt

SEQ ID NO: 5310432 - DNA, 22 bp, Homo sapiens
tccagccacggagggaggcacc

SEQ ID NO: 5310433 - DNA, 21 bp, Homo sapiens
tccagccacttccccctcttc

SEQ ID NO: 5310434 - DNA, 11 bp, Homo sapiens
tccagccagcg

SEQ ID NO: 5310435 - DNA, 18 bp, Homo sapiens
tccagccagcgcctccct

SEQ ID NO: 5310436 - DNA, 22 bp, Homo sapiens
tccagccagctcctgggcagct

SEQ ID NO: 5310437 - DNA, 14 bp, Homo sapiens
tccagccaggccca

SEQ ID NO: 5310438 - DNA, 21 bp, Homo sapiens
tccagccaggcccaggccagc

SEQ ID NO: 5310439 - DNA, 13 bp, Homo sapiens
tccagccagggct

SEQ ID NO: 5310440 - DNA, 15 bp, Homo sapiens
tccagccagggctgc

SEQ ID NO: 5310441 - DNA, 17 bp, Homo sapiens
tccagccagggtgacag

SEQ ID NO: 5310442 - DNA, 15 bp, Homo sapiens
tccagccatctcatg

SEQ ID NO: 5310443 - DNA, 15 bp, Homo sapiens
tccagccattcctga

SEQ ID NO: 5310444 - DNA, 14 bp, Homo sapiens
tccagccattgtaa

SEQ ID NO: 5310445 - DNA, 14 bp, Homo sapiens
tccagcccaaacct

SEQ ID NO: 5310446 - DNA, 16 bp, Homo sapiens
tccagcccaaacctgg

SEQ ID NO: 5310447 - DNA, 17 bp, Homo sapiens
tccagcccaaacctggg

SEQ ID NO: 5310448 - DNA, 21 bp, Homo sapiens
tccagcccaaacctgggaagg

SEQ ID NO: 5310449 - DNA, 23 bp, Homo sapiens
tccagcccaaacctgggaaggcc

SEQ ID NO: 5310450 - DNA, 14 bp, Homo sapiens
tccagcccacaccc

SEQ ID NO: 5310451 - DNA, 17 bp, Homo sapiens
tccagcccacacccctc

SEQ ID NO: 5310452 - DNA, 17 bp, Homo sapiens
tccagcccacagtgctc

SEQ ID NO: 5310453 - DNA, 20 bp, Homo sapiens
tccagcccacagtgctcagt

SEQ ID NO: 5310454 - DNA, 19 bp, Homo sapiens
tccagcccatgctggctgg

SEQ ID NO: 5310455 - DNA, 22 bp, Homo sapiens
tccagcccatgctggctggggc

SEQ ID NO: 5310456 - DNA, 21 bp, Homo sapiens
tccagccccatagaaaacaat

SEQ ID NO: 5310457 - DNA, 16 bp, Homo sapiens
tccagccccatgtgtg

SEQ ID NO: 5310458 - DNA, 19 bp, Homo sapiens
tccagcccccagtgcgctc

SEQ ID NO: 5310459 - DNA, 21 bp, Homo sapiens
tccagccccccaggctgccca

SEQ ID NO: 5310460 - DNA, 23 bp, Homo sapiens
tccagccccccaggctgcccaga

SEQ ID NO: 5310461 - DNA, 14 bp, Homo sapiens
tccagcccctcctc

SEQ ID NO: 5310462 - DNA, 19 bp, Homo sapiens
tccagcccctcctccctca

SEQ ID NO: 5310463 - DNA, 20 bp, Homo sapiens
tccagcccctcctccctcag

SEQ ID NO: 5310464 - DNA, 21 bp, Homo sapiens
tccagcccctcctccctcaga

SEQ ID NO: 5310465 - DNA, 22 bp, Homo sapiens
tccagcccctcctccctcagac

SEQ ID NO: 5310466 - DNA, 14 bp, Homo sapiens
tccagcccctctgg

SEQ ID NO: 5310467 - DNA, 15 bp, Homo sapiens
tccagcccctctggt

SEQ ID NO: 5310468 - DNA, 16 bp, Homo sapiens
tccagcccctctggtc

SEQ ID NO: 5310469 - DNA, 18 bp, Homo sapiens
tccagcccctctggtcgc

SEQ ID NO: 5310470 - DNA, 18 bp, Homo sapiens
tccagcccctcttggaga

SEQ ID NO: 5310471 - DNA, 13 bp, Homo sapiens
tccagcccctgga

SEQ ID NO: 5310472 - DNA, 21 bp, Homo sapiens
tccagcccctggacccctggg

SEQ ID NO: 5310473 - DNA, 19 bp, Homo sapiens
tccagcccctggatgcagc

SEQ ID NO: 5310474 - DNA, 14 bp, Homo sapiens
tccagcccctgtcc

SEQ ID NO: 5310475 - DNA, 15 bp, Homo sapiens
tccagcccctttcca

SEQ ID NO: 5310476 - DNA, 18 bp, Homo sapiens
tccagcccctttccaaaa

SEQ ID NO: 5310477 - DNA, 16 bp, Homo sapiens
tccagcccctttgcct

SEQ ID NO: 5310478 - DNA, 18 bp, Homo sapiens
tccagcccctttgcctct

SEQ ID NO: 5310479 - DNA, 21 bp, Homo sapiens
tccagcccctttgcctctgtc

SEQ ID NO: 5310480 - DNA, 13 bp, Homo sapiens
tccagcccgggag

SEQ ID NO: 5310481 - DNA, 14 bp, Homo sapiens
tccagcccggggcc

SEQ ID NO: 5310482 - DNA, 22 bp, Homo sapiens
tccagcccggggccagcttggc

SEQ ID NO: 5310483 - DNA, 12 bp, Homo sapiens
tccagccctccg

SEQ ID NO: 5310484 - DNA, 16 bp, Homo sapiens
tccagccctccgccag

SEQ ID NO: 5310485 - DNA, 13 bp, Homo sapiens
tccagccctgccg

SEQ ID NO: 5310486 - DNA, 15 bp, Homo sapiens
tccagccctggctga

SEQ ID NO: 5310487 - DNA, 19 bp, Homo sapiens
tccagccctggctgaagga

SEQ ID NO: 5310488 - DNA, 16 bp, Homo sapiens
tccagccctgggcaca

SEQ ID NO: 5310489 - DNA, 17 bp, Homo sapiens
tccagccctgggcacat

SEQ ID NO: 5310490 - DNA, 13 bp, Homo sapiens
tccagccctggtt

SEQ ID NO: 5310491 - DNA, 20 bp, Homo sapiens
tccagccctggttctggctg

SEQ ID NO: 5310492 - DNA, 14 bp, Homo sapiens
tccagccgaagctg

SEQ ID NO: 5310493 - DNA, 22 bp, Homo sapiens
tccagccgaagctgcaggggca

SEQ ID NO: 5310494 - DNA, 22 bp, Homo sapiens
tccagccgcaaatccatacccc

SEQ ID NO: 5310495 - DNA, 23 bp, Homo sapiens
tccagccgccattgccaccagga

SEQ ID NO: 5310496 - DNA, 16 bp, Homo sapiens
tccagccgccggctgt

SEQ ID NO: 5310497 - DNA, 16 bp, Homo sapiens
tccagccgctggcaac

SEQ ID NO: 5310498 - DNA, 22 bp, Homo sapiens
tccagccgctggcaacaacagc

SEQ ID NO: 5310499 - DNA, 20 bp, Homo sapiens
tccagccgtgtgtgcatgtg

SEQ ID NO: 5310500 - DNA, 14 bp, Homo sapiens
tccagcctcacaga

SEQ ID NO: 5310501 - DNA, 19 bp, Homo sapiens
tccagcctcacagatgctg

SEQ ID NO: 5310502 - DNA, 23 bp, Homo sapiens
tccagcctcacagatgctggcct

SEQ ID NO: 5310503 - DNA, 22 bp, Homo sapiens
tccagcctcagagatctccctt

SEQ ID NO: 5310504 - DNA, 13 bp, Homo sapiens
tccagcctcagcc

SEQ ID NO: 5310505 - DNA, 14 bp, Homo sapiens
tccagcctccaggg

SEQ ID NO: 5310506 - DNA, 17 bp, Homo sapiens
tccagcctccagggcat

SEQ ID NO: 5310507 - DNA, 14 bp, Homo sapiens
tccagcctcccctc

SEQ ID NO: 5310508 - DNA, 16 bp, Homo sapiens
tccagcctcccctccc

SEQ ID NO: 5310509 - DNA, 19 bp, Homo sapiens
tccagcctcccctcccctg

SEQ ID NO: 5310510 - DNA, 13 bp, Homo sapiens
tccagcctccctg

SEQ ID NO: 5310511 - DNA, 23 bp, Homo sapiens
tccagcctccctgtctccagctg

SEQ ID NO: 5310512 - DNA, 14 bp, Homo sapiens
tccagcctcggcct

SEQ ID NO: 5310513 - DNA, 22 bp, Homo sapiens
tccagcctctcccggctgcctg

SEQ ID NO: 5310514 - DNA, 23 bp, Homo sapiens
tccagcctctcccggctgcctgc

SEQ ID NO: 5310515 - DNA, 23 bp, Homo sapiens
tccagcctgacaacagcctgaga

SEQ ID NO: 5310516 - DNA, 13 bp, Homo sapiens
tccagcctgagca

SEQ ID NO: 5310517 - DNA, 21 bp, Homo sapiens
tccagcctgctagtctgccct

SEQ ID NO: 5310518 - DNA, 22 bp, Homo sapiens
tccagcctggaaacctgtctga

SEQ ID NO: 5310519 - DNA, 14 bp, Homo sapiens
tccagcctggaccc

SEQ ID NO: 5310520 - DNA, 21 bp, Homo sapiens
tccagcctggacccccagctt

SEQ ID NO: 5310521 - DNA, 13 bp, Homo sapiens
tccagcctggctc

SEQ ID NO: 5310522 - DNA, 12 bp, Homo sapiens
tccagcctggga

SEQ ID NO: 5310523 - DNA, 14 bp, Homo sapiens
tccagcctgggaca

SEQ ID NO: 5310524 - DNA, 16 bp, Homo sapiens
tccagcctgggacaca

SEQ ID NO: 5310525 - DNA, 15 bp, Homo sapiens
tccagcctgggcaac

SEQ ID NO: 5310526 - DNA, 21 bp, Homo sapiens
tccagggccccaggcccgcgg

SEQ ID NO: 5310527 - DNA, 20 bp, Homo sapiens
tccagggccctgagctcggt

SEQ ID NO: 5310528 - DNA, 20 bp, Homo sapiens
tccagggcctgacaccccct

SEQ ID NO: 5310529 - DNA, 18 bp, Homo sapiens
tccagggcgcaggggagg

SEQ ID NO: 5310530 - DNA, 19 bp, Homo sapiens
tccagggcgcaggggaggg

SEQ ID NO: 5310531 - DNA, 20 bp, Homo sapiens
tccagggcgccagggtgctg

SEQ ID NO: 5310532 - DNA, 23 bp, Homo sapiens
tccagggcgccagggtgctgtcg

SEQ ID NO: 5310533 - DNA, 9 bp, Homo sapiens
tccagggct

SEQ ID NO: 5310534 - DNA, 14 bp, Homo sapiens
tccagggctagtga

SEQ ID NO: 5310535 - DNA, 21 bp, Homo sapiens
tccagggctccaaatctgcct

SEQ ID NO: 5310536 - DNA, 13 bp, Homo sapiens
tccagggctgcca

SEQ ID NO: 5310537 - DNA, 12 bp, Homo sapiens
tccagggctggg

SEQ ID NO: 5310538 - DNA, 18 bp, Homo sapiens
tccagggctggggtgagc

SEQ ID NO: 5310539 - DNA, 18 bp, Homo sapiens
tccaggggaagccagtga

SEQ ID NO: 5310540 - DNA, 19 bp, Homo sapiens
tccaggggagatggggagg

SEQ ID NO: 5310541 - DNA, 14 bp, Homo sapiens
tccaggggagggaa

SEQ ID NO: 5310542 - DNA, 20 bp, Homo sapiens
tccaggggagggaaaagcta

SEQ ID NO: 5310543 - DNA, 17 bp, Homo sapiens
tccaggggatgggaggt

SEQ ID NO: 5310544 - DNA, 23 bp, Homo sapiens
tccaggggccaattttggatgag

SEQ ID NO: 5310545 - DNA, 17 bp, Homo sapiens
tccaggggcccctccag

SEQ ID NO: 5310546 - DNA, 21 bp, Homo sapiens
tccaggggcccttgggacagc

SEQ ID NO: 5310547 - DNA, 13 bp, Homo sapiens
tccaggggcctgc

SEQ ID NO: 5310548 - DNA, 22 bp, Homo sapiens
tccaggggctgcagccccctgc

SEQ ID NO: 5310549 - DNA, 21 bp, Homo sapiens
tccaggggctgcttcctcctg

SEQ ID NO: 5310550 - DNA, 23 bp, Homo sapiens
tccaggggctgcttcctcctgga

SEQ ID NO: 5310551 - DNA, 19 bp, Homo sapiens
tccaggggtcaccttgaga

SEQ ID NO: 5310552 - DNA, 14 bp, Homo sapiens
tccaggggtcctag

SEQ ID NO: 5310553 - DNA, 20 bp, Homo sapiens
tccaggggtgggacaccctg

SEQ ID NO: 5310554 - DNA, 18 bp, Homo sapiens
tccagggtacatgcttta

SEQ ID NO: 5310555 - DNA, 22 bp, Homo sapiens
tccagggtaggcaaggctgccg

SEQ ID NO: 5310556 - DNA, 13 bp, Homo sapiens
tccagggtccagc

SEQ ID NO: 5310557 - DNA, 18 bp, Homo sapiens
tccagggtccagccctcc

SEQ ID NO: 5310558 - DNA, 14 bp, Homo sapiens
tccagggtcccctg

SEQ ID NO: 5310559 - DNA, 16 bp, Homo sapiens
tccagggtcctctctt

SEQ ID NO: 5310560 - DNA, 21 bp, Homo sapiens
tccagggtctaaagagaacaa

SEQ ID NO: 5310561 - DNA, 14 bp, Homo sapiens
tccagggtctgagt

SEQ ID NO: 5310562 - DNA, 19 bp, Homo sapiens
tccagggtgacaaggcctg

SEQ ID NO: 5310563 - DNA, 15 bp, Homo sapiens
tccagggtggcagca

SEQ ID NO: 5310564 - DNA, 21 bp, Homo sapiens
tccagggttctcttgttttga

SEQ ID NO: 5310565 - DNA, 18 bp, Homo sapiens
tccagggtttctctgcag

SEQ ID NO: 5310566 - DNA, 17 bp, Homo sapiens
tccaggtaccttgacct

SEQ ID NO: 5310567 - DNA, 18 bp, Homo sapiens
tccaggtaccttgacctt

SEQ ID NO: 5310568 - DNA, 16 bp, Homo sapiens
tccaggtacgcacaga

SEQ ID NO: 5310569 - DNA, 19 bp, Homo sapiens
tccaggtagagggtgtgta

SEQ ID NO: 5310570 - DNA, 18 bp, Homo sapiens
tccaggtatctccaggat

SEQ ID NO: 5310571 - DNA, 18 bp, Homo sapiens
tccaggtcaacagaatga

SEQ ID NO: 5310572 - DNA, 21 bp, Homo sapiens
tccaggtcaacagaatgaaaa

SEQ ID NO: 5310573 - DNA, 22 bp, Homo sapiens
tccaggtcaacagaatgaaaaa

SEQ ID NO: 5310574 - DNA, 22 bp, Homo sapiens
tccaggtcacaggcatccgctg

SEQ ID NO: 5310575 - DNA, 23 bp, Homo sapiens
tccaggtcacaggcatccgctgc

SEQ ID NO: 5310576 - DNA, 16 bp, Homo sapiens
tccaggtcaccagcct

SEQ ID NO: 5310577 - DNA, 17 bp, Homo sapiens
tccaggtcaccagcctg

SEQ ID NO: 5310578 - DNA, 19 bp, Homo sapiens
tccaggtcaccagcctgac

SEQ ID NO: 5310579 - DNA, 20 bp, Homo sapiens
tccaggtcaccagcctgact

SEQ ID NO: 5310580 - DNA, 14 bp, Homo sapiens
tccaggtcagcctg

SEQ ID NO: 5310581 - DNA, 15 bp, Homo sapiens
tccaggtcagcctgg

SEQ ID NO: 5310582 - DNA, 12 bp, Homo sapiens
tccaggtcagga

SEQ ID NO: 5310583 - DNA, 15 bp, Homo sapiens
tccaggtcatgcagt

SEQ ID NO: 5310584 - DNA, 24 bp, Homo sapiens
tccaggtccaaacccttcaactcc

SEQ ID NO: 5310585 - DNA, 19 bp, Homo sapiens
tccaggtccgtagctcccc

SEQ ID NO: 5310586 - DNA, 15 bp, Homo sapiens
tccaggtcctttcct

SEQ ID NO: 5310587 - DNA, 20 bp, Homo sapiens
tccaggtcggagtgcctgga

SEQ ID NO: 5310588 - DNA, 18 bp, Homo sapiens
tccaggtcgggctcagct

SEQ ID NO: 5310589 - DNA, 19 bp, Homo sapiens
tccaggtctagaaggccag

SEQ ID NO: 5310590 - DNA, 21 bp, Homo sapiens
tccaggtctagaaggccaggc

SEQ ID NO: 5310591 - DNA, 23 bp, Homo sapiens
tccaggtctagaaggccaggcct

SEQ ID NO: 5310592 - DNA, 13 bp, Homo sapiens
tccaggtctgcct

SEQ ID NO: 5310593 - DNA, 19 bp, Homo sapiens
tccaggtgagaacatccat

SEQ ID NO: 5310594 - DNA, 21 bp, Homo sapiens
tccaggtgagtgtgagggcag

SEQ ID NO: 5310595 - DNA, 22 bp, Homo sapiens
tccaggtgagtgtgagggcagc

SEQ ID NO: 5310596 - DNA, 23 bp, Homo sapiens
tccaggtgagtgtgagggcagca

SEQ ID NO: 5310597 - DNA, 22 bp, Homo sapiens
tccaggtgatcccccaaacagc

SEQ ID NO: 5310598 - DNA, 17 bp, Homo sapiens
tccaggtgattctgatc

SEQ ID NO: 5310599 - DNA, 18 bp, Homo sapiens
tccaggtgcacaagctcc

SEQ ID NO: 5310600 - DNA, 13 bp, Homo sapiens
tccaggtgcccag

SEQ ID NO: 5310601 - DNA, 19 bp, Homo sapiens
tccaggtgcctggcccttg

SEQ ID NO: 5310602 - DNA, 21 bp, Homo sapiens
tccaggtgcctggcccttggc

SEQ ID NO: 5310603 - DNA, 12 bp, Homo sapiens
tccaggtgctca

SEQ ID NO: 5310604 - DNA, 15 bp, Homo sapiens
tccaggtggcaggat

SEQ ID NO: 5310605 - DNA, 13 bp, Homo sapiens
tccaggtggtccc

SEQ ID NO: 5310606 - DNA, 18 bp, Homo sapiens
tccaggtggtcccatagg

SEQ ID NO: 5310607 - DNA, 18 bp, Homo sapiens
tccaggtgtgcacagaaa

SEQ ID NO: 5310608 - DNA, 21 bp, Homo sapiens
tccaggtgtgcacagaaaacc

SEQ ID NO: 5310609 - DNA, 22 bp, Homo sapiens
tccaggtgtggaccggccgcag

SEQ ID NO: 5310610 - DNA, 20 bp, Homo sapiens
tccaggttcaacccacagct

SEQ ID NO: 5310611 - DNA, 16 bp, Homo sapiens
tccaggttcagcttgt

SEQ ID NO: 5310612 - DNA, 18 bp, Homo sapiens
tccaggttccctcccaga

SEQ ID NO: 5310613 - DNA, 12 bp, Homo sapiens
tccaggttcctc

SEQ ID NO: 5310614 - DNA, 15 bp, Homo sapiens
tccaggttgatcttg

SEQ ID NO: 5310615 - DNA, 17 bp, Homo sapiens
tccaggttgcctcaaca

SEQ ID NO: 5310616 - DNA, 19 bp, Homo sapiens
tccaggttgcctcaacagc

SEQ ID NO: 5310617 - DNA, 23 bp, Homo sapiens
tccaggttgcctcaacagcagga

SEQ ID NO: 5310618 - DNA, 23 bp, Homo sapiens
tccaggttggttttgctgttgat

SEQ ID NO: 5310619 - DNA, 17 bp, Homo sapiens
tccaggtttaagctgtt

SEQ ID NO: 5310620 - DNA, 13 bp, Homo sapiens
tccaggtttttca

SEQ ID NO: 5310621 - DNA, 17 bp, Homo sapiens
tccaggtttttcaatta

SEQ ID NO: 5310622 - DNA, 21 bp, Homo sapiens
tccaggtttttcaattaaacg

SEQ ID NO: 5310623 - DNA, 24 bp, Homo sapiens
tccaggtttttcaattaaacggat

SEQ ID NO: 5310624 - DNA, 22 bp, Homo sapiens
tccaggtttttctggcattttc

SEQ ID NO: 5310625 - DNA, 16 bp, Homo sapiens
tccagtaaaagttgtg

SEQ ID NO: 5310626 - DNA, 16 bp, Homo sapiens
tccagtaacctcggag

SEQ ID NO: 5310627 - DNA, 15 bp, Homo sapiens
tccagtaactttttt

SEQ ID NO: 5310628 - DNA, 19 bp, Homo sapiens
tccagtaagatcactgttt

SEQ ID NO: 5310629 - DNA, 22 bp, Homo sapiens
tccagtaagatcactgtttaga

SEQ ID NO: 5310630 - DNA, 18 bp, Homo sapiens
tccagtaaggaatgatat

SEQ ID NO: 5310631 - DNA, 13 bp, Homo sapiens
tccagtaaggatt

SEQ ID NO: 5310632 - DNA, 22 bp, Homo sapiens
tccagtaaggatttttatgtac

SEQ ID NO: 5310633 - DNA, 18 bp, Homo sapiens
tccagtaccataatctta

SEQ ID NO: 5310634 - DNA, 17 bp, Homo sapiens
tccagtacctttgtcac

SEQ ID NO: 5310635 - DNA, 15 bp, Homo sapiens
tccagtactggagct

SEQ ID NO: 5310636 - DNA, 14 bp, Homo sapiens
tccagtagctccgc

SEQ ID NO: 5310637 - DNA, 14 bp, Homo sapiens
tccagtaggaaatt

SEQ ID NO: 5310638 - DNA, 16 bp, Homo sapiens
tccagtaggatccagt

SEQ ID NO: 5310639 - DNA, 19 bp, Homo sapiens
tccagtataaattacatgc

SEQ ID NO: 5310640 - DNA, 20 bp, Homo sapiens
tccagtataaattacatgca

SEQ ID NO: 5310641 - DNA, 21 bp, Homo sapiens
tccagtataagactactgaat

SEQ ID NO: 5310642 - DNA, 16 bp, Homo sapiens
tccagtatcctgaaac

SEQ ID NO: 5310643 - DNA, 15 bp, Homo sapiens
tccagtatcctgctg

SEQ ID NO: 5310644 - DNA, 14 bp, Homo sapiens
tccagtatcttgaa

SEQ ID NO: 5310645 - DNA, 15 bp, Homo sapiens
tccagtatcttgaag

SEQ ID NO: 5310646 - DNA, 18 bp, Homo sapiens
tccagtatgacagaggag

SEQ ID NO: 5310647 - DNA, 16 bp, Homo sapiens
tccagtattgaaaact

SEQ ID NO: 5310648 - DNA, 18 bp, Homo sapiens
tccagtattgaaaacttc

SEQ ID NO: 5310649 - DNA, 13 bp, Homo sapiens
tccagtattgctg

SEQ ID NO: 5310650 - DNA, 14 bp, Homo sapiens
tccagtattgctga

SEQ ID NO: 5310651 - DNA, 21 bp, Homo sapiens
tccagtattgtatatgagttt

SEQ ID NO: 5310652 - DNA, 14 bp, Homo sapiens
tccagtattttagt

SEQ ID NO: 5310653 - DNA, 22 bp, Homo sapiens
tccagtcaaagcggatgctggc

SEQ ID NO: 5310654 - DNA, 16 bp, Homo sapiens
tccagtcaaatctggg

SEQ ID NO: 5310655 - DNA, 17 bp, Homo sapiens
tccagtcaaatctgggc

SEQ ID NO: 5310656 - DNA, 22 bp, Homo sapiens
tccagtcaagttccctcctgca

SEQ ID NO: 5310657 - DNA, 20 bp, Homo sapiens
tccagtcaggcctatctaaa

SEQ ID NO: 5310658 - DNA, 16 bp, Homo sapiens
tccagtcatcctgccc

SEQ ID NO: 5310659 - DNA, 23 bp, Homo sapiens
tccagtcatctgtaagagcttgc

SEQ ID NO: 5310660 - DNA, 17 bp, Homo sapiens
tccagtcatggccaaat

SEQ ID NO: 5310661 - DNA, 14 bp, Homo sapiens
tccagtcattatgt

SEQ ID NO: 5310662 - DNA, 15 bp, Homo sapiens
tccagtcattatgtt

SEQ ID NO: 5310663 - DNA, 23 bp, Homo sapiens
tccagtcattatgttaatatttc

SEQ ID NO: 5310664 - DNA, 14 bp, Homo sapiens
tccagtccccagaa

SEQ ID NO: 5310665 - DNA, 21 bp, Homo sapiens
tccagtccccagaactctgcc

SEQ ID NO: 5310666 - DNA, 22 bp, Homo sapiens
tccagtccccagaactctgcct

SEQ ID NO: 5310667 - DNA, 20 bp, Homo sapiens
tccagtcctaactttctgaa

SEQ ID NO: 5310668 - DNA, 18 bp, Homo sapiens
tccagtcctatctgggct

SEQ ID NO: 5310669 - DNA, 12 bp, Homo sapiens
tccagtcctgcc

SEQ ID NO: 5310670 - DNA, 13 bp, Homo sapiens
tccagtcctgctc

SEQ ID NO: 5310671 - DNA, 15 bp, Homo sapiens
tccagtcctgctctc

SEQ ID NO: 5310672 - DNA, 18 bp, Homo sapiens
tccagtcctgctggcctg

SEQ ID NO: 5310673 - DNA, 22 bp, Homo sapiens
tccagtcctgctggcctgctct

SEQ ID NO: 5310674 - DNA, 21 bp, Homo sapiens
tccagtcctttgttgctgttg

SEQ ID NO: 5310675 - DNA, 16 bp, Homo sapiens
tccagtctatcattgt

SEQ ID NO: 5310676 - DNA, 21 bp, Homo sapiens
tccagtctcactgacacagga

SEQ ID NO: 5310677 - DNA, 17 bp, Homo sapiens
tccagtctcatcctccc

SEQ ID NO: 5310678 - DNA, 15 bp, Homo sapiens
tccagtctcctgaca

SEQ ID NO: 5310679 - DNA, 16 bp, Homo sapiens
tccagtctcctgacat

SEQ ID NO: 5310680 - DNA, 17 bp, Homo sapiens
tccagtctcctgacatt

SEQ ID NO: 5310681 - DNA, 17 bp, Homo sapiens
tccagtctgctctcagc

SEQ ID NO: 5310682 - DNA, 21 bp, Homo sapiens
tccagtctgctctcagcttgt

SEQ ID NO: 5310683 - DNA, 13 bp, Homo sapiens
tccagtctgctgc

SEQ ID NO: 5310684 - DNA, 19 bp, Homo sapiens
tccagtctgctgccctcca

SEQ ID NO: 5310685 - DNA, 22 bp, Homo sapiens
tccagtctgctgccctccatcc

SEQ ID NO: 5310686 - DNA, 10 bp, Homo sapiens
tccagtctgt

SEQ ID NO: 5310687 - DNA, 20 bp, Homo sapiens
tccagtctgtgatccttggt

SEQ ID NO: 5310688 - DNA, 13 bp, Homo sapiens
tccagtcttccac

SEQ ID NO: 5310689 - DNA, 15 bp, Homo sapiens
tccagtcttcctgac

SEQ ID NO: 5310690 - DNA, 23 bp, Homo sapiens
tccagtcttcctgacactttaat

SEQ ID NO: 5310691 - DNA, 12 bp, Homo sapiens
tccagtgaaatg

SEQ ID NO: 5310692 - DNA, 15 bp, Homo sapiens
tccagtgaaatgatt

SEQ ID NO: 5310693 - DNA, 15 bp, Homo sapiens
tccagtgaacattcc

SEQ ID NO: 5310694 - DNA, 13 bp, Homo sapiens
tccagtgacatga

SEQ ID NO: 5310695 - DNA, 23 bp, Homo sapiens
tccagtgacatgattctgaactt

SEQ ID NO: 5310696 - DNA, 16 bp, Homo sapiens
tccagtgaccctggag

SEQ ID NO: 5310697 - DNA, 20 bp, Homo sapiens
tccagtgacttgttctgagt

SEQ ID NO: 5310698 - DNA, 12 bp, Homo sapiens
tccagtgacttt

SEQ ID NO: 5310699 - DNA, 14 bp, Homo sapiens
tccagtgagaaatt

SEQ ID NO: 5310700 - DNA, 17 bp, Homo sapiens
tccagtgagcagtgttg

SEQ ID NO: 5310701 - DNA, 15 bp, Homo sapiens
tccagtgaggccaag

SEQ ID NO: 5310702 - DNA, 18 bp, Homo sapiens
tccattctttcttcctcc

SEQ ID NO: 5310703 - DNA, 19 bp, Homo sapiens
tccattctttcttcctcca

SEQ ID NO: 5310704 - DNA, 20 bp, Homo sapiens
tccattgacatgtacagaga

SEQ ID NO: 5310705 - DNA, 16 bp, Homo sapiens
tccattgaccagctct

SEQ ID NO: 5310706 - DNA, 20 bp, Homo sapiens
tccattgaccttaatttctt

SEQ ID NO: 5310707 - DNA, 21 bp, Homo sapiens
tccattgatctgccaaatcgt

SEQ ID NO: 5310708 - DNA, 12 bp, Homo sapiens
tccattgatttt

SEQ ID NO: 5310709 - DNA, 19 bp, Homo sapiens
tccattgctcccagtgcca

SEQ ID NO: 5310710 - DNA, 14 bp, Homo sapiens
tccattgctgttgt

SEQ ID NO: 5310711 - DNA, 15 bp, Homo sapiens
tccattgctgttgtt

SEQ ID NO: 5310712 - DNA, 22 bp, Homo sapiens
tccattgcttattcttgagcac

SEQ ID NO: 5310713 - DNA, 16 bp, Homo sapiens
tccattggatctgcaa

SEQ ID NO: 5310714 - DNA, 19 bp, Homo sapiens
tccattgggactgattttt

SEQ ID NO: 5310715 - DNA, 20 bp, Homo sapiens
tccattgggcacagtccaga

SEQ ID NO: 5310716 - DNA, 22 bp, Homo sapiens
tccattggtccaagattccgga

SEQ ID NO: 5310717 - DNA, 16 bp, Homo sapiens
tccattggttcttcct

SEQ ID NO: 5310718 - DNA, 17 bp, Homo sapiens
tccattggttcttcctt

SEQ ID NO: 5310719 - DNA, 13 bp, Homo sapiens
tccattgtatctt

SEQ ID NO: 5310720 - DNA, 22 bp, Homo sapiens
tccattgtcatgagtccatgag

SEQ ID NO: 5310721 - DNA, 20 bp, Homo sapiens
tccattgtgtgatccagccc

SEQ ID NO: 5310722 - DNA, 11 bp, Homo sapiens
tccattgttgt

SEQ ID NO: 5310723 - DNA, 17 bp, Homo sapiens
tccattgtttaaaaata

SEQ ID NO: 5310724 - DNA, 23 bp, Homo sapiens
tccattgtttaaaaatacacatg

SEQ ID NO: 5310725 - DNA, 13 bp, Homo sapiens
tccattgtttcct

SEQ ID NO: 5310726 - DNA, 16 bp, Homo sapiens
tccatttaagacacat

SEQ ID NO: 5310727 - DNA, 17 bp, Homo sapiens
tccatttaataattata

SEQ ID NO: 5310728 - DNA, 18 bp, Homo sapiens
tccatttaataattatat

SEQ ID NO: 5310729 - DNA, 18 bp, Homo sapiens
tccatttacagtctcttt

SEQ ID NO: 5310730 - DNA, 16 bp, Homo sapiens
tccatttactgacact

SEQ ID NO: 5310731 - DNA, 19 bp, Homo sapiens
tccatttacttaagactta

SEQ ID NO: 5310732 - DNA, 22 bp, Homo sapiens
tccatttacttaagacttaatg

SEQ ID NO: 5310733 - DNA, 17 bp, Homo sapiens
tccatttataaccccag

SEQ ID NO: 5310734 - DNA, 23 bp, Homo sapiens
tccatttataaccccagcctgac

SEQ ID NO: 5310735 - DNA, 14 bp, Homo sapiens
tccatttatatatg

SEQ ID NO: 5310736 - DNA, 18 bp, Homo sapiens
tccatttatcctagaaaa

SEQ ID NO: 5310737 - DNA, 19 bp, Homo sapiens
tccatttatcctagaaaat

SEQ ID NO: 5310738 - DNA, 15 bp, Homo sapiens
tccatttattgtttg

SEQ ID NO: 5310739 - DNA, 15 bp, Homo sapiens
tccatttcaactcca

SEQ ID NO: 5310740 - DNA, 19 bp, Homo sapiens
tccatttcacacaggtcct

SEQ ID NO: 5310741 - DNA, 21 bp, Homo sapiens
tccatttcagtttgtttactt

SEQ ID NO: 5310742 - DNA, 14 bp, Homo sapiens
tccatttcatgtga

SEQ ID NO: 5310743 - DNA, 18 bp, Homo sapiens
tccatttcatgtgatcta

SEQ ID NO: 5310744 - DNA, 17 bp, Homo sapiens
tccatttccaaatgtgg

SEQ ID NO: 5310745 - DNA, 17 bp, Homo sapiens
tccatttcccacatctt

SEQ ID NO: 5310746 - DNA, 18 bp, Homo sapiens
tccatttcccctccttcc

SEQ ID NO: 5310747 - DNA, 14 bp, Homo sapiens
tccatttctaatta

SEQ ID NO: 5310748 - DNA, 14 bp, Homo sapiens
tccatttctactgt

SEQ ID NO: 5310749 - DNA, 12 bp, Homo sapiens
tccatttctctc

SEQ ID NO: 5310750 - DNA, 15 bp, Homo sapiens
tccatttctctccaa

SEQ ID NO: 5310751 - DNA, 11 bp, Homo sapiens
tccatttctga

SEQ ID NO: 5310752 - DNA, 11 bp, Homo sapiens
tccatttctgt

SEQ ID NO: 5310753 - DNA, 17 bp, Homo sapiens
tccatttcttcagaggg

SEQ ID NO: 5310754 - DNA, 16 bp, Homo sapiens
tccatttctttcttcc

SEQ ID NO: 5310755 - DNA, 12 bp, Homo sapiens
tccatttgagaa

SEQ ID NO: 5310756 - DNA, 14 bp, Homo sapiens
tccatttgcctttc

SEQ ID NO: 5310757 - DNA, 18 bp, Homo sapiens
tccatttggacaaaatgg

SEQ ID NO: 5310758 - DNA, 15 bp, Homo sapiens
tccatttggatttta

SEQ ID NO: 5310759 - DNA, 23 bp, Homo sapiens
tccatttggcagaactgctgggg

SEQ ID NO: 5310760 - DNA, 19 bp, Homo sapiens
tccatttggtcctttctcc

SEQ ID NO: 5310761 - DNA, 13 bp, Homo sapiens
tccatttgttcct

SEQ ID NO: 5310762 - DNA, 14 bp, Homo sapiens
tccattttaaaaac

SEQ ID NO: 5310763 - DNA, 13 bp, Homo sapiens
tccattttaacaa

SEQ ID NO: 5310764 - DNA, 21 bp, Homo sapiens
tccattttaacaactgctctt

SEQ ID NO: 5310765 - DNA, 15 bp, Homo sapiens
tccattttacttcca

SEQ ID NO: 5310766 - DNA, 19 bp, Homo sapiens
tccattttaggtgataaaa

SEQ ID NO: 5310767 - DNA, 14 bp, Homo sapiens
tccattttatgcag

SEQ ID NO: 5310768 - DNA, 20 bp, Homo sapiens
tccattttcactaaaagtgt

SEQ ID NO: 5310769 - DNA, 18 bp, Homo sapiens
tccattttcctacaggca

SEQ ID NO: 5310770 - DNA, 11 bp, Homo sapiens
tccattttcta

SEQ ID NO: 5310771 - DNA, 15 bp, Homo sapiens
tccattttcttgtca

SEQ ID NO: 5310772 - DNA, 13 bp, Homo sapiens
tccattttggaaa

SEQ ID NO: 5310773 - DNA, 15 bp, Homo sapiens
tccattttggaaaat

SEQ ID NO: 5310774 - DNA, 22 bp, Homo sapiens
tccattttggcgctattacaaa

SEQ ID NO: 5310775 - DNA, 15 bp, Homo sapiens
tccattttgtgaagc

SEQ ID NO: 5310776 - DNA, 16 bp, Homo sapiens
tccattttgtgaagcc

SEQ ID NO: 5310777 - DNA, 15 bp, Homo sapiens
tccatttttacaagt

SEQ ID NO: 5310778 - DNA, 20 bp, Homo sapiens
tccatttttactaaagcagt

SEQ ID NO: 5310779 - DNA, 16 bp, Homo sapiens
tccatttttcccagga

SEQ ID NO: 5310780 - DNA, 18 bp, Homo sapiens
tccatttttcccaggaca

SEQ ID NO: 5310781 - DNA, 17 bp, Homo sapiens
tccatttttgagtaaaa

SEQ ID NO: 5310782 - DNA, 23 bp, Homo sapiens
tccatttttttctttacttatct

SEQ ID NO: 5310783 - DNA, 16 bp, Homo sapiens
tcccaaaaacagcccc

SEQ ID NO: 5310784 - DNA, 19 bp, Homo sapiens
tcccaaaaaccccagtgtt

SEQ ID NO: 5310785 - DNA, 19 bp, Homo sapiens
tcccaaaacaatctattta

SEQ ID NO: 5310786 - DNA, 16 bp, Homo sapiens
tcccaaaatcccctca

SEQ ID NO: 5310787 - DNA, 17 bp, Homo sapiens
tcccaaaatcccctcag

SEQ ID NO: 5310788 - DNA, 19 bp, Homo sapiens
tcccaaaatcccctcagcc

SEQ ID NO: 5310789 - DNA, 20 bp, Homo sapiens
tcccaaaatgttgaaatatg

SEQ ID NO: 5310790 - DNA, 15 bp, Homo sapiens
tcccaaaattaggga

SEQ ID NO: 5310791 - DNA, 23 bp, Homo sapiens
tcccaaacccagtctcctctcca

SEQ ID NO: 5310792 - DNA, 14 bp, Homo sapiens
tcccaaacccttcg

SEQ ID NO: 5310793 - DNA, 21 bp, Homo sapiens
tcccaaacgcctcccctgccc

SEQ ID NO: 5310794 - DNA, 16 bp, Homo sapiens
tcccaaactttaaaat

SEQ ID NO: 5310795 - DNA, 17 bp, Homo sapiens
tcccaaagaaccccagg

SEQ ID NO: 5310796 - DNA, 23 bp, Homo sapiens
tcccaaagaactacccccttttc

SEQ ID NO: 5310797 - DNA, 21 bp, Homo sapiens
tcccaaagaagttctggtatg

SEQ ID NO: 5310798 - DNA, 15 bp, Homo sapiens
tcccaaagagctgcc

SEQ ID NO: 5310799 - DNA, 21 bp, Homo sapiens
tcccaaagcaagcacctgggt

SEQ ID NO: 5310800 - DNA, 23 bp, Homo sapiens
tcccaaagcaagcacctgggtgt

SEQ ID NO: 5310801 - DNA, 18 bp, Homo sapiens
tcccaaagcacttttaaa

SEQ ID NO: 5310802 - DNA, 21 bp, Homo sapiens
tcccaaagcagtgcatgctgt

SEQ ID NO: 5310803 - DNA, 19 bp, Homo sapiens
tcccaaagccagaaccaga

SEQ ID NO: 5310804 - DNA, 22 bp, Homo sapiens
tcccaaagcggccgatgggagt

SEQ ID NO: 5310805 - DNA, 21 bp, Homo sapiens
tcccaaagggagggtggcaga

SEQ ID NO: 5310806 - DNA, 18 bp, Homo sapiens
tcccaaaggtaagtctga

SEQ ID NO: 5310807 - DNA, 21 bp, Homo sapiens
tcccaaagtccccctcctcag

SEQ ID NO: 5310808 - DNA, 17 bp, Homo sapiens
tcccaaagtcctctgct

SEQ ID NO: 5310809 - DNA, 18 bp, Homo sapiens
tcccaaagtcctctgctc

SEQ ID NO: 5310810 - DNA, 21 bp, Homo sapiens
tcccaaagtcctgggattaca

SEQ ID NO: 5310811 - DNA, 21 bp, Homo sapiens
tcccaaagtgaactctcaaat

SEQ ID NO: 5310812 - DNA, 11 bp, Homo sapiens
tcccaaagtgc

SEQ ID NO: 5310813 - DNA, 19 bp, Homo sapiens
tcccaaagtgccttctgag

SEQ ID NO: 5310814 - DNA, 15 bp, Homo sapiens
tcccaaatcaaaata

SEQ ID NO: 5310815 - DNA, 19 bp, Homo sapiens
tcccaaatcaaaataaaag

SEQ ID NO: 5310816 - DNA, 18 bp, Homo sapiens
tcccaaatccgccagtgt

SEQ ID NO: 5310817 - DNA, 19 bp, Homo sapiens
tcccaaatccgccagtgtt

SEQ ID NO: 5310818 - DNA, 22 bp, Homo sapiens
tcccaaatccgccagtgtttct

SEQ ID NO: 5310819 - DNA, 18 bp, Homo sapiens
tcccaaatcctatttaaa

SEQ ID NO: 5310820 - DNA, 16 bp, Homo sapiens
tcccaaatccttccca

SEQ ID NO: 5310821 - DNA, 14 bp, Homo sapiens
tcccaaatctcaaa

SEQ ID NO: 5310822 - DNA, 23 bp, Homo sapiens
tcccaaatgaaatactgccttgg

SEQ ID NO: 5310823 - DNA, 14 bp, Homo sapiens
tcccaaatgagcca

SEQ ID NO: 5310824 - DNA, 20 bp, Homo sapiens
tcccaaatgtgtgcccagct

SEQ ID NO: 5310825 - DNA, 13 bp, Homo sapiens
tcccaaatttgag

SEQ ID NO: 5310826 - DNA, 19 bp, Homo sapiens
tcccaaatttgattgattt

SEQ ID NO: 5310827 - DNA, 20 bp, Homo sapiens
tcccaaatttgattgatttg

SEQ ID NO: 5310828 - DNA, 19 bp, Homo sapiens
tcccaacaacatccatgtc

SEQ ID NO: 5310829 - DNA, 14 bp, Homo sapiens
tcccaacaagcaag

SEQ ID NO: 5310830 - DNA, 23 bp, Homo sapiens
tcccaacaagtgctctttccacc

SEQ ID NO: 5310831 - DNA, 19 bp, Homo sapiens
tcccaacacaaggtgggca

SEQ ID NO: 5310832 - DNA, 21 bp, Homo sapiens
tcccaacacaaggtgggcagg

SEQ ID NO: 5310833 - DNA, 22 bp, Homo sapiens
tcccaacacatcacttaccact

SEQ ID NO: 5310834 - DNA, 15 bp, Homo sapiens
tcccaacactcttgg

SEQ ID NO: 5310835 - DNA, 18 bp, Homo sapiens
tcccaacagaggcctccc

SEQ ID NO: 5310836 - DNA, 16 bp, Homo sapiens
tcccaacagcccagca

SEQ ID NO: 5310837 - DNA, 23 bp, Homo sapiens
tcccaacagcccagcaagaagga

SEQ ID NO: 5310838 - DNA, 14 bp, Homo sapiens
tcccaacagctcca

SEQ ID NO: 5310839 - DNA, 16 bp, Homo sapiens
tcccaacagtcatgtt

SEQ ID NO: 5310840 - DNA, 21 bp, Homo sapiens
tcccaacatgggagggatcag

SEQ ID NO: 5310841 - DNA, 17 bp, Homo sapiens
tcccaacattctgcaat

SEQ ID NO: 5310842 - DNA, 17 bp, Homo sapiens
tcccaacatttcttaaa

SEQ ID NO: 5310843 - DNA, 16 bp, Homo sapiens
tcccaaccaaccagca

SEQ ID NO: 5310844 - DNA, 15 bp, Homo sapiens
tcccaaccaggcacc

SEQ ID NO: 5310845 - DNA, 15 bp, Homo sapiens
tcccaaccccagggc

SEQ ID NO: 5310846 - DNA, 22 bp, Homo sapiens
tcccaaccccagggcccccaca

SEQ ID NO: 5310847 - DNA, 15 bp, Homo sapiens
tcccaacccccctcc

SEQ ID NO: 5310848 - DNA, 19 bp, Homo sapiens
tcccaacccccctcctgct

SEQ ID NO: 5310849 - DNA, 21 bp, Homo sapiens
tcccaaccccttaagccctgg

SEQ ID NO: 5310850 - DNA, 23 bp, Homo sapiens
tcccaaccctgggctggggagga

SEQ ID NO: 5310851 - DNA, 16 bp, Homo sapiens
tcccaacctcaatgcc

SEQ ID NO: 5310852 - DNA, 22 bp, Homo sapiens
tcccaacctcaatgccctgcca

SEQ ID NO: 5310853 - DNA, 14 bp, Homo sapiens
tcccaacctcccct

SEQ ID NO: 5310854 - DNA, 16 bp, Homo sapiens
tcccaacctcccctgg

SEQ ID NO: 5310855 - DNA, 17 bp, Homo sapiens
tcccaacgagcctcctc

SEQ ID NO: 5310856 - DNA, 17 bp, Homo sapiens
tcccaacgctgaagcgg

SEQ ID NO: 5310857 - DNA, 21 bp, Homo sapiens
tcccaacgtactcctcagacg

SEQ ID NO: 5310858 - DNA, 13 bp, Homo sapiens
tcccaactcaccc

SEQ ID NO: 5310859 - DNA, 16 bp, Homo sapiens
tcccaactcaccccag

SEQ ID NO: 5310860 - DNA, 19 bp, Homo sapiens
tcccaactcaccccagccc

SEQ ID NO: 5310861 - DNA, 17 bp, Homo sapiens
tcccaactcactgtgct

SEQ ID NO: 5310862 - DNA, 19 bp, Homo sapiens
tcccaactcactgtgctcc

SEQ ID NO: 5310863 - DNA, 14 bp, Homo sapiens
tcccaactcagcct

SEQ ID NO: 5310864 - DNA, 17 bp, Homo sapiens
tcccaactcagcctgtt

SEQ ID NO: 5310865 - DNA, 19 bp, Homo sapiens
tcccaactcagcctgttcc

SEQ ID NO: 5310866 - DNA, 20 bp, Homo sapiens
tcccaactcagcctgttcct

SEQ ID NO: 5310867 - DNA, 13 bp, Homo sapiens
tcccaactccctt

SEQ ID NO: 5310868 - DNA, 16 bp, Homo sapiens
tcccaactctagctgg

SEQ ID NO: 5310869 - DNA, 15 bp, Homo sapiens
tcccaactgctgctt

SEQ ID NO: 5310870 - DNA, 22 bp, Homo sapiens
tcccaactttggaaaacataaa

SEQ ID NO: 5310871 - DNA, 20 bp, Homo sapiens
tcccaagaaaggaaaccttt

SEQ ID NO: 5310872 - DNA, 17 bp, Homo sapiens
tcccaagaacagcaggc

SEQ ID NO: 5310873 - DNA, 13 bp, Homo sapiens
tcccaagaatgca

SEQ ID NO: 5310874 - DNA, 20 bp, Homo sapiens
tcccaagaatgcaagatttc

SEQ ID NO: 5310875 - DNA, 12 bp, Homo sapiens
tcccaagacagt

SEQ ID NO: 5310876 - DNA, 22 bp, Homo sapiens
tcccaagagaaggggaagcact

SEQ ID NO: 5310877 - DNA, 16 bp, Homo sapiens
tcccaagagattatgt

SEQ ID NO: 5310878 - DNA, 18 bp, Homo sapiens
tcccaagaggccagggtg

SEQ ID NO: 5310879 - DNA, 12 bp, Homo sapiens
tcccagaatcaa

SEQ ID NO: 5310880 - DNA, 22 bp, Homo sapiens
tcccagaatcaaagcaatgcat

SEQ ID NO: 5310881 - DNA, 14 bp, Homo sapiens
tcccagaatcccag

SEQ ID NO: 5310882 - DNA, 18 bp, Homo sapiens
tcccagaatctctgagcc

SEQ ID NO: 5310883 - DNA, 17 bp, Homo sapiens
tcccagaatgctgggtt

SEQ ID NO: 5310884 - DNA, 17 bp, Homo sapiens
tcccagaatggaaaaaa

SEQ ID NO: 5310885 - DNA, 18 bp, Homo sapiens
tcccagacacccaccctc

SEQ ID NO: 5310886 - DNA, 17 bp, Homo sapiens
tcccagacagctggacc

SEQ ID NO: 5310887 - DNA, 18 bp, Homo sapiens
tcccagacagctggaccc

SEQ ID NO: 5310888 - DNA, 22 bp, Homo sapiens
tcccagacaggccctccctgtc

SEQ ID NO: 5310889 - DNA, 16 bp, Homo sapiens
tcccagacatgctgcc

SEQ ID NO: 5310890 - DNA, 20 bp, Homo sapiens
tcccagacatgctgcccacc

SEQ ID NO: 5310891 - DNA, 19 bp, Homo sapiens
tcccagacattgatgggga

SEQ ID NO: 5310892 - DNA, 20 bp, Homo sapiens
tcccagaccacctccctgcc

SEQ ID NO: 5310893 - DNA, 21 bp, Homo sapiens
tcccagaccagccaagggtcc

SEQ ID NO: 5310894 - DNA, 18 bp, Homo sapiens
tcccagacccagggcagt

SEQ ID NO: 5310895 - DNA, 16 bp, Homo sapiens
tcccagaccccgcagc

SEQ ID NO: 5310896 - DNA, 13 bp, Homo sapiens
tcccagacctagg

SEQ ID NO: 5310897 - DNA, 19 bp, Homo sapiens
tcccagaccttaagacact

SEQ ID NO: 5310898 - DNA, 20 bp, Homo sapiens
tcccagaccttaagacactg

SEQ ID NO: 5310899 - DNA, 23 bp, Homo sapiens
tcccagaccttaagacactgtga

SEQ ID NO: 5310900 - DNA, 16 bp, Homo sapiens
tcccagactctgcctc

SEQ ID NO: 5310901 - DNA, 13 bp, Homo sapiens
tcccagacttgct

SEQ ID NO: 5310902 - DNA, 17 bp, Homo sapiens
tcccagacttgtttcct

SEQ ID NO: 5310903 - DNA, 13 bp, Homo sapiens
tcccagagaacaa

SEQ ID NO: 5310904 - DNA, 19 bp, Homo sapiens
tcccagagaacaatcacta

SEQ ID NO: 5310905 - DNA, 22 bp, Homo sapiens
tcccagagaacaatcactattc

SEQ ID NO: 5310906 - DNA, 20 bp, Homo sapiens
tcccagagacctcatcagcc

SEQ ID NO: 5310907 - DNA, 14 bp, Homo sapiens
tcccagagagacgc

SEQ ID NO: 5310908 - DNA, 14 bp, Homo sapiens
tcccagagagcccg

SEQ ID NO: 5310909 - DNA, 16 bp, Homo sapiens
tcccagagcaaaataa

SEQ ID NO: 5310910 - DNA, 22 bp, Homo sapiens
tcccagagcacaagaaggccag

SEQ ID NO: 5310911 - DNA, 11 bp, Homo sapiens
tcccagagccc

SEQ ID NO: 5310912 - DNA, 12 bp, Homo sapiens
tcccagagccct

SEQ ID NO: 5310913 - DNA, 22 bp, Homo sapiens
tcccagagctcatcccccctgc

SEQ ID NO: 5310914 - DNA, 21 bp, Homo sapiens
tcccagagctggtggacccag

SEQ ID NO: 5310915 - DNA, 19 bp, Homo sapiens
tcccagagcttattggcca

SEQ ID NO: 5310916 - DNA, 21 bp, Homo sapiens
tcccagagcttattggccact

SEQ ID NO: 5310917 - DNA, 14 bp, Homo sapiens
tcccagaggagcag

SEQ ID NO: 5310918 - DNA, 13 bp, Homo sapiens
tcccagaggcaga

SEQ ID NO: 5310919 - DNA, 14 bp, Homo sapiens
tcccagaggccagg

SEQ ID NO: 5310920 - DNA, 15 bp, Homo sapiens
tcccagaggccagga

SEQ ID NO: 5310921 - DNA, 11 bp, Homo sapiens
tcccagaggct

SEQ ID NO: 5310922 - DNA, 23 bp, Homo sapiens
tcccagaggggcctgccacctgg

SEQ ID NO: 5310923 - DNA, 14 bp, Homo sapiens
tcccagaggtccag

SEQ ID NO: 5310924 - DNA, 18 bp, Homo sapiens
tcccagaggtccagccca

SEQ ID NO: 5310925 - DNA, 13 bp, Homo sapiens
tcccagaggtggg

SEQ ID NO: 5310926 - DNA, 23 bp, Homo sapiens
tcccagaggtgggatcctccctc

SEQ ID NO: 5310927 - DNA, 21 bp, Homo sapiens
tcccagaggttatctgcctgg

SEQ ID NO: 5310928 - DNA, 22 bp, Homo sapiens
tcccagaggttatctgcctggc

SEQ ID NO: 5310929 - DNA, 24 bp, Homo sapiens
tcccagaggttatctgcctggcct

SEQ ID NO: 5310930 - DNA, 17 bp, Homo sapiens
tcccagagtcagaggag

SEQ ID NO: 5310931 - DNA, 19 bp, Homo sapiens
tcccagagtcagaggagaa

SEQ ID NO: 5310932 - DNA, 22 bp, Homo sapiens
tcccagagtcagaggagaagag

SEQ ID NO: 5310933 - DNA, 15 bp, Homo sapiens
tcccagagtcctctg

SEQ ID NO: 5310934 - DNA, 16 bp, Homo sapiens
tcccagagtgctagga

SEQ ID NO: 5310935 - DNA, 17 bp, Homo sapiens
tcccagagttatttccc

SEQ ID NO: 5310936 - DNA, 12 bp, Homo sapiens
tcccagagtttg

SEQ ID NO: 5310937 - DNA, 16 bp, Homo sapiens
tcccagataatgtgaa

SEQ ID NO: 5310938 - DNA, 16 bp, Homo sapiens
tcccagatacttgggg

SEQ ID NO: 5310939 - DNA, 15 bp, Homo sapiens
tcccagatagaatgt

SEQ ID NO: 5310940 - DNA, 16 bp, Homo sapiens
tcccagatagtcccag

SEQ ID NO: 5310941 - DNA, 18 bp, Homo sapiens
tcccagatcaagcctgcc

SEQ ID NO: 5310942 - DNA, 19 bp, Homo sapiens
tcccagatcctctgctgac

SEQ ID NO: 5310943 - DNA, 14 bp, Homo sapiens
tcccagatgctggg

SEQ ID NO: 5310944 - DNA, 15 bp, Homo sapiens
tcccagatgctgggg

SEQ ID NO: 5310945 - DNA, 18 bp, Homo sapiens
tcccagattactccttcc

SEQ ID NO: 5310946 - DNA, 20 bp, Homo sapiens
tcccagcaaagttttcagat

SEQ ID NO: 5310947 - DNA, 22 bp, Homo sapiens
tcccagcaagacctcatctgtg

SEQ ID NO: 5310948 - DNA, 12 bp, Homo sapiens
tcccagcaattt

SEQ ID NO: 5310949 - DNA, 23 bp, Homo sapiens
tcccagcaatttggaggctgagg

SEQ ID NO: 5310950 - DNA, 13 bp, Homo sapiens
tcccagcacaggc

SEQ ID NO: 5310951 - DNA, 15 bp, Homo sapiens
tcccagcaccacacc

SEQ ID NO: 5310952 - DNA, 12 bp, Homo sapiens
tcccagcacctg

SEQ ID NO: 5310953 - DNA, 14 bp, Homo sapiens
tcccagcacctgcc

SEQ ID NO: 5310954 - DNA, 17 bp, Homo sapiens
tcccagcacctgccagg

SEQ ID NO: 5310955 - DNA, 18 bp, Homo sapiens
tcccagcacctgccaggg

SEQ ID NO: 5310956 - DNA, 20 bp, Homo sapiens
tcccagcacctgccagggcc

SEQ ID NO: 5310957 - DNA, 16 bp, Homo sapiens
tcccagcacctggcac

SEQ ID NO: 5310958 - DNA, 16 bp, Homo sapiens
tcccagcactcccctt

SEQ ID NO: 5310959 - DNA, 18 bp, Homo sapiens
tcccagcactccccttgc

SEQ ID NO: 5310960 - DNA, 21 bp, Homo sapiens
tcccagcactccccttgcctt

SEQ ID NO: 5310961 - DNA, 22 bp, Homo sapiens
tcccagcactccccttgccttc

SEQ ID NO: 5310962 - DNA, 16 bp, Homo sapiens
tcccagcactgcctcc

SEQ ID NO: 5310963 - DNA, 18 bp, Homo sapiens
tcccagcactgcctcctg

SEQ ID NO: 5310964 - DNA, 21 bp, Homo sapiens
tcccagcactgcctcctgttt

SEQ ID NO: 5310965 - DNA, 13 bp, Homo sapiens
tcccagcactttg

SEQ ID NO: 5310966 - DNA, 22 bp, Homo sapiens
tcccagcactttgagaggctga

SEQ ID NO: 5310967 - DNA, 16 bp, Homo sapiens
tcccagcactttggga

SEQ ID NO: 5310968 - DNA, 18 bp, Homo sapiens
tcccagcactttgggagg

SEQ ID NO: 5310969 - DNA, 21 bp, Homo sapiens
tcccagcactttgggaggcct

SEQ ID NO: 5310970 - DNA, 16 bp, Homo sapiens
tcccagcagagcccac

SEQ ID NO: 5310971 - DNA, 18 bp, Homo sapiens
tcccagcagagcccacca

SEQ ID NO: 5310972 - DNA, 14 bp, Homo sapiens
tcccagcagcagag

SEQ ID NO: 5310973 - DNA, 13 bp, Homo sapiens
tcccagcagccag

SEQ ID NO: 5310974 - DNA, 23 bp, Homo sapiens
tcccagcagctcaacctaccctg

SEQ ID NO: 5310975 - DNA, 21 bp, Homo sapiens
tcccagcagctgggccggcca

SEQ ID NO: 5310976 - DNA, 23 bp, Homo sapiens
tcccagcagctgggccggccagc

SEQ ID NO: 5310977 - DNA, 18 bp, Homo sapiens
tcccagcatccctggagc

SEQ ID NO: 5310978 - DNA, 21 bp, Homo sapiens
tcccagcatccctggagcagg

SEQ ID NO: 5310979 - DNA, 16 bp, Homo sapiens
tcccagcatctcagag

SEQ ID NO: 5310980 - DNA, 22 bp, Homo sapiens
tcccagcatctcagagtccagt

SEQ ID NO: 5310981 - DNA, 22 bp, Homo sapiens
tcccagcattgctactgctcag

SEQ ID NO: 5310982 - DNA, 15 bp, Homo sapiens
tcccagcatttgtcc

SEQ ID NO: 5310983 - DNA, 15 bp, Homo sapiens
tcccagccaccacca

SEQ ID NO: 5310984 - DNA, 12 bp, Homo sapiens
tcccagccaccc

SEQ ID NO: 5310985 - DNA, 13 bp, Homo sapiens
tcccagccacccc

SEQ ID NO: 5310986 - DNA, 14 bp, Homo sapiens
tcccagccaggccc

SEQ ID NO: 5310987 - DNA, 16 bp, Homo sapiens
tcccagccatgcccag

SEQ ID NO: 5310988 - DNA, 18 bp, Homo sapiens
tcccagccatgcccagga

SEQ ID NO: 5310989 - DNA, 19 bp, Homo sapiens
tcccagccatgcccaggac

SEQ ID NO: 5310990 - DNA, 12 bp, Homo sapiens
tcccagccccag

SEQ ID NO: 5310991 - DNA, 21 bp, Homo sapiens
tcccagcccccaaccccaaga

SEQ ID NO: 5310992 - DNA, 15 bp, Homo sapiens
tcccagccccctgac

SEQ ID NO: 5310993 - DNA, 17 bp, Homo sapiens
tcccagccccctgacca

SEQ ID NO: 5310994 - DNA, 14 bp, Homo sapiens
tcccagcccctacc

SEQ ID NO: 5310995 - DNA, 19 bp, Homo sapiens
tcccagcccctcctccctc

SEQ ID NO: 5310996 - DNA, 23 bp, Homo sapiens
tcccagcccctcctccctcaggc

SEQ ID NO: 5310997 - DNA, 14 bp, Homo sapiens
tcccagcccctggt

SEQ ID NO: 5310998 - DNA, 18 bp, Homo sapiens
tcccagccctatggatgt

SEQ ID NO: 5310999 - DNA, 16 bp, Homo sapiens
tcccagccctcatccc

SEQ ID NO: 5311000 - DNA, 18 bp, Homo sapiens
tcccagccctcatcccac

SEQ ID NO: 5311001 - DNA, 16 bp, Homo sapiens
tcccagccctgagggg

SEQ ID NO: 5311002 - DNA, 19 bp, Homo sapiens
tcccagccctgaggggtgg

SEQ ID NO: 5311003 - DNA, 16 bp, Homo sapiens
tcccagccctgcccag

SEQ ID NO: 5311004 - DNA, 17 bp, Homo sapiens
tcccagccctgcccaga

SEQ ID NO: 5311005 - DNA, 18 bp, Homo sapiens
tcccagccctgcccagag

SEQ ID NO: 5311006 - DNA, 13 bp, Homo sapiens
tcccagccggcca

SEQ ID NO: 5311007 - DNA, 23 bp, Homo sapiens
tcccagccggccaatggaaacct

SEQ ID NO: 5311008 - DNA, 21 bp, Homo sapiens
tcccagcctacccctcctgcg

SEQ ID NO: 5311009 - DNA, 22 bp, Homo sapiens
tcccagcctctggggcagagct

SEQ ID NO: 5311010 - DNA, 12 bp, Homo sapiens
tcccagcctgct

SEQ ID NO: 5311011 - DNA, 16 bp, Homo sapiens
tcccagcctgctgaga

SEQ ID NO: 5311012 - DNA, 11 bp, Homo sapiens
tcccagcctgg

SEQ ID NO: 5311013 - DNA, 16 bp, Homo sapiens
tcccagcctgggctcc

SEQ ID NO: 5311014 - DNA, 20 bp, Homo sapiens
tcccagcctgggctcctctg

SEQ ID NO: 5311015 - DNA, 22 bp, Homo sapiens
tcccagcctggggctccctctc

SEQ ID NO: 5311016 - DNA, 15 bp, Homo sapiens
tcccagcctgggggc

SEQ ID NO: 5311017 - DNA, 18 bp, Homo sapiens
tcccagcctgggggccag

SEQ ID NO: 5311018 - DNA, 18 bp, Homo sapiens
tcccagccttgagatgct

SEQ ID NO: 5311019 - DNA, 14 bp, Homo sapiens
tcccagccttggca

SEQ ID NO: 5311020 - DNA, 21 bp, Homo sapiens
tcccagccttggcatctagag

SEQ ID NO: 5311021 - DNA, 17 bp, Homo sapiens
tcccagcgagccacagg

SEQ ID NO: 5311022 - DNA, 15 bp, Homo sapiens
tcccagcgctctggg

SEQ ID NO: 5311023 - DNA, 17 bp, Homo sapiens
tcccagcggcctcaggg

SEQ ID NO: 5311024 - DNA, 21 bp, Homo sapiens
tcccagcggctggtgcagggc

SEQ ID NO: 5311025 - DNA, 20 bp, Homo sapiens
tcccagcgtgtgtatccgac

SEQ ID NO: 5311026 - DNA, 24 bp, Homo sapiens
tcccagcgtttagtttctagaggc

SEQ ID NO: 5311027 - DNA, 14 bp, Homo sapiens
tcccagctacaggg

SEQ ID NO: 5311028 - DNA, 20 bp, Homo sapiens
tcccagctaccaagtcagac

SEQ ID NO: 5311029 - DNA, 16 bp, Homo sapiens
tcccagctacccagga

SEQ ID NO: 5311030 - DNA, 17 bp, Homo sapiens
tcccagctacccaggag

SEQ ID NO: 5311031 - DNA, 20 bp, Homo sapiens
tcccagctacccaggaggct

SEQ ID NO: 5311032 - DNA, 22 bp, Homo sapiens
tcccagctactagggaggctga

SEQ ID NO: 5311033 - DNA, 19 bp, Homo sapiens
tcccagctactcagaagcc

SEQ ID NO: 5311034 - DNA, 22 bp, Homo sapiens
tcccagctactcaggaggctga

SEQ ID NO: 5311035 - DNA, 23 bp, Homo sapiens
tcccagctactcaggaggctgag

SEQ ID NO: 5311036 - DNA, 22 bp, Homo sapiens
tcccagctactggggaggctga

SEQ ID NO: 5311037 - DNA, 16 bp, Homo sapiens
tcccagctaggaagag

SEQ ID NO: 5311038 - DNA, 20 bp, Homo sapiens
tcccagctaggaagagcagg

SEQ ID NO: 5311039 - DNA, 23 bp, Homo sapiens
tcccagctaggaagagcaggact

SEQ ID NO: 5311040 - DNA, 10 bp, Homo sapiens
tcccagctca

SEQ ID NO: 5311041 - DNA, 19 bp, Homo sapiens
tcccagctcagtgccaaag

SEQ ID NO: 5311042 - DNA, 15 bp, Homo sapiens
tcccagctccacccc

SEQ ID NO: 5311043 - DNA, 16 bp, Homo sapiens
tcccagctccccccgc

SEQ ID NO: 5311044 - DNA, 21 bp, Homo sapiens
tcccagctccccccgcccacc

SEQ ID NO: 5311045 - DNA, 13 bp, Homo sapiens
tcccagctcccct

SEQ ID NO: 5311046 - DNA, 19 bp, Homo sapiens
tcccagctcccctcttttg

SEQ ID NO: 5311047 - DNA, 15 bp, Homo sapiens
tcccagctcctttct

SEQ ID NO: 5311048 - DNA, 20 bp, Homo sapiens
tcccagctctacattctgct

SEQ ID NO: 5311049 - DNA, 22 bp, Homo sapiens
tcccagctctacattctgctct

SEQ ID NO: 5311050 - DNA, 17 bp, Homo sapiens
tcccagctctaccctgc

SEQ ID NO: 5311051 - DNA, 21 bp, Homo sapiens
tcccagctctagacaaccctg

SEQ ID NO: 5311052 - DNA, 22 bp, Homo sapiens
tcccagctctagcctctggact

SEQ ID NO: 5311053 - DNA, 17 bp, Homo sapiens
tcccagctgacagtcct

SEQ ID NO: 5311054 - DNA, 22 bp, Homo sapiens
tcccagctgacagtcctctcca

SEQ ID NO: 5311055 - DNA, 10 bp, Homo sapiens
tcccagctgc

SEQ ID NO: 5311056 - DNA, 23 bp, Homo sapiens
tccccagcgattccctctcccag

SEQ ID NO: 5311057 - DNA, 19 bp, Homo sapiens
tccccagcggtttccactt

SEQ ID NO: 5311058 - DNA, 20 bp, Homo sapiens
tccccagcggtttccacttg

SEQ ID NO: 5311059 - DNA, 20 bp, Homo sapiens
tccccagctcagagccccgc

SEQ ID NO: 5311060 - DNA, 17 bp, Homo sapiens
tccccagctccccagga

SEQ ID NO: 5311061 - DNA, 21 bp, Homo sapiens
tccccagctccccaggactca

SEQ ID NO: 5311062 - DNA, 18 bp, Homo sapiens
tccccagctcccccaggc

SEQ ID NO: 5311063 - DNA, 20 bp, Homo sapiens
tccccagctcccccaggcag

SEQ ID NO: 5311064 - DNA, 14 bp, Homo sapiens
tccccagctctcag

SEQ ID NO: 5311065 - DNA, 17 bp, Homo sapiens
tccccagctgattagtg

SEQ ID NO: 5311066 - DNA, 15 bp, Homo sapiens
tccccagctggtggc

SEQ ID NO: 5311067 - DNA, 20 bp, Homo sapiens
tccccagctggtggccctgt

SEQ ID NO: 5311068 - DNA, 14 bp, Homo sapiens
tccccagctgttta

SEQ ID NO: 5311069 - DNA, 20 bp, Homo sapiens
tccccaggaagcccactgcc

SEQ ID NO: 5311070 - DNA, 12 bp, Homo sapiens
tccccaggaccc

SEQ ID NO: 5311071 - DNA, 17 bp, Homo sapiens
tccccaggactcaccct

SEQ ID NO: 5311072 - DNA, 23 bp, Homo sapiens
tccccaggactcaccctcatacc

SEQ ID NO: 5311073 - DNA, 11 bp, Homo sapiens
tccccaggagg

SEQ ID NO: 5311074 - DNA, 19 bp, Homo sapiens
tccccaggatggactcttc

SEQ ID NO: 5311075 - DNA, 12 bp, Homo sapiens
tccccaggccca

SEQ ID NO: 5311076 - DNA, 15 bp, Homo sapiens
tccccaggcccacca

SEQ ID NO: 5311077 - DNA, 14 bp, Homo sapiens
tccccaggcccagc

SEQ ID NO: 5311078 - DNA, 16 bp, Homo sapiens
tccccaggcccagccc

SEQ ID NO: 5311079 - DNA, 21 bp, Homo sapiens
tccccaggccgtggctgccca

SEQ ID NO: 5311080 - DNA, 16 bp, Homo sapiens
tccccaggcctccagc

SEQ ID NO: 5311081 - DNA, 19 bp, Homo sapiens
tccccaggcctccagcctc

SEQ ID NO: 5311082 - DNA, 20 bp, Homo sapiens
tccccaggcctccagcctct

SEQ ID NO: 5311083 - DNA, 21 bp, Homo sapiens
tccccaggcctccagcctctc

SEQ ID NO: 5311084 - DNA, 14 bp, Homo sapiens
tccccaggcctggc

SEQ ID NO: 5311085 - DNA, 17 bp, Homo sapiens
tccccaggcctggctcc

SEQ ID NO: 5311086 - DNA, 18 bp, Homo sapiens
tccccaggcctggctccc

SEQ ID NO: 5311087 - DNA, 16 bp, Homo sapiens
tccccaggctgcccac

SEQ ID NO: 5311088 - DNA, 20 bp, Homo sapiens
tccccaggctggagaccccc

SEQ ID NO: 5311089 - DNA, 23 bp, Homo sapiens
tccccagggaagcagcagcctcg

SEQ ID NO: 5311090 - DNA, 14 bp, Homo sapiens
tccccagggcagcc

SEQ ID NO: 5311091 - DNA, 16 bp, Homo sapiens
tccccagggcagcctc

SEQ ID NO: 5311092 - DNA, 11 bp, Homo sapiens
tccccagggcc

SEQ ID NO: 5311093 - DNA, 14 bp, Homo sapiens
tccccagggcccct

SEQ ID NO: 5311094 - DNA, 22 bp, Homo sapiens
tccccagggcccctccctctgc

SEQ ID NO: 5311095 - DNA, 13 bp, Homo sapiens
tccccagggctcc

SEQ ID NO: 5311096 - DNA, 16 bp, Homo sapiens
tccccagggctccctt

SEQ ID NO: 5311097 - DNA, 14 bp, Homo sapiens
tccccaggggagag

SEQ ID NO: 5311098 - DNA, 20 bp, Homo sapiens
tccccaggggcatgactgtc

SEQ ID NO: 5311099 - DNA, 22 bp, Homo sapiens
tccccaggggtcccagccaccc

SEQ ID NO: 5311100 - DNA, 17 bp, Homo sapiens
tccccaggtccagctct

SEQ ID NO: 5311101 - DNA, 15 bp, Homo sapiens
tccccaggtccccaa

SEQ ID NO: 5311102 - DNA, 19 bp, Homo sapiens
tccccaggtccccaaactt

SEQ ID NO: 5311103 - DNA, 18 bp, Homo sapiens
tccccaggtcctgtctct

SEQ ID NO: 5311104 - DNA, 21 bp, Homo sapiens
tccccaggtctctccactgct

SEQ ID NO: 5311105 - DNA, 15 bp, Homo sapiens
tccccaggtggctga

SEQ ID NO: 5311106 - DNA, 22 bp, Homo sapiens
tccccaggtggctgacccagtc

SEQ ID NO: 5311107 - DNA, 17 bp, Homo sapiens
tccccaggtgtgtgctt

SEQ ID NO: 5311108 - DNA, 14 bp, Homo sapiens
tccccagtaaaatt

SEQ ID NO: 5311109 - DNA, 20 bp, Homo sapiens
tccccagtagagaaacattt

SEQ ID NO: 5311110 - DNA, 20 bp, Homo sapiens
tccccagtagctgggattac

SEQ ID NO: 5311111 - DNA, 16 bp, Homo sapiens
tccccagtcccaatgc

SEQ ID NO: 5311112 - DNA, 16 bp, Homo sapiens
tccccagtccccagcc

SEQ ID NO: 5311113 - DNA, 18 bp, Homo sapiens
tccccagtgactccaggg

SEQ ID NO: 5311114 - DNA, 11 bp, Homo sapiens
tccccagtgcc

SEQ ID NO: 5311115 - DNA, 14 bp, Homo sapiens
tccccagtgcccgg

SEQ ID NO: 5311116 - DNA, 14 bp, Homo sapiens
tccccagtgcctgc

SEQ ID NO: 5311117 - DNA, 18 bp, Homo sapiens
tccccagtgcctgccact

SEQ ID NO: 5311118 - DNA, 22 bp, Homo sapiens
tccccagtgcctgccactctct

SEQ ID NO: 5311119 - DNA, 17 bp, Homo sapiens
tccccagtgctcctgtg

SEQ ID NO: 5311120 - DNA, 16 bp, Homo sapiens
tccccagtgtttttgc

SEQ ID NO: 5311121 - DNA, 16 bp, Homo sapiens
tccccagttccacagc

SEQ ID NO: 5311122 - DNA, 16 bp, Homo sapiens
tccccagttgccgtct

SEQ ID NO: 5311123 - DNA, 22 bp, Homo sapiens
tccccataagacaaacactgcc

SEQ ID NO: 5311124 - DNA, 15 bp, Homo sapiens
tccccatacacacac

SEQ ID NO: 5311125 - DNA, 21 bp, Homo sapiens
tccccatacacacacaaacca

SEQ ID NO: 5311126 - DNA, 15 bp, Homo sapiens
tccccatactctgtc

SEQ ID NO: 5311127 - DNA, 17 bp, Homo sapiens
tccccatacttcctggg

SEQ ID NO: 5311128 - DNA, 20 bp, Homo sapiens
tccccatagcaaagggtctg

SEQ ID NO: 5311129 - DNA, 16 bp, Homo sapiens
tccccatatataaatt

SEQ ID NO: 5311130 - DNA, 15 bp, Homo sapiens
tccccatatttgtgt

SEQ ID NO: 5311131 - DNA, 17 bp, Homo sapiens
tccccatatttgtgttc

SEQ ID NO: 5311132 - DNA, 21 bp, Homo sapiens
tccccatatttgtgttcagtt

SEQ ID NO: 5311133 - DNA, 16 bp, Homo sapiens
tccccatcaggtagct

SEQ ID NO: 5311134 - DNA, 15 bp, Homo sapiens
tccccatccccacca

SEQ ID NO: 5311135 - DNA, 19 bp, Homo sapiens
tccccatccctgtcatttt

SEQ ID NO: 5311136 - DNA, 16 bp, Homo sapiens
tccccatcctccagct

SEQ ID NO: 5311137 - DNA, 18 bp, Homo sapiens
tccccatcctccagcttc

SEQ ID NO: 5311138 - DNA, 18 bp, Homo sapiens
tccccatcgccttctggc

SEQ ID NO: 5311139 - DNA, 15 bp, Homo sapiens
tccccatcggccctg

SEQ ID NO: 5311140 - DNA, 21 bp, Homo sapiens
tccccatcggccctgtcccct

SEQ ID NO: 5311141 - DNA, 14 bp, Homo sapiens
tccccatctcaggc

SEQ ID NO: 5311142 - DNA, 14 bp, Homo sapiens
tccccatctccctg

SEQ ID NO: 5311143 - DNA, 15 bp, Homo sapiens
tccccatctccctgc

SEQ ID NO: 5311144 - DNA, 22 bp, Homo sapiens
tccccatctccctgcctggccc

SEQ ID NO: 5311145 - DNA, 13 bp, Homo sapiens
tccccatctctgt

SEQ ID NO: 5311146 - DNA, 15 bp, Homo sapiens
tccccatctctgtct

SEQ ID NO: 5311147 - DNA, 16 bp, Homo sapiens
tccccatctctgtctg

SEQ ID NO: 5311148 - DNA, 18 bp, Homo sapiens
tccccatctctgtctggg

SEQ ID NO: 5311149 - DNA, 16 bp, Homo sapiens
tccccatctgccacag

SEQ ID NO: 5311150 - DNA, 19 bp, Homo sapiens
tccccatctgccacaggcc

SEQ ID NO: 5311151 - DNA, 17 bp, Homo sapiens
tccccatctgtccagct

SEQ ID NO: 5311152 - DNA, 18 bp, Homo sapiens
tccccatctgtgttctaa

SEQ ID NO: 5311153 - DNA, 14 bp, Homo sapiens
tccccatcttctaa

SEQ ID NO: 5311154 - DNA, 16 bp, Homo sapiens
tccccatgaaccctgc

SEQ ID NO: 5311155 - DNA, 23 bp, Homo sapiens
tccccatgaaccctgccctgctc

SEQ ID NO: 5311156 - DNA, 20 bp, Homo sapiens
tccccatgattccctcctcg

SEQ ID NO: 5311157 - DNA, 16 bp, Homo sapiens
tccccatgcagacatg

SEQ ID NO: 5311158 - DNA, 20 bp, Homo sapiens
tccccatgcctgtggctgcg

SEQ ID NO: 5311159 - DNA, 17 bp, Homo sapiens
tccccatgctcagctca

SEQ ID NO: 5311160 - DNA, 21 bp, Homo sapiens
tccccatgcttaacatacccg

SEQ ID NO: 5311161 - DNA, 20 bp, Homo sapiens
tccccatggctcctcaccac

SEQ ID NO: 5311162 - DNA, 19 bp, Homo sapiens
tccccatgggcacagtggt

SEQ ID NO: 5311163 - DNA, 24 bp, Homo sapiens
tccccatgggcacagtggtgaccc

SEQ ID NO: 5311164 - DNA, 19 bp, Homo sapiens
tccccattagagtcagcct

SEQ ID NO: 5311165 - DNA, 16 bp, Homo sapiens
tccccattcagacact

SEQ ID NO: 5311166 - DNA, 16 bp, Homo sapiens
tccccattcagtgaca

SEQ ID NO: 5311167 - DNA, 14 bp, Homo sapiens
tccccattcctacc

SEQ ID NO: 5311168 - DNA, 16 bp, Homo sapiens
tccccattctctgcct

SEQ ID NO: 5311169 - DNA, 17 bp, Homo sapiens
tccccattcttcctagt

SEQ ID NO: 5311170 - DNA, 18 bp, Homo sapiens
tccccattgcctcctcct

SEQ ID NO: 5311171 - DNA, 18 bp, Homo sapiens
tccccattgccttctggg

SEQ ID NO: 5311172 - DNA, 19 bp, Homo sapiens
tccccattgccttctgggg

SEQ ID NO: 5311173 - DNA, 16 bp, Homo sapiens
tccccatttccactgt

SEQ ID NO: 5311174 - DNA, 22 bp, Homo sapiens
tccccatttcctcttccttctc

SEQ ID NO: 5311175 - DNA, 15 bp, Homo sapiens
tccccatttctgcct

SEQ ID NO: 5311176 - DNA, 19 bp, Homo sapiens
tcccccaaacagcatgtgc

SEQ ID NO: 5311177 - DNA, 19 bp, Homo sapiens
tcccccaaaccctgcttct

SEQ ID NO: 5311178 - DNA, 18 bp, Homo sapiens
tcccccaaactttttgtt

SEQ ID NO: 5311179 - DNA, 22 bp, Homo sapiens
tcccccaacaccccgcctgcct

SEQ ID NO: 5311180 - DNA, 15 bp, Homo sapiens
tcccccaaccaagga

SEQ ID NO: 5311181 - DNA, 23 bp, Homo sapiens
tcccccaaccaaggaaggagccc

SEQ ID NO: 5311182 - DNA, 15 bp, Homo sapiens
tcccccaaccccagc

SEQ ID NO: 5311183 - DNA, 17 bp, Homo sapiens
tcccccaacccccaccc

SEQ ID NO: 5311184 - DNA, 16 bp, Homo sapiens
tcccccaaccccctgc

SEQ ID NO: 5311185 - DNA, 17 bp, Homo sapiens
tcccccaaccccctgca

SEQ ID NO: 5311186 - DNA, 14 bp, Homo sapiens
tcccccaactcagg

SEQ ID NO: 5311187 - DNA, 15 bp, Homo sapiens
tcccccaactcagga

SEQ ID NO: 5311188 - DNA, 12 bp, Homo sapiens
tcccccaactct

SEQ ID NO: 5311189 - DNA, 20 bp, Homo sapiens
tcccccaagcagaagaccag

SEQ ID NO: 5311190 - DNA, 19 bp, Homo sapiens
tcccccacagtttgatgtc

SEQ ID NO: 5311191 - DNA, 17 bp, Homo sapiens
tcccccaccactcaggc

SEQ ID NO: 5311192 - DNA, 17 bp, Homo sapiens
tcccccaccagctgcag

SEQ ID NO: 5311193 - DNA, 17 bp, Homo sapiens
tcccccaccattccaca

SEQ ID NO: 5311194 - DNA, 20 bp, Homo sapiens
tcccccacccacctctctgg

SEQ ID NO: 5311195 - DNA, 16 bp, Homo sapiens
tcccccaccccagagt

SEQ ID NO: 5311196 - DNA, 19 bp, Homo sapiens
tcccccaccccatttctct

SEQ ID NO: 5311197 - DNA, 18 bp, Homo sapiens
tcccccaccccctcccca

SEQ ID NO: 5311198 - DNA, 21 bp, Homo sapiens
tcccccaccccctccccaggg

SEQ ID NO: 5311199 - DNA, 15 bp, Homo sapiens
tcccccacccctcca

SEQ ID NO: 5311200 - DNA, 18 bp, Homo sapiens
tcccccacccctccacgt

SEQ ID NO: 5311201 - DNA, 22 bp, Homo sapiens
tcccccaccctactccctccaa

SEQ ID NO: 5311202 - DNA, 12 bp, Homo sapiens
tcccccaccctc

SEQ ID NO: 5311203 - DNA, 13 bp, Homo sapiens
tcccccaccctcc

SEQ ID NO: 5311204 - DNA, 17 bp, Homo sapiens
tcccccaccctccatgc

SEQ ID NO: 5311205 - DNA, 13 bp, Homo sapiens
tcccccaccctgg

SEQ ID NO: 5311206 - DNA, 14 bp, Homo sapiens
tcccccaccgccca

SEQ ID NO: 5311207 - DNA, 15 bp, Homo sapiens
tcccccaccgcccac

SEQ ID NO: 5311208 - DNA, 18 bp, Homo sapiens
tcccccaccgcccactct

SEQ ID NO: 5311209 - DNA, 14 bp, Homo sapiens
tcccccacctcttt

SEQ ID NO: 5311210 - DNA, 12 bp, Homo sapiens
tcccccacctga

SEQ ID NO: 5311211 - DNA, 13 bp, Homo sapiens
tcccccacctgca

SEQ ID NO: 5311212 - DNA, 15 bp, Homo sapiens
tcccccacctgcagc

SEQ ID NO: 5311213 - DNA, 18 bp, Homo sapiens
tcccccacgtctctctgc

SEQ ID NO: 5311214 - DNA, 21 bp, Homo sapiens
tcccccacgtctctctgcctg

SEQ ID NO: 5311215 - DNA, 22 bp, Homo sapiens
tcccccacgtctctctgcctgc

SEQ ID NO: 5311216 - DNA, 21 bp, Homo sapiens
tcccccacgtggactctgtgc

SEQ ID NO: 5311217 - DNA, 24 bp, Homo sapiens
tcccccactactgcagcacctcca

SEQ ID NO: 5311218 - DNA, 20 bp, Homo sapiens
tcccccactctctcacccac

SEQ ID NO: 5311219 - DNA, 23 bp, Homo sapiens
tcccccactctctcacccaccag

SEQ ID NO: 5311220 - DNA, 14 bp, Homo sapiens
tcccccactgccac

SEQ ID NO: 5311221 - DNA, 14 bp, Homo sapiens
tcccccactgccat

SEQ ID NO: 5311222 - DNA, 22 bp, Homo sapiens
tcccccactttcaagacagatg

SEQ ID NO: 5311223 - DNA, 13 bp, Homo sapiens
tcccccagacttt

SEQ ID NO: 5311224 - DNA, 11 bp, Homo sapiens
tcccccagagc

SEQ ID NO: 5311225 - DNA, 21 bp, Homo sapiens
tcccccagagcatctgcccca

SEQ ID NO: 5311226 - DNA, 15 bp, Homo sapiens
tcccccagaggtgga

SEQ ID NO: 5311227 - DNA, 13 bp, Homo sapiens
tcccccagagtgc

SEQ ID NO: 5311228 - DNA, 23 bp, Homo sapiens
tcccccagcaaagcccccagagc

SEQ ID NO: 5311229 - DNA, 22 bp, Homo sapiens
tcccccagcaacgcccctccaa

SEQ ID NO: 5311230 - DNA, 24 bp, Homo sapiens
tcccccagcacagatgaggagcag

SEQ ID NO: 5311231 - DNA, 18 bp, Homo sapiens
tcccccagcagaaccagc

SEQ ID NO: 5311232 - DNA, 23 bp, Homo sapiens
tcccccagcagaatggaggcagg

SEQ ID NO: 5311233 - DNA, 15 bp, Homo sapiens
tcccccagccactcc

SEQ ID NO: 5311234 - DNA, 22 bp, Homo sapiens
tccccttccagctccctcccct

SEQ ID NO: 5311235 - DNA, 15 bp, Homo sapiens
tccccttccatttct

SEQ ID NO: 5311236 - DNA, 20 bp, Homo sapiens
tccccttccccaattactat

SEQ ID NO: 5311237 - DNA, 15 bp, Homo sapiens
tccccttccccgtcc

SEQ ID NO: 5311238 - DNA, 15 bp, Homo sapiens
tccccttcccctccc

SEQ ID NO: 5311239 - DNA, 17 bp, Homo sapiens
tccccttcccctcccct

SEQ ID NO: 5311240 - DNA, 18 bp, Homo sapiens
tccccttccccttccttc

SEQ ID NO: 5311241 - DNA, 15 bp, Homo sapiens
tccccttccctgcaa

SEQ ID NO: 5311242 - DNA, 16 bp, Homo sapiens
tccccttccctgggga

SEQ ID NO: 5311243 - DNA, 13 bp, Homo sapiens
tccccttcctaag

SEQ ID NO: 5311244 - DNA, 21 bp, Homo sapiens
tccccttcctaattccacagc

SEQ ID NO: 5311245 - DNA, 16 bp, Homo sapiens
tccccttcctcactgc

SEQ ID NO: 5311246 - DNA, 23 bp, Homo sapiens
tccccttcctcattatcaaacag

SEQ ID NO: 5311247 - DNA, 11 bp, Homo sapiens
tccccttcctg

SEQ ID NO: 5311248 - DNA, 15 bp, Homo sapiens
tccccttcctgcacc

SEQ ID NO: 5311249 - DNA, 19 bp, Homo sapiens
tccccttcctgcacccgta

SEQ ID NO: 5311250 - DNA, 15 bp, Homo sapiens
tccccttcctggaca

SEQ ID NO: 5311251 - DNA, 19 bp, Homo sapiens
tccccttcctggacacact

SEQ ID NO: 5311252 - DNA, 16 bp, Homo sapiens
tccccttcctgtttca

SEQ ID NO: 5311253 - DNA, 19 bp, Homo sapiens
tccccttcgcgtatttcag

SEQ ID NO: 5311254 - DNA, 18 bp, Homo sapiens
tccccttcgctgaaattg

SEQ ID NO: 5311255 - DNA, 20 bp, Homo sapiens
tccccttctcccctgcactg

SEQ ID NO: 5311256 - DNA, 16 bp, Homo sapiens
tccccttctgaatcag

SEQ ID NO: 5311257 - DNA, 18 bp, Homo sapiens
tccccttcttcccgcccc

SEQ ID NO: 5311258 - DNA, 23 bp, Homo sapiens
tccccttcttcccgccccacctc

SEQ ID NO: 5311259 - DNA, 12 bp, Homo sapiens
tccccttcttgc

SEQ ID NO: 5311260 - DNA, 15 bp, Homo sapiens
tccccttcttgtgtc

SEQ ID NO: 5311261 - DNA, 14 bp, Homo sapiens
tccccttgagctga

SEQ ID NO: 5311262 - DNA, 17 bp, Homo sapiens
tccccttgaggtctcag

SEQ ID NO: 5311263 - DNA, 15 bp, Homo sapiens
tccccttgccacatc

SEQ ID NO: 5311264 - DNA, 15 bp, Homo sapiens
tccccttgccagctg

SEQ ID NO: 5311265 - DNA, 22 bp, Homo sapiens
tccccttgcccagggctcagcc

SEQ ID NO: 5311266 - DNA, 17 bp, Homo sapiens
tccccttgcccttcctg

SEQ ID NO: 5311267 - DNA, 18 bp, Homo sapiens
tccccttgcccttcctga

SEQ ID NO: 5311268 - DNA, 20 bp, Homo sapiens
tccccttgcccttcctgacc

SEQ ID NO: 5311269 - DNA, 14 bp, Homo sapiens
tccccttgcccttg

SEQ ID NO: 5311270 - DNA, 20 bp, Homo sapiens
tccccttgcccttgccctga

SEQ ID NO: 5311271 - DNA, 19 bp, Homo sapiens
tccccttggacctccaggg

SEQ ID NO: 5311272 - DNA, 22 bp, Homo sapiens
tccccttgggatgggcacaggc

SEQ ID NO: 5311273 - DNA, 18 bp, Homo sapiens
tccccttgggatgtacct

SEQ ID NO: 5311274 - DNA, 14 bp, Homo sapiens
tccccttgggcggc

SEQ ID NO: 5311275 - DNA, 21 bp, Homo sapiens
tccccttgtttgtcccttcta

SEQ ID NO: 5311276 - DNA, 17 bp, Homo sapiens
tcccctttactcagccc

SEQ ID NO: 5311277 - DNA, 16 bp, Homo sapiens
tcccctttccaattcc

SEQ ID NO: 5311278 - DNA, 20 bp, Homo sapiens
tcccctttccaattccaaaa

SEQ ID NO: 5311279 - DNA, 12 bp, Homo sapiens
tcccctttcctg

SEQ ID NO: 5311280 - DNA, 11 bp, Homo sapiens
tcccctttctc

SEQ ID NO: 5311281 - DNA, 12 bp, Homo sapiens
tcccctttctct

SEQ ID NO: 5311282 - DNA, 13 bp, Homo sapiens
tcccctttgcact

SEQ ID NO: 5311283 - DNA, 19 bp, Homo sapiens
tcccctttgcactgtaatg

SEQ ID NO: 5311284 - DNA, 20 bp, Homo sapiens
tcccctttgggggtgtgtgt

SEQ ID NO: 5311285 - DNA, 14 bp, Homo sapiens
tcccctttgtcctg

SEQ ID NO: 5311286 - DNA, 22 bp, Homo sapiens
tcccctttgtcctgcgttttct

SEQ ID NO: 5311287 - DNA, 18 bp, Homo sapiens
tccccttttaaggtttca

SEQ ID NO: 5311288 - DNA, 17 bp, Homo sapiens
tccccttttattgctgc

SEQ ID NO: 5311289 - DNA, 19 bp, Homo sapiens
tccccttttctatgttgct

SEQ ID NO: 5311290 - DNA, 20 bp, Homo sapiens
tccccttttcttttctaccc

SEQ ID NO: 5311291 - DNA, 17 bp, Homo sapiens
tccccttttgcctggct

SEQ ID NO: 5311292 - DNA, 19 bp, Homo sapiens
tccccttttgcctggctgt

SEQ ID NO: 5311293 - DNA, 20 bp, Homo sapiens
tccccttttgcctggctgtg

SEQ ID NO: 5311294 - DNA, 21 bp, Homo sapiens
tccccttttgcctggctgtgg

SEQ ID NO: 5311295 - DNA, 18 bp, Homo sapiens
tcccgaaagcctttcctc

SEQ ID NO: 5311296 - DNA, 19 bp, Homo sapiens
tcccgaacactgagaaata

SEQ ID NO: 5311297 - DNA, 19 bp, Homo sapiens
tcccgaagccatcacttct

SEQ ID NO: 5311298 - DNA, 14 bp, Homo sapiens
tcccgacagcccat

SEQ ID NO: 5311299 - DNA, 21 bp, Homo sapiens
tcccgacccagccagctgcag

SEQ ID NO: 5311300 - DNA, 22 bp, Homo sapiens
tcccgacccagccagctgcagg

SEQ ID NO: 5311301 - DNA, 21 bp, Homo sapiens
tcccgacctaccaccccactg

SEQ ID NO: 5311302 - DNA, 19 bp, Homo sapiens
tcccgagcaaagtctaaag

SEQ ID NO: 5311303 - DNA, 18 bp, Homo sapiens
tcccgagcaaccctctga

SEQ ID NO: 5311304 - DNA, 22 bp, Homo sapiens
tcccgagcacctccacatcctc

SEQ ID NO: 5311305 - DNA, 15 bp, Homo sapiens
tcccgagctcctctt

SEQ ID NO: 5311306 - DNA, 22 bp, Homo sapiens
tcccgagcttagattctgtatg

SEQ ID NO: 5311307 - DNA, 22 bp, Homo sapiens
tcccgaggaagggccagagcct

SEQ ID NO: 5311308 - DNA, 21 bp, Homo sapiens
tcccgaggatgctgtcaggag

SEQ ID NO: 5311309 - DNA, 16 bp, Homo sapiens
tcccgaggcagcaaca

SEQ ID NO: 5311310 - DNA, 23 bp, Homo sapiens
tcccgaggcagcaacaggaccag

SEQ ID NO: 5311311 - DNA, 19 bp, Homo sapiens
tcccgagtagctgggacta

SEQ ID NO: 5311312 - DNA, 20 bp, Homo sapiens
tcccgagtagttgggattac

SEQ ID NO: 5311313 - DNA, 23 bp, Homo sapiens
tcccgagtagttgggattacagg

SEQ ID NO: 5311314 - DNA, 16 bp, Homo sapiens
tcccgagtctgggaca

SEQ ID NO: 5311315 - DNA, 15 bp, Homo sapiens
tcccgattgtaactc

SEQ ID NO: 5311316 - DNA, 21 bp, Homo sapiens
tcccgcacatggtgtgggggg

SEQ ID NO: 5311317 - DNA, 18 bp, Homo sapiens
tcccgcactctgccccca

SEQ ID NO: 5311318 - DNA, 19 bp, Homo sapiens
tcccgcagagactggggcc

SEQ ID NO: 5311319 - DNA, 19 bp, Homo sapiens
tcccgcagcaccagcctga

SEQ ID NO: 5311320 - DNA, 14 bp, Homo sapiens
tcccgcatgctgcc

SEQ ID NO: 5311321 - DNA, 17 bp, Homo sapiens
tcccgcatgctgcctgc

SEQ ID NO: 5311322 - DNA, 21 bp, Homo sapiens
tcccgcatgctgcctgcctcc

SEQ ID NO: 5311323 - DNA, 14 bp, Homo sapiens
tcccgcatggtttt

SEQ ID NO: 5311324 - DNA, 22 bp, Homo sapiens
tcccgcatggtttttataatat

SEQ ID NO: 5311325 - DNA, 15 bp, Homo sapiens
tcccgccacacgctc

SEQ ID NO: 5311326 - DNA, 20 bp, Homo sapiens
tcccgccagggagtgtgatg

SEQ ID NO: 5311327 - DNA, 14 bp, Homo sapiens
tcccgccccagggt

SEQ ID NO: 5311328 - DNA, 18 bp, Homo sapiens
tcccgccccagggtctga

SEQ ID NO: 5311329 - DNA, 19 bp, Homo sapiens
tcccgccccagggtctgaa

SEQ ID NO: 5311330 - DNA, 16 bp, Homo sapiens
tcccgccccgcccctc

SEQ ID NO: 5311331 - DNA, 17 bp, Homo sapiens
tcccgccccgggctggc

SEQ ID NO: 5311332 - DNA, 18 bp, Homo sapiens
tcccgccccgggctggcc

SEQ ID NO: 5311333 - DNA, 20 bp, Homo sapiens
tcccgccccgggctggccct

SEQ ID NO: 5311334 - DNA, 23 bp, Homo sapiens
tcccgccccgggctggccctgtg

SEQ ID NO: 5311335 - DNA, 15 bp, Homo sapiens
tcccgccccttcccc

SEQ ID NO: 5311336 - DNA, 15 bp, Homo sapiens
tcccgccctcacctg

SEQ ID NO: 5311337 - DNA, 14 bp, Homo sapiens
tcccgccctggctc

SEQ ID NO: 5311338 - DNA, 23 bp, Homo sapiens
tcccgccgagtactatgtattac

SEQ ID NO: 5311339 - DNA, 13 bp, Homo sapiens
tcccgccgcctcg

SEQ ID NO: 5311340 - DNA, 15 bp, Homo sapiens
tcccgccgcctcggg

SEQ ID NO: 5311341 - DNA, 15 bp, Homo sapiens
tcccgccggaggcca

SEQ ID NO: 5311342 - DNA, 14 bp, Homo sapiens
tcccgcctcagcct

SEQ ID NO: 5311343 - DNA, 18 bp, Homo sapiens
tcccgcctcagcctctca

SEQ ID NO: 5311344 - DNA, 19 bp, Homo sapiens
tcccgcctgattggggcct

SEQ ID NO: 5311345 - DNA, 22 bp, Homo sapiens
tcccgcctgattggggcctcac

SEQ ID NO: 5311346 - DNA, 19 bp, Homo sapiens
tcccgccttcaggttcctc

SEQ ID NO: 5311347 - DNA, 15 bp, Homo sapiens
tcccgccttctccag

SEQ ID NO: 5311348 - DNA, 13 bp, Homo sapiens
tcccgcctttgac

SEQ ID NO: 5311349 - DNA, 20 bp, Homo sapiens
tcccgcgggaagccagcccg

SEQ ID NO: 5311350 - DNA, 12 bp, Homo sapiens
tcccgcggtgcc

SEQ ID NO: 5311351 - DNA, 15 bp, Homo sapiens
tcccgcggtgctgac

SEQ ID NO: 5311352 - DNA, 20 bp, Homo sapiens
tcccgcggtgctgactgagg

SEQ ID NO: 5311353 - DNA, 15 bp, Homo sapiens
tcccgcgttcaagac

SEQ ID NO: 5311354 - DNA, 15 bp, Homo sapiens
tcccgctcagccctc

SEQ ID NO: 5311355 - DNA, 16 bp, Homo sapiens
tcccgctcagccctcc

SEQ ID NO: 5311356 - DNA, 14 bp, Homo sapiens
tcccgctccccacc

SEQ ID NO: 5311357 - DNA, 14 bp, Homo sapiens
tcccgctgcacaca

SEQ ID NO: 5311358 - DNA, 18 bp, Homo sapiens
tcccgctgcacacagacg

SEQ ID NO: 5311359 - DNA, 16 bp, Homo sapiens
tcccgctgcctcctgc

SEQ ID NO: 5311360 - DNA, 22 bp, Homo sapiens
tcccgctgcctcctgctctctg

SEQ ID NO: 5311361 - DNA, 13 bp, Homo sapiens
tcccgcttagcct

SEQ ID NO: 5311362 - DNA, 21 bp, Homo sapiens
tcccgcttagcctgcctcacc

SEQ ID NO: 5311363 - DNA, 14 bp, Homo sapiens
tcccgcttcctccg

SEQ ID NO: 5311364 - DNA, 16 bp, Homo sapiens
tcccgcttcctccggc

SEQ ID NO: 5311365 - DNA, 16 bp, Homo sapiens
tcccgcttcctggcct

SEQ ID NO: 5311366 - DNA, 17 bp, Homo sapiens
tcccgcttcctggcctc

SEQ ID NO: 5311367 - DNA, 18 bp, Homo sapiens
tcccgcttcctggcctcc

SEQ ID NO: 5311368 - DNA, 17 bp, Homo sapiens
tcccgcttgctctcctg

SEQ ID NO: 5311369 - DNA, 19 bp, Homo sapiens
tcccgcttgctctcctgga

SEQ ID NO: 5311370 - DNA, 21 bp, Homo sapiens
tcccggactgcaagcagggct

SEQ ID NO: 5311371 - DNA, 14 bp, Homo sapiens
tcccggagcacagc

SEQ ID NO: 5311372 - DNA, 15 bp, Homo sapiens
tcccggagcacagcc

SEQ ID NO: 5311373 - DNA, 12 bp, Homo sapiens
tcccggagcctg

SEQ ID NO: 5311374 - DNA, 19 bp, Homo sapiens
tcccggagcctgtgcagcc

SEQ ID NO: 5311375 - DNA, 14 bp, Homo sapiens
tcccggagctcaag

SEQ ID NO: 5311376 - DNA, 21 bp, Homo sapiens
tcccggagggaaactgtgaat

SEQ ID NO: 5311377 - DNA, 22 bp, Homo sapiens
tcccggagggaaactgtgaatg

SEQ ID NO: 5311378 - DNA, 21 bp, Homo sapiens
tcccggagggccctgagctga

SEQ ID NO: 5311379 - DNA, 23 bp, Homo sapiens
tcccggcaagcgcttctgctgaa

SEQ ID NO: 5311380 - DNA, 14 bp, Homo sapiens
tcccggcatcctga

SEQ ID NO: 5311381 - DNA, 16 bp, Homo sapiens
tcccggccagctctgg

SEQ ID NO: 5311382 - DNA, 21 bp, Homo sapiens
tcccggcccccggccaaggac

SEQ ID NO: 5311383 - DNA, 14 bp, Homo sapiens
tcccggccccgcgc

SEQ ID NO: 5311384 - DNA, 23 bp, Homo sapiens
tcccggccccgcgcgtgccccca

SEQ ID NO: 5311385 - DNA, 15 bp, Homo sapiens
tcccggccctgcctg

SEQ ID NO: 5311386 - DNA, 13 bp, Homo sapiens
tcccggccgcgcc

SEQ ID NO: 5311387 - DNA, 19 bp, Homo sapiens
tcccggccgcgccgccgcc

SEQ ID NO: 5311388 - DNA, 18 bp, Homo sapiens
tcccggccggccctggct

SEQ ID NO: 5311389 - DNA, 17 bp, Homo sapiens
tcccggcctaggcacct

SEQ ID NO: 5311390 - DNA, 15 bp, Homo sapiens
tcccggctgccccca

SEQ ID NO: 5311391 - DNA, 18 bp, Homo sapiens
tcccggctgccctttctg

SEQ ID NO: 5311392 - DNA, 22 bp, Homo sapiens
tcccggctgccctttctgggca

SEQ ID NO: 5311393 - DNA, 16 bp, Homo sapiens
tcccggctgcctgccg

SEQ ID NO: 5311394 - DNA, 12 bp, Homo sapiens
tcccggcttcca

SEQ ID NO: 5311395 - DNA, 20 bp, Homo sapiens
tcccggctttgcagggagac

SEQ ID NO: 5311396 - DNA, 22 bp, Homo sapiens
tcccgggaagcatcctccccac

SEQ ID NO: 5311397 - DNA, 22 bp, Homo sapiens
tcccgggaatgaccgctctccc

SEQ ID NO: 5311398 - DNA, 21 bp, Homo sapiens
tcccgggacacctaggctagg

SEQ ID NO: 5311399 - DNA, 14 bp, Homo sapiens
tcccgggactctgc

SEQ ID NO: 5311400 - DNA, 14 bp, Homo sapiens
tcccgggagaggag

SEQ ID NO: 5311401 - DNA, 18 bp, Homo sapiens
tcccgggagaggagatca

SEQ ID NO: 5311402 - DNA, 22 bp, Homo sapiens
tcccgggagctgggccctgcct

SEQ ID NO: 5311403 - DNA, 13 bp, Homo sapiens
tcccgggccaaga

SEQ ID NO: 5311404 - DNA, 16 bp, Homo sapiens
tcccgggccacgcccc

SEQ ID NO: 5311405 - DNA, 17 bp, Homo sapiens
tcccgggccacgcccca

SEQ ID NO: 5311406 - DNA, 21 bp, Homo sapiens
tcccgggccacgccccagccc

SEQ ID NO: 5311407 - DNA, 17 bp, Homo sapiens
tcccgggccccacagac

SEQ ID NO: 5311408 - DNA, 19 bp, Homo sapiens
tcccgggccctcagccctc

SEQ ID NO: 5311409 - DNA, 13 bp, Homo sapiens
tcccgggccctcc

SEQ ID NO: 5311410 - DNA, 13 bp, Homo sapiens
tcccgggctaaga

SEQ ID NO: 5311411 - DNA, 16 bp, Homo sapiens
tccctctcgctcccct

SEQ ID NO: 5311412 - DNA, 12 bp, Homo sapiens
tccctctcggaa

SEQ ID NO: 5311413 - DNA, 9 bp, Homo sapiens
tccctctct

SEQ ID NO: 5311414 - DNA, 20 bp, Homo sapiens
tccctctctcagcacagcct

SEQ ID NO: 5311415 - DNA, 17 bp, Homo sapiens
tccctctctcatgagaa

SEQ ID NO: 5311416 - DNA, 20 bp, Homo sapiens
tccctctctcatgagaagcc

SEQ ID NO: 5311417 - DNA, 15 bp, Homo sapiens
tccctctctccacac

SEQ ID NO: 5311418 - DNA, 21 bp, Homo sapiens
tccctctctccacacggagct

SEQ ID NO: 5311419 - DNA, 19 bp, Homo sapiens
tccctctctccctgcctca

SEQ ID NO: 5311420 - DNA, 12 bp, Homo sapiens
tccctctctctg

SEQ ID NO: 5311421 - DNA, 23 bp, Homo sapiens
tccctctctctgggaccactggg

SEQ ID NO: 5311422 - DNA, 23 bp, Homo sapiens
tccctctctcttctgctccaccc

SEQ ID NO: 5311423 - DNA, 15 bp, Homo sapiens
tccctctctggacct

SEQ ID NO: 5311424 - DNA, 13 bp, Homo sapiens
tccctctctggag

SEQ ID NO: 5311425 - DNA, 13 bp, Homo sapiens
tccctctctggtt

SEQ ID NO: 5311426 - DNA, 19 bp, Homo sapiens
tccctctcttccccttccc

SEQ ID NO: 5311427 - DNA, 15 bp, Homo sapiens
tccctctcttccggg

SEQ ID NO: 5311428 - DNA, 18 bp, Homo sapiens
tccctctcttccgggagc

SEQ ID NO: 5311429 - DNA, 17 bp, Homo sapiens
tccctctcttggctatt

SEQ ID NO: 5311430 - DNA, 13 bp, Homo sapiens
tccctctgaccca

SEQ ID NO: 5311431 - DNA, 16 bp, Homo sapiens
tccctctgaggctgta

SEQ ID NO: 5311432 - DNA, 17 bp, Homo sapiens
tccctctgattggtttt

SEQ ID NO: 5311433 - DNA, 20 bp, Homo sapiens
tccctctgcagaatcccttt

SEQ ID NO: 5311434 - DNA, 14 bp, Homo sapiens
tccctctgcattga

SEQ ID NO: 5311435 - DNA, 11 bp, Homo sapiens
tccctctgccc

SEQ ID NO: 5311436 - DNA, 22 bp, Homo sapiens
tccctctgccccaagcagccag

SEQ ID NO: 5311437 - DNA, 22 bp, Homo sapiens
tccctctgccccgccctccttc

SEQ ID NO: 5311438 - DNA, 13 bp, Homo sapiens
tccctctgcctga

SEQ ID NO: 5311439 - DNA, 21 bp, Homo sapiens
tccctctgcctgaaccttcca

SEQ ID NO: 5311440 - DNA, 22 bp, Homo sapiens
tccctctgcctgaccccaggcc

SEQ ID NO: 5311441 - DNA, 18 bp, Homo sapiens
tccctctgcctgggatgc

SEQ ID NO: 5311442 - DNA, 19 bp, Homo sapiens
tccctctgcctgggatgcc

SEQ ID NO: 5311443 - DNA, 22 bp, Homo sapiens
tccctctgcctgggatgccctt

SEQ ID NO: 5311444 - DNA, 15 bp, Homo sapiens
tccctctgccttcag

SEQ ID NO: 5311445 - DNA, 18 bp, Homo sapiens
tccctctgctcctggagc

SEQ ID NO: 5311446 - DNA, 14 bp, Homo sapiens
tccctctgctctca

SEQ ID NO: 5311447 - DNA, 15 bp, Homo sapiens
tccctctgctgcttt

SEQ ID NO: 5311448 - DNA, 16 bp, Homo sapiens
tccctctgctgctttt

SEQ ID NO: 5311449 - DNA, 12 bp, Homo sapiens
tccctctggagt

SEQ ID NO: 5311450 - DNA, 18 bp, Homo sapiens
tccctctggccctgcctt

SEQ ID NO: 5311451 - DNA, 11 bp, Homo sapiens
tccctctggga

SEQ ID NO: 5311452 - DNA, 17 bp, Homo sapiens
tccctctgggcacgcct

SEQ ID NO: 5311453 - DNA, 19 bp, Homo sapiens
tccctctgggcctgttctc

SEQ ID NO: 5311454 - DNA, 13 bp, Homo sapiens
tccctctggggct

SEQ ID NO: 5311455 - DNA, 17 bp, Homo sapiens
tccctctggggctgttc

SEQ ID NO: 5311456 - DNA, 23 bp, Homo sapiens
tccctctgggggctctggccaag

SEQ ID NO: 5311457 - DNA, 20 bp, Homo sapiens
tccctctggggggtggggac

SEQ ID NO: 5311458 - DNA, 19 bp, Homo sapiens
tccctctgggttccagcag

SEQ ID NO: 5311459 - DNA, 18 bp, Homo sapiens
tccctctgtccaccagcc

SEQ ID NO: 5311460 - DNA, 22 bp, Homo sapiens
tccctctgtcttttctcctccg

SEQ ID NO: 5311461 - DNA, 18 bp, Homo sapiens
tccctctgtgtctgctct

SEQ ID NO: 5311462 - DNA, 20 bp, Homo sapiens
tccctctgttaggtccattt

SEQ ID NO: 5311463 - DNA, 14 bp, Homo sapiens
tccctctgtttctc

SEQ ID NO: 5311464 - DNA, 16 bp, Homo sapiens
tccctcttcactcccc

SEQ ID NO: 5311465 - DNA, 18 bp, Homo sapiens
tccctcttcactgtggcc

SEQ ID NO: 5311466 - DNA, 13 bp, Homo sapiens
tccctcttcccag

SEQ ID NO: 5311467 - DNA, 15 bp, Homo sapiens
tccctcttccctctc

SEQ ID NO: 5311468 - DNA, 18 bp, Homo sapiens
tccctcttccctctccct

SEQ ID NO: 5311469 - DNA, 16 bp, Homo sapiens
tccctcttcctctcca

SEQ ID NO: 5311470 - DNA, 16 bp, Homo sapiens
tccctcttctaaccca

SEQ ID NO: 5311471 - DNA, 17 bp, Homo sapiens
tccctcttctcaagtgc

SEQ ID NO: 5311472 - DNA, 14 bp, Homo sapiens
tccctcttctctcc

SEQ ID NO: 5311473 - DNA, 20 bp, Homo sapiens
tccctcttctttcagacttg

SEQ ID NO: 5311474 - DNA, 16 bp, Homo sapiens
tccctcttgacattca

SEQ ID NO: 5311475 - DNA, 22 bp, Homo sapiens
tccctcttgtaagtcatctact

SEQ ID NO: 5311476 - DNA, 15 bp, Homo sapiens
tccctcttgtgctca

SEQ ID NO: 5311477 - DNA, 18 bp, Homo sapiens
tccctcttgtgctcagtc

SEQ ID NO: 5311478 - DNA, 12 bp, Homo sapiens
tccctcttgttt

SEQ ID NO: 5311479 - DNA, 19 bp, Homo sapiens
tccctcttgttttgtttgt

SEQ ID NO: 5311480 - DNA, 20 bp, Homo sapiens
tccctcttgttttgtttgtc

SEQ ID NO: 5311481 - DNA, 19 bp, Homo sapiens
tccctctttcatctcctga

SEQ ID NO: 5311482 - DNA, 18 bp, Homo sapiens
tccctctttccctccctt

SEQ ID NO: 5311483 - DNA, 14 bp, Homo sapiens
tccctctttcctgt

SEQ ID NO: 5311484 - DNA, 16 bp, Homo sapiens
tccctctttctacatt

SEQ ID NO: 5311485 - DNA, 15 bp, Homo sapiens
tccctctttctagcc

SEQ ID NO: 5311486 - DNA, 13 bp, Homo sapiens
tccctctttgcct

SEQ ID NO: 5311487 - DNA, 22 bp, Homo sapiens
tccctctttggcagttgcatta

SEQ ID NO: 5311488 - DNA, 18 bp, Homo sapiens
tccctcttttcttactcc

SEQ ID NO: 5311489 - DNA, 18 bp, Homo sapiens
tccctgaaaacccagaga

SEQ ID NO: 5311490 - DNA, 19 bp, Homo sapiens
tccctgaaaacccagagag

SEQ ID NO: 5311491 - DNA, 12 bp, Homo sapiens
tccctgaacaga

SEQ ID NO: 5311492 - DNA, 21 bp, Homo sapiens
tccctgaacatagttttcacc

SEQ ID NO: 5311493 - DNA, 19 bp, Homo sapiens
tccctgaacatctgtgtgt

SEQ ID NO: 5311494 - DNA, 15 bp, Homo sapiens
tccctgaaccatccc

SEQ ID NO: 5311495 - DNA, 19 bp, Homo sapiens
tccctgaacctcagtttcc

SEQ ID NO: 5311496 - DNA, 20 bp, Homo sapiens
tccctgaacctcagtttcct

SEQ ID NO: 5311497 - DNA, 14 bp, Homo sapiens
tccctgaaccttcc

SEQ ID NO: 5311498 - DNA, 22 bp, Homo sapiens
tccctgaacgttttcttctttc

SEQ ID NO: 5311499 - DNA, 23 bp, Homo sapiens
tccctgaacgttttcttctttcc

SEQ ID NO: 5311500 - DNA, 16 bp, Homo sapiens
tccctgaactcccaga

SEQ ID NO: 5311501 - DNA, 15 bp, Homo sapiens
tccctgaactgggac

SEQ ID NO: 5311502 - DNA, 14 bp, Homo sapiens
tccctgaacttcct

SEQ ID NO: 5311503 - DNA, 13 bp, Homo sapiens
tccctgaactttt

SEQ ID NO: 5311504 - DNA, 12 bp, Homo sapiens
tccctgaagcca

SEQ ID NO: 5311505 - DNA, 16 bp, Homo sapiens
tccctgaagccagcct

SEQ ID NO: 5311506 - DNA, 17 bp, Homo sapiens
tccctgaagccagcctt

SEQ ID NO: 5311507 - DNA, 19 bp, Homo sapiens
tccctgaagccagccttct

SEQ ID NO: 5311508 - DNA, 11 bp, Homo sapiens
tccctgaaggc

SEQ ID NO: 5311509 - DNA, 16 bp, Homo sapiens
tccctgaaggccccgc

SEQ ID NO: 5311510 - DNA, 21 bp, Homo sapiens
tccctgaaggccccgcccagg

SEQ ID NO: 5311511 - DNA, 17 bp, Homo sapiens
tccctgaagtcttgcat

SEQ ID NO: 5311512 - DNA, 16 bp, Homo sapiens
tccctgaagttatgtg

SEQ ID NO: 5311513 - DNA, 15 bp, Homo sapiens
tccctgaatcctctc

SEQ ID NO: 5311514 - DNA, 22 bp, Homo sapiens
tccctgaatctgaccacagaca

SEQ ID NO: 5311515 - DNA, 15 bp, Homo sapiens
tccctgaccaccctg

SEQ ID NO: 5311516 - DNA, 17 bp, Homo sapiens
tccctgaccaccctgcc

SEQ ID NO: 5311517 - DNA, 21 bp, Homo sapiens
tccctgaccaccctgcctgtg

SEQ ID NO: 5311518 - DNA, 21 bp, Homo sapiens
tccctgaccccctgtcctagg

SEQ ID NO: 5311519 - DNA, 16 bp, Homo sapiens
tccctgaccctgcaga

SEQ ID NO: 5311520 - DNA, 17 bp, Homo sapiens
tccctgaccctgtatat

SEQ ID NO: 5311521 - DNA, 23 bp, Homo sapiens
tccctgaccctttgaggccccca

SEQ ID NO: 5311522 - DNA, 20 bp, Homo sapiens
tccctgaccttagcgttctg

SEQ ID NO: 5311523 - DNA, 17 bp, Homo sapiens
tccctgaccttctccag

SEQ ID NO: 5311524 - DNA, 19 bp, Homo sapiens
tccctgaccttctccaggg

SEQ ID NO: 5311525 - DNA, 16 bp, Homo sapiens
tccctgacgtctgcca

SEQ ID NO: 5311526 - DNA, 17 bp, Homo sapiens
tccctgacgtctgccac

SEQ ID NO: 5311527 - DNA, 16 bp, Homo sapiens
tccctgactctctgtg

SEQ ID NO: 5311528 - DNA, 13 bp, Homo sapiens
tccctgacttccc

SEQ ID NO: 5311529 - DNA, 22 bp, Homo sapiens
tccctgacttcccagctggcag

SEQ ID NO: 5311530 - DNA, 14 bp, Homo sapiens
tccctgacttgctt

SEQ ID NO: 5311531 - DNA, 21 bp, Homo sapiens
tccctgagaagcctcatggga

SEQ ID NO: 5311532 - DNA, 21 bp, Homo sapiens
tccctgagatttaacccctcc

SEQ ID NO: 5311533 - DNA, 15 bp, Homo sapiens
tccctgagcctgcat

SEQ ID NO: 5311534 - DNA, 18 bp, Homo sapiens
tccctgagcctgcattct

SEQ ID NO: 5311535 - DNA, 23 bp, Homo sapiens
tccctgagctagaaccctctgtt

SEQ ID NO: 5311536 - DNA, 15 bp, Homo sapiens
tccctgaggactgat

SEQ ID NO: 5311537 - DNA, 15 bp, Homo sapiens
tccctgaggatgggt

SEQ ID NO: 5311538 - DNA, 11 bp, Homo sapiens
tccctgaggca

SEQ ID NO: 5311539 - DNA, 18 bp, Homo sapiens
tccctgagggcccttccc

SEQ ID NO: 5311540 - DNA, 13 bp, Homo sapiens
tccctgagggcgg

SEQ ID NO: 5311541 - DNA, 17 bp, Homo sapiens
tccctgagggcggagcg

SEQ ID NO: 5311542 - DNA, 19 bp, Homo sapiens
tccctgaggtacctttcca

SEQ ID NO: 5311543 - DNA, 21 bp, Homo sapiens
tccctgaggtacctttccacc

SEQ ID NO: 5311544 - DNA, 17 bp, Homo sapiens
tccctgaggtcacctgg

SEQ ID NO: 5311545 - DNA, 14 bp, Homo sapiens
tccctgagtcacca

SEQ ID NO: 5311546 - DNA, 21 bp, Homo sapiens
tccctgagtgcgggctgaggc

SEQ ID NO: 5311547 - DNA, 15 bp, Homo sapiens
tccctgatcccagac

SEQ ID NO: 5311548 - DNA, 15 bp, Homo sapiens
tccctgatccctgat

SEQ ID NO: 5311549 - DNA, 19 bp, Homo sapiens
tccctgatgacacccaccc

SEQ ID NO: 5311550 - DNA, 14 bp, Homo sapiens
tccctgatggaccc

SEQ ID NO: 5311551 - DNA, 23 bp, Homo sapiens
tccctgatggcagaactcccaca

SEQ ID NO: 5311552 - DNA, 14 bp, Homo sapiens
tccctgatttggag

SEQ ID NO: 5311553 - DNA, 15 bp, Homo sapiens
tccctgcaaccaact

SEQ ID NO: 5311554 - DNA, 16 bp, Homo sapiens
tccctgcaaccaacta

SEQ ID NO: 5311555 - DNA, 14 bp, Homo sapiens
tccctgcaaggtgc

SEQ ID NO: 5311556 - DNA, 11 bp, Homo sapiens
tccctgcacac

SEQ ID NO: 5311557 - DNA, 20 bp, Homo sapiens
tccctgcacacacatgcata

SEQ ID NO: 5311558 - DNA, 12 bp, Homo sapiens
tccctgcacagc

SEQ ID NO: 5311559 - DNA, 13 bp, Homo sapiens
tccctgcacagcc

SEQ ID NO: 5311560 - DNA, 16 bp, Homo sapiens
tccctgcacagcctct

SEQ ID NO: 5311561 - DNA, 17 bp, Homo sapiens
tccctgcacagcctcta

SEQ ID NO: 5311562 - DNA, 17 bp, Homo sapiens
tccctgcacagtgactt

SEQ ID NO: 5311563 - DNA, 20 bp, Homo sapiens
tccctgcacagtgacttctg

SEQ ID NO: 5311564 - DNA, 11 bp, Homo sapiens
tccctgcaccc

SEQ ID NO: 5311565 - DNA, 21 bp, Homo sapiens
tccctgcaccgccgcagaagc

SEQ ID NO: 5311566 - DNA, 22 bp, Homo sapiens
tccctgcaccgccgcagaagca

SEQ ID NO: 5311567 - DNA, 22 bp, Homo sapiens
tccctgcactaaagccagcctg

SEQ ID NO: 5311568 - DNA, 13 bp, Homo sapiens
tccctgcactgtg

SEQ ID NO: 5311569 - DNA, 17 bp, Homo sapiens
tccctgcagaagccaga

SEQ ID NO: 5311570 - DNA, 19 bp, Homo sapiens
tccctgcagaagccagaag

SEQ ID NO: 5311571 - DNA, 15 bp, Homo sapiens
tccctgcagactcca

SEQ ID NO: 5311572 - DNA, 23 bp, Homo sapiens
tccctgcagatgccaccctagcc

SEQ ID NO: 5311573 - DNA, 11 bp, Homo sapiens
tccctgcagct

SEQ ID NO: 5311574 - DNA, 15 bp, Homo sapiens
tccctgcagctgacc

SEQ ID NO: 5311575 - DNA, 16 bp, Homo sapiens
tccctgcagctgaccg

SEQ ID NO: 5311576 - DNA, 12 bp, Homo sapiens
tccctgcagctt

SEQ ID NO: 5311577 - DNA, 15 bp, Homo sapiens
tccctgcagggccat

SEQ ID NO: 5311578 - DNA, 13 bp, Homo sapiens
tccctgcaggggc

SEQ ID NO: 5311579 - DNA, 13 bp, Homo sapiens
tccctgcatcctg

SEQ ID NO: 5311580 - DNA, 23 bp, Homo sapiens
tccctgcatggcatcctccagcc

SEQ ID NO: 5311581 - DNA, 14 bp, Homo sapiens
tccctgcatttctg

SEQ ID NO: 5311582 - DNA, 13 bp, Homo sapiens
tccctgccaactc

SEQ ID NO: 5311583 - DNA, 16 bp, Homo sapiens
tccctgccaatggact

SEQ ID NO: 5311584 - DNA, 13 bp, Homo sapiens
tccctgccaccgt

SEQ ID NO: 5311585 - DNA, 12 bp, Homo sapiens
tccctgccactg

SEQ ID NO: 5311586 - DNA, 15 bp, Homo sapiens
tccctgccacttcaa

SEQ ID NO: 5311587 - DNA, 12 bp, Homo sapiens
tccctgccagag

SEQ ID NO: 5311588 - DNA, 15 bp, Homo sapiens
tccctgccatccccc

SEQ ID NO: 5311589 - DNA, 21 bp, Homo sapiens
tccctgcccaaactccccttc

SEQ ID NO: 5311590 - DNA, 23 bp, Homo sapiens
tccctgcccaaactccccttccc

SEQ ID NO: 5311591 - DNA, 21 bp, Homo sapiens
tcccttttgactcttccgtgc

SEQ ID NO: 5311592 - DNA, 20 bp, Homo sapiens
tcccttttgcataagattaa

SEQ ID NO: 5311593 - DNA, 15 bp, Homo sapiens
tcccttttgcatcat

SEQ ID NO: 5311594 - DNA, 17 bp, Homo sapiens
tcccttttgcattgcca

SEQ ID NO: 5311595 - DNA, 18 bp, Homo sapiens
tcccttttgtaagttgag

SEQ ID NO: 5311596 - DNA, 19 bp, Homo sapiens
tccctttttaaaaaatacc

SEQ ID NO: 5311597 - DNA, 17 bp, Homo sapiens
tccctttttacacttta

SEQ ID NO: 5311598 - DNA, 15 bp, Homo sapiens
tccctttttatgtgg

SEQ ID NO: 5311599 - DNA, 12 bp, Homo sapiens
tccctttttcat

SEQ ID NO: 5311600 - DNA, 20 bp, Homo sapiens
tccctttttcataaattatt

SEQ ID NO: 5311601 - DNA, 14 bp, Homo sapiens
tccctttttccttg

SEQ ID NO: 5311602 - DNA, 15 bp, Homo sapiens
tccctttttccttgt

SEQ ID NO: 5311603 - DNA, 13 bp, Homo sapiens
tccctttttgaat

SEQ ID NO: 5311604 - DNA, 15 bp, Homo sapiens
tccctttttgaattg

SEQ ID NO: 5311605 - DNA, 17 bp, Homo sapiens
tccctttttgcagggga

SEQ ID NO: 5311606 - DNA, 22 bp, Homo sapiens
tccctttttgcaggggactggg

SEQ ID NO: 5311607 - DNA, 23 bp, Homo sapiens
tccctttttgcaggggactgggc

SEQ ID NO: 5311608 - DNA, 16 bp, Homo sapiens
tcccttttttcttccc

SEQ ID NO: 5311609 - DNA, 20 bp, Homo sapiens
tcccttttttggctgctgaa

SEQ ID NO: 5311610 - DNA, 23 bp, Homo sapiens
tcccttttttggctgctgaaggc

SEQ ID NO: 5311611 - DNA, 13 bp, Homo sapiens
tccctttttttaa

SEQ ID NO: 5311612 - DNA, 13 bp, Homo sapiens
tccctttttttct

SEQ ID NO: 5311613 - DNA, 23 bp, Homo sapiens
tccgaaaaatcctcttcctctga

SEQ ID NO: 5311614 - DNA, 18 bp, Homo sapiens
tccgaaaccaaagaagaa

SEQ ID NO: 5311615 - DNA, 18 bp, Homo sapiens
tccgaaaccagttaagaa

SEQ ID NO: 5311616 - DNA, 20 bp, Homo sapiens
tccgaaagaagacacagaac

SEQ ID NO: 5311617 - DNA, 19 bp, Homo sapiens
tccgaacaccctcgaagcg

SEQ ID NO: 5311618 - DNA, 15 bp, Homo sapiens
tccgaacctcctctg

SEQ ID NO: 5311619 - DNA, 15 bp, Homo sapiens
tccgaagaaaagata

SEQ ID NO: 5311620 - DNA, 24 bp, Homo sapiens
tccgaagaattccatagtggacca

SEQ ID NO: 5311621 - DNA, 18 bp, Homo sapiens
tccgaagctacttctcca

SEQ ID NO: 5311622 - DNA, 21 bp, Homo sapiens
tccgacaaccgatgctccagc

SEQ ID NO: 5311623 - DNA, 20 bp, Homo sapiens
tccgaccactaattgccaag

SEQ ID NO: 5311624 - DNA, 13 bp, Homo sapiens
tccgaccagacac

SEQ ID NO: 5311625 - DNA, 17 bp, Homo sapiens
tccgaccagacaccttg

SEQ ID NO: 5311626 - DNA, 20 bp, Homo sapiens
tccgaccctcatggccccca

SEQ ID NO: 5311627 - DNA, 15 bp, Homo sapiens
tccgaccctctggga

SEQ ID NO: 5311628 - DNA, 20 bp, Homo sapiens
tccgacctacgttcctggcc

SEQ ID NO: 5311629 - DNA, 22 bp, Homo sapiens
tccgacctctctcctctgaaac

SEQ ID NO: 5311630 - DNA, 14 bp, Homo sapiens
tccgactccccctc

SEQ ID NO: 5311631 - DNA, 16 bp, Homo sapiens
tccgactccccctccc

SEQ ID NO: 5311632 - DNA, 18 bp, Homo sapiens
tccgactccccctccccg

SEQ ID NO: 5311633 - DNA, 16 bp, Homo sapiens
tccgactctaagctgt

SEQ ID NO: 5311634 - DNA, 17 bp, Homo sapiens
tccgactctaagctgtg

SEQ ID NO: 5311635 - DNA, 18 bp, Homo sapiens
tccgactctaagctgtgt

SEQ ID NO: 5311636 - DNA, 20 bp, Homo sapiens
tccgactctaagctgtgtgc

SEQ ID NO: 5311637 - DNA, 23 bp, Homo sapiens
tccgactctttctgagtgccttc

SEQ ID NO: 5311638 - DNA, 18 bp, Homo sapiens
tccgacttcccctgggca

SEQ ID NO: 5311639 - DNA, 19 bp, Homo sapiens
tccgacttcccctgggcaa

SEQ ID NO: 5311640 - DNA, 21 bp, Homo sapiens
tccgacttcccctgggcaaga

SEQ ID NO: 5311641 - DNA, 21 bp, Homo sapiens
tccgacttgaattttcccact

SEQ ID NO: 5311642 - DNA, 22 bp, Homo sapiens
tccgacttgaattttcccactg

SEQ ID NO: 5311643 - DNA, 14 bp, Homo sapiens
tccgagaacaacag

SEQ ID NO: 5311644 - DNA, 15 bp, Homo sapiens
tccgagacagtccag

SEQ ID NO: 5311645 - DNA, 17 bp, Homo sapiens
tccgagacagtccagtg

SEQ ID NO: 5311646 - DNA, 17 bp, Homo sapiens
tccgagacccccttttc

SEQ ID NO: 5311647 - DNA, 18 bp, Homo sapiens
tccgagacccccttttct

SEQ ID NO: 5311648 - DNA, 13 bp, Homo sapiens
tccgagaggctgg

SEQ ID NO: 5311649 - DNA, 16 bp, Homo sapiens
tccgagaggtgggcca

SEQ ID NO: 5311650 - DNA, 24 bp, Homo sapiens
tccgagatccccagggcagcctgg

SEQ ID NO: 5311651 - DNA, 17 bp, Homo sapiens
tccgagcattccagtaa

SEQ ID NO: 5311652 - DNA, 12 bp, Homo sapiens
tccgagcccctg

SEQ ID NO: 5311653 - DNA, 14 bp, Homo sapiens
tccgagcccctgtt

SEQ ID NO: 5311654 - DNA, 23 bp, Homo sapiens
tccgagcccctgtttctcctcca

SEQ ID NO: 5311655 - DNA, 17 bp, Homo sapiens
tccgagcctccagtcca

SEQ ID NO: 5311656 - DNA, 20 bp, Homo sapiens
tccgagcgacggctcctccc

SEQ ID NO: 5311657 - DNA, 12 bp, Homo sapiens
tccgagctctgg

SEQ ID NO: 5311658 - DNA, 15 bp, Homo sapiens
tccgagctctggtgc

SEQ ID NO: 5311659 - DNA, 19 bp, Homo sapiens
tccgagctgaggactctgc

SEQ ID NO: 5311660 - DNA, 23 bp, Homo sapiens
tccgagcttgggataaagcaagg

SEQ ID NO: 5311661 - DNA, 17 bp, Homo sapiens
tccgaggggctggagcg

SEQ ID NO: 5311662 - DNA, 23 bp, Homo sapiens
tccgaggtggtgggggcgccgca

SEQ ID NO: 5311663 - DNA, 21 bp, Homo sapiens
tccgaggttttgaggcgggaa

SEQ ID NO: 5311664 - DNA, 18 bp, Homo sapiens
tccgagtctttctcactg

SEQ ID NO: 5311665 - DNA, 12 bp, Homo sapiens
tccgagtggtga

SEQ ID NO: 5311666 - DNA, 13 bp, Homo sapiens
tccgagtgtgttt

SEQ ID NO: 5311667 - DNA, 13 bp, Homo sapiens
tccgatcaacatt

SEQ ID NO: 5311668 - DNA, 20 bp, Homo sapiens
tccgcaagagtaaaggaaat

SEQ ID NO: 5311669 - DNA, 21 bp, Homo sapiens
tccgcacacctctggctgtct

SEQ ID NO: 5311670 - DNA, 20 bp, Homo sapiens
tccgcaccagctgctctgcc

SEQ ID NO: 5311671 - DNA, 17 bp, Homo sapiens
tccgcaccctccctagc

SEQ ID NO: 5311672 - DNA, 22 bp, Homo sapiens
tccgcaccctgcctacgccagg

SEQ ID NO: 5311673 - DNA, 15 bp, Homo sapiens
tccgcaccctgtcct

SEQ ID NO: 5311674 - DNA, 22 bp, Homo sapiens
tccgcacctgaccgctgcccag

SEQ ID NO: 5311675 - DNA, 22 bp, Homo sapiens
tccgcacgcggccgctctccgc

SEQ ID NO: 5311676 - DNA, 15 bp, Homo sapiens
tccgcagaagccctg

SEQ ID NO: 5311677 - DNA, 15 bp, Homo sapiens
tccgcagcagggaag

SEQ ID NO: 5311678 - DNA, 17 bp, Homo sapiens
tccgcagcagggaagct

SEQ ID NO: 5311679 - DNA, 15 bp, Homo sapiens
tccgcaggtgctggt

SEQ ID NO: 5311680 - DNA, 18 bp, Homo sapiens
tccgcaggtgctggtccc

SEQ ID NO: 5311681 - DNA, 22 bp, Homo sapiens
tccgcagttgtagcagaaacca

SEQ ID NO: 5311682 - DNA, 13 bp, Homo sapiens
tccgcataagaaa

SEQ ID NO: 5311683 - DNA, 15 bp, Homo sapiens
tccgcataagaaaaa

SEQ ID NO: 5311684 - DNA, 19 bp, Homo sapiens
tccgcataagaaaaagaat

SEQ ID NO: 5311685 - DNA, 21 bp, Homo sapiens
tccgcatccctaccgacccag

SEQ ID NO: 5311686 - DNA, 17 bp, Homo sapiens
tccgcatccctgcttct

SEQ ID NO: 5311687 - DNA, 20 bp, Homo sapiens
tccgcatccctgcttctggc

SEQ ID NO: 5311688 - DNA, 17 bp, Homo sapiens
tccgcatgatgtttccc

SEQ ID NO: 5311689 - DNA, 13 bp, Homo sapiens
tccgcatgtgtct

SEQ ID NO: 5311690 - DNA, 15 bp, Homo sapiens
tccgcatgtgtctgt

SEQ ID NO: 5311691 - DNA, 19 bp, Homo sapiens
tccgcatgtgtctgtattc

SEQ ID NO: 5311692 - DNA, 17 bp, Homo sapiens
tccgcattggaagagcc

SEQ ID NO: 5311693 - DNA, 17 bp, Homo sapiens
tccgccaaacactccac

SEQ ID NO: 5311694 - DNA, 11 bp, Homo sapiens
tccgccactca

SEQ ID NO: 5311695 - DNA, 21 bp, Homo sapiens
tccgccactcagccatttccc

SEQ ID NO: 5311696 - DNA, 19 bp, Homo sapiens
tccgccactggggctcaga

SEQ ID NO: 5311697 - DNA, 21 bp, Homo sapiens
tccgccactggggctcagagc

SEQ ID NO: 5311698 - DNA, 13 bp, Homo sapiens
tccgccagacccc

SEQ ID NO: 5311699 - DNA, 20 bp, Homo sapiens
tccgccagaccccgtggctc

SEQ ID NO: 5311700 - DNA, 21 bp, Homo sapiens
tccgccagaccccgtggctct

SEQ ID NO: 5311701 - DNA, 22 bp, Homo sapiens
tccgccagaccccgtggctctg

SEQ ID NO: 5311702 - DNA, 18 bp, Homo sapiens
tccgccagccacaggacc

SEQ ID NO: 5311703 - DNA, 19 bp, Homo sapiens
tccgccagccacaggacca

SEQ ID NO: 5311704 - DNA, 21 bp, Homo sapiens
tccgccagccacaggaccacc

SEQ ID NO: 5311705 - DNA, 15 bp, Homo sapiens
tccgccagcctcctc

SEQ ID NO: 5311706 - DNA, 16 bp, Homo sapiens
tccgccagcctcctct

SEQ ID NO: 5311707 - DNA, 23 bp, Homo sapiens
tccgccatccagggtctggcaga

SEQ ID NO: 5311708 - DNA, 22 bp, Homo sapiens
tccgccatggggtcggctcctg

SEQ ID NO: 5311709 - DNA, 15 bp, Homo sapiens
tccgccatggtgtcc

SEQ ID NO: 5311710 - DNA, 13 bp, Homo sapiens
tccgcccaaatca

SEQ ID NO: 5311711 - DNA, 18 bp, Homo sapiens
tccgcccactcctgggac

SEQ ID NO: 5311712 - DNA, 17 bp, Homo sapiens
tccgcccatccctgacc

SEQ ID NO: 5311713 - DNA, 15 bp, Homo sapiens
tccgccccagacaca

SEQ ID NO: 5311714 - DNA, 16 bp, Homo sapiens
tccgccccagacacac

SEQ ID NO: 5311715 - DNA, 12 bp, Homo sapiens
tccgcccccagc

SEQ ID NO: 5311716 - DNA, 14 bp, Homo sapiens
tccgcccccagcct

SEQ ID NO: 5311717 - DNA, 15 bp, Homo sapiens
tccgcccccaggtag

SEQ ID NO: 5311718 - DNA, 13 bp, Homo sapiens
tccgcccccatgc

SEQ ID NO: 5311719 - DNA, 21 bp, Homo sapiens
tccgccccgtccccccatccc

SEQ ID NO: 5311720 - DNA, 16 bp, Homo sapiens
tccgccccgtgctcct

SEQ ID NO: 5311721 - DNA, 19 bp, Homo sapiens
tccgccccgtgctcctctg

SEQ ID NO: 5311722 - DNA, 16 bp, Homo sapiens
tccgcccctgagccca

SEQ ID NO: 5311723 - DNA, 18 bp, Homo sapiens
tccgcccctgagcccact

SEQ ID NO: 5311724 - DNA, 17 bp, Homo sapiens
tccgcccgcccaccccg

SEQ ID NO: 5311725 - DNA, 21 bp, Homo sapiens
tccgcccgctcctgccgcaga

SEQ ID NO: 5311726 - DNA, 23 bp, Homo sapiens
tccgcccgcttccctccttcatg

SEQ ID NO: 5311727 - DNA, 14 bp, Homo sapiens
tccgccctgcagca

SEQ ID NO: 5311728 - DNA, 17 bp, Homo sapiens
tccgccctgctcctccc

SEQ ID NO: 5311729 - DNA, 13 bp, Homo sapiens
tccgcccttccct

SEQ ID NO: 5311730 - DNA, 16 bp, Homo sapiens
tccgcctactgtccct

SEQ ID NO: 5311731 - DNA, 12 bp, Homo sapiens
tccgcctcctgt

SEQ ID NO: 5311732 - DNA, 15 bp, Homo sapiens
tccgcctctgagcca

SEQ ID NO: 5311733 - DNA, 21 bp, Homo sapiens
tccgcctctgagccaggagcc

SEQ ID NO: 5311734 - DNA, 15 bp, Homo sapiens
tccgcctgaaagtgt

SEQ ID NO: 5311735 - DNA, 20 bp, Homo sapiens
tccgcctgaggccagcctgc

SEQ ID NO: 5311736 - DNA, 22 bp, Homo sapiens
tccgcctgcagaggacagagct

SEQ ID NO: 5311737 - DNA, 17 bp, Homo sapiens
tccgcctgcctctgcct

SEQ ID NO: 5311738 - DNA, 13 bp, Homo sapiens
tccgcctgcgcct

SEQ ID NO: 5311739 - DNA, 16 bp, Homo sapiens
tccgcctggcccggga

SEQ ID NO: 5311740 - DNA, 18 bp, Homo sapiens
tccgcctggccggctcca

SEQ ID NO: 5311741 - DNA, 19 bp, Homo sapiens
tccgcctggccggctccag

SEQ ID NO: 5311742 - DNA, 16 bp, Homo sapiens
tccgcctggcctggcc

SEQ ID NO: 5311743 - DNA, 20 bp, Homo sapiens
tccgcctgggtcatgggcct

SEQ ID NO: 5311744 - DNA, 23 bp, Homo sapiens
tccgcctgggtcatgggcctgtg

SEQ ID NO: 5311745 - DNA, 11 bp, Homo sapiens
tccgcctgtcc

SEQ ID NO: 5311746 - DNA, 12 bp, Homo sapiens
tccgcctgtggg

SEQ ID NO: 5311747 - DNA, 17 bp, Homo sapiens
tccgccttcactccggt

SEQ ID NO: 5311748 - DNA, 17 bp, Homo sapiens
tccgcctttacaaggga

SEQ ID NO: 5311749 - DNA, 22 bp, Homo sapiens
tccgcctttccggggctgctgg

SEQ ID NO: 5311750 - DNA, 18 bp, Homo sapiens
tccgccttttgtatacat

SEQ ID NO: 5311751 - DNA, 16 bp, Homo sapiens
tccgcgccgatgccac

SEQ ID NO: 5311752 - DNA, 17 bp, Homo sapiens
tccgcgccgatgccacc

SEQ ID NO: 5311753 - DNA, 19 bp, Homo sapiens
tccgcgccgatgccaccgg

SEQ ID NO: 5311754 - DNA, 16 bp, Homo sapiens
tccgcgctcggggctg

SEQ ID NO: 5311755 - DNA, 15 bp, Homo sapiens
tccgcggaggcccct

SEQ ID NO: 5311756 - DNA, 17 bp, Homo sapiens
tccgcggaggcccctga

SEQ ID NO: 5311757 - DNA, 17 bp, Homo sapiens
tccgcggcggcttcgcg

SEQ ID NO: 5311758 - DNA, 18 bp, Homo sapiens
tccgcgggagaccccttg

SEQ ID NO: 5311759 - DNA, 20 bp, Homo sapiens
tccgcgggctgactgggcca

SEQ ID NO: 5311760 - DNA, 23 bp, Homo sapiens
tccgcgggctgactgggccacag

SEQ ID NO: 5311761 - DNA, 23 bp, Homo sapiens
tccgcgggtcccggccgcgccgc

SEQ ID NO: 5311762 - DNA, 15 bp, Homo sapiens
tccgcgggtgggact

SEQ ID NO: 5311763 - DNA, 21 bp, Homo sapiens
tccgcgtcctttcctctcctc

SEQ ID NO: 5311764 - DNA, 16 bp, Homo sapiens
tccgctaaatatttac

SEQ ID NO: 5311765 - DNA, 16 bp, Homo sapiens
tccgctaagacctccc

SEQ ID NO: 5311766 - DNA, 14 bp, Homo sapiens
tccgctagaagtct

SEQ ID NO: 5311767 - DNA, 15 bp, Homo sapiens
tccgctatccaccaa

SEQ ID NO: 5311768 - DNA, 17 bp, Homo sapiens
tcctatccactgggcac

SEQ ID NO: 5311769 - DNA, 18 bp, Homo sapiens
tcctatcccatcccatcc

SEQ ID NO: 5311770 - DNA, 13 bp, Homo sapiens
tcctatccccgga

SEQ ID NO: 5311771 - DNA, 18 bp, Homo sapiens
tcctatcccgtgagtgga

SEQ ID NO: 5311772 - DNA, 13 bp, Homo sapiens
tcctatccttata

SEQ ID NO: 5311773 - DNA, 19 bp, Homo sapiens
tcctatccttggagagcag

SEQ ID NO: 5311774 - DNA, 15 bp, Homo sapiens
tcctatcgactttat

SEQ ID NO: 5311775 - DNA, 23 bp, Homo sapiens
tcctatctagcatttatttctct

SEQ ID NO: 5311776 - DNA, 17 bp, Homo sapiens
tcctatctatcttccaa

SEQ ID NO: 5311777 - DNA, 14 bp, Homo sapiens
tcctatctccctgg

SEQ ID NO: 5311778 - DNA, 13 bp, Homo sapiens
tcctatctgggct

SEQ ID NO: 5311779 - DNA, 18 bp, Homo sapiens
tcctatctggggagctcc

SEQ ID NO: 5311780 - DNA, 22 bp, Homo sapiens
tcctatctgtatgtctgcctaa

SEQ ID NO: 5311781 - DNA, 22 bp, Homo sapiens
tcctatcttcatatctatcaga

SEQ ID NO: 5311782 - DNA, 13 bp, Homo sapiens
tcctatctttaca

SEQ ID NO: 5311783 - DNA, 17 bp, Homo sapiens
tcctatcttttatttca

SEQ ID NO: 5311784 - DNA, 17 bp, Homo sapiens
tcctatgaatgctttgc

SEQ ID NO: 5311785 - DNA, 20 bp, Homo sapiens
tcctatgactcaaagatgaa

SEQ ID NO: 5311786 - DNA, 20 bp, Homo sapiens
tcctatgatggatggcagac

SEQ ID NO: 5311787 - DNA, 21 bp, Homo sapiens
tcctatgatggatggcagact

SEQ ID NO: 5311788 - DNA, 22 bp, Homo sapiens
tcctatgatgtatactgccact

SEQ ID NO: 5311789 - DNA, 21 bp, Homo sapiens
tcctatgcatggtttcagcac

SEQ ID NO: 5311790 - DNA, 22 bp, Homo sapiens
tcctatgcatggtttcagcact

SEQ ID NO: 5311791 - DNA, 16 bp, Homo sapiens
tcctatgcccaggtac

SEQ ID NO: 5311792 - DNA, 15 bp, Homo sapiens
tcctatgccttcaaa

SEQ ID NO: 5311793 - DNA, 22 bp, Homo sapiens
tcctatgctattgacaataaaa

SEQ ID NO: 5311794 - DNA, 15 bp, Homo sapiens
tcctatgcttaataa

SEQ ID NO: 5311795 - DNA, 13 bp, Homo sapiens
tcctatggaaaca

SEQ ID NO: 5311796 - DNA, 20 bp, Homo sapiens
tcctatggctggccactgca

SEQ ID NO: 5311797 - DNA, 21 bp, Homo sapiens
tcctatgtacagagctttctt

SEQ ID NO: 5311798 - DNA, 17 bp, Homo sapiens
tcctatgtatatcttct

SEQ ID NO: 5311799 - DNA, 21 bp, Homo sapiens
tcctatgtgattttaactctg

SEQ ID NO: 5311800 - DNA, 23 bp, Homo sapiens
tcctatgtgattttaactctgtc

SEQ ID NO: 5311801 - DNA, 16 bp, Homo sapiens
tcctatgtggcagctg

SEQ ID NO: 5311802 - DNA, 12 bp, Homo sapiens
tcctatgtgtga

SEQ ID NO: 5311803 - DNA, 19 bp, Homo sapiens
tcctatgtgtgcctcctag

SEQ ID NO: 5311804 - DNA, 18 bp, Homo sapiens
tcctattaaaacacagct

SEQ ID NO: 5311805 - DNA, 19 bp, Homo sapiens
tcctattaaaacacagctt

SEQ ID NO: 5311806 - DNA, 15 bp, Homo sapiens
tcctattaatttatt

SEQ ID NO: 5311807 - DNA, 19 bp, Homo sapiens
tcctattactgatgtgtgc

SEQ ID NO: 5311808 - DNA, 16 bp, Homo sapiens
tcctattacttttcat

SEQ ID NO: 5311809 - DNA, 17 bp, Homo sapiens
tcctattcaaattccta

SEQ ID NO: 5311810 - DNA, 14 bp, Homo sapiens
tcctattcagttcc

SEQ ID NO: 5311811 - DNA, 17 bp, Homo sapiens
tcctattctcaccagga

SEQ ID NO: 5311812 - DNA, 15 bp, Homo sapiens
tcctattctcctgcc

SEQ ID NO: 5311813 - DNA, 16 bp, Homo sapiens
tcctattctttgccac

SEQ ID NO: 5311814 - DNA, 22 bp, Homo sapiens
tcctattgtgatttgactgttt

SEQ ID NO: 5311815 - DNA, 17 bp, Homo sapiens
tcctatttaaagacctg

SEQ ID NO: 5311816 - DNA, 15 bp, Homo sapiens
tcctatttagacatg

SEQ ID NO: 5311817 - DNA, 16 bp, Homo sapiens
tcctatttatttgagg

SEQ ID NO: 5311818 - DNA, 12 bp, Homo sapiens
tcctatttcaga

SEQ ID NO: 5311819 - DNA, 13 bp, Homo sapiens
tcctatttcagaa

SEQ ID NO: 5311820 - DNA, 13 bp, Homo sapiens
tcctatttcagta

SEQ ID NO: 5311821 - DNA, 21 bp, Homo sapiens
tcctatttcagtacttcagca

SEQ ID NO: 5311822 - DNA, 15 bp, Homo sapiens
tcctatttcttatag

SEQ ID NO: 5311823 - DNA, 17 bp, Homo sapiens
tcctatttgcagttact

SEQ ID NO: 5311824 - DNA, 14 bp, Homo sapiens
tcctattttaaaac

SEQ ID NO: 5311825 - DNA, 16 bp, Homo sapiens
tcctattttaaaacca

SEQ ID NO: 5311826 - DNA, 22 bp, Homo sapiens
tcctattttaaaaccatgcagc

SEQ ID NO: 5311827 - DNA, 16 bp, Homo sapiens
tcctattttggagtgg

SEQ ID NO: 5311828 - DNA, 13 bp, Homo sapiens
tcctatttttgta

SEQ ID NO: 5311829 - DNA, 14 bp, Homo sapiens
tcctatttttgtaa

SEQ ID NO: 5311830 - DNA, 17 bp, Homo sapiens
tcctatttttgtaaact

SEQ ID NO: 5311831 - DNA, 16 bp, Homo sapiens
tcctatttttgtgaag

SEQ ID NO: 5311832 - DNA, 17 bp, Homo sapiens
tcctatttttgtgaaga

SEQ ID NO: 5311833 - DNA, 19 bp, Homo sapiens
tcctcaaaaagcagaagga

SEQ ID NO: 5311834 - DNA, 20 bp, Homo sapiens
tcctcaaaaagcagaaggag

SEQ ID NO: 5311835 - DNA, 14 bp, Homo sapiens
tcctcaaaaatcat

SEQ ID NO: 5311836 - DNA, 19 bp, Homo sapiens
tcctcaaaaatcatcaaag

SEQ ID NO: 5311837 - DNA, 20 bp, Homo sapiens
tcctcaaaacttcagacata

SEQ ID NO: 5311838 - DNA, 14 bp, Homo sapiens
tcctcaaacaacac

SEQ ID NO: 5311839 - DNA, 14 bp, Homo sapiens
tcctcaaacacaca

SEQ ID NO: 5311840 - DNA, 14 bp, Homo sapiens
tcctcaaaccactt

SEQ ID NO: 5311841 - DNA, 15 bp, Homo sapiens
tcctcaaagcctcaa

SEQ ID NO: 5311842 - DNA, 23 bp, Homo sapiens
tcctcaaagggtgccttctagct

SEQ ID NO: 5311843 - DNA, 18 bp, Homo sapiens
tcctcaaataagtcttcc

SEQ ID NO: 5311844 - DNA, 16 bp, Homo sapiens
tcctcaaatcaaaaac

SEQ ID NO: 5311845 - DNA, 24 bp, Homo sapiens
tcctcaaatcaaaaacaggcaggt

SEQ ID NO: 5311846 - DNA, 19 bp, Homo sapiens
tcctcaaattttttgactt

SEQ ID NO: 5311847 - DNA, 17 bp, Homo sapiens
tcctcaacccacatggg

SEQ ID NO: 5311848 - DNA, 23 bp, Homo sapiens
tcctcaagaaataaaaggaagcc

SEQ ID NO: 5311849 - DNA, 13 bp, Homo sapiens
tcctcaagacttt

SEQ ID NO: 5311850 - DNA, 18 bp, Homo sapiens
tcctcaagcaataattgt

SEQ ID NO: 5311851 - DNA, 19 bp, Homo sapiens
tcctcaagcaataattgtt

SEQ ID NO: 5311852 - DNA, 23 bp, Homo sapiens
tcctcaagcaataattgtttcca

SEQ ID NO: 5311853 - DNA, 13 bp, Homo sapiens
tcctcaagcctgt

SEQ ID NO: 5311854 - DNA, 15 bp, Homo sapiens
tcctcaagcctgtgg

SEQ ID NO: 5311855 - DNA, 20 bp, Homo sapiens
tcctcaagcctgtgggcagc

SEQ ID NO: 5311856 - DNA, 18 bp, Homo sapiens
tcctcaagggcagagaac

SEQ ID NO: 5311857 - DNA, 14 bp, Homo sapiens
tcctcaaggggcca

SEQ ID NO: 5311858 - DNA, 21 bp, Homo sapiens
tcctcaaggggccatcctgtc

SEQ ID NO: 5311859 - DNA, 14 bp, Homo sapiens
tcctcaatccagct

SEQ ID NO: 5311860 - DNA, 20 bp, Homo sapiens
tcctcacacacggaggccag

SEQ ID NO: 5311861 - DNA, 20 bp, Homo sapiens
tcctcacacccacctgctgc

SEQ ID NO: 5311862 - DNA, 23 bp, Homo sapiens
tcctcacacccacctgctgctgt

SEQ ID NO: 5311863 - DNA, 14 bp, Homo sapiens
tcctcacacccctg

SEQ ID NO: 5311864 - DNA, 12 bp, Homo sapiens
tcctcacactcc

SEQ ID NO: 5311865 - DNA, 16 bp, Homo sapiens
tcctcacactgctgtc

SEQ ID NO: 5311866 - DNA, 20 bp, Homo sapiens
tcctcacactgctgtcctct

SEQ ID NO: 5311867 - DNA, 21 bp, Homo sapiens
tcctcacactgctgtcctctc

SEQ ID NO: 5311868 - DNA, 22 bp, Homo sapiens
tcctcacactgctgtcctctcc

SEQ ID NO: 5311869 - DNA, 15 bp, Homo sapiens
tcctcacacttactg

SEQ ID NO: 5311870 - DNA, 13 bp, Homo sapiens
tcctcacagcagt

SEQ ID NO: 5311871 - DNA, 15 bp, Homo sapiens
tcctcacagcctctc

SEQ ID NO: 5311872 - DNA, 21 bp, Homo sapiens
tcctcacaggagcagacagag

SEQ ID NO: 5311873 - DNA, 21 bp, Homo sapiens
tcctcacagttgccatgtaga

SEQ ID NO: 5311874 - DNA, 15 bp, Homo sapiens
tcctcacatgcccgc

SEQ ID NO: 5311875 - DNA, 16 bp, Homo sapiens
tcctcaccaataactt

SEQ ID NO: 5311876 - DNA, 13 bp, Homo sapiens
tcctcacccacct

SEQ ID NO: 5311877 - DNA, 17 bp, Homo sapiens
tcctcacccacctctgg

SEQ ID NO: 5311878 - DNA, 20 bp, Homo sapiens
tcctcacccagggcccccaa

SEQ ID NO: 5311879 - DNA, 15 bp, Homo sapiens
tcctcaccccagtgc

SEQ ID NO: 5311880 - DNA, 23 bp, Homo sapiens
tcctcaccccagtgcctgtctgg

SEQ ID NO: 5311881 - DNA, 21 bp, Homo sapiens
tcctcacccccacccctgtac

SEQ ID NO: 5311882 - DNA, 16 bp, Homo sapiens
tcctcacccccagctt

SEQ ID NO: 5311883 - DNA, 13 bp, Homo sapiens
tcctcacccctgt

SEQ ID NO: 5311884 - DNA, 15 bp, Homo sapiens
tcctcacccctgtcc

SEQ ID NO: 5311885 - DNA, 17 bp, Homo sapiens
tcctcaccccttccttt

SEQ ID NO: 5311886 - DNA, 17 bp, Homo sapiens
tcctcaccctgtgggac

SEQ ID NO: 5311887 - DNA, 19 bp, Homo sapiens
tcctcaccctgtgggaccg

SEQ ID NO: 5311888 - DNA, 20 bp, Homo sapiens
tcctcaccctgtgggaccgc

SEQ ID NO: 5311889 - DNA, 12 bp, Homo sapiens
tcctcacctctg

SEQ ID NO: 5311890 - DNA, 15 bp, Homo sapiens
tcctcacctctggac

SEQ ID NO: 5311891 - DNA, 16 bp, Homo sapiens
tcctcacctctggact

SEQ ID NO: 5311892 - DNA, 12 bp, Homo sapiens
tcctcacctggt

SEQ ID NO: 5311893 - DNA, 13 bp, Homo sapiens
tcctcacctggtt

SEQ ID NO: 5311894 - DNA, 18 bp, Homo sapiens
tcctcacgccccctgtga

SEQ ID NO: 5311895 - DNA, 21 bp, Homo sapiens
tcctcacgccccctgtgactt

SEQ ID NO: 5311896 - DNA, 23 bp, Homo sapiens
tcctcacgtgcaggacagctctt

SEQ ID NO: 5311897 - DNA, 13 bp, Homo sapiens
tcctcactaaaaa

SEQ ID NO: 5311898 - DNA, 12 bp, Homo sapiens
tcctcactccct

SEQ ID NO: 5311899 - DNA, 19 bp, Homo sapiens
tcctcactcccttcccata

SEQ ID NO: 5311900 - DNA, 23 bp, Homo sapiens
tcctcactcgggtttctctgtgg

SEQ ID NO: 5311901 - DNA, 22 bp, Homo sapiens
tcctcactgagaaggccccagg

SEQ ID NO: 5311902 - DNA, 23 bp, Homo sapiens
tcctcactgagaaggccccaggg

SEQ ID NO: 5311903 - DNA, 13 bp, Homo sapiens
tcctcactgccac

SEQ ID NO: 5311904 - DNA, 15 bp, Homo sapiens
tcctcactgccacta

SEQ ID NO: 5311905 - DNA, 12 bp, Homo sapiens
tcctcactgccc

SEQ ID NO: 5311906 - DNA, 14 bp, Homo sapiens
tcctcactgcccca

SEQ ID NO: 5311907 - DNA, 17 bp, Homo sapiens
tcctcactgctccctga

SEQ ID NO: 5311908 - DNA, 20 bp, Homo sapiens
tcctcactgctccctgaagc

SEQ ID NO: 5311909 - DNA, 23 bp, Homo sapiens
tcctcactggaggagcagcttcc

SEQ ID NO: 5311910 - DNA, 13 bp, Homo sapiens
tcctcactggcca

SEQ ID NO: 5311911 - DNA, 18 bp, Homo sapiens
tcctcactggccatccct

SEQ ID NO: 5311912 - DNA, 22 bp, Homo sapiens
tcctcactggccatccctcgtg

SEQ ID NO: 5311913 - DNA, 16 bp, Homo sapiens
tcctcactgggctcac

SEQ ID NO: 5311914 - DNA, 22 bp, Homo sapiens
tcctcactgggtggggtgagga

SEQ ID NO: 5311915 - DNA, 16 bp, Homo sapiens
tcctcactgtcctgtt

SEQ ID NO: 5311916 - DNA, 22 bp, Homo sapiens
tcctcactgtggtaaatgccac

SEQ ID NO: 5311917 - DNA, 22 bp, Homo sapiens
tcctcacttccatacagctcta

SEQ ID NO: 5311918 - DNA, 17 bp, Homo sapiens
tcctcacttctgtctcc

SEQ ID NO: 5311919 - DNA, 19 bp, Homo sapiens
tcctcacttggctgtctga

SEQ ID NO: 5311920 - DNA, 24 bp, Homo sapiens
tcctcacttttcaatttgtcatgt

SEQ ID NO: 5311921 - DNA, 22 bp, Homo sapiens
tcctcagaaccattcactggca

SEQ ID NO: 5311922 - DNA, 23 bp, Homo sapiens
tcctcagaatagtgatgtgttcg

SEQ ID NO: 5311923 - DNA, 17 bp, Homo sapiens
tcctcagaatgatttgt

SEQ ID NO: 5311924 - DNA, 15 bp, Homo sapiens
tcctcagactgctca

SEQ ID NO: 5311925 - DNA, 17 bp, Homo sapiens
tcctcagagaatttcta

SEQ ID NO: 5311926 - DNA, 20 bp, Homo sapiens
tcctcagagcaggggccaga

SEQ ID NO: 5311927 - DNA, 14 bp, Homo sapiens
tcctcagagctcca

SEQ ID NO: 5311928 - DNA, 19 bp, Homo sapiens
tcctcagagctccatgctg

SEQ ID NO: 5311929 - DNA, 16 bp, Homo sapiens
tcctcagaggctgagc

SEQ ID NO: 5311930 - DNA, 20 bp, Homo sapiens
tcctcagaggctgagccctg

SEQ ID NO: 5311931 - DNA, 16 bp, Homo sapiens
tcctcagatgatgttt

SEQ ID NO: 5311932 - DNA, 13 bp, Homo sapiens
tcctcagatgggg

SEQ ID NO: 5311933 - DNA, 19 bp, Homo sapiens
tcctcagcatttcttttct

SEQ ID NO: 5311934 - DNA, 17 bp, Homo sapiens
tcctcagccagcctcct

SEQ ID NO: 5311935 - DNA, 12 bp, Homo sapiens
tcctcagccagt

SEQ ID NO: 5311936 - DNA, 14 bp, Homo sapiens
tcctcagccccagg

SEQ ID NO: 5311937 - DNA, 15 bp, Homo sapiens
tcctcagccccaggg

SEQ ID NO: 5311938 - DNA, 20 bp, Homo sapiens
tcctcagcccccaggccagg

SEQ ID NO: 5311939 - DNA, 20 bp, Homo sapiens
tcctcagccctctcttgcca

SEQ ID NO: 5311940 - DNA, 12 bp, Homo sapiens
tcctcagcctcc

SEQ ID NO: 5311941 - DNA, 22 bp, Homo sapiens
tcctcagcctcccaagtagctg

SEQ ID NO: 5311942 - DNA, 20 bp, Homo sapiens
tcctcagcctcctcatctgg

SEQ ID NO: 5311943 - DNA, 15 bp, Homo sapiens
tcctcagcctctgca

SEQ ID NO: 5311944 - DNA, 16 bp, Homo sapiens
tcctcagcctctgcaa

SEQ ID NO: 5311945 - DNA, 17 bp, Homo sapiens
tcctcagcctctgcaac

SEQ ID NO: 5311946 - DNA, 15 bp, Homo sapiens
tcctcctctcctgga

SEQ ID NO: 5311947 - DNA, 22 bp, Homo sapiens
tcctcctctgcctacagccagg

SEQ ID NO: 5311948 - DNA, 14 bp, Homo sapiens
tcctcctctgtgct

SEQ ID NO: 5311949 - DNA, 17 bp, Homo sapiens
tcctcctgaagcctctg

SEQ ID NO: 5311950 - DNA, 18 bp, Homo sapiens
tcctcctgaagcctctgc

SEQ ID NO: 5311951 - DNA, 16 bp, Homo sapiens
tcctcctgagagctgt

SEQ ID NO: 5311952 - DNA, 17 bp, Homo sapiens
tcctcctgagtagctgg

SEQ ID NO: 5311953 - DNA, 23 bp, Homo sapiens
tcctcctgagtgatcccatttct

SEQ ID NO: 5311954 - DNA, 12 bp, Homo sapiens
tcctcctgatgg

SEQ ID NO: 5311955 - DNA, 13 bp, Homo sapiens
tcctcctgatggc

SEQ ID NO: 5311956 - DNA, 23 bp, Homo sapiens
tcctcctgatggccaagagcatc

SEQ ID NO: 5311957 - DNA, 13 bp, Homo sapiens
tcctcctgcagac

SEQ ID NO: 5311958 - DNA, 14 bp, Homo sapiens
tcctcctgcagaca

SEQ ID NO: 5311959 - DNA, 23 bp, Homo sapiens
tcctcctgcagacacctggactg

SEQ ID NO: 5311960 - DNA, 15 bp, Homo sapiens
tcctcctgcagacca

SEQ ID NO: 5311961 - DNA, 11 bp, Homo sapiens
tcctcctgcat

SEQ ID NO: 5311962 - DNA, 12 bp, Homo sapiens
tcctcctgccca

SEQ ID NO: 5311963 - DNA, 17 bp, Homo sapiens
tcctcctgcccacctgt

SEQ ID NO: 5311964 - DNA, 21 bp, Homo sapiens
tcctcctgcccccaccccagg

SEQ ID NO: 5311965 - DNA, 13 bp, Homo sapiens
tcctcctgccctc

SEQ ID NO: 5311966 - DNA, 15 bp, Homo sapiens
tcctcctgccctccg

SEQ ID NO: 5311967 - DNA, 15 bp, Homo sapiens
tcctcctgccctcct

SEQ ID NO: 5311968 - DNA, 15 bp, Homo sapiens
tcctcctgccctgtc

SEQ ID NO: 5311969 - DNA, 16 bp, Homo sapiens
tcctcctgccctgtcc

SEQ ID NO: 5311970 - DNA, 19 bp, Homo sapiens
tcctcctgccctgtccctg

SEQ ID NO: 5311971 - DNA, 20 bp, Homo sapiens
tcctcctgcctcagccttcc

SEQ ID NO: 5311972 - DNA, 11 bp, Homo sapiens
tcctcctgctc

SEQ ID NO: 5311973 - DNA, 20 bp, Homo sapiens
tcctcctgctctgcttcctc

SEQ ID NO: 5311974 - DNA, 14 bp, Homo sapiens
tcctcctgctgcca

SEQ ID NO: 5311975 - DNA, 11 bp, Homo sapiens
tcctcctgctt

SEQ ID NO: 5311976 - DNA, 19 bp, Homo sapiens
tcctcctggaaccttgctg

SEQ ID NO: 5311977 - DNA, 22 bp, Homo sapiens
tcctcctggaaccttgctgtcc

SEQ ID NO: 5311978 - DNA, 12 bp, Homo sapiens
tcctcctggaag

SEQ ID NO: 5311979 - DNA, 14 bp, Homo sapiens
tcctcctggagcag

SEQ ID NO: 5311980 - DNA, 12 bp, Homo sapiens
tcctcctgggct

SEQ ID NO: 5311981 - DNA, 17 bp, Homo sapiens
tcctcctgggctccaga

SEQ ID NO: 5311982 - DNA, 18 bp, Homo sapiens
tcctcctgggctccagag

SEQ ID NO: 5311983 - DNA, 20 bp, Homo sapiens
tcctcctgggggctggctcc

SEQ ID NO: 5311984 - DNA, 21 bp, Homo sapiens
tcctcctggtgggtccagggg

SEQ ID NO: 5311985 - DNA, 18 bp, Homo sapiens
tcctcctgtcttggcctc

SEQ ID NO: 5311986 - DNA, 18 bp, Homo sapiens
tcctcctgtgctatttgt

SEQ ID NO: 5311987 - DNA, 16 bp, Homo sapiens
tcctcctgtgtacagg

SEQ ID NO: 5311988 - DNA, 13 bp, Homo sapiens
tcctcctgtgtga

SEQ ID NO: 5311989 - DNA, 22 bp, Homo sapiens
tcctcctgttcctgccttctct

SEQ ID NO: 5311990 - DNA, 21 bp, Homo sapiens
tcctccttaaaacagagaagg

SEQ ID NO: 5311991 - DNA, 15 bp, Homo sapiens
tcctccttcactgtt

SEQ ID NO: 5311992 - DNA, 16 bp, Homo sapiens
tcctccttcactgttt

SEQ ID NO: 5311993 - DNA, 15 bp, Homo sapiens
tcctccttccaggcc

SEQ ID NO: 5311994 - DNA, 19 bp, Homo sapiens
tcctccttccaggccccag

SEQ ID NO: 5311995 - DNA, 21 bp, Homo sapiens
tcctccttccaggccccaggc

SEQ ID NO: 5311996 - DNA, 23 bp, Homo sapiens
tcctccttccaggccccaggctg

SEQ ID NO: 5311997 - DNA, 13 bp, Homo sapiens
tcctccttccatg

SEQ ID NO: 5311998 - DNA, 13 bp, Homo sapiens
tcctccttcccaa

SEQ ID NO: 5311999 - DNA, 13 bp, Homo sapiens
tcctccttcctgg

SEQ ID NO: 5312000 - DNA, 18 bp, Homo sapiens
tcctccttcctgggaccc

SEQ ID NO: 5312001 - DNA, 14 bp, Homo sapiens
tcctccttgggcag

SEQ ID NO: 5312002 - DNA, 19 bp, Homo sapiens
tcctccttgggcagggtct

SEQ ID NO: 5312003 - DNA, 17 bp, Homo sapiens
tcctccttggtgcctgg

SEQ ID NO: 5312004 - DNA, 19 bp, Homo sapiens
tcctccttggtgcctggcc

SEQ ID NO: 5312005 - DNA, 23 bp, Homo sapiens
tcctcctttactttctctctcct

SEQ ID NO: 5312006 - DNA, 11 bp, Homo sapiens
tcctcctttct

SEQ ID NO: 5312007 - DNA, 15 bp, Homo sapiens
tcctcctttctgagg

SEQ ID NO: 5312008 - DNA, 17 bp, Homo sapiens
tcctcctttctttgctg

SEQ ID NO: 5312009 - DNA, 18 bp, Homo sapiens
tcctcctttgcctaggag

SEQ ID NO: 5312010 - DNA, 19 bp, Homo sapiens
tcctcctttgtttaataaa

SEQ ID NO: 5312011 - DNA, 21 bp, Homo sapiens
tcctccttttcacagttctct

SEQ ID NO: 5312012 - DNA, 14 bp, Homo sapiens
tcctccttttcact

SEQ ID NO: 5312013 - DNA, 16 bp, Homo sapiens
tcctccttttcacttt

SEQ ID NO: 5312014 - DNA, 22 bp, Homo sapiens
tcctccttttcttcaccctccc

SEQ ID NO: 5312015 - DNA, 11 bp, Homo sapiens
tcctccttttt

SEQ ID NO: 5312016 - DNA, 14 bp, Homo sapiens
tcctcgaacccact

SEQ ID NO: 5312017 - DNA, 20 bp, Homo sapiens
tcctcgaagccatgtgctgc

SEQ ID NO: 5312018 - DNA, 17 bp, Homo sapiens
tcctcgacatcactgtt

SEQ ID NO: 5312019 - DNA, 16 bp, Homo sapiens
tcctcgagatcccaac

SEQ ID NO: 5312020 - DNA, 17 bp, Homo sapiens
tcctcgagccctccccc

SEQ ID NO: 5312021 - DNA, 17 bp, Homo sapiens
tcctcgagggcagggac

SEQ ID NO: 5312022 - DNA, 20 bp, Homo sapiens
tcctcgatgggagggatggc

SEQ ID NO: 5312023 - DNA, 13 bp, Homo sapiens
tcctcgcaagctg

SEQ ID NO: 5312024 - DNA, 18 bp, Homo sapiens
tcctcgcacacactggct

SEQ ID NO: 5312025 - DNA, 20 bp, Homo sapiens
tcctcgcacagggcatgcct

SEQ ID NO: 5312026 - DNA, 21 bp, Homo sapiens
tcctcgcacagggcatgcctg

SEQ ID NO: 5312027 - DNA, 17 bp, Homo sapiens
tcctcgcagagaggcca

SEQ ID NO: 5312028 - DNA, 23 bp, Homo sapiens
tcctcgcagagaggccaggtgca

SEQ ID NO: 5312029 - DNA, 24 bp, Homo sapiens
tcctcgcagagaggccaggtgcag

SEQ ID NO: 5312030 - DNA, 21 bp, Homo sapiens
tcctcgcagcctctcagtgcc

SEQ ID NO: 5312031 - DNA, 20 bp, Homo sapiens
tcctcgcccccaccagtgta

SEQ ID NO: 5312032 - DNA, 14 bp, Homo sapiens
tcctcgccctgggt

SEQ ID NO: 5312033 - DNA, 17 bp, Homo sapiens
tcctcgctctgggatgc

SEQ ID NO: 5312034 - DNA, 12 bp, Homo sapiens
tcctcgctgtgc

SEQ ID NO: 5312035 - DNA, 18 bp, Homo sapiens
tcctcgctgtgccaccac

SEQ ID NO: 5312036 - DNA, 16 bp, Homo sapiens
tcctcggactgtgtgc

SEQ ID NO: 5312037 - DNA, 17 bp, Homo sapiens
tcctcggagagcagcag

SEQ ID NO: 5312038 - DNA, 16 bp, Homo sapiens
tcctcggccagagctc

SEQ ID NO: 5312039 - DNA, 22 bp, Homo sapiens
tcctcggccagagctcccagga

SEQ ID NO: 5312040 - DNA, 17 bp, Homo sapiens
tcctcggccctgtagcc

SEQ ID NO: 5312041 - DNA, 19 bp, Homo sapiens
tcctcggccctgtagccct

SEQ ID NO: 5312042 - DNA, 23 bp, Homo sapiens
tcctcggccctgtagccctggcc

SEQ ID NO: 5312043 - DNA, 13 bp, Homo sapiens
tcctcgggaaaca

SEQ ID NO: 5312044 - DNA, 21 bp, Homo sapiens
tcctcgggatgaaaagccata

SEQ ID NO: 5312045 - DNA, 18 bp, Homo sapiens
tcctcgggcgcctgcgct

SEQ ID NO: 5312046 - DNA, 22 bp, Homo sapiens
tcctcgggcgcctgcgctcctc

SEQ ID NO: 5312047 - DNA, 17 bp, Homo sapiens
tcctcggggctccaggc

SEQ ID NO: 5312048 - DNA, 18 bp, Homo sapiens
tcctcgggtggggcctgc

SEQ ID NO: 5312049 - DNA, 17 bp, Homo sapiens
tcctcggtactcccata

SEQ ID NO: 5312050 - DNA, 23 bp, Homo sapiens
tcctcggtcgccccgtgtttgcg

SEQ ID NO: 5312051 - DNA, 21 bp, Homo sapiens
tcctcggtggcatttgctgaa

SEQ ID NO: 5312052 - DNA, 16 bp, Homo sapiens
tcctcggtggctctgg

SEQ ID NO: 5312053 - DNA, 20 bp, Homo sapiens
tcctcggtggctctggggta

SEQ ID NO: 5312054 - DNA, 16 bp, Homo sapiens
tcctcgtcccctgcct

SEQ ID NO: 5312055 - DNA, 19 bp, Homo sapiens
tcctcgtccggcctgcagc

SEQ ID NO: 5312056 - DNA, 22 bp, Homo sapiens
tcctcgtccggcctgcagccca

SEQ ID NO: 5312057 - DNA, 23 bp, Homo sapiens
tcctcgtccggcctgcagcccag

SEQ ID NO: 5312058 - DNA, 17 bp, Homo sapiens
tcctcgttcctttctcc

SEQ ID NO: 5312059 - DNA, 21 bp, Homo sapiens
tcctcgttgggccgctctgat

SEQ ID NO: 5312060 - DNA, 17 bp, Homo sapiens
tcctctaaagaaacttg

SEQ ID NO: 5312061 - DNA, 22 bp, Homo sapiens
tcctctaacaggggctggtggg

SEQ ID NO: 5312062 - DNA, 18 bp, Homo sapiens
tcctctaactcactgcct

SEQ ID NO: 5312063 - DNA, 13 bp, Homo sapiens
tcctctaactcat

SEQ ID NO: 5312064 - DNA, 21 bp, Homo sapiens
tcctctaattaaaatgtgcag

SEQ ID NO: 5312065 - DNA, 18 bp, Homo sapiens
tcctctactaacaatcag

SEQ ID NO: 5312066 - DNA, 18 bp, Homo sapiens
tcctctactcttacagag

SEQ ID NO: 5312067 - DNA, 21 bp, Homo sapiens
tcctctactttgctccgtgga

SEQ ID NO: 5312068 - DNA, 13 bp, Homo sapiens
tcctctagaaata

SEQ ID NO: 5312069 - DNA, 22 bp, Homo sapiens
tcctctagaagccaagggaaag

SEQ ID NO: 5312070 - DNA, 18 bp, Homo sapiens
tcctctagccatcccttg

SEQ ID NO: 5312071 - DNA, 22 bp, Homo sapiens
tcctctagccatcccttgggga

SEQ ID NO: 5312072 - DNA, 21 bp, Homo sapiens
tcctctagctgtgggggtgag

SEQ ID NO: 5312073 - DNA, 16 bp, Homo sapiens
tcctctaggaaatgta

SEQ ID NO: 5312074 - DNA, 22 bp, Homo sapiens
tcctctaggcaagcaggacctg

SEQ ID NO: 5312075 - DNA, 23 bp, Homo sapiens
tcctctaggcaagcaggacctgg

SEQ ID NO: 5312076 - DNA, 22 bp, Homo sapiens
tcctctagtgaatgtaggctgg

SEQ ID NO: 5312077 - DNA, 20 bp, Homo sapiens
tcctctatacatctctcccc

SEQ ID NO: 5312078 - DNA, 21 bp, Homo sapiens
tcctctatacatctctcccca

SEQ ID NO: 5312079 - DNA, 16 bp, Homo sapiens
tcctctataggagatg

SEQ ID NO: 5312080 - DNA, 14 bp, Homo sapiens
tcctctatcctggg

SEQ ID NO: 5312081 - DNA, 15 bp, Homo sapiens
tcctctatggaagga

SEQ ID NO: 5312082 - DNA, 12 bp, Homo sapiens
tcctctatgtgg

SEQ ID NO: 5312083 - DNA, 13 bp, Homo sapiens
tcctctatttctt

SEQ ID NO: 5312084 - DNA, 14 bp, Homo sapiens
tcctctattttgtg

SEQ ID NO: 5312085 - DNA, 22 bp, Homo sapiens
tcctctcaaacctggcagatgg

SEQ ID NO: 5312086 - DNA, 21 bp, Homo sapiens
tcctctcaaattcagctctga

SEQ ID NO: 5312087 - DNA, 18 bp, Homo sapiens
tcctctcaaccacctttc

SEQ ID NO: 5312088 - DNA, 17 bp, Homo sapiens
tcctctcacctcagcct

SEQ ID NO: 5312089 - DNA, 18 bp, Homo sapiens
tcctctcaccttgtccct

SEQ ID NO: 5312090 - DNA, 14 bp, Homo sapiens
tcctctcactcctg

SEQ ID NO: 5312091 - DNA, 15 bp, Homo sapiens
tcctctcactcctgc

SEQ ID NO: 5312092 - DNA, 17 bp, Homo sapiens
tcctctcactcctgcct

SEQ ID NO: 5312093 - DNA, 16 bp, Homo sapiens
tcctctcagaactcct

SEQ ID NO: 5312094 - DNA, 21 bp, Homo sapiens
tcctctcagaactcctgtgtg

SEQ ID NO: 5312095 - DNA, 13 bp, Homo sapiens
tcctctcagagtg

SEQ ID NO: 5312096 - DNA, 12 bp, Homo sapiens
tcctctcagctt

SEQ ID NO: 5312097 - DNA, 14 bp, Homo sapiens
tcctctcagtgttt

SEQ ID NO: 5312098 - DNA, 20 bp, Homo sapiens
tcctctcatccttttctcct

SEQ ID NO: 5312099 - DNA, 14 bp, Homo sapiens
tcctctcattgtct

SEQ ID NO: 5312100 - DNA, 18 bp, Homo sapiens
tcctctcatttccagctt

SEQ ID NO: 5312101 - DNA, 16 bp, Homo sapiens
tcctctccacaggagc

SEQ ID NO: 5312102 - DNA, 22 bp, Homo sapiens
tcctctccaccagacgccttcc

SEQ ID NO: 5312103 - DNA, 17 bp, Homo sapiens
tcctctccaccctcctc

SEQ ID NO: 5312104 - DNA, 22 bp, Homo sapiens
tcctctccaccctcctctagcc

SEQ ID NO: 5312105 - DNA, 23 bp, Homo sapiens
tcctctccaccctcctctagcca

SEQ ID NO: 5312106 - DNA, 12 bp, Homo sapiens
tcctctccactg

SEQ ID NO: 5312107 - DNA, 13 bp, Homo sapiens
tcctctccactgc

SEQ ID NO: 5312108 - DNA, 14 bp, Homo sapiens
tcctctccactgct

SEQ ID NO: 5312109 - DNA, 17 bp, Homo sapiens
tcctctccactgctgga

SEQ ID NO: 5312110 - DNA, 12 bp, Homo sapiens
tcctctccagag

SEQ ID NO: 5312111 - DNA, 24 bp, Homo sapiens
tcctctccagccttctctctctgg

SEQ ID NO: 5312112 - DNA, 14 bp, Homo sapiens
tcctctccatgcaa

SEQ ID NO: 5312113 - DNA, 22 bp, Homo sapiens
tcctctcccacagagtgctgga

SEQ ID NO: 5312114 - DNA, 16 bp, Homo sapiens
tcctctcccatccccc

SEQ ID NO: 5312115 - DNA, 19 bp, Homo sapiens
tcctctcccatccccctgc

SEQ ID NO: 5312116 - DNA, 20 bp, Homo sapiens
tcctctcccatccccctgcc

SEQ ID NO: 5312117 - DNA, 22 bp, Homo sapiens
tcctctcccattgtccctctgc

SEQ ID NO: 5312118 - DNA, 12 bp, Homo sapiens
tcctctccccag

SEQ ID NO: 5312119 - DNA, 13 bp, Homo sapiens
tcctctccccagc

SEQ ID NO: 5312120 - DNA, 18 bp, Homo sapiens
tcctctccccagcccaga

SEQ ID NO: 5312121 - DNA, 19 bp, Homo sapiens
tcctctccccagcctggca

SEQ ID NO: 5312122 - DNA, 22 bp, Homo sapiens
tcctctcccccaaccccctgca

SEQ ID NO: 5312123 - DNA, 22 bp, Homo sapiens
tcctgcagggccagacctgcct

SEQ ID NO: 5312124 - DNA, 19 bp, Homo sapiens
tcctgcagggcttctcctc

SEQ ID NO: 5312125 - DNA, 18 bp, Homo sapiens
tcctgcagtagaaggtgc

SEQ ID NO: 5312126 - DNA, 13 bp, Homo sapiens
tcctgcagtttgg

SEQ ID NO: 5312127 - DNA, 14 bp, Homo sapiens
tcctgcagtttggg

SEQ ID NO: 5312128 - DNA, 21 bp, Homo sapiens
tcctgcagtttgggagacatg

SEQ ID NO: 5312129 - DNA, 15 bp, Homo sapiens
tcctgcatggtaggg

SEQ ID NO: 5312130 - DNA, 14 bp, Homo sapiens
tcctgcatgtatgc

SEQ ID NO: 5312131 - DNA, 21 bp, Homo sapiens
tcctgcatgtcggggcccctg

SEQ ID NO: 5312132 - DNA, 22 bp, Homo sapiens
tcctgcatgtcggggcccctgc

SEQ ID NO: 5312133 - DNA, 23 bp, Homo sapiens
tcctgcatgtcggggcccctgcg

SEQ ID NO: 5312134 - DNA, 23 bp, Homo sapiens
tcctgcattgggtgatcattcac

SEQ ID NO: 5312135 - DNA, 21 bp, Homo sapiens
tcctgccaaaagatctgggga

SEQ ID NO: 5312136 - DNA, 22 bp, Homo sapiens
tcctgccaagtggtttctatga

SEQ ID NO: 5312137 - DNA, 11 bp, Homo sapiens
tcctgccacca

SEQ ID NO: 5312138 - DNA, 18 bp, Homo sapiens
tcctgccaccagcatcca

SEQ ID NO: 5312139 - DNA, 13 bp, Homo sapiens
tcctgccacctgc

SEQ ID NO: 5312140 - DNA, 20 bp, Homo sapiens
tcctgccacctggggcagtc

SEQ ID NO: 5312141 - DNA, 13 bp, Homo sapiens
tcctgccactgac

SEQ ID NO: 5312142 - DNA, 15 bp, Homo sapiens
tcctgccactgacct

SEQ ID NO: 5312143 - DNA, 18 bp, Homo sapiens
tcctgccactgacctcac

SEQ ID NO: 5312144 - DNA, 18 bp, Homo sapiens
tcctgccactgttttgtt

SEQ ID NO: 5312145 - DNA, 13 bp, Homo sapiens
tcctgccagccca

SEQ ID NO: 5312146 - DNA, 15 bp, Homo sapiens
tcctgccagcccagc

SEQ ID NO: 5312147 - DNA, 21 bp, Homo sapiens
tcctgccagccccacacagct

SEQ ID NO: 5312148 - DNA, 15 bp, Homo sapiens
tcctgccagcccggc

SEQ ID NO: 5312149 - DNA, 18 bp, Homo sapiens
tcctgccagctctgtcac

SEQ ID NO: 5312150 - DNA, 14 bp, Homo sapiens
tcctgccagctgcc

SEQ ID NO: 5312151 - DNA, 18 bp, Homo sapiens
tcctgccagctgccttcc

SEQ ID NO: 5312152 - DNA, 11 bp, Homo sapiens
tcctgccagga

SEQ ID NO: 5312153 - DNA, 12 bp, Homo sapiens
tcctgccaggag

SEQ ID NO: 5312154 - DNA, 13 bp, Homo sapiens
tcctgccaggagc

SEQ ID NO: 5312155 - DNA, 17 bp, Homo sapiens
tcctgccaggagcagcc

SEQ ID NO: 5312156 - DNA, 21 bp, Homo sapiens
tcctgccaggagcagcctcca

SEQ ID NO: 5312157 - DNA, 13 bp, Homo sapiens
tcctgccaggcac

SEQ ID NO: 5312158 - DNA, 20 bp, Homo sapiens
tcctgccaggctctccctct

SEQ ID NO: 5312159 - DNA, 23 bp, Homo sapiens
tcctgccagggaactggcctgct

SEQ ID NO: 5312160 - DNA, 15 bp, Homo sapiens
tcctgccagggtgag

SEQ ID NO: 5312161 - DNA, 21 bp, Homo sapiens
tcctgccatgggtgcagaccc

SEQ ID NO: 5312162 - DNA, 15 bp, Homo sapiens
tcctgcccaaaatgt

SEQ ID NO: 5312163 - DNA, 19 bp, Homo sapiens
tcctgcccaaaatgtgaag

SEQ ID NO: 5312164 - DNA, 23 bp, Homo sapiens
tcctgcccaagcacttcacagct

SEQ ID NO: 5312165 - DNA, 21 bp, Homo sapiens
tcctgcccaccctaccagctc

SEQ ID NO: 5312166 - DNA, 22 bp, Homo sapiens
tcctgcccaccctaccagctcc

SEQ ID NO: 5312167 - DNA, 19 bp, Homo sapiens
tcctgcccacgcagacctg

SEQ ID NO: 5312168 - DNA, 20 bp, Homo sapiens
tcctgcccacgcagacctgc

SEQ ID NO: 5312169 - DNA, 13 bp, Homo sapiens
tcctgcccacggg

SEQ ID NO: 5312170 - DNA, 20 bp, Homo sapiens
tcctgcccacgtgcagcacc

SEQ ID NO: 5312171 - DNA, 14 bp, Homo sapiens
tcctgcccactctg

SEQ ID NO: 5312172 - DNA, 22 bp, Homo sapiens
tcctgcccactctgaccgggct

SEQ ID NO: 5312173 - DNA, 20 bp, Homo sapiens
tcctgcccactgctgcagta

SEQ ID NO: 5312174 - DNA, 21 bp, Homo sapiens
tcctgcccagctctgaccctg

SEQ ID NO: 5312175 - DNA, 13 bp, Homo sapiens
tcctgcccaggac

SEQ ID NO: 5312176 - DNA, 16 bp, Homo sapiens
tcctgcccaggagagc

SEQ ID NO: 5312177 - DNA, 14 bp, Homo sapiens
tcctgcccaggagc

SEQ ID NO: 5312178 - DNA, 17 bp, Homo sapiens
tcctgcccaggccacag

SEQ ID NO: 5312179 - DNA, 14 bp, Homo sapiens
tcctgcccagtccc

SEQ ID NO: 5312180 - DNA, 17 bp, Homo sapiens
tcctgcccagtccccca

SEQ ID NO: 5312181 - DNA, 21 bp, Homo sapiens
tcctgcccagtcccccaaccc

SEQ ID NO: 5312182 - DNA, 22 bp, Homo sapiens
tcctgcccagtgttgtttgtaa

SEQ ID NO: 5312183 - DNA, 17 bp, Homo sapiens
tcctgcccatgtgtccc

SEQ ID NO: 5312184 - DNA, 18 bp, Homo sapiens
tcctgcccatgtgtcccc

SEQ ID NO: 5312185 - DNA, 19 bp, Homo sapiens
tcctgcccatgtgtcccct

SEQ ID NO: 5312186 - DNA, 20 bp, Homo sapiens
tcctgcccatgtgtcccctc

SEQ ID NO: 5312187 - DNA, 18 bp, Homo sapiens
tcctgccccaagggccca

SEQ ID NO: 5312188 - DNA, 23 bp, Homo sapiens
tcctgccccaagggcccagaccc

SEQ ID NO: 5312189 - DNA, 16 bp, Homo sapiens
tcctgccccacactcc

SEQ ID NO: 5312190 - DNA, 13 bp, Homo sapiens
tcctgcccccaag

SEQ ID NO: 5312191 - DNA, 20 bp, Homo sapiens
tcctgcccccacacctggcc

SEQ ID NO: 5312192 - DNA, 22 bp, Homo sapiens
tcctgcccccacacctggccct

SEQ ID NO: 5312193 - DNA, 23 bp, Homo sapiens
tcctgcccccacacctggccctg

SEQ ID NO: 5312194 - DNA, 14 bp, Homo sapiens
tcctgcccccaccc

SEQ ID NO: 5312195 - DNA, 16 bp, Homo sapiens
tcctgcccccacccca

SEQ ID NO: 5312196 - DNA, 18 bp, Homo sapiens
tcctgcccccaccccagg

SEQ ID NO: 5312197 - DNA, 20 bp, Homo sapiens
tcctgcccccaccccaggct

SEQ ID NO: 5312198 - DNA, 17 bp, Homo sapiens
tcctgcccccccacccc

SEQ ID NO: 5312199 - DNA, 22 bp, Homo sapiens
tcctgcccccgacagcccagcc

SEQ ID NO: 5312200 - DNA, 19 bp, Homo sapiens
tcctgcccccgccctgctg

SEQ ID NO: 5312201 - DNA, 19 bp, Homo sapiens
tcctgccccctgaaactta

SEQ ID NO: 5312202 - DNA, 22 bp, Homo sapiens
tcctgccccctgaaacttattt

SEQ ID NO: 5312203 - DNA, 14 bp, Homo sapiens
tcctgccccctgcc

SEQ ID NO: 5312204 - DNA, 16 bp, Homo sapiens
tcctgccccctgccag

SEQ ID NO: 5312205 - DNA, 15 bp, Homo sapiens
tcctgcccctcgcct

SEQ ID NO: 5312206 - DNA, 14 bp, Homo sapiens
tcctgcccctgttc

SEQ ID NO: 5312207 - DNA, 22 bp, Homo sapiens
tcctgcccctttcaggcctaca

SEQ ID NO: 5312208 - DNA, 16 bp, Homo sapiens
tcctgcccgagggcag

SEQ ID NO: 5312209 - DNA, 18 bp, Homo sapiens
tcctgcccgagggcagcc

SEQ ID NO: 5312210 - DNA, 23 bp, Homo sapiens
tcctgccctaactctgcccaccc

SEQ ID NO: 5312211 - DNA, 23 bp, Homo sapiens
tcctgccctagcagtttgcctct

SEQ ID NO: 5312212 - DNA, 20 bp, Homo sapiens
tcctgccctccgccccgtcc

SEQ ID NO: 5312213 - DNA, 14 bp, Homo sapiens
tcctgccctccgga

SEQ ID NO: 5312214 - DNA, 24 bp, Homo sapiens
tcctgccctccggaggagcagcct

SEQ ID NO: 5312215 - DNA, 13 bp, Homo sapiens
tcctgccctctgc

SEQ ID NO: 5312216 - DNA, 17 bp, Homo sapiens
tcctgccctctgctctg

SEQ ID NO: 5312217 - DNA, 23 bp, Homo sapiens
tcctgccctctgctctgcctgga

SEQ ID NO: 5312218 - DNA, 11 bp, Homo sapiens
tcctgccctgc

SEQ ID NO: 5312219 - DNA, 15 bp, Homo sapiens
tcctgccctgggagg

SEQ ID NO: 5312220 - DNA, 22 bp, Homo sapiens
tcctgccctgtacctctctctg

SEQ ID NO: 5312221 - DNA, 15 bp, Homo sapiens
tcctgccctgtccct

SEQ ID NO: 5312222 - DNA, 21 bp, Homo sapiens
tcctgccctgtccctgtcccc

SEQ ID NO: 5312223 - DNA, 13 bp, Homo sapiens
tcctgccctgtgg

SEQ ID NO: 5312224 - DNA, 18 bp, Homo sapiens
tcctgccctgttgtgtat

SEQ ID NO: 5312225 - DNA, 20 bp, Homo sapiens
tcctgcccttacctgccagg

SEQ ID NO: 5312226 - DNA, 16 bp, Homo sapiens
tcctgcccttccctct

SEQ ID NO: 5312227 - DNA, 15 bp, Homo sapiens
tcctgcccttcctca

SEQ ID NO: 5312228 - DNA, 16 bp, Homo sapiens
tcctgcccttcctcag

SEQ ID NO: 5312229 - DNA, 23 bp, Homo sapiens
tcctgcccttgaaccccctccct

SEQ ID NO: 5312230 - DNA, 16 bp, Homo sapiens
tcctgccgactcctgg

SEQ ID NO: 5312231 - DNA, 23 bp, Homo sapiens
tcctgccgagtgctctgatgcaa

SEQ ID NO: 5312232 - DNA, 20 bp, Homo sapiens
tcctgccgcagagctggccg

SEQ ID NO: 5312233 - DNA, 22 bp, Homo sapiens
tcctgccgcccgaggtggctgc

SEQ ID NO: 5312234 - DNA, 16 bp, Homo sapiens
tcctgccggagaggaa

SEQ ID NO: 5312235 - DNA, 17 bp, Homo sapiens
tcctgccggagaggaag

SEQ ID NO: 5312236 - DNA, 22 bp, Homo sapiens
tcctgccggagaggaagagaca

SEQ ID NO: 5312237 - DNA, 21 bp, Homo sapiens
tcctgccgggcaggtcccagg

SEQ ID NO: 5312238 - DNA, 19 bp, Homo sapiens
tcctgccgtccctcctgtt

SEQ ID NO: 5312239 - DNA, 10 bp, Homo sapiens
tcctgcctaa

SEQ ID NO: 5312240 - DNA, 13 bp, Homo sapiens
tcctgcctaaatt

SEQ ID NO: 5312241 - DNA, 16 bp, Homo sapiens
tcctgcctaaatttca

SEQ ID NO: 5312242 - DNA, 17 bp, Homo sapiens
tcctgcctaaatttcac

SEQ ID NO: 5312243 - DNA, 15 bp, Homo sapiens
tcctgcctacatccc

SEQ ID NO: 5312244 - DNA, 16 bp, Homo sapiens
tcctgcctacatccca

SEQ ID NO: 5312245 - DNA, 22 bp, Homo sapiens
tcctgcctcagcctcccatagc

SEQ ID NO: 5312246 - DNA, 19 bp, Homo sapiens
tcctgcctcagcctcccca

SEQ ID NO: 5312247 - DNA, 19 bp, Homo sapiens
tcctgcctcagcctcccga

SEQ ID NO: 5312248 - DNA, 13 bp, Homo sapiens
tcctgcctccggg

SEQ ID NO: 5312249 - DNA, 14 bp, Homo sapiens
tcctgcctccgggc

SEQ ID NO: 5312250 - DNA, 22 bp, Homo sapiens
tcctgcctctactgggaaggct

SEQ ID NO: 5312251 - DNA, 12 bp, Homo sapiens
tcctgcctctct

SEQ ID NO: 5312252 - DNA, 17 bp, Homo sapiens
tcctgcctctctgctcc

SEQ ID NO: 5312253 - DNA, 18 bp, Homo sapiens
tcctgcctctctgctcca

SEQ ID NO: 5312254 - DNA, 19 bp, Homo sapiens
tcctgcctctctgctccag

SEQ ID NO: 5312255 - DNA, 21 bp, Homo sapiens
tcctgcctcttgtttctgtgc

SEQ ID NO: 5312256 - DNA, 23 bp, Homo sapiens
tcctgcctcttgtttctgtgccc

SEQ ID NO: 5312257 - DNA, 19 bp, Homo sapiens
tcctgcctgcccccacacc

SEQ ID NO: 5312258 - DNA, 20 bp, Homo sapiens
tcctgcctgcccctctcccg

SEQ ID NO: 5312259 - DNA, 15 bp, Homo sapiens
tcctgcctgccctgc

SEQ ID NO: 5312260 - DNA, 18 bp, Homo sapiens
tcctgcctgccctgcctc

SEQ ID NO: 5312261 - DNA, 13 bp, Homo sapiens
tcctgcctggcac

SEQ ID NO: 5312262 - DNA, 12 bp, Homo sapiens
tcctgcctggcc

SEQ ID NO: 5312263 - DNA, 14 bp, Homo sapiens
tcctgcctggccag

SEQ ID NO: 5312264 - DNA, 12 bp, Homo sapiens
tcctgcctgggt

SEQ ID NO: 5312265 - DNA, 19 bp, Homo sapiens
tcctgcctgggtgggacag

SEQ ID NO: 5312266 - DNA, 21 bp, Homo sapiens
tcctgcctgggtgggacagcc

SEQ ID NO: 5312267 - DNA, 14 bp, Homo sapiens
tcctgcctgtctgc

SEQ ID NO: 5312268 - DNA, 12 bp, Homo sapiens
tcctgcctgtgc

SEQ ID NO: 5312269 - DNA, 14 bp, Homo sapiens
tcctgcctgtggcc

SEQ ID NO: 5312270 - DNA, 18 bp, Homo sapiens
tcctgccttagagccagg

SEQ ID NO: 5312271 - DNA, 14 bp, Homo sapiens
tcctgccttctctt

SEQ ID NO: 5312272 - DNA, 22 bp, Homo sapiens
tcctgccttctgtcctggtgtc

SEQ ID NO: 5312273 - DNA, 12 bp, Homo sapiens
tcctgccttgat

SEQ ID NO: 5312274 - DNA, 23 bp, Homo sapiens
tcctgccttgatgaagcccgtgt

SEQ ID NO: 5312275 - DNA, 23 bp, Homo sapiens
tcctgccttgatgaagcctgtgc

SEQ ID NO: 5312276 - DNA, 15 bp, Homo sapiens
tcctgcctttgcctc

SEQ ID NO: 5312277 - DNA, 21 bp, Homo sapiens
tcctgcgaccttgcaacctca

SEQ ID NO: 5312278 - DNA, 15 bp, Homo sapiens
tcctgcgccccgccc

SEQ ID NO: 5312279 - DNA, 20 bp, Homo sapiens
tcctgcgccccgcccacacc

SEQ ID NO: 5312280 - DNA, 18 bp, Homo sapiens
tcctgcgccctgtgcccg

SEQ ID NO: 5312281 - DNA, 21 bp, Homo sapiens
tcctgcgcctgcgcctcctcc

SEQ ID NO: 5312282 - DNA, 21 bp, Homo sapiens
tcctgcggagtgaagaggggc

SEQ ID NO: 5312283 - DNA, 22 bp, Homo sapiens
tcctgcggagtgaagaggggca

SEQ ID NO: 5312284 - DNA, 15 bp, Homo sapiens
tcctgcggcaggact

SEQ ID NO: 5312285 - DNA, 21 bp, Homo sapiens
tcctgcggcaggactgcagag

SEQ ID NO: 5312286 - DNA, 22 bp, Homo sapiens
tcctgcggcaggactgcagagc

SEQ ID NO: 5312287 - DNA, 12 bp, Homo sapiens
tcctgcggctca

SEQ ID NO: 5312288 - DNA, 12 bp, Homo sapiens
tcctgcgggctt

SEQ ID NO: 5312289 - DNA, 23 bp, Homo sapiens
tcctgcgggcttttccccggtcc

SEQ ID NO: 5312290 - DNA, 14 bp, Homo sapiens
tcctgcgggtttta

SEQ ID NO: 5312291 - DNA, 21 bp, Homo sapiens
tcctgcgtcccagcctgcacc

SEQ ID NO: 5312292 - DNA, 21 bp, Homo sapiens
tcctgcgtcctcctcacctca

SEQ ID NO: 5312293 - DNA, 14 bp, Homo sapiens
tcctgcgtgtgccc

SEQ ID NO: 5312294 - DNA, 18 bp, Homo sapiens
tcctgcgttcagcccctg

SEQ ID NO: 5312295 - DNA, 22 bp, Homo sapiens
tcctgcgttcagcccctgatct

SEQ ID NO: 5312296 - DNA, 17 bp, Homo sapiens
tcctgctacacaaaagc

SEQ ID NO: 5312297 - DNA, 20 bp, Homo sapiens
tcctgctacagtagctgtgg

SEQ ID NO: 5312298 - DNA, 21 bp, Homo sapiens
tcctgctacagtagctgtggg

SEQ ID NO: 5312299 - DNA, 18 bp, Homo sapiens
tcctgtccctacccactc

SEQ ID NO: 5312300 - DNA, 13 bp, Homo sapiens
tcctgtccctcca

SEQ ID NO: 5312301 - DNA, 16 bp, Homo sapiens
tcctgtccctccatcc

SEQ ID NO: 5312302 - DNA, 14 bp, Homo sapiens
tcctgtcccttttc

SEQ ID NO: 5312303 - DNA, 20 bp, Homo sapiens
tcctgtccggagcgaccctg

SEQ ID NO: 5312304 - DNA, 16 bp, Homo sapiens
tcctgtcctcagcttc

SEQ ID NO: 5312305 - DNA, 21 bp, Homo sapiens
tcctgtcctcccatcccctgg

SEQ ID NO: 5312306 - DNA, 15 bp, Homo sapiens
tcctgtcctctttca

SEQ ID NO: 5312307 - DNA, 17 bp, Homo sapiens
tcctgtcctctttcagc

SEQ ID NO: 5312308 - DNA, 19 bp, Homo sapiens
tcctgtcctctttcagctc

SEQ ID NO: 5312309 - DNA, 21 bp, Homo sapiens
tcctgtcctctttcagctcct

SEQ ID NO: 5312310 - DNA, 15 bp, Homo sapiens
tcctgtcctgcctcc

SEQ ID NO: 5312311 - DNA, 17 bp, Homo sapiens
tcctgtcctgcctcctc

SEQ ID NO: 5312312 - DNA, 18 bp, Homo sapiens
tcctgtcctgcctcctca

SEQ ID NO: 5312313 - DNA, 13 bp, Homo sapiens
tcctgtcctgctc

SEQ ID NO: 5312314 - DNA, 17 bp, Homo sapiens
tcctgtcctgctcacgt

SEQ ID NO: 5312315 - DNA, 13 bp, Homo sapiens
tcctgtcctggct

SEQ ID NO: 5312316 - DNA, 17 bp, Homo sapiens
tcctgtcctggctccca

SEQ ID NO: 5312317 - DNA, 23 bp, Homo sapiens
tcctgtcctttacacattcggct

SEQ ID NO: 5312318 - DNA, 15 bp, Homo sapiens
tcctgtcctttcttg

SEQ ID NO: 5312319 - DNA, 18 bp, Homo sapiens
tcctgtcctttgttatta

SEQ ID NO: 5312320 - DNA, 22 bp, Homo sapiens
tcctgtcgaaggggaggcacac

SEQ ID NO: 5312321 - DNA, 19 bp, Homo sapiens
tcctgtcggagccctgtct

SEQ ID NO: 5312322 - DNA, 15 bp, Homo sapiens
tcctgtctcaatagc

SEQ ID NO: 5312323 - DNA, 16 bp, Homo sapiens
tcctgtctcaatagct

SEQ ID NO: 5312324 - DNA, 18 bp, Homo sapiens
tcctgtctcaatagctcc

SEQ ID NO: 5312325 - DNA, 16 bp, Homo sapiens
tcctgtctcccctctg

SEQ ID NO: 5312326 - DNA, 19 bp, Homo sapiens
tcctgtctcccctctgctg

SEQ ID NO: 5312327 - DNA, 23 bp, Homo sapiens
tcctgtctccctcctctgcccgg

SEQ ID NO: 5312328 - DNA, 19 bp, Homo sapiens
tcctgtctcctctgtcagt

SEQ ID NO: 5312329 - DNA, 12 bp, Homo sapiens
tcctgtctctgc

SEQ ID NO: 5312330 - DNA, 15 bp, Homo sapiens
tcctgtctctggcct

SEQ ID NO: 5312331 - DNA, 12 bp, Homo sapiens
tcctgtctgcca

SEQ ID NO: 5312332 - DNA, 17 bp, Homo sapiens
tcctgtctgccagccag

SEQ ID NO: 5312333 - DNA, 18 bp, Homo sapiens
tcctgtctgccctctggg

SEQ ID NO: 5312334 - DNA, 23 bp, Homo sapiens
tcctgtctggctcggacccaccc

SEQ ID NO: 5312335 - DNA, 12 bp, Homo sapiens
tcctgtctgttt

SEQ ID NO: 5312336 - DNA, 13 bp, Homo sapiens
tcctgtctgttta

SEQ ID NO: 5312337 - DNA, 14 bp, Homo sapiens
tcctgtcttatcct

SEQ ID NO: 5312338 - DNA, 15 bp, Homo sapiens
tcctgtcttccaaat

SEQ ID NO: 5312339 - DNA, 15 bp, Homo sapiens
tcctgtcttcccagg

SEQ ID NO: 5312340 - DNA, 17 bp, Homo sapiens
tcctgtcttcccagggt

SEQ ID NO: 5312341 - DNA, 16 bp, Homo sapiens
tcctgtcttctgcttt

SEQ ID NO: 5312342 - DNA, 15 bp, Homo sapiens
tcctgtcttctttct

SEQ ID NO: 5312343 - DNA, 16 bp, Homo sapiens
tcctgtcttctttctc

SEQ ID NO: 5312344 - DNA, 18 bp, Homo sapiens
tcctgtcttctttctcca

SEQ ID NO: 5312345 - DNA, 21 bp, Homo sapiens
tcctgtcttctttctccatgg

SEQ ID NO: 5312346 - DNA, 22 bp, Homo sapiens
tcctgtcttctttctccatgga

SEQ ID NO: 5312347 - DNA, 20 bp, Homo sapiens
tcctgtcttgtctattgtat

SEQ ID NO: 5312348 - DNA, 16 bp, Homo sapiens
tcctgtcttttcaggt

SEQ ID NO: 5312349 - DNA, 18 bp, Homo sapiens
tcctgtgaaatattctta

SEQ ID NO: 5312350 - DNA, 16 bp, Homo sapiens
tcctgtgaatggaggc

SEQ ID NO: 5312351 - DNA, 20 bp, Homo sapiens
tcctgtgaatggaggcagag

SEQ ID NO: 5312352 - DNA, 17 bp, Homo sapiens
tcctgtgacaacactca

SEQ ID NO: 5312353 - DNA, 11 bp, Homo sapiens
tcctgtgacac

SEQ ID NO: 5312354 - DNA, 15 bp, Homo sapiens
tcctgtgacatgtaa

SEQ ID NO: 5312355 - DNA, 15 bp, Homo sapiens
tcctgtgaccccacc

SEQ ID NO: 5312356 - DNA, 18 bp, Homo sapiens
tcctgtgaggagccccat

SEQ ID NO: 5312357 - DNA, 22 bp, Homo sapiens
tcctgtgaggatagagacttgc

SEQ ID NO: 5312358 - DNA, 23 bp, Homo sapiens
tcctgtgaggatagagacttgca

SEQ ID NO: 5312359 - DNA, 18 bp, Homo sapiens
tcctgtgaggtttcccaa

SEQ ID NO: 5312360 - DNA, 20 bp, Homo sapiens
tcctgtgatacatttctgaa

SEQ ID NO: 5312361 - DNA, 22 bp, Homo sapiens
tcctgtgatagagttcttttaa

SEQ ID NO: 5312362 - DNA, 21 bp, Homo sapiens
tcctgtgatccacccaaccct

SEQ ID NO: 5312363 - DNA, 12 bp, Homo sapiens
tcctgtgatgtc

SEQ ID NO: 5312364 - DNA, 14 bp, Homo sapiens
tcctgtgcacagcc

SEQ ID NO: 5312365 - DNA, 14 bp, Homo sapiens
tcctgtgcagaagg

SEQ ID NO: 5312366 - DNA, 16 bp, Homo sapiens
tcctgtgcatgggtga

SEQ ID NO: 5312367 - DNA, 18 bp, Homo sapiens
tcctgtgcatgggtgaag

SEQ ID NO: 5312368 - DNA, 21 bp, Homo sapiens
tcctgtgccaggactctcttt

SEQ ID NO: 5312369 - DNA, 22 bp, Homo sapiens
tcctgtgccaggactctctttc

SEQ ID NO: 5312370 - DNA, 17 bp, Homo sapiens
tcctgtgcccacatccc

SEQ ID NO: 5312371 - DNA, 23 bp, Homo sapiens
tcctgtgcccacccgtcttcaat

SEQ ID NO: 5312372 - DNA, 21 bp, Homo sapiens
tcctgtgcccatcatctctgc

SEQ ID NO: 5312373 - DNA, 21 bp, Homo sapiens
tcctgtgccctcaccccaatc

SEQ ID NO: 5312374 - DNA, 23 bp, Homo sapiens
tcctgtgccgtaaggattgcatc

SEQ ID NO: 5312375 - DNA, 13 bp, Homo sapiens
tcctgtgcctggc

SEQ ID NO: 5312376 - DNA, 14 bp, Homo sapiens
tcctgtgcctggcc

SEQ ID NO: 5312377 - DNA, 21 bp, Homo sapiens
tcctgtgcctttcctatcacc

SEQ ID NO: 5312378 - DNA, 20 bp, Homo sapiens
tcctgtgctaagtctttccc

SEQ ID NO: 5312379 - DNA, 13 bp, Homo sapiens
tcctgtgctacag

SEQ ID NO: 5312380 - DNA, 22 bp, Homo sapiens
tcctgtgctatttgtacaaata

SEQ ID NO: 5312381 - DNA, 15 bp, Homo sapiens
tcctgtggaaatatg

SEQ ID NO: 5312382 - DNA, 16 bp, Homo sapiens
tcctgtggaaatatgc

SEQ ID NO: 5312383 - DNA, 23 bp, Homo sapiens
tcctgtggaaatatgcaacctgt

SEQ ID NO: 5312384 - DNA, 22 bp, Homo sapiens
tcctgtggaacccagcagttct

SEQ ID NO: 5312385 - DNA, 23 bp, Homo sapiens
tcctgtggaaggcagagaaatct

SEQ ID NO: 5312386 - DNA, 16 bp, Homo sapiens
tcctgtggcataaatt

SEQ ID NO: 5312387 - DNA, 17 bp, Homo sapiens
tcctgtggcatgcaaaa

SEQ ID NO: 5312388 - DNA, 22 bp, Homo sapiens
tcctgtggcatgcaaaagaaag

SEQ ID NO: 5312389 - DNA, 13 bp, Homo sapiens
tcctgtggccagg

SEQ ID NO: 5312390 - DNA, 23 bp, Homo sapiens
tcctgtggccccaccctgggccc

SEQ ID NO: 5312391 - DNA, 13 bp, Homo sapiens
tcctgtggcctga

SEQ ID NO: 5312392 - DNA, 19 bp, Homo sapiens
tcctgtggcctgctcatca

SEQ ID NO: 5312393 - DNA, 18 bp, Homo sapiens
tcctgtggctccctctct

SEQ ID NO: 5312394 - DNA, 19 bp, Homo sapiens
tcctgtggctccctctctc

SEQ ID NO: 5312395 - DNA, 20 bp, Homo sapiens
tcctgtggctttgttttctt

SEQ ID NO: 5312396 - DNA, 15 bp, Homo sapiens
tcctgtgggacctgg

SEQ ID NO: 5312397 - DNA, 18 bp, Homo sapiens
tcctgtgggagcctcgca

SEQ ID NO: 5312398 - DNA, 16 bp, Homo sapiens
tcctgtgggccaggag

SEQ ID NO: 5312399 - DNA, 21 bp, Homo sapiens
tcctgtgggccaggagctcag

SEQ ID NO: 5312400 - DNA, 13 bp, Homo sapiens
tcctgtgggtggg

SEQ ID NO: 5312401 - DNA, 18 bp, Homo sapiens
tcctgtgggtggggcttc

SEQ ID NO: 5312402 - DNA, 21 bp, Homo sapiens
tcctgtgggtgttctttcctg

SEQ ID NO: 5312403 - DNA, 19 bp, Homo sapiens
tcctgtggtagtcctccca

SEQ ID NO: 5312404 - DNA, 22 bp, Homo sapiens
tcctgtggtagtcctcccaagc

SEQ ID NO: 5312405 - DNA, 18 bp, Homo sapiens
tcctgtgtaacatctgcc

SEQ ID NO: 5312406 - DNA, 22 bp, Homo sapiens
tcctgtgtaatcatttcttggg

SEQ ID NO: 5312407 - DNA, 13 bp, Homo sapiens
tcctgtgtacagg

SEQ ID NO: 5312408 - DNA, 20 bp, Homo sapiens
tcctgtgtacctcactgtcc

SEQ ID NO: 5312409 - DNA, 13 bp, Homo sapiens
tcctgtgtactgt

SEQ ID NO: 5312410 - DNA, 23 bp, Homo sapiens
tcctgtgtattaaacctttccat

SEQ ID NO: 5312411 - DNA, 22 bp, Homo sapiens
tcctgtgtcagaaaccctggtc

SEQ ID NO: 5312412 - DNA, 16 bp, Homo sapiens
tcctgtgtcagtttat

SEQ ID NO: 5312413 - DNA, 17 bp, Homo sapiens
tcctgtgtcatctgtca

SEQ ID NO: 5312414 - DNA, 18 bp, Homo sapiens
tcctgtgtcatctgtcag

SEQ ID NO: 5312415 - DNA, 14 bp, Homo sapiens
tcctgtgtcccctg

SEQ ID NO: 5312416 - DNA, 23 bp, Homo sapiens
tcctgtgtcttgcaatggcagcc

SEQ ID NO: 5312417 - DNA, 24 bp, Homo sapiens
tcctgtgtcttgcaatggcagcct

SEQ ID NO: 5312418 - DNA, 15 bp, Homo sapiens
tcctgtgtgcagtga

SEQ ID NO: 5312419 - DNA, 15 bp, Homo sapiens
tcctgtgtggagagg

SEQ ID NO: 5312420 - DNA, 16 bp, Homo sapiens
tcctgtgtggagaggg

SEQ ID NO: 5312421 - DNA, 18 bp, Homo sapiens
tcctgtgtggggaggcag

SEQ ID NO: 5312422 - DNA, 19 bp, Homo sapiens
tcctgtgtggggaggcagc

SEQ ID NO: 5312423 - DNA, 22 bp, Homo sapiens
tcctgtgtggggaggcagctcc

SEQ ID NO: 5312424 - DNA, 21 bp, Homo sapiens
tcctgtgtggtttagtgtaaa

SEQ ID NO: 5312425 - DNA, 18 bp, Homo sapiens
tcctgtgtgtactctgtc

SEQ ID NO: 5312426 - DNA, 14 bp, Homo sapiens
tcctgtgtgtctgc

SEQ ID NO: 5312427 - DNA, 14 bp, Homo sapiens
tcctgtgtgtgcgc

SEQ ID NO: 5312428 - DNA, 13 bp, Homo sapiens
tcctgtgttccct

SEQ ID NO: 5312429 - DNA, 15 bp, Homo sapiens
tcctgtgtttgtcct

SEQ ID NO: 5312430 - DNA, 21 bp, Homo sapiens
tcctgttaaattttctctaaa

SEQ ID NO: 5312431 - DNA, 23 bp, Homo sapiens
tcctgttaaattttctctaaact

SEQ ID NO: 5312432 - DNA, 18 bp, Homo sapiens
tcctgttaacactgtaat

SEQ ID NO: 5312433 - DNA, 20 bp, Homo sapiens
tcctgttaacactgtaatat

SEQ ID NO: 5312434 - DNA, 22 bp, Homo sapiens
tcctgttaacgtcatctcaggg

SEQ ID NO: 5312435 - DNA, 21 bp, Homo sapiens
tcctgttaatgtatttgttca

SEQ ID NO: 5312436 - DNA, 14 bp, Homo sapiens
tcctgttactatgg

SEQ ID NO: 5312437 - DNA, 13 bp, Homo sapiens
tcctgttactgaa

SEQ ID NO: 5312438 - DNA, 18 bp, Homo sapiens
tcctgttacttacctaaa

SEQ ID NO: 5312439 - DNA, 16 bp, Homo sapiens
tcctgttacttgcttc

SEQ ID NO: 5312440 - DNA, 17 bp, Homo sapiens
tcctgttacttgcttca

SEQ ID NO: 5312441 - DNA, 21 bp, Homo sapiens
tcctgttaggccaactgcctc

SEQ ID NO: 5312442 - DNA, 15 bp, Homo sapiens
tcctgttcacaccag

SEQ ID NO: 5312443 - DNA, 19 bp, Homo sapiens
tcctgttcaccttatgtat

SEQ ID NO: 5312444 - DNA, 15 bp, Homo sapiens
tcctgttcagcattc

SEQ ID NO: 5312445 - DNA, 18 bp, Homo sapiens
tcctgttcagcattctta

SEQ ID NO: 5312446 - DNA, 18 bp, Homo sapiens
tcctgttcagtaataaaa

SEQ ID NO: 5312447 - DNA, 13 bp, Homo sapiens
tcctgttcagtga

SEQ ID NO: 5312448 - DNA, 13 bp, Homo sapiens
tcctgttccctac

SEQ ID NO: 5312449 - DNA, 14 bp, Homo sapiens
tcctgttccctcct

SEQ ID NO: 5312450 - DNA, 20 bp, Homo sapiens
tcctgttccctcctggtcct

SEQ ID NO: 5312451 - DNA, 13 bp, Homo sapiens
tcctgttcctgcc

SEQ ID NO: 5312452 - DNA, 14 bp, Homo sapiens
tcctgttcctgcct

SEQ ID NO: 5312453 - DNA, 17 bp, Homo sapiens
tcctgttcctgccttct

SEQ ID NO: 5312454 - DNA, 16 bp, Homo sapiens
tcctgttctcagagct

SEQ ID NO: 5312455 - DNA, 20 bp, Homo sapiens
tcctgttctgcgctgtgtac

SEQ ID NO: 5312456 - DNA, 22 bp, Homo sapiens
tcctgttctgcgctgtgtacaa

SEQ ID NO: 5312457 - DNA, 12 bp, Homo sapiens
tcctgttctgtg

SEQ ID NO: 5312458 - DNA, 14 bp, Homo sapiens
tcctgttcttcctt

SEQ ID NO: 5312459 - DNA, 18 bp, Homo sapiens
tcctgttgaaaagccatg

SEQ ID NO: 5312460 - DNA, 14 bp, Homo sapiens
tcctgttgaagact

SEQ ID NO: 5312461 - DNA, 14 bp, Homo sapiens
tcctgttgaatctt

SEQ ID NO: 5312462 - DNA, 21 bp, Homo sapiens
tcctgttgaatgacaaagtat

SEQ ID NO: 5312463 - DNA, 19 bp, Homo sapiens
tcctgttgcacccagccct

SEQ ID NO: 5312464 - DNA, 20 bp, Homo sapiens
tcctgttgcacccagccctg

SEQ ID NO: 5312465 - DNA, 23 bp, Homo sapiens
tcctgttgccacactttcactgg

SEQ ID NO: 5312466 - DNA, 15 bp, Homo sapiens
tcctgttgccatgga

SEQ ID NO: 5312467 - DNA, 23 bp, Homo sapiens
tcctgttgctgtcttcagtctca

SEQ ID NO: 5312468 - DNA, 13 bp, Homo sapiens
tcctgttgggaga

SEQ ID NO: 5312469 - DNA, 21 bp, Homo sapiens
tcctgttgggagagggcgcag

SEQ ID NO: 5312470 - DNA, 17 bp, Homo sapiens
tcctgttggtttcattt

SEQ ID NO: 5312471 - DNA, 18 bp, Homo sapiens
tcctgttggtttcatttg

SEQ ID NO: 5312472 - DNA, 14 bp, Homo sapiens
tcctgttgttactg

SEQ ID NO: 5312473 - DNA, 18 bp, Homo sapiens
tcctgtttaactccctag

SEQ ID NO: 5312474 - DNA, 19 bp, Homo sapiens
tcctgtttataatctgaag

SEQ ID NO: 5312475 - DNA, 12 bp, Homo sapiens
tcctgtttcaga

SEQ ID NO: 5312476 - DNA, 14 bp, Homo sapiens
tccttcttcctcaa

SEQ ID NO: 5312477 - DNA, 15 bp, Homo sapiens
tccttcttgccctga

SEQ ID NO: 5312478 - DNA, 17 bp, Homo sapiens
tccttcttggcttcctg

SEQ ID NO: 5312479 - DNA, 20 bp, Homo sapiens
tccttctttctcttccctcc

SEQ ID NO: 5312480 - DNA, 15 bp, Homo sapiens
tccttctttttaaaa

SEQ ID NO: 5312481 - DNA, 21 bp, Homo sapiens
tccttgaaaaaaagttgcttt

SEQ ID NO: 5312482 - DNA, 23 bp, Homo sapiens
tccttgaaaaaaagttgctttgt

SEQ ID NO: 5312483 - DNA, 12 bp, Homo sapiens
tccttgaaacag

SEQ ID NO: 5312484 - DNA, 16 bp, Homo sapiens
tccttgaaacagaaaa

SEQ ID NO: 5312485 - DNA, 16 bp, Homo sapiens
tccttgaaatttctca

SEQ ID NO: 5312486 - DNA, 18 bp, Homo sapiens
tccttgaaatttctcagc

SEQ ID NO: 5312487 - DNA, 15 bp, Homo sapiens
tccttgaactgaggc

SEQ ID NO: 5312488 - DNA, 20 bp, Homo sapiens
tccttgaagaactgcaggcc

SEQ ID NO: 5312489 - DNA, 19 bp, Homo sapiens
tccttgaagaatctctcct

SEQ ID NO: 5312490 - DNA, 20 bp, Homo sapiens
tccttgaagacatatcatgt

SEQ ID NO: 5312491 - DNA, 23 bp, Homo sapiens
tccttgaagacatatcatgtgtg

SEQ ID NO: 5312492 - DNA, 13 bp, Homo sapiens
tccttgaagcttg

SEQ ID NO: 5312493 - DNA, 17 bp, Homo sapiens
tccttgaatctgaaaga

SEQ ID NO: 5312494 - DNA, 22 bp, Homo sapiens
tccttgacaccttactttccca

SEQ ID NO: 5312495 - DNA, 22 bp, Homo sapiens
tccttgaccactggccctgggg

SEQ ID NO: 5312496 - DNA, 17 bp, Homo sapiens
tccttgagacacggagc

SEQ ID NO: 5312497 - DNA, 16 bp, Homo sapiens
tccttgagagaccagg

SEQ ID NO: 5312498 - DNA, 13 bp, Homo sapiens
tccttgaggacag

SEQ ID NO: 5312499 - DNA, 19 bp, Homo sapiens
tccttgaggacctccacct

SEQ ID NO: 5312500 - DNA, 22 bp, Homo sapiens
tccttgaggggagccaggaggg

SEQ ID NO: 5312501 - DNA, 21 bp, Homo sapiens
tccttgaggggcagtttggga

SEQ ID NO: 5312502 - DNA, 16 bp, Homo sapiens
tccttgagtgtatgag

SEQ ID NO: 5312503 - DNA, 15 bp, Homo sapiens
tccttgataaaagtc

SEQ ID NO: 5312504 - DNA, 17 bp, Homo sapiens
tccttgataaaagtcat

SEQ ID NO: 5312505 - DNA, 17 bp, Homo sapiens
tccttgataatatattg

SEQ ID NO: 5312506 - DNA, 17 bp, Homo sapiens
tccttgatatttgtatt

SEQ ID NO: 5312507 - DNA, 19 bp, Homo sapiens
tccttgatatttgtattta

SEQ ID NO: 5312508 - DNA, 19 bp, Homo sapiens
tccttgatgccagagggcc

SEQ ID NO: 5312509 - DNA, 22 bp, Homo sapiens
tccttgatgtacagattttatt

SEQ ID NO: 5312510 - DNA, 18 bp, Homo sapiens
tccttgattacttccact

SEQ ID NO: 5312511 - DNA, 22 bp, Homo sapiens
tccttgatttatcacacaaagc

SEQ ID NO: 5312512 - DNA, 17 bp, Homo sapiens
tccttgcaaccaggcag

SEQ ID NO: 5312513 - DNA, 18 bp, Homo sapiens
tccttgcaaccaggcagc

SEQ ID NO: 5312514 - DNA, 19 bp, Homo sapiens
tccttgcaaccaggcagct

SEQ ID NO: 5312515 - DNA, 21 bp, Homo sapiens
tccttgcacactcccctgcac

SEQ ID NO: 5312516 - DNA, 24 bp, Homo sapiens
tccttgcacccctcactctggcct

SEQ ID NO: 5312517 - DNA, 19 bp, Homo sapiens
tccttgcacctcagcctcc

SEQ ID NO: 5312518 - DNA, 15 bp, Homo sapiens
tccttgcatcaattt

SEQ ID NO: 5312519 - DNA, 15 bp, Homo sapiens
tccttgccacaatca

SEQ ID NO: 5312520 - DNA, 13 bp, Homo sapiens
tccttgccacccc

SEQ ID NO: 5312521 - DNA, 19 bp, Homo sapiens
tccttgccagccccacccc

SEQ ID NO: 5312522 - DNA, 13 bp, Homo sapiens
tccttgcccaggt

SEQ ID NO: 5312523 - DNA, 22 bp, Homo sapiens
tccttgcccaggtgagggaagg

SEQ ID NO: 5312524 - DNA, 23 bp, Homo sapiens
tccttgcccaggtgagggaagga

SEQ ID NO: 5312525 - DNA, 13 bp, Homo sapiens
tccttgccccaca

SEQ ID NO: 5312526 - DNA, 16 bp, Homo sapiens
tccttgccccacagtt

SEQ ID NO: 5312527 - DNA, 15 bp, Homo sapiens
tccttgccccactcc

SEQ ID NO: 5312528 - DNA, 15 bp, Homo sapiens
tccttgcccctgctc

SEQ ID NO: 5312529 - DNA, 22 bp, Homo sapiens
tccttgcccctgctctgtagcc

SEQ ID NO: 5312530 - DNA, 15 bp, Homo sapiens
tccttgccctgggcc

SEQ ID NO: 5312531 - DNA, 19 bp, Homo sapiens
tccttgccctgggccagcc

SEQ ID NO: 5312532 - DNA, 21 bp, Homo sapiens
tccttgcctgaactccagagg

SEQ ID NO: 5312533 - DNA, 12 bp, Homo sapiens
tccttgcctggt

SEQ ID NO: 5312534 - DNA, 21 bp, Homo sapiens
tccttgccttaataaatatgt

SEQ ID NO: 5312535 - DNA, 15 bp, Homo sapiens
tccttgccttcaaac

SEQ ID NO: 5312536 - DNA, 13 bp, Homo sapiens
tccttgctcctgg

SEQ ID NO: 5312537 - DNA, 18 bp, Homo sapiens
tccttgctcctggaacct

SEQ ID NO: 5312538 - DNA, 15 bp, Homo sapiens
tccttgctctgcacc

SEQ ID NO: 5312539 - DNA, 23 bp, Homo sapiens
tccttgctgaaacgcatctagtt

SEQ ID NO: 5312540 - DNA, 22 bp, Homo sapiens
tccttgctgcaaggctcttcct

SEQ ID NO: 5312541 - DNA, 14 bp, Homo sapiens
tccttgctgcagct

SEQ ID NO: 5312542 - DNA, 17 bp, Homo sapiens
tccttgctgcagcttct

SEQ ID NO: 5312543 - DNA, 18 bp, Homo sapiens
tccttgctggtagaagct

SEQ ID NO: 5312544 - DNA, 22 bp, Homo sapiens
tccttgcttatgacatcacttg

SEQ ID NO: 5312545 - DNA, 14 bp, Homo sapiens
tccttgctttacaa

SEQ ID NO: 5312546 - DNA, 16 bp, Homo sapiens
tccttggaaggtcttt

SEQ ID NO: 5312547 - DNA, 16 bp, Homo sapiens
tccttggactccatcg

SEQ ID NO: 5312548 - DNA, 16 bp, Homo sapiens
tccttggagagcagct

SEQ ID NO: 5312549 - DNA, 13 bp, Homo sapiens
tccttggaggcca

SEQ ID NO: 5312550 - DNA, 17 bp, Homo sapiens
tccttggagtcccaggg

SEQ ID NO: 5312551 - DNA, 20 bp, Homo sapiens
tccttggagtgctgcagctt

SEQ ID NO: 5312552 - DNA, 21 bp, Homo sapiens
tccttggagtgctgcagcttt

SEQ ID NO: 5312553 - DNA, 22 bp, Homo sapiens
tccttggattttcctgaaagtg

SEQ ID NO: 5312554 - DNA, 17 bp, Homo sapiens
tccttggcaactttctt

SEQ ID NO: 5312555 - DNA, 12 bp, Homo sapiens
tccttggcacca

SEQ ID NO: 5312556 - DNA, 16 bp, Homo sapiens
tccttggcaccaaaga

SEQ ID NO: 5312557 - DNA, 19 bp, Homo sapiens
tccttggcacccccatgct

SEQ ID NO: 5312558 - DNA, 23 bp, Homo sapiens
tccttggcaggctgatttctagg

SEQ ID NO: 5312559 - DNA, 15 bp, Homo sapiens
tccttggcatgcctt

SEQ ID NO: 5312560 - DNA, 17 bp, Homo sapiens
tccttggcatgccttcc

SEQ ID NO: 5312561 - DNA, 18 bp, Homo sapiens
tccttggcatgccttcca

SEQ ID NO: 5312562 - DNA, 20 bp, Homo sapiens
tccttggcatgccttccagc

SEQ ID NO: 5312563 - DNA, 18 bp, Homo sapiens
tccttggccaagagaagg

SEQ ID NO: 5312564 - DNA, 16 bp, Homo sapiens
tccttggccatgcaga

SEQ ID NO: 5312565 - DNA, 15 bp, Homo sapiens
tccttggcccagcag

SEQ ID NO: 5312566 - DNA, 17 bp, Homo sapiens
tccttggcccagcagcg

SEQ ID NO: 5312567 - DNA, 23 bp, Homo sapiens
tccttggcccagcagcggcccag

SEQ ID NO: 5312568 - DNA, 23 bp, Homo sapiens
tccttggcctgctaaggtcttgg

SEQ ID NO: 5312569 - DNA, 17 bp, Homo sapiens
tccttggctgaattaaa

SEQ ID NO: 5312570 - DNA, 17 bp, Homo sapiens
tccttggctgcagccat

SEQ ID NO: 5312571 - DNA, 22 bp, Homo sapiens
tccttggcttgcctggtggggg

SEQ ID NO: 5312572 - DNA, 14 bp, Homo sapiens
tccttgggaggaag

SEQ ID NO: 5312573 - DNA, 21 bp, Homo sapiens
tccttgggaggaagcagaata

SEQ ID NO: 5312574 - DNA, 22 bp, Homo sapiens
tccttgggaggaagcagaataa

SEQ ID NO: 5312575 - DNA, 23 bp, Homo sapiens
tccttgggaggaagcagaataaa

SEQ ID NO: 5312576 - DNA, 20 bp, Homo sapiens
tccttgggaggccccactgg

SEQ ID NO: 5312577 - DNA, 14 bp, Homo sapiens
tccttgggcctggc

SEQ ID NO: 5312578 - DNA, 16 bp, Homo sapiens
tccttgggcctggcca

SEQ ID NO: 5312579 - DNA, 17 bp, Homo sapiens
tccttgggcgtctcccc

SEQ ID NO: 5312580 - DNA, 18 bp, Homo sapiens
tccttgggcgtctccccc

SEQ ID NO: 5312581 - DNA, 18 bp, Homo sapiens
tccttgggcgtctctaat

SEQ ID NO: 5312582 - DNA, 17 bp, Homo sapiens
tccttgggctcctggct

SEQ ID NO: 5312583 - DNA, 21 bp, Homo sapiens
tccttgggctcctggctgcca

SEQ ID NO: 5312584 - DNA, 20 bp, Homo sapiens
tccttggggaaacttgggaa

SEQ ID NO: 5312585 - DNA, 21 bp, Homo sapiens
tccttggggaggggtcagctc

SEQ ID NO: 5312586 - DNA, 15 bp, Homo sapiens
tccttggggcaggca

SEQ ID NO: 5312587 - DNA, 17 bp, Homo sapiens
tccttggggcagggcct

SEQ ID NO: 5312588 - DNA, 20 bp, Homo sapiens
tccttgggtcattgacctct

SEQ ID NO: 5312589 - DNA, 19 bp, Homo sapiens
tccttggtctatgtgctct

SEQ ID NO: 5312590 - DNA, 16 bp, Homo sapiens
tccttggtctgctggt

SEQ ID NO: 5312591 - DNA, 15 bp, Homo sapiens
tccttggtgcctctg

SEQ ID NO: 5312592 - DNA, 18 bp, Homo sapiens
tccttggtgcctggcctg

SEQ ID NO: 5312593 - DNA, 16 bp, Homo sapiens
tccttggtgctaaaga

SEQ ID NO: 5312594 - DNA, 15 bp, Homo sapiens
tccttggtgctgtgt

SEQ ID NO: 5312595 - DNA, 21 bp, Homo sapiens
tccttggtgtcgggcatgaca

SEQ ID NO: 5312596 - DNA, 22 bp, Homo sapiens
tccttggtgtcgggcatgacac

SEQ ID NO: 5312597 - DNA, 17 bp, Homo sapiens
tccttggtgtggaggtg

SEQ ID NO: 5312598 - DNA, 15 bp, Homo sapiens
tccttggttgggtca

SEQ ID NO: 5312599 - DNA, 19 bp, Homo sapiens
tccttggtttgctagtatc

SEQ ID NO: 5312600 - DNA, 21 bp, Homo sapiens
tccttggtttgctagtatctt

SEQ ID NO: 5312601 - DNA, 12 bp, Homo sapiens
tccttgtacttg

SEQ ID NO: 5312602 - DNA, 20 bp, Homo sapiens
tccttgtagacgcacctgct

SEQ ID NO: 5312603 - DNA, 19 bp, Homo sapiens
tccttgtagccttttgact

SEQ ID NO: 5312604 - DNA, 20 bp, Homo sapiens
tccttgtagccttttgactt

SEQ ID NO: 5312605 - DNA, 23 bp, Homo sapiens
tccttgtataaggagctttgctc

SEQ ID NO: 5312606 - DNA, 22 bp, Homo sapiens
tccttgtatgaataaaaggctg

SEQ ID NO: 5312607 - DNA, 20 bp, Homo sapiens
tccttgtcaacaaagtgctt

SEQ ID NO: 5312608 - DNA, 21 bp, Homo sapiens
tccttgtcaacaaagtgcttt

SEQ ID NO: 5312609 - DNA, 22 bp, Homo sapiens
tccttgtcacagaatctccatt

SEQ ID NO: 5312610 - DNA, 19 bp, Homo sapiens
tccttgtcactgaagattg

SEQ ID NO: 5312611 - DNA, 20 bp, Homo sapiens
tccttgtcagggtctccttc

SEQ ID NO: 5312612 - DNA, 16 bp, Homo sapiens
tccttgtccacccacc

SEQ ID NO: 5312613 - DNA, 14 bp, Homo sapiens
tccttgtccccaca

SEQ ID NO: 5312614 - DNA, 17 bp, Homo sapiens
tccttgtccccacactc

SEQ ID NO: 5312615 - DNA, 22 bp, Homo sapiens
tccttgtccccacactcctaca

SEQ ID NO: 5312616 - DNA, 12 bp, Homo sapiens
tccttgtctctg

SEQ ID NO: 5312617 - DNA, 15 bp, Homo sapiens
tccttgtcttgtaat

SEQ ID NO: 5312618 - DNA, 19 bp, Homo sapiens
tccttgtgacttacaattt

SEQ ID NO: 5312619 - DNA, 17 bp, Homo sapiens
tccttgtgatgtgcacg

SEQ ID NO: 5312620 - DNA, 19 bp, Homo sapiens
tccttgtgcaattgtcttt

SEQ ID NO: 5312621 - DNA, 12 bp, Homo sapiens
tccttgtgcatg

SEQ ID NO: 5312622 - DNA, 20 bp, Homo sapiens
tccttgtggactggctgtgc

SEQ ID NO: 5312623 - DNA, 17 bp, Homo sapiens
tccttgtggcctatgaa

SEQ ID NO: 5312624 - DNA, 23 bp, Homo sapiens
tccttgtggccttttttataact

SEQ ID NO: 5312625 - DNA, 19 bp, Homo sapiens
tccttgtgggcctgggctc

SEQ ID NO: 5312626 - DNA, 21 bp, Homo sapiens
tccttgtgtatcctgacagcg

SEQ ID NO: 5312627 - DNA, 14 bp, Homo sapiens
tccttgtgttacta

SEQ ID NO: 5312628 - DNA, 14 bp, Homo sapiens
tccttgtgttttgt

SEQ ID NO: 5312629 - DNA, 19 bp, Homo sapiens
tccttgttacccatgaaaa

SEQ ID NO: 5312630 - DNA, 17 bp, Homo sapiens
tccttgttcatggagag

SEQ ID NO: 5312631 - DNA, 16 bp, Homo sapiens
tccttgttggtcagag

SEQ ID NO: 5312632 - DNA, 18 bp, Homo sapiens
tccttgttggtcagagga

SEQ ID NO: 5312633 - DNA, 21 bp, Homo sapiens
tccttgttgtttcttgcctga

SEQ ID NO: 5312634 - DNA, 21 bp, Homo sapiens
tccttgtttatcagatacatc

SEQ ID NO: 5312635 - DNA, 13 bp, Homo sapiens
tccttgtttcaaa

SEQ ID NO: 5312636 - DNA, 22 bp, Homo sapiens
tccttgtttcaaacacaaatgc

SEQ ID NO: 5312637 - DNA, 22 bp, Homo sapiens
tccttgttttaagattgtaatt

SEQ ID NO: 5312638 - DNA, 18 bp, Homo sapiens
tcctttaaaaaagaaaag

SEQ ID NO: 5312639 - DNA, 15 bp, Homo sapiens
tcctttaaagtgagt

SEQ ID NO: 5312640 - DNA, 18 bp, Homo sapiens
tcctttaaattctccaac

SEQ ID NO: 5312641 - DNA, 16 bp, Homo sapiens
tcctttaaatttcagc

SEQ ID NO: 5312642 - DNA, 11 bp, Homo sapiens
tcctttaacaa

SEQ ID NO: 5312643 - DNA, 23 bp, Homo sapiens
tcctttaacctttgctgtagtgt

SEQ ID NO: 5312644 - DNA, 15 bp, Homo sapiens
tcctttaactctgcg

SEQ ID NO: 5312645 - DNA, 14 bp, Homo sapiens
tcctttaatatgaa

SEQ ID NO: 5312646 - DNA, 18 bp, Homo sapiens
tcctttaatatgaaattt

SEQ ID NO: 5312647 - DNA, 22 bp, Homo sapiens
tcctttacaaaagaaatacctt

SEQ ID NO: 5312648 - DNA, 20 bp, Homo sapiens
tcctttacaactaaataaca

SEQ ID NO: 5312649 - DNA, 21 bp, Homo sapiens
tcctttacaactaaataacac

SEQ ID NO: 5312650 - DNA, 15 bp, Homo sapiens
tcctttaccctcatc

SEQ ID NO: 5312651 - DNA, 22 bp, Homo sapiens
tcgcccatgagagcgcagcccg

SEQ ID NO: 5312652 - DNA, 19 bp, Homo sapiens
tcgcccatgctggagtgca

SEQ ID NO: 5312653 - DNA, 22 bp, Homo sapiens
tcgccccaacactgtccttccc

SEQ ID NO: 5312654 - DNA, 11 bp, Homo sapiens
tcgccccaccc

SEQ ID NO: 5312655 - DNA, 12 bp, Homo sapiens
tcgccccaccca

SEQ ID NO: 5312656 - DNA, 15 bp, Homo sapiens
tcgccccagatcacc

SEQ ID NO: 5312657 - DNA, 12 bp, Homo sapiens
tcgcccccacca

SEQ ID NO: 5312658 - DNA, 20 bp, Homo sapiens
tcgcccccaccagtgtagca

SEQ ID NO: 5312659 - DNA, 13 bp, Homo sapiens
tcgcccccacttt

SEQ ID NO: 5312660 - DNA, 16 bp, Homo sapiens
tcgccccctgcctgcc

SEQ ID NO: 5312661 - DNA, 18 bp, Homo sapiens
tcgccccctgcctgccat

SEQ ID NO: 5312662 - DNA, 15 bp, Homo sapiens
tcgccccgtgtttgc

SEQ ID NO: 5312663 - DNA, 17 bp, Homo sapiens
tcgcccctcagagcatg

SEQ ID NO: 5312664 - DNA, 13 bp, Homo sapiens
tcgcccctccagt

SEQ ID NO: 5312665 - DNA, 13 bp, Homo sapiens
tcgcccctcccct

SEQ ID NO: 5312666 - DNA, 12 bp, Homo sapiens
tcgcccctcctc

SEQ ID NO: 5312667 - DNA, 13 bp, Homo sapiens
tcgcccctcctcg

SEQ ID NO: 5312668 - DNA, 22 bp, Homo sapiens
tcgcccgagctgtttatgtttt

SEQ ID NO: 5312669 - DNA, 17 bp, Homo sapiens
tcgcccgcccactgtcc

SEQ ID NO: 5312670 - DNA, 19 bp, Homo sapiens
tcgcccgcccactgtcctg

SEQ ID NO: 5312671 - DNA, 20 bp, Homo sapiens
tcgcccgcccactgtcctgg

SEQ ID NO: 5312672 - DNA, 21 bp, Homo sapiens
tcgcccgcccactgtcctggg

SEQ ID NO: 5312673 - DNA, 14 bp, Homo sapiens
tcgccctcccaggc

SEQ ID NO: 5312674 - DNA, 16 bp, Homo sapiens
tcgccctcctttccct

SEQ ID NO: 5312675 - DNA, 17 bp, Homo sapiens
tcgccctcctttccctt

SEQ ID NO: 5312676 - DNA, 14 bp, Homo sapiens
tcgccctctctcac

SEQ ID NO: 5312677 - DNA, 18 bp, Homo sapiens
tcgccctctctcaccagc

SEQ ID NO: 5312678 - DNA, 20 bp, Homo sapiens
tcgccctctctcaccagcct

SEQ ID NO: 5312679 - DNA, 21 bp, Homo sapiens
tcgccctctctcaccagcctt

SEQ ID NO: 5312680 - DNA, 14 bp, Homo sapiens
tcgccctctgtgcc

SEQ ID NO: 5312681 - DNA, 18 bp, Homo sapiens
tcgccctctgtgcctaat

SEQ ID NO: 5312682 - DNA, 19 bp, Homo sapiens
tcgccctctgtgcctaata

SEQ ID NO: 5312683 - DNA, 18 bp, Homo sapiens
tcgccctggactgtgtgc

SEQ ID NO: 5312684 - DNA, 17 bp, Homo sapiens
tcgccctggcaggcagg

SEQ ID NO: 5312685 - DNA, 21 bp, Homo sapiens
tcgccctgtccctcccactcc

SEQ ID NO: 5312686 - DNA, 12 bp, Homo sapiens
tcgccctgtgcc

SEQ ID NO: 5312687 - DNA, 16 bp, Homo sapiens
tcgcccttcagcccac

SEQ ID NO: 5312688 - DNA, 12 bp, Homo sapiens
tcgcccttctcc

SEQ ID NO: 5312689 - DNA, 16 bp, Homo sapiens
tcgccggatctgaggg

SEQ ID NO: 5312690 - DNA, 16 bp, Homo sapiens
tcgccgtgtctcagcc

SEQ ID NO: 5312691 - DNA, 22 bp, Homo sapiens
tcgcctactaagtacccttggg

SEQ ID NO: 5312692 - DNA, 13 bp, Homo sapiens
tcgcctaggattt

SEQ ID NO: 5312693 - DNA, 18 bp, Homo sapiens
tcgcctaggatttcagcc

SEQ ID NO: 5312694 - DNA, 15 bp, Homo sapiens
tcgcctatcttaggt

SEQ ID NO: 5312695 - DNA, 16 bp, Homo sapiens
tcgcctcctcctcctg

SEQ ID NO: 5312696 - DNA, 19 bp, Homo sapiens
tcgcctcctcctcctgccc

SEQ ID NO: 5312697 - DNA, 23 bp, Homo sapiens
tcgcctcggatcagctgagcctt

SEQ ID NO: 5312698 - DNA, 18 bp, Homo sapiens
tcgcctgagcccaggagg

SEQ ID NO: 5312699 - DNA, 12 bp, Homo sapiens
tcgcctgcctgc

SEQ ID NO: 5312700 - DNA, 14 bp, Homo sapiens
tcgcctgggacgcc

SEQ ID NO: 5312701 - DNA, 17 bp, Homo sapiens
tcgcctgggcccaggct

SEQ ID NO: 5312702 - DNA, 20 bp, Homo sapiens
tcgcctgtggagctcagccc

SEQ ID NO: 5312703 - DNA, 16 bp, Homo sapiens
tcgcctgtgggaagag

SEQ ID NO: 5312704 - DNA, 18 bp, Homo sapiens
tcgcctgtgggaagagaa

SEQ ID NO: 5312705 - DNA, 15 bp, Homo sapiens
tcgccttccacctct

SEQ ID NO: 5312706 - DNA, 16 bp, Homo sapiens
tcgccttccctcctgc

SEQ ID NO: 5312707 - DNA, 12 bp, Homo sapiens
tcgccttctggg

SEQ ID NO: 5312708 - DNA, 14 bp, Homo sapiens
tcgcctttcagcag

SEQ ID NO: 5312709 - DNA, 16 bp, Homo sapiens
tcgcctttcagcaggc

SEQ ID NO: 5312710 - DNA, 22 bp, Homo sapiens
tcgcctttcagcaggcagcctt

SEQ ID NO: 5312711 - DNA, 23 bp, Homo sapiens
tcgcctttcccaggtgctacacc

SEQ ID NO: 5312712 - DNA, 23 bp, Homo sapiens
tcgcctttgtcttgtacttctgt

SEQ ID NO: 5312713 - DNA, 13 bp, Homo sapiens
tcgcgacaatgca

SEQ ID NO: 5312714 - DNA, 19 bp, Homo sapiens
tcgcgagcacatgttcata

SEQ ID NO: 5312715 - DNA, 23 bp, Homo sapiens
tcgcgccagcgacctctctgcct

SEQ ID NO: 5312716 - DNA, 14 bp, Homo sapiens
tcgcgcccaaaaga

SEQ ID NO: 5312717 - DNA, 12 bp, Homo sapiens
tcgcgcccctgt

SEQ ID NO: 5312718 - DNA, 17 bp, Homo sapiens
tcgcgcccgcccctgca

SEQ ID NO: 5312719 - DNA, 15 bp, Homo sapiens
tcgcgctcagtaaac

SEQ ID NO: 5312720 - DNA, 23 bp, Homo sapiens
tcgcgctggaatccagaaggaag

SEQ ID NO: 5312721 - DNA, 22 bp, Homo sapiens
tcgcggccctcagtagtccctg

SEQ ID NO: 5312722 - DNA, 19 bp, Homo sapiens
tcgcggcggagctggcccc

SEQ ID NO: 5312723 - DNA, 20 bp, Homo sapiens
tcgcggcggagctggccccg

SEQ ID NO: 5312724 - DNA, 20 bp, Homo sapiens
tcgcggctgggagcctcgcc

SEQ ID NO: 5312725 - DNA, 21 bp, Homo sapiens
tcgcggctgggagcctcgccc

SEQ ID NO: 5312726 - DNA, 15 bp, Homo sapiens
tcgcgggcagcgggc

SEQ ID NO: 5312727 - DNA, 22 bp, Homo sapiens
tcgcgggcagcgggccaggccc

SEQ ID NO: 5312728 - DNA, 23 bp, Homo sapiens
tcgcggggcagcaaagcagctga

SEQ ID NO: 5312729 - DNA, 14 bp, Homo sapiens
tcgcggtcttgggc

SEQ ID NO: 5312730 - DNA, 16 bp, Homo sapiens
tcgcggtcttgggcac

SEQ ID NO: 5312731 - DNA, 21 bp, Homo sapiens
tcgcggtgtgtcctctgtgcc

SEQ ID NO: 5312732 - DNA, 17 bp, Homo sapiens
tcgctaatcagtcattt

SEQ ID NO: 5312733 - DNA, 12 bp, Homo sapiens
tcgctagaaaaa

SEQ ID NO: 5312734 - DNA, 23 bp, Homo sapiens
tcgctagcatttcccaacacaaa

SEQ ID NO: 5312735 - DNA, 19 bp, Homo sapiens
tcgctagtcagtaaagata

SEQ ID NO: 5312736 - DNA, 19 bp, Homo sapiens
tcgctatgggaggcagccg

SEQ ID NO: 5312737 - DNA, 15 bp, Homo sapiens
tcgctattcccaggc

SEQ ID NO: 5312738 - DNA, 16 bp, Homo sapiens
tcgctattcccaggca

SEQ ID NO: 5312739 - DNA, 18 bp, Homo sapiens
tcgctattcccaggcagg

SEQ ID NO: 5312740 - DNA, 16 bp, Homo sapiens
tcgctcaccgctggcc

SEQ ID NO: 5312741 - DNA, 21 bp, Homo sapiens
tcgctcaccgctggcccttag

SEQ ID NO: 5312742 - DNA, 12 bp, Homo sapiens
tcgctcactgtt

SEQ ID NO: 5312743 - DNA, 13 bp, Homo sapiens
tcgctcagaagag

SEQ ID NO: 5312744 - DNA, 12 bp, Homo sapiens
tcgctcaggctg

SEQ ID NO: 5312745 - DNA, 19 bp, Homo sapiens
tcgctcaggctggagtgca

SEQ ID NO: 5312746 - DNA, 17 bp, Homo sapiens
tcgctcagtcagtgcac

SEQ ID NO: 5312747 - DNA, 13 bp, Homo sapiens
tcgctcagtctgt

SEQ ID NO: 5312748 - DNA, 16 bp, Homo sapiens
tcgctcagtctgttca

SEQ ID NO: 5312749 - DNA, 23 bp, Homo sapiens
tcgctccaactccaacatccact

SEQ ID NO: 5312750 - DNA, 18 bp, Homo sapiens
tcgctccaccttgcagct

SEQ ID NO: 5312751 - DNA, 21 bp, Homo sapiens
tcgctcccacattctgatgag

SEQ ID NO: 5312752 - DNA, 23 bp, Homo sapiens
tcgctcccatgcacaactctcca

SEQ ID NO: 5312753 - DNA, 12 bp, Homo sapiens
tcgctcccctct

SEQ ID NO: 5312754 - DNA, 13 bp, Homo sapiens
tcgctccctccca

SEQ ID NO: 5312755 - DNA, 14 bp, Homo sapiens
tcgctccctcccag

SEQ ID NO: 5312756 - DNA, 16 bp, Homo sapiens
tcgctcctcaacccct

SEQ ID NO: 5312757 - DNA, 22 bp, Homo sapiens
tcgctcctcaacccctcccctc

SEQ ID NO: 5312758 - DNA, 16 bp, Homo sapiens
tcgctcctcccagatg

SEQ ID NO: 5312759 - DNA, 18 bp, Homo sapiens
tcgctctcgctctctctc

SEQ ID NO: 5312760 - DNA, 21 bp, Homo sapiens
tcgctctctcgtactctctct

SEQ ID NO: 5312761 - DNA, 17 bp, Homo sapiens
tcgctctgctgcccagg

SEQ ID NO: 5312762 - DNA, 13 bp, Homo sapiens
tcgctctgctgga

SEQ ID NO: 5312763 - DNA, 20 bp, Homo sapiens
tcgctctgctggcctggccg

SEQ ID NO: 5312764 - DNA, 18 bp, Homo sapiens
tcgctctgtcacccaggc

SEQ ID NO: 5312765 - DNA, 18 bp, Homo sapiens
tcgctctgtcgcccaggc

SEQ ID NO: 5312766 - DNA, 19 bp, Homo sapiens
tcgctctgtcgcccaggct

SEQ ID NO: 5312767 - DNA, 20 bp, Homo sapiens
tcgctctgtcgcccaggctg

SEQ ID NO: 5312768 - DNA, 18 bp, Homo sapiens
tcgctctgttgcccaggc

SEQ ID NO: 5312769 - DNA, 12 bp, Homo sapiens
tcgctcttgagg

SEQ ID NO: 5312770 - DNA, 16 bp, Homo sapiens
tcgctgacttcatgga

SEQ ID NO: 5312771 - DNA, 17 bp, Homo sapiens
tcgctgacttcatggaa

SEQ ID NO: 5312772 - DNA, 12 bp, Homo sapiens
tcgctgatgcag

SEQ ID NO: 5312773 - DNA, 13 bp, Homo sapiens
tcgctgatgcaga

SEQ ID NO: 5312774 - DNA, 19 bp, Homo sapiens
tcgctgatgctgggctggg

SEQ ID NO: 5312775 - DNA, 19 bp, Homo sapiens
tcgctgcacatggcctgag

SEQ ID NO: 5312776 - DNA, 11 bp, Homo sapiens
tcgctgccacc

SEQ ID NO: 5312777 - DNA, 15 bp, Homo sapiens
tcgctgccaggacac

SEQ ID NO: 5312778 - DNA, 19 bp, Homo sapiens
tcgctgccaggacacctgc

SEQ ID NO: 5312779 - DNA, 19 bp, Homo sapiens
tcgctgccatcaccgctgg

SEQ ID NO: 5312780 - DNA, 18 bp, Homo sapiens
tcgctgccctctctgcca

SEQ ID NO: 5312781 - DNA, 16 bp, Homo sapiens
tcgctgccctgtggac

SEQ ID NO: 5312782 - DNA, 11 bp, Homo sapiens
tcgctgctgcg

SEQ ID NO: 5312783 - DNA, 16 bp, Homo sapiens
tcgctgcttcgtggga

SEQ ID NO: 5312784 - DNA, 17 bp, Homo sapiens
tcgctggacaacccaga

SEQ ID NO: 5312785 - DNA, 17 bp, Homo sapiens
tcgctggactattgtgc

SEQ ID NO: 5312786 - DNA, 20 bp, Homo sapiens
tcgctggactctcagtctct

SEQ ID NO: 5312787 - DNA, 22 bp, Homo sapiens
tcgctggatggcggaagctgct

SEQ ID NO: 5312788 - DNA, 17 bp, Homo sapiens
tcgctggcagagaaggc

SEQ ID NO: 5312789 - DNA, 14 bp, Homo sapiens
tcgctgggctgtgg

SEQ ID NO: 5312790 - DNA, 21 bp, Homo sapiens
tcgctggggaagggggctcca

SEQ ID NO: 5312791 - DNA, 19 bp, Homo sapiens
tcgctgtatgatttaggct

SEQ ID NO: 5312792 - DNA, 19 bp, Homo sapiens
tcgctgtcactggctggct

SEQ ID NO: 5312793 - DNA, 22 bp, Homo sapiens
tcgctgtcactggctggctcct

SEQ ID NO: 5312794 - DNA, 15 bp, Homo sapiens
tcgctgtccaagtgt

SEQ ID NO: 5312795 - DNA, 16 bp, Homo sapiens
tcgctgtccaagtgtt

SEQ ID NO: 5312796 - DNA, 16 bp, Homo sapiens
tcgctgtcctgctgtg

SEQ ID NO: 5312797 - DNA, 16 bp, Homo sapiens
tcgctgtgctaggtct

SEQ ID NO: 5312798 - DNA, 17 bp, Homo sapiens
tcgctgtggtttctcgt

SEQ ID NO: 5312799 - DNA, 17 bp, Homo sapiens
tcgctgttgctgaatag

SEQ ID NO: 5312800 - DNA, 20 bp, Homo sapiens
tcgcttatatgtccttgggt

SEQ ID NO: 5312801 - DNA, 14 bp, Homo sapiens
tcgcttcccccata

SEQ ID NO: 5312802 - DNA, 17 bp, Homo sapiens
tcgcttcccccatagcc

SEQ ID NO: 5312803 - DNA, 19 bp, Homo sapiens
tcgcttccctgaaagactg

SEQ ID NO: 5312804 - DNA, 14 bp, Homo sapiens
tcgcttctcctcca

SEQ ID NO: 5312805 - DNA, 22 bp, Homo sapiens
tcgcttctgtgtatctctttca

SEQ ID NO: 5312806 - DNA, 15 bp, Homo sapiens
tcgcttcttgcctct

SEQ ID NO: 5312807 - DNA, 22 bp, Homo sapiens
tcgcttgaaccggggaggtgga

SEQ ID NO: 5312808 - DNA, 14 bp, Homo sapiens
tcgcttgagcccag

SEQ ID NO: 5312809 - DNA, 14 bp, Homo sapiens
tcgcttgccaaagc

SEQ ID NO: 5312810 - DNA, 22 bp, Homo sapiens
tcgcttggctccatgctcctca

SEQ ID NO: 5312811 - DNA, 23 bp, Homo sapiens
tcgcttgtgcagaaaacattgtt

SEQ ID NO: 5312812 - DNA, 17 bp, Homo sapiens
tcgcttgttttaaaagg

SEQ ID NO: 5312813 - DNA, 17 bp, Homo sapiens
tcgctttctcagtgtgt

SEQ ID NO: 5312814 - DNA, 19 bp, Homo sapiens
tcgctttcttgctgtccaa

SEQ ID NO: 5312815 - DNA, 15 bp, Homo sapiens
tcgcttttaataaac

SEQ ID NO: 5312816 - DNA, 18 bp, Homo sapiens
tcgcttttaataaactgc

SEQ ID NO: 5312817 - DNA, 15 bp, Homo sapiens
tcgcttttggtattt

SEQ ID NO: 5312818 - DNA, 20 bp, Homo sapiens
tcggaaaaaaaaaaagaaaa

SEQ ID NO: 5312819 - DNA, 13 bp, Homo sapiens
tcggaaaaataat

SEQ ID NO: 5312820 - DNA, 20 bp, Homo sapiens
tcggaaaagcgtctttaaga

SEQ ID NO: 5312821 - DNA, 13 bp, Homo sapiens
tcggaaacactga

SEQ ID NO: 5312822 - DNA, 20 bp, Homo sapiens
tcggaaatacactacaaatg

SEQ ID NO: 5312823 - DNA, 15 bp, Homo sapiens
tcggaagaacatgaa

SEQ ID NO: 5312824 - DNA, 17 bp, Homo sapiens
tcggaagagagggctga

SEQ ID NO: 5312825 - DNA, 19 bp, Homo sapiens
tcggaagagagggctgagc

SEQ ID NO: 5312826 - DNA, 13 bp, Homo sapiens
tcggaatggtaac

SEQ ID NO: 5312827 - DNA, 13 bp, Homo sapiens
tcggaatgtcata

SEQ ID NO: 5312828 - DNA, 18 bp, Homo sapiens
tcggaattcataataaat

SEQ ID NO: 5312829 - DNA, 14 bp, Homo sapiens
tcggaattcctgca

SEQ ID NO: 5312830 - DNA, 19 bp, Homo sapiens
tctaaaataggttttccct

SEQ ID NO: 5312831 - DNA, 22 bp, Homo sapiens
tctaaaatatttatgaagaaaa

SEQ ID NO: 5312832 - DNA, 21 bp, Homo sapiens
tctaaaatcagaggtaaatag

SEQ ID NO: 5312833 - DNA, 18 bp, Homo sapiens
tctaaaatcttatagttc

SEQ ID NO: 5312834 - DNA, 23 bp, Homo sapiens
tctaaaatcttatagttctaggc

SEQ ID NO: 5312835 - DNA, 22 bp, Homo sapiens
tctaaaatgcctcagtgtattt

SEQ ID NO: 5312836 - DNA, 19 bp, Homo sapiens
tctaaaatgctgttctcaa

SEQ ID NO: 5312837 - DNA, 22 bp, Homo sapiens
tctaaaatgtgatgttctaagg

SEQ ID NO: 5312838 - DNA, 18 bp, Homo sapiens
tctaaaatgttaaaacat

SEQ ID NO: 5312839 - DNA, 22 bp, Homo sapiens
tctaaaatttcataattctgaa

SEQ ID NO: 5312840 - DNA, 19 bp, Homo sapiens
tctaaacaaaattgcaatt

SEQ ID NO: 5312841 - DNA, 22 bp, Homo sapiens
tctaaacaagaaccatttgcaa

SEQ ID NO: 5312842 - DNA, 18 bp, Homo sapiens
tctaaacaagaatcagtc

SEQ ID NO: 5312843 - DNA, 21 bp, Homo sapiens
tctaaacacacttagaatact

SEQ ID NO: 5312844 - DNA, 20 bp, Homo sapiens
tctaaacacttcattcttta

SEQ ID NO: 5312845 - DNA, 17 bp, Homo sapiens
tctaaacagaaattatt

SEQ ID NO: 5312846 - DNA, 22 bp, Homo sapiens
tctaaacataagtaactttaag

SEQ ID NO: 5312847 - DNA, 23 bp, Homo sapiens
tctaaaccaagattatgtgactt

SEQ ID NO: 5312848 - DNA, 18 bp, Homo sapiens
tctaaaccacaaaagttg

SEQ ID NO: 5312849 - DNA, 18 bp, Homo sapiens
tctaaaccatgaaaagtt

SEQ ID NO: 5312850 - DNA, 20 bp, Homo sapiens
tctaaacccaaataaatgtg

SEQ ID NO: 5312851 - DNA, 24 bp, Homo sapiens
tctaaacccagcaaaacagattca

SEQ ID NO: 5312852 - DNA, 14 bp, Homo sapiens
tctaaacggtgacc

SEQ ID NO: 5312853 - DNA, 21 bp, Homo sapiens
tctaaacgtaagcactgtttt

SEQ ID NO: 5312854 - DNA, 20 bp, Homo sapiens
tctaaacgtggtcaccttcg

SEQ ID NO: 5312855 - DNA, 23 bp, Homo sapiens
tctaaactaggattgacattcta

SEQ ID NO: 5312856 - DNA, 22 bp, Homo sapiens
tctaaactgccccctctgccct

SEQ ID NO: 5312857 - DNA, 14 bp, Homo sapiens
tctaaactggagac

SEQ ID NO: 5312858 - DNA, 15 bp, Homo sapiens
tctaaactggtacaa

SEQ ID NO: 5312859 - DNA, 18 bp, Homo sapiens
tctaaactggtacaattt

SEQ ID NO: 5312860 - DNA, 12 bp, Homo sapiens
tctaaactgttt

SEQ ID NO: 5312861 - DNA, 14 bp, Homo sapiens
tctaaactgtttct

SEQ ID NO: 5312862 - DNA, 15 bp, Homo sapiens
tctaaactgtttctt

SEQ ID NO: 5312863 - DNA, 15 bp, Homo sapiens
tctaaactgttttca

SEQ ID NO: 5312864 - DNA, 18 bp, Homo sapiens
tctaaactgttttcatgt

SEQ ID NO: 5312865 - DNA, 17 bp, Homo sapiens
tctaaacttccccatct

SEQ ID NO: 5312866 - DNA, 19 bp, Homo sapiens
tctaaactttaatatgtat

SEQ ID NO: 5312867 - DNA, 13 bp, Homo sapiens
tctaaagaaaaat

SEQ ID NO: 5312868 - DNA, 19 bp, Homo sapiens
tctaaagaaaaatgcctgt

SEQ ID NO: 5312869 - DNA, 15 bp, Homo sapiens
tctaaagaaacagaa

SEQ ID NO: 5312870 - DNA, 17 bp, Homo sapiens
tctaaagaaagatactc

SEQ ID NO: 5312871 - DNA, 15 bp, Homo sapiens
tctaaagagaacaag

SEQ ID NO: 5312872 - DNA, 12 bp, Homo sapiens
tctaaagagcac

SEQ ID NO: 5312873 - DNA, 14 bp, Homo sapiens
tctaaagagcatct

SEQ ID NO: 5312874 - DNA, 20 bp, Homo sapiens
tctaaagagtttattttaag

SEQ ID NO: 5312875 - DNA, 18 bp, Homo sapiens
tctaaagataatattact

SEQ ID NO: 5312876 - DNA, 22 bp, Homo sapiens
tctaaagatctttttttaagtg

SEQ ID NO: 5312877 - DNA, 18 bp, Homo sapiens
tctaaagatggagtttct

SEQ ID NO: 5312878 - DNA, 19 bp, Homo sapiens
tctaaagatggagtttcta

SEQ ID NO: 5312879 - DNA, 20 bp, Homo sapiens
tctaaagatggagtttctaa

SEQ ID NO: 5312880 - DNA, 23 bp, Homo sapiens
tctaaagatggagtttctaaggt

SEQ ID NO: 5312881 - DNA, 13 bp, Homo sapiens
tctaaagattcta

SEQ ID NO: 5312882 - DNA, 12 bp, Homo sapiens
tctaaagcaaat

SEQ ID NO: 5312883 - DNA, 22 bp, Homo sapiens
tctaaagcactggtttcaagaa

SEQ ID NO: 5312884 - DNA, 23 bp, Homo sapiens
tctaaagcactggtttcaagaat

SEQ ID NO: 5312885 - DNA, 17 bp, Homo sapiens
tctaaagcagaggcaac

SEQ ID NO: 5312886 - DNA, 18 bp, Homo sapiens
tctaaagccaaaggtcta

SEQ ID NO: 5312887 - DNA, 20 bp, Homo sapiens
tctaaagccattgtagtcct

SEQ ID NO: 5312888 - DNA, 19 bp, Homo sapiens
tctaaagctggtttaatgt

SEQ ID NO: 5312889 - DNA, 17 bp, Homo sapiens
tctaaaggatgagattt

SEQ ID NO: 5312890 - DNA, 18 bp, Homo sapiens
tctaaaggatgagatttt

SEQ ID NO: 5312891 - DNA, 23 bp, Homo sapiens
tctaaaggcggagggtctccctg

SEQ ID NO: 5312892 - DNA, 19 bp, Homo sapiens
tctaaaggctacctttgta

SEQ ID NO: 5312893 - DNA, 20 bp, Homo sapiens
tctaaaggctacctttgtat

SEQ ID NO: 5312894 - DNA, 20 bp, Homo sapiens
tctaaagggatctgcttaaa

SEQ ID NO: 5312895 - DNA, 18 bp, Homo sapiens
tctaaaggtggtgaggca

SEQ ID NO: 5312896 - DNA, 14 bp, Homo sapiens
tctaaagtaaaatt

SEQ ID NO: 5312897 - DNA, 22 bp, Homo sapiens
tctaaagtgttggtctttctaa

SEQ ID NO: 5312898 - DNA, 19 bp, Homo sapiens
tctaaagtgtttagctgtc

SEQ ID NO: 5312899 - DNA, 20 bp, Homo sapiens
tctaaagttactactgattt

SEQ ID NO: 5312900 - DNA, 12 bp, Homo sapiens
tctaaagttata

SEQ ID NO: 5312901 - DNA, 14 bp, Homo sapiens
tctaaagttatatt

SEQ ID NO: 5312902 - DNA, 13 bp, Homo sapiens
tctaaagttctaa

SEQ ID NO: 5312903 - DNA, 15 bp, Homo sapiens
tctaaagttgctcca

SEQ ID NO: 5312904 - DNA, 11 bp, Homo sapiens
tctaaagttgt

SEQ ID NO: 5312905 - DNA, 12 bp, Homo sapiens
tctaaagtttac

SEQ ID NO: 5312906 - DNA, 17 bp, Homo sapiens
tctaaagtttacagtaa

SEQ ID NO: 5312907 - DNA, 18 bp, Homo sapiens
tctaaagtttacagtaaa

SEQ ID NO: 5312908 - DNA, 22 bp, Homo sapiens
tctaaagtttacagtaaataaa

SEQ ID NO: 5312909 - DNA, 14 bp, Homo sapiens
tctaaataaaaata

SEQ ID NO: 5312910 - DNA, 16 bp, Homo sapiens
tctaaataaaaatatg

SEQ ID NO: 5312911 - DNA, 18 bp, Homo sapiens
tctaaataaaaatatgta

SEQ ID NO: 5312912 - DNA, 15 bp, Homo sapiens
tctaaataaaatata

SEQ ID NO: 5312913 - DNA, 12 bp, Homo sapiens
tctaaataaaga

SEQ ID NO: 5312914 - DNA, 14 bp, Homo sapiens
tctaaataaggaat

SEQ ID NO: 5312915 - DNA, 19 bp, Homo sapiens
tctaaataaggaatttcct

SEQ ID NO: 5312916 - DNA, 15 bp, Homo sapiens
tctaaatagatactt

SEQ ID NO: 5312917 - DNA, 19 bp, Homo sapiens
tctaaatagatacttttga

SEQ ID NO: 5312918 - DNA, 18 bp, Homo sapiens
tctaaatagcgattataa

SEQ ID NO: 5312919 - DNA, 18 bp, Homo sapiens
tctaaataggatcctgga

SEQ ID NO: 5312920 - DNA, 14 bp, Homo sapiens
tctaaatattgctt

SEQ ID NO: 5312921 - DNA, 22 bp, Homo sapiens
tctaaatcactttaatttagaa

SEQ ID NO: 5312922 - DNA, 17 bp, Homo sapiens
tctaaatcatatataat

SEQ ID NO: 5312923 - DNA, 21 bp, Homo sapiens
tctaaatccgacttgaatatt

SEQ ID NO: 5312924 - DNA, 20 bp, Homo sapiens
tctaaatctatttattaata

SEQ ID NO: 5312925 - DNA, 16 bp, Homo sapiens
tctaaatcttccttgt

SEQ ID NO: 5312926 - DNA, 17 bp, Homo sapiens
tctaaatcttccttgtg

SEQ ID NO: 5312927 - DNA, 12 bp, Homo sapiens
tctaaatgcaat

SEQ ID NO: 5312928 - DNA, 23 bp, Homo sapiens
tctaaatgcatatcctgagccat

SEQ ID NO: 5312929 - DNA, 22 bp, Homo sapiens
tctaaatgtacaaattcttata

SEQ ID NO: 5312930 - DNA, 21 bp, Homo sapiens
tctaaatgtagttctgctcca

SEQ ID NO: 5312931 - DNA, 17 bp, Homo sapiens
tctaaattaaaaaagaa

SEQ ID NO: 5312932 - DNA, 18 bp, Homo sapiens
tctaaattaaagccttta

SEQ ID NO: 5312933 - DNA, 18 bp, Homo sapiens
tctaaattacaaaggtaa

SEQ ID NO: 5312934 - DNA, 13 bp, Homo sapiens
tctaaattcactg

SEQ ID NO: 5312935 - DNA, 17 bp, Homo sapiens
tctaaattctttatttc

SEQ ID NO: 5312936 - DNA, 15 bp, Homo sapiens
tctaaattctttcat

SEQ ID NO: 5312937 - DNA, 13 bp, Homo sapiens
tctaaattgaata

SEQ ID NO: 5312938 - DNA, 15 bp, Homo sapiens
tctaaattgaataat

SEQ ID NO: 5312939 - DNA, 21 bp, Homo sapiens
tctaaatttcttcctatttct

SEQ ID NO: 5312940 - DNA, 13 bp, Homo sapiens
tctaaatttgaat

SEQ ID NO: 5312941 - DNA, 17 bp, Homo sapiens
tctaaatttgaatgtta

SEQ ID NO: 5312942 - DNA, 22 bp, Homo sapiens
tctaaatttgaatgttaagcag

SEQ ID NO: 5312943 - DNA, 23 bp, Homo sapiens
tctaaatttgaatgttaagcaga

SEQ ID NO: 5312944 - DNA, 18 bp, Homo sapiens
tctaacaaatgatctagt

SEQ ID NO: 5312945 - DNA, 12 bp, Homo sapiens
tctaacaagtca

SEQ ID NO: 5312946 - DNA, 23 bp, Homo sapiens
tctaacaagtcataggttaatat

SEQ ID NO: 5312947 - DNA, 19 bp, Homo sapiens
tctaacaataatatttcaa

SEQ ID NO: 5312948 - DNA, 22 bp, Homo sapiens
tctaacaataatatttcaagtg

SEQ ID NO: 5312949 - DNA, 12 bp, Homo sapiens
tctaacacattt

SEQ ID NO: 5312950 - DNA, 23 bp, Homo sapiens
tctaacactcgactctgctgctc

SEQ ID NO: 5312951 - DNA, 11 bp, Homo sapiens
tctaacagcac

SEQ ID NO: 5312952 - DNA, 14 bp, Homo sapiens
tctaacagcaccaa

SEQ ID NO: 5312953 - DNA, 22 bp, Homo sapiens
tctaacagccctcctctgcact

SEQ ID NO: 5312954 - DNA, 15 bp, Homo sapiens
tctaacagctcagga

SEQ ID NO: 5312955 - DNA, 24 bp, Homo sapiens
tctaacatatgatactgatgccat

SEQ ID NO: 5312956 - DNA, 16 bp, Homo sapiens
tctaacatatgtatta

SEQ ID NO: 5312957 - DNA, 13 bp, Homo sapiens
tctaacatgaaat

SEQ ID NO: 5312958 - DNA, 20 bp, Homo sapiens
tctaacatttttgaggaagt

SEQ ID NO: 5312959 - DNA, 14 bp, Homo sapiens
tctaaccaaaaagt

SEQ ID NO: 5312960 - DNA, 17 bp, Homo sapiens
tctaaccaagaggctgg

SEQ ID NO: 5312961 - DNA, 18 bp, Homo sapiens
tctaaccaaggctgtgtt

SEQ ID NO: 5312962 - DNA, 13 bp, Homo sapiens
tctaaccaattgt

SEQ ID NO: 5312963 - DNA, 15 bp, Homo sapiens
tctaaccaattgtga

SEQ ID NO: 5312964 - DNA, 18 bp, Homo sapiens
tctaaccacacagcctac

SEQ ID NO: 5312965 - DNA, 17 bp, Homo sapiens
tctaaccacagctcctt

SEQ ID NO: 5312966 - DNA, 22 bp, Homo sapiens
tctaaccacagctccttttcca

SEQ ID NO: 5312967 - DNA, 20 bp, Homo sapiens
tctaaccacggttatttaag

SEQ ID NO: 5312968 - DNA, 16 bp, Homo sapiens
tctaacccaactgact

SEQ ID NO: 5312969 - DNA, 15 bp, Homo sapiens
tctaacccaagacat

SEQ ID NO: 5312970 - DNA, 15 bp, Homo sapiens
tctaacccagtctta

SEQ ID NO: 5312971 - DNA, 22 bp, Homo sapiens
tctaacccagtcttatttttct

SEQ ID NO: 5312972 - DNA, 17 bp, Homo sapiens
tctaaccccaggccccg

SEQ ID NO: 5312973 - DNA, 16 bp, Homo sapiens
tctaacccccagctgg

SEQ ID NO: 5312974 - DNA, 17 bp, Homo sapiens
tctaacccccagctggg

SEQ ID NO: 5312975 - DNA, 23 bp, Homo sapiens
tctaaccctaggcatcacatgct

SEQ ID NO: 5312976 - DNA, 19 bp, Homo sapiens
tctaaccctatactgtagt

SEQ ID NO: 5312977 - DNA, 15 bp, Homo sapiens
tctaaccctcccatg

SEQ ID NO: 5312978 - DNA, 20 bp, Homo sapiens
tctaacctcatcttcttcac

SEQ ID NO: 5312979 - DNA, 13 bp, Homo sapiens
tctaacctccttt

SEQ ID NO: 5312980 - DNA, 21 bp, Homo sapiens
tctaaccttcacgattaactg

SEQ ID NO: 5312981 - DNA, 21 bp, Homo sapiens
tctaaccttgaatgctgccag

SEQ ID NO: 5312982 - DNA, 21 bp, Homo sapiens
tctaacgcaaaaatagctctt

SEQ ID NO: 5312983 - DNA, 22 bp, Homo sapiens
tctaacgcaaaaatagctcttg

SEQ ID NO: 5312984 - DNA, 15 bp, Homo sapiens
tctaacgctgaactg

SEQ ID NO: 5312985 - DNA, 15 bp, Homo sapiens
tctaactacaaaggt

SEQ ID NO: 5312986 - DNA, 17 bp, Homo sapiens
tctaactacaaggacaa

SEQ ID NO: 5312987 - DNA, 19 bp, Homo sapiens
tctaactagaaatctgcca

SEQ ID NO: 5312988 - DNA, 15 bp, Homo sapiens
tctaactcaaagact

SEQ ID NO: 5312989 - DNA, 15 bp, Homo sapiens
tctaactcactgcct

SEQ ID NO: 5312990 - DNA, 16 bp, Homo sapiens
tctaactcagaattat

SEQ ID NO: 5312991 - DNA, 12 bp, Homo sapiens
tctaactccctc

SEQ ID NO: 5312992 - DNA, 13 bp, Homo sapiens
tctaactccctcc

SEQ ID NO: 5312993 - DNA, 14 bp, Homo sapiens
tctaactccctcct

SEQ ID NO: 5312994 - DNA, 22 bp, Homo sapiens
tctaactccctcctcacactcc

SEQ ID NO: 5312995 - DNA, 23 bp, Homo sapiens
tctaactccctcctcacactcca

SEQ ID NO: 5312996 - DNA, 19 bp, Homo sapiens
tctaactccttgaggtctt

SEQ ID NO: 5312997 - DNA, 17 bp, Homo sapiens
tctaactctgatgtaaa

SEQ ID NO: 5312998 - DNA, 13 bp, Homo sapiens
tctaactggacag

SEQ ID NO: 5312999 - DNA, 19 bp, Homo sapiens
tctaactggacagcctctt

SEQ ID NO: 5313000 - DNA, 13 bp, Homo sapiens
tctaactgtaaat

SEQ ID NO: 5313001 - DNA, 17 bp, Homo sapiens
tctaactgtaaatcact

SEQ ID NO: 5313002 - DNA, 20 bp, Homo sapiens
tctaactgtaaatcacttgt

SEQ ID NO: 5313003 - DNA, 12 bp, Homo sapiens
tctaactgtata

SEQ ID NO: 5313004 - DNA, 17 bp, Homo sapiens
tctaacttaatgtagtt

SEQ ID NO: 5313005 - DNA, 22 bp, Homo sapiens
tctaacttcaccatattaccac

SEQ ID NO: 5313006 - DNA, 13 bp, Homo sapiens
tctacccagccca

SEQ ID NO: 5313007 - DNA, 19 bp, Homo sapiens
tctacccatcttaaaaaca

SEQ ID NO: 5313008 - DNA, 21 bp, Homo sapiens
tctacccatcttaaaaacaac

SEQ ID NO: 5313009 - DNA, 23 bp, Homo sapiens
tctacccatgagcctgcccgctg

SEQ ID NO: 5313010 - DNA, 19 bp, Homo sapiens
tctacccatgttgggaaaa

SEQ ID NO: 5313011 - DNA, 12 bp, Homo sapiens
tctaccccacct

SEQ ID NO: 5313012 - DNA, 13 bp, Homo sapiens
tctaccccacctg

SEQ ID NO: 5313013 - DNA, 14 bp, Homo sapiens
tctaccccacctga

SEQ ID NO: 5313014 - DNA, 23 bp, Homo sapiens
tctaccccagactagatgtagta

SEQ ID NO: 5313015 - DNA, 16 bp, Homo sapiens
tctacccccaacacca

SEQ ID NO: 5313016 - DNA, 17 bp, Homo sapiens
tctacccccaacaccac

SEQ ID NO: 5313017 - DNA, 22 bp, Homo sapiens
tctacccctcccggccctgcct

SEQ ID NO: 5313018 - DNA, 13 bp, Homo sapiens
tctacccctggat

SEQ ID NO: 5313019 - DNA, 13 bp, Homo sapiens
tctacccctttct

SEQ ID NO: 5313020 - DNA, 19 bp, Homo sapiens
tctacccggcccagagacc

SEQ ID NO: 5313021 - DNA, 22 bp, Homo sapiens
tctacccggcccagagacccct

SEQ ID NO: 5313022 - DNA, 16 bp, Homo sapiens
tctacccgtgcctggg

SEQ ID NO: 5313023 - DNA, 22 bp, Homo sapiens
tctacccgtgcctgggcccctc

SEQ ID NO: 5313024 - DNA, 15 bp, Homo sapiens
tctaccctcccaccc

SEQ ID NO: 5313025 - DNA, 21 bp, Homo sapiens
tctaccctcttagaaaaacca

SEQ ID NO: 5313026 - DNA, 14 bp, Homo sapiens
tctaccctggcact

SEQ ID NO: 5313027 - DNA, 19 bp, Homo sapiens
tctaccctgggtcctcggg

SEQ ID NO: 5313028 - DNA, 21 bp, Homo sapiens
tctaccctgggtcctcgggcc

SEQ ID NO: 5313029 - DNA, 20 bp, Homo sapiens
tctaccctggtaggaaagca

SEQ ID NO: 5313030 - DNA, 23 bp, Homo sapiens
tctaccctgtctgtcccttttct

SEQ ID NO: 5313031 - DNA, 17 bp, Homo sapiens
tctacccttttcctttt

SEQ ID NO: 5313032 - DNA, 22 bp, Homo sapiens
tctaccgacctgtctccctggg

SEQ ID NO: 5313033 - DNA, 19 bp, Homo sapiens
tctaccgtaattgctttgt

SEQ ID NO: 5313034 - DNA, 21 bp, Homo sapiens
tctacctaatgtctcactgtt

SEQ ID NO: 5313035 - DNA, 16 bp, Homo sapiens
tctacctacatatttg

SEQ ID NO: 5313036 - DNA, 16 bp, Homo sapiens
tctacctagatttaat

SEQ ID NO: 5313037 - DNA, 21 bp, Homo sapiens
tctacctagatttaatataaa

SEQ ID NO: 5313038 - DNA, 14 bp, Homo sapiens
tctacctatatgca

SEQ ID NO: 5313039 - DNA, 22 bp, Homo sapiens
tctacctcaaggtaacaagagt

SEQ ID NO: 5313040 - DNA, 21 bp, Homo sapiens
tctacctccttagctttccct

SEQ ID NO: 5313041 - DNA, 11 bp, Homo sapiens
tctacctctct

SEQ ID NO: 5313042 - DNA, 14 bp, Homo sapiens
tctacctctctcct

SEQ ID NO: 5313043 - DNA, 13 bp, Homo sapiens
tctacctctgact

SEQ ID NO: 5313044 - DNA, 15 bp, Homo sapiens
tctacctctgacttc

SEQ ID NO: 5313045 - DNA, 13 bp, Homo sapiens
tctacctgagcat

SEQ ID NO: 5313046 - DNA, 20 bp, Homo sapiens
tctacctgagcattcaggca

SEQ ID NO: 5313047 - DNA, 18 bp, Homo sapiens
tctacctgcaacacaaca

SEQ ID NO: 5313048 - DNA, 16 bp, Homo sapiens
tctacctgcaggactc

SEQ ID NO: 5313049 - DNA, 22 bp, Homo sapiens
tctacctgcaggcggggctcct

SEQ ID NO: 5313050 - DNA, 14 bp, Homo sapiens
tctacctgccactc

SEQ ID NO: 5313051 - DNA, 15 bp, Homo sapiens
tctacctgccactca

SEQ ID NO: 5313052 - DNA, 21 bp, Homo sapiens
tctacctgccactcacacagc

SEQ ID NO: 5313053 - DNA, 12 bp, Homo sapiens
tctacctgccct

SEQ ID NO: 5313054 - DNA, 14 bp, Homo sapiens
tctacctgccctct

SEQ ID NO: 5313055 - DNA, 18 bp, Homo sapiens
tctacctgccctctctca

SEQ ID NO: 5313056 - DNA, 19 bp, Homo sapiens
tctacctgccctctctcag

SEQ ID NO: 5313057 - DNA, 17 bp, Homo sapiens
tctacctgctggacagc

SEQ ID NO: 5313058 - DNA, 20 bp, Homo sapiens
tctacctgctggacagcctc

SEQ ID NO: 5313059 - DNA, 16 bp, Homo sapiens
tctacctgcttggtct

SEQ ID NO: 5313060 - DNA, 12 bp, Homo sapiens
tctacctggagg

SEQ ID NO: 5313061 - DNA, 22 bp, Homo sapiens
tctacctggctacaattacttt

SEQ ID NO: 5313062 - DNA, 22 bp, Homo sapiens
tctacctgtacacattcctgca

SEQ ID NO: 5313063 - DNA, 18 bp, Homo sapiens
tctacctgtattgtctga

SEQ ID NO: 5313064 - DNA, 14 bp, Homo sapiens
tctacctgtcctcc

SEQ ID NO: 5313065 - DNA, 20 bp, Homo sapiens
tctacctgtgttcattctta

SEQ ID NO: 5313066 - DNA, 22 bp, Homo sapiens
tctacctgtgtttttttctaaa

SEQ ID NO: 5313067 - DNA, 13 bp, Homo sapiens
tctacctgttctg

SEQ ID NO: 5313068 - DNA, 15 bp, Homo sapiens
tctacctgttctgta

SEQ ID NO: 5313069 - DNA, 14 bp, Homo sapiens
tctaccttcataag

SEQ ID NO: 5313070 - DNA, 14 bp, Homo sapiens
tctaccttcatttt

SEQ ID NO: 5313071 - DNA, 21 bp, Homo sapiens
tctaccttccagtcaggatga

SEQ ID NO: 5313072 - DNA, 16 bp, Homo sapiens
tctaccttcctgtccc

SEQ ID NO: 5313073 - DNA, 18 bp, Homo sapiens
tctaccttcctgtccctg

SEQ ID NO: 5313074 - DNA, 20 bp, Homo sapiens
tctaccttctccccagctcc

SEQ ID NO: 5313075 - DNA, 16 bp, Homo sapiens
tctaccttgaggtctt

SEQ ID NO: 5313076 - DNA, 15 bp, Homo sapiens
tctaccttgcagtgt

SEQ ID NO: 5313077 - DNA, 20 bp, Homo sapiens
tctacgaagccacaggcctg

SEQ ID NO: 5313078 - DNA, 22 bp, Homo sapiens
tctacgccaatgttatgccagc

SEQ ID NO: 5313079 - DNA, 21 bp, Homo sapiens
tctacgccactccacaaatga

SEQ ID NO: 5313080 - DNA, 16 bp, Homo sapiens
tctacgctctcctttc

SEQ ID NO: 5313081 - DNA, 19 bp, Homo sapiens
tctacggtgtatggttctg

SEQ ID NO: 5313082 - DNA, 15 bp, Homo sapiens
tctacgtataaatat

SEQ ID NO: 5313083 - DNA, 16 bp, Homo sapiens
tctacgtataaatatg

SEQ ID NO: 5313084 - DNA, 20 bp, Homo sapiens
tctacgtataaatatgaaat

SEQ ID NO: 5313085 - DNA, 22 bp, Homo sapiens
tctacgtataaatatgaaatga

SEQ ID NO: 5313086 - DNA, 17 bp, Homo sapiens
tctacgtcatgtatttt

SEQ ID NO: 5313087 - DNA, 19 bp, Homo sapiens
tctacgtcatgtattttat

SEQ ID NO: 5313088 - DNA, 21 bp, Homo sapiens
tctacgtcatgtattttatga

SEQ ID NO: 5313089 - DNA, 15 bp, Homo sapiens
tctactaaaaataca

SEQ ID NO: 5313090 - DNA, 19 bp, Homo sapiens
tctactaaaaatacaaaaa

SEQ ID NO: 5313091 - DNA, 15 bp, Homo sapiens
tctactaaaaatgca

SEQ ID NO: 5313092 - DNA, 16 bp, Homo sapiens
tctactaaaaatgcaa

SEQ ID NO: 5313093 - DNA, 16 bp, Homo sapiens
tctactaaaattcaaa

SEQ ID NO: 5313094 - DNA, 21 bp, Homo sapiens
tctactaagttattttatgac

SEQ ID NO: 5313095 - DNA, 19 bp, Homo sapiens
tctactaatgcctcttcat

SEQ ID NO: 5313096 - DNA, 18 bp, Homo sapiens
tctactaggtctgctcct

SEQ ID NO: 5313097 - DNA, 14 bp, Homo sapiens
tctactatttatgt

SEQ ID NO: 5313098 - DNA, 21 bp, Homo sapiens
tctactatttgaaaaaagaag

SEQ ID NO: 5313099 - DNA, 22 bp, Homo sapiens
tctactcaaacacttattgttt

SEQ ID NO: 5313100 - DNA, 22 bp, Homo sapiens
tctactcaacccattgttgtca

SEQ ID NO: 5313101 - DNA, 14 bp, Homo sapiens
tctactcatatata

SEQ ID NO: 5313102 - DNA, 12 bp, Homo sapiens
tctactccaaat

SEQ ID NO: 5313103 - DNA, 16 bp, Homo sapiens
tctactccatggttct

SEQ ID NO: 5313104 - DNA, 15 bp, Homo sapiens
tctactccctcttgt

SEQ ID NO: 5313105 - DNA, 16 bp, Homo sapiens
tctactcctagaagaa

SEQ ID NO: 5313106 - DNA, 15 bp, Homo sapiens
tctactcctcacagc

SEQ ID NO: 5313107 - DNA, 12 bp, Homo sapiens
tctactcctgcc

SEQ ID NO: 5313108 - DNA, 14 bp, Homo sapiens
tctactcctgcctc

SEQ ID NO: 5313109 - DNA, 13 bp, Homo sapiens
tctactccttccc

SEQ ID NO: 5313110 - DNA, 19 bp, Homo sapiens
tctactccttgtaaagact

SEQ ID NO: 5313111 - DNA, 17 bp, Homo sapiens
tctactctagatggcaa

SEQ ID NO: 5313112 - DNA, 20 bp, Homo sapiens
tctactctaggactgggccc

SEQ ID NO: 5313113 - DNA, 18 bp, Homo sapiens
tctactctagggaaaaac

SEQ ID NO: 5313114 - DNA, 17 bp, Homo sapiens
tctactcttaagccatc

SEQ ID NO: 5313115 - DNA, 22 bp, Homo sapiens
tctactcttaagtttctcagct

SEQ ID NO: 5313116 - DNA, 12 bp, Homo sapiens
tctactcttcct

SEQ ID NO: 5313117 - DNA, 19 bp, Homo sapiens
tctactcttgagagctcag

SEQ ID NO: 5313118 - DNA, 21 bp, Homo sapiens
tctactcttttgaagtgtttt

SEQ ID NO: 5313119 - DNA, 22 bp, Homo sapiens
tctactgaattggcttccagat

SEQ ID NO: 5313120 - DNA, 14 bp, Homo sapiens
tctactgactatat

SEQ ID NO: 5313121 - DNA, 11 bp, Homo sapiens
tctactgagca

SEQ ID NO: 5313122 - DNA, 18 bp, Homo sapiens
tctactgaggtgctatgt

SEQ ID NO: 5313123 - DNA, 19 bp, Homo sapiens
tctactgaggtgctatgtt

SEQ ID NO: 5313124 - DNA, 13 bp, Homo sapiens
tctactgccctcc

SEQ ID NO: 5313125 - DNA, 14 bp, Homo sapiens
tctactgccctccc

SEQ ID NO: 5313126 - DNA, 17 bp, Homo sapiens
tctactgccctcccctt

SEQ ID NO: 5313127 - DNA, 18 bp, Homo sapiens
tctactgccttgaaaaat

SEQ ID NO: 5313128 - DNA, 22 bp, Homo sapiens
tctactgccttgaaaaatgaca

SEQ ID NO: 5313129 - DNA, 23 bp, Homo sapiens
tctactgcttggatccatacaaa

SEQ ID NO: 5313130 - DNA, 19 bp, Homo sapiens
tctactggataaacttgct

SEQ ID NO: 5313131 - DNA, 16 bp, Homo sapiens
tctactgggagcctac

SEQ ID NO: 5313132 - DNA, 16 bp, Homo sapiens
tctactggtcttgtgg

SEQ ID NO: 5313133 - DNA, 23 bp, Homo sapiens
tctactggtcttgtggaattggg

SEQ ID NO: 5313134 - DNA, 20 bp, Homo sapiens
tctactgtaagaagagccat

SEQ ID NO: 5313135 - DNA, 21 bp, Homo sapiens
tctactgtatggaatacaatg

SEQ ID NO: 5313136 - DNA, 14 bp, Homo sapiens
tctactgtctcctc

SEQ ID NO: 5313137 - DNA, 12 bp, Homo sapiens
tctactgtggca

SEQ ID NO: 5313138 - DNA, 22 bp, Homo sapiens
tctactgttatgtgagaacatt

SEQ ID NO: 5313139 - DNA, 12 bp, Homo sapiens
tctactgttgca

SEQ ID NO: 5313140 - DNA, 20 bp, Homo sapiens
tctacttacacatcttccac

SEQ ID NO: 5313141 - DNA, 14 bp, Homo sapiens
tctacttacagttg

SEQ ID NO: 5313142 - DNA, 19 bp, Homo sapiens
tctacttccaaactaattt

SEQ ID NO: 5313143 - DNA, 14 bp, Homo sapiens
tctacttccccatg

SEQ ID NO: 5313144 - DNA, 15 bp, Homo sapiens
tctacttcccctggg

SEQ ID NO: 5313145 - DNA, 19 bp, Homo sapiens
tctacttcccctgggatgc

SEQ ID NO: 5313146 - DNA, 20 bp, Homo sapiens
tctacttccccttcttgcca

SEQ ID NO: 5313147 - DNA, 22 bp, Homo sapiens
tctacttccccttcttgccatt

SEQ ID NO: 5313148 - DNA, 20 bp, Homo sapiens
tctacttctctgttgtcaaa

SEQ ID NO: 5313149 - DNA, 19 bp, Homo sapiens
tctacttctgcccttgcca

SEQ ID NO: 5313150 - DNA, 14 bp, Homo sapiens
tctacttctgtgtc

SEQ ID NO: 5313151 - DNA, 20 bp, Homo sapiens
tctacttgatatttccttca

SEQ ID NO: 5313152 - DNA, 16 bp, Homo sapiens
tctacttgcacactct

SEQ ID NO: 5313153 - DNA, 13 bp, Homo sapiens
tctacttgctctg

SEQ ID NO: 5313154 - DNA, 20 bp, Homo sapiens
tctacttgctctggacctgc

SEQ ID NO: 5313155 - DNA, 19 bp, Homo sapiens
tctacttgtaaaatgcttt

SEQ ID NO: 5313156 - DNA, 15 bp, Homo sapiens
tctacttgtcatatc

SEQ ID NO: 5313157 - DNA, 18 bp, Homo sapiens
tctacttgtcatatcact

SEQ ID NO: 5313158 - DNA, 17 bp, Homo sapiens
tctacttgtttaacatt

SEQ ID NO: 5313159 - DNA, 15 bp, Homo sapiens
tctactttaaattgt

SEQ ID NO: 5313160 - DNA, 16 bp, Homo sapiens
tctactttaaattgtg

SEQ ID NO: 5313161 - DNA, 19 bp, Homo sapiens
tctactttaaattgtggat

SEQ ID NO: 5313162 - DNA, 15 bp, Homo sapiens
tctactttaataaat

SEQ ID NO: 5313163 - DNA, 14 bp, Homo sapiens
tctactttataatc

SEQ ID NO: 5313164 - DNA, 19 bp, Homo sapiens
tctactttcatcttaaact

SEQ ID NO: 5313165 - DNA, 22 bp, Homo sapiens
tctactttccccagaggaccac

SEQ ID NO: 5313166 - DNA, 17 bp, Homo sapiens
tctactttccctctggg

SEQ ID NO: 5313167 - DNA, 13 bp, Homo sapiens
tctactttctctt

SEQ ID NO: 5313168 - DNA, 21 bp, Homo sapiens
tctactttgaaatatttaatt

SEQ ID NO: 5313169 - DNA, 12 bp, Homo sapiens
tctactttgaag

SEQ ID NO: 5313170 - DNA, 19 bp, Homo sapiens
tctactttgactaataccc

SEQ ID NO: 5313171 - DNA, 20 bp, Homo sapiens
tctactttgataaagtaaaa

SEQ ID NO: 5313172 - DNA, 17 bp, Homo sapiens
tctactttgattctgat

SEQ ID NO: 5313173 - DNA, 15 bp, Homo sapiens
tctactttgcccctt

SEQ ID NO: 5313174 - DNA, 17 bp, Homo sapiens
tctactttttccttcct

SEQ ID NO: 5313175 - DNA, 20 bp, Homo sapiens
tctactttttccttcctgcc

SEQ ID NO: 5313176 - DNA, 18 bp, Homo sapiens
tctactttttttttaatt

SEQ ID NO: 5313177 - DNA, 14 bp, Homo sapiens
tctagaaaaaaggg

SEQ ID NO: 5313178 - DNA, 16 bp, Homo sapiens
tctagaaaaacaggca

SEQ ID NO: 5313179 - DNA, 18 bp, Homo sapiens
tctagaaaaacaggcact

SEQ ID NO: 5313180 - DNA, 22 bp, Homo sapiens
tctagaaaaacaggcacttggc

SEQ ID NO: 5313181 - DNA, 16 bp, Homo sapiens
tctagaaaagcttcct

SEQ ID NO: 5313182 - DNA, 19 bp, Homo sapiens
tctagaaaagcttcctagc

SEQ ID NO: 5313183 - DNA, 16 bp, Homo sapiens
tctataaattgtagaa

SEQ ID NO: 5313184 - DNA, 19 bp, Homo sapiens
tctataaatttaagaaaac

SEQ ID NO: 5313185 - DNA, 13 bp, Homo sapiens
tctataacagata

SEQ ID NO: 5313186 - DNA, 19 bp, Homo sapiens
tctataacagatcctttca

SEQ ID NO: 5313187 - DNA, 21 bp, Homo sapiens
tctataacagatcctttcaaa

SEQ ID NO: 5313188 - DNA, 20 bp, Homo sapiens
tctataaccaaatgaaatat

SEQ ID NO: 5313189 - DNA, 13 bp, Homo sapiens
tctataagaaaaa

SEQ ID NO: 5313190 - DNA, 14 bp, Homo sapiens
tctataagaaaaag

SEQ ID NO: 5313191 - DNA, 15 bp, Homo sapiens
tctataagagaatta

SEQ ID NO: 5313192 - DNA, 16 bp, Homo sapiens
tctataagtgttcagt

SEQ ID NO: 5313193 - DNA, 19 bp, Homo sapiens
tctataagtgttcagtgtt

SEQ ID NO: 5313194 - DNA, 18 bp, Homo sapiens
tctataatatttcctttt

SEQ ID NO: 5313195 - DNA, 19 bp, Homo sapiens
tctataatcccagcacttt

SEQ ID NO: 5313196 - DNA, 20 bp, Homo sapiens
tctataatcccagcactttg

SEQ ID NO: 5313197 - DNA, 15 bp, Homo sapiens
tctataatggaaaca

SEQ ID NO: 5313198 - DNA, 19 bp, Homo sapiens
tctataatggaaacattta

SEQ ID NO: 5313199 - DNA, 21 bp, Homo sapiens
tctataattccttaaaatttt

SEQ ID NO: 5313200 - DNA, 13 bp, Homo sapiens
tctataatttcca

SEQ ID NO: 5313201 - DNA, 11 bp, Homo sapiens
tctatacaaat

SEQ ID NO: 5313202 - DNA, 16 bp, Homo sapiens
tctatacacaccctgc

SEQ ID NO: 5313203 - DNA, 13 bp, Homo sapiens
tctatacacataa

SEQ ID NO: 5313204 - DNA, 18 bp, Homo sapiens
tctatacatctctcccca

SEQ ID NO: 5313205 - DNA, 17 bp, Homo sapiens
tctatacattcctgaga

SEQ ID NO: 5313206 - DNA, 16 bp, Homo sapiens
tctataccaataaagt

SEQ ID NO: 5313207 - DNA, 18 bp, Homo sapiens
tctataccaataaagtga

SEQ ID NO: 5313208 - DNA, 15 bp, Homo sapiens
tctatacccacccag

SEQ ID NO: 5313209 - DNA, 12 bp, Homo sapiens
tctatactgtgg

SEQ ID NO: 5313210 - DNA, 19 bp, Homo sapiens
tctatactgtggcctgcag

SEQ ID NO: 5313211 - DNA, 21 bp, Homo sapiens
tctatactgtggcctgcagga

SEQ ID NO: 5313212 - DNA, 17 bp, Homo sapiens
tctatactttgttctgt

SEQ ID NO: 5313213 - DNA, 19 bp, Homo sapiens
tctatactttgttctgttg

SEQ ID NO: 5313214 - DNA, 22 bp, Homo sapiens
tctatactttgttctgttgtct

SEQ ID NO: 5313215 - DNA, 23 bp, Homo sapiens
tctatactttgttctgttgtctg

SEQ ID NO: 5313216 - DNA, 21 bp, Homo sapiens
tctatagaaagtgttctgtta

SEQ ID NO: 5313217 - DNA, 22 bp, Homo sapiens
tctatagaaagtgttctgttac

SEQ ID NO: 5313218 - DNA, 23 bp, Homo sapiens
tctatagaaagtgttctgttaca

SEQ ID NO: 5313219 - DNA, 21 bp, Homo sapiens
tctatagaaatattgtgctta

SEQ ID NO: 5313220 - DNA, 16 bp, Homo sapiens
tctatagagaaaaact

SEQ ID NO: 5313221 - DNA, 13 bp, Homo sapiens
tctatagagcctg

SEQ ID NO: 5313222 - DNA, 14 bp, Homo sapiens
tctatagcagtcat

SEQ ID NO: 5313223 - DNA, 18 bp, Homo sapiens
tctatagcagtcatcatt

SEQ ID NO: 5313224 - DNA, 15 bp, Homo sapiens
tctatagcatcactt

SEQ ID NO: 5313225 - DNA, 20 bp, Homo sapiens
tctatagccaaaaatagcta

SEQ ID NO: 5313226 - DNA, 23 bp, Homo sapiens
tctatagccaactgctaatgcaa

SEQ ID NO: 5313227 - DNA, 12 bp, Homo sapiens
tctatagctctt

SEQ ID NO: 5313228 - DNA, 15 bp, Homo sapiens
tctatagctcttcta

SEQ ID NO: 5313229 - DNA, 18 bp, Homo sapiens
tctataggaacatatgaa

SEQ ID NO: 5313230 - DNA, 21 bp, Homo sapiens
tctataggaacatatgaaaat

SEQ ID NO: 5313231 - DNA, 19 bp, Homo sapiens
tctataggcagcttctaag

SEQ ID NO: 5313232 - DNA, 18 bp, Homo sapiens
tctatagtagacacacta

SEQ ID NO: 5313233 - DNA, 15 bp, Homo sapiens
tctatagtagtcaat

SEQ ID NO: 5313234 - DNA, 17 bp, Homo sapiens
tctatagtagtcaatta

SEQ ID NO: 5313235 - DNA, 19 bp, Homo sapiens
tctatagtagtcaattagt

SEQ ID NO: 5313236 - DNA, 21 bp, Homo sapiens
tctatagtatagaatgaactg

SEQ ID NO: 5313237 - DNA, 21 bp, Homo sapiens
tctatagttatacatcttcat

SEQ ID NO: 5313238 - DNA, 19 bp, Homo sapiens
tctatagttattgttttat

SEQ ID NO: 5313239 - DNA, 12 bp, Homo sapiens
tctatagttcta

SEQ ID NO: 5313240 - DNA, 15 bp, Homo sapiens
tctatagttctagac

SEQ ID NO: 5313241 - DNA, 21 bp, Homo sapiens
tctatagttgatatgttttat

SEQ ID NO: 5313242 - DNA, 16 bp, Homo sapiens
tctatagtttgattct

SEQ ID NO: 5313243 - DNA, 20 bp, Homo sapiens
tctatataaaaaatatatgt

SEQ ID NO: 5313244 - DNA, 20 bp, Homo sapiens
tctatataaaatgtattcaa

SEQ ID NO: 5313245 - DNA, 23 bp, Homo sapiens
tctatataaaatgtattcaagca

SEQ ID NO: 5313246 - DNA, 14 bp, Homo sapiens
tctatataaatcgc

SEQ ID NO: 5313247 - DNA, 21 bp, Homo sapiens
tctatataaccacatttctaa

SEQ ID NO: 5313248 - DNA, 12 bp, Homo sapiens
tctatatacttt

SEQ ID NO: 5313249 - DNA, 13 bp, Homo sapiens
tctatatataatt

SEQ ID NO: 5313250 - DNA, 23 bp, Homo sapiens
tctatatataattctgtacatag

SEQ ID NO: 5313251 - DNA, 16 bp, Homo sapiens
tctatatatacaatga

SEQ ID NO: 5313252 - DNA, 18 bp, Homo sapiens
tctatatatacatataca

SEQ ID NO: 5313253 - DNA, 20 bp, Homo sapiens
tctatatatacatcatactt

SEQ ID NO: 5313254 - DNA, 14 bp, Homo sapiens
tctatatatataat

SEQ ID NO: 5313255 - DNA, 19 bp, Homo sapiens
tctatatatgtatctacaa

SEQ ID NO: 5313256 - DNA, 15 bp, Homo sapiens
tctatatatgtgtat

SEQ ID NO: 5313257 - DNA, 13 bp, Homo sapiens
tctatatcaaaaa

SEQ ID NO: 5313258 - DNA, 13 bp, Homo sapiens
tctatatccttga

SEQ ID NO: 5313259 - DNA, 12 bp, Homo sapiens
tctatatctgaa

SEQ ID NO: 5313260 - DNA, 20 bp, Homo sapiens
tctatatctttaaataaatg

SEQ ID NO: 5313261 - DNA, 21 bp, Homo sapiens
tctatatctttaaataaatgt

SEQ ID NO: 5313262 - DNA, 11 bp, Homo sapiens
tctatatgaac

SEQ ID NO: 5313263 - DNA, 13 bp, Homo sapiens
tctatatgcattt

SEQ ID NO: 5313264 - DNA, 14 bp, Homo sapiens
tctatatgcattta

SEQ ID NO: 5313265 - DNA, 13 bp, Homo sapiens
tctatatgtactt

SEQ ID NO: 5313266 - DNA, 21 bp, Homo sapiens
tctatatgtacttgtcaaaga

SEQ ID NO: 5313267 - DNA, 20 bp, Homo sapiens
tctatatgtgcggcttttca

SEQ ID NO: 5313268 - DNA, 18 bp, Homo sapiens
tctatatgttgctgaaac

SEQ ID NO: 5313269 - DNA, 18 bp, Homo sapiens
tctatatgtttaaaagta

SEQ ID NO: 5313270 - DNA, 18 bp, Homo sapiens
tctatattagatcaaata

SEQ ID NO: 5313271 - DNA, 14 bp, Homo sapiens
tctatattcctcca

SEQ ID NO: 5313272 - DNA, 15 bp, Homo sapiens
tctatattcctccag

SEQ ID NO: 5313273 - DNA, 17 bp, Homo sapiens
tctatattcctccagct

SEQ ID NO: 5313274 - DNA, 15 bp, Homo sapiens
tctatattctttatt

SEQ ID NO: 5313275 - DNA, 13 bp, Homo sapiens
tctatatttactg

SEQ ID NO: 5313276 - DNA, 14 bp, Homo sapiens
tctatatttactgt

SEQ ID NO: 5313277 - DNA, 15 bp, Homo sapiens
tctatatttactgtt

SEQ ID NO: 5313278 - DNA, 15 bp, Homo sapiens
tctatatttcatatt

SEQ ID NO: 5313279 - DNA, 13 bp, Homo sapiens
tctatatttgtaa

SEQ ID NO: 5313280 - DNA, 14 bp, Homo sapiens
tctatatttgtctt

SEQ ID NO: 5313281 - DNA, 13 bp, Homo sapiens
tctatattttaca

SEQ ID NO: 5313282 - DNA, 19 bp, Homo sapiens
tctatattttcattctcct

SEQ ID NO: 5313283 - DNA, 15 bp, Homo sapiens
tctatatttttgtga

SEQ ID NO: 5313284 - DNA, 17 bp, Homo sapiens
tctatcaaatgaaactc

SEQ ID NO: 5313285 - DNA, 12 bp, Homo sapiens
tctatcaacatt

SEQ ID NO: 5313286 - DNA, 21 bp, Homo sapiens
tctatcaaccccagacactgg

SEQ ID NO: 5313287 - DNA, 14 bp, Homo sapiens
tctatcaagcccag

SEQ ID NO: 5313288 - DNA, 17 bp, Homo sapiens
tctatcaagtcaatcat

SEQ ID NO: 5313289 - DNA, 22 bp, Homo sapiens
tctatcaagtcaatcatttctc

SEQ ID NO: 5313290 - DNA, 23 bp, Homo sapiens
tctatcaagtcaatcatttctca

SEQ ID NO: 5313291 - DNA, 14 bp, Homo sapiens
tctatcaccaagga

SEQ ID NO: 5313292 - DNA, 14 bp, Homo sapiens
tctatcaccaggat

SEQ ID NO: 5313293 - DNA, 14 bp, Homo sapiens
tctatcacctgtca

SEQ ID NO: 5313294 - DNA, 17 bp, Homo sapiens
tctatcacctgtcatca

SEQ ID NO: 5313295 - DNA, 17 bp, Homo sapiens
tctatcactggcaatat

SEQ ID NO: 5313296 - DNA, 17 bp, Homo sapiens
tctatcagaagttgtat

SEQ ID NO: 5313297 - DNA, 22 bp, Homo sapiens
tctatcagacgtgctccctccc

SEQ ID NO: 5313298 - DNA, 13 bp, Homo sapiens
tctatcagactca

SEQ ID NO: 5313299 - DNA, 17 bp, Homo sapiens
tctatcagactcagttt

SEQ ID NO: 5313300 - DNA, 19 bp, Homo sapiens
tctatcagactcagttttt

SEQ ID NO: 5313301 - DNA, 23 bp, Homo sapiens
tctatcagcatctgacaggtgaa

SEQ ID NO: 5313302 - DNA, 16 bp, Homo sapiens
tctatcagcattgttt

SEQ ID NO: 5313303 - DNA, 13 bp, Homo sapiens
tctatcagtactt

SEQ ID NO: 5313304 - DNA, 14 bp, Homo sapiens
tctatcagtacttt

SEQ ID NO: 5313305 - DNA, 17 bp, Homo sapiens
tctatcagtacttttat

SEQ ID NO: 5313306 - DNA, 20 bp, Homo sapiens
tctatcagtacttttattaa

SEQ ID NO: 5313307 - DNA, 20 bp, Homo sapiens
tctatcagtgacttctgaat

SEQ ID NO: 5313308 - DNA, 16 bp, Homo sapiens
tctatcagttatcctt

SEQ ID NO: 5313309 - DNA, 20 bp, Homo sapiens
tctatcatggaatatttata

SEQ ID NO: 5313310 - DNA, 14 bp, Homo sapiens
tctatcattccaat

SEQ ID NO: 5313311 - DNA, 16 bp, Homo sapiens
tctatcattccaattc

SEQ ID NO: 5313312 - DNA, 13 bp, Homo sapiens
tctatcatttaat

SEQ ID NO: 5313313 - DNA, 16 bp, Homo sapiens
tctatcatttttgtac

SEQ ID NO: 5313314 - DNA, 15 bp, Homo sapiens
tctatccaaacatgt

SEQ ID NO: 5313315 - DNA, 16 bp, Homo sapiens
tctatcctacaacaag

SEQ ID NO: 5313316 - DNA, 19 bp, Homo sapiens
tctatcctagtcttcacaa

SEQ ID NO: 5313317 - DNA, 20 bp, Homo sapiens
tctatcctagtcttcacaac

SEQ ID NO: 5313318 - DNA, 13 bp, Homo sapiens
tctatcctctctc

SEQ ID NO: 5313319 - DNA, 15 bp, Homo sapiens
tctatcctgaatcta

SEQ ID NO: 5313320 - DNA, 20 bp, Homo sapiens
tctatcgagtttgcaatgtc

SEQ ID NO: 5313321 - DNA, 23 bp, Homo sapiens
tctatcggccaggctggagtgca

SEQ ID NO: 5313322 - DNA, 19 bp, Homo sapiens
tctatcgttattataaatg

SEQ ID NO: 5313323 - DNA, 13 bp, Homo sapiens
tctatctaaatga

SEQ ID NO: 5313324 - DNA, 19 bp, Homo sapiens
tctatctaatcagatcttc

SEQ ID NO: 5313325 - DNA, 12 bp, Homo sapiens
tctatctaatga

SEQ ID NO: 5313326 - DNA, 14 bp, Homo sapiens
tctatctaattttt

SEQ ID NO: 5313327 - DNA, 18 bp, Homo sapiens
tctatctcacagcacact

SEQ ID NO: 5313328 - DNA, 16 bp, Homo sapiens
tctatctcatctgtct

SEQ ID NO: 5313329 - DNA, 16 bp, Homo sapiens
tctatctctaagctgt

SEQ ID NO: 5313330 - DNA, 14 bp, Homo sapiens
tctatctctttctt

SEQ ID NO: 5313331 - DNA, 20 bp, Homo sapiens
tctatctgcctttacctaca

SEQ ID NO: 5313332 - DNA, 14 bp, Homo sapiens
tctatcttccaaat

SEQ ID NO: 5313333 - DNA, 23 bp, Homo sapiens
tctatcttccaaatgcaatttga

SEQ ID NO: 5313334 - DNA, 12 bp, Homo sapiens
tctatcttcttt

SEQ ID NO: 5313335 - DNA, 14 bp, Homo sapiens
tctatcttgtaaat

SEQ ID NO: 5313336 - DNA, 18 bp, Homo sapiens
tctatgaaaagcaactga

SEQ ID NO: 5313337 - DNA, 18 bp, Homo sapiens
tctatgaaataatgtgaa

SEQ ID NO: 5313338 - DNA, 21 bp, Homo sapiens
tctatgaactagagactctgt

SEQ ID NO: 5313339 - DNA, 15 bp, Homo sapiens
tctatgaagagaagg

SEQ ID NO: 5313340 - DNA, 22 bp, Homo sapiens
tctatgaagcccacccagaaaa

SEQ ID NO: 5313341 - DNA, 22 bp, Homo sapiens
tctatgaatatggaaaggccag

SEQ ID NO: 5313342 - DNA, 14 bp, Homo sapiens
tctatgacaaattc

SEQ ID NO: 5313343 - DNA, 19 bp, Homo sapiens
tctatgactgtgtttaata

SEQ ID NO: 5313344 - DNA, 12 bp, Homo sapiens
tctatgagaaaa

SEQ ID NO: 5313345 - DNA, 15 bp, Homo sapiens
tctatgagacctccc

SEQ ID NO: 5313346 - DNA, 22 bp, Homo sapiens
tctatgagcaactccttacttc

SEQ ID NO: 5313347 - DNA, 14 bp, Homo sapiens
tctatgagcatctc

SEQ ID NO: 5313348 - DNA, 18 bp, Homo sapiens
tctatgagggtgtttcct

SEQ ID NO: 5313349 - DNA, 16 bp, Homo sapiens
tctatgagtctagatg

SEQ ID NO: 5313350 - DNA, 18 bp, Homo sapiens
tctatgataattacaata

SEQ ID NO: 5313351 - DNA, 20 bp, Homo sapiens
tctatgataattacaataca

SEQ ID NO: 5313352 - DNA, 19 bp, Homo sapiens
tctatgatatatttatatc

SEQ ID NO: 5313353 - DNA, 15 bp, Homo sapiens
tctatgatcagaact

SEQ ID NO: 5313354 - DNA, 22 bp, Homo sapiens
tctatgatgtttcttttgcaat

SEQ ID NO: 5313355 - DNA, 15 bp, Homo sapiens
tctatgattaaactg

SEQ ID NO: 5313356 - DNA, 22 bp, Homo sapiens
tctatgattccaggtggcatca

SEQ ID NO: 5313357 - DNA, 22 bp, Homo sapiens
tctatgcaaatgcctccaagcc

SEQ ID NO: 5313358 - DNA, 14 bp, Homo sapiens
tctatgcaattgta

SEQ ID NO: 5313359 - DNA, 17 bp, Homo sapiens
tctatgcaattgtacaa

SEQ ID NO: 5313360 - DNA, 20 bp, Homo sapiens
tctatgcaatttttaaacta

SEQ ID NO: 5313361 - DNA, 23 bp, Homo sapiens
tctatgcaatttttaaactagta

SEQ ID NO: 5313362 - DNA, 19 bp, Homo sapiens
tctcagatgttaaaataaa

SEQ ID NO: 5313363 - DNA, 22 bp, Homo sapiens
tctcagattgacctataaaaca

SEQ ID NO: 5313364 - DNA, 17 bp, Homo sapiens
tctcagatttccacaga

SEQ ID NO: 5313365 - DNA, 17 bp, Homo sapiens
tctcagatttctgagga

SEQ ID NO: 5313366 - DNA, 13 bp, Homo sapiens
tctcagattttat

SEQ ID NO: 5313367 - DNA, 14 bp, Homo sapiens
tctcagattttatt

SEQ ID NO: 5313368 - DNA, 15 bp, Homo sapiens
tctcagattttatta

SEQ ID NO: 5313369 - DNA, 18 bp, Homo sapiens
tctcagattttattatgt

SEQ ID NO: 5313370 - DNA, 19 bp, Homo sapiens
tctcagattttattatgta

SEQ ID NO: 5313371 - DNA, 22 bp, Homo sapiens
tctcagattttattatgtaaat

SEQ ID NO: 5313372 - DNA, 22 bp, Homo sapiens
tctcagcaaagctacaggactg

SEQ ID NO: 5313373 - DNA, 18 bp, Homo sapiens
tctcagcaagtgtacagt

SEQ ID NO: 5313374 - DNA, 22 bp, Homo sapiens
tctcagcacagcctggggaggg

SEQ ID NO: 5313375 - DNA, 21 bp, Homo sapiens
tctcagcactaattagtgtcc

SEQ ID NO: 5313376 - DNA, 13 bp, Homo sapiens
tctcagcagaaac

SEQ ID NO: 5313377 - DNA, 17 bp, Homo sapiens
tctcagcagaaacacac

SEQ ID NO: 5313378 - DNA, 12 bp, Homo sapiens
tctcagcagagt

SEQ ID NO: 5313379 - DNA, 13 bp, Homo sapiens
tctcagcagagtg

SEQ ID NO: 5313380 - DNA, 14 bp, Homo sapiens
tctcagcagccagc

SEQ ID NO: 5313381 - DNA, 18 bp, Homo sapiens
tctcagcagccagctcct

SEQ ID NO: 5313382 - DNA, 19 bp, Homo sapiens
tctcagcatagcctgcctg

SEQ ID NO: 5313383 - DNA, 19 bp, Homo sapiens
tctcagcatcctggaaatt

SEQ ID NO: 5313384 - DNA, 22 bp, Homo sapiens
tctcagcatcctggaaatttgt

SEQ ID NO: 5313385 - DNA, 20 bp, Homo sapiens
tctcagcatgtagggcttct

SEQ ID NO: 5313386 - DNA, 22 bp, Homo sapiens
tctcagcatgtagggcttctgt

SEQ ID NO: 5313387 - DNA, 20 bp, Homo sapiens
tctcagccaacccgctccac

SEQ ID NO: 5313388 - DNA, 23 bp, Homo sapiens
tctcagccagcccgtgtgtataa

SEQ ID NO: 5313389 - DNA, 14 bp, Homo sapiens
tctcagcccagaag

SEQ ID NO: 5313390 - DNA, 15 bp, Homo sapiens
tctcagcccagaaga

SEQ ID NO: 5313391 - DNA, 16 bp, Homo sapiens
tctcagcccagaagaa

SEQ ID NO: 5313392 - DNA, 13 bp, Homo sapiens
tctcagcccaggt

SEQ ID NO: 5313393 - DNA, 19 bp, Homo sapiens
tctcagccccgggcctgcc

SEQ ID NO: 5313394 - DNA, 12 bp, Homo sapiens
tctcagcccctt

SEQ ID NO: 5313395 - DNA, 21 bp, Homo sapiens
tctcagccgcttctgactgct

SEQ ID NO: 5313396 - DNA, 14 bp, Homo sapiens
tctcagcctccact

SEQ ID NO: 5313397 - DNA, 21 bp, Homo sapiens
tctcagcctccggatgacaca

SEQ ID NO: 5313398 - DNA, 15 bp, Homo sapiens
tctcagcctcctcag

SEQ ID NO: 5313399 - DNA, 12 bp, Homo sapiens
tctcagcctggg

SEQ ID NO: 5313400 - DNA, 13 bp, Homo sapiens
tctcagcctgggc

SEQ ID NO: 5313401 - DNA, 15 bp, Homo sapiens
tctcagccttacatt

SEQ ID NO: 5313402 - DNA, 18 bp, Homo sapiens
tctcagccttggttcctg

SEQ ID NO: 5313403 - DNA, 20 bp, Homo sapiens
tctcagcgggagtctcctca

SEQ ID NO: 5313404 - DNA, 15 bp, Homo sapiens
tctcagctaagctca

SEQ ID NO: 5313405 - DNA, 20 bp, Homo sapiens
tctcagctactcaggaggct

SEQ ID NO: 5313406 - DNA, 15 bp, Homo sapiens
tctcagctcactgca

SEQ ID NO: 5313407 - DNA, 22 bp, Homo sapiens
tctcagctcactgcaacctcca

SEQ ID NO: 5313408 - DNA, 15 bp, Homo sapiens
tctcagctcccaggc

SEQ ID NO: 5313409 - DNA, 16 bp, Homo sapiens
tctcagctcccaggcc

SEQ ID NO: 5313410 - DNA, 21 bp, Homo sapiens
tctcagctccccctgtcccct

SEQ ID NO: 5313411 - DNA, 22 bp, Homo sapiens
tctcagctccccctgtcccctc

SEQ ID NO: 5313412 - DNA, 20 bp, Homo sapiens
tctcagctccgggggtgagg

SEQ ID NO: 5313413 - DNA, 19 bp, Homo sapiens
tctcagctcttctgactta

SEQ ID NO: 5313414 - DNA, 18 bp, Homo sapiens
tctcagcttcatttccgt

SEQ ID NO: 5313415 - DNA, 11 bp, Homo sapiens
tctcaggaaat

SEQ ID NO: 5313416 - DNA, 15 bp, Homo sapiens
tctcaggacacaggc

SEQ ID NO: 5313417 - DNA, 20 bp, Homo sapiens
tctcaggacacaggcctgtg

SEQ ID NO: 5313418 - DNA, 21 bp, Homo sapiens
tctcaggacctagggatgttc

SEQ ID NO: 5313419 - DNA, 22 bp, Homo sapiens
tctcaggagatggagggcttgg

SEQ ID NO: 5313420 - DNA, 15 bp, Homo sapiens
tctcaggagcacagg

SEQ ID NO: 5313421 - DNA, 16 bp, Homo sapiens
tctcaggagcacaggc

SEQ ID NO: 5313422 - DNA, 22 bp, Homo sapiens
tctcaggagcaccctgtcttct

SEQ ID NO: 5313423 - DNA, 15 bp, Homo sapiens
tctcaggagcatggg

SEQ ID NO: 5313424 - DNA, 20 bp, Homo sapiens
tctcaggaggaggctgccct

SEQ ID NO: 5313425 - DNA, 14 bp, Homo sapiens
tctcaggaggaggg

SEQ ID NO: 5313426 - DNA, 23 bp, Homo sapiens
tctcaggatatccttatcagagc

SEQ ID NO: 5313427 - DNA, 22 bp, Homo sapiens
tctcaggatcccctctcttcct

SEQ ID NO: 5313428 - DNA, 11 bp, Homo sapiens
tctcaggcagc

SEQ ID NO: 5313429 - DNA, 22 bp, Homo sapiens
tctcaggcagcaccacactggg

SEQ ID NO: 5313430 - DNA, 21 bp, Homo sapiens
tctcaggcatgcctgtgtgac

SEQ ID NO: 5313431 - DNA, 17 bp, Homo sapiens
tctcaggccaccacaga

SEQ ID NO: 5313432 - DNA, 13 bp, Homo sapiens
tctcaggccacct

SEQ ID NO: 5313433 - DNA, 18 bp, Homo sapiens
tctcaggccacctgcccc

SEQ ID NO: 5313434 - DNA, 21 bp, Homo sapiens
tctcaggccacctgccccctt

SEQ ID NO: 5313435 - DNA, 18 bp, Homo sapiens
tctcaggccgagagcctt

SEQ ID NO: 5313436 - DNA, 15 bp, Homo sapiens
tctcaggctcaagtt

SEQ ID NO: 5313437 - DNA, 17 bp, Homo sapiens
tctcaggctcaagtttt

SEQ ID NO: 5313438 - DNA, 15 bp, Homo sapiens
tctcaggctctgccc

SEQ ID NO: 5313439 - DNA, 20 bp, Homo sapiens
tctcaggctctgccctgccc

SEQ ID NO: 5313440 - DNA, 12 bp, Homo sapiens
tctcaggctgag

SEQ ID NO: 5313441 - DNA, 15 bp, Homo sapiens
tctcaggctgaggga

SEQ ID NO: 5313442 - DNA, 13 bp, Homo sapiens
tctcaggctgcct

SEQ ID NO: 5313443 - DNA, 15 bp, Homo sapiens
tctcaggctgcctga

SEQ ID NO: 5313444 - DNA, 16 bp, Homo sapiens
tctcaggctgcctgag

SEQ ID NO: 5313445 - DNA, 15 bp, Homo sapiens
tctcaggctggcatc

SEQ ID NO: 5313446 - DNA, 16 bp, Homo sapiens
tctcaggctggcatct

SEQ ID NO: 5313447 - DNA, 20 bp, Homo sapiens
tctcaggctgtgcttacctg

SEQ ID NO: 5313448 - DNA, 17 bp, Homo sapiens
tctcagggaagcccagc

SEQ ID NO: 5313449 - DNA, 22 bp, Homo sapiens
tctcagggaagcccagctccag

SEQ ID NO: 5313450 - DNA, 23 bp, Homo sapiens
tctcagggaagcccagctccagg

SEQ ID NO: 5313451 - DNA, 12 bp, Homo sapiens
tctcagggcaga

SEQ ID NO: 5313452 - DNA, 15 bp, Homo sapiens
tctcagggcctggca

SEQ ID NO: 5313453 - DNA, 19 bp, Homo sapiens
tctcagggcctggtcgttt

SEQ ID NO: 5313454 - DNA, 12 bp, Homo sapiens
tctcagggctcc

SEQ ID NO: 5313455 - DNA, 14 bp, Homo sapiens
tctcagggctcggg

SEQ ID NO: 5313456 - DNA, 12 bp, Homo sapiens
tctcagggctgg

SEQ ID NO: 5313457 - DNA, 19 bp, Homo sapiens
tctcagggctggagcctgg

SEQ ID NO: 5313458 - DNA, 22 bp, Homo sapiens
tctcagggctggagcctggggt

SEQ ID NO: 5313459 - DNA, 16 bp, Homo sapiens
tctcaggggtgctggg

SEQ ID NO: 5313460 - DNA, 17 bp, Homo sapiens
tctcagggtcactgtcc

SEQ ID NO: 5313461 - DNA, 20 bp, Homo sapiens
tctcagggtcactgtccttg

SEQ ID NO: 5313462 - DNA, 18 bp, Homo sapiens
tctcaggtcactccagtg

SEQ ID NO: 5313463 - DNA, 13 bp, Homo sapiens
tctcaggtccagc

SEQ ID NO: 5313464 - DNA, 19 bp, Homo sapiens
tctcaggtctgaatcttca

SEQ ID NO: 5313465 - DNA, 16 bp, Homo sapiens
tctcaggtctgagttg

SEQ ID NO: 5313466 - DNA, 20 bp, Homo sapiens
tctcaggtgccactccctga

SEQ ID NO: 5313467 - DNA, 21 bp, Homo sapiens
tctcaggtgccactccctgag

SEQ ID NO: 5313468 - DNA, 19 bp, Homo sapiens
tctcaggtgccagtcttcc

SEQ ID NO: 5313469 - DNA, 21 bp, Homo sapiens
tctcaggtgggttagagatgg

SEQ ID NO: 5313470 - DNA, 22 bp, Homo sapiens
tctcaggttaagtgtgagtaat

SEQ ID NO: 5313471 - DNA, 12 bp, Homo sapiens
tctcaggttctc

SEQ ID NO: 5313472 - DNA, 14 bp, Homo sapiens
tctcagtacacttc

SEQ ID NO: 5313473 - DNA, 15 bp, Homo sapiens
tctcagtacctcccc

SEQ ID NO: 5313474 - DNA, 19 bp, Homo sapiens
tctcagtatcttaaaattg

SEQ ID NO: 5313475 - DNA, 16 bp, Homo sapiens
tctcagtcactttttc

SEQ ID NO: 5313476 - DNA, 16 bp, Homo sapiens
tctcagtcatgcataa

SEQ ID NO: 5313477 - DNA, 19 bp, Homo sapiens
tctcagtcatgcataaata

SEQ ID NO: 5313478 - DNA, 11 bp, Homo sapiens
tctcagtcccc

SEQ ID NO: 5313479 - DNA, 19 bp, Homo sapiens
tctcagtcctttgttataa

SEQ ID NO: 5313480 - DNA, 24 bp, Homo sapiens
tctcagtctaaggtctcatgctgt

SEQ ID NO: 5313481 - DNA, 12 bp, Homo sapiens
tctcagtctcac

SEQ ID NO: 5313482 - DNA, 18 bp, Homo sapiens
tctcagtgattcgctttt

SEQ ID NO: 5313483 - DNA, 15 bp, Homo sapiens
tctcagtgatttcct

SEQ ID NO: 5313484 - DNA, 19 bp, Homo sapiens
tctcagtgccaactgtggc

SEQ ID NO: 5313485 - DNA, 20 bp, Homo sapiens
tctcagtgccaactgtggct

SEQ ID NO: 5313486 - DNA, 15 bp, Homo sapiens
tctcagtgccttctc

SEQ ID NO: 5313487 - DNA, 23 bp, Homo sapiens
tctcagtgcttcttactattaag

SEQ ID NO: 5313488 - DNA, 15 bp, Homo sapiens
tctcagtgctttcct

SEQ ID NO: 5313489 - DNA, 16 bp, Homo sapiens
tctcagtggtgcagga

SEQ ID NO: 5313490 - DNA, 16 bp, Homo sapiens
tctcagtggtgtgtga

SEQ ID NO: 5313491 - DNA, 18 bp, Homo sapiens
tctcagtggtgtgtgaag

SEQ ID NO: 5313492 - DNA, 19 bp, Homo sapiens
tctcagtggtgtgtgaagt

SEQ ID NO: 5313493 - DNA, 11 bp, Homo sapiens
tctcagtgtcc

SEQ ID NO: 5313494 - DNA, 20 bp, Homo sapiens
tctcagtgttaatactgaga

SEQ ID NO: 5313495 - DNA, 12 bp, Homo sapiens
tctcagtgtttt

SEQ ID NO: 5313496 - DNA, 23 bp, Homo sapiens
tctcagtgttttggactccatct

SEQ ID NO: 5313497 - DNA, 22 bp, Homo sapiens
tctcagttatgtagtttcttgt

SEQ ID NO: 5313498 - DNA, 19 bp, Homo sapiens
tctcagttattcagattga

SEQ ID NO: 5313499 - DNA, 21 bp, Homo sapiens
tctcagttcatttcctgaggt

SEQ ID NO: 5313500 - DNA, 23 bp, Homo sapiens
tctcagttctcttgctttcacat

SEQ ID NO: 5313501 - DNA, 14 bp, Homo sapiens
tctcagttgcagaa

SEQ ID NO: 5313502 - DNA, 15 bp, Homo sapiens
tctcagttggaaata

SEQ ID NO: 5313503 - DNA, 14 bp, Homo sapiens
tctcagttgtttgc

SEQ ID NO: 5313504 - DNA, 17 bp, Homo sapiens
tctcagtttgtgtgtct

SEQ ID NO: 5313505 - DNA, 15 bp, Homo sapiens
tctcagttttcataa

SEQ ID NO: 5313506 - DNA, 13 bp, Homo sapiens
tctcataaatctt

SEQ ID NO: 5313507 - DNA, 21 bp, Homo sapiens
tctcataagtagcattcatgt

SEQ ID NO: 5313508 - DNA, 20 bp, Homo sapiens
tctcataattcctacagcac

SEQ ID NO: 5313509 - DNA, 16 bp, Homo sapiens
tctcataatttataca

SEQ ID NO: 5313510 - DNA, 15 bp, Homo sapiens
tctcatacaagccat

SEQ ID NO: 5313511 - DNA, 13 bp, Homo sapiens
tctcatacctctg

SEQ ID NO: 5313512 - DNA, 15 bp, Homo sapiens
tctcatacctctgac

SEQ ID NO: 5313513 - DNA, 16 bp, Homo sapiens
tctcatagatgacccc

SEQ ID NO: 5313514 - DNA, 19 bp, Homo sapiens
tctcatagcaggaaatgta

SEQ ID NO: 5313515 - DNA, 20 bp, Homo sapiens
tctcatagcattaactaatc

SEQ ID NO: 5313516 - DNA, 24 bp, Homo sapiens
tctcatagcattaactaatctatt

SEQ ID NO: 5313517 - DNA, 14 bp, Homo sapiens
tctcatagctcata

SEQ ID NO: 5313518 - DNA, 24 bp, Homo sapiens
tctcataggaaaagtacatttaat

SEQ ID NO: 5313519 - DNA, 17 bp, Homo sapiens
tctcataggaattaaat

SEQ ID NO: 5313520 - DNA, 16 bp, Homo sapiens
tctcataggagttagg

SEQ ID NO: 5313521 - DNA, 21 bp, Homo sapiens
tctcataggagttaggctgtc

SEQ ID NO: 5313522 - DNA, 19 bp, Homo sapiens
tctcatagggatgctgtga

SEQ ID NO: 5313523 - DNA, 20 bp, Homo sapiens
tctcataggttgagcaattt

SEQ ID NO: 5313524 - DNA, 17 bp, Homo sapiens
tctcatatatattttaa

SEQ ID NO: 5313525 - DNA, 18 bp, Homo sapiens
tctcatatatattttaaa

SEQ ID NO: 5313526 - DNA, 13 bp, Homo sapiens
tctcatattttca

SEQ ID NO: 5313527 - DNA, 17 bp, Homo sapiens
tctcatcaactgaatga

SEQ ID NO: 5313528 - DNA, 15 bp, Homo sapiens
tctcatcacacacat

SEQ ID NO: 5313529 - DNA, 18 bp, Homo sapiens
tctcatcacacacatgga

SEQ ID NO: 5313530 - DNA, 17 bp, Homo sapiens
tctcatcaccccagagg

SEQ ID NO: 5313531 - DNA, 16 bp, Homo sapiens
tctcatcactcccctc

SEQ ID NO: 5313532 - DNA, 16 bp, Homo sapiens
tctcatcagcccaggt

SEQ ID NO: 5313533 - DNA, 15 bp, Homo sapiens
tctcatcagtgtcct

SEQ ID NO: 5313534 - DNA, 14 bp, Homo sapiens
tctcatcatattgt

SEQ ID NO: 5313535 - DNA, 18 bp, Homo sapiens
tctcatcatattgtatgt

SEQ ID NO: 5313536 - DNA, 10 bp, Homo sapiens
tctcatcatg

SEQ ID NO: 5313537 - DNA, 20 bp, Homo sapiens
tctcatccaggtcctttcct

SEQ ID NO: 5313538 - DNA, 23 bp, Homo sapiens
tctcatccaggtcctttccttct

SEQ ID NO: 5313539 - DNA, 15 bp, Homo sapiens
tctcatccattcctc

SEQ ID NO: 5313540 - DNA, 18 bp, Homo sapiens
tctccctccgactccaga

SEQ ID NO: 5313541 - DNA, 19 bp, Homo sapiens
tctccctccgactccagat

SEQ ID NO: 5313542 - DNA, 15 bp, Homo sapiens
tctccctcctcagct

SEQ ID NO: 5313543 - DNA, 19 bp, Homo sapiens
tctccctcctccaggtcgg

SEQ ID NO: 5313544 - DNA, 17 bp, Homo sapiens
tctccctcctcctcctt

SEQ ID NO: 5313545 - DNA, 20 bp, Homo sapiens
tctccctcctggtgaagtgt

SEQ ID NO: 5313546 - DNA, 21 bp, Homo sapiens
tctccctcgggggctcttccc

SEQ ID NO: 5313547 - DNA, 18 bp, Homo sapiens
tctccctctaggctctgc

SEQ ID NO: 5313548 - DNA, 23 bp, Homo sapiens
tctccctctcactgtctgagagt

SEQ ID NO: 5313549 - DNA, 22 bp, Homo sapiens
tctccctctcatgtccctccag

SEQ ID NO: 5313550 - DNA, 14 bp, Homo sapiens
tctccctctcctgc

SEQ ID NO: 5313551 - DNA, 11 bp, Homo sapiens
tctccctctga

SEQ ID NO: 5313552 - DNA, 15 bp, Homo sapiens
tctccctctggccct

SEQ ID NO: 5313553 - DNA, 20 bp, Homo sapiens
tctccctctggccctgcctt

SEQ ID NO: 5313554 - DNA, 13 bp, Homo sapiens
tctccctctggtc

SEQ ID NO: 5313555 - DNA, 14 bp, Homo sapiens
tctccctctggtct

SEQ ID NO: 5313556 - DNA, 21 bp, Homo sapiens
tctccctctgtcttttctcct

SEQ ID NO: 5313557 - DNA, 22 bp, Homo sapiens
tctccctcttctcaagtgcctt

SEQ ID NO: 5313558 - DNA, 14 bp, Homo sapiens
tctccctctttcta

SEQ ID NO: 5313559 - DNA, 15 bp, Homo sapiens
tctccctctttctag

SEQ ID NO: 5313560 - DNA, 14 bp, Homo sapiens
tctccctgaagagt

SEQ ID NO: 5313561 - DNA, 14 bp, Homo sapiens
tctccctgacattt

SEQ ID NO: 5313562 - DNA, 12 bp, Homo sapiens
tctccctgacct

SEQ ID NO: 5313563 - DNA, 13 bp, Homo sapiens
tctccctgacctt

SEQ ID NO: 5313564 - DNA, 13 bp, Homo sapiens
tctccctgagcct

SEQ ID NO: 5313565 - DNA, 12 bp, Homo sapiens
tctccctgaggt

SEQ ID NO: 5313566 - DNA, 18 bp, Homo sapiens
tctccctgatggaccctc

SEQ ID NO: 5313567 - DNA, 23 bp, Homo sapiens
tctccctgatggaccctcagtct

SEQ ID NO: 5313568 - DNA, 15 bp, Homo sapiens
tctccctgcacagcc

SEQ ID NO: 5313569 - DNA, 14 bp, Homo sapiens
tctccctgcagcct

SEQ ID NO: 5313570 - DNA, 16 bp, Homo sapiens
tctccctgcatcctga

SEQ ID NO: 5313571 - DNA, 21 bp, Homo sapiens
tctccctgcatcctgaggcca

SEQ ID NO: 5313572 - DNA, 15 bp, Homo sapiens
tctccctgcatggca

SEQ ID NO: 5313573 - DNA, 19 bp, Homo sapiens
tctccctgcatggcatcct

SEQ ID NO: 5313574 - DNA, 14 bp, Homo sapiens
tctccctgccaagt

SEQ ID NO: 5313575 - DNA, 14 bp, Homo sapiens
tctccctgccatcc

SEQ ID NO: 5313576 - DNA, 17 bp, Homo sapiens
tctccctgccatccccc

SEQ ID NO: 5313577 - DNA, 21 bp, Homo sapiens
tctccctgccatccccctctc

SEQ ID NO: 5313578 - DNA, 12 bp, Homo sapiens
tctccctgccgc

SEQ ID NO: 5313579 - DNA, 18 bp, Homo sapiens
tctccctgcctcacatct

SEQ ID NO: 5313580 - DNA, 20 bp, Homo sapiens
tctccctgcctcacatctcc

SEQ ID NO: 5313581 - DNA, 15 bp, Homo sapiens
tctccctgcctcctg

SEQ ID NO: 5313582 - DNA, 13 bp, Homo sapiens
tctccctgcctgg

SEQ ID NO: 5313583 - DNA, 14 bp, Homo sapiens
tctccctgcctggc

SEQ ID NO: 5313584 - DNA, 12 bp, Homo sapiens
tctccctgcctt

SEQ ID NO: 5313585 - DNA, 21 bp, Homo sapiens
tctccctggatctacctggag

SEQ ID NO: 5313586 - DNA, 22 bp, Homo sapiens
tctccctggccacccttggcct

SEQ ID NO: 5313587 - DNA, 15 bp, Homo sapiens
tctccctggccccag

SEQ ID NO: 5313588 - DNA, 21 bp, Homo sapiens
tctccctgggaagcctgtgcc

SEQ ID NO: 5313589 - DNA, 18 bp, Homo sapiens
tctccctgggcaccctgc

SEQ ID NO: 5313590 - DNA, 19 bp, Homo sapiens
tctccctgggcaccctgca

SEQ ID NO: 5313591 - DNA, 22 bp, Homo sapiens
tctccctggggaggacccctgc

SEQ ID NO: 5313592 - DNA, 16 bp, Homo sapiens
tctccctggtgcctct

SEQ ID NO: 5313593 - DNA, 19 bp, Homo sapiens
tctccctggtgcctctgtg

SEQ ID NO: 5313594 - DNA, 19 bp, Homo sapiens
tctccctggttgcctctct

SEQ ID NO: 5313595 - DNA, 13 bp, Homo sapiens
tctccctgtcaca

SEQ ID NO: 5313596 - DNA, 16 bp, Homo sapiens
tctccctgtcacgctc

SEQ ID NO: 5313597 - DNA, 19 bp, Homo sapiens
tctccctgtgttacccagg

SEQ ID NO: 5313598 - DNA, 19 bp, Homo sapiens
tctccctgtgttctgggct

SEQ ID NO: 5313599 - DNA, 15 bp, Homo sapiens
tctcccttacccatc

SEQ ID NO: 5313600 - DNA, 20 bp, Homo sapiens
tctcccttactattcccact

SEQ ID NO: 5313601 - DNA, 15 bp, Homo sapiens
tctcccttccacctc

SEQ ID NO: 5313602 - DNA, 13 bp, Homo sapiens
tctcccttccctc

SEQ ID NO: 5313603 - DNA, 16 bp, Homo sapiens
tctcccttccctcctc

SEQ ID NO: 5313604 - DNA, 17 bp, Homo sapiens
tctcccttcctctctcc

SEQ ID NO: 5313605 - DNA, 14 bp, Homo sapiens
tctcccttctctct

SEQ ID NO: 5313606 - DNA, 19 bp, Homo sapiens
tctcccttctttaccttca

SEQ ID NO: 5313607 - DNA, 21 bp, Homo sapiens
tctcccttctttaccttcatt

SEQ ID NO: 5313608 - DNA, 13 bp, Homo sapiens
tctcccttgaggg

SEQ ID NO: 5313609 - DNA, 16 bp, Homo sapiens
tctcccttgccctccc

SEQ ID NO: 5313610 - DNA, 11 bp, Homo sapiens
tctcccttgga

SEQ ID NO: 5313611 - DNA, 18 bp, Homo sapiens
tctcccttggattgtccc

SEQ ID NO: 5313612 - DNA, 19 bp, Homo sapiens
tctcccttggattgtcccc

SEQ ID NO: 5313613 - DNA, 21 bp, Homo sapiens
tctcccttggattgtccccga

SEQ ID NO: 5313614 - DNA, 18 bp, Homo sapiens
tctcccttggcccagaga

SEQ ID NO: 5313615 - DNA, 16 bp, Homo sapiens
tctcccttgggctctg

SEQ ID NO: 5313616 - DNA, 22 bp, Homo sapiens
tctcccttgggctctgatgaaa

SEQ ID NO: 5313617 - DNA, 20 bp, Homo sapiens
tctcccttgtcctgcttggg

SEQ ID NO: 5313618 - DNA, 21 bp, Homo sapiens
tctccctttagtggagccagg

SEQ ID NO: 5313619 - DNA, 19 bp, Homo sapiens
tctccctttagttctgctg

SEQ ID NO: 5313620 - DNA, 17 bp, Homo sapiens
tctccctttctctctcc

SEQ ID NO: 5313621 - DNA, 19 bp, Homo sapiens
tctccctttctctctcctc

SEQ ID NO: 5313622 - DNA, 22 bp, Homo sapiens
tctccctttctctctcctctct

SEQ ID NO: 5313623 - DNA, 15 bp, Homo sapiens
tctcccttttccatg

SEQ ID NO: 5313624 - DNA, 12 bp, Homo sapiens
tctccgaaagaa

SEQ ID NO: 5313625 - DNA, 23 bp, Homo sapiens
tctccgaaatgctgtctttcttg

SEQ ID NO: 5313626 - DNA, 12 bp, Homo sapiens
tctccgagagag

SEQ ID NO: 5313627 - DNA, 21 bp, Homo sapiens
tctccgcacacctctggctgt

SEQ ID NO: 5313628 - DNA, 18 bp, Homo sapiens
tctccgcatcgcatcctc

SEQ ID NO: 5313629 - DNA, 20 bp, Homo sapiens
tctccgcattggaagagccc

SEQ ID NO: 5313630 - DNA, 13 bp, Homo sapiens
tctccgccagcct

SEQ ID NO: 5313631 - DNA, 14 bp, Homo sapiens
tctccgccagcctc

SEQ ID NO: 5313632 - DNA, 15 bp, Homo sapiens
tctccgccagcctcc

SEQ ID NO: 5313633 - DNA, 20 bp, Homo sapiens
tctccgccagcctcctctgg

SEQ ID NO: 5313634 - DNA, 13 bp, Homo sapiens
tctccgcccacgc

SEQ ID NO: 5313635 - DNA, 20 bp, Homo sapiens
tctccgccccccggcctggc

SEQ ID NO: 5313636 - DNA, 16 bp, Homo sapiens
tctccgcctccacact

SEQ ID NO: 5313637 - DNA, 17 bp, Homo sapiens
tctccggcctctccagc

SEQ ID NO: 5313638 - DNA, 12 bp, Homo sapiens
tctccggcctgg

SEQ ID NO: 5313639 - DNA, 16 bp, Homo sapiens
tctccggcgcagacag

SEQ ID NO: 5313640 - DNA, 16 bp, Homo sapiens
tctccggctcccagcc

SEQ ID NO: 5313641 - DNA, 18 bp, Homo sapiens
tctccggctcccagcctc

SEQ ID NO: 5313642 - DNA, 19 bp, Homo sapiens
tctccggggccatttgcaa

SEQ ID NO: 5313643 - DNA, 17 bp, Homo sapiens
tctccggggtctgtgct

SEQ ID NO: 5313644 - DNA, 21 bp, Homo sapiens
tctccggggtctgtgctgtgc

SEQ ID NO: 5313645 - DNA, 16 bp, Homo sapiens
tctccgggtgtggcct

SEQ ID NO: 5313646 - DNA, 17 bp, Homo sapiens
tctccgggtgtggcctc

SEQ ID NO: 5313647 - DNA, 19 bp, Homo sapiens
tctccgggtgtggcctcag

SEQ ID NO: 5313648 - DNA, 23 bp, Homo sapiens
tctccgggtgtggcctcagccct

SEQ ID NO: 5313649 - DNA, 13 bp, Homo sapiens
tctccgtatttat

SEQ ID NO: 5313650 - DNA, 16 bp, Homo sapiens
tctccgttagctcctg

SEQ ID NO: 5313651 - DNA, 14 bp, Homo sapiens
tctccgttccatct

SEQ ID NO: 5313652 - DNA, 15 bp, Homo sapiens
tctccgttccatctg

SEQ ID NO: 5313653 - DNA, 13 bp, Homo sapiens
tctcctaaagctt

SEQ ID NO: 5313654 - DNA, 14 bp, Homo sapiens
tctcctaaagcttt

SEQ ID NO: 5313655 - DNA, 16 bp, Homo sapiens
tctcctaaaggtgagg

SEQ ID NO: 5313656 - DNA, 15 bp, Homo sapiens
tctcctaaattgttg

SEQ ID NO: 5313657 - DNA, 14 bp, Homo sapiens
tctcctaacaaaag

SEQ ID NO: 5313658 - DNA, 16 bp, Homo sapiens
tctcctaacaaaagaa

SEQ ID NO: 5313659 - DNA, 19 bp, Homo sapiens
tctcctaacaaaagaacta

SEQ ID NO: 5313660 - DNA, 23 bp, Homo sapiens
tctcctaagcacctgtaatgtgc

SEQ ID NO: 5313661 - DNA, 16 bp, Homo sapiens
tctcctaatttgtttc

SEQ ID NO: 5313662 - DNA, 22 bp, Homo sapiens
tctcctaccccacctcatgcct

SEQ ID NO: 5313663 - DNA, 23 bp, Homo sapiens
tctcctaccccacctcatgcctg

SEQ ID NO: 5313664 - DNA, 14 bp, Homo sapiens
tctcctactcctga

SEQ ID NO: 5313665 - DNA, 14 bp, Homo sapiens
tctcctactctgtg

SEQ ID NO: 5313666 - DNA, 15 bp, Homo sapiens
tctcctactctgtgt

SEQ ID NO: 5313667 - DNA, 17 bp, Homo sapiens
tctcctactctgtgtaa

SEQ ID NO: 5313668 - DNA, 19 bp, Homo sapiens
tctcctactttgaaaactg

SEQ ID NO: 5313669 - DNA, 17 bp, Homo sapiens
tctcctagactgaccct

SEQ ID NO: 5313670 - DNA, 14 bp, Homo sapiens
tctcctagcccctc

SEQ ID NO: 5313671 - DNA, 17 bp, Homo sapiens
tctcctagcccctctct

SEQ ID NO: 5313672 - DNA, 19 bp, Homo sapiens
tctcctaggggcttggtcc

SEQ ID NO: 5313673 - DNA, 17 bp, Homo sapiens
tctcctataatctgtca

SEQ ID NO: 5313674 - DNA, 17 bp, Homo sapiens
tctcctatacccagcag

SEQ ID NO: 5313675 - DNA, 19 bp, Homo sapiens
tctcctatacccagcagag

SEQ ID NO: 5313676 - DNA, 19 bp, Homo sapiens
tctcctatatatttctatt

SEQ ID NO: 5313677 - DNA, 22 bp, Homo sapiens
tctcctatatatttctattatt

SEQ ID NO: 5313678 - DNA, 16 bp, Homo sapiens
tctcctatcttctcca

SEQ ID NO: 5313679 - DNA, 19 bp, Homo sapiens
tctcctatcttttatttca

SEQ ID NO: 5313680 - DNA, 23 bp, Homo sapiens
tctcctatcttttatttcattca

SEQ ID NO: 5313681 - DNA, 14 bp, Homo sapiens
tctcctatgtggca

SEQ ID NO: 5313682 - DNA, 19 bp, Homo sapiens
tctcctatgtgtaaggtga

SEQ ID NO: 5313683 - DNA, 13 bp, Homo sapiens
tctcctatttttt

SEQ ID NO: 5313684 - DNA, 20 bp, Homo sapiens
tctcctatttttttaaaatc

SEQ ID NO: 5313685 - DNA, 14 bp, Homo sapiens
tctcctcaagcctg

SEQ ID NO: 5313686 - DNA, 13 bp, Homo sapiens
tctcctcactccc

SEQ ID NO: 5313687 - DNA, 23 bp, Homo sapiens
tctcctcactcccttctacctgc

SEQ ID NO: 5313688 - DNA, 16 bp, Homo sapiens
tctcctcactgccact

SEQ ID NO: 5313689 - DNA, 17 bp, Homo sapiens
tctcctcactgccacta

SEQ ID NO: 5313690 - DNA, 15 bp, Homo sapiens
tctcctcactgtatc

SEQ ID NO: 5313691 - DNA, 18 bp, Homo sapiens
tctcctcagagtcccggc

SEQ ID NO: 5313692 - DNA, 20 bp, Homo sapiens
tctcctcaggaccctcagcc

SEQ ID NO: 5313693 - DNA, 12 bp, Homo sapiens
tctcctcagggt

SEQ ID NO: 5313694 - DNA, 17 bp, Homo sapiens
tctcctcagggtggggg

SEQ ID NO: 5313695 - DNA, 18 bp, Homo sapiens
tctcctcagggtgggggg

SEQ ID NO: 5313696 - DNA, 20 bp, Homo sapiens
tctcctcagtggcttctcca

SEQ ID NO: 5313697 - DNA, 14 bp, Homo sapiens
tctcctcatccatt

SEQ ID NO: 5313698 - DNA, 13 bp, Homo sapiens
tctcctcatctcc

SEQ ID NO: 5313699 - DNA, 17 bp, Homo sapiens
tctcctcatttaatatt

SEQ ID NO: 5313700 - DNA, 16 bp, Homo sapiens
tctcctccaaatgctg

SEQ ID NO: 5313701 - DNA, 15 bp, Homo sapiens
tctcctccagagtca

SEQ ID NO: 5313702 - DNA, 17 bp, Homo sapiens
tctcctccatactcagg

SEQ ID NO: 5313703 - DNA, 14 bp, Homo sapiens
tctcctccatcttc

SEQ ID NO: 5313704 - DNA, 20 bp, Homo sapiens
tctcctccattgctgttgtt

SEQ ID NO: 5313705 - DNA, 12 bp, Homo sapiens
tctcctcccagc

SEQ ID NO: 5313706 - DNA, 22 bp, Homo sapiens
tctcctcccagcgtgtgtatcc

SEQ ID NO: 5313707 - DNA, 15 bp, Homo sapiens
tctcctcccagctgc

SEQ ID NO: 5313708 - DNA, 12 bp, Homo sapiens
tctcctccccaa

SEQ ID NO: 5313709 - DNA, 15 bp, Homo sapiens
tctcctccccacccg

SEQ ID NO: 5313710 - DNA, 16 bp, Homo sapiens
tctcctccccacctgt

SEQ ID NO: 5313711 - DNA, 14 bp, Homo sapiens
tctcctcccctact

SEQ ID NO: 5313712 - DNA, 22 bp, Homo sapiens
tctcctccccttcctgtttctc

SEQ ID NO: 5313713 - DNA, 19 bp, Homo sapiens
tctcctcccgccccgcccc

SEQ ID NO: 5313714 - DNA, 23 bp, Homo sapiens
tctcctccctctgtccctctcct

SEQ ID NO: 5313715 - DNA, 20 bp, Homo sapiens
tctcctccctgggctaagca

SEQ ID NO: 5313716 - DNA, 14 bp, Homo sapiens
tctcctcccttcct

SEQ ID NO: 5313717 - DNA, 15 bp, Homo sapiens
tctcctcctcccctc

SEQ ID NO: 5313718 - DNA, 21 bp, Homo sapiens
tctcctcctccgcgctgtgta

SEQ ID NO: 5313719 - DNA, 14 bp, Homo sapiens
tctccttcccccag

SEQ ID NO: 5313720 - DNA, 16 bp, Homo sapiens
tctccttcccccagcc

SEQ ID NO: 5313721 - DNA, 17 bp, Homo sapiens
tctccttcccccagccc

SEQ ID NO: 5313722 - DNA, 19 bp, Homo sapiens
tctccttcccccagcccaa

SEQ ID NO: 5313723 - DNA, 20 bp, Homo sapiens
tctccttcccccagcccaat

SEQ ID NO: 5313724 - DNA, 23 bp, Homo sapiens
tctccttcccccagcccaataaa

SEQ ID NO: 5313725 - DNA, 19 bp, Homo sapiens
tctccttcccctttcccca

SEQ ID NO: 5313726 - DNA, 17 bp, Homo sapiens
tctccttccctctttcc

SEQ ID NO: 5313727 - DNA, 13 bp, Homo sapiens
tctccttcccttc

SEQ ID NO: 5313728 - DNA, 15 bp, Homo sapiens
tctccttcccttctc

SEQ ID NO: 5313729 - DNA, 18 bp, Homo sapiens
tctccttcctcagcctcc

SEQ ID NO: 5313730 - DNA, 19 bp, Homo sapiens
tctccttcctcagcctccc

SEQ ID NO: 5313731 - DNA, 16 bp, Homo sapiens
tctccttcctcttggc

SEQ ID NO: 5313732 - DNA, 17 bp, Homo sapiens
tctccttcgctttcctg

SEQ ID NO: 5313733 - DNA, 18 bp, Homo sapiens
tctccttcgtatcccgag

SEQ ID NO: 5313734 - DNA, 19 bp, Homo sapiens
tctccttctaaaaacttct

SEQ ID NO: 5313735 - DNA, 13 bp, Homo sapiens
tctccttgaagca

SEQ ID NO: 5313736 - DNA, 17 bp, Homo sapiens
tctccttgataacagct

SEQ ID NO: 5313737 - DNA, 19 bp, Homo sapiens
tctccttgcccccagtgcc

SEQ ID NO: 5313738 - DNA, 18 bp, Homo sapiens
tctccttgccctgggcca

SEQ ID NO: 5313739 - DNA, 23 bp, Homo sapiens
tctccttgccctgggccagccca

SEQ ID NO: 5313740 - DNA, 14 bp, Homo sapiens
tctccttgctctgt

SEQ ID NO: 5313741 - DNA, 13 bp, Homo sapiens
tctccttggagga

SEQ ID NO: 5313742 - DNA, 21 bp, Homo sapiens
tctccttgggctcctggctgc

SEQ ID NO: 5313743 - DNA, 22 bp, Homo sapiens
tctccttgggctcctggctgcc

SEQ ID NO: 5313744 - DNA, 21 bp, Homo sapiens
tctccttggtgtcgggcatga

SEQ ID NO: 5313745 - DNA, 17 bp, Homo sapiens
tctccttggttatattt

SEQ ID NO: 5313746 - DNA, 13 bp, Homo sapiens
tctccttgtactt

SEQ ID NO: 5313747 - DNA, 14 bp, Homo sapiens
tctccttgtacttg

SEQ ID NO: 5313748 - DNA, 19 bp, Homo sapiens
tctccttgtacttgaataa

SEQ ID NO: 5313749 - DNA, 14 bp, Homo sapiens
tctccttgtggcct

SEQ ID NO: 5313750 - DNA, 15 bp, Homo sapiens
tctccttgtggccta

SEQ ID NO: 5313751 - DNA, 19 bp, Homo sapiens
tctccttgtggcctatgaa

SEQ ID NO: 5313752 - DNA, 13 bp, Homo sapiens
tctccttgtgtta

SEQ ID NO: 5313753 - DNA, 13 bp, Homo sapiens
tctccttgttctg

SEQ ID NO: 5313754 - DNA, 14 bp, Homo sapiens
tctccttgttctga

SEQ ID NO: 5313755 - DNA, 15 bp, Homo sapiens
tctcctttaattgta

SEQ ID NO: 5313756 - DNA, 19 bp, Homo sapiens
tctcctttcaccaccccct

SEQ ID NO: 5313757 - DNA, 14 bp, Homo sapiens
tctcctttcagggc

SEQ ID NO: 5313758 - DNA, 14 bp, Homo sapiens
tctcctttccactg

SEQ ID NO: 5313759 - DNA, 16 bp, Homo sapiens
tctcctttcctacagt

SEQ ID NO: 5313760 - DNA, 17 bp, Homo sapiens
tctcctttccttcccag

SEQ ID NO: 5313761 - DNA, 18 bp, Homo sapiens
tctcctttccttcccagg

SEQ ID NO: 5313762 - DNA, 22 bp, Homo sapiens
tctcctttctaagccctgttct

SEQ ID NO: 5313763 - DNA, 15 bp, Homo sapiens
tctcctttctgtgca

SEQ ID NO: 5313764 - DNA, 20 bp, Homo sapiens
tctcctttctttttcttctt

SEQ ID NO: 5313765 - DNA, 23 bp, Homo sapiens
tctcctttgataaaataaatgag

SEQ ID NO: 5313766 - DNA, 14 bp, Homo sapiens
tctcctttgcaata

SEQ ID NO: 5313767 - DNA, 20 bp, Homo sapiens
tctcctttggcatgtttaat

SEQ ID NO: 5313768 - DNA, 11 bp, Homo sapiens
tctcctttgta

SEQ ID NO: 5313769 - DNA, 20 bp, Homo sapiens
tctcctttgtactttgtgct

SEQ ID NO: 5313770 - DNA, 14 bp, Homo sapiens
tctcctttgtatat

SEQ ID NO: 5313771 - DNA, 22 bp, Homo sapiens
tctcctttgtatattatttcta

SEQ ID NO: 5313772 - DNA, 14 bp, Homo sapiens
tctcctttgtccat

SEQ ID NO: 5313773 - DNA, 22 bp, Homo sapiens
tctccttttatctggtgcctcc

SEQ ID NO: 5313774 - DNA, 13 bp, Homo sapiens
tctccttttccta

SEQ ID NO: 5313775 - DNA, 17 bp, Homo sapiens
tctccttttcctctctc

SEQ ID NO: 5313776 - DNA, 14 bp, Homo sapiens
tctccttttctcca

SEQ ID NO: 5313777 - DNA, 18 bp, Homo sapiens
tctccttttcttttgtta

SEQ ID NO: 5313778 - DNA, 22 bp, Homo sapiens
tctccttttcttttgttactgt

SEQ ID NO: 5313779 - DNA, 17 bp, Homo sapiens
tctccttttgaacttgt

SEQ ID NO: 5313780 - DNA, 19 bp, Homo sapiens
tctccttttgcgcttattt

SEQ ID NO: 5313781 - DNA, 22 bp, Homo sapiens
tctcctttttattttaggcact

SEQ ID NO: 5313782 - DNA, 17 bp, Homo sapiens
tctcgaactcctgacct

SEQ ID NO: 5313783 - DNA, 14 bp, Homo sapiens
tctcgaactcctgg

SEQ ID NO: 5313784 - DNA, 22 bp, Homo sapiens
tctcgaagtcttccatcagcag

SEQ ID NO: 5313785 - DNA, 15 bp, Homo sapiens
tctcgaatttgaaga

SEQ ID NO: 5313786 - DNA, 18 bp, Homo sapiens
tctcgaatttgaagagat

SEQ ID NO: 5313787 - DNA, 22 bp, Homo sapiens
tctcgaccttctggtatcttgt

SEQ ID NO: 5313788 - DNA, 22 bp, Homo sapiens
tctcgacggcacgcacttgcct

SEQ ID NO: 5313789 - DNA, 12 bp, Homo sapiens
tctcgactcccc

SEQ ID NO: 5313790 - DNA, 16 bp, Homo sapiens
tctcgagcgccctgca

SEQ ID NO: 5313791 - DNA, 12 bp, Homo sapiens
tctcgatctcct

SEQ ID NO: 5313792 - DNA, 16 bp, Homo sapiens
tctcgatctcctgacc

SEQ ID NO: 5313793 - DNA, 17 bp, Homo sapiens
tctcgatgcaatgaaca

SEQ ID NO: 5313794 - DNA, 15 bp, Homo sapiens
tctcgatgctgctgg

SEQ ID NO: 5313795 - DNA, 16 bp, Homo sapiens
tctcgatgctgctggc

SEQ ID NO: 5313796 - DNA, 19 bp, Homo sapiens
tctcgatgctgctggcctc

SEQ ID NO: 5313797 - DNA, 22 bp, Homo sapiens
tctcgatgctgctggcctccct

SEQ ID NO: 5313798 - DNA, 16 bp, Homo sapiens
tctcgcagcctgaagc

SEQ ID NO: 5313799 - DNA, 16 bp, Homo sapiens
tctcgcataggacctt

SEQ ID NO: 5313800 - DNA, 15 bp, Homo sapiens
tctcgccatgatcag

SEQ ID NO: 5313801 - DNA, 16 bp, Homo sapiens
tctcgccccttccctc

SEQ ID NO: 5313802 - DNA, 22 bp, Homo sapiens
tctcgccccttccctctctccc

SEQ ID NO: 5313803 - DNA, 23 bp, Homo sapiens
tctcgccccttccctctctccct

SEQ ID NO: 5313804 - DNA, 12 bp, Homo sapiens
tctcgcctggaa

SEQ ID NO: 5313805 - DNA, 21 bp, Homo sapiens
tctcgcggcctcttctctcag

SEQ ID NO: 5313806 - DNA, 18 bp, Homo sapiens
tctcgctccctcccagga

SEQ ID NO: 5313807 - DNA, 15 bp, Homo sapiens
tctcgctctctctcg

SEQ ID NO: 5313808 - DNA, 17 bp, Homo sapiens
tctcgctctgttgccca

SEQ ID NO: 5313809 - DNA, 21 bp, Homo sapiens
tctcgctctgttgcccaggct

SEQ ID NO: 5313810 - DNA, 19 bp, Homo sapiens
tctcgctgatgctgggctg

SEQ ID NO: 5313811 - DNA, 22 bp, Homo sapiens
tctcgctgcgcagcctccaggg

SEQ ID NO: 5313812 - DNA, 13 bp, Homo sapiens
tctcgctgtcact

SEQ ID NO: 5313813 - DNA, 15 bp, Homo sapiens
tctcgcttccctgaa

SEQ ID NO: 5313814 - DNA, 19 bp, Homo sapiens
tctcggactaagcctacct

SEQ ID NO: 5313815 - DNA, 20 bp, Homo sapiens
tctcggactttgcaggagtt

SEQ ID NO: 5313816 - DNA, 16 bp, Homo sapiens
tctcggagccctcaga

SEQ ID NO: 5313817 - DNA, 16 bp, Homo sapiens
tctcggagctggccca

SEQ ID NO: 5313818 - DNA, 12 bp, Homo sapiens
tctcggaggcca

SEQ ID NO: 5313819 - DNA, 14 bp, Homo sapiens
tctcggaggccagg

SEQ ID NO: 5313820 - DNA, 19 bp, Homo sapiens
tctcggagtatctgggaac

SEQ ID NO: 5313821 - DNA, 18 bp, Homo sapiens
tctcggatagttgctatt

SEQ ID NO: 5313822 - DNA, 20 bp, Homo sapiens
tctcggatcaggctcccagg

SEQ ID NO: 5313823 - DNA, 23 bp, Homo sapiens
tctcggatgaccaaaccagcctt

SEQ ID NO: 5313824 - DNA, 12 bp, Homo sapiens
tctcggcagagg

SEQ ID NO: 5313825 - DNA, 13 bp, Homo sapiens
tctcggcagaggt

SEQ ID NO: 5313826 - DNA, 16 bp, Homo sapiens
tctcggcagaggtggt

SEQ ID NO: 5313827 - DNA, 22 bp, Homo sapiens
tctcggcatagtccccagagct

SEQ ID NO: 5313828 - DNA, 13 bp, Homo sapiens
tctcggccaggca

SEQ ID NO: 5313829 - DNA, 18 bp, Homo sapiens
tctcggccccatcgcccc

SEQ ID NO: 5313830 - DNA, 19 bp, Homo sapiens
tctcggccccctcacccca

SEQ ID NO: 5313831 - DNA, 16 bp, Homo sapiens
tctcggcccctctgat

SEQ ID NO: 5313832 - DNA, 13 bp, Homo sapiens
tctcggcccctgt

SEQ ID NO: 5313833 - DNA, 17 bp, Homo sapiens
tctcggcccctgtctgt

SEQ ID NO: 5313834 - DNA, 19 bp, Homo sapiens
tctcggcccctgtctgttc

SEQ ID NO: 5313835 - DNA, 16 bp, Homo sapiens
tctcggccctgaacca

SEQ ID NO: 5313836 - DNA, 15 bp, Homo sapiens
tctcggcccttgccg

SEQ ID NO: 5313837 - DNA, 15 bp, Homo sapiens
tctcggctcactgca

SEQ ID NO: 5313838 - DNA, 15 bp, Homo sapiens
tctcggctcaggctc

SEQ ID NO: 5313839 - DNA, 13 bp, Homo sapiens
tctcggctctgca

SEQ ID NO: 5313840 - DNA, 19 bp, Homo sapiens
tctcggctggaagaacatc

SEQ ID NO: 5313841 - DNA, 20 bp, Homo sapiens
tctcggcttggatcctgggc

SEQ ID NO: 5313842 - DNA, 15 bp, Homo sapiens
tctcgggaaattatt

SEQ ID NO: 5313843 - DNA, 14 bp, Homo sapiens
tctcgggagaggat

SEQ ID NO: 5313844 - DNA, 15 bp, Homo sapiens
tctcgggagccctag

SEQ ID NO: 5313845 - DNA, 22 bp, Homo sapiens
tctcggggcccttggggcctgg

SEQ ID NO: 5313846 - DNA, 17 bp, Homo sapiens
tctcggggtcaggttct

SEQ ID NO: 5313847 - DNA, 16 bp, Homo sapiens
tctcggggtccagtgc

SEQ ID NO: 5313848 - DNA, 17 bp, Homo sapiens
tctcggggtccagtgca

SEQ ID NO: 5313849 - DNA, 14 bp, Homo sapiens
tctcgggtgcattt

SEQ ID NO: 5313850 - DNA, 21 bp, Homo sapiens
tctcgggtgcatttgagagaa

SEQ ID NO: 5313851 - DNA, 15 bp, Homo sapiens
tctcgtactttcaca

SEQ ID NO: 5313852 - DNA, 23 bp, Homo sapiens
tctcgtatccaacccaaggacct

SEQ ID NO: 5313853 - DNA, 17 bp, Homo sapiens
tctcgtatggatttcta

SEQ ID NO: 5313854 - DNA, 16 bp, Homo sapiens
tctcgtattttgtccc

SEQ ID NO: 5313855 - DNA, 12 bp, Homo sapiens
tctcgtccccct

SEQ ID NO: 5313856 - DNA, 16 bp, Homo sapiens
tctcgtccccctccct

SEQ ID NO: 5313857 - DNA, 20 bp, Homo sapiens
tctcgtccccctccctgccc

SEQ ID NO: 5313858 - DNA, 21 bp, Homo sapiens
tctcgtccccctccctgccca

SEQ ID NO: 5313859 - DNA, 15 bp, Homo sapiens
tctcgtccctctgct

SEQ ID NO: 5313860 - DNA, 17 bp, Homo sapiens
tctcgtcttccgtctcc

SEQ ID NO: 5313861 - DNA, 14 bp, Homo sapiens
tctcgtctttactt

SEQ ID NO: 5313862 - DNA, 17 bp, Homo sapiens
tctcgtgatatgctgct

SEQ ID NO: 5313863 - DNA, 19 bp, Homo sapiens
tctcgtgatatgctgcttg

SEQ ID NO: 5313864 - DNA, 20 bp, Homo sapiens
tctcgtgatccgcctgcctc

SEQ ID NO: 5313865 - DNA, 14 bp, Homo sapiens
tctcgtgattgata

SEQ ID NO: 5313866 - DNA, 17 bp, Homo sapiens
tctcgtggtagaagcca

SEQ ID NO: 5313867 - DNA, 15 bp, Homo sapiens
tctcgtgtacagctc

SEQ ID NO: 5313868 - DNA, 18 bp, Homo sapiens
tctcgtgtacagctccct

SEQ ID NO: 5313869 - DNA, 13 bp, Homo sapiens
tctcgtgttcgct

SEQ ID NO: 5313870 - DNA, 20 bp, Homo sapiens
tctcgtgttcgctggctgat

SEQ ID NO: 5313871 - DNA, 13 bp, Homo sapiens
tctcgtgtttgct

SEQ ID NO: 5313872 - DNA, 19 bp, Homo sapiens
tctcgtgtttgcttaaaat

SEQ ID NO: 5313873 - DNA, 16 bp, Homo sapiens
tctcgttcccaaagaa

SEQ ID NO: 5313874 - DNA, 22 bp, Homo sapiens
tctcgttgaggccaaggaatga

SEQ ID NO: 5313875 - DNA, 13 bp, Homo sapiens
tctcgttgcccta

SEQ ID NO: 5313876 - DNA, 16 bp, Homo sapiens
tctcgtttctgcccag

SEQ ID NO: 5313877 - DNA, 23 bp, Homo sapiens
tctcgttttgttgccaaagctgg

SEQ ID NO: 5313878 - DNA, 19 bp, Homo sapiens
tctctaaaaataaaatgat

SEQ ID NO: 5313879 - DNA, 14 bp, Homo sapiens
tctctaaaacagca

SEQ ID NO: 5313880 - DNA, 17 bp, Homo sapiens
tctctaaaagtgtccac

SEQ ID NO: 5313881 - DNA, 20 bp, Homo sapiens
tctctaaactgctgttaatt

SEQ ID NO: 5313882 - DNA, 20 bp, Homo sapiens
tctctaaactggcatctgct

SEQ ID NO: 5313883 - DNA, 16 bp, Homo sapiens
tctctaaactggtaca

SEQ ID NO: 5313884 - DNA, 17 bp, Homo sapiens
tctctaaactgtttctt

SEQ ID NO: 5313885 - DNA, 18 bp, Homo sapiens
tctctaaatcaagtattt

SEQ ID NO: 5313886 - DNA, 19 bp, Homo sapiens
tctctaaatcttccttgtg

SEQ ID NO: 5313887 - DNA, 22 bp, Homo sapiens
tctctaacagctccatacttct

SEQ ID NO: 5313888 - DNA, 14 bp, Homo sapiens
tctctaacagtgga

SEQ ID NO: 5313889 - DNA, 20 bp, Homo sapiens
tctctaacagtggacaaagt

SEQ ID NO: 5313890 - DNA, 14 bp, Homo sapiens
tctctaacccctag

SEQ ID NO: 5313891 - DNA, 18 bp, Homo sapiens
tctctaactcagaaacat

SEQ ID NO: 5313892 - DNA, 21 bp, Homo sapiens
tctctaactcagaaacatcag

SEQ ID NO: 5313893 - DNA, 16 bp, Homo sapiens
tctctaactcctgcca

SEQ ID NO: 5313894 - DNA, 18 bp, Homo sapiens
tctctaacttattttatt

SEQ ID NO: 5313895 - DNA, 17 bp, Homo sapiens
tctctaacttctcaagt

SEQ ID NO: 5313896 - DNA, 17 bp, Homo sapiens
tctctaagacaaatgca

SEQ ID NO: 5313897 - DNA, 23 bp, Homo sapiens
tctctaagacaaatgcagtgtat

SEQ ID NO: 5313898 - DNA, 14 bp, Homo sapiens
tctctgagactgct

SEQ ID NO: 5313899 - DNA, 21 bp, Homo sapiens
tctctgagccccctgtgccca

SEQ ID NO: 5313900 - DNA, 22 bp, Homo sapiens
tctctgagccccctgtgcccac

SEQ ID NO: 5313901 - DNA, 24 bp, Homo sapiens
tctctgagccccctgtgcccaccc

SEQ ID NO: 5313902 - DNA, 13 bp, Homo sapiens
tctctgaggacac

SEQ ID NO: 5313903 - DNA, 20 bp, Homo sapiens
tctctgaggcaaggcccaga

SEQ ID NO: 5313904 - DNA, 12 bp, Homo sapiens
tctctgaggcta

SEQ ID NO: 5313905 - DNA, 19 bp, Homo sapiens
tctctgaggctctccaaat

SEQ ID NO: 5313906 - DNA, 21 bp, Homo sapiens
tctctgaggggctaccaggaa

SEQ ID NO: 5313907 - DNA, 22 bp, Homo sapiens
tctctgaggggctaccaggaaa

SEQ ID NO: 5313908 - DNA, 23 bp, Homo sapiens
tctctgaggggctaccaggaaag

SEQ ID NO: 5313909 - DNA, 22 bp, Homo sapiens
tctctgagtcaaatccagtggt

SEQ ID NO: 5313910 - DNA, 23 bp, Homo sapiens
tctctgagtcaaatccagtggtg

SEQ ID NO: 5313911 - DNA, 19 bp, Homo sapiens
tctctgagtggaggaagcc

SEQ ID NO: 5313912 - DNA, 13 bp, Homo sapiens
tctctgagtggtg

SEQ ID NO: 5313913 - DNA, 20 bp, Homo sapiens
tctctgagtggtggttcctt

SEQ ID NO: 5313914 - DNA, 21 bp, Homo sapiens
tctctgagtggtggttccttt

SEQ ID NO: 5313915 - DNA, 16 bp, Homo sapiens
tctctgagtgtctctg

SEQ ID NO: 5313916 - DNA, 18 bp, Homo sapiens
tctctgagtgtctctgcc

SEQ ID NO: 5313917 - DNA, 21 bp, Homo sapiens
tctctgagtgtctctgcctgg

SEQ ID NO: 5313918 - DNA, 18 bp, Homo sapiens
tctctgatatacaaaggg

SEQ ID NO: 5313919 - DNA, 20 bp, Homo sapiens
tctctgatcacaacttttct

SEQ ID NO: 5313920 - DNA, 23 bp, Homo sapiens
tctctgatcacaacttttctgct

SEQ ID NO: 5313921 - DNA, 23 bp, Homo sapiens
tctctgatcttgtgctcagcatg

SEQ ID NO: 5313922 - DNA, 15 bp, Homo sapiens
tctctgatgcagaaa

SEQ ID NO: 5313923 - DNA, 15 bp, Homo sapiens
tctctgatgcagctt

SEQ ID NO: 5313924 - DNA, 22 bp, Homo sapiens
tctctgatggcacttttgagct

SEQ ID NO: 5313925 - DNA, 15 bp, Homo sapiens
tctctgattaaattt

SEQ ID NO: 5313926 - DNA, 22 bp, Homo sapiens
tctctgattaaatttaatatac

SEQ ID NO: 5313927 - DNA, 16 bp, Homo sapiens
tctctgattacagtgg

SEQ ID NO: 5313928 - DNA, 18 bp, Homo sapiens
tctctgattagttgacag

SEQ ID NO: 5313929 - DNA, 21 bp, Homo sapiens
tctctgattagttgacagtat

SEQ ID NO: 5313930 - DNA, 23 bp, Homo sapiens
tctctgattagttgacagtatta

SEQ ID NO: 5313931 - DNA, 14 bp, Homo sapiens
tctctgatttgcaa

SEQ ID NO: 5313932 - DNA, 14 bp, Homo sapiens
tctctgcaatgctt

SEQ ID NO: 5313933 - DNA, 14 bp, Homo sapiens
tctctgcaatttgt

SEQ ID NO: 5313934 - DNA, 22 bp, Homo sapiens
tctctgcaatttgtttaaagaa

SEQ ID NO: 5313935 - DNA, 11 bp, Homo sapiens
tctctgcagcc

SEQ ID NO: 5313936 - DNA, 15 bp, Homo sapiens
tctctgcagccagcc

SEQ ID NO: 5313937 - DNA, 16 bp, Homo sapiens
tctctgcagccagccc

SEQ ID NO: 5313938 - DNA, 17 bp, Homo sapiens
tctctgcagccagccca

SEQ ID NO: 5313939 - DNA, 19 bp, Homo sapiens
tctctgcagccagcccagc

SEQ ID NO: 5313940 - DNA, 20 bp, Homo sapiens
tctctgcagccagcccagcc

SEQ ID NO: 5313941 - DNA, 13 bp, Homo sapiens
tctctgcagccca

SEQ ID NO: 5313942 - DNA, 15 bp, Homo sapiens
tctctgcagctgccg

SEQ ID NO: 5313943 - DNA, 16 bp, Homo sapiens
tctctgcagctgccgg

SEQ ID NO: 5313944 - DNA, 11 bp, Homo sapiens
tctctgcaggt

SEQ ID NO: 5313945 - DNA, 15 bp, Homo sapiens
tctctgcaggtccct

SEQ ID NO: 5313946 - DNA, 22 bp, Homo sapiens
tctctgcaggtccctaataaag

SEQ ID NO: 5313947 - DNA, 13 bp, Homo sapiens
tctctgcagtaaa

SEQ ID NO: 5313948 - DNA, 22 bp, Homo sapiens
tctctgcagtcctccggggtgg

SEQ ID NO: 5313949 - DNA, 20 bp, Homo sapiens
tctctgcatccatttgaaca

SEQ ID NO: 5313950 - DNA, 23 bp, Homo sapiens
tctctgcatccatttgaacacat

SEQ ID NO: 5313951 - DNA, 20 bp, Homo sapiens
tctctgcatttttctgcaga

SEQ ID NO: 5313952 - DNA, 23 bp, Homo sapiens
tctctgccaacatgaggacagaa

SEQ ID NO: 5313953 - DNA, 16 bp, Homo sapiens
tctctgccacccactc

SEQ ID NO: 5313954 - DNA, 17 bp, Homo sapiens
tctctgccacccactca

SEQ ID NO: 5313955 - DNA, 12 bp, Homo sapiens
tctctgccagcc

SEQ ID NO: 5313956 - DNA, 12 bp, Homo sapiens
tctctgccagct

SEQ ID NO: 5313957 - DNA, 19 bp, Homo sapiens
tctctgccagctccacagg

SEQ ID NO: 5313958 - DNA, 18 bp, Homo sapiens
tctctgccatgtggcaga

SEQ ID NO: 5313959 - DNA, 21 bp, Homo sapiens
tctctgccatgtggcagaagt

SEQ ID NO: 5313960 - DNA, 19 bp, Homo sapiens
tctctgccattctgtgcag

SEQ ID NO: 5313961 - DNA, 12 bp, Homo sapiens
tctctgcccaac

SEQ ID NO: 5313962 - DNA, 22 bp, Homo sapiens
tctctgcccaagttgctctgta

SEQ ID NO: 5313963 - DNA, 15 bp, Homo sapiens
tctctgcccagcttt

SEQ ID NO: 5313964 - DNA, 15 bp, Homo sapiens
tctctgcccattccc

SEQ ID NO: 5313965 - DNA, 22 bp, Homo sapiens
tctctgccccacccaagcccaa

SEQ ID NO: 5313966 - DNA, 21 bp, Homo sapiens
tctctgcccccagcctctgtc

SEQ ID NO: 5313967 - DNA, 21 bp, Homo sapiens
tctctgcccccattgattttt

SEQ ID NO: 5313968 - DNA, 23 bp, Homo sapiens
tctctgcccctaaagatgggagg

SEQ ID NO: 5313969 - DNA, 17 bp, Homo sapiens
tctctgcccgggcccct

SEQ ID NO: 5313970 - DNA, 20 bp, Homo sapiens
tctctgccctgccctggcca

SEQ ID NO: 5313971 - DNA, 13 bp, Homo sapiens
tctctgccctggg

SEQ ID NO: 5313972 - DNA, 22 bp, Homo sapiens
tctctgcccttgatcagcccca

SEQ ID NO: 5313973 - DNA, 14 bp, Homo sapiens
tctctgccgcctgc

SEQ ID NO: 5313974 - DNA, 16 bp, Homo sapiens
tctctgccgcctgcgt

SEQ ID NO: 5313975 - DNA, 22 bp, Homo sapiens
tctctgccgctacctccctccc

SEQ ID NO: 5313976 - DNA, 21 bp, Homo sapiens
tctctgccggctctttccttg

SEQ ID NO: 5313977 - DNA, 18 bp, Homo sapiens
tctctgcctagaatcttt

SEQ ID NO: 5313978 - DNA, 23 bp, Homo sapiens
tctctgcctagaatctttattca

SEQ ID NO: 5313979 - DNA, 15 bp, Homo sapiens
tctctgcctccaggt

SEQ ID NO: 5313980 - DNA, 16 bp, Homo sapiens
tctctgcctccaggtt

SEQ ID NO: 5313981 - DNA, 23 bp, Homo sapiens
tctctgcctccctcaccctgagc

SEQ ID NO: 5313982 - DNA, 13 bp, Homo sapiens
tctctgcctcctc

SEQ ID NO: 5313983 - DNA, 15 bp, Homo sapiens
tctctgcctctcttc

SEQ ID NO: 5313984 - DNA, 12 bp, Homo sapiens
tctctgcctctg

SEQ ID NO: 5313985 - DNA, 12 bp, Homo sapiens
tctctgcctgct

SEQ ID NO: 5313986 - DNA, 15 bp, Homo sapiens
tctctgcctgctggg

SEQ ID NO: 5313987 - DNA, 16 bp, Homo sapiens
tctctgcctgctgggc

SEQ ID NO: 5313988 - DNA, 17 bp, Homo sapiens
tctctgcctgctgggct

SEQ ID NO: 5313989 - DNA, 21 bp, Homo sapiens
tctctgcctgcttcctggacc

SEQ ID NO: 5313990 - DNA, 15 bp, Homo sapiens
tctctgcctggagca

SEQ ID NO: 5313991 - DNA, 12 bp, Homo sapiens
tctctgcctggg

SEQ ID NO: 5313992 - DNA, 14 bp, Homo sapiens
tctctgccttgcct

SEQ ID NO: 5313993 - DNA, 13 bp, Homo sapiens
tctctgcctttga

SEQ ID NO: 5313994 - DNA, 13 bp, Homo sapiens
tctctgcgctgag

SEQ ID NO: 5313995 - DNA, 18 bp, Homo sapiens
tctctgctagatttctac

SEQ ID NO: 5313996 - DNA, 14 bp, Homo sapiens
tctctgctcatggg

SEQ ID NO: 5313997 - DNA, 15 bp, Homo sapiens
tctctgctcatgggt

SEQ ID NO: 5313998 - DNA, 13 bp, Homo sapiens
tctctgctccacc

SEQ ID NO: 5313999 - DNA, 15 bp, Homo sapiens
tctctgctccaccac

SEQ ID NO: 5314000 - DNA, 19 bp, Homo sapiens
tctctgctccaccacatcc

SEQ ID NO: 5314001 - DNA, 12 bp, Homo sapiens
tctctgctccag

SEQ ID NO: 5314002 - DNA, 16 bp, Homo sapiens
tctctgctccagagag

SEQ ID NO: 5314003 - DNA, 14 bp, Homo sapiens
tctctgctcctcac

SEQ ID NO: 5314004 - DNA, 13 bp, Homo sapiens
tctctgctccttc

SEQ ID NO: 5314005 - DNA, 15 bp, Homo sapiens
tctctgctctagcca

SEQ ID NO: 5314006 - DNA, 16 bp, Homo sapiens
tctctgctctctatgt

SEQ ID NO: 5314007 - DNA, 18 bp, Homo sapiens
tctctgctctgcgtgtca

SEQ ID NO: 5314008 - DNA, 23 bp, Homo sapiens
tctctgctctgcgtgtcacctgt

SEQ ID NO: 5314009 - DNA, 16 bp, Homo sapiens
tctctgctctgctcag

SEQ ID NO: 5314010 - DNA, 18 bp, Homo sapiens
tctctgctcttgcctgca

SEQ ID NO: 5314011 - DNA, 21 bp, Homo sapiens
tctctgctctttcctcggcct

SEQ ID NO: 5314012 - DNA, 13 bp, Homo sapiens
tctctgctgaagg

SEQ ID NO: 5314013 - DNA, 15 bp, Homo sapiens
tctctgctgagctgg

SEQ ID NO: 5314014 - DNA, 22 bp, Homo sapiens
tctctgctgagctgggcccagc

SEQ ID NO: 5314015 - DNA, 14 bp, Homo sapiens
tctctgctgagggc

SEQ ID NO: 5314016 - DNA, 14 bp, Homo sapiens
tctctgctgcatct

SEQ ID NO: 5314017 - DNA, 13 bp, Homo sapiens
tctctgctgccgc

SEQ ID NO: 5314018 - DNA, 13 bp, Homo sapiens
tctctgctggacg

SEQ ID NO: 5314019 - DNA, 14 bp, Homo sapiens
tctctgctggcagg

SEQ ID NO: 5314020 - DNA, 16 bp, Homo sapiens
tctctgctggcccagc

SEQ ID NO: 5314021 - DNA, 19 bp, Homo sapiens
tctctgctggcccagccaa

SEQ ID NO: 5314022 - DNA, 11 bp, Homo sapiens
tctctgctggg

SEQ ID NO: 5314023 - DNA, 16 bp, Homo sapiens
tctctgctgggtctcc

SEQ ID NO: 5314024 - DNA, 11 bp, Homo sapiens
tctctgctgta

SEQ ID NO: 5314025 - DNA, 14 bp, Homo sapiens
tctctgctgtccta

SEQ ID NO: 5314026 - DNA, 11 bp, Homo sapiens
tctctgcttca

SEQ ID NO: 5314027 - DNA, 12 bp, Homo sapiens
tctctgcttcca

SEQ ID NO: 5314028 - DNA, 17 bp, Homo sapiens
tctctgcttccagttgg

SEQ ID NO: 5314029 - DNA, 14 bp, Homo sapiens
tctctgcttccatg

SEQ ID NO: 5314030 - DNA, 17 bp, Homo sapiens
tctctgcttccgttcct

SEQ ID NO: 5314031 - DNA, 20 bp, Homo sapiens
tctctgcttccgttcctccc

SEQ ID NO: 5314032 - DNA, 18 bp, Homo sapiens
tctctgctttccttttct

SEQ ID NO: 5314033 - DNA, 15 bp, Homo sapiens
tctctgcttttccat

SEQ ID NO: 5314034 - DNA, 16 bp, Homo sapiens
tctctggaaaggagga

SEQ ID NO: 5314035 - DNA, 14 bp, Homo sapiens
tctctggaacctga

SEQ ID NO: 5314036 - DNA, 20 bp, Homo sapiens
tctctggaagagggaggggc

SEQ ID NO: 5314037 - DNA, 21 bp, Homo sapiens
tctctggaaggccccttccct

SEQ ID NO: 5314038 - DNA, 23 bp, Homo sapiens
tctctggaaggggcagccctgag

SEQ ID NO: 5314039 - DNA, 19 bp, Homo sapiens
tctctggaatttgaaacac

SEQ ID NO: 5314040 - DNA, 15 bp, Homo sapiens
tctctggacctcagt

SEQ ID NO: 5314041 - DNA, 17 bp, Homo sapiens
tctctggacctcagttt

SEQ ID NO: 5314042 - DNA, 13 bp, Homo sapiens
tctctggacctga

SEQ ID NO: 5314043 - DNA, 17 bp, Homo sapiens
tctctggactttctcca

SEQ ID NO: 5314044 - DNA, 22 bp, Homo sapiens
tctctggagccaagtccagatt

SEQ ID NO: 5314045 - DNA, 14 bp, Homo sapiens
tctctggagccaga

SEQ ID NO: 5314046 - DNA, 17 bp, Homo sapiens
tctctggagccagagag

SEQ ID NO: 5314047 - DNA, 20 bp, Homo sapiens
tctctggagtgatggtgtcc

SEQ ID NO: 5314048 - DNA, 21 bp, Homo sapiens
tctctggagtgatggtgtcct

SEQ ID NO: 5314049 - DNA, 23 bp, Homo sapiens
tctctggagtgatggtgtccttc

SEQ ID NO: 5314050 - DNA, 15 bp, Homo sapiens
tctctggattcctgt

SEQ ID NO: 5314051 - DNA, 18 bp, Homo sapiens
tctctggcaatcttgccc

SEQ ID NO: 5314052 - DNA, 15 bp, Homo sapiens
tctctggcactttga

SEQ ID NO: 5314053 - DNA, 20 bp, Homo sapiens
tctctggcagagaaggatgt

SEQ ID NO: 5314054 - DNA, 14 bp, Homo sapiens
tctctggcatttgt

SEQ ID NO: 5314055 - DNA, 15 bp, Homo sapiens
tctctggcccagaaa

SEQ ID NO: 5314056 - DNA, 15 bp, Homo sapiens
tctctggccccaagg

SEQ ID NO: 5314057 - DNA, 13 bp, Homo sapiens
tctctggcccctc

SEQ ID NO: 5314058 - DNA, 19 bp, Homo sapiens
tctctggcccttcttgcct

SEQ ID NO: 5314059 - DNA, 15 bp, Homo sapiens
tctctggcctcccac

SEQ ID NO: 5314060 - DNA, 19 bp, Homo sapiens
tctctggcctcctgggggc

SEQ ID NO: 5314061 - DNA, 12 bp, Homo sapiens
tctctggccttc

SEQ ID NO: 5314062 - DNA, 16 bp, Homo sapiens
tctctggccttcggcc

SEQ ID NO: 5314063 - DNA, 16 bp, Homo sapiens
tctctggcgacagttt

SEQ ID NO: 5314064 - DNA, 19 bp, Homo sapiens
tctctggctactccctgga

SEQ ID NO: 5314065 - DNA, 21 bp, Homo sapiens
tctctggctactccctggacc

SEQ ID NO: 5314066 - DNA, 13 bp, Homo sapiens
tctctggctcagc

SEQ ID NO: 5314067 - DNA, 16 bp, Homo sapiens
tctctggctccagaat

SEQ ID NO: 5314068 - DNA, 12 bp, Homo sapiens
tctctggctcta

SEQ ID NO: 5314069 - DNA, 22 bp, Homo sapiens
tctctggctgagggatgactta

SEQ ID NO: 5314070 - DNA, 22 bp, Homo sapiens
tctctggctgtaaggctctaga

SEQ ID NO: 5314071 - DNA, 23 bp, Homo sapiens
tctctggctgtctgtctgcagtg

SEQ ID NO: 5314072 - DNA, 15 bp, Homo sapiens
tctctggcttctctc

SEQ ID NO: 5314073 - DNA, 16 bp, Homo sapiens
tctctgggactctcct

SEQ ID NO: 5314074 - DNA, 15 bp, Homo sapiens
tctctgggagacttt

SEQ ID NO: 5314075 - DNA, 14 bp, Homo sapiens
tctctgggccccag

SEQ ID NO: 5314076 - DNA, 14 bp, Homo sapiens
tctctgggcctgtg

SEQ ID NO: 5314077 - DNA, 14 bp, Homo sapiens
tctcttctgctcca

SEQ ID NO: 5314078 - DNA, 13 bp, Homo sapiens
tctcttctggtgt

SEQ ID NO: 5314079 - DNA, 21 bp, Homo sapiens
tctcttcttaaccctgaacaa

SEQ ID NO: 5314080 - DNA, 17 bp, Homo sapiens
tctcttcttactgtatt

SEQ ID NO: 5314081 - DNA, 22 bp, Homo sapiens
tctcttcttcccctttgtcctg

SEQ ID NO: 5314082 - DNA, 19 bp, Homo sapiens
tctcttctttattgcacta

SEQ ID NO: 5314083 - DNA, 20 bp, Homo sapiens
tctcttctttattgcactag

SEQ ID NO: 5314084 - DNA, 13 bp, Homo sapiens
tctcttctttcca

SEQ ID NO: 5314085 - DNA, 16 bp, Homo sapiens
tctcttcttttggctt

SEQ ID NO: 5314086 - DNA, 18 bp, Homo sapiens
tctcttcttttggcttcc

SEQ ID NO: 5314087 - DNA, 12 bp, Homo sapiens
tctcttgaaacc

SEQ ID NO: 5314088 - DNA, 23 bp, Homo sapiens
tctcttgaataaagtattctagt

SEQ ID NO: 5314089 - DNA, 15 bp, Homo sapiens
tctcttgactccact

SEQ ID NO: 5314090 - DNA, 15 bp, Homo sapiens
tctcttgagcatcaa

SEQ ID NO: 5314091 - DNA, 13 bp, Homo sapiens
tctcttgagcctg

SEQ ID NO: 5314092 - DNA, 15 bp, Homo sapiens
tctcttgagcctggg

SEQ ID NO: 5314093 - DNA, 17 bp, Homo sapiens
tctcttgagctggcctc

SEQ ID NO: 5314094 - DNA, 22 bp, Homo sapiens
tctcttgagggagcttagccaa

SEQ ID NO: 5314095 - DNA, 16 bp, Homo sapiens
tctcttgattgatttt

SEQ ID NO: 5314096 - DNA, 12 bp, Homo sapiens
tctcttgatttt

SEQ ID NO: 5314097 - DNA, 17 bp, Homo sapiens
tctcttgcataagcctc

SEQ ID NO: 5314098 - DNA, 21 bp, Homo sapiens
tctcttgcattgtgacaagaa

SEQ ID NO: 5314099 - DNA, 19 bp, Homo sapiens
tctcttgccccaaatcaca

SEQ ID NO: 5314100 - DNA, 15 bp, Homo sapiens
tctcttgccccttgt

SEQ ID NO: 5314101 - DNA, 15 bp, Homo sapiens
tctcttgcccttcct

SEQ ID NO: 5314102 - DNA, 18 bp, Homo sapiens
tctcttgcccttcctact

SEQ ID NO: 5314103 - DNA, 22 bp, Homo sapiens
tctcttgccgaggagccaggca

SEQ ID NO: 5314104 - DNA, 13 bp, Homo sapiens
tctcttgcctcaa

SEQ ID NO: 5314105 - DNA, 12 bp, Homo sapiens
tctcttgcctgc

SEQ ID NO: 5314106 - DNA, 12 bp, Homo sapiens
tctcttgcttgt

SEQ ID NO: 5314107 - DNA, 18 bp, Homo sapiens
tctcttggaaaataagac

SEQ ID NO: 5314108 - DNA, 23 bp, Homo sapiens
tctcttggaaatgttaagaaaga

SEQ ID NO: 5314109 - DNA, 17 bp, Homo sapiens
tctcttggaattagatg

SEQ ID NO: 5314110 - DNA, 18 bp, Homo sapiens
tctcttggaccctgggag

SEQ ID NO: 5314111 - DNA, 19 bp, Homo sapiens
tctcttggaccctgggagt

SEQ ID NO: 5314112 - DNA, 22 bp, Homo sapiens
tctcttggagcttttttgcata

SEQ ID NO: 5314113 - DNA, 15 bp, Homo sapiens
tctcttggctattga

SEQ ID NO: 5314114 - DNA, 14 bp, Homo sapiens
tctcttgggaagca

SEQ ID NO: 5314115 - DNA, 17 bp, Homo sapiens
tctcttgggaagcagtt

SEQ ID NO: 5314116 - DNA, 18 bp, Homo sapiens
tctcttgggaagcagttt

SEQ ID NO: 5314117 - DNA, 21 bp, Homo sapiens
tctcttgggaagcagtttcag

SEQ ID NO: 5314118 - DNA, 13 bp, Homo sapiens
tctcttgggagtc

SEQ ID NO: 5314119 - DNA, 18 bp, Homo sapiens
tctcttgggagtcttggg

SEQ ID NO: 5314120 - DNA, 19 bp, Homo sapiens
tctcttgggagtcttgggt

SEQ ID NO: 5314121 - DNA, 20 bp, Homo sapiens
tctcttgggccaagccagct

SEQ ID NO: 5314122 - DNA, 21 bp, Homo sapiens
tctcttggggaaggatctccc

SEQ ID NO: 5314123 - DNA, 23 bp, Homo sapiens
tctcttggggaaggatctccccg

SEQ ID NO: 5314124 - DNA, 21 bp, Homo sapiens
tctcttgggtgggacagggct

SEQ ID NO: 5314125 - DNA, 22 bp, Homo sapiens
tctcttgggtgggacagggctt

SEQ ID NO: 5314126 - DNA, 20 bp, Homo sapiens
tctcttggtatgcatctttt

SEQ ID NO: 5314127 - DNA, 13 bp, Homo sapiens
tctcttggtctct

SEQ ID NO: 5314128 - DNA, 17 bp, Homo sapiens
tctcttggtctctttct

SEQ ID NO: 5314129 - DNA, 22 bp, Homo sapiens
tctcttggtgaaataataaaat

SEQ ID NO: 5314130 - DNA, 13 bp, Homo sapiens
tctcttggtgtta

SEQ ID NO: 5314131 - DNA, 18 bp, Homo sapiens
tctcttggtttccttcct

SEQ ID NO: 5314132 - DNA, 15 bp, Homo sapiens
tctcttgtaaaaaga

SEQ ID NO: 5314133 - DNA, 17 bp, Homo sapiens
tctcttgtaccagccca

SEQ ID NO: 5314134 - DNA, 18 bp, Homo sapiens
tctcttgtaccagcccag

SEQ ID NO: 5314135 - DNA, 18 bp, Homo sapiens
tctcttgtatagctgaaa

SEQ ID NO: 5314136 - DNA, 20 bp, Homo sapiens
tctcttgtcctcttctgctc

SEQ ID NO: 5314137 - DNA, 22 bp, Homo sapiens
tctcttgtgacgtgcactgtga

SEQ ID NO: 5314138 - DNA, 23 bp, Homo sapiens
tctcttgtgatttggttgcactt

SEQ ID NO: 5314139 - DNA, 14 bp, Homo sapiens
tctcttgttaaatg

SEQ ID NO: 5314140 - DNA, 12 bp, Homo sapiens
tctcttgtttaa

SEQ ID NO: 5314141 - DNA, 14 bp, Homo sapiens
tctcttgtttgtct

SEQ ID NO: 5314142 - DNA, 16 bp, Homo sapiens
tctcttgtttgtctta

SEQ ID NO: 5314143 - DNA, 22 bp, Homo sapiens
tctctttaaaaaagactgaaca

SEQ ID NO: 5314144 - DNA, 14 bp, Homo sapiens
tctctttaaaagct

SEQ ID NO: 5314145 - DNA, 21 bp, Homo sapiens
tctctttaaaaggaaagaaaa

SEQ ID NO: 5314146 - DNA, 14 bp, Homo sapiens
tctctttaaaatgc

SEQ ID NO: 5314147 - DNA, 17 bp, Homo sapiens
tctctttaactcaggac

SEQ ID NO: 5314148 - DNA, 20 bp, Homo sapiens
tctctttaatgtcacaggca

SEQ ID NO: 5314149 - DNA, 23 bp, Homo sapiens
tctctttacagctttgtttctgc

SEQ ID NO: 5314150 - DNA, 15 bp, Homo sapiens
tctctttacattttg

SEQ ID NO: 5314151 - DNA, 17 bp, Homo sapiens
tctctttagtataattg

SEQ ID NO: 5314152 - DNA, 23 bp, Homo sapiens
tctctttagtataattgacctac

SEQ ID NO: 5314153 - DNA, 14 bp, Homo sapiens
tctctttcaatgtg

SEQ ID NO: 5314154 - DNA, 13 bp, Homo sapiens
tctctttcacaca

SEQ ID NO: 5314155 - DNA, 15 bp, Homo sapiens
tctctttcacacaat

SEQ ID NO: 5314156 - DNA, 21 bp, Homo sapiens
tctctttcagtattaaactct

SEQ ID NO: 5314157 - DNA, 15 bp, Homo sapiens
tctctttcatgagtt

SEQ ID NO: 5314158 - DNA, 16 bp, Homo sapiens
tctctttccactttgt

SEQ ID NO: 5314159 - DNA, 13 bp, Homo sapiens
tctctttccatct

SEQ ID NO: 5314160 - DNA, 18 bp, Homo sapiens
tctctttcccccacccta

SEQ ID NO: 5314161 - DNA, 12 bp, Homo sapiens
tctctttcctac

SEQ ID NO: 5314162 - DNA, 11 bp, Homo sapiens
tctctttcctt

SEQ ID NO: 5314163 - DNA, 18 bp, Homo sapiens
tctctttccttcttgcct

SEQ ID NO: 5314164 - DNA, 19 bp, Homo sapiens
tctctttccttcttgcctt

SEQ ID NO: 5314165 - DNA, 13 bp, Homo sapiens
tctctttccttga

SEQ ID NO: 5314166 - DNA, 10 bp, Homo sapiens
tctctttctc

SEQ ID NO: 5314167 - DNA, 15 bp, Homo sapiens
tctctttctctctct

SEQ ID NO: 5314168 - DNA, 15 bp, Homo sapiens
tctctttctctcttc

SEQ ID NO: 5314169 - DNA, 19 bp, Homo sapiens
tctctttctctcttccctc

SEQ ID NO: 5314170 - DNA, 11 bp, Homo sapiens
tctctttctgt

SEQ ID NO: 5314171 - DNA, 14 bp, Homo sapiens
tctctttctgtaca

SEQ ID NO: 5314172 - DNA, 19 bp, Homo sapiens
tctctttctgtttcctggc

SEQ ID NO: 5314173 - DNA, 20 bp, Homo sapiens
tctctttcttattttgtaat

SEQ ID NO: 5314174 - DNA, 21 bp, Homo sapiens
tctctttcttattttgtaata

SEQ ID NO: 5314175 - DNA, 22 bp, Homo sapiens
tctctttcttattttgtaataa

SEQ ID NO: 5314176 - DNA, 13 bp, Homo sapiens
tctctttcttcct

SEQ ID NO: 5314177 - DNA, 18 bp, Homo sapiens
tctctttcttcctttcta

SEQ ID NO: 5314178 - DNA, 12 bp, Homo sapiens
tctctttgactt

SEQ ID NO: 5314179 - DNA, 17 bp, Homo sapiens
tctctttgataacaaaa

SEQ ID NO: 5314180 - DNA, 19 bp, Homo sapiens
tctctttgataacaaaaaa

SEQ ID NO: 5314181 - DNA, 19 bp, Homo sapiens
tctctttgccatttcttct

SEQ ID NO: 5314182 - DNA, 18 bp, Homo sapiens
tctctttgcctgaagaaa

SEQ ID NO: 5314183 - DNA, 19 bp, Homo sapiens
tctctttggaaaatagttt

SEQ ID NO: 5314184 - DNA, 14 bp, Homo sapiens
tctctttggaatga

SEQ ID NO: 5314185 - DNA, 15 bp, Homo sapiens
tctctttggactctc

SEQ ID NO: 5314186 - DNA, 16 bp, Homo sapiens
tctctttgggaatgtt

SEQ ID NO: 5314187 - DNA, 13 bp, Homo sapiens
tctctttgtcctg

SEQ ID NO: 5314188 - DNA, 15 bp, Homo sapiens
tctctttgtgcagtg

SEQ ID NO: 5314189 - DNA, 22 bp, Homo sapiens
tctctttgtgggtttttcatct

SEQ ID NO: 5314190 - DNA, 13 bp, Homo sapiens
tctctttgttctc

SEQ ID NO: 5314191 - DNA, 19 bp, Homo sapiens
tctctttgttctcagctcc

SEQ ID NO: 5314192 - DNA, 21 bp, Homo sapiens
tctctttgttctcagctcccc

SEQ ID NO: 5314193 - DNA, 23 bp, Homo sapiens
tctctttgttctcagctccccct

SEQ ID NO: 5314194 - DNA, 21 bp, Homo sapiens
tctctttgttcttcaatgtga

SEQ ID NO: 5314195 - DNA, 23 bp, Homo sapiens
tctctttgttcttcaatgtgaaa

SEQ ID NO: 5314196 - DNA, 18 bp, Homo sapiens
tctcttttaaaatatcct

SEQ ID NO: 5314197 - DNA, 19 bp, Homo sapiens
tctcttttcaaacacacac

SEQ ID NO: 5314198 - DNA, 20 bp, Homo sapiens
tctcttttcaaacacacaca

SEQ ID NO: 5314199 - DNA, 12 bp, Homo sapiens
tctcttttcatt

SEQ ID NO: 5314200 - DNA, 14 bp, Homo sapiens
tctcttttcccact

SEQ ID NO: 5314201 - DNA, 15 bp, Homo sapiens
tctcttttccccgcc

SEQ ID NO: 5314202 - DNA, 16 bp, Homo sapiens
tctcttttccctcctt

SEQ ID NO: 5314203 - DNA, 13 bp, Homo sapiens
tctcttttcctcc

SEQ ID NO: 5314204 - DNA, 21 bp, Homo sapiens
tctcttttcctgttgtattga

SEQ ID NO: 5314205 - DNA, 13 bp, Homo sapiens
tctcttttctctt

SEQ ID NO: 5314206 - DNA, 13 bp, Homo sapiens
tctcttttcttta

SEQ ID NO: 5314207 - DNA, 20 bp, Homo sapiens
tctcttttctttagagcatt

SEQ ID NO: 5314208 - DNA, 19 bp, Homo sapiens
tctcttttctttctgtctt

SEQ ID NO: 5314209 - DNA, 20 bp, Homo sapiens
tctcttttgaaacaatactc

SEQ ID NO: 5314210 - DNA, 14 bp, Homo sapiens
tctcttttgaaagt

SEQ ID NO: 5314211 - DNA, 18 bp, Homo sapiens
tctcttttgaaagtagag

SEQ ID NO: 5314212 - DNA, 21 bp, Homo sapiens
tctcttttgaatgttaagaat

SEQ ID NO: 5314213 - DNA, 20 bp, Homo sapiens
tctcttttgaggtccctgta

SEQ ID NO: 5314214 - DNA, 11 bp, Homo sapiens
tctctttttat

SEQ ID NO: 5314215 - DNA, 14 bp, Homo sapiens
tctctttttccaga

SEQ ID NO: 5314216 - DNA, 15 bp, Homo sapiens
tctctttttcttcct

SEQ ID NO: 5314217 - DNA, 23 bp, Homo sapiens
tctctttttcttgtaaacctgga

SEQ ID NO: 5314218 - DNA, 13 bp, Homo sapiens
tctctttttggag

SEQ ID NO: 5314219 - DNA, 14 bp, Homo sapiens
tctcttttttaagt

SEQ ID NO: 5314220 - DNA, 16 bp, Homo sapiens
tctcttttttacaaag

SEQ ID NO: 5314221 - DNA, 22 bp, Homo sapiens
tctcttttttcaactggctggg

SEQ ID NO: 5314222 - DNA, 14 bp, Homo sapiens
tctcttttttcaga

SEQ ID NO: 5314223 - DNA, 24 bp, Homo sapiens
tctctttttttaaaaagttgatag

SEQ ID NO: 5314224 - DNA, 16 bp, Homo sapiens
tctgaaaaacattcca

SEQ ID NO: 5314225 - DNA, 14 bp, Homo sapiens
tctgaaaaactaaa

SEQ ID NO: 5314226 - DNA, 20 bp, Homo sapiens
tctgaaaaagacataaaaca

SEQ ID NO: 5314227 - DNA, 13 bp, Homo sapiens
tctgaaaaatgaa

SEQ ID NO: 5314228 - DNA, 20 bp, Homo sapiens
tctgaaaaatgcctgctgct

SEQ ID NO: 5314229 - DNA, 23 bp, Homo sapiens
tctgaaaaattcctttgtgtttc

SEQ ID NO: 5314230 - DNA, 19 bp, Homo sapiens
tctgaaaacccaaggccag

SEQ ID NO: 5314231 - DNA, 13 bp, Homo sapiens
tctgaaaactgtt

SEQ ID NO: 5314232 - DNA, 14 bp, Homo sapiens
tctgaaaactgttt

SEQ ID NO: 5314233 - DNA, 17 bp, Homo sapiens
tctgaaaagaaatgcta

SEQ ID NO: 5314234 - DNA, 22 bp, Homo sapiens
tctgaaaagaggagccagagaa

SEQ ID NO: 5314235 - DNA, 15 bp, Homo sapiens
tctgaaaagtgtgta

SEQ ID NO: 5314236 - DNA, 23 bp, Homo sapiens
tctgaaaagtgtgtatatatttt

SEQ ID NO: 5314237 - DNA, 16 bp, Homo sapiens
tctgaaaatacatttc

SEQ ID NO: 5314238 - DNA, 13 bp, Homo sapiens
tctgaaaatattt

SEQ ID NO: 5314239 - DNA, 21 bp, Homo sapiens
tctgaaaatatttttttctag

SEQ ID NO: 5314240 - DNA, 22 bp, Homo sapiens
tctgaaaatatttttttctagc

SEQ ID NO: 5314241 - DNA, 13 bp, Homo sapiens
tctgaaaatgtat

SEQ ID NO: 5314242 - DNA, 23 bp, Homo sapiens
tctgaaaatgtatgtgtaagtat

SEQ ID NO: 5314243 - DNA, 13 bp, Homo sapiens
tctgaaaatgtga

SEQ ID NO: 5314244 - DNA, 18 bp, Homo sapiens
tctgaaaattaacactgc

SEQ ID NO: 5314245 - DNA, 14 bp, Homo sapiens
tctgaaaattctgg

SEQ ID NO: 5314246 - DNA, 15 bp, Homo sapiens
tctgaaaatttatat

SEQ ID NO: 5314247 - DNA, 17 bp, Homo sapiens
tctgaaaatttatataa

SEQ ID NO: 5314248 - DNA, 9 bp, Homo sapiens
tctgaaaca

SEQ ID NO: 5314249 - DNA, 22 bp, Homo sapiens
tctgaaacacagtcatgtgtca

SEQ ID NO: 5314250 - DNA, 14 bp, Homo sapiens
tctgaaacagagaa

SEQ ID NO: 5314251 - DNA, 14 bp, Homo sapiens
tctgaaacagctgc

SEQ ID NO: 5314252 - DNA, 15 bp, Homo sapiens
tctgaaacagctgcc

SEQ ID NO: 5314253 - DNA, 18 bp, Homo sapiens
tctgaaacagctgcctta

SEQ ID NO: 5314254 - DNA, 15 bp, Homo sapiens
tctgaaaccagtgtt

SEQ ID NO: 5314255 - DNA, 16 bp, Homo sapiens
tctgaaacccacagat

SEQ ID NO: 5314256 - DNA, 22 bp, Homo sapiens
tctgaattctgctctaaataaa

SEQ ID NO: 5314257 - DNA, 15 bp, Homo sapiens
tctgaattgagaaaa

SEQ ID NO: 5314258 - DNA, 18 bp, Homo sapiens
tctgaattgctatgtgaa

SEQ ID NO: 5314259 - DNA, 20 bp, Homo sapiens
tctgaattggctaaaagaca

SEQ ID NO: 5314260 - DNA, 22 bp, Homo sapiens
tctgaattggctaaaagacatg

SEQ ID NO: 5314261 - DNA, 13 bp, Homo sapiens
tctgaatttgcaa

SEQ ID NO: 5314262 - DNA, 15 bp, Homo sapiens
tctgaatttgcaaag

SEQ ID NO: 5314263 - DNA, 17 bp, Homo sapiens
tctgaatttgcaaagta

SEQ ID NO: 5314264 - DNA, 21 bp, Homo sapiens
tctgaatttgcaaagtactgt

SEQ ID NO: 5314265 - DNA, 19 bp, Homo sapiens
tctgaatttgccctgggaa

SEQ ID NO: 5314266 - DNA, 20 bp, Homo sapiens
tctgaatttgccctgggaaa

SEQ ID NO: 5314267 - DNA, 16 bp, Homo sapiens
tctgaattttgcaatg

SEQ ID NO: 5314268 - DNA, 23 bp, Homo sapiens
tctgaattttgcaatgtatttag

SEQ ID NO: 5314269 - DNA, 22 bp, Homo sapiens
tctgaattttggggattttcaa

SEQ ID NO: 5314270 - DNA, 16 bp, Homo sapiens
tctgaatttttaaaca

SEQ ID NO: 5314271 - DNA, 18 bp, Homo sapiens
tctgacaaaggtggtaaa

SEQ ID NO: 5314272 - DNA, 13 bp, Homo sapiens
tctgacaaagtgt

SEQ ID NO: 5314273 - DNA, 19 bp, Homo sapiens
tctgacaaagtgtgtctca

SEQ ID NO: 5314274 - DNA, 19 bp, Homo sapiens
tctgacaactgtgaagcca

SEQ ID NO: 5314275 - DNA, 19 bp, Homo sapiens
tctgacaagataaaggaag

SEQ ID NO: 5314276 - DNA, 15 bp, Homo sapiens
tctgacaagctggcc

SEQ ID NO: 5314277 - DNA, 22 bp, Homo sapiens
tctgacaagctggccaaagtca

SEQ ID NO: 5314278 - DNA, 13 bp, Homo sapiens
tctgacaagggct

SEQ ID NO: 5314279 - DNA, 16 bp, Homo sapiens
tctgacaagggctgac

SEQ ID NO: 5314280 - DNA, 23 bp, Homo sapiens
tctgacaagggctgacctgcctc

SEQ ID NO: 5314281 - DNA, 22 bp, Homo sapiens
tctgacacaagtgtattatttc

SEQ ID NO: 5314282 - DNA, 19 bp, Homo sapiens
tctgacacacagctctgtc

SEQ ID NO: 5314283 - DNA, 17 bp, Homo sapiens
tctgacactgtgtaaga

SEQ ID NO: 5314284 - DNA, 16 bp, Homo sapiens
tctgacagaaagcaga

SEQ ID NO: 5314285 - DNA, 22 bp, Homo sapiens
tctgacagcatttcagctgtga

SEQ ID NO: 5314286 - DNA, 13 bp, Homo sapiens
tctgacagccaga

SEQ ID NO: 5314287 - DNA, 12 bp, Homo sapiens
tctgacagcctc

SEQ ID NO: 5314288 - DNA, 14 bp, Homo sapiens
tctgacagctgtcc

SEQ ID NO: 5314289 - DNA, 13 bp, Homo sapiens
tctgacaggaaga

SEQ ID NO: 5314290 - DNA, 12 bp, Homo sapiens
tctgacaggcaa

SEQ ID NO: 5314291 - DNA, 21 bp, Homo sapiens
tctgacaggcaatgctggctg

SEQ ID NO: 5314292 - DNA, 22 bp, Homo sapiens
tctgacaggcaatgctggctgt

SEQ ID NO: 5314293 - DNA, 13 bp, Homo sapiens
tctgacaggtgaa

SEQ ID NO: 5314294 - DNA, 16 bp, Homo sapiens
tctgacagtagctctt

SEQ ID NO: 5314295 - DNA, 20 bp, Homo sapiens
tctgacagtagctcttagac

SEQ ID NO: 5314296 - DNA, 13 bp, Homo sapiens
tctgacagtctca

SEQ ID NO: 5314297 - DNA, 21 bp, Homo sapiens
tctgacagtctcaaatttttc

SEQ ID NO: 5314298 - DNA, 13 bp, Homo sapiens
tctgacagtgttt

SEQ ID NO: 5314299 - DNA, 13 bp, Homo sapiens
tctgacagttgtg

SEQ ID NO: 5314300 - DNA, 20 bp, Homo sapiens
tctgacagtttttctgtttt

SEQ ID NO: 5314301 - DNA, 21 bp, Homo sapiens
tctgacataaacccatctgta

SEQ ID NO: 5314302 - DNA, 15 bp, Homo sapiens
tctgacataagtatt

SEQ ID NO: 5314303 - DNA, 19 bp, Homo sapiens
tctgacataatccagtaaa

SEQ ID NO: 5314304 - DNA, 21 bp, Homo sapiens
tctgacatattatgcctgaat

SEQ ID NO: 5314305 - DNA, 14 bp, Homo sapiens
tctgacatcaagtg

SEQ ID NO: 5314306 - DNA, 17 bp, Homo sapiens
tctgacatcaagtgtaa

SEQ ID NO: 5314307 - DNA, 14 bp, Homo sapiens
tctgacatcccttc

SEQ ID NO: 5314308 - DNA, 19 bp, Homo sapiens
tctgacatcccttcctgga

SEQ ID NO: 5314309 - DNA, 20 bp, Homo sapiens
tctgacatcccttcctggaa

SEQ ID NO: 5314310 - DNA, 14 bp, Homo sapiens
tctgacatctctgc

SEQ ID NO: 5314311 - DNA, 15 bp, Homo sapiens
tctgacatctctgca

SEQ ID NO: 5314312 - DNA, 19 bp, Homo sapiens
tctgacatgattccttcct

SEQ ID NO: 5314313 - DNA, 22 bp, Homo sapiens
tctgacatgattccttcctgtt

SEQ ID NO: 5314314 - DNA, 21 bp, Homo sapiens
tctgacatgcattgttggcta

SEQ ID NO: 5314315 - DNA, 12 bp, Homo sapiens
tctgacatgtaa

SEQ ID NO: 5314316 - DNA, 16 bp, Homo sapiens
tctgacattaacagtt

SEQ ID NO: 5314317 - DNA, 18 bp, Homo sapiens
tctgacattaacagtttt

SEQ ID NO: 5314318 - DNA, 22 bp, Homo sapiens
tctgacattctcaggaagcccc

SEQ ID NO: 5314319 - DNA, 15 bp, Homo sapiens
tctgacatttatatt

SEQ ID NO: 5314320 - DNA, 11 bp, Homo sapiens
tctgaccaaaa

SEQ ID NO: 5314321 - DNA, 21 bp, Homo sapiens
tctgaccaaaaccagagggca

SEQ ID NO: 5314322 - DNA, 13 bp, Homo sapiens
tctgaccacactt

SEQ ID NO: 5314323 - DNA, 15 bp, Homo sapiens
tctgaccacagacac

SEQ ID NO: 5314324 - DNA, 19 bp, Homo sapiens
tctgaccacagacactcct

SEQ ID NO: 5314325 - DNA, 20 bp, Homo sapiens
tctgaccacttgaggcctga

SEQ ID NO: 5314326 - DNA, 13 bp, Homo sapiens
tctgaccagagaa

SEQ ID NO: 5314327 - DNA, 15 bp, Homo sapiens
tctgaccagagaatg

SEQ ID NO: 5314328 - DNA, 16 bp, Homo sapiens
tctgaccagcagcgcc

SEQ ID NO: 5314329 - DNA, 14 bp, Homo sapiens
tctgaccatctgtg

SEQ ID NO: 5314330 - DNA, 22 bp, Homo sapiens
tctgaccatctgtgactataaa

SEQ ID NO: 5314331 - DNA, 14 bp, Homo sapiens
tctgaccatttcag

SEQ ID NO: 5314332 - DNA, 16 bp, Homo sapiens
tctgacccacagcctc

SEQ ID NO: 5314333 - DNA, 13 bp, Homo sapiens
tctgacccactgc

SEQ ID NO: 5314334 - DNA, 12 bp, Homo sapiens
tctgacccagag

SEQ ID NO: 5314335 - DNA, 23 bp, Homo sapiens
tctgacccagtgcccccactgac

SEQ ID NO: 5314336 - DNA, 22 bp, Homo sapiens
tctgacccatagcactcttgtt

SEQ ID NO: 5314337 - DNA, 17 bp, Homo sapiens
tctgacccatgctgccc

SEQ ID NO: 5314338 - DNA, 19 bp, Homo sapiens
tctgacccatgctgccctg

SEQ ID NO: 5314339 - DNA, 21 bp, Homo sapiens
tctgaccccaagggggctgct

SEQ ID NO: 5314340 - DNA, 15 bp, Homo sapiens
tctgaccccagccca

SEQ ID NO: 5314341 - DNA, 18 bp, Homo sapiens
tctgaccccagcccagac

SEQ ID NO: 5314342 - DNA, 20 bp, Homo sapiens
tctgaccccagcccagacag

SEQ ID NO: 5314343 - DNA, 21 bp, Homo sapiens
tctgaccccagcccagacagc

SEQ ID NO: 5314344 - DNA, 18 bp, Homo sapiens
tctgaccccggggggctg

SEQ ID NO: 5314345 - DNA, 15 bp, Homo sapiens
tctgacccctcctca

SEQ ID NO: 5314346 - DNA, 21 bp, Homo sapiens
tctgaccctagctctttcctt

SEQ ID NO: 5314347 - DNA, 14 bp, Homo sapiens
tctgaccctcccag

SEQ ID NO: 5314348 - DNA, 16 bp, Homo sapiens
tctgaccctctggaaa

SEQ ID NO: 5314349 - DNA, 23 bp, Homo sapiens
tctgacccttgggcctgggcctc

SEQ ID NO: 5314350 - DNA, 15 bp, Homo sapiens
tctgaccgattcctt

SEQ ID NO: 5314351 - DNA, 20 bp, Homo sapiens
tctgaccgattcctttatat

SEQ ID NO: 5314352 - DNA, 23 bp, Homo sapiens
tctgaccgggcttcctccctcca

SEQ ID NO: 5314353 - DNA, 18 bp, Homo sapiens
tctgaccgggtctgcttc

SEQ ID NO: 5314354 - DNA, 21 bp, Homo sapiens
tctgaccgttttcacttgtct

SEQ ID NO: 5314355 - DNA, 21 bp, Homo sapiens
tctgacctaatatttggagct

SEQ ID NO: 5314356 - DNA, 12 bp, Homo sapiens
tctgacctcctc

SEQ ID NO: 5314357 - DNA, 20 bp, Homo sapiens
tctgacctcctctgggccct

SEQ ID NO: 5314358 - DNA, 21 bp, Homo sapiens
tctgacctgcaaaaatgctgg

SEQ ID NO: 5314359 - DNA, 12 bp, Homo sapiens
tctgacctgcag

SEQ ID NO: 5314360 - DNA, 22 bp, Homo sapiens
tctgacctgcccccgctctgcc

SEQ ID NO: 5314361 - DNA, 17 bp, Homo sapiens
tctgacgcaccactgcc

SEQ ID NO: 5314362 - DNA, 16 bp, Homo sapiens
tctgacgcagcctgag

SEQ ID NO: 5314363 - DNA, 16 bp, Homo sapiens
tctgacgctgacaata

SEQ ID NO: 5314364 - DNA, 13 bp, Homo sapiens
tctgacgcttgtg

SEQ ID NO: 5314365 - DNA, 20 bp, Homo sapiens
tctgacgcttgtgacagtgc

SEQ ID NO: 5314366 - DNA, 13 bp, Homo sapiens
tctgacggccctg

SEQ ID NO: 5314367 - DNA, 14 bp, Homo sapiens
tctgacggccctgc

SEQ ID NO: 5314368 - DNA, 17 bp, Homo sapiens
tctgacgtagaaagatc

SEQ ID NO: 5314369 - DNA, 23 bp, Homo sapiens
tctgacgtcagcgcaccaaaact

SEQ ID NO: 5314370 - DNA, 23 bp, Homo sapiens
tctgactactgggcaaagagtgt

SEQ ID NO: 5314371 - DNA, 14 bp, Homo sapiens
tctgactactttgc

SEQ ID NO: 5314372 - DNA, 23 bp, Homo sapiens
tctgactagattattatttgggg

SEQ ID NO: 5314373 - DNA, 14 bp, Homo sapiens
tctgactcacaaga

SEQ ID NO: 5314374 - DNA, 16 bp, Homo sapiens
tctgactcacaagaag

SEQ ID NO: 5314375 - DNA, 20 bp, Homo sapiens
tctgactcaggcgcctggca

SEQ ID NO: 5314376 - DNA, 14 bp, Homo sapiens
tctgactccactca

SEQ ID NO: 5314377 - DNA, 14 bp, Homo sapiens
tctgactccagtgg

SEQ ID NO: 5314378 - DNA, 23 bp, Homo sapiens
tctgactccagtggggcaagatt

SEQ ID NO: 5314379 - DNA, 19 bp, Homo sapiens
tctgactcccaaagagctg

SEQ ID NO: 5314380 - DNA, 20 bp, Homo sapiens
tctgactccctccccaccca

SEQ ID NO: 5314381 - DNA, 23 bp, Homo sapiens
tctgactccctccccacccaaga

SEQ ID NO: 5314382 - DNA, 17 bp, Homo sapiens
tctgactctaaaatatg

SEQ ID NO: 5314383 - DNA, 14 bp, Homo sapiens
tctgactctgagct

SEQ ID NO: 5314384 - DNA, 14 bp, Homo sapiens
tctgactctgggtt

SEQ ID NO: 5314385 - DNA, 15 bp, Homo sapiens
tctgactctgggttc

SEQ ID NO: 5314386 - DNA, 13 bp, Homo sapiens
tctgactcttgcc

SEQ ID NO: 5314387 - DNA, 18 bp, Homo sapiens
tctgactgcaacttctgt

SEQ ID NO: 5314388 - DNA, 14 bp, Homo sapiens
tctgactgcacgtg

SEQ ID NO: 5314389 - DNA, 16 bp, Homo sapiens
tctgactgccaaataa

SEQ ID NO: 5314390 - DNA, 20 bp, Homo sapiens
tctgactgccaaataaatca

SEQ ID NO: 5314391 - DNA, 14 bp, Homo sapiens
tctgactgccaagc

SEQ ID NO: 5314392 - DNA, 23 bp, Homo sapiens
tctgactgccaagccagattctc

SEQ ID NO: 5314393 - DNA, 17 bp, Homo sapiens
tctgactgccccctcct

SEQ ID NO: 5314394 - DNA, 20 bp, Homo sapiens
tctgactgtcacctcgtggg

SEQ ID NO: 5314395 - DNA, 15 bp, Homo sapiens
tctgactgtccctgc

SEQ ID NO: 5314396 - DNA, 10 bp, Homo sapiens
tctgactgtt

SEQ ID NO: 5314397 - DNA, 21 bp, Homo sapiens
tctgactgtttatttaaggat

SEQ ID NO: 5314398 - DNA, 19 bp, Homo sapiens
tctgacttaagcaaaagaa

SEQ ID NO: 5314399 - DNA, 20 bp, Homo sapiens
tctgacttaagctgcctcaa

SEQ ID NO: 5314400 - DNA, 19 bp, Homo sapiens
tctgacttacttaaccagg

SEQ ID NO: 5314401 - DNA, 23 bp, Homo sapiens
tctgacttccccgcattccaggc

SEQ ID NO: 5314402 - DNA, 15 bp, Homo sapiens
tctgacttctagctg

SEQ ID NO: 5314403 - DNA, 17 bp, Homo sapiens
tctgacttctagctgtc

SEQ ID NO: 5314404 - DNA, 17 bp, Homo sapiens
tctgacttctcccatct

SEQ ID NO: 5314405 - DNA, 19 bp, Homo sapiens
tctgacttctgcctggaga

SEQ ID NO: 5314406 - DNA, 20 bp, Homo sapiens
tctgacttctgcctggagac

SEQ ID NO: 5314407 - DNA, 18 bp, Homo sapiens
tctgactttaattgtgtg

SEQ ID NO: 5314408 - DNA, 17 bp, Homo sapiens
tctgactttctcttcta

SEQ ID NO: 5314409 - DNA, 13 bp, Homo sapiens
tctgactttgaat

SEQ ID NO: 5314410 - DNA, 14 bp, Homo sapiens
tctgactttgaatt

SEQ ID NO: 5314411 - DNA, 17 bp, Homo sapiens
tctgactttgaatttat

SEQ ID NO: 5314412 - DNA, 21 bp, Homo sapiens
tctgactttgaatttatataa

SEQ ID NO: 5314413 - DNA, 17 bp, Homo sapiens
tctgactttttctgtgc

SEQ ID NO: 5314414 - DNA, 17 bp, Homo sapiens
tctgactttttgtttct

SEQ ID NO: 5314415 - DNA, 20 bp, Homo sapiens
tctgagaaacctgttgaaga

SEQ ID NO: 5314416 - DNA, 12 bp, Homo sapiens
tctgagaaatag

SEQ ID NO: 5314417 - DNA, 13 bp, Homo sapiens
tctgagaaattga

SEQ ID NO: 5314418 - DNA, 21 bp, Homo sapiens
tctgagaacagacgttaccaa

SEQ ID NO: 5314419 - DNA, 22 bp, Homo sapiens
tctgagaaccaaaagatgcctt

SEQ ID NO: 5314420 - DNA, 16 bp, Homo sapiens
tctgagaagaggagcc

SEQ ID NO: 5314421 - DNA, 23 bp, Homo sapiens
tctgagaagaggagccctcatct

SEQ ID NO: 5314422 - DNA, 12 bp, Homo sapiens
tctgagaagatt

SEQ ID NO: 5314423 - DNA, 17 bp, Homo sapiens
tctgagaagcgctgccc

SEQ ID NO: 5314424 - DNA, 18 bp, Homo sapiens
tctgagaagcgctgccct

SEQ ID NO: 5314425 - DNA, 17 bp, Homo sapiens
tctgagaaggtccttaa

SEQ ID NO: 5314426 - DNA, 18 bp, Homo sapiens
tctgagaatcacggtggt

SEQ ID NO: 5314427 - DNA, 15 bp, Homo sapiens
tctgagaatctttat

SEQ ID NO: 5314428 - DNA, 19 bp, Homo sapiens
tctgagaatctttattgag

SEQ ID NO: 5314429 - DNA, 14 bp, Homo sapiens
tctgagaatgaaca

SEQ ID NO: 5314430 - DNA, 20 bp, Homo sapiens
tctgagaatgcccaactctt

SEQ ID NO: 5314431 - DNA, 20 bp, Homo sapiens
tctgagaattccaaggagtt

SEQ ID NO: 5314432 - DNA, 20 bp, Homo sapiens
tctgagaattgcaaaactag

SEQ ID NO: 5314433 - DNA, 21 bp, Homo sapiens
tctgcaatttgtttaaagaat

SEQ ID NO: 5314434 - DNA, 19 bp, Homo sapiens
tctgcacaagctgcaccct

SEQ ID NO: 5314435 - DNA, 14 bp, Homo sapiens
tctgcacacaaata

SEQ ID NO: 5314436 - DNA, 17 bp, Homo sapiens
tctgcacacaaatatta

SEQ ID NO: 5314437 - DNA, 13 bp, Homo sapiens
tctgcacacataa

SEQ ID NO: 5314438 - DNA, 19 bp, Homo sapiens
tctgcacacataacacaca

SEQ ID NO: 5314439 - DNA, 20 bp, Homo sapiens
tctgcacacataacacacat

SEQ ID NO: 5314440 - DNA, 23 bp, Homo sapiens
tctgcacaccttgaatctgcctg

SEQ ID NO: 5314441 - DNA, 20 bp, Homo sapiens
tctgcacactctcttctcca

SEQ ID NO: 5314442 - DNA, 19 bp, Homo sapiens
tctgcacagacaagcagcc

SEQ ID NO: 5314443 - DNA, 22 bp, Homo sapiens
tctgcacagacaagcagccctt

SEQ ID NO: 5314444 - DNA, 14 bp, Homo sapiens
tctgcacagagggt

SEQ ID NO: 5314445 - DNA, 22 bp, Homo sapiens
tctgcacagagggtcccattgt

SEQ ID NO: 5314446 - DNA, 13 bp, Homo sapiens
tctgcacagatgg

SEQ ID NO: 5314447 - DNA, 15 bp, Homo sapiens
tctgcacagatggat

SEQ ID NO: 5314448 - DNA, 15 bp, Homo sapiens
tctgcacagctggcc

SEQ ID NO: 5314449 - DNA, 16 bp, Homo sapiens
tctgcacagcttttcc

SEQ ID NO: 5314450 - DNA, 17 bp, Homo sapiens
tctgcacaggtctctgt

SEQ ID NO: 5314451 - DNA, 14 bp, Homo sapiens
tctgcacagtcaga

SEQ ID NO: 5314452 - DNA, 20 bp, Homo sapiens
tctgcacataaactctttta

SEQ ID NO: 5314453 - DNA, 17 bp, Homo sapiens
tctgcacatctacttgc

SEQ ID NO: 5314454 - DNA, 12 bp, Homo sapiens
tctgcacatgaa

SEQ ID NO: 5314455 - DNA, 15 bp, Homo sapiens
tctgcacatgtcttg

SEQ ID NO: 5314456 - DNA, 13 bp, Homo sapiens
tctgcacattaga

SEQ ID NO: 5314457 - DNA, 15 bp, Homo sapiens
tctgcacccagaaca

SEQ ID NO: 5314458 - DNA, 22 bp, Homo sapiens
tctgcacccagtgaacacattt

SEQ ID NO: 5314459 - DNA, 14 bp, Homo sapiens
tctgcaccccacag

SEQ ID NO: 5314460 - DNA, 15 bp, Homo sapiens
tctgcaccccacagg

SEQ ID NO: 5314461 - DNA, 21 bp, Homo sapiens
tctgcacccccagcaagaagg

SEQ ID NO: 5314462 - DNA, 15 bp, Homo sapiens
tctgcacccccctgg

SEQ ID NO: 5314463 - DNA, 17 bp, Homo sapiens
tctgcacccccctgggc

SEQ ID NO: 5314464 - DNA, 13 bp, Homo sapiens
tctgcacccctct

SEQ ID NO: 5314465 - DNA, 18 bp, Homo sapiens
tctgcaccccttctctcc

SEQ ID NO: 5314466 - DNA, 20 bp, Homo sapiens
tctgcaccccttctctcctc

SEQ ID NO: 5314467 - DNA, 21 bp, Homo sapiens
tctgcaccccttctctcctcc

SEQ ID NO: 5314468 - DNA, 12 bp, Homo sapiens
tctgcaccctcc

SEQ ID NO: 5314469 - DNA, 17 bp, Homo sapiens
tctgcaccctccaccct

SEQ ID NO: 5314470 - DNA, 23 bp, Homo sapiens
tctgcaccctggggcctggacct

SEQ ID NO: 5314471 - DNA, 20 bp, Homo sapiens
tctgcacccttcttttctca

SEQ ID NO: 5314472 - DNA, 18 bp, Homo sapiens
tctgcaccgtactgtgga

SEQ ID NO: 5314473 - DNA, 21 bp, Homo sapiens
tctgcacctatgtagctctgc

SEQ ID NO: 5314474 - DNA, 14 bp, Homo sapiens
tctgcacctgtctc

SEQ ID NO: 5314475 - DNA, 15 bp, Homo sapiens
tctgcacgctcaatg

SEQ ID NO: 5314476 - DNA, 16 bp, Homo sapiens
tctgcacgtgcacaca

SEQ ID NO: 5314477 - DNA, 22 bp, Homo sapiens
tctgcacgtgcacacacctgca

SEQ ID NO: 5314478 - DNA, 20 bp, Homo sapiens
tctgcactccatggccaccc

SEQ ID NO: 5314479 - DNA, 21 bp, Homo sapiens
tctgcactcccacctgacaca

SEQ ID NO: 5314480 - DNA, 14 bp, Homo sapiens
tctgcactcccctg

SEQ ID NO: 5314481 - DNA, 15 bp, Homo sapiens
tctgcactcccctgc

SEQ ID NO: 5314482 - DNA, 17 bp, Homo sapiens
tctgcactcccctgctg

SEQ ID NO: 5314483 - DNA, 19 bp, Homo sapiens
tctgcactcccctgctggg

SEQ ID NO: 5314484 - DNA, 17 bp, Homo sapiens
tctgcactcctggaacc

SEQ ID NO: 5314485 - DNA, 20 bp, Homo sapiens
tctgcactcctttatctgta

SEQ ID NO: 5314486 - DNA, 22 bp, Homo sapiens
tctgcactcctttatctgtaat

SEQ ID NO: 5314487 - DNA, 20 bp, Homo sapiens
tctgcactctaaactgcaaa

SEQ ID NO: 5314488 - DNA, 12 bp, Homo sapiens
tctgcactgaaa

SEQ ID NO: 5314489 - DNA, 22 bp, Homo sapiens
tctgcactgagcagagtcttgc

SEQ ID NO: 5314490 - DNA, 21 bp, Homo sapiens
tctgcactggggcgtttccta

SEQ ID NO: 5314491 - DNA, 17 bp, Homo sapiens
tctgcacttctgttcca

SEQ ID NO: 5314492 - DNA, 17 bp, Homo sapiens
tctgcagaaaaaaaaga

SEQ ID NO: 5314493 - DNA, 17 bp, Homo sapiens
tctgcagaacagtgaaa

SEQ ID NO: 5314494 - DNA, 20 bp, Homo sapiens
tctgcagaacatatcaaaat

SEQ ID NO: 5314495 - DNA, 15 bp, Homo sapiens
tctgcagaagaggag

SEQ ID NO: 5314496 - DNA, 23 bp, Homo sapiens
tctgcagaagccaagggaagaca

SEQ ID NO: 5314497 - DNA, 13 bp, Homo sapiens
tctgcagaaggaa

SEQ ID NO: 5314498 - DNA, 22 bp, Homo sapiens
tctgcagaataaaatctctatt

SEQ ID NO: 5314499 - DNA, 21 bp, Homo sapiens
tctgcagacaagtcttgctgt

SEQ ID NO: 5314500 - DNA, 23 bp, Homo sapiens
tctgcagacacgccttcccctca

SEQ ID NO: 5314501 - DNA, 19 bp, Homo sapiens
tctgcagacactgtgggta

SEQ ID NO: 5314502 - DNA, 22 bp, Homo sapiens
tctgcagacgtctgccttggca

SEQ ID NO: 5314503 - DNA, 23 bp, Homo sapiens
tctgcagactgctagtgttctgt

SEQ ID NO: 5314504 - DNA, 16 bp, Homo sapiens
tctgcagacttcccag

SEQ ID NO: 5314505 - DNA, 12 bp, Homo sapiens
tctgcagagact

SEQ ID NO: 5314506 - DNA, 19 bp, Homo sapiens
tctgcagagtcactcacac

SEQ ID NO: 5314507 - DNA, 17 bp, Homo sapiens
tctgcagagtggtgaag

SEQ ID NO: 5314508 - DNA, 19 bp, Homo sapiens
tctgcagatagaaagcatt

SEQ ID NO: 5314509 - DNA, 15 bp, Homo sapiens
tctgcagcaactccc

SEQ ID NO: 5314510 - DNA, 16 bp, Homo sapiens
tctgcagcaactccca

SEQ ID NO: 5314511 - DNA, 17 bp, Homo sapiens
tctgcagcaactcccac

SEQ ID NO: 5314512 - DNA, 21 bp, Homo sapiens
tctgcagcacctcacctgaga

SEQ ID NO: 5314513 - DNA, 20 bp, Homo sapiens
tctgcagcactttaaccctc

SEQ ID NO: 5314514 - DNA, 23 bp, Homo sapiens
tctgcagcactttaaccctctct

SEQ ID NO: 5314515 - DNA, 20 bp, Homo sapiens
tctgcagcatgacctgtgac

SEQ ID NO: 5314516 - DNA, 15 bp, Homo sapiens
tctgcagcattgaag

SEQ ID NO: 5314517 - DNA, 14 bp, Homo sapiens
tctgcagccagccc

SEQ ID NO: 5314518 - DNA, 15 bp, Homo sapiens
tctgcagccagccca

SEQ ID NO: 5314519 - DNA, 21 bp, Homo sapiens
tctgcagccattcttcaggtc

SEQ ID NO: 5314520 - DNA, 13 bp, Homo sapiens
tctgcagcccaca

SEQ ID NO: 5314521 - DNA, 18 bp, Homo sapiens
tctgcagcccacagagga

SEQ ID NO: 5314522 - DNA, 22 bp, Homo sapiens
tctgcagcccattcccaaggga

SEQ ID NO: 5314523 - DNA, 23 bp, Homo sapiens
tctgcagcccggcgccaccatcc

SEQ ID NO: 5314524 - DNA, 15 bp, Homo sapiens
tctgcagccctgaga

SEQ ID NO: 5314525 - DNA, 19 bp, Homo sapiens
tctgcagcccttgggcagt

SEQ ID NO: 5314526 - DNA, 21 bp, Homo sapiens
tctgcagcccttgggcagttc

SEQ ID NO: 5314527 - DNA, 15 bp, Homo sapiens
tctgcagcctcggcc

SEQ ID NO: 5314528 - DNA, 15 bp, Homo sapiens
tctgcagcctgagct

SEQ ID NO: 5314529 - DNA, 19 bp, Homo sapiens
tctgcagcctgagctccac

SEQ ID NO: 5314530 - DNA, 24 bp, Homo sapiens
tctgcagcctgagctccaccctcc

SEQ ID NO: 5314531 - DNA, 12 bp, Homo sapiens
tctgcagcggca

SEQ ID NO: 5314532 - DNA, 22 bp, Homo sapiens
tctgcagctcaagggctggcac

SEQ ID NO: 5314533 - DNA, 12 bp, Homo sapiens
tctgcagctgcc

SEQ ID NO: 5314534 - DNA, 14 bp, Homo sapiens
tctgcagctgccgg

SEQ ID NO: 5314535 - DNA, 14 bp, Homo sapiens
tctgcagctggtgt

SEQ ID NO: 5314536 - DNA, 17 bp, Homo sapiens
tctgcagctggtgtggg

SEQ ID NO: 5314537 - DNA, 14 bp, Homo sapiens
tctgcagctgtttc

SEQ ID NO: 5314538 - DNA, 13 bp, Homo sapiens
tctgcaggacaga

SEQ ID NO: 5314539 - DNA, 19 bp, Homo sapiens
tctgcaggatgattgtaca

SEQ ID NO: 5314540 - DNA, 16 bp, Homo sapiens
tctgcaggcagacacg

SEQ ID NO: 5314541 - DNA, 17 bp, Homo sapiens
tctgcaggcagccttgc

SEQ ID NO: 5314542 - DNA, 14 bp, Homo sapiens
tctgcaggccacca

SEQ ID NO: 5314543 - DNA, 12 bp, Homo sapiens
tctgcagggaat

SEQ ID NO: 5314544 - DNA, 21 bp, Homo sapiens
tctgcagggcagcctgtggga

SEQ ID NO: 5314545 - DNA, 19 bp, Homo sapiens
tctgcaggggcctggagga

SEQ ID NO: 5314546 - DNA, 21 bp, Homo sapiens
tctgcagggtgaagcaccagg

SEQ ID NO: 5314547 - DNA, 18 bp, Homo sapiens
tctgcagggtgacgcctg

SEQ ID NO: 5314548 - DNA, 11 bp, Homo sapiens
tctgcaggtcc

SEQ ID NO: 5314549 - DNA, 17 bp, Homo sapiens
tctgcaggtccctaata

SEQ ID NO: 5314550 - DNA, 15 bp, Homo sapiens
tctgcaggtgagcag

SEQ ID NO: 5314551 - DNA, 21 bp, Homo sapiens
tctgcaggtgggctgctgagg

SEQ ID NO: 5314552 - DNA, 18 bp, Homo sapiens
tctgcagtaaaacacatt

SEQ ID NO: 5314553 - DNA, 15 bp, Homo sapiens
tctgcagtaaatctt

SEQ ID NO: 5314554 - DNA, 16 bp, Homo sapiens
tctgcagtaaatcttt

SEQ ID NO: 5314555 - DNA, 18 bp, Homo sapiens
tctgcagtagtctctgtg

SEQ ID NO: 5314556 - DNA, 15 bp, Homo sapiens
tctgcagtattctgt

SEQ ID NO: 5314557 - DNA, 20 bp, Homo sapiens
tctgcagtcctccggggtgg

SEQ ID NO: 5314558 - DNA, 16 bp, Homo sapiens
tctgcagtcctggtgg

SEQ ID NO: 5314559 - DNA, 16 bp, Homo sapiens
tctgcagtcgcttgcc

SEQ ID NO: 5314560 - DNA, 18 bp, Homo sapiens
tctgcagtcgcttgccaa

SEQ ID NO: 5314561 - DNA, 21 bp, Homo sapiens
tctgcagtcgcttgccaaagc

SEQ ID NO: 5314562 - DNA, 23 bp, Homo sapiens
tctgcagtcgcttgccaaagcag

SEQ ID NO: 5314563 - DNA, 18 bp, Homo sapiens
tctgcagtctcatttctc

SEQ ID NO: 5314564 - DNA, 18 bp, Homo sapiens
tctgcagtctctatacca

SEQ ID NO: 5314565 - DNA, 20 bp, Homo sapiens
tctgcagtctctataccaat

SEQ ID NO: 5314566 - DNA, 23 bp, Homo sapiens
tctgcagtgaggggagatgctgg

SEQ ID NO: 5314567 - DNA, 14 bp, Homo sapiens
tctgcagtgttctg

SEQ ID NO: 5314568 - DNA, 17 bp, Homo sapiens
tctgcagtgttctgtga

SEQ ID NO: 5314569 - DNA, 18 bp, Homo sapiens
tctgcagtgttctgtgaa

SEQ ID NO: 5314570 - DNA, 17 bp, Homo sapiens
tctgcagttctttttgt

SEQ ID NO: 5314571 - DNA, 17 bp, Homo sapiens
tctgcagtttttcccaa

SEQ ID NO: 5314572 - DNA, 15 bp, Homo sapiens
tctgcatagacaaag

SEQ ID NO: 5314573 - DNA, 20 bp, Homo sapiens
tctgcatagcgaaataaaaa

SEQ ID NO: 5314574 - DNA, 19 bp, Homo sapiens
tctgcatataataagcact

SEQ ID NO: 5314575 - DNA, 17 bp, Homo sapiens
tctgcatatttctgtat

SEQ ID NO: 5314576 - DNA, 21 bp, Homo sapiens
tctgcatcagctgctgaaaca

SEQ ID NO: 5314577 - DNA, 19 bp, Homo sapiens
tctgcatcatctgtagata

SEQ ID NO: 5314578 - DNA, 21 bp, Homo sapiens
tctgcatccagagattcattt

SEQ ID NO: 5314579 - DNA, 22 bp, Homo sapiens
tctgcatccagagattcatttt

SEQ ID NO: 5314580 - DNA, 21 bp, Homo sapiens
tctgcatcccagcacctgcct

SEQ ID NO: 5314581 - DNA, 23 bp, Homo sapiens
tctgcatcccagcacctgcctcc

SEQ ID NO: 5314582 - DNA, 24 bp, Homo sapiens
tctgcatcccagcacctgcctcct

SEQ ID NO: 5314583 - DNA, 19 bp, Homo sapiens
tctgcatcctctggagcca

SEQ ID NO: 5314584 - DNA, 17 bp, Homo sapiens
tctgcatctcctgtctt

SEQ ID NO: 5314585 - DNA, 15 bp, Homo sapiens
tctgcatctgaccac

SEQ ID NO: 5314586 - DNA, 14 bp, Homo sapiens
tctgcatctgactc

SEQ ID NO: 5314587 - DNA, 16 bp, Homo sapiens
tctgcatcttaacatg

SEQ ID NO: 5314588 - DNA, 14 bp, Homo sapiens
tctgcatctttttg

SEQ ID NO: 5314589 - DNA, 15 bp, Homo sapiens
tctgcatgcggccca

SEQ ID NO: 5314590 - DNA, 17 bp, Homo sapiens
tctgcatgcggcccagc

SEQ ID NO: 5314591 - DNA, 18 bp, Homo sapiens
tctgcatgcggcccagcc

SEQ ID NO: 5314592 - DNA, 20 bp, Homo sapiens
tctgcatgctcctctgcctg

SEQ ID NO: 5314593 - DNA, 16 bp, Homo sapiens
tctgcatgcttagagc

SEQ ID NO: 5314594 - DNA, 15 bp, Homo sapiens
tctgcatggcagaag

SEQ ID NO: 5314595 - DNA, 16 bp, Homo sapiens
tctgcatggcagaagc

SEQ ID NO: 5314596 - DNA, 21 bp, Homo sapiens
tctgcatgtaaaatcttcagc

SEQ ID NO: 5314597 - DNA, 23 bp, Homo sapiens
tctgcatgtaaaatcttcagctg

SEQ ID NO: 5314598 - DNA, 13 bp, Homo sapiens
tctgcatgtacta

SEQ ID NO: 5314599 - DNA, 12 bp, Homo sapiens
tctgcatgtttg

SEQ ID NO: 5314600 - DNA, 14 bp, Homo sapiens
tctgcatgttttcc

SEQ ID NO: 5314601 - DNA, 15 bp, Homo sapiens
tctgcattaataata

SEQ ID NO: 5314602 - DNA, 22 bp, Homo sapiens
tctgcattaataatagctaata

SEQ ID NO: 5314603 - DNA, 17 bp, Homo sapiens
tctgcattcaggatcaa

SEQ ID NO: 5314604 - DNA, 21 bp, Homo sapiens
tctgcattcatttttatagca

SEQ ID NO: 5314605 - DNA, 19 bp, Homo sapiens
tctgcattccccgctgccc

SEQ ID NO: 5314606 - DNA, 13 bp, Homo sapiens
tctgcattcctga

SEQ ID NO: 5314607 - DNA, 17 bp, Homo sapiens
tctgcattcctgtaact

SEQ ID NO: 5314608 - DNA, 17 bp, Homo sapiens
tctgcattgacctggag

SEQ ID NO: 5314609 - DNA, 17 bp, Homo sapiens
tctgcattgagaaggaa

SEQ ID NO: 5314610 - DNA, 23 bp, Homo sapiens
tctgcattgagaaggaactgata

SEQ ID NO: 5314611 - DNA, 14 bp, Homo sapiens
tctgcattgcccag

SEQ ID NO: 5314612 - DNA, 10 bp, Homo sapiens
tctgcattta

SEQ ID NO: 5314613 - DNA, 19 bp, Homo sapiens
tctgcatttataaatgtgt

SEQ ID NO: 5314614 - DNA, 16 bp, Homo sapiens
tctgcatttcatatta

SEQ ID NO: 5314615 - DNA, 13 bp, Homo sapiens
tctgcatttggta

SEQ ID NO: 5314616 - DNA, 14 bp, Homo sapiens
tctgcatttgtcta

SEQ ID NO: 5314617 - DNA, 21 bp, Homo sapiens
tctgcattttctgaaactaat

SEQ ID NO: 5314618 - DNA, 16 bp, Homo sapiens
tctgcattttctgggt

SEQ ID NO: 5314619 - DNA, 16 bp, Homo sapiens
tctgcattttgctatt

SEQ ID NO: 5314620 - DNA, 20 bp, Homo sapiens
tctgcatttttcagagaata

SEQ ID NO: 5314621 - DNA, 18 bp, Homo sapiens
tctgccaaaatgcaacat

SEQ ID NO: 5314622 - DNA, 16 bp, Homo sapiens
tctgccaataaattct

SEQ ID NO: 5314623 - DNA, 14 bp, Homo sapiens
tctgccaatctgta

SEQ ID NO: 5314624 - DNA, 13 bp, Homo sapiens
tctgccaatgcca

SEQ ID NO: 5314625 - DNA, 14 bp, Homo sapiens
tctgccaatgccat

SEQ ID NO: 5314626 - DNA, 19 bp, Homo sapiens
tctgccaatgccatgactg

SEQ ID NO: 5314627 - DNA, 21 bp, Homo sapiens
tctgccaatgccatgactgct

SEQ ID NO: 5314628 - DNA, 13 bp, Homo sapiens
tctgccaatgtgg

SEQ ID NO: 5314629 - DNA, 15 bp, Homo sapiens
tctgccacactctga

SEQ ID NO: 5314630 - DNA, 14 bp, Homo sapiens
tctgccacagagag

SEQ ID NO: 5314631 - DNA, 19 bp, Homo sapiens
tctgccacagagagtcctt

SEQ ID NO: 5314632 - DNA, 20 bp, Homo sapiens
tctgccacaggccatatttg

SEQ ID NO: 5314633 - DNA, 20 bp, Homo sapiens
tctgccacagggacttgcct

SEQ ID NO: 5314634 - DNA, 10 bp, Homo sapiens
tctgccacca

SEQ ID NO: 5314635 - DNA, 16 bp, Homo sapiens
tctgccaccagcgccc

SEQ ID NO: 5314636 - DNA, 13 bp, Homo sapiens
tctgccacccact

SEQ ID NO: 5314637 - DNA, 14 bp, Homo sapiens
tctgccacccactc

SEQ ID NO: 5314638 - DNA, 21 bp, Homo sapiens
tctgccacccactcaggattg

SEQ ID NO: 5314639 - DNA, 13 bp, Homo sapiens
tctgccaccccta

SEQ ID NO: 5314640 - DNA, 14 bp, Homo sapiens
tctgccaccctacc

SEQ ID NO: 5314641 - DNA, 14 bp, Homo sapiens
tctgccacctcccc

SEQ ID NO: 5314642 - DNA, 15 bp, Homo sapiens
tctgccacctcccct

SEQ ID NO: 5314643 - DNA, 11 bp, Homo sapiens
tctgccacctg

SEQ ID NO: 5314644 - DNA, 16 bp, Homo sapiens
tctgccacctgcacag

SEQ ID NO: 5314645 - DNA, 22 bp, Homo sapiens
tctgccacgtggtggcccagct

SEQ ID NO: 5314646 - DNA, 14 bp, Homo sapiens
tctgccactgagga

SEQ ID NO: 5314647 - DNA, 20 bp, Homo sapiens
tctgccactgaggagacaga

SEQ ID NO: 5314648 - DNA, 23 bp, Homo sapiens
tctgccactgtgaaccggctccc

SEQ ID NO: 5314649 - DNA, 16 bp, Homo sapiens
tctgccacttcccagg

SEQ ID NO: 5314650 - DNA, 22 bp, Homo sapiens
tctgccagaagatcccctcagg

SEQ ID NO: 5314651 - DNA, 15 bp, Homo sapiens
tctgccagaatactg

SEQ ID NO: 5314652 - DNA, 17 bp, Homo sapiens
tctgccagacctgcatg

SEQ ID NO: 5314653 - DNA, 13 bp, Homo sapiens
tctgccagccagc

SEQ ID NO: 5314654 - DNA, 16 bp, Homo sapiens
tctgccagccagcagc

SEQ ID NO: 5314655 - DNA, 17 bp, Homo sapiens
tctgccagccagcagcc

SEQ ID NO: 5314656 - DNA, 12 bp, Homo sapiens
tctgccagcgcc

SEQ ID NO: 5314657 - DNA, 21 bp, Homo sapiens
tctgccagctccacagggtgg

SEQ ID NO: 5314658 - DNA, 19 bp, Homo sapiens
tctgccagctgggcccagc

SEQ ID NO: 5314659 - DNA, 12 bp, Homo sapiens
tctgccaggcac

SEQ ID NO: 5314660 - DNA, 15 bp, Homo sapiens
tctgccaggcactct

SEQ ID NO: 5314661 - DNA, 23 bp, Homo sapiens
tctgccaggcactctcatcaccc

SEQ ID NO: 5314662 - DNA, 12 bp, Homo sapiens
tctgccaggccc

SEQ ID NO: 5314663 - DNA, 14 bp, Homo sapiens
tctgccaggccccc

SEQ ID NO: 5314664 - DNA, 14 bp, Homo sapiens
tctgccagggagct

SEQ ID NO: 5314665 - DNA, 11 bp, Homo sapiens
tctgccagggc

SEQ ID NO: 5314666 - DNA, 13 bp, Homo sapiens
tctgccagggcag

SEQ ID NO: 5314667 - DNA, 22 bp, Homo sapiens
tctgccagggcccctctcccca

SEQ ID NO: 5314668 - DNA, 23 bp, Homo sapiens
tctgccagggcccctctccccag

SEQ ID NO: 5314669 - DNA, 24 bp, Homo sapiens
tctgccagggcccctctccccagg

SEQ ID NO: 5314670 - DNA, 16 bp, Homo sapiens
tctgccaggggcttcc

SEQ ID NO: 5314671 - DNA, 17 bp, Homo sapiens
tctgccagtcctgtcct

SEQ ID NO: 5314672 - DNA, 23 bp, Homo sapiens
tctgccagtcgggagagccaggc

SEQ ID NO: 5314673 - DNA, 21 bp, Homo sapiens
tctgccagtgacagacaggct

SEQ ID NO: 5314674 - DNA, 12 bp, Homo sapiens
tctgccagtgga

SEQ ID NO: 5314675 - DNA, 22 bp, Homo sapiens
tctgccatattctgttggccag

SEQ ID NO: 5314676 - DNA, 22 bp, Homo sapiens
tctgccatcacatagtattatg

SEQ ID NO: 5314677 - DNA, 22 bp, Homo sapiens
tctgccatcagcccctgctgct

SEQ ID NO: 5314678 - DNA, 23 bp, Homo sapiens
tctgccatcagcccctgctgctc

SEQ ID NO: 5314679 - DNA, 23 bp, Homo sapiens
tctgccatcatttttgatgacta

SEQ ID NO: 5314680 - DNA, 15 bp, Homo sapiens
tctgccatcctccct

SEQ ID NO: 5314681 - DNA, 13 bp, Homo sapiens
tctgccatctaat

SEQ ID NO: 5314682 - DNA, 21 bp, Homo sapiens
tctgccatggccttggcaggc

SEQ ID NO: 5314683 - DNA, 16 bp, Homo sapiens
tctgccatgggagagt

SEQ ID NO: 5314684 - DNA, 20 bp, Homo sapiens
tctgccatgggagagtccag

SEQ ID NO: 5314685 - DNA, 22 bp, Homo sapiens
tctgccatgggagagtccaggc

SEQ ID NO: 5314686 - DNA, 12 bp, Homo sapiens
tctgccatgtgg

SEQ ID NO: 5314687 - DNA, 15 bp, Homo sapiens
tctgccatgtggcag

SEQ ID NO: 5314688 - DNA, 22 bp, Homo sapiens
tctgccattctgtgcaggctgc

SEQ ID NO: 5314689 - DNA, 15 bp, Homo sapiens
tctgccattgggacc

SEQ ID NO: 5314690 - DNA, 17 bp, Homo sapiens
tctgccattgggaccct

SEQ ID NO: 5314691 - DNA, 24 bp, Homo sapiens
tctgccattgggaccctccagtgc

SEQ ID NO: 5314692 - DNA, 17 bp, Homo sapiens
tctgccatttatttcct

SEQ ID NO: 5314693 - DNA, 21 bp, Homo sapiens
tctgccatttcaaatttctat

SEQ ID NO: 5314694 - DNA, 15 bp, Homo sapiens
tctgcccaactttca

SEQ ID NO: 5314695 - DNA, 23 bp, Homo sapiens
tctgcccaagcagcctggagact

SEQ ID NO: 5314696 - DNA, 20 bp, Homo sapiens
tctgcccaagttgctctgta

SEQ ID NO: 5314697 - DNA, 20 bp, Homo sapiens
tctgcccacagtctttccgt

SEQ ID NO: 5314698 - DNA, 18 bp, Homo sapiens
tctgcccacattggaccc

SEQ ID NO: 5314699 - DNA, 10 bp, Homo sapiens
tctgcccacc

SEQ ID NO: 5314700 - DNA, 17 bp, Homo sapiens
tctgcccaccccgcctc

SEQ ID NO: 5314701 - DNA, 20 bp, Homo sapiens
tctgcccaccccgcctctgg

SEQ ID NO: 5314702 - DNA, 22 bp, Homo sapiens
tctgcccaccccgcctctgggc

SEQ ID NO: 5314703 - DNA, 17 bp, Homo sapiens
tctgcccacctcggcct

SEQ ID NO: 5314704 - DNA, 15 bp, Homo sapiens
tctgcccacctgggg

SEQ ID NO: 5314705 - DNA, 20 bp, Homo sapiens
tctgcccacgcagaggacgc

SEQ ID NO: 5314706 - DNA, 18 bp, Homo sapiens
tctgcccactccctgcaa

SEQ ID NO: 5314707 - DNA, 13 bp, Homo sapiens
tctgcccactcgg

SEQ ID NO: 5314708 - DNA, 19 bp, Homo sapiens
tctgcccacttccccttcc

SEQ ID NO: 5314709 - DNA, 16 bp, Homo sapiens
tctgcccagccctctg

SEQ ID NO: 5314710 - DNA, 19 bp, Homo sapiens
tctgcccagccctctgtgg

SEQ ID NO: 5314711 - DNA, 14 bp, Homo sapiens
tctgcccagcctgc

SEQ ID NO: 5314712 - DNA, 19 bp, Homo sapiens
tctgcccagcttgggccca

SEQ ID NO: 5314713 - DNA, 17 bp, Homo sapiens
tctgcccagcttttcat

SEQ ID NO: 5314714 - DNA, 12 bp, Homo sapiens
tctgcccaggac

SEQ ID NO: 5314715 - DNA, 11 bp, Homo sapiens
tctgcccaggc

SEQ ID NO: 5314716 - DNA, 16 bp, Homo sapiens
tctgcccagggatttg

SEQ ID NO: 5314717 - DNA, 23 bp, Homo sapiens
tctgcccaggggtgccccctcct

SEQ ID NO: 5314718 - DNA, 20 bp, Homo sapiens
tctgcccatcctgcccctga

SEQ ID NO: 5314719 - DNA, 12 bp, Homo sapiens
tctgcccatgcc

SEQ ID NO: 5314720 - DNA, 21 bp, Homo sapiens
tctgcccatgcctaaagccca

SEQ ID NO: 5314721 - DNA, 18 bp, Homo sapiens
tctgcccattccccagcc

SEQ ID NO: 5314722 - DNA, 13 bp, Homo sapiens
tctgccccaagca

SEQ ID NO: 5314723 - DNA, 18 bp, Homo sapiens
tctgccccaagcagccag

SEQ ID NO: 5314724 - DNA, 21 bp, Homo sapiens
tctgccccaagcagccagcca

SEQ ID NO: 5314725 - DNA, 15 bp, Homo sapiens
tctgccccaagcccc

SEQ ID NO: 5314726 - DNA, 16 bp, Homo sapiens
tctgccccaagccccc

SEQ ID NO: 5314727 - DNA, 16 bp, Homo sapiens
tctgccccaagttttg

SEQ ID NO: 5314728 - DNA, 21 bp, Homo sapiens
tctgccccaatcgggtccaga

SEQ ID NO: 5314729 - DNA, 23 bp, Homo sapiens
tctgccccaatcgggtccagaga

SEQ ID NO: 5314730 - DNA, 18 bp, Homo sapiens
tctgccccacacccagcc

SEQ ID NO: 5314731 - DNA, 17 bp, Homo sapiens
tctgccccacccaccta

SEQ ID NO: 5314732 - DNA, 18 bp, Homo sapiens
tctgccccaccttgccag

SEQ ID NO: 5314733 - DNA, 20 bp, Homo sapiens
tctgccccaccttgccaggg

SEQ ID NO: 5314734 - DNA, 15 bp, Homo sapiens
tctgccccagcccag

SEQ ID NO: 5314735 - DNA, 14 bp, Homo sapiens
tctgccccagcttg

SEQ ID NO: 5314736 - DNA, 18 bp, Homo sapiens
tctgccccagcttgggca

SEQ ID NO: 5314737 - DNA, 15 bp, Homo sapiens
tctgccccagcttta

SEQ ID NO: 5314738 - DNA, 16 bp, Homo sapiens
tctgccccagctttat

SEQ ID NO: 5314739 - DNA, 17 bp, Homo sapiens
tctgccccagctttatc

SEQ ID NO: 5314740 - DNA, 15 bp, Homo sapiens
tctgccccatcctcc

SEQ ID NO: 5314741 - DNA, 19 bp, Homo sapiens
tctgccccatcctccagca

SEQ ID NO: 5314742 - DNA, 13 bp, Homo sapiens
tctgcccccagcc

SEQ ID NO: 5314743 - DNA, 14 bp, Homo sapiens
tctgcccccagccc

SEQ ID NO: 5314744 - DNA, 14 bp, Homo sapiens
tctgcccccagctg

SEQ ID NO: 5314745 - DNA, 15 bp, Homo sapiens
tctgcccccagctgc

SEQ ID NO: 5314746 - DNA, 17 bp, Homo sapiens
tctgccccccagggcta

SEQ ID NO: 5314747 - DNA, 22 bp, Homo sapiens
tctgcccccgcgggttctagac

SEQ ID NO: 5314748 - DNA, 20 bp, Homo sapiens
tctgcccccgtcttctctcc

SEQ ID NO: 5314749 - DNA, 21 bp, Homo sapiens
tctgcccccgtcttctctcca

SEQ ID NO: 5314750 - DNA, 17 bp, Homo sapiens
tctgccccctcagggat

SEQ ID NO: 5314751 - DNA, 23 bp, Homo sapiens
tctgccccctcccccatgggctg

SEQ ID NO: 5314752 - DNA, 16 bp, Homo sapiens
tctgccccctcccccg

SEQ ID NO: 5314753 - DNA, 14 bp, Homo sapiens
tctgccccctgcag

SEQ ID NO: 5314754 - DNA, 15 bp, Homo sapiens
tctgccccctgcaga

SEQ ID NO: 5314755 - DNA, 16 bp, Homo sapiens
tctgcccctcaggggg

SEQ ID NO: 5314756 - DNA, 18 bp, Homo sapiens
tctgcccctcccccactt

SEQ ID NO: 5314757 - DNA, 16 bp, Homo sapiens
tctgcccctccgtccc

SEQ ID NO: 5314758 - DNA, 22 bp, Homo sapiens
tctgcccctccgtccccagggt

SEQ ID NO: 5314759 - DNA, 22 bp, Homo sapiens
tctgcccctctactgttgcaca

SEQ ID NO: 5314760 - DNA, 22 bp, Homo sapiens
tctgcccctctccaggcgccgg

SEQ ID NO: 5314761 - DNA, 17 bp, Homo sapiens
tctgcccctcttccctg

SEQ ID NO: 5314762 - DNA, 14 bp, Homo sapiens
tctgcccctgatca

SEQ ID NO: 5314763 - DNA, 23 bp, Homo sapiens
tctgcccctgatcactcccagca

SEQ ID NO: 5314764 - DNA, 14 bp, Homo sapiens
tctgcccctgcagc

SEQ ID NO: 5314765 - DNA, 15 bp, Homo sapiens
tctgcccctgcagct

SEQ ID NO: 5314766 - DNA, 19 bp, Homo sapiens
tctgccccttctgtttcca

SEQ ID NO: 5314767 - DNA, 19 bp, Homo sapiens
tctgccccttgggcatcca

SEQ ID NO: 5314768 - DNA, 20 bp, Homo sapiens
tctgccccttgggcctccca

SEQ ID NO: 5314769 - DNA, 22 bp, Homo sapiens
tctgccccttgggcctcccact

SEQ ID NO: 5314770 - DNA, 17 bp, Homo sapiens
tctgcccgcctgcccac

SEQ ID NO: 5314771 - DNA, 23 bp, Homo sapiens
tctgcccgcctgcccacctgcct

SEQ ID NO: 5314772 - DNA, 23 bp, Homo sapiens
tctgcccgggaaggtcaccagca

SEQ ID NO: 5314773 - DNA, 19 bp, Homo sapiens
tctgccctaacctgacaga

SEQ ID NO: 5314774 - DNA, 22 bp, Homo sapiens
tctgccctcagatgaaaataaa

SEQ ID NO: 5314775 - DNA, 18 bp, Homo sapiens
tctgccctccctccttcc

SEQ ID NO: 5314776 - DNA, 13 bp, Homo sapiens
tctgccctccctg

SEQ ID NO: 5314777 - DNA, 19 bp, Homo sapiens
tctgccctcccttcttgtg

SEQ ID NO: 5314778 - DNA, 14 bp, Homo sapiens
tctgccctcctgcc

SEQ ID NO: 5314779 - DNA, 19 bp, Homo sapiens
tctgccctcctgccaaaag

SEQ ID NO: 5314780 - DNA, 16 bp, Homo sapiens
tctgccctctccctgt

SEQ ID NO: 5314781 - DNA, 14 bp, Homo sapiens
tctgccctgagccc

SEQ ID NO: 5314782 - DNA, 15 bp, Homo sapiens
tctgccctgagccct

SEQ ID NO: 5314783 - DNA, 17 bp, Homo sapiens
tctgccctgcccatact

SEQ ID NO: 5314784 - DNA, 14 bp, Homo sapiens
tctgccctgccctg

SEQ ID NO: 5314785 - DNA, 15 bp, Homo sapiens
tctgccctgccctgg

SEQ ID NO: 5314786 - DNA, 17 bp, Homo sapiens
tctgccctgccctggcc

SEQ ID NO: 5314787 - DNA, 22 bp, Homo sapiens
tctgccctgccctggccactgg

SEQ ID NO: 5314788 - DNA, 20 bp, Homo sapiens
tctgctgcttttggggaatg

SEQ ID NO: 5314789 - DNA, 18 bp, Homo sapiens
tctgctggaaggggcagc

SEQ ID NO: 5314790 - DNA, 21 bp, Homo sapiens
tctgctggaaggggcagcagg

SEQ ID NO: 5314791 - DNA, 22 bp, Homo sapiens
tctgctggagaaagccacgccc

SEQ ID NO: 5314792 - DNA, 22 bp, Homo sapiens
tctgctggaggaggggaagctg

SEQ ID NO: 5314793 - DNA, 16 bp, Homo sapiens
tctgctggataaaatg

SEQ ID NO: 5314794 - DNA, 18 bp, Homo sapiens
tctgctggataaaatgag

SEQ ID NO: 5314795 - DNA, 22 bp, Homo sapiens
tctgctggataaaatgaggttc

SEQ ID NO: 5314796 - DNA, 21 bp, Homo sapiens
tctgctggccgggcacagctg

SEQ ID NO: 5314797 - DNA, 14 bp, Homo sapiens
tctgctggcctctg

SEQ ID NO: 5314798 - DNA, 16 bp, Homo sapiens
tctgctggcctctgcg

SEQ ID NO: 5314799 - DNA, 16 bp, Homo sapiens
tctgctggcctggatc

SEQ ID NO: 5314800 - DNA, 17 bp, Homo sapiens
tctgctggcctggatct

SEQ ID NO: 5314801 - DNA, 24 bp, Homo sapiens
tctgctgggctggggcctgatggg

SEQ ID NO: 5314802 - DNA, 23 bp, Homo sapiens
tctgctggggcctgggacaactg

SEQ ID NO: 5314803 - DNA, 21 bp, Homo sapiens
tctgctgggtttccacacagc

SEQ ID NO: 5314804 - DNA, 15 bp, Homo sapiens
tctgctggtatttct

SEQ ID NO: 5314805 - DNA, 18 bp, Homo sapiens
tctgctggtctctggctc

SEQ ID NO: 5314806 - DNA, 19 bp, Homo sapiens
tctgctggtctctggctct

SEQ ID NO: 5314807 - DNA, 17 bp, Homo sapiens
tctgctggttttaacaa

SEQ ID NO: 5314808 - DNA, 16 bp, Homo sapiens
tctgctgtacagatat

SEQ ID NO: 5314809 - DNA, 12 bp, Homo sapiens
tctgctgtagaa

SEQ ID NO: 5314810 - DNA, 21 bp, Homo sapiens
tctgctgtattgatatcacta

SEQ ID NO: 5314811 - DNA, 18 bp, Homo sapiens
tctgctgtcagtctgctt

SEQ ID NO: 5314812 - DNA, 18 bp, Homo sapiens
tctgctgtccagacagcc

SEQ ID NO: 5314813 - DNA, 19 bp, Homo sapiens
tctgctgtccagacagcct

SEQ ID NO: 5314814 - DNA, 17 bp, Homo sapiens
tctgctgtccccttggc

SEQ ID NO: 5314815 - DNA, 15 bp, Homo sapiens
tctgctgtcctgcag

SEQ ID NO: 5314816 - DNA, 15 bp, Homo sapiens
tctgctgtctcagcc

SEQ ID NO: 5314817 - DNA, 15 bp, Homo sapiens
tctgctgtctctcct

SEQ ID NO: 5314818 - DNA, 18 bp, Homo sapiens
tctgctgtggtctataaa

SEQ ID NO: 5314819 - DNA, 19 bp, Homo sapiens
tctgctgtgtggaaaaaaa

SEQ ID NO: 5314820 - DNA, 13 bp, Homo sapiens
tctgctgttaact

SEQ ID NO: 5314821 - DNA, 16 bp, Homo sapiens
tctgctgttccagtgg

SEQ ID NO: 5314822 - DNA, 19 bp, Homo sapiens
tctgctgttcttcacttct

SEQ ID NO: 5314823 - DNA, 16 bp, Homo sapiens
tctgctgttcttcagt

SEQ ID NO: 5314824 - DNA, 17 bp, Homo sapiens
tctgctgttcttcagtc

SEQ ID NO: 5314825 - DNA, 18 bp, Homo sapiens
tctgctgttcttcagtcc

SEQ ID NO: 5314826 - DNA, 17 bp, Homo sapiens
tctgctgttgccatagc

SEQ ID NO: 5314827 - DNA, 18 bp, Homo sapiens
tctgctgttgccatagcc

SEQ ID NO: 5314828 - DNA, 15 bp, Homo sapiens
tctgctgttgtggga

SEQ ID NO: 5314829 - DNA, 15 bp, Homo sapiens
tctgctgtttacaac

SEQ ID NO: 5314830 - DNA, 17 bp, Homo sapiens
tctgctgtttacaacat

SEQ ID NO: 5314831 - DNA, 22 bp, Homo sapiens
tctgctgtttgttccaggctca

SEQ ID NO: 5314832 - DNA, 19 bp, Homo sapiens
tctgcttacaattccctgc

SEQ ID NO: 5314833 - DNA, 21 bp, Homo sapiens
tctgcttacaattccctgctg

SEQ ID NO: 5314834 - DNA, 22 bp, Homo sapiens
tctgcttacaattccctgctgt

SEQ ID NO: 5314835 - DNA, 14 bp, Homo sapiens
tctgcttaccaaaa

SEQ ID NO: 5314836 - DNA, 14 bp, Homo sapiens
tctgcttacttttt

SEQ ID NO: 5314837 - DNA, 12 bp, Homo sapiens
tctgcttagaaa

SEQ ID NO: 5314838 - DNA, 14 bp, Homo sapiens
tctgcttagaaata

SEQ ID NO: 5314839 - DNA, 16 bp, Homo sapiens
tctgcttatccttcca

SEQ ID NO: 5314840 - DNA, 18 bp, Homo sapiens
tctgcttatttcatctgt

SEQ ID NO: 5314841 - DNA, 13 bp, Homo sapiens
tctgcttcagcct

SEQ ID NO: 5314842 - DNA, 13 bp, Homo sapiens
tctgcttcagtgg

SEQ ID NO: 5314843 - DNA, 19 bp, Homo sapiens
tctgcttcatccaatgtga

SEQ ID NO: 5314844 - DNA, 24 bp, Homo sapiens
tctgcttcatttcctctgagctgt

SEQ ID NO: 5314845 - DNA, 17 bp, Homo sapiens
tctgcttccacatgtgc

SEQ ID NO: 5314846 - DNA, 22 bp, Homo sapiens
tctgcttccatggcttcctgag

SEQ ID NO: 5314847 - DNA, 17 bp, Homo sapiens
tctgcttccctggggcc

SEQ ID NO: 5314848 - DNA, 16 bp, Homo sapiens
tctgcttcccttgcct

SEQ ID NO: 5314849 - DNA, 14 bp, Homo sapiens
tctgcttctagtat

SEQ ID NO: 5314850 - DNA, 21 bp, Homo sapiens
tctgcttctctctctctcaca

SEQ ID NO: 5314851 - DNA, 15 bp, Homo sapiens
tctgcttctgcacct

SEQ ID NO: 5314852 - DNA, 18 bp, Homo sapiens
tctgcttcttcatcttga

SEQ ID NO: 5314853 - DNA, 15 bp, Homo sapiens
tctgcttctttgcct

SEQ ID NO: 5314854 - DNA, 19 bp, Homo sapiens
tctgcttgacaacatctga

SEQ ID NO: 5314855 - DNA, 20 bp, Homo sapiens
tctgcttgagtcaggtttga

SEQ ID NO: 5314856 - DNA, 18 bp, Homo sapiens
tctgcttgatttttgcct

SEQ ID NO: 5314857 - DNA, 20 bp, Homo sapiens
tctgcttgcatcacttgggg

SEQ ID NO: 5314858 - DNA, 16 bp, Homo sapiens
tctgcttgccagccag

SEQ ID NO: 5314859 - DNA, 17 bp, Homo sapiens
tctgcttgccatccctc

SEQ ID NO: 5314860 - DNA, 18 bp, Homo sapiens
tctgcttgctcccaagcc

SEQ ID NO: 5314861 - DNA, 19 bp, Homo sapiens
tctgcttgctcccaagccc

SEQ ID NO: 5314862 - DNA, 18 bp, Homo sapiens
tctgcttgtgacattaaa

SEQ ID NO: 5314863 - DNA, 14 bp, Homo sapiens
tctgcttgtgttaa

SEQ ID NO: 5314864 - DNA, 19 bp, Homo sapiens
tctgcttgttattagagat

SEQ ID NO: 5314865 - DNA, 20 bp, Homo sapiens
tctgctttaaattaaaattt

SEQ ID NO: 5314866 - DNA, 23 bp, Homo sapiens
tctgctttaaattaaaattttat

SEQ ID NO: 5314867 - DNA, 12 bp, Homo sapiens
tctgctttagac

SEQ ID NO: 5314868 - DNA, 19 bp, Homo sapiens
tctgctttagacttgaaaa

SEQ ID NO: 5314869 - DNA, 15 bp, Homo sapiens
tctgctttatctttt

SEQ ID NO: 5314870 - DNA, 17 bp, Homo sapiens
tctgctttcacttaagt

SEQ ID NO: 5314871 - DNA, 12 bp, Homo sapiens
tctgctttcctc

SEQ ID NO: 5314872 - DNA, 15 bp, Homo sapiens
tctgctttccttttc

SEQ ID NO: 5314873 - DNA, 17 bp, Homo sapiens
tctgctttccttttctc

SEQ ID NO: 5314874 - DNA, 18 bp, Homo sapiens
tctgctttccttttctct

SEQ ID NO: 5314875 - DNA, 19 bp, Homo sapiens
tctgctttccttttctctg

SEQ ID NO: 5314876 - DNA, 17 bp, Homo sapiens
tctgctttctcctttaa

SEQ ID NO: 5314877 - DNA, 15 bp, Homo sapiens
tctgctttctgcctc

SEQ ID NO: 5314878 - DNA, 19 bp, Homo sapiens
tctgctttctgcctctcct

SEQ ID NO: 5314879 - DNA, 14 bp, Homo sapiens
tctgctttctgttc

SEQ ID NO: 5314880 - DNA, 18 bp, Homo sapiens
tctgctttctgttcatct

SEQ ID NO: 5314881 - DNA, 20 bp, Homo sapiens
tctgctttctgttcatctct

SEQ ID NO: 5314882 - DNA, 15 bp, Homo sapiens
tctgctttcttgcca

SEQ ID NO: 5314883 - DNA, 21 bp, Homo sapiens
tctgctttgactgagcagact

SEQ ID NO: 5314884 - DNA, 16 bp, Homo sapiens
tctgctttgctgttat

SEQ ID NO: 5314885 - DNA, 23 bp, Homo sapiens
tctgctttggggcttatcagaac

SEQ ID NO: 5314886 - DNA, 17 bp, Homo sapiens
tctgcttttaagttttt

SEQ ID NO: 5314887 - DNA, 16 bp, Homo sapiens
tctgcttttccattct

SEQ ID NO: 5314888 - DNA, 16 bp, Homo sapiens
tctgcttttcctgtct

SEQ ID NO: 5314889 - DNA, 18 bp, Homo sapiens
tctgcttttcctgtctgt

SEQ ID NO: 5314890 - DNA, 15 bp, Homo sapiens
tctgcttttctgccc

SEQ ID NO: 5314891 - DNA, 17 bp, Homo sapiens
tctgcttttctgccctg

SEQ ID NO: 5314892 - DNA, 20 bp, Homo sapiens
tctgcttttctgccctggct

SEQ ID NO: 5314893 - DNA, 22 bp, Homo sapiens
tctgcttttctgccctggctgc

SEQ ID NO: 5314894 - DNA, 18 bp, Homo sapiens
tctgcttttgcatctttg

SEQ ID NO: 5314895 - DNA, 17 bp, Homo sapiens
tctgcttttgctggggt

SEQ ID NO: 5314896 - DNA, 14 bp, Homo sapiens
tctgctttttctgt

SEQ ID NO: 5314897 - DNA, 18 bp, Homo sapiens
tctggaaaaaaaaaaata

SEQ ID NO: 5314898 - DNA, 18 bp, Homo sapiens
tctggaaaaaaaatatat

SEQ ID NO: 5314899 - DNA, 19 bp, Homo sapiens
tctggaaaaaaaatatata

SEQ ID NO: 5314900 - DNA, 23 bp, Homo sapiens
tctggaaaactattgagccttgc

SEQ ID NO: 5314901 - DNA, 19 bp, Homo sapiens
tctggaaaactcaggattc

SEQ ID NO: 5314902 - DNA, 20 bp, Homo sapiens
tctggaaaactcaggattct

SEQ ID NO: 5314903 - DNA, 17 bp, Homo sapiens
tctggaaaatgcttctt

SEQ ID NO: 5314904 - DNA, 17 bp, Homo sapiens
tctggaaaccaaatagg

SEQ ID NO: 5314905 - DNA, 22 bp, Homo sapiens
tctggaaacctgtcattgtatt

SEQ ID NO: 5314906 - DNA, 14 bp, Homo sapiens
tctggaaaggagga

SEQ ID NO: 5314907 - DNA, 16 bp, Homo sapiens
tctggaaaggaggaag

SEQ ID NO: 5314908 - DNA, 13 bp, Homo sapiens
tctggaaagggca

SEQ ID NO: 5314909 - DNA, 19 bp, Homo sapiens
tctggaaaggggggagctg

SEQ ID NO: 5314910 - DNA, 21 bp, Homo sapiens
tctggaaagtgatgtcagaat

SEQ ID NO: 5314911 - DNA, 20 bp, Homo sapiens
tctggaaagttttctccact

SEQ ID NO: 5314912 - DNA, 17 bp, Homo sapiens
tctggaaatccagataa

SEQ ID NO: 5314913 - DNA, 13 bp, Homo sapiens
tctggaaatgtct

SEQ ID NO: 5314914 - DNA, 13 bp, Homo sapiens
tctggaaatgttc

SEQ ID NO: 5314915 - DNA, 19 bp, Homo sapiens
tctggaaattcttccctgg

SEQ ID NO: 5314916 - DNA, 15 bp, Homo sapiens
tctggaaccatcctc

SEQ ID NO: 5314917 - DNA, 18 bp, Homo sapiens
tctggaacccagactcag

SEQ ID NO: 5314918 - DNA, 16 bp, Homo sapiens
tctggaacctcagcct

SEQ ID NO: 5314919 - DNA, 19 bp, Homo sapiens
tctggaacctcagcctggc

SEQ ID NO: 5314920 - DNA, 15 bp, Homo sapiens
tctggaacctgactt

SEQ ID NO: 5314921 - DNA, 20 bp, Homo sapiens
tctggaacgctctaggcaga

SEQ ID NO: 5314922 - DNA, 22 bp, Homo sapiens
tctggaacgctctaggcagaag

SEQ ID NO: 5314923 - DNA, 14 bp, Homo sapiens
tctggaactgctgc

SEQ ID NO: 5314924 - DNA, 15 bp, Homo sapiens
tctggaactgctgct

SEQ ID NO: 5314925 - DNA, 11 bp, Homo sapiens
tctggaagaaa

SEQ ID NO: 5314926 - DNA, 13 bp, Homo sapiens
tctggaagaaaaa

SEQ ID NO: 5314927 - DNA, 17 bp, Homo sapiens
tctggaagaaagccctg

SEQ ID NO: 5314928 - DNA, 19 bp, Homo sapiens
tctggaagacgtggctctg

SEQ ID NO: 5314929 - DNA, 13 bp, Homo sapiens
tctggaagagagg

SEQ ID NO: 5314930 - DNA, 18 bp, Homo sapiens
tctggaagaggccttccc

SEQ ID NO: 5314931 - DNA, 23 bp, Homo sapiens
tctggaagagggaggggccctgt

SEQ ID NO: 5314932 - DNA, 15 bp, Homo sapiens
tctggaagattctta

SEQ ID NO: 5314933 - DNA, 12 bp, Homo sapiens
tctggaagcaaa

SEQ ID NO: 5314934 - DNA, 14 bp, Homo sapiens
tctggaagcaaatg

SEQ ID NO: 5314935 - DNA, 18 bp, Homo sapiens
tctggaagccctggagac

SEQ ID NO: 5314936 - DNA, 14 bp, Homo sapiens
tctggaagcctgga

SEQ ID NO: 5314937 - DNA, 16 bp, Homo sapiens
tctggaagctgagcag

SEQ ID NO: 5314938 - DNA, 20 bp, Homo sapiens
tctggaagctgattaaaaca

SEQ ID NO: 5314939 - DNA, 20 bp, Homo sapiens
tctggaaggcccctcccagc

SEQ ID NO: 5314940 - DNA, 16 bp, Homo sapiens
tctggaaggctggctg

SEQ ID NO: 5314941 - DNA, 17 bp, Homo sapiens
tctggaaggctggctga

SEQ ID NO: 5314942 - DNA, 23 bp, Homo sapiens
tctggaaggggcagccctgagtg

SEQ ID NO: 5314943 - DNA, 13 bp, Homo sapiens
tctggaagtccaa

SEQ ID NO: 5314944 - DNA, 19 bp, Homo sapiens
tctggaagtccccgggagc

SEQ ID NO: 5314945 - DNA, 22 bp, Homo sapiens
tctggaagtgactttggctgca

SEQ ID NO: 5314946 - DNA, 19 bp, Homo sapiens
tctggaataaggagaatga

SEQ ID NO: 5314947 - DNA, 22 bp, Homo sapiens
tctggaatacatgaaatataga

SEQ ID NO: 5314948 - DNA, 18 bp, Homo sapiens
tctggaatactgaaaaag

SEQ ID NO: 5314949 - DNA, 20 bp, Homo sapiens
tctggaatactgaaaaagaa

SEQ ID NO: 5314950 - DNA, 23 bp, Homo sapiens
tctggaatcattgtccagagctg

SEQ ID NO: 5314951 - DNA, 18 bp, Homo sapiens
tctggaatcccagctccg

SEQ ID NO: 5314952 - DNA, 16 bp, Homo sapiens
tctggaatctgaggca

SEQ ID NO: 5314953 - DNA, 16 bp, Homo sapiens
tctggaatgcagtggt

SEQ ID NO: 5314954 - DNA, 23 bp, Homo sapiens
tctggaatggtacatgtcttcca

SEQ ID NO: 5314955 - DNA, 15 bp, Homo sapiens
tctggaatgtaatca

SEQ ID NO: 5314956 - DNA, 17 bp, Homo sapiens
tctggaattaaggtcaa

SEQ ID NO: 5314957 - DNA, 21 bp, Homo sapiens
tctggaattgatgtttacatg

SEQ ID NO: 5314958 - DNA, 15 bp, Homo sapiens
tctggaattgtggct

SEQ ID NO: 5314959 - DNA, 19 bp, Homo sapiens
tctggaattgttgaatgta

SEQ ID NO: 5314960 - DNA, 14 bp, Homo sapiens
tctggaatttaatt

SEQ ID NO: 5314961 - DNA, 23 bp, Homo sapiens
tctggacaagaagagtcctttta

SEQ ID NO: 5314962 - DNA, 14 bp, Homo sapiens
tctggacacactgt

SEQ ID NO: 5314963 - DNA, 14 bp, Homo sapiens
tctggacactgcca

SEQ ID NO: 5314964 - DNA, 14 bp, Homo sapiens
tctggacagcagaa

SEQ ID NO: 5314965 - DNA, 18 bp, Homo sapiens
tctggacagccccaccct

SEQ ID NO: 5314966 - DNA, 21 bp, Homo sapiens
tctggacattctctttgataa

SEQ ID NO: 5314967 - DNA, 23 bp, Homo sapiens
tctggaccatgctgagacatccc

SEQ ID NO: 5314968 - DNA, 21 bp, Homo sapiens
tctggaccccatctgtgaata

SEQ ID NO: 5314969 - DNA, 16 bp, Homo sapiens
tctggacccttggcct

SEQ ID NO: 5314970 - DNA, 14 bp, Homo sapiens
tctggacctcagtt

SEQ ID NO: 5314971 - DNA, 15 bp, Homo sapiens
tctggacctcagttt

SEQ ID NO: 5314972 - DNA, 20 bp, Homo sapiens
tctggacctccatccctgct

SEQ ID NO: 5314973 - DNA, 21 bp, Homo sapiens
tctggacctccatccctgctc

SEQ ID NO: 5314974 - DNA, 13 bp, Homo sapiens
tctggacctcccc

SEQ ID NO: 5314975 - DNA, 17 bp, Homo sapiens
tctggacctccccctct

SEQ ID NO: 5314976 - DNA, 21 bp, Homo sapiens
tctggacctcggtgatgcctt

SEQ ID NO: 5314977 - DNA, 14 bp, Homo sapiens
tctggacctctggg

SEQ ID NO: 5314978 - DNA, 15 bp, Homo sapiens
tctggacctctgggt

SEQ ID NO: 5314979 - DNA, 14 bp, Homo sapiens
tctggacggcaggc

SEQ ID NO: 5314980 - DNA, 15 bp, Homo sapiens
tctggacggcaggct

SEQ ID NO: 5314981 - DNA, 22 bp, Homo sapiens
tctggacggggatggttcccca

SEQ ID NO: 5314982 - DNA, 14 bp, Homo sapiens
tctggacgtgaaat

SEQ ID NO: 5314983 - DNA, 19 bp, Homo sapiens
tctggactaaccctgtggt

SEQ ID NO: 5314984 - DNA, 20 bp, Homo sapiens
tctggactacacccaagcct

SEQ ID NO: 5314985 - DNA, 17 bp, Homo sapiens
tctggactccacggatg

SEQ ID NO: 5314986 - DNA, 18 bp, Homo sapiens
tctggactcctctgtcca

SEQ ID NO: 5314987 - DNA, 14 bp, Homo sapiens
tctggactctaaag

SEQ ID NO: 5314988 - DNA, 15 bp, Homo sapiens
tctggactctgcccc

SEQ ID NO: 5314989 - DNA, 14 bp, Homo sapiens
tctggactctggac

SEQ ID NO: 5314990 - DNA, 17 bp, Homo sapiens
tctggactgaagcctgc

SEQ ID NO: 5314991 - DNA, 19 bp, Homo sapiens
tctggactgaagcctgcag

SEQ ID NO: 5314992 - DNA, 21 bp, Homo sapiens
tctggactgaagcctgcagga

SEQ ID NO: 5314993 - DNA, 22 bp, Homo sapiens
tctggactgctattctagagct

SEQ ID NO: 5314994 - DNA, 13 bp, Homo sapiens
tctggactggaaa

SEQ ID NO: 5314995 - DNA, 12 bp, Homo sapiens
tctggactggcc

SEQ ID NO: 5314996 - DNA, 15 bp, Homo sapiens
tctggactggctaga

SEQ ID NO: 5314997 - DNA, 22 bp, Homo sapiens
tctggactgtgggtttgtgggg

SEQ ID NO: 5314998 - DNA, 18 bp, Homo sapiens
tctggacttggtcttgaa

SEQ ID NO: 5314999 - DNA, 22 bp, Homo sapiens
tctggactttctctaataataa

SEQ ID NO: 5315000 - DNA, 22 bp, Homo sapiens
tctggactttgcttcccctcca

SEQ ID NO: 5315001 - DNA, 15 bp, Homo sapiens
tctggagaagcagtg

SEQ ID NO: 5315002 - DNA, 22 bp, Homo sapiens
tctggagaagctcccaggaaca

SEQ ID NO: 5315003 - DNA, 19 bp, Homo sapiens
tctggagaaggcctggaag

SEQ ID NO: 5315004 - DNA, 18 bp, Homo sapiens
tctggagacagccccaga

SEQ ID NO: 5315005 - DNA, 20 bp, Homo sapiens
tctggagaccaccagggcat

SEQ ID NO: 5315006 - DNA, 23 bp, Homo sapiens
tctggagaccaggactctgcctt

SEQ ID NO: 5315007 - DNA, 12 bp, Homo sapiens
tctggagagcct

SEQ ID NO: 5315008 - DNA, 13 bp, Homo sapiens
tctggagagctag

SEQ ID NO: 5315009 - DNA, 12 bp, Homo sapiens
tctggagagctg

SEQ ID NO: 5315010 - DNA, 24 bp, Homo sapiens
tctggagatggaagcttgttgaaa

SEQ ID NO: 5315011 - DNA, 21 bp, Homo sapiens
tctggagcaatctgacccttc

SEQ ID NO: 5315012 - DNA, 21 bp, Homo sapiens
tctggagccaaggcagagggg

SEQ ID NO: 5315013 - DNA, 16 bp, Homo sapiens
tctggagccaagtcca

SEQ ID NO: 5315014 - DNA, 19 bp, Homo sapiens
tctggagccacctgtccca

SEQ ID NO: 5315015 - DNA, 13 bp, Homo sapiens
tctggagccagag

SEQ ID NO: 5315016 - DNA, 14 bp, Homo sapiens
tctggagccagaga

SEQ ID NO: 5315017 - DNA, 12 bp, Homo sapiens
tctggagcccct

SEQ ID NO: 5315018 - DNA, 20 bp, Homo sapiens
tctggagcccctatcctgca

SEQ ID NO: 5315019 - DNA, 23 bp, Homo sapiens
tctggagcccctatcctgcaccc

SEQ ID NO: 5315020 - DNA, 16 bp, Homo sapiens
tctggagcccctcctc

SEQ ID NO: 5315021 - DNA, 18 bp, Homo sapiens
tctggagcccctcctccc

SEQ ID NO: 5315022 - DNA, 21 bp, Homo sapiens
tctggagccctaaccccttcc

SEQ ID NO: 5315023 - DNA, 12 bp, Homo sapiens
tctggagccctt

SEQ ID NO: 5315024 - DNA, 16 bp, Homo sapiens
tctggagcccttgggt

SEQ ID NO: 5315025 - DNA, 12 bp, Homo sapiens
tctggagcctga

SEQ ID NO: 5315026 - DNA, 16 bp, Homo sapiens
tctggagcctgatgtc

SEQ ID NO: 5315027 - DNA, 12 bp, Homo sapiens
tctggagctgag

SEQ ID NO: 5315028 - DNA, 21 bp, Homo sapiens
tctggagctgctgttccaaca

SEQ ID NO: 5315029 - DNA, 21 bp, Homo sapiens
tctggagctggcactgtggag

SEQ ID NO: 5315030 - DNA, 23 bp, Homo sapiens
tctggagcttaattttctgtgga

SEQ ID NO: 5315031 - DNA, 19 bp, Homo sapiens
tctggaggaaagggaggag

SEQ ID NO: 5315032 - DNA, 13 bp, Homo sapiens
tctggaggaagtt

SEQ ID NO: 5315033 - DNA, 18 bp, Homo sapiens
tctggaggaagttctcca

SEQ ID NO: 5315034 - DNA, 21 bp, Homo sapiens
tctggaggacacacagtctca

SEQ ID NO: 5315035 - DNA, 16 bp, Homo sapiens
tctggaggcctctggc

SEQ ID NO: 5315036 - DNA, 21 bp, Homo sapiens
tctggaggccttccagctgct

SEQ ID NO: 5315037 - DNA, 24 bp, Homo sapiens
tctggaggctgcagagctgaccca

SEQ ID NO: 5315038 - DNA, 13 bp, Homo sapiens
tctggaggctgcg

SEQ ID NO: 5315039 - DNA, 22 bp, Homo sapiens
tctggaggctgcgtcctgagga

SEQ ID NO: 5315040 - DNA, 14 bp, Homo sapiens
tctggaggctggca

SEQ ID NO: 5315041 - DNA, 17 bp, Homo sapiens
tctggaggggagagctt

SEQ ID NO: 5315042 - DNA, 18 bp, Homo sapiens
tctggaggtacgaaaaga

SEQ ID NO: 5315043 - DNA, 17 bp, Homo sapiens
tctggaggtgctgctct

SEQ ID NO: 5315044 - DNA, 18 bp, Homo sapiens
tctggaggtgctgctcta

SEQ ID NO: 5315045 - DNA, 22 bp, Homo sapiens
tctggaggtggggagggcctct

SEQ ID NO: 5315046 - DNA, 19 bp, Homo sapiens
tctggaggttgataacttt

SEQ ID NO: 5315047 - DNA, 16 bp, Homo sapiens
tctggagtcccacccg

SEQ ID NO: 5315048 - DNA, 20 bp, Homo sapiens
tctggagtctgaaggagagg

SEQ ID NO: 5315049 - DNA, 20 bp, Homo sapiens
tctggagtcttcctgtagtg

SEQ ID NO: 5315050 - DNA, 18 bp, Homo sapiens
tctggagtgagaggcccc

SEQ ID NO: 5315051 - DNA, 16 bp, Homo sapiens
tctggagtgagtctgt

SEQ ID NO: 5315052 - DNA, 18 bp, Homo sapiens
tctggagtgatagctact

SEQ ID NO: 5315053 - DNA, 20 bp, Homo sapiens
tctggagtgattctagaggg

SEQ ID NO: 5315054 - DNA, 19 bp, Homo sapiens
tctggagtggccactaagc

SEQ ID NO: 5315055 - DNA, 19 bp, Homo sapiens
tctggagtggtaacagctc

SEQ ID NO: 5315056 - DNA, 13 bp, Homo sapiens
tctggagttccca

SEQ ID NO: 5315057 - DNA, 16 bp, Homo sapiens
tctggagtttcatgtt

SEQ ID NO: 5315058 - DNA, 13 bp, Homo sapiens
tctggagtttctc

SEQ ID NO: 5315059 - DNA, 19 bp, Homo sapiens
tctggataaaccaccctct

SEQ ID NO: 5315060 - DNA, 20 bp, Homo sapiens
tctggataaaccaccctctg

SEQ ID NO: 5315061 - DNA, 22 bp, Homo sapiens
tctggataatttgtataagatg

SEQ ID NO: 5315062 - DNA, 14 bp, Homo sapiens
tctggataggagcc

SEQ ID NO: 5315063 - DNA, 16 bp, Homo sapiens
tctggataggagcctg

SEQ ID NO: 5315064 - DNA, 16 bp, Homo sapiens
tctggatatcaaggtg

SEQ ID NO: 5315065 - DNA, 22 bp, Homo sapiens
tctggatatggtgcaaaaatga

SEQ ID NO: 5315066 - DNA, 15 bp, Homo sapiens
tctggatcagtaaaa

SEQ ID NO: 5315067 - DNA, 15 bp, Homo sapiens
tctggatccctggag

SEQ ID NO: 5315068 - DNA, 22 bp, Homo sapiens
tctggatcctgctgtggcctca

SEQ ID NO: 5315069 - DNA, 16 bp, Homo sapiens
tctggatctagaaggg

SEQ ID NO: 5315070 - DNA, 14 bp, Homo sapiens
tctggatctcctgc

SEQ ID NO: 5315071 - DNA, 21 bp, Homo sapiens
tctggatctgaccctcccagt

SEQ ID NO: 5315072 - DNA, 13 bp, Homo sapiens
tctggatgaaggc

SEQ ID NO: 5315073 - DNA, 19 bp, Homo sapiens
tctggatgcacagatgcca

SEQ ID NO: 5315074 - DNA, 22 bp, Homo sapiens
tctggatgcctgattgccaagc

SEQ ID NO: 5315075 - DNA, 14 bp, Homo sapiens
tctggatgggagga

SEQ ID NO: 5315076 - DNA, 15 bp, Homo sapiens
tctggatgggaggag

SEQ ID NO: 5315077 - DNA, 18 bp, Homo sapiens
tctggatgggaggagagc

SEQ ID NO: 5315078 - DNA, 18 bp, Homo sapiens
tctggatgggcttggcca

SEQ ID NO: 5315079 - DNA, 18 bp, Homo sapiens
tctggattatattatgaa

SEQ ID NO: 5315080 - DNA, 19 bp, Homo sapiens
tctggattattctgggggc

SEQ ID NO: 5315081 - DNA, 16 bp, Homo sapiens
tctggattcagccttc

SEQ ID NO: 5315082 - DNA, 19 bp, Homo sapiens
tctggattcagccttcttt

SEQ ID NO: 5315083 - DNA, 14 bp, Homo sapiens
tctggattccagag

SEQ ID NO: 5315084 - DNA, 22 bp, Homo sapiens
tctggattccagagcactgctc

SEQ ID NO: 5315085 - DNA, 13 bp, Homo sapiens
tctggattcccag

SEQ ID NO: 5315086 - DNA, 22 bp, Homo sapiens
tctggattcccaggatgagcat

SEQ ID NO: 5315087 - DNA, 21 bp, Homo sapiens
tctggattctgaatctcaaga

SEQ ID NO: 5315088 - DNA, 13 bp, Homo sapiens
tctggattgtggt

SEQ ID NO: 5315089 - DNA, 21 bp, Homo sapiens
tctggatttttacaaataaag

SEQ ID NO: 5315090 - DNA, 17 bp, Homo sapiens
tctggcaaacatgtgca

SEQ ID NO: 5315091 - DNA, 21 bp, Homo sapiens
tctggcaaagcttttagaaat

SEQ ID NO: 5315092 - DNA, 14 bp, Homo sapiens
tctggcaaatattt

SEQ ID NO: 5315093 - DNA, 23 bp, Homo sapiens
tctggcaagagactactctgcct

SEQ ID NO: 5315094 - DNA, 15 bp, Homo sapiens
tctggcaagagcaga

SEQ ID NO: 5315095 - DNA, 15 bp, Homo sapiens
tctggcaatattctg

SEQ ID NO: 5315096 - DNA, 18 bp, Homo sapiens
tctggcaatcttgccctt

SEQ ID NO: 5315097 - DNA, 14 bp, Homo sapiens
tctggcaatgccac

SEQ ID NO: 5315098 - DNA, 20 bp, Homo sapiens
tctggcaatgccacagccct

SEQ ID NO: 5315099 - DNA, 22 bp, Homo sapiens
tctggcaatgccacagccctgt

SEQ ID NO: 5315100 - DNA, 23 bp, Homo sapiens
tctggcaatgccacagccctgtc

SEQ ID NO: 5315101 - DNA, 20 bp, Homo sapiens
tctggcacactccctctcct

SEQ ID NO: 5315102 - DNA, 19 bp, Homo sapiens
tctggcaccatcagcctgt

SEQ ID NO: 5315103 - DNA, 18 bp, Homo sapiens
tctggcacgtggccagga

SEQ ID NO: 5315104 - DNA, 19 bp, Homo sapiens
tctggcacgtggccaggag

SEQ ID NO: 5315105 - DNA, 22 bp, Homo sapiens
tctggcacgtggccaggagcca

SEQ ID NO: 5315106 - DNA, 16 bp, Homo sapiens
tctggcacttccattg

SEQ ID NO: 5315107 - DNA, 13 bp, Homo sapiens
tctggcagagcct

SEQ ID NO: 5315108 - DNA, 11 bp, Homo sapiens
tctggcagcca

SEQ ID NO: 5315109 - DNA, 12 bp, Homo sapiens
tctggcagccac

SEQ ID NO: 5315110 - DNA, 21 bp, Homo sapiens
tctggcagccacacttctcag

SEQ ID NO: 5315111 - DNA, 23 bp, Homo sapiens
tctggcagccacacttctcagga

SEQ ID NO: 5315112 - DNA, 15 bp, Homo sapiens
tctggcagggcagca

SEQ ID NO: 5315113 - DNA, 18 bp, Homo sapiens
tctggcaggtcctcccct

SEQ ID NO: 5315114 - DNA, 16 bp, Homo sapiens
tctggcatctcccaca

SEQ ID NO: 5315115 - DNA, 16 bp, Homo sapiens
tctggccaagggccag

SEQ ID NO: 5315116 - DNA, 18 bp, Homo sapiens
tctggccaagggccagac

SEQ ID NO: 5315117 - DNA, 20 bp, Homo sapiens
tctggccaagggccagacag

SEQ ID NO: 5315118 - DNA, 21 bp, Homo sapiens
tctggccaagggccagacaga

SEQ ID NO: 5315119 - DNA, 19 bp, Homo sapiens
tctggccacaatcctcccc

SEQ ID NO: 5315120 - DNA, 21 bp, Homo sapiens
tctggccacaatcctccccac

SEQ ID NO: 5315121 - DNA, 18 bp, Homo sapiens
tctggccacatcagcccc

SEQ ID NO: 5315122 - DNA, 11 bp, Homo sapiens
tctggccaccc

SEQ ID NO: 5315123 - DNA, 21 bp, Homo sapiens
tctggccaccccagagtggga

SEQ ID NO: 5315124 - DNA, 17 bp, Homo sapiens
tctggccaccctggccc

SEQ ID NO: 5315125 - DNA, 13 bp, Homo sapiens
tctggccactctg

SEQ ID NO: 5315126 - DNA, 19 bp, Homo sapiens
tctggccagaaaaggcatt

SEQ ID NO: 5315127 - DNA, 19 bp, Homo sapiens
tctggccagacggcccgcc

SEQ ID NO: 5315128 - DNA, 15 bp, Homo sapiens
tctggccaggagctg

SEQ ID NO: 5315129 - DNA, 21 bp, Homo sapiens
tctggccatatttactacctt

SEQ ID NO: 5315130 - DNA, 15 bp, Homo sapiens
tctggcccaagctgg

SEQ ID NO: 5315131 - DNA, 22 bp, Homo sapiens
tctggcccaagctgggctccct

SEQ ID NO: 5315132 - DNA, 22 bp, Homo sapiens
tctggcccactgtgcagtggag

SEQ ID NO: 5315133 - DNA, 12 bp, Homo sapiens
tctggcccagcc

SEQ ID NO: 5315134 - DNA, 14 bp, Homo sapiens
tctggcccagccat

SEQ ID NO: 5315135 - DNA, 16 bp, Homo sapiens
tctggcccagccatgg

SEQ ID NO: 5315136 - DNA, 13 bp, Homo sapiens
tctggcccagcct

SEQ ID NO: 5315137 - DNA, 11 bp, Homo sapiens
tctggcccagg

SEQ ID NO: 5315138 - DNA, 21 bp, Homo sapiens
tctggcccaggctggccccca

SEQ ID NO: 5315139 - DNA, 22 bp, Homo sapiens
tctggcccgggcatccacgtag

SEQ ID NO: 5315140 - DNA, 9 bp, Homo sapiens
tctggccct

SEQ ID NO: 5315141 - DNA, 11 bp, Homo sapiens
tctggccctat

SEQ ID NO: 5315142 - DNA, 20 bp, Homo sapiens
tctgggtggtaactgccagc

SEQ ID NO: 5315143 - DNA, 21 bp, Homo sapiens
tctgggtggtaactgccagcc

SEQ ID NO: 5315144 - DNA, 13 bp, Homo sapiens
tctgggtgtccgc

SEQ ID NO: 5315145 - DNA, 18 bp, Homo sapiens
tctgggtgttgaccactc

SEQ ID NO: 5315146 - DNA, 22 bp, Homo sapiens
tctgggttccttcctctgagcc

SEQ ID NO: 5315147 - DNA, 20 bp, Homo sapiens
tctgggttgcttatttccct

SEQ ID NO: 5315148 - DNA, 18 bp, Homo sapiens
tctgggtttctaagcagt

SEQ ID NO: 5315149 - DNA, 14 bp, Homo sapiens
tctgggtttctaga

SEQ ID NO: 5315150 - DNA, 17 bp, Homo sapiens
tctgggtttgcccagtc

SEQ ID NO: 5315151 - DNA, 20 bp, Homo sapiens
tctgggtttgcccagtcctg

SEQ ID NO: 5315152 - DNA, 23 bp, Homo sapiens
tctgggtttgcccagtcctgggt

SEQ ID NO: 5315153 - DNA, 16 bp, Homo sapiens
tctgggtttggcaggc

SEQ ID NO: 5315154 - DNA, 22 bp, Homo sapiens
tctgggttttagaaattctata

SEQ ID NO: 5315155 - DNA, 15 bp, Homo sapiens
tctgggttttctgaa

SEQ ID NO: 5315156 - DNA, 18 bp, Homo sapiens
tctgggttttgttggctt

SEQ ID NO: 5315157 - DNA, 18 bp, Homo sapiens
tctgggtttttcttgtgg

SEQ ID NO: 5315158 - DNA, 22 bp, Homo sapiens
tctggtacgaatctcatccctc

SEQ ID NO: 5315159 - DNA, 20 bp, Homo sapiens
tctggtagacacaggataga

SEQ ID NO: 5315160 - DNA, 20 bp, Homo sapiens
tctggtagatttttaacgaa

SEQ ID NO: 5315161 - DNA, 24 bp, Homo sapiens
tctggtagcatgatggctgtagct

SEQ ID NO: 5315162 - DNA, 13 bp, Homo sapiens
tctggtagcctgc

SEQ ID NO: 5315163 - DNA, 20 bp, Homo sapiens
tctggtaggaatagcatgtc

SEQ ID NO: 5315164 - DNA, 23 bp, Homo sapiens
tctggtagggatatggcaggact

SEQ ID NO: 5315165 - DNA, 14 bp, Homo sapiens
tctggtatacattg

SEQ ID NO: 5315166 - DNA, 17 bp, Homo sapiens
tctggtattaaatgcca

SEQ ID NO: 5315167 - DNA, 14 bp, Homo sapiens
tctggtatttcccc

SEQ ID NO: 5315168 - DNA, 18 bp, Homo sapiens
tctggtcaggcccactgc

SEQ ID NO: 5315169 - DNA, 22 bp, Homo sapiens
tctggtcagtgaagcccaggag

SEQ ID NO: 5315170 - DNA, 18 bp, Homo sapiens
tctggtcatttcccccaa

SEQ ID NO: 5315171 - DNA, 16 bp, Homo sapiens
tctggtccacacacca

SEQ ID NO: 5315172 - DNA, 21 bp, Homo sapiens
tctggtcccctgtggtgatgt

SEQ ID NO: 5315173 - DNA, 21 bp, Homo sapiens
tctggtccctcttctctcctc

SEQ ID NO: 5315174 - DNA, 22 bp, Homo sapiens
tctggtccctcttctctcctca

SEQ ID NO: 5315175 - DNA, 16 bp, Homo sapiens
tctggtcctcggagct

SEQ ID NO: 5315176 - DNA, 16 bp, Homo sapiens
tctggtcctgttttct

SEQ ID NO: 5315177 - DNA, 22 bp, Homo sapiens
tctggtccttagtaaattccta

SEQ ID NO: 5315178 - DNA, 19 bp, Homo sapiens
tctggtctactctagaaga

SEQ ID NO: 5315179 - DNA, 20 bp, Homo sapiens
tctggtctataccttaagaa

SEQ ID NO: 5315180 - DNA, 13 bp, Homo sapiens
tctggtctatata

SEQ ID NO: 5315181 - DNA, 17 bp, Homo sapiens
tctggtctcctctttgt

SEQ ID NO: 5315182 - DNA, 18 bp, Homo sapiens
tctggtctcgtgttcgct

SEQ ID NO: 5315183 - DNA, 15 bp, Homo sapiens
tctggtctctctatt

SEQ ID NO: 5315184 - DNA, 14 bp, Homo sapiens
tctggtctgggtgc

SEQ ID NO: 5315185 - DNA, 12 bp, Homo sapiens
tctggtctgtgt

SEQ ID NO: 5315186 - DNA, 16 bp, Homo sapiens
tctggtcttccaggca

SEQ ID NO: 5315187 - DNA, 18 bp, Homo sapiens
tctggtgacaccagcctt

SEQ ID NO: 5315188 - DNA, 23 bp, Homo sapiens
tctggtgactttcctctttggtc

SEQ ID NO: 5315189 - DNA, 22 bp, Homo sapiens
tctggtgagcgaggacattctc

SEQ ID NO: 5315190 - DNA, 17 bp, Homo sapiens
tctggtgaggtggccca

SEQ ID NO: 5315191 - DNA, 21 bp, Homo sapiens
tctggtgaggtggcccaggcc

SEQ ID NO: 5315192 - DNA, 17 bp, Homo sapiens
tctggtgagtcaccact

SEQ ID NO: 5315193 - DNA, 21 bp, Homo sapiens
tctggtgagtgcaagagcctg

SEQ ID NO: 5315194 - DNA, 16 bp, Homo sapiens
tctggtgataaggaca

SEQ ID NO: 5315195 - DNA, 17 bp, Homo sapiens
tctggtgatctcccaag

SEQ ID NO: 5315196 - DNA, 19 bp, Homo sapiens
tctggtgcacgcctgagcg

SEQ ID NO: 5315197 - DNA, 20 bp, Homo sapiens
tctggtgcacgcctgagcgt

SEQ ID NO: 5315198 - DNA, 18 bp, Homo sapiens
tctggtgcagaatatgac

SEQ ID NO: 5315199 - DNA, 16 bp, Homo sapiens
tctggtgcctccagag

SEQ ID NO: 5315200 - DNA, 20 bp, Homo sapiens
tctggtgcctttccacacag

SEQ ID NO: 5315201 - DNA, 17 bp, Homo sapiens
tctggtgctcctgcatc

SEQ ID NO: 5315202 - DNA, 12 bp, Homo sapiens
tctggtgctgct

SEQ ID NO: 5315203 - DNA, 14 bp, Homo sapiens
tctggtgctgctgg

SEQ ID NO: 5315204 - DNA, 15 bp, Homo sapiens
tctggtgctgctggg

SEQ ID NO: 5315205 - DNA, 23 bp, Homo sapiens
tctggtggaggagctgagggagg

SEQ ID NO: 5315206 - DNA, 20 bp, Homo sapiens
tctggtggcagtaacatgca

SEQ ID NO: 5315207 - DNA, 14 bp, Homo sapiens
tctggtggccactg

SEQ ID NO: 5315208 - DNA, 19 bp, Homo sapiens
tctggtggccactgagctg

SEQ ID NO: 5315209 - DNA, 20 bp, Homo sapiens
tctggtggccactgagctgg

SEQ ID NO: 5315210 - DNA, 21 bp, Homo sapiens
tctggtggccactgagctggc

SEQ ID NO: 5315211 - DNA, 23 bp, Homo sapiens
tctggtggccactgagctggctg

SEQ ID NO: 5315212 - DNA, 14 bp, Homo sapiens
tctggtggcccctt

SEQ ID NO: 5315213 - DNA, 14 bp, Homo sapiens
tctggtggctgcca

SEQ ID NO: 5315214 - DNA, 17 bp, Homo sapiens
tctggtgggaggcccgg

SEQ ID NO: 5315215 - DNA, 21 bp, Homo sapiens
tctggtgggaggcccggggcc

SEQ ID NO: 5315216 - DNA, 19 bp, Homo sapiens
tctggtggggctgtcctgc

SEQ ID NO: 5315217 - DNA, 12 bp, Homo sapiens
tctggtgggggc

SEQ ID NO: 5315218 - DNA, 23 bp, Homo sapiens
tctggtggggtgtgttccaactg

SEQ ID NO: 5315219 - DNA, 14 bp, Homo sapiens
tctggtggtggcct

SEQ ID NO: 5315220 - DNA, 14 bp, Homo sapiens
tctggtggttattt

SEQ ID NO: 5315221 - DNA, 17 bp, Homo sapiens
tctggtggtttgattgt

SEQ ID NO: 5315222 - DNA, 16 bp, Homo sapiens
tctggtgtagctcctc

SEQ ID NO: 5315223 - DNA, 21 bp, Homo sapiens
tctggtgtagctcctctgctg

SEQ ID NO: 5315224 - DNA, 16 bp, Homo sapiens
tctggtgtaggaagtt

SEQ ID NO: 5315225 - DNA, 19 bp, Homo sapiens
tctggtgtatattttaatg

SEQ ID NO: 5315226 - DNA, 16 bp, Homo sapiens
tctggtgttctcaatg

SEQ ID NO: 5315227 - DNA, 21 bp, Homo sapiens
tctggtgttctcaatgctttt

SEQ ID NO: 5315228 - DNA, 15 bp, Homo sapiens
tctggtgttctgagt

SEQ ID NO: 5315229 - DNA, 17 bp, Homo sapiens
tctggtgtttgtcatgg

SEQ ID NO: 5315230 - DNA, 21 bp, Homo sapiens
tctggtgtttgtcatggtgaa

SEQ ID NO: 5315231 - DNA, 15 bp, Homo sapiens
tctggttagctcagc

SEQ ID NO: 5315232 - DNA, 16 bp, Homo sapiens
tctggttagctcagcc

SEQ ID NO: 5315233 - DNA, 13 bp, Homo sapiens
tctggttccaaac

SEQ ID NO: 5315234 - DNA, 17 bp, Homo sapiens
tctggttccaaaccagt

SEQ ID NO: 5315235 - DNA, 17 bp, Homo sapiens
tctggttccactcagct

SEQ ID NO: 5315236 - DNA, 14 bp, Homo sapiens
tctggttccagggt

SEQ ID NO: 5315237 - DNA, 23 bp, Homo sapiens
tctggttccagggtccctctgtg

SEQ ID NO: 5315238 - DNA, 17 bp, Homo sapiens
tctggttccctgctgcg

SEQ ID NO: 5315239 - DNA, 20 bp, Homo sapiens
tctggttcctcccctcctcc

SEQ ID NO: 5315240 - DNA, 21 bp, Homo sapiens
tctggttcctcccctcctcct

SEQ ID NO: 5315241 - DNA, 11 bp, Homo sapiens
tctggttctaa

SEQ ID NO: 5315242 - DNA, 12 bp, Homo sapiens
tctggttctata

SEQ ID NO: 5315243 - DNA, 20 bp, Homo sapiens
tctggttctcaattccaaca

SEQ ID NO: 5315244 - DNA, 15 bp, Homo sapiens
tctggttctgacact

SEQ ID NO: 5315245 - DNA, 14 bp, Homo sapiens
tctggttctgtgtc

SEQ ID NO: 5315246 - DNA, 17 bp, Homo sapiens
tctggttctgtgtcctc

SEQ ID NO: 5315247 - DNA, 20 bp, Homo sapiens
tctggttgtttctgttccaa

SEQ ID NO: 5315248 - DNA, 23 bp, Homo sapiens
tctggttgtttttgttctttgtg

SEQ ID NO: 5315249 - DNA, 17 bp, Homo sapiens
tctggtttagtgttctg

SEQ ID NO: 5315250 - DNA, 16 bp, Homo sapiens
tctggtttctgtcccc

SEQ ID NO: 5315251 - DNA, 17 bp, Homo sapiens
tctggtttctgtccccg

SEQ ID NO: 5315252 - DNA, 13 bp, Homo sapiens
tctggtttggcat

SEQ ID NO: 5315253 - DNA, 13 bp, Homo sapiens
tctggtttggggc

SEQ ID NO: 5315254 - DNA, 23 bp, Homo sapiens
tctggtttggggcgaggcagagg

SEQ ID NO: 5315255 - DNA, 23 bp, Homo sapiens
tctggttttctagcccctctgga

SEQ ID NO: 5315256 - DNA, 14 bp, Homo sapiens
tctggttttgctat

SEQ ID NO: 5315257 - DNA, 14 bp, Homo sapiens
tctgtaaaacacac

SEQ ID NO: 5315258 - DNA, 14 bp, Homo sapiens
tctgtaaaaccagg

SEQ ID NO: 5315259 - DNA, 15 bp, Homo sapiens
tctgtaaaaccaggc

SEQ ID NO: 5315260 - DNA, 17 bp, Homo sapiens
tctgtaaaaccaggctg

SEQ ID NO: 5315261 - DNA, 21 bp, Homo sapiens
tctgtaaaactaagaaactta

SEQ ID NO: 5315262 - DNA, 14 bp, Homo sapiens
tctgtaaaagtgtc

SEQ ID NO: 5315263 - DNA, 13 bp, Homo sapiens
tctgtaaaagtta

SEQ ID NO: 5315264 - DNA, 18 bp, Homo sapiens
tctgtaaaagttactaat

SEQ ID NO: 5315265 - DNA, 21 bp, Homo sapiens
tctgtaaaagttactaatata

SEQ ID NO: 5315266 - DNA, 11 bp, Homo sapiens
tctgtaaaatc

SEQ ID NO: 5315267 - DNA, 17 bp, Homo sapiens
tctgtaaacagaataaa

SEQ ID NO: 5315268 - DNA, 12 bp, Homo sapiens
tctgtaaactgt

SEQ ID NO: 5315269 - DNA, 14 bp, Homo sapiens
tctgtaaactgtgt

SEQ ID NO: 5315270 - DNA, 16 bp, Homo sapiens
tctgtaaactgtgtat

SEQ ID NO: 5315271 - DNA, 19 bp, Homo sapiens
tctgtaaactgtgtattcc

SEQ ID NO: 5315272 - DNA, 14 bp, Homo sapiens
tctgtaaagaaaac

SEQ ID NO: 5315273 - DNA, 12 bp, Homo sapiens
tctgtaaataac

SEQ ID NO: 5315274 - DNA, 12 bp, Homo sapiens
tctgtaaatatg

SEQ ID NO: 5315275 - DNA, 16 bp, Homo sapiens
tctgtaaatctacaca

SEQ ID NO: 5315276 - DNA, 20 bp, Homo sapiens
tctgtaaatttggactgttt

SEQ ID NO: 5315277 - DNA, 23 bp, Homo sapiens
tctgtaacatcactatccatgca

SEQ ID NO: 5315278 - DNA, 22 bp, Homo sapiens
tctgtaactctaaaagatcctt

SEQ ID NO: 5315279 - DNA, 15 bp, Homo sapiens
tctgtaactgcccag

SEQ ID NO: 5315280 - DNA, 20 bp, Homo sapiens
tctgtaagaaacctactgcc

SEQ ID NO: 5315281 - DNA, 22 bp, Homo sapiens
tctgtaagaaacctactgccca

SEQ ID NO: 5315282 - DNA, 15 bp, Homo sapiens
tctgtaagacaacat

SEQ ID NO: 5315283 - DNA, 15 bp, Homo sapiens
tctgtaagagaaaat

SEQ ID NO: 5315284 - DNA, 17 bp, Homo sapiens
tctgtaagagaaaatat

SEQ ID NO: 5315285 - DNA, 19 bp, Homo sapiens
tctgtaagagaaaatatta

SEQ ID NO: 5315286 - DNA, 23 bp, Homo sapiens
tctgtaagagaaaatattactta

SEQ ID NO: 5315287 - DNA, 20 bp, Homo sapiens
tctgtaagagcttgctccag

SEQ ID NO: 5315288 - DNA, 20 bp, Homo sapiens
tctgtaagaggtactaaaaa

SEQ ID NO: 5315289 - DNA, 17 bp, Homo sapiens
tctgtaagatatcccag

SEQ ID NO: 5315290 - DNA, 20 bp, Homo sapiens
tctgtaagcggtggtttgta

SEQ ID NO: 5315291 - DNA, 21 bp, Homo sapiens
tctgtaagctctttgaaacaa

SEQ ID NO: 5315292 - DNA, 23 bp, Homo sapiens
tctgtaagctgtttggttttaaa

SEQ ID NO: 5315293 - DNA, 18 bp, Homo sapiens
tctgtaaggaactggaac

SEQ ID NO: 5315294 - DNA, 13 bp, Homo sapiens
tctgtaaggtctt

SEQ ID NO: 5315295 - DNA, 17 bp, Homo sapiens
tctgtaagtgtagctca

SEQ ID NO: 5315296 - DNA, 23 bp, Homo sapiens
tctgtaataaactcatttctagc

SEQ ID NO: 5315297 - DNA, 24 bp, Homo sapiens
tctgtaataaactcatttctagca

SEQ ID NO: 5315298 - DNA, 12 bp, Homo sapiens
tctgtaataata

SEQ ID NO: 5315299 - DNA, 16 bp, Homo sapiens
tctgtaatatattgcc

SEQ ID NO: 5315300 - DNA, 17 bp, Homo sapiens
tctgtaatatttacaat

SEQ ID NO: 5315301 - DNA, 18 bp, Homo sapiens
tctgtaatatttacaatg

SEQ ID NO: 5315302 - DNA, 23 bp, Homo sapiens
tctgtaatcacactctcttctta

SEQ ID NO: 5315303 - DNA, 15 bp, Homo sapiens
tctgtaatcccagca

SEQ ID NO: 5315304 - DNA, 13 bp, Homo sapiens
tctgtaatgatac

SEQ ID NO: 5315305 - DNA, 13 bp, Homo sapiens
tctgtaatgtaaa

SEQ ID NO: 5315306 - DNA, 14 bp, Homo sapiens
tctgtaatgtaaat

SEQ ID NO: 5315307 - DNA, 16 bp, Homo sapiens
tctgtaatgtaaataa

SEQ ID NO: 5315308 - DNA, 22 bp, Homo sapiens
tctgtaatgtaaataaactatt

SEQ ID NO: 5315309 - DNA, 21 bp, Homo sapiens
tctgtaattacatatttgact

SEQ ID NO: 5315310 - DNA, 17 bp, Homo sapiens
tctgtaattgataatag

SEQ ID NO: 5315311 - DNA, 17 bp, Homo sapiens
tctgtaattgtgtgtga

SEQ ID NO: 5315312 - DNA, 14 bp, Homo sapiens
tctgtaatttgaat

SEQ ID NO: 5315313 - DNA, 14 bp, Homo sapiens
tctgtaattttacg

SEQ ID NO: 5315314 - DNA, 15 bp, Homo sapiens
tctgtacaaaaacaa

SEQ ID NO: 5315315 - DNA, 23 bp, Homo sapiens
tctgtacaaaggggaaagaacat

SEQ ID NO: 5315316 - DNA, 20 bp, Homo sapiens
tctgtacaaataatagcaat

SEQ ID NO: 5315317 - DNA, 14 bp, Homo sapiens
tctgtacactgccc

SEQ ID NO: 5315318 - DNA, 16 bp, Homo sapiens
tctgtacagaatgcta

SEQ ID NO: 5315319 - DNA, 16 bp, Homo sapiens
tctgtgaacttgatgt

SEQ ID NO: 5315320 - DNA, 20 bp, Homo sapiens
tctgtgaagaatgaagtgga

SEQ ID NO: 5315321 - DNA, 20 bp, Homo sapiens
tctgtgaagaggaacagtgt

SEQ ID NO: 5315322 - DNA, 22 bp, Homo sapiens
tctgtgaagaggaacagtgtgg

SEQ ID NO: 5315323 - DNA, 13 bp, Homo sapiens
tctgtgaagctaa

SEQ ID NO: 5315324 - DNA, 14 bp, Homo sapiens
tctgtgaagctaat

SEQ ID NO: 5315325 - DNA, 20 bp, Homo sapiens
tctgtgaaggacttggtgat

SEQ ID NO: 5315326 - DNA, 20 bp, Homo sapiens
tctgtgaagtagttctgttt

SEQ ID NO: 5315327 - DNA, 19 bp, Homo sapiens
tctgtgaagtgagaccttc

SEQ ID NO: 5315328 - DNA, 12 bp, Homo sapiens
tctgtgaataca

SEQ ID NO: 5315329 - DNA, 16 bp, Homo sapiens
tctgtgaatacaatta

SEQ ID NO: 5315330 - DNA, 19 bp, Homo sapiens
tctgtgaatacaattaaag

SEQ ID NO: 5315331 - DNA, 21 bp, Homo sapiens
tctgtgaatacaattaaaggt

SEQ ID NO: 5315332 - DNA, 22 bp, Homo sapiens
tctgtgaatacaattaaaggtc

SEQ ID NO: 5315333 - DNA, 14 bp, Homo sapiens
tctgtgaatagcag

SEQ ID NO: 5315334 - DNA, 17 bp, Homo sapiens
tctgtgaatagcagtgg

SEQ ID NO: 5315335 - DNA, 21 bp, Homo sapiens
tctgtgaatagcagtggcaaa

SEQ ID NO: 5315336 - DNA, 22 bp, Homo sapiens
tctgtgaatagcagtggcaaaa

SEQ ID NO: 5315337 - DNA, 19 bp, Homo sapiens
tctgtgaatctgctttaat

SEQ ID NO: 5315338 - DNA, 13 bp, Homo sapiens
tctgtgaattaaa

SEQ ID NO: 5315339 - DNA, 15 bp, Homo sapiens
tctgtgaattcagat

SEQ ID NO: 5315340 - DNA, 18 bp, Homo sapiens
tctgtgaattgagctgca

SEQ ID NO: 5315341 - DNA, 15 bp, Homo sapiens
tctgtgaattgcctg

SEQ ID NO: 5315342 - DNA, 15 bp, Homo sapiens
tctgtgaccaaaata

SEQ ID NO: 5315343 - DNA, 20 bp, Homo sapiens
tctgtgaccaaaataccttg

SEQ ID NO: 5315344 - DNA, 17 bp, Homo sapiens
tctgtgaccaactgttg

SEQ ID NO: 5315345 - DNA, 17 bp, Homo sapiens
tctgtgacccctccttg

SEQ ID NO: 5315346 - DNA, 20 bp, Homo sapiens
tctgtgacccctccttgtca

SEQ ID NO: 5315347 - DNA, 13 bp, Homo sapiens
tctgtgacctcag

SEQ ID NO: 5315348 - DNA, 23 bp, Homo sapiens
tctgtgacctcaggcactagcct

SEQ ID NO: 5315349 - DNA, 20 bp, Homo sapiens
tctgtgacctgtcagaataa

SEQ ID NO: 5315350 - DNA, 14 bp, Homo sapiens
tctgtgactataaa

SEQ ID NO: 5315351 - DNA, 18 bp, Homo sapiens
tctgtgactcgcttagct

SEQ ID NO: 5315352 - DNA, 11 bp, Homo sapiens
tctgtgactgg

SEQ ID NO: 5315353 - DNA, 13 bp, Homo sapiens
tctgtgagaagtt

SEQ ID NO: 5315354 - DNA, 21 bp, Homo sapiens
tctgtgagactcgagaacttt

SEQ ID NO: 5315355 - DNA, 12 bp, Homo sapiens
tctgtgagattc

SEQ ID NO: 5315356 - DNA, 17 bp, Homo sapiens
tctgtgagccccacagc

SEQ ID NO: 5315357 - DNA, 17 bp, Homo sapiens
tctgtgaggaaagcaca

SEQ ID NO: 5315358 - DNA, 14 bp, Homo sapiens
tctgtgagtctgtc

SEQ ID NO: 5315359 - DNA, 22 bp, Homo sapiens
tctgtgagtctgtcctttccca

SEQ ID NO: 5315360 - DNA, 19 bp, Homo sapiens
tctgtgagtgcgtctgagg

SEQ ID NO: 5315361 - DNA, 18 bp, Homo sapiens
tctgtgagttctgttgtg

SEQ ID NO: 5315362 - DNA, 16 bp, Homo sapiens
tctgtgatccttggtg

SEQ ID NO: 5315363 - DNA, 14 bp, Homo sapiens
tctgtgatctctgc

SEQ ID NO: 5315364 - DNA, 15 bp, Homo sapiens
tctgtgatctctgct

SEQ ID NO: 5315365 - DNA, 15 bp, Homo sapiens
tctgtgatcttttaa

SEQ ID NO: 5315366 - DNA, 15 bp, Homo sapiens
tctgtgatgctccca

SEQ ID NO: 5315367 - DNA, 23 bp, Homo sapiens
tctgtgattaaagcagtaatatt

SEQ ID NO: 5315368 - DNA, 17 bp, Homo sapiens
tctgtgattacatagat

SEQ ID NO: 5315369 - DNA, 14 bp, Homo sapiens
tctgtgattatttg

SEQ ID NO: 5315370 - DNA, 22 bp, Homo sapiens
tctgtgattgccatttcttccc

SEQ ID NO: 5315371 - DNA, 13 bp, Homo sapiens
tctgtgattggct

SEQ ID NO: 5315372 - DNA, 14 bp, Homo sapiens
tctgtgattggctg

SEQ ID NO: 5315373 - DNA, 12 bp, Homo sapiens
tctgtgcaaaca

SEQ ID NO: 5315374 - DNA, 12 bp, Homo sapiens
tctgtgcaataa

SEQ ID NO: 5315375 - DNA, 17 bp, Homo sapiens
tctgtgcaatggaatat

SEQ ID NO: 5315376 - DNA, 16 bp, Homo sapiens
tctgtgcacactaaga

SEQ ID NO: 5315377 - DNA, 18 bp, Homo sapiens
tctgtgcacactaagaaa

SEQ ID NO: 5315378 - DNA, 19 bp, Homo sapiens
tctgtgcacactaagaaat

SEQ ID NO: 5315379 - DNA, 17 bp, Homo sapiens
tctgtgcacagtggctt

SEQ ID NO: 5315380 - DNA, 12 bp, Homo sapiens
tctgtgcacatg

SEQ ID NO: 5315381 - DNA, 14 bp, Homo sapiens
tctgtgcacatgcc

SEQ ID NO: 5315382 - DNA, 17 bp, Homo sapiens
tctgtgcacatgcctct

SEQ ID NO: 5315383 - DNA, 21 bp, Homo sapiens
tctgtgcacgcagtggccttc

SEQ ID NO: 5315384 - DNA, 17 bp, Homo sapiens
tctgtgcactagcctgt

SEQ ID NO: 5315385 - DNA, 20 bp, Homo sapiens
tctgtgcactagcctgtgat

SEQ ID NO: 5315386 - DNA, 21 bp, Homo sapiens
tctgtgcactagcctgtgatt

SEQ ID NO: 5315387 - DNA, 21 bp, Homo sapiens
tctgtgcaggatatttgcact

SEQ ID NO: 5315388 - DNA, 21 bp, Homo sapiens
tctgtgcaggctgcagtggct

SEQ ID NO: 5315389 - DNA, 18 bp, Homo sapiens
tctgtgcagggctggttt

SEQ ID NO: 5315390 - DNA, 18 bp, Homo sapiens
tctgtgcaggtgctgcct

SEQ ID NO: 5315391 - DNA, 15 bp, Homo sapiens
tctgtgcatctggcc

SEQ ID NO: 5315392 - DNA, 17 bp, Homo sapiens
tctgtgcatctggcctg

SEQ ID NO: 5315393 - DNA, 13 bp, Homo sapiens
tctgtgcatgtgc

SEQ ID NO: 5315394 - DNA, 17 bp, Homo sapiens
tctgtgcattcatgcaa

SEQ ID NO: 5315395 - DNA, 16 bp, Homo sapiens
tctgtgcattgtggct

SEQ ID NO: 5315396 - DNA, 18 bp, Homo sapiens
tctgtgcatttgtgtctg

SEQ ID NO: 5315397 - DNA, 22 bp, Homo sapiens
tctgtgcatttgtgtctgcctg

SEQ ID NO: 5315398 - DNA, 23 bp, Homo sapiens
tctgtgcatttgtgtctgcctgc

SEQ ID NO: 5315399 - DNA, 18 bp, Homo sapiens
tctgtgccaaagcagcta

SEQ ID NO: 5315400 - DNA, 16 bp, Homo sapiens
tctgtgccacgctcct

SEQ ID NO: 5315401 - DNA, 16 bp, Homo sapiens
tctgtgccagaaacag

SEQ ID NO: 5315402 - DNA, 15 bp, Homo sapiens
tctgtgccagagcct

SEQ ID NO: 5315403 - DNA, 23 bp, Homo sapiens
tctgtgccagctctataattgtt

SEQ ID NO: 5315404 - DNA, 12 bp, Homo sapiens
tctgtgcccagc

SEQ ID NO: 5315405 - DNA, 22 bp, Homo sapiens
tctgtgcccatgggcactgctg

SEQ ID NO: 5315406 - DNA, 14 bp, Homo sapiens
tctgtgccccatgc

SEQ ID NO: 5315407 - DNA, 22 bp, Homo sapiens
tctgtgccccatgcctgtccag

SEQ ID NO: 5315408 - DNA, 20 bp, Homo sapiens
tctgtgccccttccgccact

SEQ ID NO: 5315409 - DNA, 15 bp, Homo sapiens
tctgtgccctcctga

SEQ ID NO: 5315410 - DNA, 13 bp, Homo sapiens
tctgtgcctaata

SEQ ID NO: 5315411 - DNA, 19 bp, Homo sapiens
tctgtgcctaataaagtct

SEQ ID NO: 5315412 - DNA, 12 bp, Homo sapiens
tctgtgcctccc

SEQ ID NO: 5315413 - DNA, 14 bp, Homo sapiens
tctgtgcctccccc

SEQ ID NO: 5315414 - DNA, 21 bp, Homo sapiens
tctgtgcctccccccagaccc

SEQ ID NO: 5315415 - DNA, 20 bp, Homo sapiens
tctgtgcctccctccccagt

SEQ ID NO: 5315416 - DNA, 23 bp, Homo sapiens
tctgtgcctgggatcagtggggc

SEQ ID NO: 5315417 - DNA, 15 bp, Homo sapiens
tctgtgcctgtctgt

SEQ ID NO: 5315418 - DNA, 16 bp, Homo sapiens
tctgtgccttcgtctt

SEQ ID NO: 5315419 - DNA, 15 bp, Homo sapiens
tctgtgccttggtct

SEQ ID NO: 5315420 - DNA, 14 bp, Homo sapiens
tctgtgcctttcta

SEQ ID NO: 5315421 - DNA, 16 bp, Homo sapiens
tctgtgcgtgaaacac

SEQ ID NO: 5315422 - DNA, 17 bp, Homo sapiens
tctgtgctaagttgtct

SEQ ID NO: 5315423 - DNA, 12 bp, Homo sapiens
tctgtgctccct

SEQ ID NO: 5315424 - DNA, 16 bp, Homo sapiens
tctgtgctccctcggt

SEQ ID NO: 5315425 - DNA, 19 bp, Homo sapiens
tctgtgctgaccctcctgt

SEQ ID NO: 5315426 - DNA, 15 bp, Homo sapiens
tctgtgctggccatg

SEQ ID NO: 5315427 - DNA, 14 bp, Homo sapiens
tctgtgctgtgcct

SEQ ID NO: 5315428 - DNA, 15 bp, Homo sapiens
tctgtgctgtgcctg

SEQ ID NO: 5315429 - DNA, 12 bp, Homo sapiens
tctgtgctgtgt

SEQ ID NO: 5315430 - DNA, 13 bp, Homo sapiens
tctgtgctgtgtg

SEQ ID NO: 5315431 - DNA, 19 bp, Homo sapiens
tctgtgctgtgtggaacca

SEQ ID NO: 5315432 - DNA, 21 bp, Homo sapiens
tctgtgcttcgactactgctc

SEQ ID NO: 5315433 - DNA, 14 bp, Homo sapiens
tctgtgctttccag

SEQ ID NO: 5315434 - DNA, 17 bp, Homo sapiens
tctgtgctttccagctc

SEQ ID NO: 5315435 - DNA, 20 bp, Homo sapiens
tctgtgctttgactcacctg

SEQ ID NO: 5315436 - DNA, 21 bp, Homo sapiens
tctgtggaaaaataaaggaaa

SEQ ID NO: 5315437 - DNA, 15 bp, Homo sapiens
tctgtggaaagtgta

SEQ ID NO: 5315438 - DNA, 18 bp, Homo sapiens
tctgtggacaccactgag

SEQ ID NO: 5315439 - DNA, 13 bp, Homo sapiens
tctgtggaccctc

SEQ ID NO: 5315440 - DNA, 22 bp, Homo sapiens
tctgtggagagtgagaataatt

SEQ ID NO: 5315441 - DNA, 12 bp, Homo sapiens
tctgtggagatg

SEQ ID NO: 5315442 - DNA, 18 bp, Homo sapiens
tctgtggagcgtccttgt

SEQ ID NO: 5315443 - DNA, 23 bp, Homo sapiens
tctgtggagctgccacagagaag

SEQ ID NO: 5315444 - DNA, 20 bp, Homo sapiens
tctgtggagggagggcagct

SEQ ID NO: 5315445 - DNA, 17 bp, Homo sapiens
tctgtggagttcctgct

SEQ ID NO: 5315446 - DNA, 17 bp, Homo sapiens
tctgtggatacagtgcc

SEQ ID NO: 5315447 - DNA, 21 bp, Homo sapiens
tctgtggatacagtgcccacc

SEQ ID NO: 5315448 - DNA, 19 bp, Homo sapiens
tctgtggatgccagggccg

SEQ ID NO: 5315449 - DNA, 18 bp, Homo sapiens
tctgtggatggtcattgc

SEQ ID NO: 5315450 - DNA, 21 bp, Homo sapiens
tctgtggattcagcttctgtt

SEQ ID NO: 5315451 - DNA, 15 bp, Homo sapiens
tctgtggattctata

SEQ ID NO: 5315452 - DNA, 12 bp, Homo sapiens
tctgtggcaaaa

SEQ ID NO: 5315453 - DNA, 16 bp, Homo sapiens
tctgtggccagcctgg

SEQ ID NO: 5315454 - DNA, 17 bp, Homo sapiens
tctgtggccagcctggc

SEQ ID NO: 5315455 - DNA, 14 bp, Homo sapiens
tctgtggccagctg

SEQ ID NO: 5315456 - DNA, 15 bp, Homo sapiens
tctgtggccagctgc

SEQ ID NO: 5315457 - DNA, 14 bp, Homo sapiens
tctgtggccctctc

SEQ ID NO: 5315458 - DNA, 15 bp, Homo sapiens
tctgtggccctctct

SEQ ID NO: 5315459 - DNA, 18 bp, Homo sapiens
tctgtggccgccatctgc

SEQ ID NO: 5315460 - DNA, 22 bp, Homo sapiens
tctgtggcctgtgtccagcagc

SEQ ID NO: 5315461 - DNA, 17 bp, Homo sapiens
tctgtggctgatttact

SEQ ID NO: 5315462 - DNA, 15 bp, Homo sapiens
tctgtggctgccatc

SEQ ID NO: 5315463 - DNA, 21 bp, Homo sapiens
tctgtggcttcccatgtcttt

SEQ ID NO: 5315464 - DNA, 22 bp, Homo sapiens
tctgtggctttttgttcagaat

SEQ ID NO: 5315465 - DNA, 17 bp, Homo sapiens
tctgtgggaaaaaagaa

SEQ ID NO: 5315466 - DNA, 18 bp, Homo sapiens
tctgtgggaaaaaagaaa

SEQ ID NO: 5315467 - DNA, 13 bp, Homo sapiens
tctgtgggactgg

SEQ ID NO: 5315468 - DNA, 17 bp, Homo sapiens
tctgtgggactggccca

SEQ ID NO: 5315469 - DNA, 14 bp, Homo sapiens
tctgtgggagctca

SEQ ID NO: 5315470 - DNA, 23 bp, Homo sapiens
tctgtgggatgctgaaggagatg

SEQ ID NO: 5315471 - DNA, 17 bp, Homo sapiens
tctgtgggcactggtgg

SEQ ID NO: 5315472 - DNA, 15 bp, Homo sapiens
tctgtgggcagctgg

SEQ ID NO: 5315473 - DNA, 17 bp, Homo sapiens
tctgtgggcccctcaac

SEQ ID NO: 5315474 - DNA, 18 bp, Homo sapiens
tctgtgggcccctcaaca

SEQ ID NO: 5315475 - DNA, 16 bp, Homo sapiens
tctgtgggccctaccc

SEQ ID NO: 5315476 - DNA, 20 bp, Homo sapiens
tctgtgggctacatgctggg

SEQ ID NO: 5315477 - DNA, 12 bp, Homo sapiens
tctgtgggctgc

SEQ ID NO: 5315478 - DNA, 21 bp, Homo sapiens
tctgtgggctgcactctgtgc

SEQ ID NO: 5315479 - DNA, 15 bp, Homo sapiens
tctgtgggcttcagc

SEQ ID NO: 5315480 - DNA, 17 bp, Homo sapiens
tctgtgggcttggcctt

SEQ ID NO: 5315481 - DNA, 18 bp, Homo sapiens
tctgtgggcttggccttg

SEQ ID NO: 5315482 - DNA, 14 bp, Homo sapiens
tctgtggggccaca

SEQ ID NO: 5315483 - DNA, 18 bp, Homo sapiens
tctgtggtcacccatgca

SEQ ID NO: 5315484 - DNA, 18 bp, Homo sapiens
tctgtggtccagaagaaa

SEQ ID NO: 5315485 - DNA, 16 bp, Homo sapiens
tctgtggtccagagtc

SEQ ID NO: 5315486 - DNA, 13 bp, Homo sapiens
tctgtggtccctt

SEQ ID NO: 5315487 - DNA, 20 bp, Homo sapiens
tctgtggtggttcattccac

SEQ ID NO: 5315488 - DNA, 21 bp, Homo sapiens
tctgtggtggttcattccaca

SEQ ID NO: 5315489 - DNA, 16 bp, Homo sapiens
tctgtggtgtatgtat

SEQ ID NO: 5315490 - DNA, 17 bp, Homo sapiens
tctgtggtgtctgcctg

SEQ ID NO: 5315491 - DNA, 19 bp, Homo sapiens
tctgtggttctataataag

SEQ ID NO: 5315492 - DNA, 13 bp, Homo sapiens
tctgtggttggct

SEQ ID NO: 5315493 - DNA, 14 bp, Homo sapiens
tctgtggttggctg

SEQ ID NO: 5315494 - DNA, 20 bp, Homo sapiens
tctgtggttttcccctccct

SEQ ID NO: 5315495 - DNA, 15 bp, Homo sapiens
tctgtgtaaaatgag

SEQ ID NO: 5315496 - DNA, 14 bp, Homo sapiens
tctgtgtaaacaga

SEQ ID NO: 5315497 - DNA, 22 bp, Homo sapiens
tctgtgtaacatccaagccaga

SEQ ID NO: 5315498 - DNA, 16 bp, Homo sapiens
tcttaacgaataaagg

SEQ ID NO: 5315499 - DNA, 21 bp, Homo sapiens
tcttaactaaatttgtctttc

SEQ ID NO: 5315500 - DNA, 15 bp, Homo sapiens
tcttaactaatgtaa

SEQ ID NO: 5315501 - DNA, 16 bp, Homo sapiens
tcttaactaatgtaaa

SEQ ID NO: 5315502 - DNA, 20 bp, Homo sapiens
tcttaactaatgtaaatatt

SEQ ID NO: 5315503 - DNA, 19 bp, Homo sapiens
tcttaactgaagaaagaga

SEQ ID NO: 5315504 - DNA, 14 bp, Homo sapiens
tcttaactgtattt

SEQ ID NO: 5315505 - DNA, 16 bp, Homo sapiens
tcttaacttcttgctt

SEQ ID NO: 5315506 - DNA, 20 bp, Homo sapiens
tcttaagaaaacaaactctt

SEQ ID NO: 5315507 - DNA, 12 bp, Homo sapiens
tcttaagaagac

SEQ ID NO: 5315508 - DNA, 18 bp, Homo sapiens
tcttaagaagactgcatt

SEQ ID NO: 5315509 - DNA, 13 bp, Homo sapiens
tcttaagaatgtg

SEQ ID NO: 5315510 - DNA, 15 bp, Homo sapiens
tcttaagacactagt

SEQ ID NO: 5315511 - DNA, 21 bp, Homo sapiens
tcttaagacagcatgtgttaa

SEQ ID NO: 5315512 - DNA, 24 bp, Homo sapiens
tcttaagacagcatgtgttaatct

SEQ ID NO: 5315513 - DNA, 16 bp, Homo sapiens
tcttaagaggctgaca

SEQ ID NO: 5315514 - DNA, 16 bp, Homo sapiens
tcttaagatgtccagg

SEQ ID NO: 5315515 - DNA, 12 bp, Homo sapiens
tcttaagcactt

SEQ ID NO: 5315516 - DNA, 14 bp, Homo sapiens
tcttaagcactttg

SEQ ID NO: 5315517 - DNA, 15 bp, Homo sapiens
tcttaagcactttga

SEQ ID NO: 5315518 - DNA, 21 bp, Homo sapiens
tcttaagcagcatggaaaaat

SEQ ID NO: 5315519 - DNA, 16 bp, Homo sapiens
tcttaagcaggtttgt

SEQ ID NO: 5315520 - DNA, 13 bp, Homo sapiens
tcttaagccatct

SEQ ID NO: 5315521 - DNA, 17 bp, Homo sapiens
tcttaagccatcttggt

SEQ ID NO: 5315522 - DNA, 21 bp, Homo sapiens
tcttaagccttttgctcacaa

SEQ ID NO: 5315523 - DNA, 16 bp, Homo sapiens
tcttaaggaattttgt

SEQ ID NO: 5315524 - DNA, 20 bp, Homo sapiens
tcttaaggaattttgtctca

SEQ ID NO: 5315525 - DNA, 19 bp, Homo sapiens
tcttaagggggccttggaa

SEQ ID NO: 5315526 - DNA, 17 bp, Homo sapiens
tcttaaggtctaactgt

SEQ ID NO: 5315527 - DNA, 14 bp, Homo sapiens
tcttaagtcataat

SEQ ID NO: 5315528 - DNA, 17 bp, Homo sapiens
tcttaagtcataatgaa

SEQ ID NO: 5315529 - DNA, 15 bp, Homo sapiens
tcttaagtggtctag

SEQ ID NO: 5315530 - DNA, 16 bp, Homo sapiens
tcttaagtgtaaataa

SEQ ID NO: 5315531 - DNA, 18 bp, Homo sapiens
tcttaagtgtaaataata

SEQ ID NO: 5315532 - DNA, 18 bp, Homo sapiens
tcttaagtgtttctcaaa

SEQ ID NO: 5315533 - DNA, 20 bp, Homo sapiens
tcttaagttctatgaagagt

SEQ ID NO: 5315534 - DNA, 23 bp, Homo sapiens
tcttaagttttgtttagcaatgt

SEQ ID NO: 5315535 - DNA, 22 bp, Homo sapiens
tcttaataaaactcactcactg

SEQ ID NO: 5315536 - DNA, 14 bp, Homo sapiens
tcttaataaaataa

SEQ ID NO: 5315537 - DNA, 18 bp, Homo sapiens
tcttaatactgttattct

SEQ ID NO: 5315538 - DNA, 17 bp, Homo sapiens
tcttaatagaaagtcag

SEQ ID NO: 5315539 - DNA, 19 bp, Homo sapiens
tcttaatagaaagtcagat

SEQ ID NO: 5315540 - DNA, 15 bp, Homo sapiens
tcttaatataaattc

SEQ ID NO: 5315541 - DNA, 21 bp, Homo sapiens
tcttaatataaattcactttc

SEQ ID NO: 5315542 - DNA, 19 bp, Homo sapiens
tcttaatataactgcctta

SEQ ID NO: 5315543 - DNA, 15 bp, Homo sapiens
tcttaatatcacttt

SEQ ID NO: 5315544 - DNA, 19 bp, Homo sapiens
tcttaatatgttcttttaa

SEQ ID NO: 5315545 - DNA, 16 bp, Homo sapiens
tcttaatattcagaga

SEQ ID NO: 5315546 - DNA, 22 bp, Homo sapiens
tcttaatattcagagaaaactt

SEQ ID NO: 5315547 - DNA, 18 bp, Homo sapiens
tcttaatattgagaatca

SEQ ID NO: 5315548 - DNA, 19 bp, Homo sapiens
tcttaatattgagaatcag

SEQ ID NO: 5315549 - DNA, 16 bp, Homo sapiens
tcttaatcactactgt

SEQ ID NO: 5315550 - DNA, 14 bp, Homo sapiens
tcttaatcattttt

SEQ ID NO: 5315551 - DNA, 18 bp, Homo sapiens
tcttaatcgatgaatgta

SEQ ID NO: 5315552 - DNA, 15 bp, Homo sapiens
tcttaatctcacttc

SEQ ID NO: 5315553 - DNA, 19 bp, Homo sapiens
tcttaatcttttcacaaat

SEQ ID NO: 5315554 - DNA, 15 bp, Homo sapiens
tcttaatgaagtttg

SEQ ID NO: 5315555 - DNA, 17 bp, Homo sapiens
tcttaatgaagtttgaa

SEQ ID NO: 5315556 - DNA, 22 bp, Homo sapiens
tcttaatgaagtttgaatgtta

SEQ ID NO: 5315557 - DNA, 18 bp, Homo sapiens
tcttaatgatgttatctt

SEQ ID NO: 5315558 - DNA, 20 bp, Homo sapiens
tcttaatgatgttatcttaa

SEQ ID NO: 5315559 - DNA, 16 bp, Homo sapiens
tcttaatgccacggca

SEQ ID NO: 5315560 - DNA, 22 bp, Homo sapiens
tcttaatgctttcctccctggc

SEQ ID NO: 5315561 - DNA, 18 bp, Homo sapiens
tcttaatgtaacatgttt

SEQ ID NO: 5315562 - DNA, 13 bp, Homo sapiens
tcttaatgtacat

SEQ ID NO: 5315563 - DNA, 19 bp, Homo sapiens
tcttaatgtacatagtgct

SEQ ID NO: 5315564 - DNA, 18 bp, Homo sapiens
tcttaatgtatcaaactg

SEQ ID NO: 5315565 - DNA, 13 bp, Homo sapiens
tcttaatgttcct

SEQ ID NO: 5315566 - DNA, 20 bp, Homo sapiens
tcttaatgttcctcaaagct

SEQ ID NO: 5315567 - DNA, 14 bp, Homo sapiens
tcttaatgttgaat

SEQ ID NO: 5315568 - DNA, 21 bp, Homo sapiens
tcttaattaaaagaatatttt

SEQ ID NO: 5315569 - DNA, 13 bp, Homo sapiens
tcttaattaagta

SEQ ID NO: 5315570 - DNA, 21 bp, Homo sapiens
tcttaattaagtaaactaatg

SEQ ID NO: 5315571 - DNA, 18 bp, Homo sapiens
tcttaattactttcagaa

SEQ ID NO: 5315572 - DNA, 12 bp, Homo sapiens
tcttaattatta

SEQ ID NO: 5315573 - DNA, 14 bp, Homo sapiens
tcttaattctttgt

SEQ ID NO: 5315574 - DNA, 19 bp, Homo sapiens
tcttaattgcaagtctgcc

SEQ ID NO: 5315575 - DNA, 17 bp, Homo sapiens
tcttaattgtgtttatt

SEQ ID NO: 5315576 - DNA, 23 bp, Homo sapiens
tcttaattgtgtttattttttaa

SEQ ID NO: 5315577 - DNA, 13 bp, Homo sapiens
tcttaatttatgt

SEQ ID NO: 5315578 - DNA, 23 bp, Homo sapiens
tcttaatttatttcttaaccttt

SEQ ID NO: 5315579 - DNA, 12 bp, Homo sapiens
tcttaatttgga

SEQ ID NO: 5315580 - DNA, 13 bp, Homo sapiens
tcttaatttggaa

SEQ ID NO: 5315581 - DNA, 16 bp, Homo sapiens
tcttaatttggataat

SEQ ID NO: 5315582 - DNA, 17 bp, Homo sapiens
tcttaattttggttgta

SEQ ID NO: 5315583 - DNA, 21 bp, Homo sapiens
tcttaattttggttgtattct

SEQ ID NO: 5315584 - DNA, 19 bp, Homo sapiens
tcttacaactgactgactt

SEQ ID NO: 5315585 - DNA, 17 bp, Homo sapiens
tcttacaatcaaatctc

SEQ ID NO: 5315586 - DNA, 19 bp, Homo sapiens
tcttacaattgcactgctg

SEQ ID NO: 5315587 - DNA, 14 bp, Homo sapiens
tcttacacattcca

SEQ ID NO: 5315588 - DNA, 19 bp, Homo sapiens
tcttacacgaagaaataga

SEQ ID NO: 5315589 - DNA, 23 bp, Homo sapiens
tcttacactgcctgtatacttta

SEQ ID NO: 5315590 - DNA, 13 bp, Homo sapiens
tcttacacttctt

SEQ ID NO: 5315591 - DNA, 14 bp, Homo sapiens
tcttacagagcctt

SEQ ID NO: 5315592 - DNA, 14 bp, Homo sapiens
tcttacagccaagt

SEQ ID NO: 5315593 - DNA, 17 bp, Homo sapiens
tcttacaggcacaaaat

SEQ ID NO: 5315594 - DNA, 19 bp, Homo sapiens
tcttacaggcacaaaatga

SEQ ID NO: 5315595 - DNA, 19 bp, Homo sapiens
tcttacagtggagtgagat

SEQ ID NO: 5315596 - DNA, 22 bp, Homo sapiens
tcttacatctccttgatcatgt

SEQ ID NO: 5315597 - DNA, 12 bp, Homo sapiens
tcttacatctgc

SEQ ID NO: 5315598 - DNA, 14 bp, Homo sapiens
tcttacatgtataa

SEQ ID NO: 5315599 - DNA, 18 bp, Homo sapiens
tcttacattattaatcat

SEQ ID NO: 5315600 - DNA, 20 bp, Homo sapiens
tcttacattattaatcattc

SEQ ID NO: 5315601 - DNA, 15 bp, Homo sapiens
tcttacattggcttt

SEQ ID NO: 5315602 - DNA, 20 bp, Homo sapiens
tcttacattttcgtcctgta

SEQ ID NO: 5315603 - DNA, 15 bp, Homo sapiens
tcttaccaaaacaga

SEQ ID NO: 5315604 - DNA, 19 bp, Homo sapiens
tcttaccaagagtgggctt

SEQ ID NO: 5315605 - DNA, 18 bp, Homo sapiens
tcttaccacagtgtttta

SEQ ID NO: 5315606 - DNA, 13 bp, Homo sapiens
tcttaccagatgc

SEQ ID NO: 5315607 - DNA, 22 bp, Homo sapiens
tcttaccagatgctttcctgtt

SEQ ID NO: 5315608 - DNA, 18 bp, Homo sapiens
tcttaccattaacatttt

SEQ ID NO: 5315609 - DNA, 16 bp, Homo sapiens
tcttaccattttattc

SEQ ID NO: 5315610 - DNA, 14 bp, Homo sapiens
tcttacccaaagca

SEQ ID NO: 5315611 - DNA, 16 bp, Homo sapiens
tcttacccaaagcaca

SEQ ID NO: 5315612 - DNA, 15 bp, Homo sapiens
tcttacccaatttcc

SEQ ID NO: 5315613 - DNA, 22 bp, Homo sapiens
tcttacccacttccctgcaagg

SEQ ID NO: 5315614 - DNA, 22 bp, Homo sapiens
tcttacccagattgtgtacata

SEQ ID NO: 5315615 - DNA, 17 bp, Homo sapiens
tcttacccatatatctt

SEQ ID NO: 5315616 - DNA, 18 bp, Homo sapiens
tcttacccatatatctta

SEQ ID NO: 5315617 - DNA, 22 bp, Homo sapiens
tcttaccccgtccctttccctg

SEQ ID NO: 5315618 - DNA, 18 bp, Homo sapiens
tcttaccctagttctctt

SEQ ID NO: 5315619 - DNA, 19 bp, Homo sapiens
tcttaccctagttctctta

SEQ ID NO: 5315620 - DNA, 22 bp, Homo sapiens
tcttaccctgtacatatgtaaa

SEQ ID NO: 5315621 - DNA, 15 bp, Homo sapiens
tcttacccttctgtg

SEQ ID NO: 5315622 - DNA, 16 bp, Homo sapiens
tcttacccttctgtgc

SEQ ID NO: 5315623 - DNA, 22 bp, Homo sapiens
tcttacccttctgtgcccagct

SEQ ID NO: 5315624 - DNA, 13 bp, Homo sapiens
tcttaccctttct

SEQ ID NO: 5315625 - DNA, 15 bp, Homo sapiens
tcttaccgacaagca

SEQ ID NO: 5315626 - DNA, 17 bp, Homo sapiens
tcttaccgacaagcaca

SEQ ID NO: 5315627 - DNA, 15 bp, Homo sapiens
tcttaccgtagcctc

SEQ ID NO: 5315628 - DNA, 16 bp, Homo sapiens
tcttacctaaactgag

SEQ ID NO: 5315629 - DNA, 18 bp, Homo sapiens
tcttacctactattggcc

SEQ ID NO: 5315630 - DNA, 21 bp, Homo sapiens
tcttacctactattggcccta

SEQ ID NO: 5315631 - DNA, 14 bp, Homo sapiens
tcttacctctctgg

SEQ ID NO: 5315632 - DNA, 21 bp, Homo sapiens
tcttacctgtatgtctccagt

SEQ ID NO: 5315633 - DNA, 23 bp, Homo sapiens
tcttacctgtatgtctccagtat

SEQ ID NO: 5315634 - DNA, 14 bp, Homo sapiens
tcttaccttaaaaa

SEQ ID NO: 5315635 - DNA, 14 bp, Homo sapiens
tcttacctttatga

SEQ ID NO: 5315636 - DNA, 18 bp, Homo sapiens
tcttacgatggcacccag

SEQ ID NO: 5315637 - DNA, 14 bp, Homo sapiens
tcttactaaacatt

SEQ ID NO: 5315638 - DNA, 17 bp, Homo sapiens
tcttactaataggtctg

SEQ ID NO: 5315639 - DNA, 16 bp, Homo sapiens
tcttactaatgtaaaa

SEQ ID NO: 5315640 - DNA, 20 bp, Homo sapiens
tcttactaatgtaaaatgat

SEQ ID NO: 5315641 - DNA, 15 bp, Homo sapiens
tcttactactttaaa

SEQ ID NO: 5315642 - DNA, 21 bp, Homo sapiens
tcttactattaagcagtaaaa

SEQ ID NO: 5315643 - DNA, 13 bp, Homo sapiens
tcttactctcctc

SEQ ID NO: 5315644 - DNA, 15 bp, Homo sapiens
tcttactctgaaaca

SEQ ID NO: 5315645 - DNA, 15 bp, Homo sapiens
tcttactctgtccac

SEQ ID NO: 5315646 - DNA, 23 bp, Homo sapiens
tcttactgaaggtaaaattgaaa

SEQ ID NO: 5315647 - DNA, 14 bp, Homo sapiens
tcttactgataatt

SEQ ID NO: 5315648 - DNA, 13 bp, Homo sapiens
tcttactgcaaat

SEQ ID NO: 5315649 - DNA, 12 bp, Homo sapiens
tcttactggaaa

SEQ ID NO: 5315650 - DNA, 18 bp, Homo sapiens
tcttactgttctgaaatt

SEQ ID NO: 5315651 - DNA, 13 bp, Homo sapiens
tcttactgttttg

SEQ ID NO: 5315652 - DNA, 20 bp, Homo sapiens
tcttacttatcaaaagacag

SEQ ID NO: 5315653 - DNA, 20 bp, Homo sapiens
tcttacttattatcttcagg

SEQ ID NO: 5315654 - DNA, 17 bp, Homo sapiens
tcttacttgagccttta

SEQ ID NO: 5315655 - DNA, 16 bp, Homo sapiens
tcttacttgagtatca

SEQ ID NO: 5315656 - DNA, 21 bp, Homo sapiens
tcttacttggctttttactat

SEQ ID NO: 5315657 - DNA, 13 bp, Homo sapiens
tcttacttgtctg

SEQ ID NO: 5315658 - DNA, 13 bp, Homo sapiens
tcttactttcagt

SEQ ID NO: 5315659 - DNA, 23 bp, Homo sapiens
tcttactttcctttccccagccc

SEQ ID NO: 5315660 - DNA, 11 bp, Homo sapiens
tcttactttgt

SEQ ID NO: 5315661 - DNA, 13 bp, Homo sapiens
tcttactttgtaa

SEQ ID NO: 5315662 - DNA, 18 bp, Homo sapiens
tcttactttgtaaattct

SEQ ID NO: 5315663 - DNA, 12 bp, Homo sapiens
tcttactttgtg

SEQ ID NO: 5315664 - DNA, 13 bp, Homo sapiens
tcttactttgtta

SEQ ID NO: 5315665 - DNA, 20 bp, Homo sapiens
tcttacttttattattttaa

SEQ ID NO: 5315666 - DNA, 17 bp, Homo sapiens
tcttacttttccagtct

SEQ ID NO: 5315667 - DNA, 20 bp, Homo sapiens
tcttactttttgtaaatgct

SEQ ID NO: 5315668 - DNA, 12 bp, Homo sapiens
tcttagaaactc

SEQ ID NO: 5315669 - DNA, 12 bp, Homo sapiens
tcttagaaattt

SEQ ID NO: 5315670 - DNA, 15 bp, Homo sapiens
tcttagaaatttatt

SEQ ID NO: 5315671 - DNA, 22 bp, Homo sapiens
tcttagaacagatggctgtgaa

SEQ ID NO: 5315672 - DNA, 17 bp, Homo sapiens
tcttagaagaatattgt

SEQ ID NO: 5315673 - DNA, 19 bp, Homo sapiens
tcttagaagtggaccagga

SEQ ID NO: 5315674 - DNA, 20 bp, Homo sapiens
tcttagaagtgttgtaaaag

SEQ ID NO: 5315675 - DNA, 20 bp, Homo sapiens
tcttagaatttgtttcatct

SEQ ID NO: 5315676 - DNA, 21 bp, Homo sapiens
tcttagaatttgtttcatcta

SEQ ID NO: 5315677 - DNA, 13 bp, Homo sapiens
tcttcaaacacaa

SEQ ID NO: 5315678 - DNA, 15 bp, Homo sapiens
tcttcaaacacaagt

SEQ ID NO: 5315679 - DNA, 23 bp, Homo sapiens
tcttcaaacagtatataactttt

SEQ ID NO: 5315680 - DNA, 14 bp, Homo sapiens
tcttcaaactgtga

SEQ ID NO: 5315681 - DNA, 15 bp, Homo sapiens
tcttcaaactttcac

SEQ ID NO: 5315682 - DNA, 23 bp, Homo sapiens
tcttcaaatacaaagtaaataca

SEQ ID NO: 5315683 - DNA, 17 bp, Homo sapiens
tcttcaaatccttccaa

SEQ ID NO: 5315684 - DNA, 22 bp, Homo sapiens
tcttcaaatctcccacaagtat

SEQ ID NO: 5315685 - DNA, 21 bp, Homo sapiens
tcttcaaatgggagactcttt

SEQ ID NO: 5315686 - DNA, 11 bp, Homo sapiens
tcttcaacaga

SEQ ID NO: 5315687 - DNA, 21 bp, Homo sapiens
tcttcaacatcaatgttcatt

SEQ ID NO: 5315688 - DNA, 19 bp, Homo sapiens
tcttcaacatcctgccagc

SEQ ID NO: 5315689 - DNA, 14 bp, Homo sapiens
tcttcaacatgtgt

SEQ ID NO: 5315690 - DNA, 13 bp, Homo sapiens
tcttcaacattaa

SEQ ID NO: 5315691 - DNA, 15 bp, Homo sapiens
tcttcaaccctgccc

SEQ ID NO: 5315692 - DNA, 17 bp, Homo sapiens
tcttcaaccctgccctg

SEQ ID NO: 5315693 - DNA, 15 bp, Homo sapiens
tcttcaactccctgc

SEQ ID NO: 5315694 - DNA, 16 bp, Homo sapiens
tcttcaagatcccatt

SEQ ID NO: 5315695 - DNA, 22 bp, Homo sapiens
tcttcaagcacctgcagattct

SEQ ID NO: 5315696 - DNA, 23 bp, Homo sapiens
tcttcaagcctggcccagtgaga

SEQ ID NO: 5315697 - DNA, 15 bp, Homo sapiens
tcttcaagctgtccc

SEQ ID NO: 5315698 - DNA, 12 bp, Homo sapiens
tcttcaaggcca

SEQ ID NO: 5315699 - DNA, 16 bp, Homo sapiens
tcttcaaggcttcagt

SEQ ID NO: 5315700 - DNA, 19 bp, Homo sapiens
tcttcaagggaagaaacac

SEQ ID NO: 5315701 - DNA, 13 bp, Homo sapiens
tcttcaagggctg

SEQ ID NO: 5315702 - DNA, 17 bp, Homo sapiens
tcttcaagggctgcttc

SEQ ID NO: 5315703 - DNA, 16 bp, Homo sapiens
tcttcaataaaccaca

SEQ ID NO: 5315704 - DNA, 22 bp, Homo sapiens
tcttcaataaaccacaagcatc

SEQ ID NO: 5315705 - DNA, 16 bp, Homo sapiens
tcttcaataaattaag

SEQ ID NO: 5315706 - DNA, 19 bp, Homo sapiens
tcttcaatacaaaaagcca

SEQ ID NO: 5315707 - DNA, 13 bp, Homo sapiens
tcttcaatgatca

SEQ ID NO: 5315708 - DNA, 17 bp, Homo sapiens
tcttcaatgatcaaatt

SEQ ID NO: 5315709 - DNA, 15 bp, Homo sapiens
tcttcaatggaatac

SEQ ID NO: 5315710 - DNA, 14 bp, Homo sapiens
tcttcaatgtgaaa

SEQ ID NO: 5315711 - DNA, 20 bp, Homo sapiens
tcttcaatgtgaaactgaga

SEQ ID NO: 5315712 - DNA, 13 bp, Homo sapiens
tcttcacaaaatc

SEQ ID NO: 5315713 - DNA, 21 bp, Homo sapiens
tcttcacactatcaacactgc

SEQ ID NO: 5315714 - DNA, 20 bp, Homo sapiens
tcttcacactgcgcaggtct

SEQ ID NO: 5315715 - DNA, 24 bp, Homo sapiens
tcttcacactggtttgccaggcca

SEQ ID NO: 5315716 - DNA, 23 bp, Homo sapiens
tcttcacagtgcagcttgcagtc

SEQ ID NO: 5315717 - DNA, 17 bp, Homo sapiens
tcttcacatgtaacttt

SEQ ID NO: 5315718 - DNA, 15 bp, Homo sapiens
tcttcacattctgaa

SEQ ID NO: 5315719 - DNA, 14 bp, Homo sapiens
tcttcacattgtgt

SEQ ID NO: 5315720 - DNA, 14 bp, Homo sapiens
tcttcaccaggtgc

SEQ ID NO: 5315721 - DNA, 15 bp, Homo sapiens
tcttcaccaggtgca

SEQ ID NO: 5315722 - DNA, 21 bp, Homo sapiens
tcttcaccaggtgcatgcatg

SEQ ID NO: 5315723 - DNA, 20 bp, Homo sapiens
tcttcacccagctaatctgt

SEQ ID NO: 5315724 - DNA, 23 bp, Homo sapiens
tcttcacccaggcctatgttgat

SEQ ID NO: 5315725 - DNA, 18 bp, Homo sapiens
tcttcacccctacactgt

SEQ ID NO: 5315726 - DNA, 22 bp, Homo sapiens
tcttcaccctgtaatggttggg

SEQ ID NO: 5315727 - DNA, 19 bp, Homo sapiens
tcttcacctaagtctctgt

SEQ ID NO: 5315728 - DNA, 18 bp, Homo sapiens
tcttcacctcacttgtgg

SEQ ID NO: 5315729 - DNA, 13 bp, Homo sapiens
tcttcacctcaga

SEQ ID NO: 5315730 - DNA, 17 bp, Homo sapiens
tcttcacctcagagtgg

SEQ ID NO: 5315731 - DNA, 17 bp, Homo sapiens
tcttcacctctatccaa

SEQ ID NO: 5315732 - DNA, 15 bp, Homo sapiens
tcttcacctgccacc

SEQ ID NO: 5315733 - DNA, 21 bp, Homo sapiens
tcttcacctgccaccacacac

SEQ ID NO: 5315734 - DNA, 18 bp, Homo sapiens
tcttcacctgttatgtat

SEQ ID NO: 5315735 - DNA, 16 bp, Homo sapiens
tcttcactcaaatttt

SEQ ID NO: 5315736 - DNA, 17 bp, Homo sapiens
tcttcactccaaaaaga

SEQ ID NO: 5315737 - DNA, 14 bp, Homo sapiens
tcttcactcgcccc

SEQ ID NO: 5315738 - DNA, 18 bp, Homo sapiens
tcttcactctctgaagat

SEQ ID NO: 5315739 - DNA, 15 bp, Homo sapiens
tcttcactcttcact

SEQ ID NO: 5315740 - DNA, 21 bp, Homo sapiens
tcttcactgaatatcatatgt

SEQ ID NO: 5315741 - DNA, 19 bp, Homo sapiens
tcttcactgccatgcctca

SEQ ID NO: 5315742 - DNA, 21 bp, Homo sapiens
tcttcactgccatgcctcaag

SEQ ID NO: 5315743 - DNA, 15 bp, Homo sapiens
tcttcactgcccagg

SEQ ID NO: 5315744 - DNA, 21 bp, Homo sapiens
tcttcactggtgagacaatga

SEQ ID NO: 5315745 - DNA, 23 bp, Homo sapiens
tcttcactgtcttactcaagata

SEQ ID NO: 5315746 - DNA, 19 bp, Homo sapiens
tcttcactgtggccacagc

SEQ ID NO: 5315747 - DNA, 21 bp, Homo sapiens
tcttcactgtggccacagccc

SEQ ID NO: 5315748 - DNA, 17 bp, Homo sapiens
tcttcacttacaagaaa

SEQ ID NO: 5315749 - DNA, 17 bp, Homo sapiens
tcttcactttcctcagt

SEQ ID NO: 5315750 - DNA, 20 bp, Homo sapiens
tcttcagaaagtgtgcttta

SEQ ID NO: 5315751 - DNA, 16 bp, Homo sapiens
tcttcagaactgccct

SEQ ID NO: 5315752 - DNA, 13 bp, Homo sapiens
tcttcagaagaca

SEQ ID NO: 5315753 - DNA, 12 bp, Homo sapiens
tcttcagaatta

SEQ ID NO: 5315754 - DNA, 19 bp, Homo sapiens
tcttcagaattatccatta

SEQ ID NO: 5315755 - DNA, 15 bp, Homo sapiens
tcttcagacccagag

SEQ ID NO: 5315756 - DNA, 16 bp, Homo sapiens
tcttcagacccagaga

SEQ ID NO: 5315757 - DNA, 22 bp, Homo sapiens
tcttcagactctcagcccagaa

SEQ ID NO: 5315758 - DNA, 20 bp, Homo sapiens
tcttcagactgaggcctttt

SEQ ID NO: 5315759 - DNA, 21 bp, Homo sapiens
tcttcagagactcctgcaggc

SEQ ID NO: 5315760 - DNA, 11 bp, Homo sapiens
tcttcagagca

SEQ ID NO: 5315761 - DNA, 24 bp, Homo sapiens
tcttcagagcaaaagacttgagcc

SEQ ID NO: 5315762 - DNA, 16 bp, Homo sapiens
tcttcagagcaggggt

SEQ ID NO: 5315763 - DNA, 22 bp, Homo sapiens
tcttcagaggagcatcagctgt

SEQ ID NO: 5315764 - DNA, 15 bp, Homo sapiens
tcttcagaggccctc

SEQ ID NO: 5315765 - DNA, 12 bp, Homo sapiens
tcttcagagtga

SEQ ID NO: 5315766 - DNA, 16 bp, Homo sapiens
tcttcagagtgaagaa

SEQ ID NO: 5315767 - DNA, 19 bp, Homo sapiens
tcttcagagtgaagaatct

SEQ ID NO: 5315768 - DNA, 20 bp, Homo sapiens
tcttcagagtgaagaatctt

SEQ ID NO: 5315769 - DNA, 18 bp, Homo sapiens
tcttcagatctctaactt

SEQ ID NO: 5315770 - DNA, 14 bp, Homo sapiens
tcttcagatgccac

SEQ ID NO: 5315771 - DNA, 21 bp, Homo sapiens
tcttcagcaaaaatattttat

SEQ ID NO: 5315772 - DNA, 17 bp, Homo sapiens
tcttcagcacaaaagga

SEQ ID NO: 5315773 - DNA, 13 bp, Homo sapiens
tcttcagccatca

SEQ ID NO: 5315774 - DNA, 16 bp, Homo sapiens
tcttcagccatcaaca

SEQ ID NO: 5315775 - DNA, 12 bp, Homo sapiens
tcttcagcccag

SEQ ID NO: 5315776 - DNA, 13 bp, Homo sapiens
tcttcagcccctt

SEQ ID NO: 5315777 - DNA, 17 bp, Homo sapiens
tcttcagccccttctcc

SEQ ID NO: 5315778 - DNA, 21 bp, Homo sapiens
tcttcagccccttctcccctc

SEQ ID NO: 5315779 - DNA, 23 bp, Homo sapiens
tcttcagcctagccgacctcagc

SEQ ID NO: 5315780 - DNA, 16 bp, Homo sapiens
tcttcagcctccctca

SEQ ID NO: 5315781 - DNA, 16 bp, Homo sapiens
tcttcagcgtaaaatg

SEQ ID NO: 5315782 - DNA, 18 bp, Homo sapiens
tcttcagcgtaaaatggt

SEQ ID NO: 5315783 - DNA, 16 bp, Homo sapiens
tcttcagctcccatag

SEQ ID NO: 5315784 - DNA, 11 bp, Homo sapiens
tcttcagctgg

SEQ ID NO: 5315785 - DNA, 14 bp, Homo sapiens
tcttcagctggtgg

SEQ ID NO: 5315786 - DNA, 20 bp, Homo sapiens
tcttcagctggtggatggtg

SEQ ID NO: 5315787 - DNA, 11 bp, Homo sapiens
tcttcagcttt

SEQ ID NO: 5315788 - DNA, 13 bp, Homo sapiens
tcttcagctttat

SEQ ID NO: 5315789 - DNA, 16 bp, Homo sapiens
tcttcaggaggccctg

SEQ ID NO: 5315790 - DNA, 21 bp, Homo sapiens
tcttcaggaggccctggtgtc

SEQ ID NO: 5315791 - DNA, 22 bp, Homo sapiens
tcttcaggatattggttcttcc

SEQ ID NO: 5315792 - DNA, 23 bp, Homo sapiens
tcttcaggatgcacggtttctgt

SEQ ID NO: 5315793 - DNA, 13 bp, Homo sapiens
tcttcaggcctcc

SEQ ID NO: 5315794 - DNA, 21 bp, Homo sapiens
tcttcaggcctgctagtcact

SEQ ID NO: 5315795 - DNA, 22 bp, Homo sapiens
tcttcaggcctgctagtcactg

SEQ ID NO: 5315796 - DNA, 16 bp, Homo sapiens
tcttcaggctctgccc

SEQ ID NO: 5315797 - DNA, 17 bp, Homo sapiens
tcttcaggctctgccca

SEQ ID NO: 5315798 - DNA, 15 bp, Homo sapiens
tcttcagggcactgc

SEQ ID NO: 5315799 - DNA, 14 bp, Homo sapiens
tcttcagggtctaa

SEQ ID NO: 5315800 - DNA, 16 bp, Homo sapiens
tcttcaggtgaacact

SEQ ID NO: 5315801 - DNA, 17 bp, Homo sapiens
tcttcaggtgaacactt

SEQ ID NO: 5315802 - DNA, 14 bp, Homo sapiens
tcttcaggttctta

SEQ ID NO: 5315803 - DNA, 16 bp, Homo sapiens
tcttcagtaagccgtg

SEQ ID NO: 5315804 - DNA, 21 bp, Homo sapiens
tcttcagtcatggcattcgca

SEQ ID NO: 5315805 - DNA, 14 bp, Homo sapiens
tcttcagtctcaca

SEQ ID NO: 5315806 - DNA, 18 bp, Homo sapiens
tcttcagtgactcctgct

SEQ ID NO: 5315807 - DNA, 19 bp, Homo sapiens
tcttcagtgactcctgctg

SEQ ID NO: 5315808 - DNA, 21 bp, Homo sapiens
tcttcagtgactcctgctggt

SEQ ID NO: 5315809 - DNA, 18 bp, Homo sapiens
tcttcagtgcaaattgta

SEQ ID NO: 5315810 - DNA, 21 bp, Homo sapiens
tcttcagtgcaaattgtatct

SEQ ID NO: 5315811 - DNA, 20 bp, Homo sapiens
tcttcagtgtaatgtgactt

SEQ ID NO: 5315812 - DNA, 22 bp, Homo sapiens
tcttcagtgtaatgtgacttca

SEQ ID NO: 5315813 - DNA, 18 bp, Homo sapiens
tcttcagtgtctctgttt

SEQ ID NO: 5315814 - DNA, 20 bp, Homo sapiens
tcttcagtgtgttgacttct

SEQ ID NO: 5315815 - DNA, 22 bp, Homo sapiens
tcttcagttaagcctttggaaa

SEQ ID NO: 5315816 - DNA, 20 bp, Homo sapiens
tcttcagttggtgtgttttt

SEQ ID NO: 5315817 - DNA, 21 bp, Homo sapiens
tcttcagttggttgtgtcttt

SEQ ID NO: 5315818 - DNA, 21 bp, Homo sapiens
tcttcagttgtctctgatgca

SEQ ID NO: 5315819 - DNA, 17 bp, Homo sapiens
tcttcagtttaatgcaa

SEQ ID NO: 5315820 - DNA, 17 bp, Homo sapiens
tcttcagtttgcagagt

SEQ ID NO: 5315821 - DNA, 18 bp, Homo sapiens
tcttcagttttatcttta

SEQ ID NO: 5315822 - DNA, 15 bp, Homo sapiens
tcttcataattctaa

SEQ ID NO: 5315823 - DNA, 14 bp, Homo sapiens
tcttcatacaaagg

SEQ ID NO: 5315824 - DNA, 23 bp, Homo sapiens
tcttcataggtagaaacaaatac

SEQ ID NO: 5315825 - DNA, 19 bp, Homo sapiens
tcttcatatttttgatcat

SEQ ID NO: 5315826 - DNA, 17 bp, Homo sapiens
tcttcatccaacttcca

SEQ ID NO: 5315827 - DNA, 16 bp, Homo sapiens
tcttcatccatagaca

SEQ ID NO: 5315828 - DNA, 19 bp, Homo sapiens
tcttcatccatagacacag

SEQ ID NO: 5315829 - DNA, 16 bp, Homo sapiens
tcttcatccttagcaa

SEQ ID NO: 5315830 - DNA, 14 bp, Homo sapiens
tcttcatctccctg

SEQ ID NO: 5315831 - DNA, 12 bp, Homo sapiens
tcttcatctgcc

SEQ ID NO: 5315832 - DNA, 13 bp, Homo sapiens
tcttcatgaaatg

SEQ ID NO: 5315833 - DNA, 15 bp, Homo sapiens
tcttcatgcttgaca

SEQ ID NO: 5315834 - DNA, 22 bp, Homo sapiens
tcttcatggcatcttcaatatg

SEQ ID NO: 5315835 - DNA, 23 bp, Homo sapiens
tcttcatggcatcttcaatatga

SEQ ID NO: 5315836 - DNA, 14 bp, Homo sapiens
tcttcatggtctct

SEQ ID NO: 5315837 - DNA, 18 bp, Homo sapiens
tcttcatggtctcttcca

SEQ ID NO: 5315838 - DNA, 16 bp, Homo sapiens
tcttcatggtgacact

SEQ ID NO: 5315839 - DNA, 17 bp, Homo sapiens
tcttcatggtgacactc

SEQ ID NO: 5315840 - DNA, 21 bp, Homo sapiens
tcttcatgtacatttggaact

SEQ ID NO: 5315841 - DNA, 17 bp, Homo sapiens
tcttcattaatactgtg

SEQ ID NO: 5315842 - DNA, 22 bp, Homo sapiens
tcttcattacctcagtgagaag

SEQ ID NO: 5315843 - DNA, 23 bp, Homo sapiens
tcttcattagatgtttatttaga

SEQ ID NO: 5315844 - DNA, 21 bp, Homo sapiens
tcttcattatagtaaatctat

SEQ ID NO: 5315845 - DNA, 17 bp, Homo sapiens
tcttcattattctctgc

SEQ ID NO: 5315846 - DNA, 16 bp, Homo sapiens
tcttcattctttactg

SEQ ID NO: 5315847 - DNA, 19 bp, Homo sapiens
tcttcattgtaatctgcaa

SEQ ID NO: 5315848 - DNA, 15 bp, Homo sapiens
tcttcatttcattgt

SEQ ID NO: 5315849 - DNA, 15 bp, Homo sapiens
tcttcatttctctgc

SEQ ID NO: 5315850 - DNA, 19 bp, Homo sapiens
tcttcatttggaggaatca

SEQ ID NO: 5315851 - DNA, 19 bp, Homo sapiens
tcttcattttcattaccag

SEQ ID NO: 5315852 - DNA, 11 bp, Homo sapiens
tcttcattttg

SEQ ID NO: 5315853 - DNA, 23 bp, Homo sapiens
tcttcattttggtttatttttgt

SEQ ID NO: 5315854 - DNA, 13 bp, Homo sapiens
tcttctgctcctt

SEQ ID NO: 5315855 - DNA, 15 bp, Homo sapiens
tcttctgctcttttc

SEQ ID NO: 5315856 - DNA, 14 bp, Homo sapiens
tcttctgctgttct

SEQ ID NO: 5315857 - DNA, 20 bp, Homo sapiens
tcttctgctgttcttcactt

SEQ ID NO: 5315858 - DNA, 12 bp, Homo sapiens
tcttctgcttca

SEQ ID NO: 5315859 - DNA, 19 bp, Homo sapiens
tcttctgcttcagcctccc

SEQ ID NO: 5315860 - DNA, 12 bp, Homo sapiens
tcttctgctttg

SEQ ID NO: 5315861 - DNA, 21 bp, Homo sapiens
tcttctggaaaccaaataggc

SEQ ID NO: 5315862 - DNA, 17 bp, Homo sapiens
tcttctggagatggaag

SEQ ID NO: 5315863 - DNA, 17 bp, Homo sapiens
tcttctggagtctccag

SEQ ID NO: 5315864 - DNA, 15 bp, Homo sapiens
tcttctggagtttct

SEQ ID NO: 5315865 - DNA, 16 bp, Homo sapiens
tcttctggagtttctc

SEQ ID NO: 5315866 - DNA, 11 bp, Homo sapiens
tcttctggctt

SEQ ID NO: 5315867 - DNA, 17 bp, Homo sapiens
tcttctggctttctgag

SEQ ID NO: 5315868 - DNA, 23 bp, Homo sapiens
tcttctgggagggcagcagggct

SEQ ID NO: 5315869 - DNA, 20 bp, Homo sapiens
tcttctgggcagagcctgtc

SEQ ID NO: 5315870 - DNA, 17 bp, Homo sapiens
tcttctgggcgtctgag

SEQ ID NO: 5315871 - DNA, 16 bp, Homo sapiens
tcttctgggtgtgctt

SEQ ID NO: 5315872 - DNA, 22 bp, Homo sapiens
tcttctggtactttctgttatg

SEQ ID NO: 5315873 - DNA, 14 bp, Homo sapiens
tcttctggtagtgt

SEQ ID NO: 5315874 - DNA, 17 bp, Homo sapiens
tcttctggtctgtgtgt

SEQ ID NO: 5315875 - DNA, 18 bp, Homo sapiens
tcttctggtctgtgtgtg

SEQ ID NO: 5315876 - DNA, 18 bp, Homo sapiens
tcttctggtgagtgcaag

SEQ ID NO: 5315877 - DNA, 16 bp, Homo sapiens
tcttctggtgcatgtt

SEQ ID NO: 5315878 - DNA, 21 bp, Homo sapiens
tcttctggtgctactccatgc

SEQ ID NO: 5315879 - DNA, 19 bp, Homo sapiens
tcttctggtgttgactgga

SEQ ID NO: 5315880 - DNA, 15 bp, Homo sapiens
tcttctgtaatattt

SEQ ID NO: 5315881 - DNA, 19 bp, Homo sapiens
tcttctgtagctattcttt

SEQ ID NO: 5315882 - DNA, 20 bp, Homo sapiens
tcttctgtagctattctttg

SEQ ID NO: 5315883 - DNA, 22 bp, Homo sapiens
tcttctgtatttttttttctaa

SEQ ID NO: 5315884 - DNA, 22 bp, Homo sapiens
tcttctgtattttttttttcca

SEQ ID NO: 5315885 - DNA, 15 bp, Homo sapiens
tcttctgtcatcccg

SEQ ID NO: 5315886 - DNA, 14 bp, Homo sapiens
tcttctgtcatcta

SEQ ID NO: 5315887 - DNA, 15 bp, Homo sapiens
tcttctgtcccaagt

SEQ ID NO: 5315888 - DNA, 16 bp, Homo sapiens
tcttctgtcccaagtc

SEQ ID NO: 5315889 - DNA, 17 bp, Homo sapiens
tcttctgtcccaagtct

SEQ ID NO: 5315890 - DNA, 21 bp, Homo sapiens
tcttctgtgaaatataattgt

SEQ ID NO: 5315891 - DNA, 23 bp, Homo sapiens
tcttctgtgattcggtggagact

SEQ ID NO: 5315892 - DNA, 15 bp, Homo sapiens
tcttctgttgacatt

SEQ ID NO: 5315893 - DNA, 19 bp, Homo sapiens
tcttctgttgtagaataat

SEQ ID NO: 5315894 - DNA, 16 bp, Homo sapiens
tcttctgtttttctca

SEQ ID NO: 5315895 - DNA, 18 bp, Homo sapiens
tcttctgtttttctcaaa

SEQ ID NO: 5315896 - DNA, 19 bp, Homo sapiens
tcttctgtttttctcaaat

SEQ ID NO: 5315897 - DNA, 17 bp, Homo sapiens
tcttcttaaaagtttct

SEQ ID NO: 5315898 - DNA, 18 bp, Homo sapiens
tcttcttaaaagtttcta

SEQ ID NO: 5315899 - DNA, 18 bp, Homo sapiens
tcttcttaaccctgaaca

SEQ ID NO: 5315900 - DNA, 13 bp, Homo sapiens
tcttcttaattct

SEQ ID NO: 5315901 - DNA, 16 bp, Homo sapiens
tcttcttacacttctt

SEQ ID NO: 5315902 - DNA, 15 bp, Homo sapiens
tcttcttacatgcat

SEQ ID NO: 5315903 - DNA, 14 bp, Homo sapiens
tcttcttatcacac

SEQ ID NO: 5315904 - DNA, 18 bp, Homo sapiens
tcttcttatcacacttgc

SEQ ID NO: 5315905 - DNA, 22 bp, Homo sapiens
tcttcttatcacacttgcaaat

SEQ ID NO: 5315906 - DNA, 23 bp, Homo sapiens
tcttcttatcacacttgcaaatg

SEQ ID NO: 5315907 - DNA, 16 bp, Homo sapiens
tcttcttatctaaacc

SEQ ID NO: 5315908 - DNA, 12 bp, Homo sapiens
tcttcttatgca

SEQ ID NO: 5315909 - DNA, 14 bp, Homo sapiens
tcttcttcaaatac

SEQ ID NO: 5315910 - DNA, 15 bp, Homo sapiens
tcttcttcacatcca

SEQ ID NO: 5315911 - DNA, 22 bp, Homo sapiens
tcttcttcacatccattgtctc

SEQ ID NO: 5315912 - DNA, 14 bp, Homo sapiens
tcttcttcagaaga

SEQ ID NO: 5315913 - DNA, 16 bp, Homo sapiens
tcttcttcagaagaca

SEQ ID NO: 5315914 - DNA, 23 bp, Homo sapiens
tcttcttccaatgatgcttacta

SEQ ID NO: 5315915 - DNA, 13 bp, Homo sapiens
tcttcttccctcc

SEQ ID NO: 5315916 - DNA, 18 bp, Homo sapiens
tcttcttctaagaagaca

SEQ ID NO: 5315917 - DNA, 21 bp, Homo sapiens
tcttcttctaagaagacattt

SEQ ID NO: 5315918 - DNA, 15 bp, Homo sapiens
tcttcttcttcagaa

SEQ ID NO: 5315919 - DNA, 15 bp, Homo sapiens
tcttcttcttttcta

SEQ ID NO: 5315920 - DNA, 20 bp, Homo sapiens
tcttcttgcggcaccgccca

SEQ ID NO: 5315921 - DNA, 16 bp, Homo sapiens
tcttcttgctgcagcc

SEQ ID NO: 5315922 - DNA, 19 bp, Homo sapiens
tcttcttggccatgggagg

SEQ ID NO: 5315923 - DNA, 23 bp, Homo sapiens
tcttcttggccatgggaggcctt

SEQ ID NO: 5315924 - DNA, 20 bp, Homo sapiens
tcttcttgggagtatgttgt

SEQ ID NO: 5315925 - DNA, 23 bp, Homo sapiens
tcttcttgggagtatgttgtcat

SEQ ID NO: 5315926 - DNA, 23 bp, Homo sapiens
tcttcttgggcccggtccacagg

SEQ ID NO: 5315927 - DNA, 21 bp, Homo sapiens
tcttcttggggcccagtgcat

SEQ ID NO: 5315928 - DNA, 19 bp, Homo sapiens
tcttcttgggggcagacca

SEQ ID NO: 5315929 - DNA, 13 bp, Homo sapiens
tcttcttgtcttt

SEQ ID NO: 5315930 - DNA, 19 bp, Homo sapiens
tcttcttgtctttgtccct

SEQ ID NO: 5315931 - DNA, 21 bp, Homo sapiens
tcttcttgtctttgtccctgt

SEQ ID NO: 5315932 - DNA, 15 bp, Homo sapiens
tcttcttgtgaaatg

SEQ ID NO: 5315933 - DNA, 16 bp, Homo sapiens
tcttcttgtgtcctga

SEQ ID NO: 5315934 - DNA, 17 bp, Homo sapiens
tcttctttaatttttct

SEQ ID NO: 5315935 - DNA, 20 bp, Homo sapiens
tcttctttagatgccaaacc

SEQ ID NO: 5315936 - DNA, 15 bp, Homo sapiens
tcttctttattgcac

SEQ ID NO: 5315937 - DNA, 16 bp, Homo sapiens
tcttctttattgcact

SEQ ID NO: 5315938 - DNA, 16 bp, Homo sapiens
tcttctttccagaccc

SEQ ID NO: 5315939 - DNA, 16 bp, Homo sapiens
tcttctttccattctt

SEQ ID NO: 5315940 - DNA, 14 bp, Homo sapiens
tcttctttccctgg

SEQ ID NO: 5315941 - DNA, 16 bp, Homo sapiens
tcttctttccctggac

SEQ ID NO: 5315942 - DNA, 19 bp, Homo sapiens
tcttctttcctttactcct

SEQ ID NO: 5315943 - DNA, 21 bp, Homo sapiens
tcttctttctccatggagcct

SEQ ID NO: 5315944 - DNA, 15 bp, Homo sapiens
tcttctttctcctgt

SEQ ID NO: 5315945 - DNA, 15 bp, Homo sapiens
tcttctttctggttg

SEQ ID NO: 5315946 - DNA, 17 bp, Homo sapiens
tcttctttctgtcttta

SEQ ID NO: 5315947 - DNA, 15 bp, Homo sapiens
tcttctttcttccac

SEQ ID NO: 5315948 - DNA, 14 bp, Homo sapiens
tcttctttgtgcct

SEQ ID NO: 5315949 - DNA, 21 bp, Homo sapiens
tcttctttgtgcctttggcct

SEQ ID NO: 5315950 - DNA, 23 bp, Homo sapiens
tcttctttgtgcctttggcctgg

SEQ ID NO: 5315951 - DNA, 21 bp, Homo sapiens
tcttcttttaaaccattttct

SEQ ID NO: 5315952 - DNA, 13 bp, Homo sapiens
tcttcttttcctt

SEQ ID NO: 5315953 - DNA, 20 bp, Homo sapiens
tcttcttttgggaggatttg

SEQ ID NO: 5315954 - DNA, 22 bp, Homo sapiens
tcttcttttgtgtcctgctctg

SEQ ID NO: 5315955 - DNA, 15 bp, Homo sapiens
tcttctttttgctgt

SEQ ID NO: 5315956 - DNA, 19 bp, Homo sapiens
tcttcttttttaactgaaa

SEQ ID NO: 5315957 - DNA, 15 bp, Homo sapiens
tcttcttttttaagt

SEQ ID NO: 5315958 - DNA, 18 bp, Homo sapiens
tcttgaaaaagatggctt

SEQ ID NO: 5315959 - DNA, 13 bp, Homo sapiens
tcttgaaaaatgc

SEQ ID NO: 5315960 - DNA, 20 bp, Homo sapiens
tcttgaaaataaaaaatatt

SEQ ID NO: 5315961 - DNA, 22 bp, Homo sapiens
tcttgaaaataagattccagag

SEQ ID NO: 5315962 - DNA, 15 bp, Homo sapiens
tcttgaaaatgccac

SEQ ID NO: 5315963 - DNA, 14 bp, Homo sapiens
tcttgaaaatgttt

SEQ ID NO: 5315964 - DNA, 17 bp, Homo sapiens
tcttgaaagaagaatgt

SEQ ID NO: 5315965 - DNA, 23 bp, Homo sapiens
tcttgaaagattcaggtatgttg

SEQ ID NO: 5315966 - DNA, 20 bp, Homo sapiens
tcttgaaatataggaactta

SEQ ID NO: 5315967 - DNA, 20 bp, Homo sapiens
tcttgaaatattcagaaatt

SEQ ID NO: 5315968 - DNA, 12 bp, Homo sapiens
tcttgaaatgaa

SEQ ID NO: 5315969 - DNA, 15 bp, Homo sapiens
tcttgaaatgaaagg

SEQ ID NO: 5315970 - DNA, 20 bp, Homo sapiens
tcttgaaatgaaagggaaac

SEQ ID NO: 5315971 - DNA, 21 bp, Homo sapiens
tcttgaaatgaaagggaaact

SEQ ID NO: 5315972 - DNA, 13 bp, Homo sapiens
tcttgaaatgtag

SEQ ID NO: 5315973 - DNA, 22 bp, Homo sapiens
tcttgaaattaagaaggcaaaa

SEQ ID NO: 5315974 - DNA, 19 bp, Homo sapiens
tcttgaacactcatgctga

SEQ ID NO: 5315975 - DNA, 14 bp, Homo sapiens
tcttgaacctgtgc

SEQ ID NO: 5315976 - DNA, 14 bp, Homo sapiens
tcttgaactcctga

SEQ ID NO: 5315977 - DNA, 19 bp, Homo sapiens
tcttgaactcctgacctca

SEQ ID NO: 5315978 - DNA, 18 bp, Homo sapiens
tcttgaactcctggcctc

SEQ ID NO: 5315979 - DNA, 17 bp, Homo sapiens
tcttgaactcttggcct

SEQ ID NO: 5315980 - DNA, 18 bp, Homo sapiens
tcttgaactcttggcctc

SEQ ID NO: 5315981 - DNA, 18 bp, Homo sapiens
tcttgaactgagcttgga

SEQ ID NO: 5315982 - DNA, 17 bp, Homo sapiens
tcttgaacttgaaaaaa

SEQ ID NO: 5315983 - DNA, 11 bp, Homo sapiens
tcttgaagaat

SEQ ID NO: 5315984 - DNA, 16 bp, Homo sapiens
tcttgaagaatattgt

SEQ ID NO: 5315985 - DNA, 22 bp, Homo sapiens
tcttgaagacttttctttcagc

SEQ ID NO: 5315986 - DNA, 22 bp, Homo sapiens
tcttgaagctgggctgtctctc

SEQ ID NO: 5315987 - DNA, 16 bp, Homo sapiens
tcttgaaggaaaaatt

SEQ ID NO: 5315988 - DNA, 22 bp, Homo sapiens
tcttgaaggaaaaattcaatag

SEQ ID NO: 5315989 - DNA, 19 bp, Homo sapiens
tcttgaaggaaaatgatac

SEQ ID NO: 5315990 - DNA, 15 bp, Homo sapiens
tcttgaagggcccag

SEQ ID NO: 5315991 - DNA, 17 bp, Homo sapiens
tcttgaaggtgctgcca

SEQ ID NO: 5315992 - DNA, 19 bp, Homo sapiens
tcttgaaggtgctgccacc

SEQ ID NO: 5315993 - DNA, 20 bp, Homo sapiens
tcttgaaggtgctgccaccc

SEQ ID NO: 5315994 - DNA, 16 bp, Homo sapiens
tcttgaagtcagccac

SEQ ID NO: 5315995 - DNA, 23 bp, Homo sapiens
tcttgaagtcagccacactgggc

SEQ ID NO: 5315996 - DNA, 16 bp, Homo sapiens
tcttgaagtcattgtc

SEQ ID NO: 5315997 - DNA, 18 bp, Homo sapiens
tcttgaagtccaggactg

SEQ ID NO: 5315998 - DNA, 12 bp, Homo sapiens
tcttgaagtcct

SEQ ID NO: 5315999 - DNA, 16 bp, Homo sapiens
tcttgaagtcctggct

SEQ ID NO: 5316000 - DNA, 21 bp, Homo sapiens
tcttgaagtgatcatttcaca

SEQ ID NO: 5316001 - DNA, 13 bp, Homo sapiens
tcttgaataaact

SEQ ID NO: 5316002 - DNA, 19 bp, Homo sapiens
tcttgaataaagtattcta

SEQ ID NO: 5316003 - DNA, 12 bp, Homo sapiens
tcttgaataaga

SEQ ID NO: 5316004 - DNA, 15 bp, Homo sapiens
tcttgaatagcttat

SEQ ID NO: 5316005 - DNA, 15 bp, Homo sapiens
tcttgaatataaaaa

SEQ ID NO: 5316006 - DNA, 22 bp, Homo sapiens
tcttgaatctagggagggggaa

SEQ ID NO: 5316007 - DNA, 18 bp, Homo sapiens
tcttgaatgcttaaatga

SEQ ID NO: 5316008 - DNA, 16 bp, Homo sapiens
tcttgaatgtcttttg

SEQ ID NO: 5316009 - DNA, 11 bp, Homo sapiens
tcttgaatgtg

SEQ ID NO: 5316010 - DNA, 12 bp, Homo sapiens
tcttgaatgtgg

SEQ ID NO: 5316011 - DNA, 18 bp, Homo sapiens
tcttgaatgtggtctcag

SEQ ID NO: 5316012 - DNA, 14 bp, Homo sapiens
tcttgaattagtat

SEQ ID NO: 5316013 - DNA, 16 bp, Homo sapiens
tcttgaattcctctca

SEQ ID NO: 5316014 - DNA, 15 bp, Homo sapiens
tcttgaattcctggg

SEQ ID NO: 5316015 - DNA, 21 bp, Homo sapiens
tcttgaattgtaaggaatgat

SEQ ID NO: 5316016 - DNA, 15 bp, Homo sapiens
tcttgaattgttatg

SEQ ID NO: 5316017 - DNA, 21 bp, Homo sapiens
tcttgaattgttatgaaaatc

SEQ ID NO: 5316018 - DNA, 23 bp, Homo sapiens
tcttgaatttaataatctgtagg

SEQ ID NO: 5316019 - DNA, 18 bp, Homo sapiens
tcttgaatttctaaaaaa

SEQ ID NO: 5316020 - DNA, 14 bp, Homo sapiens
tcttgaatttctga

SEQ ID NO: 5316021 - DNA, 12 bp, Homo sapiens
tcttgaattttt

SEQ ID NO: 5316022 - DNA, 21 bp, Homo sapiens
tcttgaatttttgatgtagat

SEQ ID NO: 5316023 - DNA, 12 bp, Homo sapiens
tcttgacaagct

SEQ ID NO: 5316024 - DNA, 21 bp, Homo sapiens
tcttgacaagctgacttggca

SEQ ID NO: 5316025 - DNA, 23 bp, Homo sapiens
tcttgacaagctgacttggcact

SEQ ID NO: 5316026 - DNA, 16 bp, Homo sapiens
tcttgacaatcatctc

SEQ ID NO: 5316027 - DNA, 20 bp, Homo sapiens
tcttgacagtatatttgaaa

SEQ ID NO: 5316028 - DNA, 15 bp, Homo sapiens
tcttgacatgtaatg

SEQ ID NO: 5316029 - DNA, 19 bp, Homo sapiens
tcttgacattcaaggcatt

SEQ ID NO: 5316030 - DNA, 19 bp, Homo sapiens
tcttgaccaacagaaacct

SEQ ID NO: 5316031 - DNA, 16 bp, Homo sapiens
tcttgaccatactaat

SEQ ID NO: 5316032 - DNA, 17 bp, Homo sapiens
tcttggggtcccaggga

SEQ ID NO: 5316033 - DNA, 18 bp, Homo sapiens
tcttgggtctgccctgcc

SEQ ID NO: 5316034 - DNA, 14 bp, Homo sapiens
tcttgggtgaggac

SEQ ID NO: 5316035 - DNA, 20 bp, Homo sapiens
tcttgggtgggacagggctt

SEQ ID NO: 5316036 - DNA, 13 bp, Homo sapiens
tcttgggtgggtg

SEQ ID NO: 5316037 - DNA, 21 bp, Homo sapiens
tcttgggtgtattctctgtaa

SEQ ID NO: 5316038 - DNA, 15 bp, Homo sapiens
tcttgggttcctgta

SEQ ID NO: 5316039 - DNA, 22 bp, Homo sapiens
tcttggtaaaacattacttatt

SEQ ID NO: 5316040 - DNA, 19 bp, Homo sapiens
tcttggtactgttgctttg

SEQ ID NO: 5316041 - DNA, 15 bp, Homo sapiens
tcttggtagagattc

SEQ ID NO: 5316042 - DNA, 15 bp, Homo sapiens
tcttggtatgatcat

SEQ ID NO: 5316043 - DNA, 14 bp, Homo sapiens
tcttggtattctta

SEQ ID NO: 5316044 - DNA, 22 bp, Homo sapiens
tcttggtatttggatatctgtt

SEQ ID NO: 5316045 - DNA, 21 bp, Homo sapiens
tcttggtcacaaagctattta

SEQ ID NO: 5316046 - DNA, 18 bp, Homo sapiens
tcttggtcatgtcctgag

SEQ ID NO: 5316047 - DNA, 18 bp, Homo sapiens
tcttggtccctggaagct

SEQ ID NO: 5316048 - DNA, 14 bp, Homo sapiens
tcttggtctcagct

SEQ ID NO: 5316049 - DNA, 17 bp, Homo sapiens
tcttggtcttcccaggc

SEQ ID NO: 5316050 - DNA, 20 bp, Homo sapiens
tcttggtgaaataataaaat

SEQ ID NO: 5316051 - DNA, 20 bp, Homo sapiens
tcttggtgccttttgtgtga

SEQ ID NO: 5316052 - DNA, 22 bp, Homo sapiens
tcttggtgccttttgtgtgatg

SEQ ID NO: 5316053 - DNA, 13 bp, Homo sapiens
tcttggtgctctg

SEQ ID NO: 5316054 - DNA, 15 bp, Homo sapiens
tcttggtgctctgtg

SEQ ID NO: 5316055 - DNA, 16 bp, Homo sapiens
tcttggtgctttgtct

SEQ ID NO: 5316056 - DNA, 19 bp, Homo sapiens
tcttggtgggtgtggccag

SEQ ID NO: 5316057 - DNA, 16 bp, Homo sapiens
tcttggtgtcaaattt

SEQ ID NO: 5316058 - DNA, 13 bp, Homo sapiens
tcttggtgtctgg

SEQ ID NO: 5316059 - DNA, 13 bp, Homo sapiens
tcttggtgttaaa

SEQ ID NO: 5316060 - DNA, 17 bp, Homo sapiens
tcttggtgttaaaacac

SEQ ID NO: 5316061 - DNA, 19 bp, Homo sapiens
tcttggtgtttgactgtaa

SEQ ID NO: 5316062 - DNA, 21 bp, Homo sapiens
tcttggttcataaatgaattt

SEQ ID NO: 5316063 - DNA, 19 bp, Homo sapiens
tcttggttccagcctgcca

SEQ ID NO: 5316064 - DNA, 13 bp, Homo sapiens
tcttggttcctgg

SEQ ID NO: 5316065 - DNA, 16 bp, Homo sapiens
tcttggttcctgggat

SEQ ID NO: 5316066 - DNA, 14 bp, Homo sapiens
tcttggttcctgtt

SEQ ID NO: 5316067 - DNA, 19 bp, Homo sapiens
tcttggttcgatacctgga

SEQ ID NO: 5316068 - DNA, 21 bp, Homo sapiens
tcttggttcgatacctggagc

SEQ ID NO: 5316069 - DNA, 13 bp, Homo sapiens
tcttggttctaaa

SEQ ID NO: 5316070 - DNA, 20 bp, Homo sapiens
tcttggttcttttttcagtt

SEQ ID NO: 5316071 - DNA, 13 bp, Homo sapiens
tcttggttgagga

SEQ ID NO: 5316072 - DNA, 15 bp, Homo sapiens
tcttggtttcagcca

SEQ ID NO: 5316073 - DNA, 14 bp, Homo sapiens
tcttggtttccaaa

SEQ ID NO: 5316074 - DNA, 22 bp, Homo sapiens
tcttggtttctctctacagtgc

SEQ ID NO: 5316075 - DNA, 16 bp, Homo sapiens
tcttggtttggggaga

SEQ ID NO: 5316076 - DNA, 21 bp, Homo sapiens
tcttggtttggttcatggtga

SEQ ID NO: 5316077 - DNA, 22 bp, Homo sapiens
tcttggtttgtcagtttatctt

SEQ ID NO: 5316078 - DNA, 20 bp, Homo sapiens
tcttggttttctctctggat

SEQ ID NO: 5316079 - DNA, 21 bp, Homo sapiens
tcttggttttctctctggatg

SEQ ID NO: 5316080 - DNA, 18 bp, Homo sapiens
tcttgtaaaactgtgaca

SEQ ID NO: 5316081 - DNA, 19 bp, Homo sapiens
tcttgtaaaactgtgacat

SEQ ID NO: 5316082 - DNA, 21 bp, Homo sapiens
tcttgtaaaactgtgacattc

SEQ ID NO: 5316083 - DNA, 20 bp, Homo sapiens
tcttgtaaacctggagggtt

SEQ ID NO: 5316084 - DNA, 17 bp, Homo sapiens
tcttgtaaagactggtt

SEQ ID NO: 5316085 - DNA, 23 bp, Homo sapiens
tcttgtaaagactggttttctgc

SEQ ID NO: 5316086 - DNA, 17 bp, Homo sapiens
tcttgtaaataaagccc

SEQ ID NO: 5316087 - DNA, 12 bp, Homo sapiens
tcttgtaaatgt

SEQ ID NO: 5316088 - DNA, 20 bp, Homo sapiens
tcttgtaacaactaattata

SEQ ID NO: 5316089 - DNA, 13 bp, Homo sapiens
tcttgtaagattt

SEQ ID NO: 5316090 - DNA, 18 bp, Homo sapiens
tcttgtaagattttgaaa

SEQ ID NO: 5316091 - DNA, 15 bp, Homo sapiens
tcttgtaagcaaaag

SEQ ID NO: 5316092 - DNA, 17 bp, Homo sapiens
tcttgtaaggctttgat

SEQ ID NO: 5316093 - DNA, 18 bp, Homo sapiens
tcttgtaaggctttgatt

SEQ ID NO: 5316094 - DNA, 21 bp, Homo sapiens
tcttgtaatttccagctttct

SEQ ID NO: 5316095 - DNA, 18 bp, Homo sapiens
tcttgtacaaactttgtt

SEQ ID NO: 5316096 - DNA, 15 bp, Homo sapiens
tcttgtacacttaag

SEQ ID NO: 5316097 - DNA, 16 bp, Homo sapiens
tcttgtaccagcccag

SEQ ID NO: 5316098 - DNA, 21 bp, Homo sapiens
tcttgtaccatagaaaaatgt

SEQ ID NO: 5316099 - DNA, 16 bp, Homo sapiens
tcttgtactgtgacct

SEQ ID NO: 5316100 - DNA, 22 bp, Homo sapiens
tcttgtactgtgacctaagaac

SEQ ID NO: 5316101 - DNA, 12 bp, Homo sapiens
tcttgtacttct

SEQ ID NO: 5316102 - DNA, 14 bp, Homo sapiens
tcttgtacttctgt

SEQ ID NO: 5316103 - DNA, 17 bp, Homo sapiens
tcttgtacttctgtgtt

SEQ ID NO: 5316104 - DNA, 22 bp, Homo sapiens
tcttgtacttctgtgttcattt

SEQ ID NO: 5316105 - DNA, 17 bp, Homo sapiens
tcttgtagccatggctg

SEQ ID NO: 5316106 - DNA, 18 bp, Homo sapiens
tcttgtagctttatcaaa

SEQ ID NO: 5316107 - DNA, 14 bp, Homo sapiens
tcttgtagtcttgg

SEQ ID NO: 5316108 - DNA, 20 bp, Homo sapiens
tcttgtataagatcctagat

SEQ ID NO: 5316109 - DNA, 21 bp, Homo sapiens
tcttgtataagatcctagatc

SEQ ID NO: 5316110 - DNA, 17 bp, Homo sapiens
tcttgtatacttgtatt

SEQ ID NO: 5316111 - DNA, 14 bp, Homo sapiens
tcttgtatagctga

SEQ ID NO: 5316112 - DNA, 19 bp, Homo sapiens
tcttgtattaaactcttca

SEQ ID NO: 5316113 - DNA, 22 bp, Homo sapiens
tcttgtattaagaatgaaatac

SEQ ID NO: 5316114 - DNA, 18 bp, Homo sapiens
tcttgtattaagttgtta

SEQ ID NO: 5316115 - DNA, 20 bp, Homo sapiens
tcttgtattatctcctttga

SEQ ID NO: 5316116 - DNA, 13 bp, Homo sapiens
tcttgtatttaaa

SEQ ID NO: 5316117 - DNA, 18 bp, Homo sapiens
tcttgtatttaaaaacat

SEQ ID NO: 5316118 - DNA, 11 bp, Homo sapiens
tcttgtatttg

SEQ ID NO: 5316119 - DNA, 21 bp, Homo sapiens
tcttgtattttaataaacttt

SEQ ID NO: 5316120 - DNA, 14 bp, Homo sapiens
tcttgtattttctt

SEQ ID NO: 5316121 - DNA, 16 bp, Homo sapiens
tcttgtcacaataaat

SEQ ID NO: 5316122 - DNA, 16 bp, Homo sapiens
tcttgtcacccaggct

SEQ ID NO: 5316123 - DNA, 20 bp, Homo sapiens
tcttgtcacccaggctggag

SEQ ID NO: 5316124 - DNA, 20 bp, Homo sapiens
tcttgtcagaattggcctca

SEQ ID NO: 5316125 - DNA, 20 bp, Homo sapiens
tcttgtcagacataaagcca

SEQ ID NO: 5316126 - DNA, 14 bp, Homo sapiens
tcttgtcatacaaa

SEQ ID NO: 5316127 - DNA, 17 bp, Homo sapiens
tcttgtcatataaacct

SEQ ID NO: 5316128 - DNA, 15 bp, Homo sapiens
tcttgtcatctttta

SEQ ID NO: 5316129 - DNA, 11 bp, Homo sapiens
tcttgtcatgt

SEQ ID NO: 5316130 - DNA, 17 bp, Homo sapiens
tcttgtcatgtgtataa

SEQ ID NO: 5316131 - DNA, 18 bp, Homo sapiens
tcttgtcattaacacatt

SEQ ID NO: 5316132 - DNA, 12 bp, Homo sapiens
tcttgtcattct

SEQ ID NO: 5316133 - DNA, 23 bp, Homo sapiens
tcttgtcccacgtgtcttccact

SEQ ID NO: 5316134 - DNA, 22 bp, Homo sapiens
tcttgtccctaagtaagtttct

SEQ ID NO: 5316135 - DNA, 13 bp, Homo sapiens
tcttgtcctagct

SEQ ID NO: 5316136 - DNA, 19 bp, Homo sapiens
tcttgtcctcagtccattt

SEQ ID NO: 5316137 - DNA, 20 bp, Homo sapiens
tcttgtcctcattcttgcct

SEQ ID NO: 5316138 - DNA, 13 bp, Homo sapiens
tcttgtcctggaa

SEQ ID NO: 5316139 - DNA, 21 bp, Homo sapiens
tcttgtcctgtatagcaacct

SEQ ID NO: 5316140 - DNA, 21 bp, Homo sapiens
tcttgtcctgtgatctgtgta

SEQ ID NO: 5316141 - DNA, 17 bp, Homo sapiens
tcttgtctcaatgctca

SEQ ID NO: 5316142 - DNA, 21 bp, Homo sapiens
tcttgtctcaatgctcataac

SEQ ID NO: 5316143 - DNA, 14 bp, Homo sapiens
tcttgtctcagatt

SEQ ID NO: 5316144 - DNA, 15 bp, Homo sapiens
tcttgtctcagattt

SEQ ID NO: 5316145 - DNA, 16 bp, Homo sapiens
tcttgtctcccctgtt

SEQ ID NO: 5316146 - DNA, 13 bp, Homo sapiens
tcttgtctgtgtg

SEQ ID NO: 5316147 - DNA, 15 bp, Homo sapiens
tcttgtcttcctatt

SEQ ID NO: 5316148 - DNA, 12 bp, Homo sapiens
tcttgtctttat

SEQ ID NO: 5316149 - DNA, 14 bp, Homo sapiens
tcttgtctttcctc

SEQ ID NO: 5316150 - DNA, 16 bp, Homo sapiens
tcttgtcttttcccct

SEQ ID NO: 5316151 - DNA, 18 bp, Homo sapiens
tcttgtcttttcccctca

SEQ ID NO: 5316152 - DNA, 13 bp, Homo sapiens
tcttgtgaaagtg

SEQ ID NO: 5316153 - DNA, 15 bp, Homo sapiens
tcttgtgaaattgtg

SEQ ID NO: 5316154 - DNA, 10 bp, Homo sapiens
tcttgtgaag

SEQ ID NO: 5316155 - DNA, 15 bp, Homo sapiens
tcttgtgaaggcagg

SEQ ID NO: 5316156 - DNA, 13 bp, Homo sapiens
tcttgtgaagttg

SEQ ID NO: 5316157 - DNA, 18 bp, Homo sapiens
tcttgtgaatatgtacat

SEQ ID NO: 5316158 - DNA, 22 bp, Homo sapiens
tcttgtgaatatgtacataggc

SEQ ID NO: 5316159 - DNA, 20 bp, Homo sapiens
tcttgtgaatattgtggctc

SEQ ID NO: 5316160 - DNA, 21 bp, Homo sapiens
tcttgtgacatattatgtctt

SEQ ID NO: 5316161 - DNA, 17 bp, Homo sapiens
tcttgtgacgtgcactg

SEQ ID NO: 5316162 - DNA, 11 bp, Homo sapiens
tcttgtgacta

SEQ ID NO: 5316163 - DNA, 14 bp, Homo sapiens
tcttgtgactagtg

SEQ ID NO: 5316164 - DNA, 18 bp, Homo sapiens
tcttgtgactagtgctga

SEQ ID NO: 5316165 - DNA, 19 bp, Homo sapiens
tcttgtgactagtgctgaa

SEQ ID NO: 5316166 - DNA, 22 bp, Homo sapiens
tcttgtgactagtgctgaagct

SEQ ID NO: 5316167 - DNA, 23 bp, Homo sapiens
tcttgtgaggaaagtcattggct

SEQ ID NO: 5316168 - DNA, 14 bp, Homo sapiens
tcttgtgcactggc

SEQ ID NO: 5316169 - DNA, 22 bp, Homo sapiens
tcttgtgcactttatcttggga

SEQ ID NO: 5316170 - DNA, 23 bp, Homo sapiens
tcttgtgcataattcttccaaag

SEQ ID NO: 5316171 - DNA, 16 bp, Homo sapiens
tcttgtgcatgcaaaa

SEQ ID NO: 5316172 - DNA, 15 bp, Homo sapiens
tcttgtgcatgttta

SEQ ID NO: 5316173 - DNA, 19 bp, Homo sapiens
tcttgtgctagaatacttt

SEQ ID NO: 5316174 - DNA, 21 bp, Homo sapiens
tcttgtgctatgaaacaatct

SEQ ID NO: 5316175 - DNA, 14 bp, Homo sapiens
tcttgtgctcagtc

SEQ ID NO: 5316176 - DNA, 23 bp, Homo sapiens
tcttgtgctggatggagcccagg

SEQ ID NO: 5316177 - DNA, 17 bp, Homo sapiens
tcttgtgcttttttgat

SEQ ID NO: 5316178 - DNA, 22 bp, Homo sapiens
tcttgtggaagacacttgctga

SEQ ID NO: 5316179 - DNA, 18 bp, Homo sapiens
tcttgtggaggatgaata

SEQ ID NO: 5316180 - DNA, 19 bp, Homo sapiens
tcttgtggatgttttaatt

SEQ ID NO: 5316181 - DNA, 22 bp, Homo sapiens
tcttgtggctttgcaaccattt

SEQ ID NO: 5316182 - DNA, 15 bp, Homo sapiens
tcttgtgggagacag

SEQ ID NO: 5316183 - DNA, 15 bp, Homo sapiens
tcttgtgggataatg

SEQ ID NO: 5316184 - DNA, 23 bp, Homo sapiens
tcttgtggtgtaaagctggccct

SEQ ID NO: 5316185 - DNA, 16 bp, Homo sapiens
tcttgtggttaaaaac

SEQ ID NO: 5316186 - DNA, 19 bp, Homo sapiens
tcttgtggttataacttaa

SEQ ID NO: 5316187 - DNA, 20 bp, Homo sapiens
tcttgtggttgtgtgtgttc

SEQ ID NO: 5316188 - DNA, 18 bp, Homo sapiens
tcttgtgtagatttgaaa

SEQ ID NO: 5316189 - DNA, 18 bp, Homo sapiens
tcttgtgtatttctctgt

SEQ ID NO: 5316190 - DNA, 20 bp, Homo sapiens
tcttgtgtatttctctgtga

SEQ ID NO: 5316191 - DNA, 14 bp, Homo sapiens
tcttgtgtcctggt

SEQ ID NO: 5316192 - DNA, 15 bp, Homo sapiens
tcttgtgtcctggta

SEQ ID NO: 5316193 - DNA, 23 bp, Homo sapiens
tcttgtgtctccttatggtacac

SEQ ID NO: 5316194 - DNA, 17 bp, Homo sapiens
tcttgtgtcttgagagc

SEQ ID NO: 5316195 - DNA, 19 bp, Homo sapiens
tcttgtgtgattaacttat

SEQ ID NO: 5316196 - DNA, 21 bp, Homo sapiens
tcttgtgtgtatgcacatgaa

SEQ ID NO: 5316197 - DNA, 16 bp, Homo sapiens
tcttgtgtgtttattg

SEQ ID NO: 5316198 - DNA, 12 bp, Homo sapiens
tcttgtgtttct

SEQ ID NO: 5316199 - DNA, 16 bp, Homo sapiens
tcttgtgtttgctgca

SEQ ID NO: 5316200 - DNA, 16 bp, Homo sapiens
tcttgttaagtgcagt

SEQ ID NO: 5316201 - DNA, 20 bp, Homo sapiens
tcttgttaatattctttcaa

SEQ ID NO: 5316202 - DNA, 19 bp, Homo sapiens
tcttgttaatgtcattgct

SEQ ID NO: 5316203 - DNA, 23 bp, Homo sapiens
tcttgttatcttttgtgtcctgt

SEQ ID NO: 5316204 - DNA, 19 bp, Homo sapiens
tcttgttatggtagaaaaa

SEQ ID NO: 5316205 - DNA, 16 bp, Homo sapiens
tcttgttatgtacaaa

SEQ ID NO: 5316206 - DNA, 13 bp, Homo sapiens
tcttgttattatt

SEQ ID NO: 5316207 - DNA, 15 bp, Homo sapiens
tcttgttcaggaaaa

SEQ ID NO: 5316208 - DNA, 19 bp, Homo sapiens
tcttgttcatgttttgcta

SEQ ID NO: 5316209 - DNA, 20 bp, Homo sapiens
tcttgttcatgttttgctaa

SEQ ID NO: 5316210 - DNA, 10 bp, Homo sapiens
tctttctata

SEQ ID NO: 5316211 - DNA, 18 bp, Homo sapiens
tctttctatagaaatatt

SEQ ID NO: 5316212 - DNA, 22 bp, Homo sapiens
tctttctatattttttaaattt

SEQ ID NO: 5316213 - DNA, 22 bp, Homo sapiens
tctttctattcataataaacta

SEQ ID NO: 5316214 - DNA, 22 bp, Homo sapiens
tctttctattgttaaacaaatg

SEQ ID NO: 5316215 - DNA, 23 bp, Homo sapiens
tctttctattgttaaacaaatga

SEQ ID NO: 5316216 - DNA, 14 bp, Homo sapiens
tctttctattttca

SEQ ID NO: 5316217 - DNA, 15 bp, Homo sapiens
tctttctattttcac

SEQ ID NO: 5316218 - DNA, 18 bp, Homo sapiens
tctttctcacccaggcaa

SEQ ID NO: 5316219 - DNA, 18 bp, Homo sapiens
tctttctcactaaatctt

SEQ ID NO: 5316220 - DNA, 12 bp, Homo sapiens
tctttctcactg

SEQ ID NO: 5316221 - DNA, 13 bp, Homo sapiens
tctttctccctca

SEQ ID NO: 5316222 - DNA, 23 bp, Homo sapiens
tctttctcctcaggacaaggcct

SEQ ID NO: 5316223 - DNA, 14 bp, Homo sapiens
tctttctcctggtg

SEQ ID NO: 5316224 - DNA, 16 bp, Homo sapiens
tctttctcctggtgac

SEQ ID NO: 5316225 - DNA, 14 bp, Homo sapiens
tctttctcctgtgg

SEQ ID NO: 5316226 - DNA, 24 bp, Homo sapiens
tctttctccttagtcttctcatag

SEQ ID NO: 5316227 - DNA, 20 bp, Homo sapiens
tctttctccttcattaatga

SEQ ID NO: 5316228 - DNA, 16 bp, Homo sapiens
tctttctctactttga

SEQ ID NO: 5316229 - DNA, 10 bp, Homo sapiens
tctttctctc

SEQ ID NO: 5316230 - DNA, 15 bp, Homo sapiens
tctttctctcagtga

SEQ ID NO: 5316231 - DNA, 16 bp, Homo sapiens
tctttctctcagtgaa

SEQ ID NO: 5316232 - DNA, 19 bp, Homo sapiens
tctttctctcctcagttta

SEQ ID NO: 5316233 - DNA, 11 bp, Homo sapiens
tctttctctct

SEQ ID NO: 5316234 - DNA, 21 bp, Homo sapiens
tctttctctctcactctcttc

SEQ ID NO: 5316235 - DNA, 12 bp, Homo sapiens
tctttctctctg

SEQ ID NO: 5316236 - DNA, 19 bp, Homo sapiens
tctttctctctgtgtggca

SEQ ID NO: 5316237 - DNA, 17 bp, Homo sapiens
tctttctctcttccctc

SEQ ID NO: 5316238 - DNA, 18 bp, Homo sapiens
tctttctctcttccctca

SEQ ID NO: 5316239 - DNA, 12 bp, Homo sapiens
tctttctctgcc

SEQ ID NO: 5316240 - DNA, 16 bp, Homo sapiens
tctttctctgccagtg

SEQ ID NO: 5316241 - DNA, 11 bp, Homo sapiens
tctttctctgg

SEQ ID NO: 5316242 - DNA, 16 bp, Homo sapiens
tctttctcttacctgt

SEQ ID NO: 5316243 - DNA, 17 bp, Homo sapiens
tctttctcttccctcct

SEQ ID NO: 5316244 - DNA, 15 bp, Homo sapiens
tctttctcttccctg

SEQ ID NO: 5316245 - DNA, 23 bp, Homo sapiens
tctttctgaaatagtcaaatacg

SEQ ID NO: 5316246 - DNA, 16 bp, Homo sapiens
tctttctgaagatcaa

SEQ ID NO: 5316247 - DNA, 18 bp, Homo sapiens
tctttctgagcacacttt

SEQ ID NO: 5316248 - DNA, 13 bp, Homo sapiens
tctttctgatttt

SEQ ID NO: 5316249 - DNA, 21 bp, Homo sapiens
tctttctgcagaaacagaaag

SEQ ID NO: 5316250 - DNA, 24 bp, Homo sapiens
tctttctgctctatactgtggcct

SEQ ID NO: 5316251 - DNA, 13 bp, Homo sapiens
tctttctgctggc

SEQ ID NO: 5316252 - DNA, 22 bp, Homo sapiens
tctttctggaattgatgtttac

SEQ ID NO: 5316253 - DNA, 19 bp, Homo sapiens
tctttctggctatgcattt

SEQ ID NO: 5316254 - DNA, 21 bp, Homo sapiens
tctttctggttgtttttaaac

SEQ ID NO: 5316255 - DNA, 13 bp, Homo sapiens
tctttctgtccct

SEQ ID NO: 5316256 - DNA, 13 bp, Homo sapiens
tctttctgtctcc

SEQ ID NO: 5316257 - DNA, 16 bp, Homo sapiens
tctttctgtctccctt

SEQ ID NO: 5316258 - DNA, 20 bp, Homo sapiens
tctttctgtgcttggatttg

SEQ ID NO: 5316259 - DNA, 22 bp, Homo sapiens
tctttctgtgtggtgaaaacat

SEQ ID NO: 5316260 - DNA, 14 bp, Homo sapiens
tctttctgttgaga

SEQ ID NO: 5316261 - DNA, 16 bp, Homo sapiens
tctttctgtttcctgg

SEQ ID NO: 5316262 - DNA, 17 bp, Homo sapiens
tctttctgtttcctggc

SEQ ID NO: 5316263 - DNA, 24 bp, Homo sapiens
tctttctgtttcctggcctcagag

SEQ ID NO: 5316264 - DNA, 20 bp, Homo sapiens
tctttcttacaaggaaggtg

SEQ ID NO: 5316265 - DNA, 17 bp, Homo sapiens
tctttcttactattggt

SEQ ID NO: 5316266 - DNA, 23 bp, Homo sapiens
tctttcttcaattaatggaaaac

SEQ ID NO: 5316267 - DNA, 12 bp, Homo sapiens
tctttcttcctc

SEQ ID NO: 5316268 - DNA, 13 bp, Homo sapiens
tctttcttcctct

SEQ ID NO: 5316269 - DNA, 15 bp, Homo sapiens
tctttcttcctctgc

SEQ ID NO: 5316270 - DNA, 12 bp, Homo sapiens
tctttcttcctt

SEQ ID NO: 5316271 - DNA, 13 bp, Homo sapiens
tctttcttccttt

SEQ ID NO: 5316272 - DNA, 15 bp, Homo sapiens
tctttcttcctttac

SEQ ID NO: 5316273 - DNA, 15 bp, Homo sapiens
tctttcttcctttct

SEQ ID NO: 5316274 - DNA, 16 bp, Homo sapiens
tctttcttcctttcta

SEQ ID NO: 5316275 - DNA, 12 bp, Homo sapiens
tctttcttctcg

SEQ ID NO: 5316276 - DNA, 18 bp, Homo sapiens
tctttcttcttccacaca

SEQ ID NO: 5316277 - DNA, 19 bp, Homo sapiens
tctttcttgaaattgaaga

SEQ ID NO: 5316278 - DNA, 20 bp, Homo sapiens
tctttcttgctggctctgag

SEQ ID NO: 5316279 - DNA, 12 bp, Homo sapiens
tctttcttggga

SEQ ID NO: 5316280 - DNA, 15 bp, Homo sapiens
tctttcttggtgcat

SEQ ID NO: 5316281 - DNA, 15 bp, Homo sapiens
tctttcttgtttgtc

SEQ ID NO: 5316282 - DNA, 21 bp, Homo sapiens
tctttcttgtttgtcagcatc

SEQ ID NO: 5316283 - DNA, 16 bp, Homo sapiens
tctttctttaaatgtt

SEQ ID NO: 5316284 - DNA, 16 bp, Homo sapiens
tctttctttcaataaa

SEQ ID NO: 5316285 - DNA, 12 bp, Homo sapiens
tctttctttcca

SEQ ID NO: 5316286 - DNA, 13 bp, Homo sapiens
tctttctttccaa

SEQ ID NO: 5316287 - DNA, 14 bp, Homo sapiens
tctttctttccaaa

SEQ ID NO: 5316288 - DNA, 15 bp, Homo sapiens
tctttctttccaaag

SEQ ID NO: 5316289 - DNA, 14 bp, Homo sapiens
tctttctttcttaa

SEQ ID NO: 5316290 - DNA, 19 bp, Homo sapiens
tctttctttgcaccaaaga

SEQ ID NO: 5316291 - DNA, 20 bp, Homo sapiens
tctttctttgctgctgtgga

SEQ ID NO: 5316292 - DNA, 21 bp, Homo sapiens
tctttctttggtgcctttcct

SEQ ID NO: 5316293 - DNA, 11 bp, Homo sapiens
tctttcttttc

SEQ ID NO: 5316294 - DNA, 11 bp, Homo sapiens
tctttcttttt

SEQ ID NO: 5316295 - DNA, 23 bp, Homo sapiens
tctttctttttccttcataattt

SEQ ID NO: 5316296 - DNA, 14 bp, Homo sapiens
tctttctttttctg

SEQ ID NO: 5316297 - DNA, 20 bp, Homo sapiens
tctttctttttctggaaatt

SEQ ID NO: 5316298 - DNA, 20 bp, Homo sapiens
tctttgaaagaaatgtacta

SEQ ID NO: 5316299 - DNA, 22 bp, Homo sapiens
tctttgaaagaaggaagacttt

SEQ ID NO: 5316300 - DNA, 21 bp, Homo sapiens
tctttgaaagacttccaaaga

SEQ ID NO: 5316301 - DNA, 13 bp, Homo sapiens
tctttgaaagctt

SEQ ID NO: 5316302 - DNA, 12 bp, Homo sapiens
tctttgaaatat

SEQ ID NO: 5316303 - DNA, 21 bp, Homo sapiens
tctttgaaatatgcatgtact

SEQ ID NO: 5316304 - DNA, 14 bp, Homo sapiens
tctttgaactgccg

SEQ ID NO: 5316305 - DNA, 19 bp, Homo sapiens
tctttgaagagatgacaac

SEQ ID NO: 5316306 - DNA, 23 bp, Homo sapiens
tctttgaagttatttagaaatat

SEQ ID NO: 5316307 - DNA, 15 bp, Homo sapiens
tctttgaataaagtc

SEQ ID NO: 5316308 - DNA, 19 bp, Homo sapiens
tctttgaataaagtctgag

SEQ ID NO: 5316309 - DNA, 20 bp, Homo sapiens
tctttgaataaagtctgagt

SEQ ID NO: 5316310 - DNA, 21 bp, Homo sapiens
tctttgaataaatgtcacttt

SEQ ID NO: 5316311 - DNA, 18 bp, Homo sapiens
tctttgaatacaaagaac

SEQ ID NO: 5316312 - DNA, 16 bp, Homo sapiens
tctttgaatatgtagt

SEQ ID NO: 5316313 - DNA, 15 bp, Homo sapiens
tctttgaatgacaaa

SEQ ID NO: 5316314 - DNA, 14 bp, Homo sapiens
tctttgaatgcttt

SEQ ID NO: 5316315 - DNA, 13 bp, Homo sapiens
tctttgaatgtat

SEQ ID NO: 5316316 - DNA, 12 bp, Homo sapiens
tctttgaatttc

SEQ ID NO: 5316317 - DNA, 21 bp, Homo sapiens
tctttgaattttcattttaca

SEQ ID NO: 5316318 - DNA, 19 bp, Homo sapiens
tctttgacaactaaaatta

SEQ ID NO: 5316319 - DNA, 22 bp, Homo sapiens
tctttgacaattcctagataaa

SEQ ID NO: 5316320 - DNA, 18 bp, Homo sapiens
tctttgacaattctgggt

SEQ ID NO: 5316321 - DNA, 17 bp, Homo sapiens
tctttgacactctgcag

SEQ ID NO: 5316322 - DNA, 15 bp, Homo sapiens
tctttgacatttttg

SEQ ID NO: 5316323 - DNA, 16 bp, Homo sapiens
tctttgaccaaactgt

SEQ ID NO: 5316324 - DNA, 23 bp, Homo sapiens
tctttgacctcaacctgtgatga

SEQ ID NO: 5316325 - DNA, 19 bp, Homo sapiens
tctttgacgggaggcctca

SEQ ID NO: 5316326 - DNA, 23 bp, Homo sapiens
tctttgactgaaaaaaaaaaaga

SEQ ID NO: 5316327 - DNA, 21 bp, Homo sapiens
tctttgagaaaggattaagat

SEQ ID NO: 5316328 - DNA, 21 bp, Homo sapiens
tctttgagaatattataaaaa

SEQ ID NO: 5316329 - DNA, 15 bp, Homo sapiens
tctttgagaccatcc

SEQ ID NO: 5316330 - DNA, 23 bp, Homo sapiens
tctttgagaccatccattctcct

SEQ ID NO: 5316331 - DNA, 12 bp, Homo sapiens
tctttgagaggg

SEQ ID NO: 5316332 - DNA, 22 bp, Homo sapiens
tctttgagatagaagaactgca

SEQ ID NO: 5316333 - DNA, 22 bp, Homo sapiens
tctttgagggactgcctctgcc

SEQ ID NO: 5316334 - DNA, 18 bp, Homo sapiens
tctttgagggttccatgg

SEQ ID NO: 5316335 - DNA, 14 bp, Homo sapiens
tctttgagtaatgt

SEQ ID NO: 5316336 - DNA, 17 bp, Homo sapiens
tctttgagtcaagtcaa

SEQ ID NO: 5316337 - DNA, 20 bp, Homo sapiens
tctttgagtcaagtcaaata

SEQ ID NO: 5316338 - DNA, 20 bp, Homo sapiens
tctttgataaagaaaagaat

SEQ ID NO: 5316339 - DNA, 13 bp, Homo sapiens
tctttgataacaa

SEQ ID NO: 5316340 - DNA, 16 bp, Homo sapiens
tctttgataacaggga

SEQ ID NO: 5316341 - DNA, 19 bp, Homo sapiens
tctttgatcgtatatttct

SEQ ID NO: 5316342 - DNA, 14 bp, Homo sapiens
tctttgatgtgttg

SEQ ID NO: 5316343 - DNA, 16 bp, Homo sapiens
tctttgatgtgttgtt

SEQ ID NO: 5316344 - DNA, 12 bp, Homo sapiens
tctttgatgtta

SEQ ID NO: 5316345 - DNA, 17 bp, Homo sapiens
tctttgatgttaacaca

SEQ ID NO: 5316346 - DNA, 23 bp, Homo sapiens
tctttgattagaaaataaactca

SEQ ID NO: 5316347 - DNA, 20 bp, Homo sapiens
tctttgattatttgcatgtt

SEQ ID NO: 5316348 - DNA, 19 bp, Homo sapiens
tctttgattctccttcagc

SEQ ID NO: 5316349 - DNA, 20 bp, Homo sapiens
tctttgattctccttcagcc

SEQ ID NO: 5316350 - DNA, 21 bp, Homo sapiens
tctttgattctccttttatgt

SEQ ID NO: 5316351 - DNA, 22 bp, Homo sapiens
tctttgattctccttttatgtg

SEQ ID NO: 5316352 - DNA, 17 bp, Homo sapiens
tctttgatttgtaccat

SEQ ID NO: 5316353 - DNA, 19 bp, Homo sapiens
tctttgatttgtaccattc

SEQ ID NO: 5316354 - DNA, 21 bp, Homo sapiens
tctttgattttcgacgtttga

SEQ ID NO: 5316355 - DNA, 23 bp, Homo sapiens
tctttgcaaagtattgtaaatta

SEQ ID NO: 5316356 - DNA, 21 bp, Homo sapiens
tctttgcaacagcagtgttct

SEQ ID NO: 5316357 - DNA, 15 bp, Homo sapiens
tctttgcacatgtga

SEQ ID NO: 5316358 - DNA, 17 bp, Homo sapiens
tctttgcacatgtgacc

SEQ ID NO: 5316359 - DNA, 16 bp, Homo sapiens
tctttgcacttaaaaa

SEQ ID NO: 5316360 - DNA, 13 bp, Homo sapiens
tctttgcagacag

SEQ ID NO: 5316361 - DNA, 18 bp, Homo sapiens
tctttgcagtgaagatgt

SEQ ID NO: 5316362 - DNA, 21 bp, Homo sapiens
tctttgcattccttacttgca

SEQ ID NO: 5316363 - DNA, 22 bp, Homo sapiens
tctttgcattccttacttgcac

SEQ ID NO: 5316364 - DNA, 16 bp, Homo sapiens
tctttgcattcgtcct

SEQ ID NO: 5316365 - DNA, 19 bp, Homo sapiens
tctttgccaaggtactttt

SEQ ID NO: 5316366 - DNA, 22 bp, Homo sapiens
tctttgccaagtaagagtggtg

SEQ ID NO: 5316367 - DNA, 14 bp, Homo sapiens
tctttgccaccctc

SEQ ID NO: 5316368 - DNA, 21 bp, Homo sapiens
tctttgccaccctcatgctgt

SEQ ID NO: 5316369 - DNA, 22 bp, Homo sapiens
tctttgccaccctcatgctgtg

SEQ ID NO: 5316370 - DNA, 15 bp, Homo sapiens
tctttgccatttctt

SEQ ID NO: 5316371 - DNA, 21 bp, Homo sapiens
tctttgcccccaaacccccat

SEQ ID NO: 5316372 - DNA, 22 bp, Homo sapiens
tctttgcccccgacggctgtga

SEQ ID NO: 5316373 - DNA, 15 bp, Homo sapiens
tctttgccctttact

SEQ ID NO: 5316374 - DNA, 12 bp, Homo sapiens
tctttgcctctg

SEQ ID NO: 5316375 - DNA, 20 bp, Homo sapiens
tctttgcctctgcagtctca

SEQ ID NO: 5316376 - DNA, 12 bp, Homo sapiens
tctttgcctgtt

SEQ ID NO: 5316377 - DNA, 16 bp, Homo sapiens
tctttgcctgttcagt

SEQ ID NO: 5316378 - DNA, 17 bp, Homo sapiens
tctttgcctgttcagtt

SEQ ID NO: 5316379 - DNA, 14 bp, Homo sapiens
tctttgccttgggc

SEQ ID NO: 5316380 - DNA, 19 bp, Homo sapiens
tctttgcggggcctgtctc

SEQ ID NO: 5316381 - DNA, 17 bp, Homo sapiens
tctttgctacaataaat

SEQ ID NO: 5316382 - DNA, 19 bp, Homo sapiens
tctttgctacaataaatgc

SEQ ID NO: 5316383 - DNA, 20 bp, Homo sapiens
tctttgctacaataaatgct

SEQ ID NO: 5316384 - DNA, 21 bp, Homo sapiens
tctttgctactgaatgtgttt

SEQ ID NO: 5316385 - DNA, 16 bp, Homo sapiens
tctttgctcccagttt

SEQ ID NO: 5316386 - DNA, 15 bp, Homo sapiens
tctttgctgaagaat

SEQ ID NO: 5316387 - DNA, 12 bp, Homo sapiens
tctttgctgccc

SEQ ID NO: 5316388 - DNA, 18 bp, Homo sapiens
tctttgctgcccctgtct

SEQ ID NO: 5316389 - DNA, 23 bp, Homo sapiens
tctttgctgctgtggaaaggatt

SEQ ID NO: 5316390 - DNA, 13 bp, Homo sapiens
tctttgctgtgcc

SEQ ID NO: 5316391 - DNA, 20 bp, Homo sapiens
tctttgctgtgccaaagcag

SEQ ID NO: 5316392 - DNA, 22 bp, Homo sapiens
tctttgctgttgacgttgatct

SEQ ID NO: 5316393 - DNA, 14 bp, Homo sapiens
tctttgctgttgtt

SEQ ID NO: 5316394 - DNA, 14 bp, Homo sapiens
tctttgctgtttgc

SEQ ID NO: 5316395 - DNA, 19 bp, Homo sapiens
tctttgcttcacttctccc

SEQ ID NO: 5316396 - DNA, 16 bp, Homo sapiens
tctttgcttgaacaca

SEQ ID NO: 5316397 - DNA, 19 bp, Homo sapiens
tctttgcttgaacacagta

SEQ ID NO: 5316398 - DNA, 14 bp, Homo sapiens
tctttgcttgtcct

SEQ ID NO: 5316399 - DNA, 17 bp, Homo sapiens
tctttgcttgtcctgct

SEQ ID NO: 5316400 - DNA, 12 bp, Homo sapiens
tctttgctttgc

SEQ ID NO: 5316401 - DNA, 17 bp, Homo sapiens
tctttgctttgcccagc

SEQ ID NO: 5316402 - DNA, 18 bp, Homo sapiens
tctttgctttgctttctg

SEQ ID NO: 5316403 - DNA, 23 bp, Homo sapiens
tctttgctttgctttctgctcag

SEQ ID NO: 5316404 - DNA, 15 bp, Homo sapiens
tctttgctttgtagt

SEQ ID NO: 5316405 - DNA, 19 bp, Homo sapiens
tctttggaaagtacactct

SEQ ID NO: 5316406 - DNA, 12 bp, Homo sapiens
tctttggaaata

SEQ ID NO: 5316407 - DNA, 17 bp, Homo sapiens
tctttggaaataaaaga

SEQ ID NO: 5316408 - DNA, 17 bp, Homo sapiens
tctttggaacactgttt

SEQ ID NO: 5316409 - DNA, 15 bp, Homo sapiens
tctttggaacagata

SEQ ID NO: 5316410 - DNA, 15 bp, Homo sapiens
tctttggaagcagcc

SEQ ID NO: 5316411 - DNA, 17 bp, Homo sapiens
tctttggaaggagtgag

SEQ ID NO: 5316412 - DNA, 12 bp, Homo sapiens
tctttggaatga

SEQ ID NO: 5316413 - DNA, 13 bp, Homo sapiens
tctttggaatgaa

SEQ ID NO: 5316414 - DNA, 22 bp, Homo sapiens
tctttggaatgaaattcctcct

SEQ ID NO: 5316415 - DNA, 23 bp, Homo sapiens
tctttggaatgaaattcctcctt

SEQ ID NO: 5316416 - DNA, 17 bp, Homo sapiens
tctttggaatgaacaat

SEQ ID NO: 5316417 - DNA, 19 bp, Homo sapiens
tctttggacagaagcagct

SEQ ID NO: 5316418 - DNA, 13 bp, Homo sapiens
tctttggaccctg

SEQ ID NO: 5316419 - DNA, 17 bp, Homo sapiens
tctttggagaggatttg

SEQ ID NO: 5316420 - DNA, 20 bp, Homo sapiens
tctttggcctacattcttta

SEQ ID NO: 5316421 - DNA, 22 bp, Homo sapiens
tctttggctcccctgtaccttt

SEQ ID NO: 5316422 - DNA, 12 bp, Homo sapiens
tctttggctcta

SEQ ID NO: 5316423 - DNA, 11 bp, Homo sapiens
tctttggctgc

SEQ ID NO: 5316424 - DNA, 14 bp, Homo sapiens
tctttggctgcagg

SEQ ID NO: 5316425 - DNA, 15 bp, Homo sapiens
tctttgggaatattt

SEQ ID NO: 5316426 - DNA, 16 bp, Homo sapiens
tctttgggaatatttg

SEQ ID NO: 5316427 - DNA, 22 bp, Homo sapiens
tctttgggacacctcagaaaac

SEQ ID NO: 5316428 - DNA, 14 bp, Homo sapiens
tctttgggaccctg

SEQ ID NO: 5316429 - DNA, 20 bp, Homo sapiens
tctttgggccagacatgcca

SEQ ID NO: 5316430 - DNA, 17 bp, Homo sapiens
tctttgggcctctcctg

SEQ ID NO: 5316431 - DNA, 20 bp, Homo sapiens
tctttgggcctctcctgccc

SEQ ID NO: 5316432 - DNA, 15 bp, Homo sapiens
tctttggggaaaaat

SEQ ID NO: 5316433 - DNA, 19 bp, Homo sapiens
tctttggggaaaaattctt

SEQ ID NO: 5316434 - DNA, 20 bp, Homo sapiens
tctttggggaggtgttcact

SEQ ID NO: 5316435 - DNA, 21 bp, Homo sapiens
tctttggggcaagatccaggt

SEQ ID NO: 5316436 - DNA, 19 bp, Homo sapiens
tctttgggggattcaaatg

SEQ ID NO: 5316437 - DNA, 22 bp, Homo sapiens
tctttgggggattcaaatgcat

SEQ ID NO: 5316438 - DNA, 14 bp, Homo sapiens
tctttggggtaaaa

SEQ ID NO: 5316439 - DNA, 17 bp, Homo sapiens
tctttggggtctacact

SEQ ID NO: 5316440 - DNA, 16 bp, Homo sapiens
tctttggggtgcccct

SEQ ID NO: 5316441 - DNA, 21 bp, Homo sapiens
tctttggtacaagtttacatg

SEQ ID NO: 5316442 - DNA, 18 bp, Homo sapiens
tctttggtaggtaaatct

SEQ ID NO: 5316443 - DNA, 16 bp, Homo sapiens
tctttggtattgtctt

SEQ ID NO: 5316444 - DNA, 18 bp, Homo sapiens
tctttggtcctcttgcca

SEQ ID NO: 5316445 - DNA, 14 bp, Homo sapiens
tctttggtctacac

SEQ ID NO: 5316446 - DNA, 22 bp, Homo sapiens
tctttggtgaacattgcaatag

SEQ ID NO: 5316447 - DNA, 15 bp, Homo sapiens
tctttggtgcctttc

SEQ ID NO: 5316448 - DNA, 17 bp, Homo sapiens
tctttggtgcctttcct

SEQ ID NO: 5316449 - DNA, 22 bp, Homo sapiens
tctttggtgcctttcctgttca

SEQ ID NO: 5316450 - DNA, 23 bp, Homo sapiens
tctttggtgcctttcctgttcag

SEQ ID NO: 5316451 - DNA, 15 bp, Homo sapiens
tctttggttcctcat

SEQ ID NO: 5316452 - DNA, 16 bp, Homo sapiens
tctttggttctaagga

SEQ ID NO: 5316453 - DNA, 19 bp, Homo sapiens
tctttgtaaaatcttgcag

SEQ ID NO: 5316454 - DNA, 19 bp, Homo sapiens
tctttgtaaaggtcagagt

SEQ ID NO: 5316455 - DNA, 18 bp, Homo sapiens
tctttgtaaatgcatatt

SEQ ID NO: 5316456 - DNA, 12 bp, Homo sapiens
tctttgtaagaa

SEQ ID NO: 5316457 - DNA, 22 bp, Homo sapiens
tctttgtaagaactaaagaaga

SEQ ID NO: 5316458 - DNA, 17 bp, Homo sapiens
tctttgtaagagcaaaa

SEQ ID NO: 5316459 - DNA, 14 bp, Homo sapiens
tctttgtaagagtg

SEQ ID NO: 5316460 - DNA, 17 bp, Homo sapiens
tctttgtaagtcagtgt

SEQ ID NO: 5316461 - DNA, 21 bp, Homo sapiens
tctttgtaagtcagtgttgag

SEQ ID NO: 5316462 - DNA, 14 bp, Homo sapiens
tctttgtaataaaa

SEQ ID NO: 5316463 - DNA, 13 bp, Homo sapiens
tctttgtaatgaa

SEQ ID NO: 5316464 - DNA, 17 bp, Homo sapiens
tctttgtaatgcttgta

SEQ ID NO: 5316465 - DNA, 19 bp, Homo sapiens
tctttgtaatttaatgaaa

SEQ ID NO: 5316466 - DNA, 14 bp, Homo sapiens
tctttgtacagaca

SEQ ID NO: 5316467 - DNA, 21 bp, Homo sapiens
tctttgtaccaaaattttaaa

SEQ ID NO: 5316468 - DNA, 23 bp, Homo sapiens
tctttgtaccaaaattttaaaaa

SEQ ID NO: 5316469 - DNA, 20 bp, Homo sapiens
tctttgtaccttttgtagtt

SEQ ID NO: 5316470 - DNA, 13 bp, Homo sapiens
tctttgtataaat

SEQ ID NO: 5316471 - DNA, 21 bp, Homo sapiens
tctttgtatataggcttctca

SEQ ID NO: 5316472 - DNA, 17 bp, Homo sapiens
tctttgtatcattcatc

SEQ ID NO: 5316473 - DNA, 14 bp, Homo sapiens
tctttgtatcttaa

SEQ ID NO: 5316474 - DNA, 18 bp, Homo sapiens
tctttgtatcttaaatct

SEQ ID NO: 5316475 - DNA, 16 bp, Homo sapiens
tctttgtatcttccat

SEQ ID NO: 5316476 - DNA, 15 bp, Homo sapiens
tctttgtcaatgctc

SEQ ID NO: 5316477 - DNA, 17 bp, Homo sapiens
tctttgtcaatgctcta

SEQ ID NO: 5316478 - DNA, 15 bp, Homo sapiens
tctttgtcagggagt

SEQ ID NO: 5316479 - DNA, 21 bp, Homo sapiens
tctttgtcccggataggctaa

SEQ ID NO: 5316480 - DNA, 23 bp, Homo sapiens
tctttgtctcaccagctcagccc

SEQ ID NO: 5316481 - DNA, 14 bp, Homo sapiens
tctttgtctgcctt

SEQ ID NO: 5316482 - DNA, 17 bp, Homo sapiens
tctttgtctttttccta

SEQ ID NO: 5316483 - DNA, 16 bp, Homo sapiens
tctttgtgacaggaaa

SEQ ID NO: 5316484 - DNA, 16 bp, Homo sapiens
tctttgtgataattta

SEQ ID NO: 5316485 - DNA, 22 bp, Homo sapiens
tctttgtgataatttaagagct

SEQ ID NO: 5316486 - DNA, 13 bp, Homo sapiens
tctttgtgccttt

SEQ ID NO: 5316487 - DNA, 15 bp, Homo sapiens
tctttgtgcctttgg

SEQ ID NO: 5316488 - DNA, 13 bp, Homo sapiens
tctttgtggccaa

SEQ ID NO: 5316489 - DNA, 13 bp, Homo sapiens
tctttgtggggct

SEQ ID NO: 5316490 - DNA, 22 bp, Homo sapiens
tctttgtgggttggccaggagg

SEQ ID NO: 5316491 - DNA, 21 bp, Homo sapiens
tctttgtgggtttttcatctt

SEQ ID NO: 5316492 - DNA, 14 bp, Homo sapiens
tctttgtggtttct

SEQ ID NO: 5316493 - DNA, 19 bp, Homo sapiens
tctttgtggtttcttgttt

SEQ ID NO: 5316494 - DNA, 20 bp, Homo sapiens
tctttgtgtgttatattcca

SEQ ID NO: 5316495 - DNA, 12 bp, Homo sapiens
tctttgtgtttt

SEQ ID NO: 5316496 - DNA, 18 bp, Homo sapiens
tctttgtgttttagggtg

SEQ ID NO: 5316497 - DNA, 13 bp, Homo sapiens
tctttgttaaaat

SEQ ID NO: 5316498 - DNA, 18 bp, Homo sapiens
tctttgttaagactgctg

SEQ ID NO: 5316499 - DNA, 15 bp, Homo sapiens
tctttgttataccat

SEQ ID NO: 5316500 - DNA, 11 bp, Homo sapiens
tctttgttcaa

SEQ ID NO: 5316501 - DNA, 16 bp, Homo sapiens
tctttgttcaagatga

SEQ ID NO: 5316502 - DNA, 12 bp, Homo sapiens
tctttgttcagt

SEQ ID NO: 5316503 - DNA, 13 bp, Homo sapiens
tctttgttcctgc

SEQ ID NO: 5316504 - DNA, 14 bp, Homo sapiens
tctttgttcctgct

SEQ ID NO: 5316505 - DNA, 16 bp, Homo sapiens
tctttgttcctgcttt

SEQ ID NO: 5316506 - DNA, 20 bp, Homo sapiens
tctttgttcctgctttctct

SEQ ID NO: 5316507 - DNA, 23 bp, Homo sapiens
tctttgttcctgctttctctttc

SEQ ID NO: 5316508 - DNA, 18 bp, Homo sapiens
tctttgtttatgcacttt

SEQ ID NO: 5316509 - DNA, 16 bp, Homo sapiens
tctttgtttctttctt

SEQ ID NO: 5316510 - DNA, 15 bp, Homo sapiens
tctttgtttctttgt

SEQ ID NO: 5316511 - DNA, 17 bp, Homo sapiens
tctttgttttgtgtctc

SEQ ID NO: 5316512 - DNA, 12 bp, Homo sapiens
tctttgttttta

SEQ ID NO: 5316513 - DNA, 23 bp, Homo sapiens
tctttgttttttgttttcattaa

SEQ ID NO: 5316514 - DNA, 13 bp, Homo sapiens
tcttttaaaaagt

SEQ ID NO: 5316515 - DNA, 17 bp, Homo sapiens
tcttttaaaaagtattg

SEQ ID NO: 5316516 - DNA, 18 bp, Homo sapiens
tcttttaaaaattcaaat

SEQ ID NO: 5316517 - DNA, 22 bp, Homo sapiens
tcttttaaaataagctttctca

SEQ ID NO: 5316518 - DNA, 21 bp, Homo sapiens
tcttttaaaatgaaatgtttt

SEQ ID NO: 5316519 - DNA, 13 bp, Homo sapiens
tcttttaaagacc

SEQ ID NO: 5316520 - DNA, 13 bp, Homo sapiens
tcttttaaagact

SEQ ID NO: 5316521 - DNA, 21 bp, Homo sapiens
tcttttaaagtatttataaaa

SEQ ID NO: 5316522 - DNA, 23 bp, Homo sapiens
tcttttaaagtgttactttttgt

SEQ ID NO: 5316523 - DNA, 12 bp, Homo sapiens
tcttttaagaat

SEQ ID NO: 5316524 - DNA, 14 bp, Homo sapiens
tcttttaagaatca

SEQ ID NO: 5316525 - DNA, 18 bp, Homo sapiens
tcttttaagcatttgtat

SEQ ID NO: 5316526 - DNA, 19 bp, Homo sapiens
tcttttaagcatttgtata

SEQ ID NO: 5316527 - DNA, 15 bp, Homo sapiens
tcttttaagccctgc

SEQ ID NO: 5316528 - DNA, 16 bp, Homo sapiens
tcttttaagccctgct

SEQ ID NO: 5316529 - DNA, 12 bp, Homo sapiens
tcttttaataaa

SEQ ID NO: 5316530 - DNA, 21 bp, Homo sapiens
tcttttaatgaggaccaatgt

SEQ ID NO: 5316531 - DNA, 12 bp, Homo sapiens
tcttttaatgct

SEQ ID NO: 5316532 - DNA, 15 bp, Homo sapiens
tcttttaattacaga

SEQ ID NO: 5316533 - DNA, 17 bp, Homo sapiens
tcttttaattgaaatta

SEQ ID NO: 5316534 - DNA, 20 bp, Homo sapiens
tcttttaattgtttcagaat

SEQ ID NO: 5316535 - DNA, 15 bp, Homo sapiens
tcttttacatacagt

SEQ ID NO: 5316536 - DNA, 18 bp, Homo sapiens
tcttttacatacagtgat

SEQ ID NO: 5316537 - DNA, 23 bp, Homo sapiens
tcttttaccaacttcctctgcca

SEQ ID NO: 5316538 - DNA, 22 bp, Homo sapiens
tcttttaccctggcccctctcc

SEQ ID NO: 5316539 - DNA, 13 bp, Homo sapiens
tcttttaccctgt

SEQ ID NO: 5316540 - DNA, 15 bp, Homo sapiens
tcttttaccctgtgt

SEQ ID NO: 5316541 - DNA, 20 bp, Homo sapiens
tcttttacctgctgcttctc

SEQ ID NO: 5316542 - DNA, 13 bp, Homo sapiens
tcttttactcctt

SEQ ID NO: 5316543 - DNA, 11 bp, Homo sapiens
tcttttactgt

SEQ ID NO: 5316544 - DNA, 14 bp, Homo sapiens
tcttttactgtaat

SEQ ID NO: 5316545 - DNA, 14 bp, Homo sapiens
tcttttactgtgga

SEQ ID NO: 5316546 - DNA, 20 bp, Homo sapiens
tcttttactgttatagaata

SEQ ID NO: 5316547 - DNA, 23 bp, Homo sapiens
tcttttactttttttagtaagtt

SEQ ID NO: 5316548 - DNA, 14 bp, Homo sapiens
tcttttagaaaagg

SEQ ID NO: 5316549 - DNA, 13 bp, Homo sapiens
tcttttagacaac

SEQ ID NO: 5316550 - DNA, 12 bp, Homo sapiens
tcttttagagag

SEQ ID NO: 5316551 - DNA, 18 bp, Homo sapiens
tcttttagatcctaagtc

SEQ ID NO: 5316552 - DNA, 18 bp, Homo sapiens
tcttttaggatcagatct

SEQ ID NO: 5316553 - DNA, 20 bp, Homo sapiens
tcttttagggtaagaagttt

SEQ ID NO: 5316554 - DNA, 23 bp, Homo sapiens
tcttttagttccaacaaagaaag

SEQ ID NO: 5316555 - DNA, 18 bp, Homo sapiens
tcttttagttttagttgc

SEQ ID NO: 5316556 - DNA, 22 bp, Homo sapiens
tcttttataaaaaaaatgaaat

SEQ ID NO: 5316557 - DNA, 24 bp, Homo sapiens
tcttttataaaaaaaatgaaatgt

SEQ ID NO: 5316558 - DNA, 14 bp, Homo sapiens
tcttttataaatat

SEQ ID NO: 5316559 - DNA, 17 bp, Homo sapiens
tcttttataatgattca

SEQ ID NO: 5316560 - DNA, 18 bp, Homo sapiens
tcttttatagacgctctt

SEQ ID NO: 5316561 - DNA, 15 bp, Homo sapiens
tcttttatataacta

SEQ ID NO: 5316562 - DNA, 15 bp, Homo sapiens
tcttttatatataaa

SEQ ID NO: 5316563 - DNA, 13 bp, Homo sapiens
tcttttatatttg

SEQ ID NO: 5316564 - DNA, 14 bp, Homo sapiens
tcttttatatttgt

SEQ ID NO: 5316565 - DNA, 17 bp, Homo sapiens
tcttttatatttgtatc

SEQ ID NO: 5316566 - DNA, 22 bp, Homo sapiens
tcttttatatttgtatcgatgt

SEQ ID NO: 5316567 - DNA, 19 bp, Homo sapiens
tgaaaagaagaaagtctat

SEQ ID NO: 5316568 - DNA, 12 bp, Homo sapiens
tgaaaagagctg

SEQ ID NO: 5316569 - DNA, 14 bp, Homo sapiens
tgaaaagaggaaca

SEQ ID NO: 5316570 - DNA, 22 bp, Homo sapiens
tgaaaagataggtttgagttca

SEQ ID NO: 5316571 - DNA, 12 bp, Homo sapiens
tgaaaagatgta

SEQ ID NO: 5316572 - DNA, 13 bp, Homo sapiens
tgaaaagatgtac

SEQ ID NO: 5316573 - DNA, 22 bp, Homo sapiens
tgaaaagatgtacctggtggat

SEQ ID NO: 5316574 - DNA, 18 bp, Homo sapiens
tgaaaagattccatttta

SEQ ID NO: 5316575 - DNA, 17 bp, Homo sapiens
tgaaaagattgcaaagg

SEQ ID NO: 5316576 - DNA, 17 bp, Homo sapiens
tgaaaagatttaagcac

SEQ ID NO: 5316577 - DNA, 17 bp, Homo sapiens
tgaaaagattttaacaa

SEQ ID NO: 5316578 - DNA, 16 bp, Homo sapiens
tgaaaagcaatacaac

SEQ ID NO: 5316579 - DNA, 16 bp, Homo sapiens
tgaaaagcaatattgt

SEQ ID NO: 5316580 - DNA, 16 bp, Homo sapiens
tgaaaagcagacattt

SEQ ID NO: 5316581 - DNA, 18 bp, Homo sapiens
tgaaaagcaggttgataa

SEQ ID NO: 5316582 - DNA, 19 bp, Homo sapiens
tgaaaagcaggttgataaa

SEQ ID NO: 5316583 - DNA, 19 bp, Homo sapiens
tgaaaagccaaaggtcaaa

SEQ ID NO: 5316584 - DNA, 12 bp, Homo sapiens
tgaaaagccata

SEQ ID NO: 5316585 - DNA, 20 bp, Homo sapiens
tgaaaagccatgtttaagat

SEQ ID NO: 5316586 - DNA, 23 bp, Homo sapiens
tgaaaagcctccgcctgctgtgt

SEQ ID NO: 5316587 - DNA, 16 bp, Homo sapiens
tgaaaagcctctgttt

SEQ ID NO: 5316588 - DNA, 19 bp, Homo sapiens
tgaaaagctgactgttttt

SEQ ID NO: 5316589 - DNA, 21 bp, Homo sapiens
tgaaaagcttaataaattcca

SEQ ID NO: 5316590 - DNA, 23 bp, Homo sapiens
tgaaaagcttcttaattaatttg

SEQ ID NO: 5316591 - DNA, 14 bp, Homo sapiens
tgaaaagctttcct

SEQ ID NO: 5316592 - DNA, 21 bp, Homo sapiens
tgaaaagctttgtttgttctt

SEQ ID NO: 5316593 - DNA, 21 bp, Homo sapiens
tgaaaaggaaaaaatgcaaac

SEQ ID NO: 5316594 - DNA, 22 bp, Homo sapiens
tgaaaaggactcttgagccctc

SEQ ID NO: 5316595 - DNA, 18 bp, Homo sapiens
tgaaaaggaggggtacat

SEQ ID NO: 5316596 - DNA, 22 bp, Homo sapiens
tgaaaaggatattatctacctg

SEQ ID NO: 5316597 - DNA, 16 bp, Homo sapiens
tgaaaaggcaaaaagc

SEQ ID NO: 5316598 - DNA, 23 bp, Homo sapiens
tgaaaagggatgatgtggttttt

SEQ ID NO: 5316599 - DNA, 14 bp, Homo sapiens
tgaaaagggcactc

SEQ ID NO: 5316600 - DNA, 19 bp, Homo sapiens
tgaaaagggcactcccaac

SEQ ID NO: 5316601 - DNA, 15 bp, Homo sapiens
tgaaaagggcagagg

SEQ ID NO: 5316602 - DNA, 23 bp, Homo sapiens
tgaaaagggcggaagagttacaa

SEQ ID NO: 5316603 - DNA, 18 bp, Homo sapiens
tgaaaaggtacaacagaa

SEQ ID NO: 5316604 - DNA, 21 bp, Homo sapiens
tgaaaaggtgtccttttcctt

SEQ ID NO: 5316605 - DNA, 19 bp, Homo sapiens
tgaaaaggtttatgaaaaa

SEQ ID NO: 5316606 - DNA, 21 bp, Homo sapiens
tgaaaaggtttatgaaaaaga

SEQ ID NO: 5316607 - DNA, 14 bp, Homo sapiens
tgaaaagtaaaaaa

SEQ ID NO: 5316608 - DNA, 22 bp, Homo sapiens
tgaaaagtactaatagaacttg

SEQ ID NO: 5316609 - DNA, 12 bp, Homo sapiens
tgaaaagtagag

SEQ ID NO: 5316610 - DNA, 21 bp, Homo sapiens
tgaaaagtatattgataacct

SEQ ID NO: 5316611 - DNA, 23 bp, Homo sapiens
tgaaaagtattggttactggtga

SEQ ID NO: 5316612 - DNA, 12 bp, Homo sapiens
tgaaaagtcaaa

SEQ ID NO: 5316613 - DNA, 17 bp, Homo sapiens
tgaaaagtcgttttcca

SEQ ID NO: 5316614 - DNA, 17 bp, Homo sapiens
tgaaaagtgaagacaga

SEQ ID NO: 5316615 - DNA, 10 bp, Homo sapiens
tgaaaagtgc

SEQ ID NO: 5316616 - DNA, 14 bp, Homo sapiens
tgaaaagtgcatgg

SEQ ID NO: 5316617 - DNA, 13 bp, Homo sapiens
tgaaaagtgtcct

SEQ ID NO: 5316618 - DNA, 23 bp, Homo sapiens
tgaaaagttcagggaccgtccag

SEQ ID NO: 5316619 - DNA, 13 bp, Homo sapiens
tgaaaagttgaaa

SEQ ID NO: 5316620 - DNA, 15 bp, Homo sapiens
tgaaaagttggaagg

SEQ ID NO: 5316621 - DNA, 21 bp, Homo sapiens
tgaaaagttggaaggatctgc

SEQ ID NO: 5316622 - DNA, 23 bp, Homo sapiens
tgaaaataaaaaatattgaaatg

SEQ ID NO: 5316623 - DNA, 16 bp, Homo sapiens
tgaaaataaaaagaga

SEQ ID NO: 5316624 - DNA, 20 bp, Homo sapiens
tgaaaataaaataaacgaaa

SEQ ID NO: 5316625 - DNA, 19 bp, Homo sapiens
tgaaaataaagcagaagca

SEQ ID NO: 5316626 - DNA, 17 bp, Homo sapiens
tgaaaataaagtgtata

SEQ ID NO: 5316627 - DNA, 13 bp, Homo sapiens
tgaaaataactga

SEQ ID NO: 5316628 - DNA, 20 bp, Homo sapiens
tgaaaataactgaaccaaat

SEQ ID NO: 5316629 - DNA, 16 bp, Homo sapiens
tgaaaataactgaatt

SEQ ID NO: 5316630 - DNA, 18 bp, Homo sapiens
tgaaaataactgaatttg

SEQ ID NO: 5316631 - DNA, 15 bp, Homo sapiens
tgaaaataagaaaga

SEQ ID NO: 5316632 - DNA, 17 bp, Homo sapiens
tgaaaataagattccag

SEQ ID NO: 5316633 - DNA, 14 bp, Homo sapiens
tgaaaataagccat

SEQ ID NO: 5316634 - DNA, 20 bp, Homo sapiens
tgaaaataataaagtggcat

SEQ ID NO: 5316635 - DNA, 17 bp, Homo sapiens
tgaaaataatctctgat

SEQ ID NO: 5316636 - DNA, 13 bp, Homo sapiens
tgaaaataattgt

SEQ ID NO: 5316637 - DNA, 21 bp, Homo sapiens
tgaaaataccataggaagaca

SEQ ID NO: 5316638 - DNA, 13 bp, Homo sapiens
tgaaaatactgga

SEQ ID NO: 5316639 - DNA, 20 bp, Homo sapiens
tgaaaatactggaattcaaa

SEQ ID NO: 5316640 - DNA, 15 bp, Homo sapiens
tgaaaatagcaggac

SEQ ID NO: 5316641 - DNA, 15 bp, Homo sapiens
tgaaaatagtgttcc

SEQ ID NO: 5316642 - DNA, 22 bp, Homo sapiens
tgaaaatagtttattttaaaac

SEQ ID NO: 5316643 - DNA, 23 bp, Homo sapiens
tgaaaatagtttattttaaaaca

SEQ ID NO: 5316644 - DNA, 14 bp, Homo sapiens
tgaaaatatatatt

SEQ ID NO: 5316645 - DNA, 18 bp, Homo sapiens
tgaaaatatgtactgtat

SEQ ID NO: 5316646 - DNA, 20 bp, Homo sapiens
tgaaaatattatctttgtaa

SEQ ID NO: 5316647 - DNA, 16 bp, Homo sapiens
tgaaaatattctgatt

SEQ ID NO: 5316648 - DNA, 14 bp, Homo sapiens
tgaaaatatttaaa

SEQ ID NO: 5316649 - DNA, 14 bp, Homo sapiens
tgaaaatatttcta

SEQ ID NO: 5316650 - DNA, 21 bp, Homo sapiens
tgaaaatatttctatgtaaat

SEQ ID NO: 5316651 - DNA, 20 bp, Homo sapiens
tgaaaatatttctctagtgt

SEQ ID NO: 5316652 - DNA, 14 bp, Homo sapiens
tgaaaatcaaagta

SEQ ID NO: 5316653 - DNA, 14 bp, Homo sapiens
tgaaaatcactata

SEQ ID NO: 5316654 - DNA, 13 bp, Homo sapiens
tgaaaatcctacc

SEQ ID NO: 5316655 - DNA, 18 bp, Homo sapiens
tgaaaatcctatatctgt

SEQ ID NO: 5316656 - DNA, 19 bp, Homo sapiens
tgaaaatcctatatctgtt

SEQ ID NO: 5316657 - DNA, 22 bp, Homo sapiens
tgaaaatcctatatctgtttgt

SEQ ID NO: 5316658 - DNA, 17 bp, Homo sapiens
tgaaaatcgaggaagca

SEQ ID NO: 5316659 - DNA, 19 bp, Homo sapiens
tgaaaatcgtgacaacact

SEQ ID NO: 5316660 - DNA, 15 bp, Homo sapiens
tgaaaatctaatatt

SEQ ID NO: 5316661 - DNA, 20 bp, Homo sapiens
tgaaaatcttataatttaaa

SEQ ID NO: 5316662 - DNA, 14 bp, Homo sapiens
tgaaaatcttggag

SEQ ID NO: 5316663 - DNA, 21 bp, Homo sapiens
tgaaaatgaatatctattaat

SEQ ID NO: 5316664 - DNA, 18 bp, Homo sapiens
tgaaaatgattataagcc

SEQ ID NO: 5316665 - DNA, 21 bp, Homo sapiens
tgaaaatgcaacaacatgtat

SEQ ID NO: 5316666 - DNA, 11 bp, Homo sapiens
tgaaaatgcca

SEQ ID NO: 5316667 - DNA, 12 bp, Homo sapiens
tgaaaatgccac

SEQ ID NO: 5316668 - DNA, 13 bp, Homo sapiens
tgaaaatgccacc

SEQ ID NO: 5316669 - DNA, 13 bp, Homo sapiens
tgaaaatgctctt

SEQ ID NO: 5316670 - DNA, 16 bp, Homo sapiens
tgaaaatgctttgaaa

SEQ ID NO: 5316671 - DNA, 18 bp, Homo sapiens
tgaaaatggctgaagaaa

SEQ ID NO: 5316672 - DNA, 20 bp, Homo sapiens
tgaaaatggctgaagaaaca

SEQ ID NO: 5316673 - DNA, 18 bp, Homo sapiens
tgaaaatggtttcaagtt

SEQ ID NO: 5316674 - DNA, 20 bp, Homo sapiens
tgaaaatggtttcaagttat

SEQ ID NO: 5316675 - DNA, 13 bp, Homo sapiens
tgaaaatggtttt

SEQ ID NO: 5316676 - DNA, 12 bp, Homo sapiens
tgaaaatgtaaa

SEQ ID NO: 5316677 - DNA, 22 bp, Homo sapiens
tgaaaatgtaagtaaatgtctg

SEQ ID NO: 5316678 - DNA, 13 bp, Homo sapiens
tgaaaatgtacat

SEQ ID NO: 5316679 - DNA, 16 bp, Homo sapiens
tgaaaatgtactgaga

SEQ ID NO: 5316680 - DNA, 22 bp, Homo sapiens
tgaaaatgtatggatgaattct

SEQ ID NO: 5316681 - DNA, 24 bp, Homo sapiens
tgaaaatgtatggatgaattctga

SEQ ID NO: 5316682 - DNA, 23 bp, Homo sapiens
tgaaaatgtattcctttaaaata

SEQ ID NO: 5316683 - DNA, 14 bp, Homo sapiens
tgaaaatgtatttg

SEQ ID NO: 5316684 - DNA, 14 bp, Homo sapiens
tgaaaatgtcactg

SEQ ID NO: 5316685 - DNA, 15 bp, Homo sapiens
tgaaaatgtcagaaa

SEQ ID NO: 5316686 - DNA, 18 bp, Homo sapiens
tgaaaatgtcagaaacca

SEQ ID NO: 5316687 - DNA, 16 bp, Homo sapiens
tgaaaatgtccaggaa

SEQ ID NO: 5316688 - DNA, 13 bp, Homo sapiens
tgaaaatgtcctt

SEQ ID NO: 5316689 - DNA, 23 bp, Homo sapiens
tgaaaatgtccttgtgatgtgca

SEQ ID NO: 5316690 - DNA, 18 bp, Homo sapiens
tgaaaatgtctcagtatt

SEQ ID NO: 5316691 - DNA, 13 bp, Homo sapiens
tgaaaatgtcttg

SEQ ID NO: 5316692 - DNA, 14 bp, Homo sapiens
tgaaaatgtcttgt

SEQ ID NO: 5316693 - DNA, 13 bp, Homo sapiens
tgaaaatgtgaat

SEQ ID NO: 5316694 - DNA, 20 bp, Homo sapiens
tgaaaatgtgctatactgca

SEQ ID NO: 5316695 - DNA, 22 bp, Homo sapiens
tgaaaatgtgctatactgcata

SEQ ID NO: 5316696 - DNA, 13 bp, Homo sapiens
tgaaaatgtgtat

SEQ ID NO: 5316697 - DNA, 13 bp, Homo sapiens
tgaaaatgttcat

SEQ ID NO: 5316698 - DNA, 18 bp, Homo sapiens
tgaaaattacctttaatg

SEQ ID NO: 5316699 - DNA, 23 bp, Homo sapiens
tgaaaattcaaaaagtgtttatt

SEQ ID NO: 5316700 - DNA, 14 bp, Homo sapiens
tgaaaattcagtgg

SEQ ID NO: 5316701 - DNA, 22 bp, Homo sapiens
tgaaaattcatagtaagattga

SEQ ID NO: 5316702 - DNA, 14 bp, Homo sapiens
tgaaaattccaatt

SEQ ID NO: 5316703 - DNA, 18 bp, Homo sapiens
tgaaaattccagaaagga

SEQ ID NO: 5316704 - DNA, 20 bp, Homo sapiens
tgaaaattcgcccgagctgt

SEQ ID NO: 5316705 - DNA, 22 bp, Homo sapiens
tgaaaattctaacccaagacat

SEQ ID NO: 5316706 - DNA, 13 bp, Homo sapiens
tgaaaattctgga

SEQ ID NO: 5316707 - DNA, 13 bp, Homo sapiens
tgaaaattctgtt

SEQ ID NO: 5316708 - DNA, 12 bp, Homo sapiens
tgaaaattcttg

SEQ ID NO: 5316709 - DNA, 23 bp, Homo sapiens
tgaaaattgaccaagtgatgtgt

SEQ ID NO: 5316710 - DNA, 15 bp, Homo sapiens
tgaaaattgtataaa

SEQ ID NO: 5316711 - DNA, 12 bp, Homo sapiens
tgaaaatttata

SEQ ID NO: 5316712 - DNA, 17 bp, Homo sapiens
tgaaaatttatataact

SEQ ID NO: 5316713 - DNA, 12 bp, Homo sapiens
tgaaaattttaa

SEQ ID NO: 5316714 - DNA, 19 bp, Homo sapiens
tgaaaattttaaaaataca

SEQ ID NO: 5316715 - DNA, 14 bp, Homo sapiens
tgaaaattttacca

SEQ ID NO: 5316716 - DNA, 13 bp, Homo sapiens
tgaaaattttact

SEQ ID NO: 5316717 - DNA, 19 bp, Homo sapiens
tgaaaattttgatgtttta

SEQ ID NO: 5316718 - DNA, 19 bp, Homo sapiens
tgaaacaaaaaaaaaatga

SEQ ID NO: 5316719 - DNA, 19 bp, Homo sapiens
tgaaacaaaaattgtcttt

SEQ ID NO: 5316720 - DNA, 20 bp, Homo sapiens
tgaaacaaaccgaaaatgga

SEQ ID NO: 5316721 - DNA, 15 bp, Homo sapiens
tgaaacaaagaaaga

SEQ ID NO: 5316722 - DNA, 14 bp, Homo sapiens
tgaaacaaagctgc

SEQ ID NO: 5316723 - DNA, 18 bp, Homo sapiens
tgaaacaaagtactcttt

SEQ ID NO: 5316724 - DNA, 22 bp, Homo sapiens
tgaaacaaataatcacattgac

SEQ ID NO: 5316725 - DNA, 14 bp, Homo sapiens
tgaaacaaatatac

SEQ ID NO: 5316726 - DNA, 21 bp, Homo sapiens
tgaaacaaatatactcatttg

SEQ ID NO: 5316727 - DNA, 14 bp, Homo sapiens
tgaaacaaattaat

SEQ ID NO: 5316728 - DNA, 22 bp, Homo sapiens
tgaaacaacaaataggaattgt

SEQ ID NO: 5316729 - DNA, 18 bp, Homo sapiens
tgaaacaacattatttta

SEQ ID NO: 5316730 - DNA, 20 bp, Homo sapiens
tgaaacaacattattttaaa

SEQ ID NO: 5316731 - DNA, 22 bp, Homo sapiens
tgaaacaacattattttaaaat

SEQ ID NO: 5316732 - DNA, 21 bp, Homo sapiens
tgaaacaatgcctacagctgt

SEQ ID NO: 5316733 - DNA, 20 bp, Homo sapiens
tgaaacaattattgtacact

SEQ ID NO: 5316734 - DNA, 13 bp, Homo sapiens
tgaaacacaaaca

SEQ ID NO: 5316735 - DNA, 12 bp, Homo sapiens
tgaaacacaata

SEQ ID NO: 5316736 - DNA, 17 bp, Homo sapiens
tgaaacacaatatcatc

SEQ ID NO: 5316737 - DNA, 14 bp, Homo sapiens
aaaaagttaaatgt

SEQ ID NO: 5316738 - DNA, 12 bp, Homo sapiens
aaaaagttatat

SEQ ID NO: 5316739 - DNA, 19 bp, Homo sapiens
aaaaagttattatgtagct

SEQ ID NO: 5316740 - DNA, 13 bp, Homo sapiens
aaaaagttcagag

SEQ ID NO: 5316741 - DNA, 13 bp, Homo sapiens
aaaaagttccttc

SEQ ID NO: 5316742 - DNA, 15 bp, Homo sapiens
aaaaagttgaaccat

SEQ ID NO: 5316743 - DNA, 20 bp, Homo sapiens
aaaaagttgcagctgttttg

SEQ ID NO: 5316744 - DNA, 17 bp, Homo sapiens
aaaaagttggtatttta

SEQ ID NO: 5316745 - DNA, 12 bp, Homo sapiens
aaaaagttgtat

SEQ ID NO: 5316746 - DNA, 21 bp, Homo sapiens
aaaaagttgtatgatctgtgc

SEQ ID NO: 5316747 - DNA, 13 bp, Homo sapiens
aaaaagttgttca

SEQ ID NO: 5316748 - DNA, 14 bp, Homo sapiens
aaaaagttgttcaa

SEQ ID NO: 5316749 - DNA, 16 bp, Homo sapiens
aaaaagttgtttataa

SEQ ID NO: 5316750 - DNA, 14 bp, Homo sapiens
aaaaagtttccata

SEQ ID NO: 5316751 - DNA, 19 bp, Homo sapiens
aaaaagtttctatttagtt

SEQ ID NO: 5316752 - DNA, 19 bp, Homo sapiens
aaaaagtttgttactttga

SEQ ID NO: 5316753 - DNA, 21 bp, Homo sapiens
aaaaagtttgttactttgaat

SEQ ID NO: 5316754 - DNA, 13 bp, Homo sapiens
aaaaagttttgat

SEQ ID NO: 5316755 - DNA, 23 bp, Homo sapiens
aaaaagtttttttaaaaaagcaa

SEQ ID NO: 5316756 - DNA, 14 bp, Homo sapiens
aaaaataaaaaaca

SEQ ID NO: 5316757 - DNA, 22 bp, Homo sapiens
aaaaataaaaaggatctccttt

SEQ ID NO: 5316758 - DNA, 18 bp, Homo sapiens
aaaaataaaacagtatct

SEQ ID NO: 5316759 - DNA, 12 bp, Homo sapiens
aaaaataaaata

SEQ ID NO: 5316760 - DNA, 17 bp, Homo sapiens
aaaaataaaatgcattt

SEQ ID NO: 5316761 - DNA, 19 bp, Homo sapiens
aaaaataaactagtttcca

SEQ ID NO: 5316762 - DNA, 12 bp, Homo sapiens
aaaaataaagca

SEQ ID NO: 5316763 - DNA, 15 bp, Homo sapiens
aaaaataaagctact

SEQ ID NO: 5316764 - DNA, 13 bp, Homo sapiens
aaaaataaatata

SEQ ID NO: 5316765 - DNA, 19 bp, Homo sapiens
aaaaataaccccaaaatga

SEQ ID NO: 5316766 - DNA, 12 bp, Homo sapiens
aaaaataagttt

SEQ ID NO: 5316767 - DNA, 13 bp, Homo sapiens
aaaaataatacaa

SEQ ID NO: 5316768 - DNA, 17 bp, Homo sapiens
aaaaataatcaagattt

SEQ ID NO: 5316769 - DNA, 14 bp, Homo sapiens
aaaaataatgaatg

SEQ ID NO: 5316770 - DNA, 13 bp, Homo sapiens
aaaaataattgga

SEQ ID NO: 5316771 - DNA, 10 bp, Homo sapiens
aaaaatacaa

SEQ ID NO: 5316772 - DNA, 18 bp, Homo sapiens
aaaaatacagtaaagttt

SEQ ID NO: 5316773 - DNA, 15 bp, Homo sapiens
aaaaatacatagcat

SEQ ID NO: 5316774 - DNA, 14 bp, Homo sapiens
aaaaatacatgttc

SEQ ID NO: 5316775 - DNA, 15 bp, Homo sapiens
aaaaatacattttat

SEQ ID NO: 5316776 - DNA, 19 bp, Homo sapiens
aaaaatacgttttgtgtat

SEQ ID NO: 5316777 - DNA, 18 bp, Homo sapiens
aaaaatactatttaagat

SEQ ID NO: 5316778 - DNA, 13 bp, Homo sapiens
aaaaatactcaga

SEQ ID NO: 5316779 - DNA, 14 bp, Homo sapiens
aaaaatactctaat

SEQ ID NO: 5316780 - DNA, 15 bp, Homo sapiens
aaaaatactctaatt

SEQ ID NO: 5316781 - DNA, 22 bp, Homo sapiens
aaaaatactcttgatttcacat

SEQ ID NO: 5316782 - DNA, 15 bp, Homo sapiens
aaaaatacttgagct

SEQ ID NO: 5316783 - DNA, 22 bp, Homo sapiens
aaaaatacttgtcaatatttaa

SEQ ID NO: 5316784 - DNA, 12 bp, Homo sapiens
aaaaatagaaac

SEQ ID NO: 5316785 - DNA, 13 bp, Homo sapiens
aaaaatagaaatt

SEQ ID NO: 5316786 - DNA, 13 bp, Homo sapiens
aaaaatagagaga

SEQ ID NO: 5316787 - DNA, 18 bp, Homo sapiens
aaaaatagatgtctttta

SEQ ID NO: 5316788 - DNA, 20 bp, Homo sapiens
aaaaatagatgttttaactt

SEQ ID NO: 5316789 - DNA, 13 bp, Homo sapiens
aaaaataggcttt

SEQ ID NO: 5316790 - DNA, 19 bp, Homo sapiens
aaaaatagtaagcctccct

SEQ ID NO: 5316791 - DNA, 14 bp, Homo sapiens
aaaaatagtttgga

SEQ ID NO: 5316792 - DNA, 13 bp, Homo sapiens
aaaaatataaaac

SEQ ID NO: 5316793 - DNA, 14 bp, Homo sapiens
aaaaatataaaact

SEQ ID NO: 5316794 - DNA, 14 bp, Homo sapiens
aaaaatatacatgt

SEQ ID NO: 5316795 - DNA, 16 bp, Homo sapiens
aaaaatatacatgttt

SEQ ID NO: 5316796 - DNA, 17 bp, Homo sapiens
aaaaatatacatgttta

SEQ ID NO: 5316797 - DNA, 13 bp, Homo sapiens
aaaaatatactga

SEQ ID NO: 5316798 - DNA, 12 bp, Homo sapiens
aaaaatatatat

SEQ ID NO: 5316799 - DNA, 15 bp, Homo sapiens
aaaaatatatgtaat

SEQ ID NO: 5316800 - DNA, 21 bp, Homo sapiens
aaaaatatattaaaaatataa

SEQ ID NO: 5316801 - DNA, 12 bp, Homo sapiens
aaaaatatattt

SEQ ID NO: 5316802 - DNA, 19 bp, Homo sapiens
aaaaatatatttaatgata

SEQ ID NO: 5316803 - DNA, 20 bp, Homo sapiens
aaaaatatcaaaaaggagct

SEQ ID NO: 5316804 - DNA, 14 bp, Homo sapiens
aaaaatatcaaatt

SEQ ID NO: 5316805 - DNA, 15 bp, Homo sapiens
aaaaatatcaaatta

SEQ ID NO: 5316806 - DNA, 12 bp, Homo sapiens
aaaaatatctcc

SEQ ID NO: 5316807 - DNA, 19 bp, Homo sapiens
aaaaatatctcctccaatg

SEQ ID NO: 5316808 - DNA, 12 bp, Homo sapiens
aaaaatatgaac

SEQ ID NO: 5316809 - DNA, 14 bp, Homo sapiens
aaaaatatgtaatt

SEQ ID NO: 5316810 - DNA, 10 bp, Homo sapiens
aaaaatatta

SEQ ID NO: 5316811 - DNA, 15 bp, Homo sapiens
aaaaatattaactga

SEQ ID NO: 5316812 - DNA, 22 bp, Homo sapiens
aaaaatattcaagtaacacttt

SEQ ID NO: 5316813 - DNA, 13 bp, Homo sapiens
aaaaatattccat

SEQ ID NO: 5316814 - DNA, 12 bp, Homo sapiens
aaaaatattgct

SEQ ID NO: 5316815 - DNA, 15 bp, Homo sapiens
aaaaatattgctaaa

SEQ ID NO: 5316816 - DNA, 20 bp, Homo sapiens
aaaaatattgtcatgtttat

SEQ ID NO: 5316817 - DNA, 12 bp, Homo sapiens
aaaaatattgtt

SEQ ID NO: 5316818 - DNA, 23 bp, Homo sapiens
aaaaatattgtttctgcattcat

SEQ ID NO: 5316819 - DNA, 11 bp, Homo sapiens
aaaaatatttt

SEQ ID NO: 5316820 - DNA, 18 bp, Homo sapiens
aaaaatattttaagaaag

SEQ ID NO: 5316821 - DNA, 21 bp, Homo sapiens
aaaaatattttaagaaagaga

SEQ ID NO: 5316822 - DNA, 14 bp, Homo sapiens
aaaaatattttatg

SEQ ID NO: 5316823 - DNA, 13 bp, Homo sapiens
aaaaatattttct

SEQ ID NO: 5316824 - DNA, 12 bp, Homo sapiens
aaaaatcaagta

SEQ ID NO: 5316825 - DNA, 12 bp, Homo sapiens
aaaaatcaatca

SEQ ID NO: 5316826 - DNA, 19 bp, Homo sapiens
aaaaatcacaaaaacaaaa

SEQ ID NO: 5316827 - DNA, 17 bp, Homo sapiens
aaaaatcactcatataa

SEQ ID NO: 5316828 - DNA, 12 bp, Homo sapiens
aaaaatcactgt

SEQ ID NO: 5316829 - DNA, 17 bp, Homo sapiens
aaaaatcagtgtttaaa

SEQ ID NO: 5316830 - DNA, 13 bp, Homo sapiens
aaaaatcagtttt

SEQ ID NO: 5316831 - DNA, 17 bp, Homo sapiens
aaaaatcatctattttg

SEQ ID NO: 5316832 - DNA, 20 bp, Homo sapiens
aaaaatcatctattttgatg

SEQ ID NO: 5316833 - DNA, 12 bp, Homo sapiens
aaaaatccactc

SEQ ID NO: 5316834 - DNA, 14 bp, Homo sapiens
aaaaatccagaaac

SEQ ID NO: 5316835 - DNA, 16 bp, Homo sapiens
aaaaatccagaaagaa

SEQ ID NO: 5316836 - DNA, 14 bp, Homo sapiens
aaaaatcctgtcat

SEQ ID NO: 5316837 - DNA, 19 bp, Homo sapiens
aaaaatccttctaatctgc

SEQ ID NO: 5316838 - DNA, 17 bp, Homo sapiens
aaaaatctacagtgttt

SEQ ID NO: 5316839 - DNA, 14 bp, Homo sapiens
aaaaatctcattat

SEQ ID NO: 5316840 - DNA, 13 bp, Homo sapiens
aaaaatctgaaga

SEQ ID NO: 5316841 - DNA, 14 bp, Homo sapiens
aaaaatctgaagat

SEQ ID NO: 5316842 - DNA, 18 bp, Homo sapiens
aaaaatctgcagaaggaa

SEQ ID NO: 5316843 - DNA, 18 bp, Homo sapiens
aaaaatctgctgttaact

SEQ ID NO: 5316844 - DNA, 19 bp, Homo sapiens
aaaaatcttaatactgtta

SEQ ID NO: 5316845 - DNA, 12 bp, Homo sapiens
aaaaatctttca

SEQ ID NO: 5316846 - DNA, 14 bp, Homo sapiens
aaaaatctttcaga

SEQ ID NO: 5316847 - DNA, 15 bp, Homo sapiens
aaaaatctttttgat

SEQ ID NO: 5316848 - DNA, 13 bp, Homo sapiens
aaaaatgaaaact

SEQ ID NO: 5316849 - DNA, 12 bp, Homo sapiens
aaaaatgaaatt

SEQ ID NO: 5316850 - DNA, 14 bp, Homo sapiens
aaaaatgaagcaga

SEQ ID NO: 5316851 - DNA, 15 bp, Homo sapiens
aaaaatgaatgtcta

SEQ ID NO: 5316852 - DNA, 15 bp, Homo sapiens
aaaaatgacaacaga

SEQ ID NO: 5316853 - DNA, 17 bp, Homo sapiens
aaaaatgacagatgttg

SEQ ID NO: 5316854 - DNA, 20 bp, Homo sapiens
aaaaatgactaaaaatatta

SEQ ID NO: 5316855 - DNA, 11 bp, Homo sapiens
aaaaatgagaa

SEQ ID NO: 5316856 - DNA, 20 bp, Homo sapiens
aaaaatgagagctgtaactg

SEQ ID NO: 5316857 - DNA, 16 bp, Homo sapiens
aaaaatgagatttctt

SEQ ID NO: 5316858 - DNA, 23 bp, Homo sapiens
aaaaatgagcttccattaatttt

SEQ ID NO: 5316859 - DNA, 13 bp, Homo sapiens
aaaaatgatactt

SEQ ID NO: 5316860 - DNA, 16 bp, Homo sapiens
aaaaatgatctattgc

SEQ ID NO: 5316861 - DNA, 14 bp, Homo sapiens
aaaaatgatgtctt

SEQ ID NO: 5316862 - DNA, 15 bp, Homo sapiens
aaaaatgatgttcat

SEQ ID NO: 5316863 - DNA, 16 bp, Homo sapiens
aaaaatgatttcagta

SEQ ID NO: 5316864 - DNA, 15 bp, Homo sapiens
aaaaatgattttgct

SEQ ID NO: 5316865 - DNA, 22 bp, Homo sapiens
aaaaatgcaaatcctatgtgat

SEQ ID NO: 5316866 - DNA, 17 bp, Homo sapiens
aaaaatgcaacaaatga

SEQ ID NO: 5316867 - DNA, 15 bp, Homo sapiens
aaaaatgcaatatct

SEQ ID NO: 5316868 - DNA, 19 bp, Homo sapiens
aaaaatgcatttaagttgt

SEQ ID NO: 5316869 - DNA, 15 bp, Homo sapiens
aaaaatgccataata

SEQ ID NO: 5316870 - DNA, 22 bp, Homo sapiens
aaaaatgccataatacaaaagg

SEQ ID NO: 5316871 - DNA, 17 bp, Homo sapiens
aaaaatgcctgctgctg

SEQ ID NO: 5316872 - DNA, 13 bp, Homo sapiens
aaaaatgcctttg

SEQ ID NO: 5316873 - DNA, 22 bp, Homo sapiens
aaaaatgcctttgagacagttt

SEQ ID NO: 5316874 - DNA, 17 bp, Homo sapiens
aaaaatgctaatattaa

SEQ ID NO: 5316875 - DNA, 15 bp, Homo sapiens
aaaaatgctgcttct

SEQ ID NO: 5316876 - DNA, 12 bp, Homo sapiens
aaaaatgctggg

SEQ ID NO: 5316877 - DNA, 22 bp, Homo sapiens
aaaaatggaacataaaatacaa

SEQ ID NO: 5316878 - DNA, 17 bp, Homo sapiens
aaaaatggagttgtttt

SEQ ID NO: 5316879 - DNA, 14 bp, Homo sapiens
aaaaatggctcaga

SEQ ID NO: 5316880 - DNA, 16 bp, Homo sapiens
aaaaatgggacttctt

SEQ ID NO: 5316881 - DNA, 17 bp, Homo sapiens
aaaaatgggacttcttt

SEQ ID NO: 5316882 - DNA, 20 bp, Homo sapiens
aaaaatgggagacagcctct

SEQ ID NO: 5316883 - DNA, 22 bp, Homo sapiens
aaaaatgggagacagcctctta

SEQ ID NO: 5316884 - DNA, 14 bp, Homo sapiens
aaaaatggtataaa

SEQ ID NO: 5316885 - DNA, 18 bp, Homo sapiens
aaaaatggtataaaaggt

SEQ ID NO: 5316886 - DNA, 15 bp, Homo sapiens
aaaaatggtgcctga

SEQ ID NO: 5316887 - DNA, 19 bp, Homo sapiens
aaaaatggtggcttcagct

SEQ ID NO: 5316888 - DNA, 19 bp, Homo sapiens
aaaaatggtggtttgtcat

SEQ ID NO: 5316889 - DNA, 19 bp, Homo sapiens
aaaaatggttgatggaaaa

SEQ ID NO: 5316890 - DNA, 14 bp, Homo sapiens
aaaaatgtaaatac

SEQ ID NO: 5316891 - DNA, 23 bp, Homo sapiens
aaaaatgtaaatactcatgaatg

SEQ ID NO: 5316892 - DNA, 14 bp, Homo sapiens
aaaaatgtaacatc

SEQ ID NO: 5316893 - DNA, 16 bp, Homo sapiens
aaaaatgtaacatcat

SEQ ID NO: 5316894 - DNA, 16 bp, Homo sapiens
aaaaatgtaatttaga

SEQ ID NO: 5316895 - DNA, 15 bp, Homo sapiens
aaaaatgtacattta

SEQ ID NO: 5316896 - DNA, 21 bp, Homo sapiens
aaaaatgtacatttattcata

SEQ ID NO: 5316897 - DNA, 19 bp, Homo sapiens
aaaaatgtacttaaagggt

SEQ ID NO: 5316898 - DNA, 21 bp, Homo sapiens
aaaaatgtagaaattcttcat

SEQ ID NO: 5316899 - DNA, 18 bp, Homo sapiens
aaaaatgtagaatgattt

SEQ ID NO: 5316900 - DNA, 11 bp, Homo sapiens
aaaaatgtagg

SEQ ID NO: 5316901 - DNA, 12 bp, Homo sapiens
aaaaatgtagga

SEQ ID NO: 5316902 - DNA, 20 bp, Homo sapiens
aaaaatgtataatgactttt

SEQ ID NO: 5316903 - DNA, 16 bp, Homo sapiens
aaaaatgtatatgcac

SEQ ID NO: 5316904 - DNA, 12 bp, Homo sapiens
aaaaatgtattt

SEQ ID NO: 5316905 - DNA, 12 bp, Homo sapiens
aaaaatgtcact

SEQ ID NO: 5316906 - DNA, 16 bp, Homo sapiens
aaaaatgtcattactt

SEQ ID NO: 5316907 - DNA, 12 bp, Homo sapiens
aaaaatgtctta

SEQ ID NO: 5316908 - DNA, 14 bp, Homo sapiens
aaaaatgtgaaatt

SEQ ID NO: 5316909 - DNA, 12 bp, Homo sapiens
aaaaatgtgtaa

SEQ ID NO: 5316910 - DNA, 21 bp, Homo sapiens
aaaaatgttacgtgaagaaat

SEQ ID NO: 5316911 - DNA, 11 bp, Homo sapiens
aaaaatgttag

SEQ ID NO: 5316912 - DNA, 14 bp, Homo sapiens
aaaaatgttcactt

SEQ ID NO: 5316913 - DNA, 21 bp, Homo sapiens
aaaaatgttcccttgaccatt

SEQ ID NO: 5316914 - DNA, 12 bp, Homo sapiens
aaaaatgttcta

SEQ ID NO: 5316915 - DNA, 12 bp, Homo sapiens
aaaaatgttgaa

SEQ ID NO: 5316916 - DNA, 16 bp, Homo sapiens
aaaaatgttgagaagc

SEQ ID NO: 5316917 - DNA, 16 bp, Homo sapiens
aaaaatgtttccactg

SEQ ID NO: 5316918 - DNA, 22 bp, Homo sapiens
aaaaatgttttatggtagcttt

SEQ ID NO: 5316919 - DNA, 22 bp, Homo sapiens
aaaaatgtttttagaacatgta

SEQ ID NO: 5316920 - DNA, 23 bp, Homo sapiens
aaaaatgtttttggtcttttata

SEQ ID NO: 5316921 - DNA, 20 bp, Homo sapiens
aaaaatgttttttcatgtgt

SEQ ID NO: 5316922 - DNA, 19 bp, Homo sapiens
tgaaacacacagtgaccaa

SEQ ID NO: 5316923 - DNA, 18 bp, Homo sapiens
tgaaacacaccaggctgt

SEQ ID NO: 5316924 - DNA, 13 bp, Homo sapiens
tgaaacacacgag

SEQ ID NO: 5316925 - DNA, 15 bp, Homo sapiens
tgaaacacacgagca

SEQ ID NO: 5316926 - DNA, 14 bp, Homo sapiens
tgaaacacagctgt

SEQ ID NO: 5316927 - DNA, 17 bp, Homo sapiens
tgaaacacagctgttct

SEQ ID NO: 5316928 - DNA, 19 bp, Homo sapiens
tgaaacacagctgttcttc

SEQ ID NO: 5316929 - DNA, 20 bp, Homo sapiens
tgaaatataaactgtgagat

SEQ ID NO: 5316930 - DNA, 13 bp, Homo sapiens
tgaaatataaatt

SEQ ID NO: 5316931 - DNA, 16 bp, Homo sapiens
tgaaatataaattatc

SEQ ID NO: 5316932 - DNA, 16 bp, Homo sapiens
tgaaatatagatgtta

SEQ ID NO: 5316933 - DNA, 16 bp, Homo sapiens
tgaaatatatgtgaaa

SEQ ID NO: 5316934 - DNA, 19 bp, Homo sapiens
tgaaatatattttaaatgt

SEQ ID NO: 5316935 - DNA, 20 bp, Homo sapiens
tgaaatatattttaaatgtg

SEQ ID NO: 5316936 - DNA, 14 bp, Homo sapiens
tgaaatatcatgtt

SEQ ID NO: 5316937 - DNA, 20 bp, Homo sapiens
tgaaatatcccgggggtggg

SEQ ID NO: 5316938 - DNA, 15 bp, Homo sapiens
tgaaatatctgtatt

SEQ ID NO: 5316939 - DNA, 20 bp, Homo sapiens
tgaaatatgagaagatcctg

SEQ ID NO: 5316940 - DNA, 20 bp, Homo sapiens
tgaaatatgatgttaaaaaa

SEQ ID NO: 5316941 - DNA, 12 bp, Homo sapiens
tgaaatatgcat

SEQ ID NO: 5316942 - DNA, 19 bp, Homo sapiens
tgaaatatgcatactaatt

SEQ ID NO: 5316943 - DNA, 15 bp, Homo sapiens
tgaaatatgcatgta

SEQ ID NO: 5316944 - DNA, 15 bp, Homo sapiens
tgaaatatgctcttt

SEQ ID NO: 5316945 - DNA, 16 bp, Homo sapiens
tgaaatattaaaatca

SEQ ID NO: 5316946 - DNA, 13 bp, Homo sapiens
tgaaatattactc

SEQ ID NO: 5316947 - DNA, 21 bp, Homo sapiens
tgaaatattagttacttgcta

SEQ ID NO: 5316948 - DNA, 14 bp, Homo sapiens
tgaaatattcttag

SEQ ID NO: 5316949 - DNA, 17 bp, Homo sapiens
tgaaatattgtaaatgc

SEQ ID NO: 5316950 - DNA, 21 bp, Homo sapiens
tgaaatattttctactttaaa

SEQ ID NO: 5316951 - DNA, 14 bp, Homo sapiens
tgaaatattttctt

SEQ ID NO: 5316952 - DNA, 14 bp, Homo sapiens
tgaaatattttgaa

SEQ ID NO: 5316953 - DNA, 17 bp, Homo sapiens
tgaaatcaactcagtgg

SEQ ID NO: 5316954 - DNA, 19 bp, Homo sapiens
tgaaatcaatgcaagagtg

SEQ ID NO: 5316955 - DNA, 21 bp, Homo sapiens
tgaaatcaccacattctgtct

SEQ ID NO: 5316956 - DNA, 16 bp, Homo sapiens
tgaaatcaccttttct

SEQ ID NO: 5316957 - DNA, 19 bp, Homo sapiens
tgaaatcaccttttctaaa

SEQ ID NO: 5316958 - DNA, 19 bp, Homo sapiens
tgaaatcagtaaacactgt

SEQ ID NO: 5316959 - DNA, 18 bp, Homo sapiens
tgaaatcagtatcagaat

SEQ ID NO: 5316960 - DNA, 19 bp, Homo sapiens
tgaaatcagtggtgttaca

SEQ ID NO: 5316961 - DNA, 16 bp, Homo sapiens
tgaaatcagttactct

SEQ ID NO: 5316962 - DNA, 17 bp, Homo sapiens
tgaaatcagttactctt

SEQ ID NO: 5316963 - DNA, 17 bp, Homo sapiens
tgaaatcatattatttt

SEQ ID NO: 5316964 - DNA, 16 bp, Homo sapiens
tgaaatcatctttgtt

SEQ ID NO: 5316965 - DNA, 15 bp, Homo sapiens
tgaaatcattcattt

SEQ ID NO: 5316966 - DNA, 14 bp, Homo sapiens
tgaaatccaggtct

SEQ ID NO: 5316967 - DNA, 15 bp, Homo sapiens
tgaaatccataaact

SEQ ID NO: 5316968 - DNA, 19 bp, Homo sapiens
tgaaatccataaactaaga

SEQ ID NO: 5316969 - DNA, 12 bp, Homo sapiens
tgaaatccctgc

SEQ ID NO: 5316970 - DNA, 14 bp, Homo sapiens
tgaaatccttgaga

SEQ ID NO: 5316971 - DNA, 17 bp, Homo sapiens
tgaaatctaatatttct

SEQ ID NO: 5316972 - DNA, 23 bp, Homo sapiens
tgaaatctacaacataatgatac

SEQ ID NO: 5316973 - DNA, 19 bp, Homo sapiens
tgaaatctcagatacttat

SEQ ID NO: 5316974 - DNA, 18 bp, Homo sapiens
tgaaatctgctagaaagt

SEQ ID NO: 5316975 - DNA, 15 bp, Homo sapiens
tgaaatctgtcaaga

SEQ ID NO: 5316976 - DNA, 21 bp, Homo sapiens
tgaaatctgtcaagagtagtt

SEQ ID NO: 5316977 - DNA, 12 bp, Homo sapiens
tgaaatctgtct

SEQ ID NO: 5316978 - DNA, 18 bp, Homo sapiens
tgaaatcttaaaaacctg

SEQ ID NO: 5316979 - DNA, 19 bp, Homo sapiens
tgaaatcttaaaaacctgc

SEQ ID NO: 5316980 - DNA, 16 bp, Homo sapiens
tgaaatcttgtttgtt

SEQ ID NO: 5316981 - DNA, 19 bp, Homo sapiens
tgaaatcttgtttgttact

SEQ ID NO: 5316982 - DNA, 23 bp, Homo sapiens
tgaaatcttgtttgttactgtca

SEQ ID NO: 5316983 - DNA, 15 bp, Homo sapiens
tgaaatctttctttc

SEQ ID NO: 5316984 - DNA, 13 bp, Homo sapiens
tgaaatgaaaaca

SEQ ID NO: 5316985 - DNA, 19 bp, Homo sapiens
tgaaatgaaaacatgtaat

SEQ ID NO: 5316986 - DNA, 18 bp, Homo sapiens
tgaaatgaaaatcaattt

SEQ ID NO: 5316987 - DNA, 21 bp, Homo sapiens
tgaaatgaaacaaataatcac

SEQ ID NO: 5316988 - DNA, 12 bp, Homo sapiens
tgaaatgaaagg

SEQ ID NO: 5316989 - DNA, 17 bp, Homo sapiens
tgaaatgaaagggaaac

SEQ ID NO: 5316990 - DNA, 18 bp, Homo sapiens
tgaaatgaaagggaaact

SEQ ID NO: 5316991 - DNA, 14 bp, Homo sapiens
tgaaatgaaattta

SEQ ID NO: 5316992 - DNA, 23 bp, Homo sapiens
tgaaatgaaatttaaacattaaa

SEQ ID NO: 5316993 - DNA, 15 bp, Homo sapiens
tgaaatgaactttgt

SEQ ID NO: 5316994 - DNA, 13 bp, Homo sapiens
tgaaatgaatgaa

SEQ ID NO: 5316995 - DNA, 17 bp, Homo sapiens
tgaaatgaatttacaga

SEQ ID NO: 5316996 - DNA, 21 bp, Homo sapiens
tgaaatgagcatgcattttct

SEQ ID NO: 5316997 - DNA, 21 bp, Homo sapiens
tgaaatgaggagagaaggaca

SEQ ID NO: 5316998 - DNA, 14 bp, Homo sapiens
tgaaatgaggccta

SEQ ID NO: 5316999 - DNA, 19 bp, Homo sapiens
tgaaatgagtaaaaactag

SEQ ID NO: 5317000 - DNA, 20 bp, Homo sapiens
tgaaatgagtaaaaactaga

SEQ ID NO: 5317001 - DNA, 16 bp, Homo sapiens
tgaaatgataaagact

SEQ ID NO: 5317002 - DNA, 19 bp, Homo sapiens
tgaaatgataaagactttt

SEQ ID NO: 5317003 - DNA, 19 bp, Homo sapiens
tgaaatgatttcacagtgt

SEQ ID NO: 5317004 - DNA, 19 bp, Homo sapiens
tgaaatgcagagtcaatga

SEQ ID NO: 5317005 - DNA, 12 bp, Homo sapiens
tgaaatgcattt

SEQ ID NO: 5317006 - DNA, 17 bp, Homo sapiens
tgaaatgccaagtgcct

SEQ ID NO: 5317007 - DNA, 23 bp, Homo sapiens
tgaaatgccactgggacagctgg

SEQ ID NO: 5317008 - DNA, 18 bp, Homo sapiens
tgaaatgccttactttgt

SEQ ID NO: 5317009 - DNA, 21 bp, Homo sapiens
tgaaatgccttactttgtatg

SEQ ID NO: 5317010 - DNA, 16 bp, Homo sapiens
tgaaatgctaaacttg

SEQ ID NO: 5317011 - DNA, 21 bp, Homo sapiens
tgaaatgctatgtcatttcat

SEQ ID NO: 5317012 - DNA, 22 bp, Homo sapiens
tgaaatgctatgtcatttcatg

SEQ ID NO: 5317013 - DNA, 17 bp, Homo sapiens
tgaaatgctctcctttc

SEQ ID NO: 5317014 - DNA, 19 bp, Homo sapiens
tgaaatgctcttttgcaca

SEQ ID NO: 5317015 - DNA, 13 bp, Homo sapiens
tgaaatgctgtat

SEQ ID NO: 5317016 - DNA, 23 bp, Homo sapiens
tgaaatgcttatgcttgtgtata

SEQ ID NO: 5317017 - DNA, 15 bp, Homo sapiens
tgaaatgcttttata

SEQ ID NO: 5317018 - DNA, 18 bp, Homo sapiens
tgaaatgcttttatattc

SEQ ID NO: 5317019 - DNA, 12 bp, Homo sapiens
tgaaatggaaca

SEQ ID NO: 5317020 - DNA, 19 bp, Homo sapiens
tgaaatggacttttgtaca

SEQ ID NO: 5317021 - DNA, 19 bp, Homo sapiens
tgaaatggatactacatct

SEQ ID NO: 5317022 - DNA, 13 bp, Homo sapiens
tgaaatggctggg

SEQ ID NO: 5317023 - DNA, 15 bp, Homo sapiens
tgaaatggctggggc

SEQ ID NO: 5317024 - DNA, 20 bp, Homo sapiens
tgaaatgggaacaatatcaa

SEQ ID NO: 5317025 - DNA, 23 bp, Homo sapiens
tgaaatgggaacaatatcaatat

SEQ ID NO: 5317026 - DNA, 15 bp, Homo sapiens
tgaaatgggcattta

SEQ ID NO: 5317027 - DNA, 18 bp, Homo sapiens
tgaaatgggctttaacaa

SEQ ID NO: 5317028 - DNA, 23 bp, Homo sapiens
tgaaatggggattattatagcaa

SEQ ID NO: 5317029 - DNA, 17 bp, Homo sapiens
tgaaatggggcgctgga

SEQ ID NO: 5317030 - DNA, 17 bp, Homo sapiens
tgaaatggggctactgt

SEQ ID NO: 5317031 - DNA, 22 bp, Homo sapiens
tgaaatggttgtcacctctctc

SEQ ID NO: 5317032 - DNA, 12 bp, Homo sapiens
tgaaatgtaaca

SEQ ID NO: 5317033 - DNA, 14 bp, Homo sapiens
tgaaatgtaacatg

SEQ ID NO: 5317034 - DNA, 15 bp, Homo sapiens
tgaaatgtaacatga

SEQ ID NO: 5317035 - DNA, 15 bp, Homo sapiens
tgaaatgtaaggctg

SEQ ID NO: 5317036 - DNA, 14 bp, Homo sapiens
tgaaatgtaatttc

SEQ ID NO: 5317037 - DNA, 11 bp, Homo sapiens
tgaaatgtctt

SEQ ID NO: 5317038 - DNA, 21 bp, Homo sapiens
tgaaatgtgaatttttattgt

SEQ ID NO: 5317039 - DNA, 22 bp, Homo sapiens
tgaaatgtgaatttttattgtt

SEQ ID NO: 5317040 - DNA, 14 bp, Homo sapiens
tgaaatgtgtgtga

SEQ ID NO: 5317041 - DNA, 20 bp, Homo sapiens
tgaaatgtgtgtgatgtgac

SEQ ID NO: 5317042 - DNA, 21 bp, Homo sapiens
tgaaatgttaacaatgcctat

SEQ ID NO: 5317043 - DNA, 22 bp, Homo sapiens
tgaaatgttacaaaaataaact

SEQ ID NO: 5317044 - DNA, 22 bp, Homo sapiens
tgaaatgttacatgtagaaaaa

SEQ ID NO: 5317045 - DNA, 16 bp, Homo sapiens
tgaaatgttctgtcaa

SEQ ID NO: 5317046 - DNA, 13 bp, Homo sapiens
tgaaatgttctta

SEQ ID NO: 5317047 - DNA, 15 bp, Homo sapiens
tgaaattaaaaataa

SEQ ID NO: 5317048 - DNA, 16 bp, Homo sapiens
tgaaattaaaatcact

SEQ ID NO: 5317049 - DNA, 13 bp, Homo sapiens
tgaaattaaagaa

SEQ ID NO: 5317050 - DNA, 20 bp, Homo sapiens
tgaaattaaagaaatgaaaa

SEQ ID NO: 5317051 - DNA, 14 bp, Homo sapiens
tgaaattaacctct

SEQ ID NO: 5317052 - DNA, 22 bp, Homo sapiens
tgaaattaactgggtaatgaaa

SEQ ID NO: 5317053 - DNA, 14 bp, Homo sapiens
tgaaattaactttt

SEQ ID NO: 5317054 - DNA, 24 bp, Homo sapiens
tgaaattaagcattttgaaacaaa

SEQ ID NO: 5317055 - DNA, 12 bp, Homo sapiens
tgaaattaccct

SEQ ID NO: 5317056 - DNA, 20 bp, Homo sapiens
tgaaattacgggtacctgaa

SEQ ID NO: 5317057 - DNA, 22 bp, Homo sapiens
tgaaattacgggtacctgaaga

SEQ ID NO: 5317058 - DNA, 23 bp, Homo sapiens
tgaaattactacaaaatttgaaa

SEQ ID NO: 5317059 - DNA, 15 bp, Homo sapiens
tgaaattactgtgta

SEQ ID NO: 5317060 - DNA, 16 bp, Homo sapiens
tgaaattactgtgtaa

SEQ ID NO: 5317061 - DNA, 23 bp, Homo sapiens
tgaaattactgtgtaaatatatg

SEQ ID NO: 5317062 - DNA, 16 bp, Homo sapiens
tgaaattactttaaca

SEQ ID NO: 5317063 - DNA, 15 bp, Homo sapiens
tgaaattagccaggg

SEQ ID NO: 5317064 - DNA, 16 bp, Homo sapiens
tgaaattagtattttg

SEQ ID NO: 5317065 - DNA, 19 bp, Homo sapiens
tgaaattagtattttgagc

SEQ ID NO: 5317066 - DNA, 23 bp, Homo sapiens
tgaaattagtgttttcattctgg

SEQ ID NO: 5317067 - DNA, 18 bp, Homo sapiens
tgaaattatgtatgttta

SEQ ID NO: 5317068 - DNA, 23 bp, Homo sapiens
tgaaattatgtatgtttacatat

SEQ ID NO: 5317069 - DNA, 18 bp, Homo sapiens
tgaaattatgtcaaatgg

SEQ ID NO: 5317070 - DNA, 22 bp, Homo sapiens
tgaaattatgtcaaatggatgt

SEQ ID NO: 5317071 - DNA, 17 bp, Homo sapiens
tgaaattcaacctgtgt

SEQ ID NO: 5317072 - DNA, 21 bp, Homo sapiens
tgaaattcaacctgtgtctta

SEQ ID NO: 5317073 - DNA, 20 bp, Homo sapiens
tgaaattcaattcatagaat

SEQ ID NO: 5317074 - DNA, 14 bp, Homo sapiens
tgaaattcacaaag

SEQ ID NO: 5317075 - DNA, 18 bp, Homo sapiens
tgaaattcacaaagttaa

SEQ ID NO: 5317076 - DNA, 23 bp, Homo sapiens
tgaaattcagagcaagttcctga

SEQ ID NO: 5317077 - DNA, 12 bp, Homo sapiens
tgaaattccaaa

SEQ ID NO: 5317078 - DNA, 15 bp, Homo sapiens
tgaaattccaaagtc

SEQ ID NO: 5317079 - DNA, 17 bp, Homo sapiens
tgaaattccaaagtctc

SEQ ID NO: 5317080 - DNA, 13 bp, Homo sapiens
tgaaattcctcct

SEQ ID NO: 5317081 - DNA, 15 bp, Homo sapiens
tgaaattcctccttc

SEQ ID NO: 5317082 - DNA, 17 bp, Homo sapiens
tgaaattcctccttccc

SEQ ID NO: 5317083 - DNA, 13 bp, Homo sapiens
tgaaattctaaag

SEQ ID NO: 5317084 - DNA, 19 bp, Homo sapiens
tgaaattctattgaaaaca

SEQ ID NO: 5317085 - DNA, 15 bp, Homo sapiens
tgaaattctcagaat

SEQ ID NO: 5317086 - DNA, 17 bp, Homo sapiens
tgaaattctcagaatta

SEQ ID NO: 5317087 - DNA, 14 bp, Homo sapiens
tgaaattctcctgg

SEQ ID NO: 5317088 - DNA, 15 bp, Homo sapiens
tgaaattctcctgga

SEQ ID NO: 5317089 - DNA, 13 bp, Homo sapiens
tgaaattctgaat

SEQ ID NO: 5317090 - DNA, 15 bp, Homo sapiens
tgaaattctgaattt

SEQ ID NO: 5317091 - DNA, 18 bp, Homo sapiens
tgaaattctgaatttgca

SEQ ID NO: 5317092 - DNA, 19 bp, Homo sapiens
tgaaattctgaatttgcaa

SEQ ID NO: 5317093 - DNA, 22 bp, Homo sapiens
tgaaattctgaatttgcaaagt

SEQ ID NO: 5317094 - DNA, 16 bp, Homo sapiens
tgaaattgaacctggt

SEQ ID NO: 5317095 - DNA, 17 bp, Homo sapiens
tgaaattgaacctttgt

SEQ ID NO: 5317096 - DNA, 19 bp, Homo sapiens
tgaaattgaacctttgtgc

SEQ ID NO: 5317097 - DNA, 11 bp, Homo sapiens
tgaaattgaag

SEQ ID NO: 5317098 - DNA, 16 bp, Homo sapiens
tgaaattgcatacttt

SEQ ID NO: 5317099 - DNA, 16 bp, Homo sapiens
tgaaattggaaaggac

SEQ ID NO: 5317100 - DNA, 13 bp, Homo sapiens
tgaaattgtaatt

SEQ ID NO: 5317101 - DNA, 22 bp, Homo sapiens
tgaaattgtagtgcaaaatggt

SEQ ID NO: 5317102 - DNA, 23 bp, Homo sapiens
tgaaattgtatagtgttgatttg

SEQ ID NO: 5317103 - DNA, 22 bp, Homo sapiens
tgaaattgtctagcagagcagg

SEQ ID NO: 5317104 - DNA, 19 bp, Homo sapiens
tgaaatttaaaaataaagc

SEQ ID NO: 5317105 - DNA, 22 bp, Homo sapiens
tgaaatttaaaaataaagctac

SEQ ID NO: 5317106 - DNA, 16 bp, Homo sapiens
tgaaatttaaacatta

SEQ ID NO: 5317107 - DNA, 17 bp, Homo sapiens
tgaacatctcactttgc

SEQ ID NO: 5317108 - DNA, 16 bp, Homo sapiens
tgaacatctcatgtgt

SEQ ID NO: 5317109 - DNA, 20 bp, Homo sapiens
tgaacatctcatgtgtgctc

SEQ ID NO: 5317110 - DNA, 17 bp, Homo sapiens
tgaacatctgagtcctg

SEQ ID NO: 5317111 - DNA, 20 bp, Homo sapiens
tgaacatctgagtcctggat

SEQ ID NO: 5317112 - DNA, 16 bp, Homo sapiens
tgaacatctggcccaa

SEQ ID NO: 5317113 - DNA, 13 bp, Homo sapiens
tgaacatctgtgt

SEQ ID NO: 5317114 - DNA, 18 bp, Homo sapiens
tgaacatcttttaactgc

SEQ ID NO: 5317115 - DNA, 18 bp, Homo sapiens
tgaacatgcctagtccaa

SEQ ID NO: 5317116 - DNA, 16 bp, Homo sapiens
tgaacatgcctcctcc

SEQ ID NO: 5317117 - DNA, 22 bp, Homo sapiens
tgaacatgcctcctcctgccct

SEQ ID NO: 5317118 - DNA, 23 bp, Homo sapiens
tgaacatgcctcctcctgccctc

SEQ ID NO: 5317119 - DNA, 18 bp, Homo sapiens
tgaacatgcctgccaaag

SEQ ID NO: 5317120 - DNA, 14 bp, Homo sapiens
tgaacatggactct

SEQ ID NO: 5317121 - DNA, 18 bp, Homo sapiens
tgaacatgggagctcttg

SEQ ID NO: 5317122 - DNA, 13 bp, Homo sapiens
tgaacatgtactg

SEQ ID NO: 5317123 - DNA, 14 bp, Homo sapiens
tgaacatgtatgat

SEQ ID NO: 5317124 - DNA, 21 bp, Homo sapiens
tgaacatgtgccttttctgaa

SEQ ID NO: 5317125 - DNA, 20 bp, Homo sapiens
tgaacatgtttaatgggtat

SEQ ID NO: 5317126 - DNA, 15 bp, Homo sapiens
tgaacatgtttacag

SEQ ID NO: 5317127 - DNA, 21 bp, Homo sapiens
tgaacattacattgccatttt

SEQ ID NO: 5317128 - DNA, 17 bp, Homo sapiens
tgaacattcccagccca

SEQ ID NO: 5317129 - DNA, 12 bp, Homo sapiens
tgaacattctgt

SEQ ID NO: 5317130 - DNA, 12 bp, Homo sapiens
tgaacattgtac

SEQ ID NO: 5317131 - DNA, 20 bp, Homo sapiens
tgaacatttactacagtttt

SEQ ID NO: 5317132 - DNA, 19 bp, Homo sapiens
tgaacatttagtaccctgc

SEQ ID NO: 5317133 - DNA, 14 bp, Homo sapiens
tgaacatttatcaa

SEQ ID NO: 5317134 - DNA, 12 bp, Homo sapiens
tgaacatttcaa

SEQ ID NO: 5317135 - DNA, 17 bp, Homo sapiens
tgaacatttcttatgat

SEQ ID NO: 5317136 - DNA, 23 bp, Homo sapiens
tgaacatttgggttactatttct

SEQ ID NO: 5317137 - DNA, 14 bp, Homo sapiens
tgaacatttgtgat

SEQ ID NO: 5317138 - DNA, 16 bp, Homo sapiens
tgaacatttgtgatat

SEQ ID NO: 5317139 - DNA, 19 bp, Homo sapiens
tgaacattttaatgggttt

SEQ ID NO: 5317140 - DNA, 18 bp, Homo sapiens
tgaacattttatttttga

SEQ ID NO: 5317141 - DNA, 16 bp, Homo sapiens
tgaacattttgtggag

SEQ ID NO: 5317142 - DNA, 13 bp, Homo sapiens
tgaacatttttaa

SEQ ID NO: 5317143 - DNA, 17 bp, Homo sapiens
tgaaccaaaacattccg

SEQ ID NO: 5317144 - DNA, 14 bp, Homo sapiens
tgaaccaaattgca

SEQ ID NO: 5317145 - DNA, 15 bp, Homo sapiens
tgaaccaaattgcac

SEQ ID NO: 5317146 - DNA, 19 bp, Homo sapiens
tgaaccaacccccatctcc

SEQ ID NO: 5317147 - DNA, 19 bp, Homo sapiens
tgaaccacaagtgaatctt

SEQ ID NO: 5317148 - DNA, 16 bp, Homo sapiens
tgaaccacaggtttta

SEQ ID NO: 5317149 - DNA, 19 bp, Homo sapiens
tgaaccacatcttgctctg

SEQ ID NO: 5317150 - DNA, 22 bp, Homo sapiens
tgaaccacatcttgctctgctg

SEQ ID NO: 5317151 - DNA, 17 bp, Homo sapiens
tgaaccacattcaggga

SEQ ID NO: 5317152 - DNA, 20 bp, Homo sapiens
tgaaccaccacacccagccc

SEQ ID NO: 5317153 - DNA, 15 bp, Homo sapiens
tgaaccacgaggctg

SEQ ID NO: 5317154 - DNA, 18 bp, Homo sapiens
tgaaccacgaggctgccc

SEQ ID NO: 5317155 - DNA, 19 bp, Homo sapiens
tgaaccacgaggctgcccc

SEQ ID NO: 5317156 - DNA, 10 bp, Homo sapiens
tgaaccactg

SEQ ID NO: 5317157 - DNA, 13 bp, Homo sapiens
tgaaccactgctt

SEQ ID NO: 5317158 - DNA, 15 bp, Homo sapiens
tgaaccactgcttct

SEQ ID NO: 5317159 - DNA, 23 bp, Homo sapiens
tgaaccactgtgtactggagcct

SEQ ID NO: 5317160 - DNA, 16 bp, Homo sapiens
tgaaccacttcattct

SEQ ID NO: 5317161 - DNA, 13 bp, Homo sapiens
tgaaccacttgta

SEQ ID NO: 5317162 - DNA, 20 bp, Homo sapiens
tgaaccacttgtagatttga

SEQ ID NO: 5317163 - DNA, 23 bp, Homo sapiens
tgaaccacttgtagatttgattt

SEQ ID NO: 5317164 - DNA, 16 bp, Homo sapiens
tgaaccactttgcctc

SEQ ID NO: 5317165 - DNA, 18 bp, Homo sapiens
tgaaccagaaccagtctt

SEQ ID NO: 5317166 - DNA, 20 bp, Homo sapiens
tgaaccagagctggaacaca

SEQ ID NO: 5317167 - DNA, 21 bp, Homo sapiens
tgaaccagagctggaacacaa

SEQ ID NO: 5317168 - DNA, 22 bp, Homo sapiens
tgaaccagagggtgtggctttc

SEQ ID NO: 5317169 - DNA, 23 bp, Homo sapiens
tgaaccagccacgaacagcccgc

SEQ ID NO: 5317170 - DNA, 16 bp, Homo sapiens
tgaaccagctcatctc

SEQ ID NO: 5317171 - DNA, 20 bp, Homo sapiens
tgaaccagctcatctccaag

SEQ ID NO: 5317172 - DNA, 23 bp, Homo sapiens
tgaaccaggaatatttcctccat

SEQ ID NO: 5317173 - DNA, 16 bp, Homo sapiens
tgaaccagtcctgctg

SEQ ID NO: 5317174 - DNA, 18 bp, Homo sapiens
tgaaccagtcctgctgcc

SEQ ID NO: 5317175 - DNA, 20 bp, Homo sapiens
tgaaccagtcctgctgcctg

SEQ ID NO: 5317176 - DNA, 19 bp, Homo sapiens
tgaaccatagttactgtaa

SEQ ID NO: 5317177 - DNA, 19 bp, Homo sapiens
tgaaccatctcagaccttt

SEQ ID NO: 5317178 - DNA, 20 bp, Homo sapiens
tgaaccatggtgaagtgctt

SEQ ID NO: 5317179 - DNA, 23 bp, Homo sapiens
tgaaccatggtgaagtgcttgga

SEQ ID NO: 5317180 - DNA, 17 bp, Homo sapiens
tgaaccattaaccagat

SEQ ID NO: 5317181 - DNA, 19 bp, Homo sapiens
tgaaccattatactttata

SEQ ID NO: 5317182 - DNA, 21 bp, Homo sapiens
tgaaccattatactttatatc

SEQ ID NO: 5317183 - DNA, 21 bp, Homo sapiens
tgaaccatttgggatggagaa

SEQ ID NO: 5317184 - DNA, 17 bp, Homo sapiens
tgaacccacacctgggc

SEQ ID NO: 5317185 - DNA, 13 bp, Homo sapiens
tgaacccaggaca

SEQ ID NO: 5317186 - DNA, 19 bp, Homo sapiens
tgaacccaggagagtggaa

SEQ ID NO: 5317187 - DNA, 14 bp, Homo sapiens
tgaacccaggaggt

SEQ ID NO: 5317188 - DNA, 22 bp, Homo sapiens
tgaacccatatttgtacaccaa

SEQ ID NO: 5317189 - DNA, 22 bp, Homo sapiens
tgaacccatattttaaattctc

SEQ ID NO: 5317190 - DNA, 21 bp, Homo sapiens
tgaaccccaaatgctctctct

SEQ ID NO: 5317191 - DNA, 17 bp, Homo sapiens
tgaaccccagaggcaga

SEQ ID NO: 5317192 - DNA, 15 bp, Homo sapiens
tgaaccccatgggct

SEQ ID NO: 5317193 - DNA, 21 bp, Homo sapiens
tgaacccccgccatccttcac

SEQ ID NO: 5317194 - DNA, 13 bp, Homo sapiens
tgaacccctggcc

SEQ ID NO: 5317195 - DNA, 14 bp, Homo sapiens
tgaacccctggcca

SEQ ID NO: 5317196 - DNA, 15 bp, Homo sapiens
tgaacccctggctcc

SEQ ID NO: 5317197 - DNA, 20 bp, Homo sapiens
tgaacccctggctccttcac

SEQ ID NO: 5317198 - DNA, 19 bp, Homo sapiens
tgaacccgggggacagagg

SEQ ID NO: 5317199 - DNA, 19 bp, Homo sapiens
tgaacccgtccattcagaa

SEQ ID NO: 5317200 - DNA, 13 bp, Homo sapiens
tgaaccctcttgc

SEQ ID NO: 5317201 - DNA, 21 bp, Homo sapiens
tgaaccctcttgccatcctga

SEQ ID NO: 5317202 - DNA, 23 bp, Homo sapiens
tgaaccctcttgccatcctgatg

SEQ ID NO: 5317203 - DNA, 14 bp, Homo sapiens
tgaaccctgccctg

SEQ ID NO: 5317204 - DNA, 15 bp, Homo sapiens
tgaaccctgccctgc

SEQ ID NO: 5317205 - DNA, 13 bp, Homo sapiens
tgaaccctggcat

SEQ ID NO: 5317206 - DNA, 14 bp, Homo sapiens
tgaaccctggggcc

SEQ ID NO: 5317207 - DNA, 21 bp, Homo sapiens
tgaaccctggggcctgactgc

SEQ ID NO: 5317208 - DNA, 15 bp, Homo sapiens
tgaaccctgtgctgg

SEQ ID NO: 5317209 - DNA, 19 bp, Homo sapiens
tgaaccctgtgctggtgtc

SEQ ID NO: 5317210 - DNA, 15 bp, Homo sapiens
tgaacccttgcttgc

SEQ ID NO: 5317211 - DNA, 13 bp, Homo sapiens
tgaaccctttgtt

SEQ ID NO: 5317212 - DNA, 22 bp, Homo sapiens
tgaaccgatgagaaataaagtt

SEQ ID NO: 5317213 - DNA, 14 bp, Homo sapiens
tgaaccgcacagct

SEQ ID NO: 5317214 - DNA, 15 bp, Homo sapiens
tgaaccgcaccccat

SEQ ID NO: 5317215 - DNA, 18 bp, Homo sapiens
tgaaccgcaccccatccc

SEQ ID NO: 5317216 - DNA, 16 bp, Homo sapiens
tgaaccgctgaatatg

SEQ ID NO: 5317217 - DNA, 16 bp, Homo sapiens
tgaaccgtttacagtg

SEQ ID NO: 5317218 - DNA, 16 bp, Homo sapiens
tgaacctatttctctt

SEQ ID NO: 5317219 - DNA, 16 bp, Homo sapiens
tgaacctattttcatt

SEQ ID NO: 5317220 - DNA, 19 bp, Homo sapiens
tgaacctattttcatttgt

SEQ ID NO: 5317221 - DNA, 21 bp, Homo sapiens
tgaacctattttcatttgtac

SEQ ID NO: 5317222 - DNA, 20 bp, Homo sapiens
tgaacctcaccccgaggccc

SEQ ID NO: 5317223 - DNA, 12 bp, Homo sapiens
tgaacctgaata

SEQ ID NO: 5317224 - DNA, 17 bp, Homo sapiens
tgaacctgatgctgact

SEQ ID NO: 5317225 - DNA, 12 bp, Homo sapiens
tgaacctgcaag

SEQ ID NO: 5317226 - DNA, 15 bp, Homo sapiens
tgaacctgctactta

SEQ ID NO: 5317227 - DNA, 15 bp, Homo sapiens
tgaacctgcttcctg

SEQ ID NO: 5317228 - DNA, 17 bp, Homo sapiens
tgaacctggaaatgatg

SEQ ID NO: 5317229 - DNA, 18 bp, Homo sapiens
tgaacctggaaatgatgt

SEQ ID NO: 5317230 - DNA, 17 bp, Homo sapiens
tgaacctgggaggcaga

SEQ ID NO: 5317231 - DNA, 19 bp, Homo sapiens
tgaacctgtcacctggcct

SEQ ID NO: 5317232 - DNA, 13 bp, Homo sapiens
tgaacctgtgagt

SEQ ID NO: 5317233 - DNA, 20 bp, Homo sapiens
tgaacctgttcaaaatgtta

SEQ ID NO: 5317234 - DNA, 19 bp, Homo sapiens
tgaaccttaaaaggtactg

SEQ ID NO: 5317235 - DNA, 15 bp, Homo sapiens
tgaaccttgagcaaa

SEQ ID NO: 5317236 - DNA, 21 bp, Homo sapiens
tgaaccttggtaaattgtaaa

SEQ ID NO: 5317237 - DNA, 13 bp, Homo sapiens
tgaacctttactc

SEQ ID NO: 5317238 - DNA, 17 bp, Homo sapiens
tgaacctttgtgcccta

SEQ ID NO: 5317239 - DNA, 20 bp, Homo sapiens
tgaacctttttttttgaaac

SEQ ID NO: 5317240 - DNA, 21 bp, Homo sapiens
tgaacctttttttttgaaaca

SEQ ID NO: 5317241 - DNA, 23 bp, Homo sapiens
tgaacctttttttttgaaacagc

SEQ ID NO: 5317242 - DNA, 19 bp, Homo sapiens
tgaacgactgtatattgct

SEQ ID NO: 5317243 - DNA, 21 bp, Homo sapiens
tgaacgactgtatattgctaa

SEQ ID NO: 5317244 - DNA, 20 bp, Homo sapiens
tgaacgatccttcaaagtct

SEQ ID NO: 5317245 - DNA, 20 bp, Homo sapiens
tgaacgcacaacatgcacat

SEQ ID NO: 5317246 - DNA, 13 bp, Homo sapiens
tgaacgcccagag

SEQ ID NO: 5317247 - DNA, 13 bp, Homo sapiens
tgaacggggagaa

SEQ ID NO: 5317248 - DNA, 21 bp, Homo sapiens
tgaacgtacccaaggtcacat

SEQ ID NO: 5317249 - DNA, 16 bp, Homo sapiens
tgaacgtccacatgaa

SEQ ID NO: 5317250 - DNA, 19 bp, Homo sapiens
tgaacgtgaataggctgct

SEQ ID NO: 5317251 - DNA, 14 bp, Homo sapiens
tgaacgtgccagca

SEQ ID NO: 5317252 - DNA, 15 bp, Homo sapiens
tgaacgtgccagcag

SEQ ID NO: 5317253 - DNA, 13 bp, Homo sapiens
tgaacgtgcttct

SEQ ID NO: 5317254 - DNA, 17 bp, Homo sapiens
tgaacgtggattgtatt

SEQ ID NO: 5317255 - DNA, 16 bp, Homo sapiens
tgaacgttattatatt

SEQ ID NO: 5317256 - DNA, 17 bp, Homo sapiens
tgaacgtttggttcaaa

SEQ ID NO: 5317257 - DNA, 23 bp, Homo sapiens
tgaacgttttaataatttttgct

SEQ ID NO: 5317258 - DNA, 17 bp, Homo sapiens
tgaacgttttctaattg

SEQ ID NO: 5317259 - DNA, 16 bp, Homo sapiens
tgaacgttttcttctt

SEQ ID NO: 5317260 - DNA, 20 bp, Homo sapiens
tgaacgttttcttctttccc

SEQ ID NO: 5317261 - DNA, 21 bp, Homo sapiens
tgaacgttttcttctttccct

SEQ ID NO: 5317262 - DNA, 23 bp, Homo sapiens
tgaacgttttcttctttccctgg

SEQ ID NO: 5317263 - DNA, 18 bp, Homo sapiens
tgaactaaaaagagactg

SEQ ID NO: 5317264 - DNA, 21 bp, Homo sapiens
tgaactaaaataaaaatgaaa

SEQ ID NO: 5317265 - DNA, 17 bp, Homo sapiens
tgaactaaactttcaca

SEQ ID NO: 5317266 - DNA, 21 bp, Homo sapiens
tgaactaacataatcttaaac

SEQ ID NO: 5317267 - DNA, 15 bp, Homo sapiens
tgaactaactgccat

SEQ ID NO: 5317268 - DNA, 21 bp, Homo sapiens
tgaactaagttattgctgcat

SEQ ID NO: 5317269 - DNA, 21 bp, Homo sapiens
tgaactaagttttgtgtgtat

SEQ ID NO: 5317270 - DNA, 23 bp, Homo sapiens
tgaactaagttttgtgtgtatat

SEQ ID NO: 5317271 - DNA, 18 bp, Homo sapiens
tgaactaattcatttatt

SEQ ID NO: 5317272 - DNA, 15 bp, Homo sapiens
tgaactaatttctgt

SEQ ID NO: 5317273 - DNA, 15 bp, Homo sapiens
tgaactaatttctta

SEQ ID NO: 5317274 - DNA, 19 bp, Homo sapiens
tgaactacagcttgagaac

SEQ ID NO: 5317275 - DNA, 17 bp, Homo sapiens
tgaactacatgcataaa

SEQ ID NO: 5317276 - DNA, 19 bp, Homo sapiens
tgaactacatgcataaact

SEQ ID NO: 5317277 - DNA, 20 bp, Homo sapiens
tgaactaccttggttccccc

SEQ ID NO: 5317278 - DNA, 17 bp, Homo sapiens
tgaactagagactctgt

SEQ ID NO: 5317279 - DNA, 19 bp, Homo sapiens
tgaactagagactctgtga

SEQ ID NO: 5317280 - DNA, 21 bp, Homo sapiens
tgaactagagactctgtgatc

SEQ ID NO: 5317281 - DNA, 17 bp, Homo sapiens
tgaactaggctgagcaa

SEQ ID NO: 5317282 - DNA, 17 bp, Homo sapiens
tgaactaggtgctggca

SEQ ID NO: 5317283 - DNA, 17 bp, Homo sapiens
tgaactatgaacactgt

SEQ ID NO: 5317284 - DNA, 21 bp, Homo sapiens
tgaagaaacacagcatgcatt

SEQ ID NO: 5317285 - DNA, 21 bp, Homo sapiens
tgaagaaacagagtggcctcc

SEQ ID NO: 5317286 - DNA, 18 bp, Homo sapiens
tgaagaaacagataccat

SEQ ID NO: 5317287 - DNA, 11 bp, Homo sapiens
tgaagaaagag

SEQ ID NO: 5317288 - DNA, 15 bp, Homo sapiens
tgaagaaagagactg

SEQ ID NO: 5317289 - DNA, 21 bp, Homo sapiens
tgaagaaagagactgtgggga

SEQ ID NO: 5317290 - DNA, 20 bp, Homo sapiens
tgaagaaagccagacaactt

SEQ ID NO: 5317291 - DNA, 21 bp, Homo sapiens
tgaagaaagcctgttgtttaa

SEQ ID NO: 5317292 - DNA, 20 bp, Homo sapiens
tgaagaaagggtgtttttct

SEQ ID NO: 5317293 - DNA, 15 bp, Homo sapiens
tgaagaaagtaaaac

SEQ ID NO: 5317294 - DNA, 16 bp, Homo sapiens
tgaagaaagtcaaaaa

SEQ ID NO: 5317295 - DNA, 21 bp, Homo sapiens
tgaagaaagtcaaaaaattat

SEQ ID NO: 5317296 - DNA, 15 bp, Homo sapiens
tgaagaaataaatga

SEQ ID NO: 5317297 - DNA, 17 bp, Homo sapiens
tgaagaaataaatgaaa

SEQ ID NO: 5317298 - DNA, 17 bp, Homo sapiens
tgaagaaattataaaga

SEQ ID NO: 5317299 - DNA, 23 bp, Homo sapiens
tgaagaaattatacgtacataca

SEQ ID NO: 5317300 - DNA, 14 bp, Homo sapiens
tgaagaacacagca

SEQ ID NO: 5317301 - DNA, 21 bp, Homo sapiens
tgaagaacacagcatgtgcca

SEQ ID NO: 5317302 - DNA, 13 bp, Homo sapiens
tgaagaacactgt

SEQ ID NO: 5317303 - DNA, 21 bp, Homo sapiens
tgaagaacaggcttggcaaag

SEQ ID NO: 5317304 - DNA, 14 bp, Homo sapiens
tgaagaacatgtga

SEQ ID NO: 5317305 - DNA, 20 bp, Homo sapiens
tgaagaaccagtccccccac

SEQ ID NO: 5317306 - DNA, 21 bp, Homo sapiens
tgaagaaccctatttaaaact

SEQ ID NO: 5317307 - DNA, 20 bp, Homo sapiens
tgaagaaccctgcagggccc

SEQ ID NO: 5317308 - DNA, 19 bp, Homo sapiens
tgaagaactattttattct

SEQ ID NO: 5317309 - DNA, 13 bp, Homo sapiens
tgaagaactgagg

SEQ ID NO: 5317310 - DNA, 14 bp, Homo sapiens
tgaagaactgcact

SEQ ID NO: 5317311 - DNA, 14 bp, Homo sapiens
tgaagaactgcagg

SEQ ID NO: 5317312 - DNA, 16 bp, Homo sapiens
tgaagaactgcaggcc

SEQ ID NO: 5317313 - DNA, 17 bp, Homo sapiens
tgaagaactgcaggccc

SEQ ID NO: 5317314 - DNA, 20 bp, Homo sapiens
tgaagaactgcaggccctgg

SEQ ID NO: 5317315 - DNA, 20 bp, Homo sapiens
tgaagaagaaaacatgtctg

SEQ ID NO: 5317316 - DNA, 18 bp, Homo sapiens
tgaagaagaaccagccca

SEQ ID NO: 5317317 - DNA, 21 bp, Homo sapiens
tgaagaagaaccagcccagcc

SEQ ID NO: 5317318 - DNA, 11 bp, Homo sapiens
tgaagaagaca

SEQ ID NO: 5317319 - DNA, 20 bp, Homo sapiens
tgaagaagaccagtcacagc

SEQ ID NO: 5317320 - DNA, 21 bp, Homo sapiens
tgaagaagaccagtcacagcc

SEQ ID NO: 5317321 - DNA, 11 bp, Homo sapiens
tgaagaagaga

SEQ ID NO: 5317322 - DNA, 20 bp, Homo sapiens
tgaagaagcacttctgctgc

SEQ ID NO: 5317323 - DNA, 21 bp, Homo sapiens
tgaagaagcacttctgctgca

SEQ ID NO: 5317324 - DNA, 10 bp, Homo sapiens
tgaagaagcc

SEQ ID NO: 5317325 - DNA, 21 bp, Homo sapiens
tgaagaagccatcaattttaa

SEQ ID NO: 5317326 - DNA, 13 bp, Homo sapiens
tgaagaagccctg

SEQ ID NO: 5317327 - DNA, 14 bp, Homo sapiens
tgaagaagcctgta

SEQ ID NO: 5317328 - DNA, 16 bp, Homo sapiens
tgaagaaggagcagaa

SEQ ID NO: 5317329 - DNA, 18 bp, Homo sapiens
tgaagaaggagcagaata

SEQ ID NO: 5317330 - DNA, 22 bp, Homo sapiens
tgaagaaggggctgttcttcca

SEQ ID NO: 5317331 - DNA, 20 bp, Homo sapiens
tgaagaagggggtgggggga

SEQ ID NO: 5317332 - DNA, 15 bp, Homo sapiens
tgaagaaggtgaata

SEQ ID NO: 5317333 - DNA, 19 bp, Homo sapiens
tgaagaaggtggacctttt

SEQ ID NO: 5317334 - DNA, 21 bp, Homo sapiens
tgaagaagtcactgaacaaaa

SEQ ID NO: 5317335 - DNA, 22 bp, Homo sapiens
tgaagaagttaattcttaaaac

SEQ ID NO: 5317336 - DNA, 19 bp, Homo sapiens
tgaagaatacttctcattt

SEQ ID NO: 5317337 - DNA, 20 bp, Homo sapiens
tgaagaatacttctcatttt

SEQ ID NO: 5317338 - DNA, 16 bp, Homo sapiens
tgaagaatagaaacaa

SEQ ID NO: 5317339 - DNA, 21 bp, Homo sapiens
tgaagaataggtgcaaacaaa

SEQ ID NO: 5317340 - DNA, 22 bp, Homo sapiens
tgaagaataggtgcaaacaaac

SEQ ID NO: 5317341 - DNA, 21 bp, Homo sapiens
tgaagaatataccatttcaaa

SEQ ID NO: 5317342 - DNA, 13 bp, Homo sapiens
tgaagaatattgt

SEQ ID NO: 5317343 - DNA, 13 bp, Homo sapiens
tgaagaatattta

SEQ ID NO: 5317344 - DNA, 22 bp, Homo sapiens
tgaagaatatttaagaaaagca

SEQ ID NO: 5317345 - DNA, 21 bp, Homo sapiens
tgaagaatccttttgtagaat

SEQ ID NO: 5317346 - DNA, 20 bp, Homo sapiens
tgaagaatctacttaaccct

SEQ ID NO: 5317347 - DNA, 15 bp, Homo sapiens
tgaagaatctgcccc

SEQ ID NO: 5317348 - DNA, 17 bp, Homo sapiens
tgaagaatgcattcaaa

SEQ ID NO: 5317349 - DNA, 15 bp, Homo sapiens
tgaagaatggcgcca

SEQ ID NO: 5317350 - DNA, 14 bp, Homo sapiens
tgaagaatgtctgt

SEQ ID NO: 5317351 - DNA, 15 bp, Homo sapiens
tgaagaatgtctgta

SEQ ID NO: 5317352 - DNA, 16 bp, Homo sapiens
tgaagaatgtctgtac

SEQ ID NO: 5317353 - DNA, 17 bp, Homo sapiens
tgaagaattatgtaata

SEQ ID NO: 5317354 - DNA, 20 bp, Homo sapiens
tgaagaattattcagtgaat

SEQ ID NO: 5317355 - DNA, 22 bp, Homo sapiens
tgaagaattattcagtgaattt

SEQ ID NO: 5317356 - DNA, 21 bp, Homo sapiens
tgaagaattattttttttctt

SEQ ID NO: 5317357 - DNA, 17 bp, Homo sapiens
tgaagaatttagatctt

SEQ ID NO: 5317358 - DNA, 15 bp, Homo sapiens
tgaagaatttgttct

SEQ ID NO: 5317359 - DNA, 12 bp, Homo sapiens
tgaagaattttg

SEQ ID NO: 5317360 - DNA, 16 bp, Homo sapiens
tgaagacaaaaatact

SEQ ID NO: 5317361 - DNA, 22 bp, Homo sapiens
tgaagacaaaccactgtacata

SEQ ID NO: 5317362 - DNA, 23 bp, Homo sapiens
tgaagacaaaccactgtacatat

SEQ ID NO: 5317363 - DNA, 22 bp, Homo sapiens
tgaagacaatgacttactgtac

SEQ ID NO: 5317364 - DNA, 20 bp, Homo sapiens
tgaagacaatttgatacata

SEQ ID NO: 5317365 - DNA, 23 bp, Homo sapiens
tgaagacaatttgatacataata

SEQ ID NO: 5317366 - DNA, 16 bp, Homo sapiens
tgaagacacagcctcc

SEQ ID NO: 5317367 - DNA, 19 bp, Homo sapiens
tgaagacacagcctccccc

SEQ ID NO: 5317368 - DNA, 16 bp, Homo sapiens
tgaagacacctgcagc

SEQ ID NO: 5317369 - DNA, 19 bp, Homo sapiens
tgaagacacctgcagcctt

SEQ ID NO: 5317370 - DNA, 15 bp, Homo sapiens
tgaagacactgtcaa

SEQ ID NO: 5317371 - DNA, 17 bp, Homo sapiens
tgaagacactgtcaatg

SEQ ID NO: 5317372 - DNA, 21 bp, Homo sapiens
tgaagacactgtgcaggccca

SEQ ID NO: 5317373 - DNA, 14 bp, Homo sapiens
tgaagacagagcta

SEQ ID NO: 5317374 - DNA, 13 bp, Homo sapiens
tgaagacagcttc

SEQ ID NO: 5317375 - DNA, 14 bp, Homo sapiens
tgaagacagcttcc

SEQ ID NO: 5317376 - DNA, 16 bp, Homo sapiens
tgaagacagcttccca

SEQ ID NO: 5317377 - DNA, 17 bp, Homo sapiens
tgaagacaggcacaaaa

SEQ ID NO: 5317378 - DNA, 13 bp, Homo sapiens
tgaagacatttct

SEQ ID NO: 5317379 - DNA, 22 bp, Homo sapiens
tgaagacatttctgctctcagc

SEQ ID NO: 5317380 - DNA, 15 bp, Homo sapiens
tgaagaccatggatt

SEQ ID NO: 5317381 - DNA, 21 bp, Homo sapiens
tgaagaccattttctggttct

SEQ ID NO: 5317382 - DNA, 17 bp, Homo sapiens
tgaagacccaaaacagc

SEQ ID NO: 5317383 - DNA, 20 bp, Homo sapiens
tgaagacccaaaacagcttt

SEQ ID NO: 5317384 - DNA, 15 bp, Homo sapiens
tgaagacccagcagg

SEQ ID NO: 5317385 - DNA, 22 bp, Homo sapiens
tgaagacccttgtgcattgtgt

SEQ ID NO: 5317386 - DNA, 14 bp, Homo sapiens
tgaagacctaaagt

SEQ ID NO: 5317387 - DNA, 22 bp, Homo sapiens
tgaagacctaaatgacctcagc

SEQ ID NO: 5317388 - DNA, 15 bp, Homo sapiens
tgaagacctaaccag

SEQ ID NO: 5317389 - DNA, 15 bp, Homo sapiens
tgaagacctttaatg

SEQ ID NO: 5317390 - DNA, 19 bp, Homo sapiens
tgaagacctttttctgcac

SEQ ID NO: 5317391 - DNA, 21 bp, Homo sapiens
tgaagacctttttctgcacta

SEQ ID NO: 5317392 - DNA, 16 bp, Homo sapiens
tgaagactatgaaaat

SEQ ID NO: 5317393 - DNA, 21 bp, Homo sapiens
tgaagactcacttctcagctg

SEQ ID NO: 5317394 - DNA, 13 bp, Homo sapiens
tgaagactccctg

SEQ ID NO: 5317395 - DNA, 20 bp, Homo sapiens
tgaagactccctgatcccag

SEQ ID NO: 5317396 - DNA, 19 bp, Homo sapiens
tgaagactctgcagccctc

SEQ ID NO: 5317397 - DNA, 17 bp, Homo sapiens
tgaagactgctatcagt

SEQ ID NO: 5317398 - DNA, 15 bp, Homo sapiens
tgaagacttcctctc

SEQ ID NO: 5317399 - DNA, 16 bp, Homo sapiens
tgaagacttcctctct

SEQ ID NO: 5317400 - DNA, 17 bp, Homo sapiens
tgaagacttttctttca

SEQ ID NO: 5317401 - DNA, 13 bp, Homo sapiens
tgaagagaagctg

SEQ ID NO: 5317402 - DNA, 20 bp, Homo sapiens
tgaagagaagctgagaagaa

SEQ ID NO: 5317403 - DNA, 21 bp, Homo sapiens
tgaagagaatgtattctgtat

SEQ ID NO: 5317404 - DNA, 21 bp, Homo sapiens
tgaagagacagagacaagtaa

SEQ ID NO: 5317405 - DNA, 23 bp, Homo sapiens
tgaagagacagagacaagtaatt

SEQ ID NO: 5317406 - DNA, 23 bp, Homo sapiens
tgaagagacagttatttatagtc

SEQ ID NO: 5317407 - DNA, 23 bp, Homo sapiens
tgaagagaccaagactctgaaat

SEQ ID NO: 5317408 - DNA, 23 bp, Homo sapiens
tgaagagagcatttggcagagtc

SEQ ID NO: 5317409 - DNA, 20 bp, Homo sapiens
tgaagagagggacaggcact

SEQ ID NO: 5317410 - DNA, 16 bp, Homo sapiens
tgaagagcaaaaatat

SEQ ID NO: 5317411 - DNA, 17 bp, Homo sapiens
tgaagagccactgccat

SEQ ID NO: 5317412 - DNA, 20 bp, Homo sapiens
tgaagagcgagactctgtct

SEQ ID NO: 5317413 - DNA, 19 bp, Homo sapiens
tgaagagcgctcctctgcc

SEQ ID NO: 5317414 - DNA, 21 bp, Homo sapiens
tgaagagcgctcctctgcctt

SEQ ID NO: 5317415 - DNA, 11 bp, Homo sapiens
tgaagagctct

SEQ ID NO: 5317416 - DNA, 17 bp, Homo sapiens
tgaagagctggggagaa

SEQ ID NO: 5317417 - DNA, 19 bp, Homo sapiens
tgaagagctgtcttcccct

SEQ ID NO: 5317418 - DNA, 18 bp, Homo sapiens
tgaagagctgttgatggg

SEQ ID NO: 5317419 - DNA, 14 bp, Homo sapiens
tgaagagcttgctt

SEQ ID NO: 5317420 - DNA, 15 bp, Homo sapiens
tgaagagcttgcttt

SEQ ID NO: 5317421 - DNA, 19 bp, Homo sapiens
tgaagagcttgctttgatt

SEQ ID NO: 5317422 - DNA, 13 bp, Homo sapiens
tgaagagcttgtg

SEQ ID NO: 5317423 - DNA, 15 bp, Homo sapiens
tgaagaggaggagga

SEQ ID NO: 5317424 - DNA, 18 bp, Homo sapiens
tgaagaggaggccgcctc

SEQ ID NO: 5317425 - DNA, 17 bp, Homo sapiens
tgaagaggaggggaaga

SEQ ID NO: 5317426 - DNA, 23 bp, Homo sapiens
tgaagaggaggggaagaggcctg

SEQ ID NO: 5317427 - DNA, 18 bp, Homo sapiens
tgaagaggatcggaggct

SEQ ID NO: 5317428 - DNA, 16 bp, Homo sapiens
tgaagaggatgctgtg

SEQ ID NO: 5317429 - DNA, 21 bp, Homo sapiens
tgaagaggcaagagacagaat

SEQ ID NO: 5317430 - DNA, 23 bp, Homo sapiens
tgaagaggcctaagtcaaaactt

SEQ ID NO: 5317431 - DNA, 16 bp, Homo sapiens
tgaagaggcgggccag

SEQ ID NO: 5317432 - DNA, 17 bp, Homo sapiens
tgaagaggcttctcctg

SEQ ID NO: 5317433 - DNA, 18 bp, Homo sapiens
tgaagagggagaagcatg

SEQ ID NO: 5317434 - DNA, 23 bp, Homo sapiens
tgaagaggggaggggcctaggga

SEQ ID NO: 5317435 - DNA, 13 bp, Homo sapiens
tgaagaggggcag

SEQ ID NO: 5317436 - DNA, 15 bp, Homo sapiens
tgaagaggggccaga

SEQ ID NO: 5317437 - DNA, 18 bp, Homo sapiens
tgaagagggtagagtggg

SEQ ID NO: 5317438 - DNA, 18 bp, Homo sapiens
tgaagaggtctgattggc

SEQ ID NO: 5317439 - DNA, 22 bp, Homo sapiens
tgaagaggtctgattggctgct

SEQ ID NO: 5317440 - DNA, 15 bp, Homo sapiens
tgaagaggtgagcac

SEQ ID NO: 5317441 - DNA, 20 bp, Homo sapiens
tgaagaggttttaaagcttc

SEQ ID NO: 5317442 - DNA, 21 bp, Homo sapiens
tgaagaggttttaaagcttcc

SEQ ID NO: 5317443 - DNA, 23 bp, Homo sapiens
tgaagagtaatcaatctactcaa

SEQ ID NO: 5317444 - DNA, 13 bp, Homo sapiens
tgaagagtcagaa

SEQ ID NO: 5317445 - DNA, 23 bp, Homo sapiens
tgaagagtcctctgaatgaacct

SEQ ID NO: 5317446 - DNA, 13 bp, Homo sapiens
tgaagagtgaaga

SEQ ID NO: 5317447 - DNA, 22 bp, Homo sapiens
tgaagagtgactagtacaaatt

SEQ ID NO: 5317448 - DNA, 22 bp, Homo sapiens
tgaagagttgccccgtctctgt

SEQ ID NO: 5317449 - DNA, 13 bp, Homo sapiens
tgaagagtttgta

SEQ ID NO: 5317450 - DNA, 13 bp, Homo sapiens
tgaagataaatgc

SEQ ID NO: 5317451 - DNA, 14 bp, Homo sapiens
tgaagataaatgct

SEQ ID NO: 5317452 - DNA, 14 bp, Homo sapiens
tgaagataacgcct

SEQ ID NO: 5317453 - DNA, 21 bp, Homo sapiens
tgaagataagtgtatttttca

SEQ ID NO: 5317454 - DNA, 23 bp, Homo sapiens
tgaagataagtgtatttttcaat

SEQ ID NO: 5317455 - DNA, 16 bp, Homo sapiens
tgaagataatttgcat

SEQ ID NO: 5317456 - DNA, 12 bp, Homo sapiens
tgaagatacttt

SEQ ID NO: 5317457 - DNA, 19 bp, Homo sapiens
tgaagatactttgtattgt

SEQ ID NO: 5317458 - DNA, 16 bp, Homo sapiens
tgaagatatcttgaaa

SEQ ID NO: 5317459 - DNA, 21 bp, Homo sapiens
tgaagatatcttgaaatgaaa

SEQ ID NO: 5317460 - DNA, 16 bp, Homo sapiens
tgaagctgctgcagct

SEQ ID NO: 5317461 - DNA, 17 bp, Homo sapiens
tgaagctgctgtctcta

SEQ ID NO: 5317462 - DNA, 14 bp, Homo sapiens
tgaagctgctgtgt

SEQ ID NO: 5317463 - DNA, 19 bp, Homo sapiens
tgaagctggaagcactgct

SEQ ID NO: 5317464 - DNA, 14 bp, Homo sapiens
tgaagctggagcag

SEQ ID NO: 5317465 - DNA, 18 bp, Homo sapiens
tgaagctggccctcagct

SEQ ID NO: 5317466 - DNA, 22 bp, Homo sapiens
tgaagctggccctcagctccct

SEQ ID NO: 5317467 - DNA, 11 bp, Homo sapiens
tgaagctgggc

SEQ ID NO: 5317468 - DNA, 19 bp, Homo sapiens
tgaagctgggctgtctctc

SEQ ID NO: 5317469 - DNA, 11 bp, Homo sapiens
tgaagctgggg

SEQ ID NO: 5317470 - DNA, 13 bp, Homo sapiens
tgaagctggggac

SEQ ID NO: 5317471 - DNA, 19 bp, Homo sapiens
tgaagctgttgtgtgaggt

SEQ ID NO: 5317472 - DNA, 19 bp, Homo sapiens
tgaagcttattaatgctaa

SEQ ID NO: 5317473 - DNA, 22 bp, Homo sapiens
tgaagcttattaatgctaaggg

SEQ ID NO: 5317474 - DNA, 14 bp, Homo sapiens
tgaagcttgactcc

SEQ ID NO: 5317475 - DNA, 22 bp, Homo sapiens
tgaagcttggaggtcacagctg

SEQ ID NO: 5317476 - DNA, 14 bp, Homo sapiens
tgaagcttgtatct

SEQ ID NO: 5317477 - DNA, 19 bp, Homo sapiens
tgaagcttgtatctgatat

SEQ ID NO: 5317478 - DNA, 13 bp, Homo sapiens
tgaagcttgtgta

SEQ ID NO: 5317479 - DNA, 23 bp, Homo sapiens
tgaagctttatacgtgtagctat

SEQ ID NO: 5317480 - DNA, 19 bp, Homo sapiens
tgaagctttggccctcagt

SEQ ID NO: 5317481 - DNA, 23 bp, Homo sapiens
tgaagctttggccctcagtgggc

SEQ ID NO: 5317482 - DNA, 16 bp, Homo sapiens
tgaagcttttatgtga

SEQ ID NO: 5317483 - DNA, 16 bp, Homo sapiens
tgaaggaaaaacatgc

SEQ ID NO: 5317484 - DNA, 17 bp, Homo sapiens
tgaaggaaaaacatgct

SEQ ID NO: 5317485 - DNA, 20 bp, Homo sapiens
tgaaggaaaaacatgcttaa

SEQ ID NO: 5317486 - DNA, 15 bp, Homo sapiens
tgaaggaaaatgata

SEQ ID NO: 5317487 - DNA, 16 bp, Homo sapiens
tgaaggaaaatgttca

SEQ ID NO: 5317488 - DNA, 12 bp, Homo sapiens
tgaaggaaacat

SEQ ID NO: 5317489 - DNA, 17 bp, Homo sapiens
tgaaggaaatccttcgg

SEQ ID NO: 5317490 - DNA, 13 bp, Homo sapiens
tgaaggaaatgaa

SEQ ID NO: 5317491 - DNA, 20 bp, Homo sapiens
tgaaggaaatgagtggccag

SEQ ID NO: 5317492 - DNA, 21 bp, Homo sapiens
tgaaggaaatgagtggccagc

SEQ ID NO: 5317493 - DNA, 16 bp, Homo sapiens
tgaaggaaattcttat

SEQ ID NO: 5317494 - DNA, 12 bp, Homo sapiens
tgaaggaacagt

SEQ ID NO: 5317495 - DNA, 21 bp, Homo sapiens
tgaaggaacagtgctgttctg

SEQ ID NO: 5317496 - DNA, 16 bp, Homo sapiens
tgaaggaaccaaagcg

SEQ ID NO: 5317497 - DNA, 12 bp, Homo sapiens
tgaaggaagagg

SEQ ID NO: 5317498 - DNA, 13 bp, Homo sapiens
tgaaggaagaggg

SEQ ID NO: 5317499 - DNA, 20 bp, Homo sapiens
tgaaggaagccaaatttatc

SEQ ID NO: 5317500 - DNA, 22 bp, Homo sapiens
tgaaggaagccaaatttatcaa

SEQ ID NO: 5317501 - DNA, 23 bp, Homo sapiens
tgaaggaagccaaatttatcaaa

SEQ ID NO: 5317502 - DNA, 11 bp, Homo sapiens
tgaaggaaggg

SEQ ID NO: 5317503 - DNA, 23 bp, Homo sapiens
tgaaggaaggggctatcctggga

SEQ ID NO: 5317504 - DNA, 22 bp, Homo sapiens
tgaaggaagttcagtcttgtct

SEQ ID NO: 5317505 - DNA, 19 bp, Homo sapiens
tgaaggaatagccagagag

SEQ ID NO: 5317506 - DNA, 20 bp, Homo sapiens
tgaaggaatagccagagagg

SEQ ID NO: 5317507 - DNA, 15 bp, Homo sapiens
tgaaggaatatatgg

SEQ ID NO: 5317508 - DNA, 23 bp, Homo sapiens
tgaaggaatatatggcagagttg

SEQ ID NO: 5317509 - DNA, 20 bp, Homo sapiens
tgaaggaatgcaataaagag

SEQ ID NO: 5317510 - DNA, 15 bp, Homo sapiens
tgaaggaattacatt

SEQ ID NO: 5317511 - DNA, 19 bp, Homo sapiens
tgaaggaattagaaatgaa

SEQ ID NO: 5317512 - DNA, 20 bp, Homo sapiens
tgaaggaatttgattgcttt

SEQ ID NO: 5317513 - DNA, 14 bp, Homo sapiens
tgaaggacatgaga

SEQ ID NO: 5317514 - DNA, 17 bp, Homo sapiens
tgaaggacatgagacta

SEQ ID NO: 5317515 - DNA, 22 bp, Homo sapiens
tgaaggacattgcggacagcca

SEQ ID NO: 5317516 - DNA, 17 bp, Homo sapiens
tgaaggaccctggctct

SEQ ID NO: 5317517 - DNA, 23 bp, Homo sapiens
tgaaggaccctggctcttctctc

SEQ ID NO: 5317518 - DNA, 17 bp, Homo sapiens
tgaaggactaatagaaa

SEQ ID NO: 5317519 - DNA, 22 bp, Homo sapiens
tgaaggactaatagaaaagtat

SEQ ID NO: 5317520 - DNA, 10 bp, Homo sapiens
tgaaggactg

SEQ ID NO: 5317521 - DNA, 14 bp, Homo sapiens
tgaaggactgcaga

SEQ ID NO: 5317522 - DNA, 20 bp, Homo sapiens
tgaaggactggattggccaa

SEQ ID NO: 5317523 - DNA, 14 bp, Homo sapiens
tgaaggactgtgac

SEQ ID NO: 5317524 - DNA, 23 bp, Homo sapiens
tgaaggactgtgacaggcagcag

SEQ ID NO: 5317525 - DNA, 18 bp, Homo sapiens
tgaaggacttagccgact

SEQ ID NO: 5317526 - DNA, 13 bp, Homo sapiens
tgaaggagaaaat

SEQ ID NO: 5317527 - DNA, 17 bp, Homo sapiens
tgaaggagaaaggagcc

SEQ ID NO: 5317528 - DNA, 18 bp, Homo sapiens
tgaaggagaaaggagccg

SEQ ID NO: 5317529 - DNA, 17 bp, Homo sapiens
tgaaggagaatggcatg

SEQ ID NO: 5317530 - DNA, 16 bp, Homo sapiens
tgaaggagagcccttc

SEQ ID NO: 5317531 - DNA, 22 bp, Homo sapiens
tgaaggagaggcaacatccaaa

SEQ ID NO: 5317532 - DNA, 18 bp, Homo sapiens
tgaaggagccacgtgaat

SEQ ID NO: 5317533 - DNA, 18 bp, Homo sapiens
tgaaggaggccacctcct

SEQ ID NO: 5317534 - DNA, 15 bp, Homo sapiens
tgaaggaggcggggc

SEQ ID NO: 5317535 - DNA, 16 bp, Homo sapiens
tgaaggagtaatggga

SEQ ID NO: 5317536 - DNA, 24 bp, Homo sapiens
tgaaggatattttcaacaattaga

SEQ ID NO: 5317537 - DNA, 20 bp, Homo sapiens
tgaaggatgggggctcctgg

SEQ ID NO: 5317538 - DNA, 18 bp, Homo sapiens
tgaaggattgcatcctgc

SEQ ID NO: 5317539 - DNA, 21 bp, Homo sapiens
tgaaggatttcttattttctt

SEQ ID NO: 5317540 - DNA, 20 bp, Homo sapiens
tgaaggatttttatttgcat

SEQ ID NO: 5317541 - DNA, 21 bp, Homo sapiens
tgaaggcaaaaactgtactgt

SEQ ID NO: 5317542 - DNA, 23 bp, Homo sapiens
tgaaggcaagagatgaattgcat

SEQ ID NO: 5317543 - DNA, 15 bp, Homo sapiens
tgaaggcacctgccc

SEQ ID NO: 5317544 - DNA, 23 bp, Homo sapiens
tgaaggcagggctcctccctgga

SEQ ID NO: 5317545 - DNA, 19 bp, Homo sapiens
tgaaggcagtggcagggga

SEQ ID NO: 5317546 - DNA, 22 bp, Homo sapiens
tgaaggcccaggtcaacatcta

SEQ ID NO: 5317547 - DNA, 15 bp, Homo sapiens
tgaaggccccgccca

SEQ ID NO: 5317548 - DNA, 17 bp, Homo sapiens
tgaaggccccgcccagg

SEQ ID NO: 5317549 - DNA, 19 bp, Homo sapiens
tgaaggccccgcccaggct

SEQ ID NO: 5317550 - DNA, 14 bp, Homo sapiens
tgaaggccctgctg

SEQ ID NO: 5317551 - DNA, 16 bp, Homo sapiens
tgaaggcctcgcagga

SEQ ID NO: 5317552 - DNA, 19 bp, Homo sapiens
tgaaggccttattctacat

SEQ ID NO: 5317553 - DNA, 17 bp, Homo sapiens
tgaaggctaaaaagcaa

SEQ ID NO: 5317554 - DNA, 21 bp, Homo sapiens
tgaaggctcgagcatgcctgg

SEQ ID NO: 5317555 - DNA, 18 bp, Homo sapiens
tgaaggctggaaggcagc

SEQ ID NO: 5317556 - DNA, 11 bp, Homo sapiens
tgaaggctggc

SEQ ID NO: 5317557 - DNA, 20 bp, Homo sapiens
tgaaggctggcatgatccaa

SEQ ID NO: 5317558 - DNA, 20 bp, Homo sapiens
tgaaggctgggttctgatcc

SEQ ID NO: 5317559 - DNA, 15 bp, Homo sapiens
tgaaggctgtatcta

SEQ ID NO: 5317560 - DNA, 19 bp, Homo sapiens
tgaaggctgtatctatttt

SEQ ID NO: 5317561 - DNA, 18 bp, Homo sapiens
tgaaggcttaattgactg

SEQ ID NO: 5317562 - DNA, 23 bp, Homo sapiens
tgaaggcttaattgactgaaatt

SEQ ID NO: 5317563 - DNA, 23 bp, Homo sapiens
tgaaggctttaataaaggccaca

SEQ ID NO: 5317564 - DNA, 16 bp, Homo sapiens
tgaagggaaaattagc

SEQ ID NO: 5317565 - DNA, 19 bp, Homo sapiens
tgaagggaaagaaattctt

SEQ ID NO: 5317566 - DNA, 21 bp, Homo sapiens
tgaagggaaatcaatttaaag

SEQ ID NO: 5317567 - DNA, 15 bp, Homo sapiens
tgaagggaagagaca

SEQ ID NO: 5317568 - DNA, 17 bp, Homo sapiens
tgaagggaagtggggag

SEQ ID NO: 5317569 - DNA, 19 bp, Homo sapiens
tgaagggacagctgctggg

SEQ ID NO: 5317570 - DNA, 23 bp, Homo sapiens
tgaagggacggctgtgggaccag

SEQ ID NO: 5317571 - DNA, 9 bp, Homo sapiens
tgaagggag

SEQ ID NO: 5317572 - DNA, 19 bp, Homo sapiens
tgaagggagagccagctcc

SEQ ID NO: 5317573 - DNA, 24 bp, Homo sapiens
tgaagggattttagtcacacgtgg

SEQ ID NO: 5317574 - DNA, 19 bp, Homo sapiens
tgaagggcaagaaatggcg

SEQ ID NO: 5317575 - DNA, 17 bp, Homo sapiens
tgaagggcattctttcc

SEQ ID NO: 5317576 - DNA, 15 bp, Homo sapiens
tgaagggccagagcc

SEQ ID NO: 5317577 - DNA, 17 bp, Homo sapiens
tgaagggccagcatata

SEQ ID NO: 5317578 - DNA, 23 bp, Homo sapiens
tgaagggccagcatatatacttg

SEQ ID NO: 5317579 - DNA, 14 bp, Homo sapiens
tgaagggcccagga

SEQ ID NO: 5317580 - DNA, 14 bp, Homo sapiens
tgaagggcccgaga

SEQ ID NO: 5317581 - DNA, 16 bp, Homo sapiens
tgaagggcttcttctt

SEQ ID NO: 5317582 - DNA, 17 bp, Homo sapiens
tgaagggcttcttctta

SEQ ID NO: 5317583 - DNA, 16 bp, Homo sapiens
tgaaggggaaacacac

SEQ ID NO: 5317584 - DNA, 17 bp, Homo sapiens
tgaaggggaaacacaca

SEQ ID NO: 5317585 - DNA, 22 bp, Homo sapiens
tgaaggggcacaccactgccct

SEQ ID NO: 5317586 - DNA, 12 bp, Homo sapiens
tgaaggggccag

SEQ ID NO: 5317587 - DNA, 17 bp, Homo sapiens
tgaaggggctggtggag

SEQ ID NO: 5317588 - DNA, 18 bp, Homo sapiens
tgaaggggcttctaatga

SEQ ID NO: 5317589 - DNA, 21 bp, Homo sapiens
tgaaggggcttctaatgaccc

SEQ ID NO: 5317590 - DNA, 16 bp, Homo sapiens
tgaagggtcatttctc

SEQ ID NO: 5317591 - DNA, 19 bp, Homo sapiens
tgaagggtgacatcccagg

SEQ ID NO: 5317592 - DNA, 16 bp, Homo sapiens
tgaagggtgcctagtt

SEQ ID NO: 5317593 - DNA, 13 bp, Homo sapiens
tgaagggtggatg

SEQ ID NO: 5317594 - DNA, 19 bp, Homo sapiens
tgaaggtagaatgttttca

SEQ ID NO: 5317595 - DNA, 23 bp, Homo sapiens
tgaaggtagcattctttggagtt

SEQ ID NO: 5317596 - DNA, 20 bp, Homo sapiens
tgaaggtattttgtagatgt

SEQ ID NO: 5317597 - DNA, 15 bp, Homo sapiens
tgaaggtcaataaat

SEQ ID NO: 5317598 - DNA, 19 bp, Homo sapiens
tgaaggtcccctggcagtg

SEQ ID NO: 5317599 - DNA, 22 bp, Homo sapiens
tgaaggtctgtcataggactct

SEQ ID NO: 5317600 - DNA, 22 bp, Homo sapiens
tgaaggtgatttaagggcccag

SEQ ID NO: 5317601 - DNA, 13 bp, Homo sapiens
tgaaggtgcagtt

SEQ ID NO: 5317602 - DNA, 15 bp, Homo sapiens
tgaaggtgccagacg

SEQ ID NO: 5317603 - DNA, 17 bp, Homo sapiens
tgaaggtgccattttaa

SEQ ID NO: 5317604 - DNA, 16 bp, Homo sapiens
tgaaggtgcccaggag

SEQ ID NO: 5317605 - DNA, 15 bp, Homo sapiens
tgaaggtgctgacgg

SEQ ID NO: 5317606 - DNA, 13 bp, Homo sapiens
tgaaggtgctgcc

SEQ ID NO: 5317607 - DNA, 14 bp, Homo sapiens
tgaaggtgctgcca

SEQ ID NO: 5317608 - DNA, 16 bp, Homo sapiens
tgaaggtgctgccacc

SEQ ID NO: 5317609 - DNA, 15 bp, Homo sapiens
tgaaggtggggagaa

SEQ ID NO: 5317610 - DNA, 15 bp, Homo sapiens
tgaaggtgtgctaca

SEQ ID NO: 5317611 - DNA, 15 bp, Homo sapiens
tgaaggttaggattt

SEQ ID NO: 5317612 - DNA, 17 bp, Homo sapiens
tgaaggttcccaaggac

SEQ ID NO: 5317613 - DNA, 19 bp, Homo sapiens
tgaaggttgtatgtaaatc

SEQ ID NO: 5317614 - DNA, 14 bp, Homo sapiens
tgaaggtttacaat

SEQ ID NO: 5317615 - DNA, 21 bp, Homo sapiens
tgaaggtttacaatttacaaa

SEQ ID NO: 5317616 - DNA, 23 bp, Homo sapiens
tgaaggtttacaatttacaaagt

SEQ ID NO: 5317617 - DNA, 13 bp, Homo sapiens
tgaaggtttctga

SEQ ID NO: 5317618 - DNA, 22 bp, Homo sapiens
tgaaggtttgatgccaaagcag

SEQ ID NO: 5317619 - DNA, 23 bp, Homo sapiens
tgaaggtttgatgccaaagcaga

SEQ ID NO: 5317620 - DNA, 14 bp, Homo sapiens
tgaaggtttttgat

SEQ ID NO: 5317621 - DNA, 18 bp, Homo sapiens
tgaaggtttttgatagca

SEQ ID NO: 5317622 - DNA, 19 bp, Homo sapiens
tgaaggtttttgatagcat

SEQ ID NO: 5317623 - DNA, 18 bp, Homo sapiens
tgaaggtttttgtaaaga

SEQ ID NO: 5317624 - DNA, 20 bp, Homo sapiens
tgaaggttttttttttaagt

SEQ ID NO: 5317625 - DNA, 13 bp, Homo sapiens
tgaagtaaaacaa

SEQ ID NO: 5317626 - DNA, 22 bp, Homo sapiens
tgaagtaaaacaaacaatacct

SEQ ID NO: 5317627 - DNA, 23 bp, Homo sapiens
tgaagtaaaacaaacaatacctg

SEQ ID NO: 5317628 - DNA, 22 bp, Homo sapiens
tgaagtaaaaccttttttcttg

SEQ ID NO: 5317629 - DNA, 19 bp, Homo sapiens
tgaagtaaaatgtggcagg

SEQ ID NO: 5317630 - DNA, 19 bp, Homo sapiens
tgaagtaaagccattaaat

SEQ ID NO: 5317631 - DNA, 17 bp, Homo sapiens
tgaagtaacttgtctta

SEQ ID NO: 5317632 - DNA, 15 bp, Homo sapiens
tgaagtaagttcatc

SEQ ID NO: 5317633 - DNA, 17 bp, Homo sapiens
tgaagtaagttcatcaa

SEQ ID NO: 5317634 - DNA, 17 bp, Homo sapiens
tgaagtaagttctgaaa

SEQ ID NO: 5317635 - DNA, 16 bp, Homo sapiens
tgaagtaatatgcaca

SEQ ID NO: 5317636 - DNA, 15 bp, Homo sapiens
tgaatcactgtgctc

SEQ ID NO: 5317637 - DNA, 16 bp, Homo sapiens
tgaatcactgtgctca

SEQ ID NO: 5317638 - DNA, 16 bp, Homo sapiens
tgaatcagaaaagcta

SEQ ID NO: 5317639 - DNA, 16 bp, Homo sapiens
tgaatcagacatttta

SEQ ID NO: 5317640 - DNA, 19 bp, Homo sapiens
tgaatcagaggcagagacc

SEQ ID NO: 5317641 - DNA, 19 bp, Homo sapiens
tgaatcagatggtgtcatt

SEQ ID NO: 5317642 - DNA, 17 bp, Homo sapiens
tgaatcagctggacata

SEQ ID NO: 5317643 - DNA, 16 bp, Homo sapiens
tgaatcaggaaactca

SEQ ID NO: 5317644 - DNA, 19 bp, Homo sapiens
tgaatcagtatgaagacac

SEQ ID NO: 5317645 - DNA, 20 bp, Homo sapiens
tgaatcagtatgaagacact

SEQ ID NO: 5317646 - DNA, 21 bp, Homo sapiens
tgaatcagtatgaagacactg

SEQ ID NO: 5317647 - DNA, 20 bp, Homo sapiens
tgaatcagtttttaaaatat

SEQ ID NO: 5317648 - DNA, 21 bp, Homo sapiens
tgaatcagtttttaaaatatt

SEQ ID NO: 5317649 - DNA, 22 bp, Homo sapiens
tgaatcagtttttaaaatattt

SEQ ID NO: 5317650 - DNA, 15 bp, Homo sapiens
tgaatcatgagcctg

SEQ ID NO: 5317651 - DNA, 19 bp, Homo sapiens
tgaatcatgtaggatcttg

SEQ ID NO: 5317652 - DNA, 18 bp, Homo sapiens
tgaatcatgtagtatcaa

SEQ ID NO: 5317653 - DNA, 14 bp, Homo sapiens
tgaatcatgtctgt

SEQ ID NO: 5317654 - DNA, 16 bp, Homo sapiens
tgaatcatgtctgtat

SEQ ID NO: 5317655 - DNA, 23 bp, Homo sapiens
tgaatcatgtctgtatccccagt

SEQ ID NO: 5317656 - DNA, 14 bp, Homo sapiens
tgaatcatgttaat

SEQ ID NO: 5317657 - DNA, 19 bp, Homo sapiens
tgaatcatgttaatagaca

SEQ ID NO: 5317658 - DNA, 21 bp, Homo sapiens
tgaatcattgtatgtggtcat

SEQ ID NO: 5317659 - DNA, 22 bp, Homo sapiens
tgaatcattttacctttgacaa

SEQ ID NO: 5317660 - DNA, 17 bp, Homo sapiens
tgaatccaaatgtgaaa

SEQ ID NO: 5317661 - DNA, 19 bp, Homo sapiens
tgaatccaacgtgtaacca

SEQ ID NO: 5317662 - DNA, 18 bp, Homo sapiens
tgaatccaactgcttaaa

SEQ ID NO: 5317663 - DNA, 17 bp, Homo sapiens
tgaatccatcgatttgt

SEQ ID NO: 5317664 - DNA, 18 bp, Homo sapiens
tgaatccatcgatttgta

SEQ ID NO: 5317665 - DNA, 16 bp, Homo sapiens
tgaatccatcttgctt

SEQ ID NO: 5317666 - DNA, 22 bp, Homo sapiens
tgaatccatgatcaaaatgcat

SEQ ID NO: 5317667 - DNA, 16 bp, Homo sapiens
tgaatccatgggtctg

SEQ ID NO: 5317668 - DNA, 21 bp, Homo sapiens
tgaatcccacgcttctctttg

SEQ ID NO: 5317669 - DNA, 15 bp, Homo sapiens
tgaatcccatcaggc

SEQ ID NO: 5317670 - DNA, 22 bp, Homo sapiens
tgaatccccgacccccctaccc

SEQ ID NO: 5317671 - DNA, 24 bp, Homo sapiens
tgaatccccgacccccctacccca

SEQ ID NO: 5317672 - DNA, 11 bp, Homo sapiens
tgaatccctgg

SEQ ID NO: 5317673 - DNA, 12 bp, Homo sapiens
tgaatccctttc

SEQ ID NO: 5317674 - DNA, 15 bp, Homo sapiens
tgaatccctttcagt

SEQ ID NO: 5317675 - DNA, 16 bp, Homo sapiens
tgaatccgaagaatga

SEQ ID NO: 5317676 - DNA, 15 bp, Homo sapiens
tgaatcctaagggct

SEQ ID NO: 5317677 - DNA, 10 bp, Homo sapiens
tgaatcctac

SEQ ID NO: 5317678 - DNA, 19 bp, Homo sapiens
tgaatcctagcttcttcca

SEQ ID NO: 5317679 - DNA, 21 bp, Homo sapiens
tgaatcctctattaattactg

SEQ ID NO: 5317680 - DNA, 22 bp, Homo sapiens
tgaatcctctattaattactgt

SEQ ID NO: 5317681 - DNA, 15 bp, Homo sapiens
tgaatcctggctctg

SEQ ID NO: 5317682 - DNA, 13 bp, Homo sapiens
tgaatcctgttaa

SEQ ID NO: 5317683 - DNA, 21 bp, Homo sapiens
tgaatccttccatttcttctg

SEQ ID NO: 5317684 - DNA, 15 bp, Homo sapiens
tgaatcgcttctctt

SEQ ID NO: 5317685 - DNA, 20 bp, Homo sapiens
tgaatcgcttgcttgttgaa

SEQ ID NO: 5317686 - DNA, 16 bp, Homo sapiens
tgaatcgtttcatgta

SEQ ID NO: 5317687 - DNA, 20 bp, Homo sapiens
tgaatctaagcagcatttct

SEQ ID NO: 5317688 - DNA, 14 bp, Homo sapiens
tgaatctaaggata

SEQ ID NO: 5317689 - DNA, 15 bp, Homo sapiens
tgaatctaataaaat

SEQ ID NO: 5317690 - DNA, 17 bp, Homo sapiens
tgaatctacaaaagtga

SEQ ID NO: 5317691 - DNA, 20 bp, Homo sapiens
tgaatctacatttgtttgta

SEQ ID NO: 5317692 - DNA, 15 bp, Homo sapiens
tgaatctatgccaaa

SEQ ID NO: 5317693 - DNA, 22 bp, Homo sapiens
tgaatctatgctggtgaaaaca

SEQ ID NO: 5317694 - DNA, 22 bp, Homo sapiens
tgaatctattgtttctcctctg

SEQ ID NO: 5317695 - DNA, 15 bp, Homo sapiens
tgaatctcaatttga

SEQ ID NO: 5317696 - DNA, 16 bp, Homo sapiens
tgaatctcccaaggag

SEQ ID NO: 5317697 - DNA, 19 bp, Homo sapiens
tgaatctcccctcctcaca

SEQ ID NO: 5317698 - DNA, 20 bp, Homo sapiens
tgaatctctaaaatgctgtt

SEQ ID NO: 5317699 - DNA, 21 bp, Homo sapiens
tgaatctgaaagagcattatt

SEQ ID NO: 5317700 - DNA, 17 bp, Homo sapiens
tgaatctgaactgctct

SEQ ID NO: 5317701 - DNA, 22 bp, Homo sapiens
tgaatctgagaaagtactttct

SEQ ID NO: 5317702 - DNA, 18 bp, Homo sapiens
tgaatctgataggaaaag

SEQ ID NO: 5317703 - DNA, 20 bp, Homo sapiens
tgaatctgcagggagcaact

SEQ ID NO: 5317704 - DNA, 14 bp, Homo sapiens
tgaatctgctttaa

SEQ ID NO: 5317705 - DNA, 16 bp, Homo sapiens
tgaatctgctttaatt

SEQ ID NO: 5317706 - DNA, 20 bp, Homo sapiens
tgaatctgctttaattacct

SEQ ID NO: 5317707 - DNA, 20 bp, Homo sapiens
tgaatctgcttttcctctgc

SEQ ID NO: 5317708 - DNA, 20 bp, Homo sapiens
tgaatctgggactgtgcctg

SEQ ID NO: 5317709 - DNA, 22 bp, Homo sapiens
tgaatctgggtgggataatgga

SEQ ID NO: 5317710 - DNA, 18 bp, Homo sapiens
tgaatctggtgttgggga

SEQ ID NO: 5317711 - DNA, 13 bp, Homo sapiens
tgaatctgtacag

SEQ ID NO: 5317712 - DNA, 13 bp, Homo sapiens
tgaatctgtacat

SEQ ID NO: 5317713 - DNA, 20 bp, Homo sapiens
tgaatctgtgcaaacagtaa

SEQ ID NO: 5317714 - DNA, 18 bp, Homo sapiens
tgaatctgtgctggccat

SEQ ID NO: 5317715 - DNA, 15 bp, Homo sapiens
tgaatcttactcctt

SEQ ID NO: 5317716 - DNA, 15 bp, Homo sapiens
tgaatcttatggtgg

SEQ ID NO: 5317717 - DNA, 14 bp, Homo sapiens
tgaatcttctgaaa

SEQ ID NO: 5317718 - DNA, 15 bp, Homo sapiens
tgaatcttgtctcaa

SEQ ID NO: 5317719 - DNA, 23 bp, Homo sapiens
tgaatcttgtctcaatgctcata

SEQ ID NO: 5317720 - DNA, 18 bp, Homo sapiens
tgaatctttcatacatat

SEQ ID NO: 5317721 - DNA, 22 bp, Homo sapiens
tgaatcttttttttatataaat

SEQ ID NO: 5317722 - DNA, 17 bp, Homo sapiens
tgaatgaaaaatttaag

SEQ ID NO: 5317723 - DNA, 18 bp, Homo sapiens
tgaatgaaaaatttaagc

SEQ ID NO: 5317724 - DNA, 13 bp, Homo sapiens
tgaatgaaaacat

SEQ ID NO: 5317725 - DNA, 14 bp, Homo sapiens
tgaatgaaaacatt

SEQ ID NO: 5317726 - DNA, 18 bp, Homo sapiens
tgaatgaaaatacatctt

SEQ ID NO: 5317727 - DNA, 17 bp, Homo sapiens
tgaatgaaaatgtccat

SEQ ID NO: 5317728 - DNA, 21 bp, Homo sapiens
tgaatgaaacccccacacaca

SEQ ID NO: 5317729 - DNA, 22 bp, Homo sapiens
tgaatgaaacccccacacacac

SEQ ID NO: 5317730 - DNA, 16 bp, Homo sapiens
tgaatgaaagattaaa

SEQ ID NO: 5317731 - DNA, 21 bp, Homo sapiens
tgaatgaaagtcttgtgacta

SEQ ID NO: 5317732 - DNA, 23 bp, Homo sapiens
tgaatgaaagtcttgtgactagt

SEQ ID NO: 5317733 - DNA, 15 bp, Homo sapiens
tgaatgaaatataaa

SEQ ID NO: 5317734 - DNA, 16 bp, Homo sapiens
tgaatgaaatataaac

SEQ ID NO: 5317735 - DNA, 14 bp, Homo sapiens
tgaatgaacaacct

SEQ ID NO: 5317736 - DNA, 15 bp, Homo sapiens
tgaatgaacactctt

SEQ ID NO: 5317737 - DNA, 18 bp, Homo sapiens
tgaatgaaccatgaatga

SEQ ID NO: 5317738 - DNA, 15 bp, Homo sapiens
tgaatgaacccctgg

SEQ ID NO: 5317739 - DNA, 20 bp, Homo sapiens
tgaatgaagctaatgtgaat

SEQ ID NO: 5317740 - DNA, 20 bp, Homo sapiens
tgaatgaatggctaagcaaa

SEQ ID NO: 5317741 - DNA, 15 bp, Homo sapiens
tgaatgacaaagagt

SEQ ID NO: 5317742 - DNA, 16 bp, Homo sapiens
tgaatgacaaagtatg

SEQ ID NO: 5317743 - DNA, 15 bp, Homo sapiens
tgaatgacaacagaa

SEQ ID NO: 5317744 - DNA, 13 bp, Homo sapiens
tgaatgacaacat

SEQ ID NO: 5317745 - DNA, 15 bp, Homo sapiens
tgaatgacatcaaca

SEQ ID NO: 5317746 - DNA, 22 bp, Homo sapiens
tgaatgaccacttgatatgact

SEQ ID NO: 5317747 - DNA, 21 bp, Homo sapiens
tgaatgaccagcagcagcttt

SEQ ID NO: 5317748 - DNA, 17 bp, Homo sapiens
tgaatgactaagaggaa

SEQ ID NO: 5317749 - DNA, 22 bp, Homo sapiens
tgaatgactccactgtttttct

SEQ ID NO: 5317750 - DNA, 15 bp, Homo sapiens
tgaatgactccagga

SEQ ID NO: 5317751 - DNA, 16 bp, Homo sapiens
tgaatgactgacccaa

SEQ ID NO: 5317752 - DNA, 23 bp, Homo sapiens
tgaatgactgacccaaaatgtga

SEQ ID NO: 5317753 - DNA, 16 bp, Homo sapiens
tgaatgagaagtaaat

SEQ ID NO: 5317754 - DNA, 14 bp, Homo sapiens
tgaatgagaatgtg

SEQ ID NO: 5317755 - DNA, 18 bp, Homo sapiens
tgaatgagaatgtgccat

SEQ ID NO: 5317756 - DNA, 21 bp, Homo sapiens
tgaatgagacctggaacaaat

SEQ ID NO: 5317757 - DNA, 17 bp, Homo sapiens
tgaatgagcattctgca

SEQ ID NO: 5317758 - DNA, 19 bp, Homo sapiens
tgaatgaggattattataa

SEQ ID NO: 5317759 - DNA, 22 bp, Homo sapiens
tgaatgaggtcagcatgtctat

SEQ ID NO: 5317760 - DNA, 22 bp, Homo sapiens
tgaatgaggtcccaggcagaga

SEQ ID NO: 5317761 - DNA, 21 bp, Homo sapiens
tgaatgagtctgttgtgtgtc

SEQ ID NO: 5317762 - DNA, 16 bp, Homo sapiens
tgaatgagttttacaa

SEQ ID NO: 5317763 - DNA, 19 bp, Homo sapiens
tgaatgagttttacaaatt

SEQ ID NO: 5317764 - DNA, 15 bp, Homo sapiens
tgaatgatatctttg

SEQ ID NO: 5317765 - DNA, 12 bp, Homo sapiens
tgaatgatctat

SEQ ID NO: 5317766 - DNA, 16 bp, Homo sapiens
tgaatgatcttgtgta

SEQ ID NO: 5317767 - DNA, 14 bp, Homo sapiens
tgaatgatgagcct

SEQ ID NO: 5317768 - DNA, 14 bp, Homo sapiens
tgaatgatgtttta

SEQ ID NO: 5317769 - DNA, 17 bp, Homo sapiens
tgaatgattcatgttat

SEQ ID NO: 5317770 - DNA, 19 bp, Homo sapiens
tgaatgatttccaaagaga

SEQ ID NO: 5317771 - DNA, 14 bp, Homo sapiens
tgaatgatttgcat

SEQ ID NO: 5317772 - DNA, 15 bp, Homo sapiens
tgaatgatttttctt

SEQ ID NO: 5317773 - DNA, 19 bp, Homo sapiens
tgaatgatttttctttaca

SEQ ID NO: 5317774 - DNA, 15 bp, Homo sapiens
tgaatgcacgtttca

SEQ ID NO: 5317775 - DNA, 13 bp, Homo sapiens
tgaatgcagaaaa

SEQ ID NO: 5317776 - DNA, 20 bp, Homo sapiens
tgaatgcagcactgctgcct

SEQ ID NO: 5317777 - DNA, 17 bp, Homo sapiens
tgaatgcagtataaaat

SEQ ID NO: 5317778 - DNA, 18 bp, Homo sapiens
tgaatgcagtataaaatg

SEQ ID NO: 5317779 - DNA, 19 bp, Homo sapiens
tgaatgcagtataaaatgt

SEQ ID NO: 5317780 - DNA, 14 bp, Homo sapiens
tgaatgcataaaat

SEQ ID NO: 5317781 - DNA, 15 bp, Homo sapiens
tgaatgcataaaatg

SEQ ID NO: 5317782 - DNA, 15 bp, Homo sapiens
tgaatgcattttgtt

SEQ ID NO: 5317783 - DNA, 22 bp, Homo sapiens
tgaatgcattttgtttggtatt

SEQ ID NO: 5317784 - DNA, 14 bp, Homo sapiens
tgaatgccaaagcc

SEQ ID NO: 5317785 - DNA, 21 bp, Homo sapiens
tgaatgccatttagaatctag

SEQ ID NO: 5317786 - DNA, 23 bp, Homo sapiens
tgaatgcccacaggcaaatgcat

SEQ ID NO: 5317787 - DNA, 20 bp, Homo sapiens
tgaatgcccccagctggccc

SEQ ID NO: 5317788 - DNA, 17 bp, Homo sapiens
tgaatgccgaatttggt

SEQ ID NO: 5317789 - DNA, 20 bp, Homo sapiens
tgaatgccgaatttggtaca

SEQ ID NO: 5317790 - DNA, 23 bp, Homo sapiens
tgaatgccgaatttggtacacat

SEQ ID NO: 5317791 - DNA, 18 bp, Homo sapiens
tgaatgcctcgctccctt

SEQ ID NO: 5317792 - DNA, 20 bp, Homo sapiens
tgaatgccttatttttgaat

SEQ ID NO: 5317793 - DNA, 21 bp, Homo sapiens
tgaatgccttatttttgaatt

SEQ ID NO: 5317794 - DNA, 17 bp, Homo sapiens
tgaatgcgctttattgc

SEQ ID NO: 5317795 - DNA, 15 bp, Homo sapiens
tgaatgctattgaaa

SEQ ID NO: 5317796 - DNA, 23 bp, Homo sapiens
tgaatgctgagctgaagaaatta

SEQ ID NO: 5317797 - DNA, 12 bp, Homo sapiens
tgaatgctggga

SEQ ID NO: 5317798 - DNA, 15 bp, Homo sapiens
tgaatgctgggactc

SEQ ID NO: 5317799 - DNA, 14 bp, Homo sapiens
tgaatgctgggccc

SEQ ID NO: 5317800 - DNA, 22 bp, Homo sapiens
tgaatgctgtgggaaggcaatt

SEQ ID NO: 5317801 - DNA, 21 bp, Homo sapiens
tgaatgcttaaagaattcaaa

SEQ ID NO: 5317802 - DNA, 19 bp, Homo sapiens
tgaatgcttaaagcaaggc

SEQ ID NO: 5317803 - DNA, 19 bp, Homo sapiens
tgaatgcttaaatgatcaa

SEQ ID NO: 5317804 - DNA, 12 bp, Homo sapiens
tgaatgcttttt

SEQ ID NO: 5317805 - DNA, 18 bp, Homo sapiens
tgaatggatcaatacaca

SEQ ID NO: 5317806 - DNA, 18 bp, Homo sapiens
tgaatggattaaatggca

SEQ ID NO: 5317807 - DNA, 14 bp, Homo sapiens
tgaatggattggat

SEQ ID NO: 5317808 - DNA, 17 bp, Homo sapiens
tgaatggcctgccttga

SEQ ID NO: 5317809 - DNA, 15 bp, Homo sapiens
tgaatggctgtgccc

SEQ ID NO: 5317810 - DNA, 16 bp, Homo sapiens
tgaatggctgtgcccc

SEQ ID NO: 5317811 - DNA, 19 bp, Homo sapiens
tgaatggctttgtatagaa

SEQ ID NO: 5317812 - DNA, 14 bp, Homo sapiens
tgaatgggaaaggg

SEQ ID NO: 5317813 - DNA, 16 bp, Homo sapiens
tgaattgaaaaacaat

SEQ ID NO: 5317814 - DNA, 14 bp, Homo sapiens
tgaattgaaagaga

SEQ ID NO: 5317815 - DNA, 18 bp, Homo sapiens
tgaattgaagtcatcata

SEQ ID NO: 5317816 - DNA, 19 bp, Homo sapiens
tgaattgaagtttcaagtt

SEQ ID NO: 5317817 - DNA, 13 bp, Homo sapiens
tgaattgactacc

SEQ ID NO: 5317818 - DNA, 13 bp, Homo sapiens
tgaattgagaaaa

SEQ ID NO: 5317819 - DNA, 18 bp, Homo sapiens
tgaattgagcctaaaaat

SEQ ID NO: 5317820 - DNA, 15 bp, Homo sapiens
tgaattgagctagaa

SEQ ID NO: 5317821 - DNA, 20 bp, Homo sapiens
tgaattgaggggattaatat

SEQ ID NO: 5317822 - DNA, 13 bp, Homo sapiens
tgaattgataaaa

SEQ ID NO: 5317823 - DNA, 15 bp, Homo sapiens
tgaattgataataaa

SEQ ID NO: 5317824 - DNA, 13 bp, Homo sapiens
tgaattgattttg

SEQ ID NO: 5317825 - DNA, 16 bp, Homo sapiens
tgaattgcctgcagag

SEQ ID NO: 5317826 - DNA, 13 bp, Homo sapiens
tgaattgcctgcc

SEQ ID NO: 5317827 - DNA, 18 bp, Homo sapiens
tgaattgccttgctttta

SEQ ID NO: 5317828 - DNA, 12 bp, Homo sapiens
tgaattgccttt

SEQ ID NO: 5317829 - DNA, 13 bp, Homo sapiens
tgaattgctttat

SEQ ID NO: 5317830 - DNA, 17 bp, Homo sapiens
tgaattgctttctgctc

SEQ ID NO: 5317831 - DNA, 20 bp, Homo sapiens
tgaattggaaagacttctca

SEQ ID NO: 5317832 - DNA, 15 bp, Homo sapiens
tgaattggaactgca

SEQ ID NO: 5317833 - DNA, 16 bp, Homo sapiens
tgaattggaactgcaa

SEQ ID NO: 5317834 - DNA, 19 bp, Homo sapiens
tgaattggaactgcaatga

SEQ ID NO: 5317835 - DNA, 15 bp, Homo sapiens
tgaattggaatgcac

SEQ ID NO: 5317836 - DNA, 23 bp, Homo sapiens
tgaattggccagaggaaatctga

SEQ ID NO: 5317837 - DNA, 17 bp, Homo sapiens
tgaattggcctgaacag

SEQ ID NO: 5317838 - DNA, 17 bp, Homo sapiens
tgaattgggaacattat

SEQ ID NO: 5317839 - DNA, 13 bp, Homo sapiens
tgaattggtgaat

SEQ ID NO: 5317840 - DNA, 17 bp, Homo sapiens
tgaattggtttttccca

SEQ ID NO: 5317841 - DNA, 13 bp, Homo sapiens
tgaattgtacaga

SEQ ID NO: 5317842 - DNA, 17 bp, Homo sapiens
tgaattgtatcaatttg

SEQ ID NO: 5317843 - DNA, 13 bp, Homo sapiens
tgaattgtctttt

SEQ ID NO: 5317844 - DNA, 17 bp, Homo sapiens
tgaattgtggctgttca

SEQ ID NO: 5317845 - DNA, 23 bp, Homo sapiens
tgaattgtgtattgatgcaatat

SEQ ID NO: 5317846 - DNA, 11 bp, Homo sapiens
tgaattgtgtc

SEQ ID NO: 5317847 - DNA, 11 bp, Homo sapiens
tgaattgttat

SEQ ID NO: 5317848 - DNA, 16 bp, Homo sapiens
tgaattgttatgaaaa

SEQ ID NO: 5317849 - DNA, 17 bp, Homo sapiens
tgaattgttatgaaaat

SEQ ID NO: 5317850 - DNA, 14 bp, Homo sapiens
tgaattgttatgta

SEQ ID NO: 5317851 - DNA, 21 bp, Homo sapiens
tgaattgttgaaactaaagca

SEQ ID NO: 5317852 - DNA, 16 bp, Homo sapiens
tgaatttaaatagctt

SEQ ID NO: 5317853 - DNA, 14 bp, Homo sapiens
tgaatttaaatata

SEQ ID NO: 5317854 - DNA, 14 bp, Homo sapiens
tgaatttaagcatg

SEQ ID NO: 5317855 - DNA, 15 bp, Homo sapiens
tgaatttaaggcaaa

SEQ ID NO: 5317856 - DNA, 19 bp, Homo sapiens
tgaatttaataatctgtag

SEQ ID NO: 5317857 - DNA, 18 bp, Homo sapiens
tgaatttaccatcaaaca

SEQ ID NO: 5317858 - DNA, 17 bp, Homo sapiens
tgaatttacttccttgc

SEQ ID NO: 5317859 - DNA, 21 bp, Homo sapiens
tgaatttagaaatattcaaaa

SEQ ID NO: 5317860 - DNA, 21 bp, Homo sapiens
tgaatttatacctacctgtgt

SEQ ID NO: 5317861 - DNA, 14 bp, Homo sapiens
tgaatttatataaa

SEQ ID NO: 5317862 - DNA, 15 bp, Homo sapiens
tgaatttatctttga

SEQ ID NO: 5317863 - DNA, 16 bp, Homo sapiens
tgaatttatctttgat

SEQ ID NO: 5317864 - DNA, 15 bp, Homo sapiens
tgaatttatgagatt

SEQ ID NO: 5317865 - DNA, 18 bp, Homo sapiens
tgaatttattattgttct

SEQ ID NO: 5317866 - DNA, 15 bp, Homo sapiens
tgaatttattggctt

SEQ ID NO: 5317867 - DNA, 21 bp, Homo sapiens
tgaatttattggcttttctga

SEQ ID NO: 5317868 - DNA, 13 bp, Homo sapiens
tgaatttcactgt

SEQ ID NO: 5317869 - DNA, 11 bp, Homo sapiens
tgaatttcatc

SEQ ID NO: 5317870 - DNA, 13 bp, Homo sapiens
tgaatttctcctt

SEQ ID NO: 5317871 - DNA, 12 bp, Homo sapiens
tgaatttctgat

SEQ ID NO: 5317872 - DNA, 11 bp, Homo sapiens
tgaatttctgc

SEQ ID NO: 5317873 - DNA, 16 bp, Homo sapiens
tgaatttctggaagat

SEQ ID NO: 5317874 - DNA, 13 bp, Homo sapiens
tgaatttctttga

SEQ ID NO: 5317875 - DNA, 19 bp, Homo sapiens
tgaatttgaataaatgaga

SEQ ID NO: 5317876 - DNA, 17 bp, Homo sapiens
tgaatttgaatgaaaaa

SEQ ID NO: 5317877 - DNA, 19 bp, Homo sapiens
tgaatttgaatgaaaaatt

SEQ ID NO: 5317878 - DNA, 17 bp, Homo sapiens
tgaatttgaggagggaa

SEQ ID NO: 5317879 - DNA, 18 bp, Homo sapiens
tgaatttgagtttgctgt

SEQ ID NO: 5317880 - DNA, 21 bp, Homo sapiens
tgaatttgagtttgctgtttt

SEQ ID NO: 5317881 - DNA, 18 bp, Homo sapiens
tgaatttgcaaagtactg

SEQ ID NO: 5317882 - DNA, 19 bp, Homo sapiens
tgaatttgcaaagtactgt

SEQ ID NO: 5317883 - DNA, 14 bp, Homo sapiens
tgaatttgcatgtc

SEQ ID NO: 5317884 - DNA, 15 bp, Homo sapiens
tgaatttgcatgtct

SEQ ID NO: 5317885 - DNA, 17 bp, Homo sapiens
tgaatttgcatgtctaa

SEQ ID NO: 5317886 - DNA, 19 bp, Homo sapiens
tgaatttgccagaggacca

SEQ ID NO: 5317887 - DNA, 17 bp, Homo sapiens
tgaatttgccctgggaa

SEQ ID NO: 5317888 - DNA, 18 bp, Homo sapiens
tgaatttgccctgggaaa

SEQ ID NO: 5317889 - DNA, 12 bp, Homo sapiens
tgaatttgctaa

SEQ ID NO: 5317890 - DNA, 21 bp, Homo sapiens
tgaatttgctaagaaatgtta

SEQ ID NO: 5317891 - DNA, 13 bp, Homo sapiens
tgaatttggactt

SEQ ID NO: 5317892 - DNA, 20 bp, Homo sapiens
tgaatttggcctgcactaat

SEQ ID NO: 5317893 - DNA, 21 bp, Homo sapiens
tgaatttggcctgcactaatt

SEQ ID NO: 5317894 - DNA, 19 bp, Homo sapiens
tgaatttggggctacttat

SEQ ID NO: 5317895 - DNA, 17 bp, Homo sapiens
tgaatttgtaatgtctt

SEQ ID NO: 5317896 - DNA, 15 bp, Homo sapiens
tgaatttgtatatga

SEQ ID NO: 5317897 - DNA, 19 bp, Homo sapiens
tgaatttgtatatgactgc

SEQ ID NO: 5317898 - DNA, 16 bp, Homo sapiens
tgaatttgtattaaaa

SEQ ID NO: 5317899 - DNA, 24 bp, Homo sapiens
tgaatttgtccattgtaaatctga

SEQ ID NO: 5317900 - DNA, 18 bp, Homo sapiens
tgaatttgtccatttaaa

SEQ ID NO: 5317901 - DNA, 19 bp, Homo sapiens
tgaatttgtccatttaaaa

SEQ ID NO: 5317902 - DNA, 21 bp, Homo sapiens
tgaatttgtgaaggtggaaat

SEQ ID NO: 5317903 - DNA, 16 bp, Homo sapiens
tgaatttgttcttaaa

SEQ ID NO: 5317904 - DNA, 15 bp, Homo sapiens
tgaatttgtttgtga

SEQ ID NO: 5317905 - DNA, 15 bp, Homo sapiens
tgaattttaaaagca

SEQ ID NO: 5317906 - DNA, 13 bp, Homo sapiens
tgaattttaaaat

SEQ ID NO: 5317907 - DNA, 15 bp, Homo sapiens
tgaattttaaaatgc

SEQ ID NO: 5317908 - DNA, 18 bp, Homo sapiens
tgaattttaaaatgcaaa

SEQ ID NO: 5317909 - DNA, 15 bp, Homo sapiens
tgaattttaaaatgt

SEQ ID NO: 5317910 - DNA, 23 bp, Homo sapiens
tgaattttaaaatgtagaagaaa

SEQ ID NO: 5317911 - DNA, 16 bp, Homo sapiens
tgaattttaaagtatg

SEQ ID NO: 5317912 - DNA, 18 bp, Homo sapiens
tgaattttaaataatgta

SEQ ID NO: 5317913 - DNA, 19 bp, Homo sapiens
tgaattttagcttttgtgg

SEQ ID NO: 5317914 - DNA, 18 bp, Homo sapiens
tgaattttcaaggccttc

SEQ ID NO: 5317915 - DNA, 21 bp, Homo sapiens
tgaattttcaaggccttcagt

SEQ ID NO: 5317916 - DNA, 13 bp, Homo sapiens
tgaattttcacat

SEQ ID NO: 5317917 - DNA, 16 bp, Homo sapiens
tgaattttcattttac

SEQ ID NO: 5317918 - DNA, 18 bp, Homo sapiens
tgaattttcattttacag

SEQ ID NO: 5317919 - DNA, 19 bp, Homo sapiens
tgaattttcattttacagt

SEQ ID NO: 5317920 - DNA, 21 bp, Homo sapiens
tgaattttcattttacagtta

SEQ ID NO: 5317921 - DNA, 15 bp, Homo sapiens
tgaattttcccactg

SEQ ID NO: 5317922 - DNA, 16 bp, Homo sapiens
tgaattttcccactgc

SEQ ID NO: 5317923 - DNA, 11 bp, Homo sapiens
tgaattttcta

SEQ ID NO: 5317924 - DNA, 14 bp, Homo sapiens
tgaattttctggaa

SEQ ID NO: 5317925 - DNA, 13 bp, Homo sapiens
tgaattttctgtg

SEQ ID NO: 5317926 - DNA, 23 bp, Homo sapiens
tgaattttctttttaataaaaag

SEQ ID NO: 5317927 - DNA, 17 bp, Homo sapiens
tgaattttgcaatgtat

SEQ ID NO: 5317928 - DNA, 15 bp, Homo sapiens
tgaattttgggactt

SEQ ID NO: 5317929 - DNA, 14 bp, Homo sapiens
tgaattttgtaagt

SEQ ID NO: 5317930 - DNA, 17 bp, Homo sapiens
tgaattttgtaagtata

SEQ ID NO: 5317931 - DNA, 17 bp, Homo sapiens
tgaattttgttctctgg

SEQ ID NO: 5317932 - DNA, 16 bp, Homo sapiens
tgaattttgttgctgt

SEQ ID NO: 5317933 - DNA, 23 bp, Homo sapiens
tgaatttttaaacaagtatttgt

SEQ ID NO: 5317934 - DNA, 16 bp, Homo sapiens
tgaatttttacatttg

SEQ ID NO: 5317935 - DNA, 17 bp, Homo sapiens
tgaatttttacatttgt

SEQ ID NO: 5317936 - DNA, 15 bp, Homo sapiens
tgaatttttattgtt

SEQ ID NO: 5317937 - DNA, 16 bp, Homo sapiens
tgaatttttattgttg

SEQ ID NO: 5317938 - DNA, 15 bp, Homo sapiens
tgaatttttcttgcg

SEQ ID NO: 5317939 - DNA, 14 bp, Homo sapiens
tgaatttttgcaat

SEQ ID NO: 5317940 - DNA, 15 bp, Homo sapiens
tgaatttttgcaata

SEQ ID NO: 5317941 - DNA, 16 bp, Homo sapiens
tgaatttttgcaataa

SEQ ID NO: 5317942 - DNA, 21 bp, Homo sapiens
tgaattttttaaatgaaagaa

SEQ ID NO: 5317943 - DNA, 13 bp, Homo sapiens
tgaattttttcct

SEQ ID NO: 5317944 - DNA, 17 bp, Homo sapiens
tgaatttttttctgcac

SEQ ID NO: 5317945 - DNA, 18 bp, Homo sapiens
tgaatttttttctgcaca

SEQ ID NO: 5317946 - DNA, 22 bp, Homo sapiens
tgaatttttttctgcacagctt

SEQ ID NO: 5317947 - DNA, 15 bp, Homo sapiens
tgaatttttttgtaa

SEQ ID NO: 5317948 - DNA, 20 bp, Homo sapiens
tgaattttttttaacattcc

SEQ ID NO: 5317949 - DNA, 16 bp, Homo sapiens
tgaattttttttaatg

SEQ ID NO: 5317950 - DNA, 20 bp, Homo sapiens
tgaattttttttctgaattt

SEQ ID NO: 5317951 - DNA, 20 bp, Homo sapiens
tgaatttttttttcctagcc

SEQ ID NO: 5317952 - DNA, 18 bp, Homo sapiens
tgacaaaaaatgttttaa

SEQ ID NO: 5317953 - DNA, 19 bp, Homo sapiens
tgacaaaaaattaaagcat

SEQ ID NO: 5317954 - DNA, 15 bp, Homo sapiens
tgacaaaaataacac

SEQ ID NO: 5317955 - DNA, 18 bp, Homo sapiens
tgacaaaaggctccagtt

SEQ ID NO: 5317956 - DNA, 13 bp, Homo sapiens
tgacaaaagtaaa

SEQ ID NO: 5317957 - DNA, 14 bp, Homo sapiens
tgacaaaagtaaat

SEQ ID NO: 5317958 - DNA, 16 bp, Homo sapiens
tgacaaaagtaaatgg

SEQ ID NO: 5317959 - DNA, 14 bp, Homo sapiens
tgacaaaataacat

SEQ ID NO: 5317960 - DNA, 15 bp, Homo sapiens
tgacaaaatatataa

SEQ ID NO: 5317961 - DNA, 23 bp, Homo sapiens
tgacaaaatatataatggtttac

SEQ ID NO: 5317962 - DNA, 15 bp, Homo sapiens
tgacaaaatgggagg

SEQ ID NO: 5317963 - DNA, 20 bp, Homo sapiens
tgacaaaatgggaggaggaa

SEQ ID NO: 5317964 - DNA, 21 bp, Homo sapiens
tgacaaaatggggcagaagag

SEQ ID NO: 5317965 - DNA, 22 bp, Homo sapiens
tgacaaaatggggcagaagaga

SEQ ID NO: 5317966 - DNA, 12 bp, Homo sapiens
tgacaaaatgtt

SEQ ID NO: 5317967 - DNA, 14 bp, Homo sapiens
tgacaaaatgttat

SEQ ID NO: 5317968 - DNA, 18 bp, Homo sapiens
tgacaaaattcatttgct

SEQ ID NO: 5317969 - DNA, 13 bp, Homo sapiens
tgacaaaattttg

SEQ ID NO: 5317970 - DNA, 23 bp, Homo sapiens
tgacaaacatgatactgctgctt

SEQ ID NO: 5317971 - DNA, 16 bp, Homo sapiens
tgacaaaccataactg

SEQ ID NO: 5317972 - DNA, 14 bp, Homo sapiens
tgacaaaccatttc

SEQ ID NO: 5317973 - DNA, 17 bp, Homo sapiens
tgacaaaccatttccaa

SEQ ID NO: 5317974 - DNA, 19 bp, Homo sapiens
tgacaaaccatttccaaca

SEQ ID NO: 5317975 - DNA, 21 bp, Homo sapiens
tgacaaacccggaagatcaga

SEQ ID NO: 5317976 - DNA, 17 bp, Homo sapiens
tgacaaacctctaaccc

SEQ ID NO: 5317977 - DNA, 17 bp, Homo sapiens
tgacaaacgtccccagc

SEQ ID NO: 5317978 - DNA, 12 bp, Homo sapiens
tgacaaactgtg

SEQ ID NO: 5317979 - DNA, 22 bp, Homo sapiens
tgacaaacttctttcactcaca

SEQ ID NO: 5317980 - DNA, 15 bp, Homo sapiens
tgacaaagaaaatga

SEQ ID NO: 5317981 - DNA, 16 bp, Homo sapiens
tgacaaagaaaatgag

SEQ ID NO: 5317982 - DNA, 18 bp, Homo sapiens
tgacaaagaaaatgagaa

SEQ ID NO: 5317983 - DNA, 17 bp, Homo sapiens
tgacaaagactcctctg

SEQ ID NO: 5317984 - DNA, 19 bp, Homo sapiens
tgacaaagactcctctggg

SEQ ID NO: 5317985 - DNA, 22 bp, Homo sapiens
tgacaaagactcctctgggcct

SEQ ID NO: 5317986 - DNA, 16 bp, Homo sapiens
tgacaaagatggctca

SEQ ID NO: 5317987 - DNA, 23 bp, Homo sapiens
tgacaaagatggctcagaggggg

SEQ ID NO: 5317988 - DNA, 16 bp, Homo sapiens
tgacaaagccattctt

SEQ ID NO: 5317989 - DNA, 16 bp, Homo sapiens
tgacaaagcctctgaa

SEQ ID NO: 5317990 - DNA, 14 bp, Homo sapiens
tgacaaaggatgaa

SEQ ID NO: 5317991 - DNA, 17 bp, Homo sapiens
tgacaaaggtggtaaat

SEQ ID NO: 5317992 - DNA, 22 bp, Homo sapiens
tgacaaaggtggtaaattcaga

SEQ ID NO: 5317993 - DNA, 16 bp, Homo sapiens
tgacaccaaaatgaac

SEQ ID NO: 5317994 - DNA, 19 bp, Homo sapiens
tgacaccaaatattttcaa

SEQ ID NO: 5317995 - DNA, 17 bp, Homo sapiens
tgacaccaaccagacag

SEQ ID NO: 5317996 - DNA, 18 bp, Homo sapiens
tgacaccaataaatgttt

SEQ ID NO: 5317997 - DNA, 18 bp, Homo sapiens
tgacaccaccactgtgtc

SEQ ID NO: 5317998 - DNA, 12 bp, Homo sapiens
tgacaccagcct

SEQ ID NO: 5317999 - DNA, 16 bp, Homo sapiens
tgacaccagcctttct

SEQ ID NO: 5318000 - DNA, 22 bp, Homo sapiens
tgacaccagcctttctcccagg

SEQ ID NO: 5318001 - DNA, 23 bp, Homo sapiens
tgacaccagcctttctcccaggc

SEQ ID NO: 5318002 - DNA, 14 bp, Homo sapiens
tgacaccagggcca

SEQ ID NO: 5318003 - DNA, 13 bp, Homo sapiens
tgacaccatcaga

SEQ ID NO: 5318004 - DNA, 18 bp, Homo sapiens
tgacaccattctcctgcc

SEQ ID NO: 5318005 - DNA, 18 bp, Homo sapiens
tgacacccaccctgtgcc

SEQ ID NO: 5318006 - DNA, 22 bp, Homo sapiens
tgacacccaccctgtgccatca

SEQ ID NO: 5318007 - DNA, 13 bp, Homo sapiens
tgacacccagacc

SEQ ID NO: 5318008 - DNA, 14 bp, Homo sapiens
tgacacccaggccc

SEQ ID NO: 5318009 - DNA, 19 bp, Homo sapiens
tgacacccatgtttctctg

SEQ ID NO: 5318010 - DNA, 13 bp, Homo sapiens
tgacaccccctcc

SEQ ID NO: 5318011 - DNA, 23 bp, Homo sapiens
tgacaccccctccccgcccctgt

SEQ ID NO: 5318012 - DNA, 21 bp, Homo sapiens
tgacacccgtgagcgcctgtg

SEQ ID NO: 5318013 - DNA, 15 bp, Homo sapiens
tgacacccttctccc

SEQ ID NO: 5318014 - DNA, 16 bp, Homo sapiens
tgacacccttctccca

SEQ ID NO: 5318015 - DNA, 19 bp, Homo sapiens
tgacacccttctcccactc

SEQ ID NO: 5318016 - DNA, 20 bp, Homo sapiens
tgacacccttctcccactct

SEQ ID NO: 5318017 - DNA, 16 bp, Homo sapiens
tgacaccgtccctcag

SEQ ID NO: 5318018 - DNA, 17 bp, Homo sapiens
tgacaccgtccctcagt

SEQ ID NO: 5318019 - DNA, 18 bp, Homo sapiens
tgacaccgtccctcagtg

SEQ ID NO: 5318020 - DNA, 20 bp, Homo sapiens
tgacaccgtcgaccaggaaa

SEQ ID NO: 5318021 - DNA, 23 bp, Homo sapiens
tgacaccgtcgaccaggaaagcc

SEQ ID NO: 5318022 - DNA, 18 bp, Homo sapiens
tgacacctaactcttctt

SEQ ID NO: 5318023 - DNA, 13 bp, Homo sapiens
tgacacctaccat

SEQ ID NO: 5318024 - DNA, 19 bp, Homo sapiens
tgacacctaccatgctgct

SEQ ID NO: 5318025 - DNA, 20 bp, Homo sapiens
tgacacctagagtttggact

SEQ ID NO: 5318026 - DNA, 14 bp, Homo sapiens
tgacacctcagtca

SEQ ID NO: 5318027 - DNA, 22 bp, Homo sapiens
tgacacctccatttctctccag

SEQ ID NO: 5318028 - DNA, 20 bp, Homo sapiens
tgacacctggtgcgggcctg

SEQ ID NO: 5318029 - DNA, 19 bp, Homo sapiens
tgacacctttaaaaagcag

SEQ ID NO: 5318030 - DNA, 20 bp, Homo sapiens
tgacacctttcataatcttt

SEQ ID NO: 5318031 - DNA, 20 bp, Homo sapiens
tgacacgcaagtgtgtgagt

SEQ ID NO: 5318032 - DNA, 19 bp, Homo sapiens
tgacacgcagttgctcgct

SEQ ID NO: 5318033 - DNA, 20 bp, Homo sapiens
tgacacgcagttgctcgctt

SEQ ID NO: 5318034 - DNA, 12 bp, Homo sapiens
tgacacgcttca

SEQ ID NO: 5318035 - DNA, 14 bp, Homo sapiens
tgacacgcttctga

SEQ ID NO: 5318036 - DNA, 19 bp, Homo sapiens
tgacacgcttctgagcagg

SEQ ID NO: 5318037 - DNA, 21 bp, Homo sapiens
tgacacggggatcatctctgt

SEQ ID NO: 5318038 - DNA, 20 bp, Homo sapiens
tgacacgtctcgccaagcag

SEQ ID NO: 5318039 - DNA, 18 bp, Homo sapiens
tgacactaaccagagtca

SEQ ID NO: 5318040 - DNA, 19 bp, Homo sapiens
tgacactaccttatcaggc

SEQ ID NO: 5318041 - DNA, 23 bp, Homo sapiens
tgacactagcccaatgaaatgaa

SEQ ID NO: 5318042 - DNA, 18 bp, Homo sapiens
tgacactatatctgtata

SEQ ID NO: 5318043 - DNA, 19 bp, Homo sapiens
tgacactatatctgtatat

SEQ ID NO: 5318044 - DNA, 20 bp, Homo sapiens
tgacactcagatgcccagta

SEQ ID NO: 5318045 - DNA, 16 bp, Homo sapiens
tgacactcatataatt

SEQ ID NO: 5318046 - DNA, 18 bp, Homo sapiens
tgacactcccacccagtc

SEQ ID NO: 5318047 - DNA, 22 bp, Homo sapiens
tgacactcccttgggctccctg

SEQ ID NO: 5318048 - DNA, 20 bp, Homo sapiens
tgacactctccttgcagttc

SEQ ID NO: 5318049 - DNA, 12 bp, Homo sapiens
tgacactctcgt

SEQ ID NO: 5318050 - DNA, 18 bp, Homo sapiens
tgacactgaaagttttgt

SEQ ID NO: 5318051 - DNA, 14 bp, Homo sapiens
tgacactgaaatgc

SEQ ID NO: 5318052 - DNA, 11 bp, Homo sapiens
tgacactgacc

SEQ ID NO: 5318053 - DNA, 20 bp, Homo sapiens
tgacactgatgagtttcact

SEQ ID NO: 5318054 - DNA, 21 bp, Homo sapiens
tgacactgatgagtttcactg

SEQ ID NO: 5318055 - DNA, 17 bp, Homo sapiens
tgacactgcaattggca

SEQ ID NO: 5318056 - DNA, 18 bp, Homo sapiens
tgacactgcgaactctca

SEQ ID NO: 5318057 - DNA, 20 bp, Homo sapiens
tgacactgcggggcttggct

SEQ ID NO: 5318058 - DNA, 23 bp, Homo sapiens
tgacactgcggggcttggctgag

SEQ ID NO: 5318059 - DNA, 16 bp, Homo sapiens
tgacactgctccctga

SEQ ID NO: 5318060 - DNA, 22 bp, Homo sapiens
tgacactgctctaacagccctc

SEQ ID NO: 5318061 - DNA, 20 bp, Homo sapiens
tgacactgctggagaggccc

SEQ ID NO: 5318062 - DNA, 14 bp, Homo sapiens
tgacactggaccag

SEQ ID NO: 5318063 - DNA, 20 bp, Homo sapiens
tgacactggtattcctgcct

SEQ ID NO: 5318064 - DNA, 15 bp, Homo sapiens
tgacactgtgaccct

SEQ ID NO: 5318065 - DNA, 19 bp, Homo sapiens
tgacactgtgaccctgggt

SEQ ID NO: 5318066 - DNA, 14 bp, Homo sapiens
tgacactgtttcct

SEQ ID NO: 5318067 - DNA, 15 bp, Homo sapiens
tgacacttaaaaatg

SEQ ID NO: 5318068 - DNA, 17 bp, Homo sapiens
tgacacttatctcactg

SEQ ID NO: 5318069 - DNA, 18 bp, Homo sapiens
tgacacttcagagagctg

SEQ ID NO: 5318070 - DNA, 19 bp, Homo sapiens
tgacacttcagagagctgg

SEQ ID NO: 5318071 - DNA, 19 bp, Homo sapiens
tgacacttccattgtttaa

SEQ ID NO: 5318072 - DNA, 15 bp, Homo sapiens
tgacacttcctgtcc

SEQ ID NO: 5318073 - DNA, 22 bp, Homo sapiens
tgacacttgattgtctcctaat

SEQ ID NO: 5318074 - DNA, 14 bp, Homo sapiens
tgacacttgtacaa

SEQ ID NO: 5318075 - DNA, 22 bp, Homo sapiens
tgacactttaattaccaacctg

SEQ ID NO: 5318076 - DNA, 23 bp, Homo sapiens
tgacactttgaactcctcaaggg

SEQ ID NO: 5318077 - DNA, 20 bp, Homo sapiens
tgacactttgccagaaagca

SEQ ID NO: 5318078 - DNA, 18 bp, Homo sapiens
tgacacttttaaaataaa

SEQ ID NO: 5318079 - DNA, 19 bp, Homo sapiens
tgacacttttaaaataaat

SEQ ID NO: 5318080 - DNA, 14 bp, Homo sapiens
tgacagaaaatatg

SEQ ID NO: 5318081 - DNA, 19 bp, Homo sapiens
tgacagaaaatatgtatta

SEQ ID NO: 5318082 - DNA, 20 bp, Homo sapiens
tgacagaaaatatgtattaa

SEQ ID NO: 5318083 - DNA, 15 bp, Homo sapiens
tgacagaaagcaagg

SEQ ID NO: 5318084 - DNA, 14 bp, Homo sapiens
tgacagaaagcagt

SEQ ID NO: 5318085 - DNA, 19 bp, Homo sapiens
tgacagaaagcagttctga

SEQ ID NO: 5318086 - DNA, 21 bp, Homo sapiens
tgacagaaagcagttctgatg

SEQ ID NO: 5318087 - DNA, 22 bp, Homo sapiens
tgacagaaagcagttctgatgc

SEQ ID NO: 5318088 - DNA, 13 bp, Homo sapiens
tgacagaacactg

SEQ ID NO: 5318089 - DNA, 14 bp, Homo sapiens
tgacagaacactgt

SEQ ID NO: 5318090 - DNA, 16 bp, Homo sapiens
tgacagaacactgtct

SEQ ID NO: 5318091 - DNA, 21 bp, Homo sapiens
tgacagaacactgtcttgaag

SEQ ID NO: 5318092 - DNA, 18 bp, Homo sapiens
tgacagaaccgagaaggg

SEQ ID NO: 5318093 - DNA, 16 bp, Homo sapiens
tgacagaaggaccagc

SEQ ID NO: 5318094 - DNA, 15 bp, Homo sapiens
tgacagaaggcccga

SEQ ID NO: 5318095 - DNA, 16 bp, Homo sapiens
tgacagaaggcccgag

SEQ ID NO: 5318096 - DNA, 18 bp, Homo sapiens
tgacagaatatgtttcaa

SEQ ID NO: 5318097 - DNA, 21 bp, Homo sapiens
tgacagaatatgtttcaaact

SEQ ID NO: 5318098 - DNA, 18 bp, Homo sapiens
tgacagaatcttgtattt

SEQ ID NO: 5318099 - DNA, 22 bp, Homo sapiens
tgacagaatggctatcaaaaga

SEQ ID NO: 5318100 - DNA, 18 bp, Homo sapiens
tgacagacacaggcccgg

SEQ ID NO: 5318101 - DNA, 14 bp, Homo sapiens
tgacagacaggctc

SEQ ID NO: 5318102 - DNA, 22 bp, Homo sapiens
tgacagaccacatctttatctg

SEQ ID NO: 5318103 - DNA, 19 bp, Homo sapiens
tgacagactatttgctaat

SEQ ID NO: 5318104 - DNA, 19 bp, Homo sapiens
tgacagactcaagagaaac

SEQ ID NO: 5318105 - DNA, 14 bp, Homo sapiens
tgacagactcctga

SEQ ID NO: 5318106 - DNA, 20 bp, Homo sapiens
tgacagactgtagcttctct

SEQ ID NO: 5318107 - DNA, 17 bp, Homo sapiens
tgacagagacccagatc

SEQ ID NO: 5318108 - DNA, 22 bp, Homo sapiens
tgacagagagagatactctggg

SEQ ID NO: 5318109 - DNA, 16 bp, Homo sapiens
tgacagagagttctgg

SEQ ID NO: 5318110 - DNA, 18 bp, Homo sapiens
tgacagagcaagactctg

SEQ ID NO: 5318111 - DNA, 17 bp, Homo sapiens
tgacagagcaataccct

SEQ ID NO: 5318112 - DNA, 20 bp, Homo sapiens
tgacagagcccagcatccct

SEQ ID NO: 5318113 - DNA, 16 bp, Homo sapiens
tgacagagcctgcccc

SEQ ID NO: 5318114 - DNA, 17 bp, Homo sapiens
tgacagagcgagactcc

SEQ ID NO: 5318115 - DNA, 21 bp, Homo sapiens
tgacagagcgagattccgtct

SEQ ID NO: 5318116 - DNA, 16 bp, Homo sapiens
tgacagaggctgcacc

SEQ ID NO: 5318117 - DNA, 20 bp, Homo sapiens
tgacagaggctgcacccctg

SEQ ID NO: 5318118 - DNA, 18 bp, Homo sapiens
tgacagaggtttgaagga

SEQ ID NO: 5318119 - DNA, 21 bp, Homo sapiens
tgacagaggtttgaaggagaa

SEQ ID NO: 5318120 - DNA, 22 bp, Homo sapiens
tgacagaggtttgaaggagaat

SEQ ID NO: 5318121 - DNA, 23 bp, Homo sapiens
tgacagaggtttgaaggagaatg

SEQ ID NO: 5318122 - DNA, 17 bp, Homo sapiens
tgacagagtgagactct

SEQ ID NO: 5318123 - DNA, 19 bp, Homo sapiens
tgacagagttggtgttcat

SEQ ID NO: 5318124 - DNA, 13 bp, Homo sapiens
tgacagatatatt

SEQ ID NO: 5318125 - DNA, 22 bp, Homo sapiens
tgacagatatatttaagcctta

SEQ ID NO: 5318126 - DNA, 15 bp, Homo sapiens
tgacagatcaagctg

SEQ ID NO: 5318127 - DNA, 18 bp, Homo sapiens
tgacagatctagttctct

SEQ ID NO: 5318128 - DNA, 22 bp, Homo sapiens
tgacagatcttttttttttccc

SEQ ID NO: 5318129 - DNA, 11 bp, Homo sapiens
tgacagatgaa

SEQ ID NO: 5318130 - DNA, 15 bp, Homo sapiens
tgacagatgcttttg

SEQ ID NO: 5318131 - DNA, 18 bp, Homo sapiens
tgacagatggtgaagtaa

SEQ ID NO: 5318132 - DNA, 19 bp, Homo sapiens
tgacagatggtgaagtaac

SEQ ID NO: 5318133 - DNA, 22 bp, Homo sapiens
tgacagatgtcagccgagccgg

SEQ ID NO: 5318134 - DNA, 13 bp, Homo sapiens
tgacagatgttat

SEQ ID NO: 5318135 - DNA, 14 bp, Homo sapiens
tgacagatgttcca

SEQ ID NO: 5318136 - DNA, 14 bp, Homo sapiens
tgacagcaaaatgt

SEQ ID NO: 5318137 - DNA, 15 bp, Homo sapiens
tgacagcaaacacag

SEQ ID NO: 5318138 - DNA, 16 bp, Homo sapiens
tgacagcaaacacagt

SEQ ID NO: 5318139 - DNA, 18 bp, Homo sapiens
tgacagcaaacacagtca

SEQ ID NO: 5318140 - DNA, 15 bp, Homo sapiens
tgacagcaattcatg

SEQ ID NO: 5318141 - DNA, 18 bp, Homo sapiens
tgacagcaattcatggtt

SEQ ID NO: 5318142 - DNA, 20 bp, Homo sapiens
tgacagcaattcatggttca

SEQ ID NO: 5318143 - DNA, 17 bp, Homo sapiens
tgacagcacctgagaag

SEQ ID NO: 5318144 - DNA, 14 bp, Homo sapiens
tgacagcagcctgt

SEQ ID NO: 5318145 - DNA, 22 bp, Homo sapiens
tgacagcaggccactagtgaca

SEQ ID NO: 5318146 - DNA, 11 bp, Homo sapiens
tgacagccaga

SEQ ID NO: 5318147 - DNA, 11 bp, Homo sapiens
tgacagcccct

SEQ ID NO: 5318148 - DNA, 18 bp, Homo sapiens
tgacagcctcagtgaccc

SEQ ID NO: 5318149 - DNA, 21 bp, Homo sapiens
tgacagcctccaccttgagca

SEQ ID NO: 5318150 - DNA, 22 bp, Homo sapiens
tgacagcctcccacccccatct

SEQ ID NO: 5318151 - DNA, 13 bp, Homo sapiens
tgacagcctgggg

SEQ ID NO: 5318152 - DNA, 15 bp, Homo sapiens
tgacagcctgggggg

SEQ ID NO: 5318153 - DNA, 17 bp, Homo sapiens
tgacagccttccccagc

SEQ ID NO: 5318154 - DNA, 17 bp, Homo sapiens
tgacagccttttttcct

SEQ ID NO: 5318155 - DNA, 19 bp, Homo sapiens
tgacagcgacagaaaacct

SEQ ID NO: 5318156 - DNA, 13 bp, Homo sapiens
tgacagcgatggc

SEQ ID NO: 5318157 - DNA, 15 bp, Homo sapiens
tgacagcgatggcag

SEQ ID NO: 5318158 - DNA, 23 bp, Homo sapiens
tgacagcgatggcaggcctgacc

SEQ ID NO: 5318159 - DNA, 16 bp, Homo sapiens
tgacagcgcacagctg

SEQ ID NO: 5318160 - DNA, 15 bp, Homo sapiens
tgacagctagacacc

SEQ ID NO: 5318161 - DNA, 20 bp, Homo sapiens
tgacagctaggatgtgcatt

SEQ ID NO: 5318162 - DNA, 22 bp, Homo sapiens
tgacagctctgtttagaggagg

SEQ ID NO: 5318163 - DNA, 14 bp, Homo sapiens
tgacagctgctcct

SEQ ID NO: 5318164 - DNA, 18 bp, Homo sapiens
tgacagctgctcctagag

SEQ ID NO: 5318165 - DNA, 13 bp, Homo sapiens
tgacagctggcta

SEQ ID NO: 5318166 - DNA, 12 bp, Homo sapiens
tgacagctgtcc

SEQ ID NO: 5318167 - DNA, 21 bp, Homo sapiens
tgacagctgtccctgtcacca

SEQ ID NO: 5318168 - DNA, 14 bp, Homo sapiens
tgacagctgttcca

SEQ ID NO: 5318169 - DNA, 15 bp, Homo sapiens
tgaccatgcatttta

SEQ ID NO: 5318170 - DNA, 18 bp, Homo sapiens
tgaccatgctcatctgct

SEQ ID NO: 5318171 - DNA, 23 bp, Homo sapiens
tgaccatggttttggctctccca

SEQ ID NO: 5318172 - DNA, 13 bp, Homo sapiens
tgaccatgtgaat

SEQ ID NO: 5318173 - DNA, 17 bp, Homo sapiens
tgaccatgtgattatgg

SEQ ID NO: 5318174 - DNA, 21 bp, Homo sapiens
tgaccatgtgcggagcagcct

SEQ ID NO: 5318175 - DNA, 13 bp, Homo sapiens
tgaccatgttcat

SEQ ID NO: 5318176 - DNA, 18 bp, Homo sapiens
tgaccattctcaccctgt

SEQ ID NO: 5318177 - DNA, 14 bp, Homo sapiens
tgaccattctccac

SEQ ID NO: 5318178 - DNA, 18 bp, Homo sapiens
tgaccattctccacctgc

SEQ ID NO: 5318179 - DNA, 19 bp, Homo sapiens
tgaccattctccacctgcc

SEQ ID NO: 5318180 - DNA, 21 bp, Homo sapiens
tgaccattctccacctgccag

SEQ ID NO: 5318181 - DNA, 12 bp, Homo sapiens
tgaccattctgc

SEQ ID NO: 5318182 - DNA, 13 bp, Homo sapiens
tgaccattctttt

SEQ ID NO: 5318183 - DNA, 20 bp, Homo sapiens
tgaccattttgttaaaatct

SEQ ID NO: 5318184 - DNA, 22 bp, Homo sapiens
tgaccattttttaatttacttg

SEQ ID NO: 5318185 - DNA, 19 bp, Homo sapiens
tgacccaaaaatgttccct

SEQ ID NO: 5318186 - DNA, 12 bp, Homo sapiens
tgacccaaagca

SEQ ID NO: 5318187 - DNA, 16 bp, Homo sapiens
tgacccaagaggtggg

SEQ ID NO: 5318188 - DNA, 12 bp, Homo sapiens
tgacccaataaa

SEQ ID NO: 5318189 - DNA, 13 bp, Homo sapiens
tgacccacagcct

SEQ ID NO: 5318190 - DNA, 14 bp, Homo sapiens
tgacccacagcctc

SEQ ID NO: 5318191 - DNA, 15 bp, Homo sapiens
tgacccacagcctct

SEQ ID NO: 5318192 - DNA, 19 bp, Homo sapiens
tgacccacagcctctgcct

SEQ ID NO: 5318193 - DNA, 20 bp, Homo sapiens
tgacccacagcctctgcctg

SEQ ID NO: 5318194 - DNA, 15 bp, Homo sapiens
tgacccacagctctg

SEQ ID NO: 5318195 - DNA, 12 bp, Homo sapiens
tgacccaccagt

SEQ ID NO: 5318196 - DNA, 13 bp, Homo sapiens
tgacccaccagtg

SEQ ID NO: 5318197 - DNA, 11 bp, Homo sapiens
tgacccacccc

SEQ ID NO: 5318198 - DNA, 12 bp, Homo sapiens
tgacccacccct

SEQ ID NO: 5318199 - DNA, 18 bp, Homo sapiens
tgacccacccctgtgctc

SEQ ID NO: 5318200 - DNA, 21 bp, Homo sapiens
tgacccacccgccttggcctc

SEQ ID NO: 5318201 - DNA, 18 bp, Homo sapiens
tgacccacttctcatcac

SEQ ID NO: 5318202 - DNA, 21 bp, Homo sapiens
tgacccagacccaactcgcct

SEQ ID NO: 5318203 - DNA, 17 bp, Homo sapiens
tgacccagaggacagca

SEQ ID NO: 5318204 - DNA, 22 bp, Homo sapiens
tgacccagaggggacgctgagg

SEQ ID NO: 5318205 - DNA, 18 bp, Homo sapiens
tgacccagccccttgaga

SEQ ID NO: 5318206 - DNA, 23 bp, Homo sapiens
tgacccagccccttgagaaacct

SEQ ID NO: 5318207 - DNA, 14 bp, Homo sapiens
tgacccagccctga

SEQ ID NO: 5318208 - DNA, 12 bp, Homo sapiens
tgacccagcctg

SEQ ID NO: 5318209 - DNA, 13 bp, Homo sapiens
tgacccagcctga

SEQ ID NO: 5318210 - DNA, 17 bp, Homo sapiens
tgacccagcctgaaaga

SEQ ID NO: 5318211 - DNA, 13 bp, Homo sapiens
tgacccaggaata

SEQ ID NO: 5318212 - DNA, 12 bp, Homo sapiens
tgacccaggccg

SEQ ID NO: 5318213 - DNA, 15 bp, Homo sapiens
tgacccaggccgcag

SEQ ID NO: 5318214 - DNA, 21 bp, Homo sapiens
tgacccaggccgcagctcttg

SEQ ID NO: 5318215 - DNA, 19 bp, Homo sapiens
tgacccaggctgcctgagc

SEQ ID NO: 5318216 - DNA, 13 bp, Homo sapiens
tgacccaggctgg

SEQ ID NO: 5318217 - DNA, 13 bp, Homo sapiens
tgacccagtgaga

SEQ ID NO: 5318218 - DNA, 18 bp, Homo sapiens
tgacccagtgcccccact

SEQ ID NO: 5318219 - DNA, 14 bp, Homo sapiens
tgacccagtggcat

SEQ ID NO: 5318220 - DNA, 20 bp, Homo sapiens
tgacccagtgtgtgctcagc

SEQ ID NO: 5318221 - DNA, 12 bp, Homo sapiens
tgacccatgctg

SEQ ID NO: 5318222 - DNA, 15 bp, Homo sapiens
tgacccatgctgccc

SEQ ID NO: 5318223 - DNA, 16 bp, Homo sapiens
tgacccatgctgccct

SEQ ID NO: 5318224 - DNA, 16 bp, Homo sapiens
tgacccatgggcagga

SEQ ID NO: 5318225 - DNA, 19 bp, Homo sapiens
tgacccatgggcaggagac

SEQ ID NO: 5318226 - DNA, 15 bp, Homo sapiens
tgacccattgctgtt

SEQ ID NO: 5318227 - DNA, 19 bp, Homo sapiens
tgaccccaaagagcctgga

SEQ ID NO: 5318228 - DNA, 22 bp, Homo sapiens
tgaccccaaagagcctggagaa

SEQ ID NO: 5318229 - DNA, 15 bp, Homo sapiens
tgaccccacctagaa

SEQ ID NO: 5318230 - DNA, 18 bp, Homo sapiens
tgaccccacgatttgtct

SEQ ID NO: 5318231 - DNA, 18 bp, Homo sapiens
tgaccccagaaaagcata

SEQ ID NO: 5318232 - DNA, 13 bp, Homo sapiens
tgaccccagagga

SEQ ID NO: 5318233 - DNA, 12 bp, Homo sapiens
tgaccccagctc

SEQ ID NO: 5318234 - DNA, 22 bp, Homo sapiens
tgaccccaggagggaggcaggg

SEQ ID NO: 5318235 - DNA, 18 bp, Homo sapiens
tgaccccagggcacagga

SEQ ID NO: 5318236 - DNA, 19 bp, Homo sapiens
tgaccccagggcacaggag

SEQ ID NO: 5318237 - DNA, 22 bp, Homo sapiens
tgaccccagggcacaggagcta

SEQ ID NO: 5318238 - DNA, 18 bp, Homo sapiens
tgaccccagggcctgtct

SEQ ID NO: 5318239 - DNA, 17 bp, Homo sapiens
tgaccccaggtcagccc

SEQ ID NO: 5318240 - DNA, 19 bp, Homo sapiens
tgaccccaggtcagccctg

SEQ ID NO: 5318241 - DNA, 20 bp, Homo sapiens
tgaccccagtggaaaacaaa

SEQ ID NO: 5318242 - DNA, 23 bp, Homo sapiens
tgaccccagtttcttcttacact

SEQ ID NO: 5318243 - DNA, 18 bp, Homo sapiens
tgaccccatctctgctgc

SEQ ID NO: 5318244 - DNA, 14 bp, Homo sapiens
tgacccccagctcc

SEQ ID NO: 5318245 - DNA, 18 bp, Homo sapiens
tgacccccatctgagctg

SEQ ID NO: 5318246 - DNA, 20 bp, Homo sapiens
tgacccccatctgagctggg

SEQ ID NO: 5318247 - DNA, 21 bp, Homo sapiens
tgacccccatctgagctgggg

SEQ ID NO: 5318248 - DNA, 13 bp, Homo sapiens
tgacccccatgta

SEQ ID NO: 5318249 - DNA, 14 bp, Homo sapiens
tgacccccctcagg

SEQ ID NO: 5318250 - DNA, 16 bp, Homo sapiens
tgaccccctcccccca

SEQ ID NO: 5318251 - DNA, 13 bp, Homo sapiens
tgaccccctgtcc

SEQ ID NO: 5318252 - DNA, 21 bp, Homo sapiens
tgacccccttgattcccaccg

SEQ ID NO: 5318253 - DNA, 20 bp, Homo sapiens
tgaccccgagaagtgctctt

SEQ ID NO: 5318254 - DNA, 22 bp, Homo sapiens
tgaccccgagaagtgctcttgg

SEQ ID NO: 5318255 - DNA, 15 bp, Homo sapiens
tgaccccgccatgca

SEQ ID NO: 5318256 - DNA, 19 bp, Homo sapiens
tgaccccggggggctggga

SEQ ID NO: 5318257 - DNA, 13 bp, Homo sapiens
tgacccctcatct

SEQ ID NO: 5318258 - DNA, 14 bp, Homo sapiens
tgacccctccctgc

SEQ ID NO: 5318259 - DNA, 22 bp, Homo sapiens
tgacccctcctggggccaggcc

SEQ ID NO: 5318260 - DNA, 19 bp, Homo sapiens
tgacccctcgtccaccccc

SEQ ID NO: 5318261 - DNA, 14 bp, Homo sapiens
tgacccctctaatt

SEQ ID NO: 5318262 - DNA, 13 bp, Homo sapiens
tgacccctggcca

SEQ ID NO: 5318263 - DNA, 17 bp, Homo sapiens
tgacccctggccacagc

SEQ ID NO: 5318264 - DNA, 18 bp, Homo sapiens
tgacccctggccacagcc

SEQ ID NO: 5318265 - DNA, 21 bp, Homo sapiens
tgacccctggccacagccttc

SEQ ID NO: 5318266 - DNA, 14 bp, Homo sapiens
tgacccctgtgtga

SEQ ID NO: 5318267 - DNA, 11 bp, Homo sapiens
tgaccccttca

SEQ ID NO: 5318268 - DNA, 11 bp, Homo sapiens
tgaccccttcc

SEQ ID NO: 5318269 - DNA, 15 bp, Homo sapiens
tgaccccttcctgtc

SEQ ID NO: 5318270 - DNA, 18 bp, Homo sapiens
tgaccccttcctgtctgg

SEQ ID NO: 5318271 - DNA, 16 bp, Homo sapiens
tgacccctttccccca

SEQ ID NO: 5318272 - DNA, 20 bp, Homo sapiens
tgacccctttcccccacccc

SEQ ID NO: 5318273 - DNA, 16 bp, Homo sapiens
tgacccggaggaaagg

SEQ ID NO: 5318274 - DNA, 21 bp, Homo sapiens
tgacccggaggccacatgagt

SEQ ID NO: 5318275 - DNA, 22 bp, Homo sapiens
tgacccggattggccctgcccc

SEQ ID NO: 5318276 - DNA, 23 bp, Homo sapiens
tgacccggcccccgccctctgcc

SEQ ID NO: 5318277 - DNA, 22 bp, Homo sapiens
tgacccggcccctaccagccac

SEQ ID NO: 5318278 - DNA, 17 bp, Homo sapiens
tgacccggggcagctgg

SEQ ID NO: 5318279 - DNA, 19 bp, Homo sapiens
tgacccggttgcagtcact

SEQ ID NO: 5318280 - DNA, 13 bp, Homo sapiens
tgacccgtacaca

SEQ ID NO: 5318281 - DNA, 19 bp, Homo sapiens
tgacccgtccattcttcag

SEQ ID NO: 5318282 - DNA, 18 bp, Homo sapiens
tgaccctagaattccttt

SEQ ID NO: 5318283 - DNA, 19 bp, Homo sapiens
tgaccctcaattcatattt

SEQ ID NO: 5318284 - DNA, 12 bp, Homo sapiens
tgaccctcactt

SEQ ID NO: 5318285 - DNA, 13 bp, Homo sapiens
tgaccctcagctg

SEQ ID NO: 5318286 - DNA, 17 bp, Homo sapiens
tgaccctcagctgtcac

SEQ ID NO: 5318287 - DNA, 22 bp, Homo sapiens
tgaccctcagctgtcacctgct

SEQ ID NO: 5318288 - DNA, 21 bp, Homo sapiens
tgaccctcatctttcttccaa

SEQ ID NO: 5318289 - DNA, 15 bp, Homo sapiens
tgaccctcattcttt

SEQ ID NO: 5318290 - DNA, 12 bp, Homo sapiens
tgaccctcccac

SEQ ID NO: 5318291 - DNA, 16 bp, Homo sapiens
tgaccctcccactccc

SEQ ID NO: 5318292 - DNA, 12 bp, Homo sapiens
tgaccctccctt

SEQ ID NO: 5318293 - DNA, 15 bp, Homo sapiens
tgaccctcctgtcca

SEQ ID NO: 5318294 - DNA, 22 bp, Homo sapiens
tgaccctcctgttgcacccagc

SEQ ID NO: 5318295 - DNA, 13 bp, Homo sapiens
tgaccctccttct

SEQ ID NO: 5318296 - DNA, 14 bp, Homo sapiens
tgaccctctcactt

SEQ ID NO: 5318297 - DNA, 23 bp, Homo sapiens
tgaccctctgaatggtccagggt

SEQ ID NO: 5318298 - DNA, 15 bp, Homo sapiens
tgaccctctgtcccc

SEQ ID NO: 5318299 - DNA, 17 bp, Homo sapiens
tgaccctctgtccccag

SEQ ID NO: 5318300 - DNA, 19 bp, Homo sapiens
tgaccctctgtccccaggc

SEQ ID NO: 5318301 - DNA, 22 bp, Homo sapiens
tgaccctgaaaggaacactggc

SEQ ID NO: 5318302 - DNA, 17 bp, Homo sapiens
tgaccctgagggctcct

SEQ ID NO: 5318303 - DNA, 20 bp, Homo sapiens
tgaccctgagggctcctcca

SEQ ID NO: 5318304 - DNA, 14 bp, Homo sapiens
tgaccctgcaccct

SEQ ID NO: 5318305 - DNA, 12 bp, Homo sapiens
tgaccctgcaga

SEQ ID NO: 5318306 - DNA, 16 bp, Homo sapiens
tgaccctgcagagatg

SEQ ID NO: 5318307 - DNA, 13 bp, Homo sapiens
tgaccctgcctct

SEQ ID NO: 5318308 - DNA, 22 bp, Homo sapiens
tgaccctggagcggctctcctg

SEQ ID NO: 5318309 - DNA, 13 bp, Homo sapiens
tgaccctggagct

SEQ ID NO: 5318310 - DNA, 21 bp, Homo sapiens
tgaccctgggcagttccttac

SEQ ID NO: 5318311 - DNA, 18 bp, Homo sapiens
tgaccctgggcttctgta

SEQ ID NO: 5318312 - DNA, 17 bp, Homo sapiens
tgaccctggggctggct

SEQ ID NO: 5318313 - DNA, 23 bp, Homo sapiens
tgaccctggtgggctgttcagct

SEQ ID NO: 5318314 - DNA, 20 bp, Homo sapiens
tgaccctgtatatagcccag

SEQ ID NO: 5318315 - DNA, 14 bp, Homo sapiens
tgaccctgtgacaa

SEQ ID NO: 5318316 - DNA, 16 bp, Homo sapiens
tgaccctgtgccccag

SEQ ID NO: 5318317 - DNA, 16 bp, Homo sapiens
tgaccctgtgccccgc

SEQ ID NO: 5318318 - DNA, 12 bp, Homo sapiens
tgacccttcagg

SEQ ID NO: 5318319 - DNA, 13 bp, Homo sapiens
tgacccttcaggg

SEQ ID NO: 5318320 - DNA, 21 bp, Homo sapiens
tgacccttcagggccagaagg

SEQ ID NO: 5318321 - DNA, 16 bp, Homo sapiens
tgacccttctctcact

SEQ ID NO: 5318322 - DNA, 15 bp, Homo sapiens
tgacccttgaaccaa

SEQ ID NO: 5318323 - DNA, 23 bp, Homo sapiens
tgacccttgagcttaaacagaag

SEQ ID NO: 5318324 - DNA, 13 bp, Homo sapiens
tgaccctttcctc

SEQ ID NO: 5318325 - DNA, 21 bp, Homo sapiens
tgaccctttgaggcccccagt

SEQ ID NO: 5318326 - DNA, 17 bp, Homo sapiens
tgacccttttctgatcg

SEQ ID NO: 5318327 - DNA, 20 bp, Homo sapiens
tgacccttttctgatcgtct

SEQ ID NO: 5318328 - DNA, 16 bp, Homo sapiens
tgacccttttgtgtct

SEQ ID NO: 5318329 - DNA, 17 bp, Homo sapiens
tgaccgacaaaattcca

SEQ ID NO: 5318330 - DNA, 18 bp, Homo sapiens
tgaccgacaaaattccag

SEQ ID NO: 5318331 - DNA, 18 bp, Homo sapiens
tgaccgactaccccagtc

SEQ ID NO: 5318332 - DNA, 14 bp, Homo sapiens
tgaccgagccctgg

SEQ ID NO: 5318333 - DNA, 15 bp, Homo sapiens
tgaccgagccctgga

SEQ ID NO: 5318334 - DNA, 20 bp, Homo sapiens
tgaccgagccctggagagcc

SEQ ID NO: 5318335 - DNA, 19 bp, Homo sapiens
tgaccgatgtgtctcccag

SEQ ID NO: 5318336 - DNA, 18 bp, Homo sapiens
tgaccgattatgctttct

SEQ ID NO: 5318337 - DNA, 21 bp, Homo sapiens
tgaccgcacgttctctgcccc

SEQ ID NO: 5318338 - DNA, 16 bp, Homo sapiens
tgaccgcccagctctc

SEQ ID NO: 5318339 - DNA, 22 bp, Homo sapiens
tgaccggaatggtcaaatctct

SEQ ID NO: 5318340 - DNA, 14 bp, Homo sapiens
tgaccggctgccgt

SEQ ID NO: 5318341 - DNA, 15 bp, Homo sapiens
tgaccgggcactggc

SEQ ID NO: 5318342 - DNA, 18 bp, Homo sapiens
tgaccgggggctgctggg

SEQ ID NO: 5318343 - DNA, 20 bp, Homo sapiens
tgaccgggggctgctgggcg

SEQ ID NO: 5318344 - DNA, 13 bp, Homo sapiens
tgaccggtgcttt

SEQ ID NO: 5318345 - DNA, 21 bp, Homo sapiens
tgaccggtttggagtaatcag

SEQ ID NO: 5318346 - DNA, 20 bp, Homo sapiens
tgaccgtgaggccagagaca

SEQ ID NO: 5318347 - DNA, 18 bp, Homo sapiens
tgaccgtgctggccccag

SEQ ID NO: 5318348 - DNA, 21 bp, Homo sapiens
tgaccttggaggaatgacaat

SEQ ID NO: 5318349 - DNA, 14 bp, Homo sapiens
tgaccttgggacca

SEQ ID NO: 5318350 - DNA, 18 bp, Homo sapiens
tgaccttgtaatgtaact

SEQ ID NO: 5318351 - DNA, 15 bp, Homo sapiens
tgacctttaagagaa

SEQ ID NO: 5318352 - DNA, 14 bp, Homo sapiens
tgacctttaattca

SEQ ID NO: 5318353 - DNA, 18 bp, Homo sapiens
tgacctttaattcaggta

SEQ ID NO: 5318354 - DNA, 16 bp, Homo sapiens
tgacctttaggtatta

SEQ ID NO: 5318355 - DNA, 16 bp, Homo sapiens
tgacctttatttatta

SEQ ID NO: 5318356 - DNA, 18 bp, Homo sapiens
tgacctttatttattaaa

SEQ ID NO: 5318357 - DNA, 13 bp, Homo sapiens
tgacctttcaata

SEQ ID NO: 5318358 - DNA, 18 bp, Homo sapiens
tgacctttcaataggaaa

SEQ ID NO: 5318359 - DNA, 15 bp, Homo sapiens
tgacctttgtcttct

SEQ ID NO: 5318360 - DNA, 18 bp, Homo sapiens
tgacctttttaatccagg

SEQ ID NO: 5318361 - DNA, 15 bp, Homo sapiens
tgacgaaatggaaac

SEQ ID NO: 5318362 - DNA, 14 bp, Homo sapiens
tgacgaagtctctt

SEQ ID NO: 5318363 - DNA, 15 bp, Homo sapiens
tgacgaatcctgctc

SEQ ID NO: 5318364 - DNA, 15 bp, Homo sapiens
tgacgacaagtgctg

SEQ ID NO: 5318365 - DNA, 21 bp, Homo sapiens
tgacgacatacatgctacttt

SEQ ID NO: 5318366 - DNA, 23 bp, Homo sapiens
tgacgacctacatctgaaatcta

SEQ ID NO: 5318367 - DNA, 15 bp, Homo sapiens
tgacgaggctgggcc

SEQ ID NO: 5318368 - DNA, 15 bp, Homo sapiens
tgacgatcttccccc

SEQ ID NO: 5318369 - DNA, 21 bp, Homo sapiens
tgacgatgatgtacagattct

SEQ ID NO: 5318370 - DNA, 19 bp, Homo sapiens
tgacgattatttatttctg

SEQ ID NO: 5318371 - DNA, 20 bp, Homo sapiens
tgacgattatttatttctgt

SEQ ID NO: 5318372 - DNA, 22 bp, Homo sapiens
tgacgattatttatttctgtaa

SEQ ID NO: 5318373 - DNA, 19 bp, Homo sapiens
tgacgcaacccacgtgtaa

SEQ ID NO: 5318374 - DNA, 18 bp, Homo sapiens
tgacgcaccactgccaat

SEQ ID NO: 5318375 - DNA, 15 bp, Homo sapiens
tgacgcagacagagg

SEQ ID NO: 5318376 - DNA, 14 bp, Homo sapiens
tgacgcagccggag

SEQ ID NO: 5318377 - DNA, 14 bp, Homo sapiens
tgacgcagcctgag

SEQ ID NO: 5318378 - DNA, 15 bp, Homo sapiens
tgacgcagcctgaga

SEQ ID NO: 5318379 - DNA, 16 bp, Homo sapiens
tgacgcagcctgagaa

SEQ ID NO: 5318380 - DNA, 17 bp, Homo sapiens
tgacgcagcctgagaat

SEQ ID NO: 5318381 - DNA, 14 bp, Homo sapiens
tgacgccatcccag

SEQ ID NO: 5318382 - DNA, 20 bp, Homo sapiens
tgacgccatcccagccccaa

SEQ ID NO: 5318383 - DNA, 17 bp, Homo sapiens
tgacgcccaccttcggg

SEQ ID NO: 5318384 - DNA, 22 bp, Homo sapiens
tgacgctcagccccaggccagc

SEQ ID NO: 5318385 - DNA, 18 bp, Homo sapiens
tgacgctgaataaatgtc

SEQ ID NO: 5318386 - DNA, 14 bp, Homo sapiens
tgacgctgatacat

SEQ ID NO: 5318387 - DNA, 15 bp, Homo sapiens
tgacgctgatacata

SEQ ID NO: 5318388 - DNA, 12 bp, Homo sapiens
tgacgcttccct

SEQ ID NO: 5318389 - DNA, 15 bp, Homo sapiens
tgacgcttgtgacag

SEQ ID NO: 5318390 - DNA, 16 bp, Homo sapiens
tgacgcttgtgacagt

SEQ ID NO: 5318391 - DNA, 20 bp, Homo sapiens
tgacgcttgtgacagtgcct

SEQ ID NO: 5318392 - DNA, 20 bp, Homo sapiens
tgacggaagccaacttggct

SEQ ID NO: 5318393 - DNA, 22 bp, Homo sapiens
tgacggaaggacctatgtttgc

SEQ ID NO: 5318394 - DNA, 23 bp, Homo sapiens
tgacggaaggacctatgtttgct

SEQ ID NO: 5318395 - DNA, 16 bp, Homo sapiens
tgacggacgtcctgct

SEQ ID NO: 5318396 - DNA, 15 bp, Homo sapiens
tgacggactcagact

SEQ ID NO: 5318397 - DNA, 18 bp, Homo sapiens
tgacggactcagactcct

SEQ ID NO: 5318398 - DNA, 23 bp, Homo sapiens
tgacggcagtaaatccacagtga

SEQ ID NO: 5318399 - DNA, 20 bp, Homo sapiens
tgacggccctcatctatgag

SEQ ID NO: 5318400 - DNA, 12 bp, Homo sapiens
tgacggccctgc

SEQ ID NO: 5318401 - DNA, 16 bp, Homo sapiens
tgacggccttcttggt

SEQ ID NO: 5318402 - DNA, 14 bp, Homo sapiens
tgacggctggggac

SEQ ID NO: 5318403 - DNA, 20 bp, Homo sapiens
tgacggctggggacccaccc

SEQ ID NO: 5318404 - DNA, 21 bp, Homo sapiens
tgacggctgtgtatttctgta

SEQ ID NO: 5318405 - DNA, 14 bp, Homo sapiens
tgacgggaggcccc

SEQ ID NO: 5318406 - DNA, 20 bp, Homo sapiens
tgacgggaggccccagctct

SEQ ID NO: 5318407 - DNA, 23 bp, Homo sapiens
tgacgggaggccccagctctgag

SEQ ID NO: 5318408 - DNA, 17 bp, Homo sapiens
tgacgggaggcctcagt

SEQ ID NO: 5318409 - DNA, 13 bp, Homo sapiens
tgacgggccaggc

SEQ ID NO: 5318410 - DNA, 20 bp, Homo sapiens
tgacgggccaggccctggag

SEQ ID NO: 5318411 - DNA, 19 bp, Homo sapiens
tgacgggggttggggtggg

SEQ ID NO: 5318412 - DNA, 18 bp, Homo sapiens
tgacggtgcagtctgggt

SEQ ID NO: 5318413 - DNA, 19 bp, Homo sapiens
tgacggtttatgctgggca

SEQ ID NO: 5318414 - DNA, 20 bp, Homo sapiens
tgacgtaagctctatctgca

SEQ ID NO: 5318415 - DNA, 23 bp, Homo sapiens
tgacgtacaagtagttctgtatt

SEQ ID NO: 5318416 - DNA, 18 bp, Homo sapiens
tgacgtattgtgaaattt

SEQ ID NO: 5318417 - DNA, 21 bp, Homo sapiens
tgacgtcaacccaagctctgg

SEQ ID NO: 5318418 - DNA, 19 bp, Homo sapiens
tgacgtcaagtctccttcc

SEQ ID NO: 5318419 - DNA, 23 bp, Homo sapiens
tgacgtcagtagtttgagaccag

SEQ ID NO: 5318420 - DNA, 14 bp, Homo sapiens
tgacgtctgggtgg

SEQ ID NO: 5318421 - DNA, 21 bp, Homo sapiens
tgacgtgaccaattgccctgc

SEQ ID NO: 5318422 - DNA, 23 bp, Homo sapiens
tgacgtgaccaattgccctgcca

SEQ ID NO: 5318423 - DNA, 16 bp, Homo sapiens
tgacgtgaccatggtg

SEQ ID NO: 5318424 - DNA, 17 bp, Homo sapiens
tgacgtgaccggacttt

SEQ ID NO: 5318425 - DNA, 18 bp, Homo sapiens
tgacgtgactcagagctt

SEQ ID NO: 5318426 - DNA, 20 bp, Homo sapiens
tgacgtgcacaaaccttctt

SEQ ID NO: 5318427 - DNA, 18 bp, Homo sapiens
tgacgtgcacctgtactc

SEQ ID NO: 5318428 - DNA, 19 bp, Homo sapiens
tgacgtgcacctgtactca

SEQ ID NO: 5318429 - DNA, 14 bp, Homo sapiens
tgacgtgcactgtg

SEQ ID NO: 5318430 - DNA, 23 bp, Homo sapiens
tgacgtgccttttgcacccctcc

SEQ ID NO: 5318431 - DNA, 13 bp, Homo sapiens
tgacgtgggcatc

SEQ ID NO: 5318432 - DNA, 18 bp, Homo sapiens
tgacgtggtaaaatgtga

SEQ ID NO: 5318433 - DNA, 22 bp, Homo sapiens
tgacgtggtaaaatgtgaaaaa

SEQ ID NO: 5318434 - DNA, 19 bp, Homo sapiens
tgacgtgtgtggctgggac

SEQ ID NO: 5318435 - DNA, 20 bp, Homo sapiens
tgacgtgtgtggctgggacc

SEQ ID NO: 5318436 - DNA, 14 bp, Homo sapiens
tgacgtgtgtggtc

SEQ ID NO: 5318437 - DNA, 17 bp, Homo sapiens
tgacgttgttgtcattg

SEQ ID NO: 5318438 - DNA, 20 bp, Homo sapiens
tgacgttgttgtcattgtcc

SEQ ID NO: 5318439 - DNA, 18 bp, Homo sapiens
tgacgtttcttctttcta

SEQ ID NO: 5318440 - DNA, 17 bp, Homo sapiens
tgactaaaaatatcaca

SEQ ID NO: 5318441 - DNA, 21 bp, Homo sapiens
tgactaaaaatatcacactga

SEQ ID NO: 5318442 - DNA, 14 bp, Homo sapiens
tgactaaaaatatt

SEQ ID NO: 5318443 - DNA, 12 bp, Homo sapiens
tgactaaacttt

SEQ ID NO: 5318444 - DNA, 21 bp, Homo sapiens
tgactaaactttttttctgta

SEQ ID NO: 5318445 - DNA, 17 bp, Homo sapiens
tgactaaagagagaatg

SEQ ID NO: 5318446 - DNA, 14 bp, Homo sapiens
tgactaaagctatg

SEQ ID NO: 5318447 - DNA, 22 bp, Homo sapiens
tgactaaagtaccagattataa

SEQ ID NO: 5318448 - DNA, 18 bp, Homo sapiens
tgactaaattttctttta

SEQ ID NO: 5318449 - DNA, 23 bp, Homo sapiens
tgactaaattttcttttaagcat

SEQ ID NO: 5318450 - DNA, 16 bp, Homo sapiens
tgactaacaagatttg

SEQ ID NO: 5318451 - DNA, 19 bp, Homo sapiens
tgactaacaagatttgtaa

SEQ ID NO: 5318452 - DNA, 17 bp, Homo sapiens
tgactaacaggccaaag

SEQ ID NO: 5318453 - DNA, 22 bp, Homo sapiens
tgactaactcaaatacacattt

SEQ ID NO: 5318454 - DNA, 17 bp, Homo sapiens
tgactaagaattttgtt

SEQ ID NO: 5318455 - DNA, 17 bp, Homo sapiens
tgactaagccaagctgt

SEQ ID NO: 5318456 - DNA, 19 bp, Homo sapiens
tgactaagccaagctgtgt

SEQ ID NO: 5318457 - DNA, 22 bp, Homo sapiens
tgactaagccccgcatatgtga

SEQ ID NO: 5318458 - DNA, 17 bp, Homo sapiens
tgactaagccccgtctg

SEQ ID NO: 5318459 - DNA, 20 bp, Homo sapiens
tgactaagttgcaagatctt

SEQ ID NO: 5318460 - DNA, 23 bp, Homo sapiens
tgactaatccttaataactatgg

SEQ ID NO: 5318461 - DNA, 14 bp, Homo sapiens
tgactaatgctttt

SEQ ID NO: 5318462 - DNA, 16 bp, Homo sapiens
tgactaatggcatgag

SEQ ID NO: 5318463 - DNA, 21 bp, Homo sapiens
tgactaattagggtacattta

SEQ ID NO: 5318464 - DNA, 14 bp, Homo sapiens
tgactaattgtata

SEQ ID NO: 5318465 - DNA, 15 bp, Homo sapiens
tgactaattgtataa

SEQ ID NO: 5318466 - DNA, 19 bp, Homo sapiens
tgactaattgtataacagg

SEQ ID NO: 5318467 - DNA, 21 bp, Homo sapiens
tgactaattttacatgtttat

SEQ ID NO: 5318468 - DNA, 20 bp, Homo sapiens
tgactacagacattaaataa

SEQ ID NO: 5318469 - DNA, 13 bp, Homo sapiens
tgactacagggcc

SEQ ID NO: 5318470 - DNA, 14 bp, Homo sapiens
tgactacagggccg

SEQ ID NO: 5318471 - DNA, 18 bp, Homo sapiens
tgactacagtcaggaaag

SEQ ID NO: 5318472 - DNA, 20 bp, Homo sapiens
tgactacatttagcccctct

SEQ ID NO: 5318473 - DNA, 12 bp, Homo sapiens
tgactacatttt

SEQ ID NO: 5318474 - DNA, 13 bp, Homo sapiens
tgactacattttg

SEQ ID NO: 5318475 - DNA, 14 bp, Homo sapiens
tgactacatttttt

SEQ ID NO: 5318476 - DNA, 17 bp, Homo sapiens
tgactaccctagttcaa

SEQ ID NO: 5318477 - DNA, 17 bp, Homo sapiens
tgactaccgtgccagca

SEQ ID NO: 5318478 - DNA, 13 bp, Homo sapiens
tgactacctactg

SEQ ID NO: 5318479 - DNA, 24 bp, Homo sapiens
tgactacgtcttaagtcagatttt

SEQ ID NO: 5318480 - DNA, 15 bp, Homo sapiens
tgactactttgcctt

SEQ ID NO: 5318481 - DNA, 22 bp, Homo sapiens
tgactagaactcctgtcttctt

SEQ ID NO: 5318482 - DNA, 17 bp, Homo sapiens
tgactagaccccaccct

SEQ ID NO: 5318483 - DNA, 23 bp, Homo sapiens
tgactagagacgcaccttgctgc

SEQ ID NO: 5318484 - DNA, 15 bp, Homo sapiens
tgactagcaaacaaa

SEQ ID NO: 5318485 - DNA, 21 bp, Homo sapiens
tgactagcaaacaaaaataga

SEQ ID NO: 5318486 - DNA, 15 bp, Homo sapiens
tgactaggaaaagtt

SEQ ID NO: 5318487 - DNA, 17 bp, Homo sapiens
tgactagggagccatgt

SEQ ID NO: 5318488 - DNA, 18 bp, Homo sapiens
tgactagggagccatgtt

SEQ ID NO: 5318489 - DNA, 20 bp, Homo sapiens
tgactagggagccatgtttc

SEQ ID NO: 5318490 - DNA, 17 bp, Homo sapiens
tgactagggattcaggc

SEQ ID NO: 5318491 - DNA, 18 bp, Homo sapiens
tgactagggattcaggct

SEQ ID NO: 5318492 - DNA, 23 bp, Homo sapiens
tgactagggattcaggctgcttg

SEQ ID NO: 5318493 - DNA, 15 bp, Homo sapiens
tgactagtacaaatt

SEQ ID NO: 5318494 - DNA, 16 bp, Homo sapiens
tgactagtacaaatta

SEQ ID NO: 5318495 - DNA, 23 bp, Homo sapiens
tgactagtacaaattataaaaag

SEQ ID NO: 5318496 - DNA, 14 bp, Homo sapiens
tgactagtcacctg

SEQ ID NO: 5318497 - DNA, 13 bp, Homo sapiens
tgactagtgctga

SEQ ID NO: 5318498 - DNA, 17 bp, Homo sapiens
tgactataaagctgtta

SEQ ID NO: 5318499 - DNA, 15 bp, Homo sapiens
tgactataacaaaat

SEQ ID NO: 5318500 - DNA, 21 bp, Homo sapiens
tgactatcacacactttctct

SEQ ID NO: 5318501 - DNA, 22 bp, Homo sapiens
tgactatcacacactttctctt

SEQ ID NO: 5318502 - DNA, 15 bp, Homo sapiens
tgactatcacataca

SEQ ID NO: 5318503 - DNA, 14 bp, Homo sapiens
tgactatcataaaa

SEQ ID NO: 5318504 - DNA, 23 bp, Homo sapiens
tgactatcccaacagtcatgttt

SEQ ID NO: 5318505 - DNA, 20 bp, Homo sapiens
tgactatgaaacgaatataa

SEQ ID NO: 5318506 - DNA, 20 bp, Homo sapiens
tgactatggctctggcacca

SEQ ID NO: 5318507 - DNA, 17 bp, Homo sapiens
tgactattacactgcct

SEQ ID NO: 5318508 - DNA, 18 bp, Homo sapiens
tgactattctgtatcttt

SEQ ID NO: 5318509 - DNA, 19 bp, Homo sapiens
tgactattgtaatgccaat

SEQ ID NO: 5318510 - DNA, 16 bp, Homo sapiens
tgactattttttaata

SEQ ID NO: 5318511 - DNA, 17 bp, Homo sapiens
tgactattttttaataa

SEQ ID NO: 5318512 - DNA, 13 bp, Homo sapiens
tgactcaaactcc

SEQ ID NO: 5318513 - DNA, 14 bp, Homo sapiens
tgactcaaagtctg

SEQ ID NO: 5318514 - DNA, 23 bp, Homo sapiens
tgactcaacatgttactgaccag

SEQ ID NO: 5318515 - DNA, 14 bp, Homo sapiens
tgactcaagattcc

SEQ ID NO: 5318516 - DNA, 18 bp, Homo sapiens
tgactcaagattcccagg

SEQ ID NO: 5318517 - DNA, 22 bp, Homo sapiens
tgactcaagattcccaggagtt

SEQ ID NO: 5318518 - DNA, 22 bp, Homo sapiens
tgactcaagattttttctggtc

SEQ ID NO: 5318519 - DNA, 16 bp, Homo sapiens
tgactcaattatttgc

SEQ ID NO: 5318520 - DNA, 20 bp, Homo sapiens
tgactcaattatttgcatat

SEQ ID NO: 5318521 - DNA, 22 bp, Homo sapiens
tgactcacaggccctggagaag

SEQ ID NO: 5318522 - DNA, 20 bp, Homo sapiens
tgactcacattgccttgagc

SEQ ID NO: 5318523 - DNA, 12 bp, Homo sapiens
tgactcacccaa

SEQ ID NO: 5318524 - DNA, 19 bp, Homo sapiens
tgacttgtttgtcttccat

SEQ ID NO: 5318525 - DNA, 13 bp, Homo sapiens
tgactttaaaaga

SEQ ID NO: 5318526 - DNA, 15 bp, Homo sapiens
tgactttaattgtgt

SEQ ID NO: 5318527 - DNA, 16 bp, Homo sapiens
tgactttaatttatgt

SEQ ID NO: 5318528 - DNA, 14 bp, Homo sapiens
tgactttacaggag

SEQ ID NO: 5318529 - DNA, 22 bp, Homo sapiens
tgactttacgcccatctcagga

SEQ ID NO: 5318530 - DNA, 14 bp, Homo sapiens
tgactttacttgtg

SEQ ID NO: 5318531 - DNA, 20 bp, Homo sapiens
tgactttacttgtggtgtga

SEQ ID NO: 5318532 - DNA, 21 bp, Homo sapiens
tgactttagaaagctgacatt

SEQ ID NO: 5318533 - DNA, 12 bp, Homo sapiens
tgactttagaat

SEQ ID NO: 5318534 - DNA, 18 bp, Homo sapiens
tgactttagtctgcaaaa

SEQ ID NO: 5318535 - DNA, 19 bp, Homo sapiens
tgactttagtctgcaaaat

SEQ ID NO: 5318536 - DNA, 15 bp, Homo sapiens
tgactttagtgaaag

SEQ ID NO: 5318537 - DNA, 14 bp, Homo sapiens
tgactttataaatt

SEQ ID NO: 5318538 - DNA, 23 bp, Homo sapiens
tgactttatgttgtatgattcca

SEQ ID NO: 5318539 - DNA, 15 bp, Homo sapiens
tgactttattattta

SEQ ID NO: 5318540 - DNA, 14 bp, Homo sapiens
tgactttatttttc

SEQ ID NO: 5318541 - DNA, 15 bp, Homo sapiens
tgactttcaaaatat

SEQ ID NO: 5318542 - DNA, 17 bp, Homo sapiens
tgactttcaaaatatat

SEQ ID NO: 5318543 - DNA, 16 bp, Homo sapiens
tgactttcagattgta

SEQ ID NO: 5318544 - DNA, 13 bp, Homo sapiens
tgactttcaggta

SEQ ID NO: 5318545 - DNA, 13 bp, Homo sapiens
tgactttcatttg

SEQ ID NO: 5318546 - DNA, 16 bp, Homo sapiens
tgactttccagaatga

SEQ ID NO: 5318547 - DNA, 23 bp, Homo sapiens
tgactttccccaccagatgctga

SEQ ID NO: 5318548 - DNA, 16 bp, Homo sapiens
tgactttcctatgaca

SEQ ID NO: 5318549 - DNA, 12 bp, Homo sapiens
tgactttcctta

SEQ ID NO: 5318550 - DNA, 23 bp, Homo sapiens
tgactttctcttctacacgtcct

SEQ ID NO: 5318551 - DNA, 13 bp, Homo sapiens
tgactttcttttt

SEQ ID NO: 5318552 - DNA, 12 bp, Homo sapiens
tgactttgaact

SEQ ID NO: 5318553 - DNA, 13 bp, Homo sapiens
tgactttgaataa

SEQ ID NO: 5318554 - DNA, 13 bp, Homo sapiens
tgactttgaattt

SEQ ID NO: 5318555 - DNA, 15 bp, Homo sapiens
tgactttgaatttat

SEQ ID NO: 5318556 - DNA, 17 bp, Homo sapiens
tgactttgaatttatat

SEQ ID NO: 5318557 - DNA, 17 bp, Homo sapiens
tgactttgcacctgcaa

SEQ ID NO: 5318558 - DNA, 14 bp, Homo sapiens
tgactttgccccct

SEQ ID NO: 5318559 - DNA, 16 bp, Homo sapiens
tgactttgctctttct

SEQ ID NO: 5318560 - DNA, 15 bp, Homo sapiens
tgactttgcttgctt

SEQ ID NO: 5318561 - DNA, 12 bp, Homo sapiens
tgactttggata

SEQ ID NO: 5318562 - DNA, 15 bp, Homo sapiens
tgactttggataata

SEQ ID NO: 5318563 - DNA, 20 bp, Homo sapiens
tgactttggataataaggaa

SEQ ID NO: 5318564 - DNA, 13 bp, Homo sapiens
tgactttggctga

SEQ ID NO: 5318565 - DNA, 20 bp, Homo sapiens
tgactttggggacaccctcc

SEQ ID NO: 5318566 - DNA, 18 bp, Homo sapiens
tgactttggtttttccaa

SEQ ID NO: 5318567 - DNA, 11 bp, Homo sapiens
tgactttgtct

SEQ ID NO: 5318568 - DNA, 20 bp, Homo sapiens
tgactttgtctctcctggct

SEQ ID NO: 5318569 - DNA, 15 bp, Homo sapiens
tgacttttaaaaata

SEQ ID NO: 5318570 - DNA, 16 bp, Homo sapiens
tgacttttataaagca

SEQ ID NO: 5318571 - DNA, 23 bp, Homo sapiens
tgacttttcaagtatttaagcct

SEQ ID NO: 5318572 - DNA, 15 bp, Homo sapiens
tgacttttctgatta

SEQ ID NO: 5318573 - DNA, 19 bp, Homo sapiens
tgacttttctggaagacat

SEQ ID NO: 5318574 - DNA, 13 bp, Homo sapiens
tgacttttctgta

SEQ ID NO: 5318575 - DNA, 14 bp, Homo sapiens
tgacttttgaagaa

SEQ ID NO: 5318576 - DNA, 18 bp, Homo sapiens
tgacttttgaattacaga

SEQ ID NO: 5318577 - DNA, 14 bp, Homo sapiens
tgacttttgtgaaa

SEQ ID NO: 5318578 - DNA, 12 bp, Homo sapiens
tgactttttaaa

SEQ ID NO: 5318579 - DNA, 17 bp, Homo sapiens
tgactttttaaaatata

SEQ ID NO: 5318580 - DNA, 23 bp, Homo sapiens
tgactttttaaaattctgagtga

SEQ ID NO: 5318581 - DNA, 19 bp, Homo sapiens
tgactttttataaaatggc

SEQ ID NO: 5318582 - DNA, 14 bp, Homo sapiens
tgactttttgaatg

SEQ ID NO: 5318583 - DNA, 17 bp, Homo sapiens
tgactttttgcatttaa

SEQ ID NO: 5318584 - DNA, 23 bp, Homo sapiens
tgactttttgcatttaaaacaga

SEQ ID NO: 5318585 - DNA, 19 bp, Homo sapiens
tgactttttggaattcagc

SEQ ID NO: 5318586 - DNA, 20 bp, Homo sapiens
tgactttttggaattcagca

SEQ ID NO: 5318587 - DNA, 22 bp, Homo sapiens
tgactttttggaattcagcagt

SEQ ID NO: 5318588 - DNA, 15 bp, Homo sapiens
tgactttttgtttct

SEQ ID NO: 5318589 - DNA, 16 bp, Homo sapiens
tgactttttgtttctt

SEQ ID NO: 5318590 - DNA, 16 bp, Homo sapiens
tgactttttttctgat

SEQ ID NO: 5318591 - DNA, 17 bp, Homo sapiens
tgactttttttggtata

SEQ ID NO: 5318592 - DNA, 22 bp, Homo sapiens
tgactttttttggtataatgtt

SEQ ID NO: 5318593 - DNA, 15 bp, Homo sapiens
tgactttttttgtat

SEQ ID NO: 5318594 - DNA, 19 bp, Homo sapiens
tgactttttttgtatgtgt

SEQ ID NO: 5318595 - DNA, 17 bp, Homo sapiens
tgagaaaaagctcctgt

SEQ ID NO: 5318596 - DNA, 18 bp, Homo sapiens
tgagaaaaaggaaaaaaa

SEQ ID NO: 5318597 - DNA, 15 bp, Homo sapiens
tgagaaaaataaatg

SEQ ID NO: 5318598 - DNA, 18 bp, Homo sapiens
tgagaaaaatatatacta

SEQ ID NO: 5318599 - DNA, 14 bp, Homo sapiens
tgagaaaaatgtaa

SEQ ID NO: 5318600 - DNA, 21 bp, Homo sapiens
tgagaaaacgttttgtttgaa

SEQ ID NO: 5318601 - DNA, 13 bp, Homo sapiens
tgagaaaactcaa

SEQ ID NO: 5318602 - DNA, 22 bp, Homo sapiens
tgagaaaactgtgaccaagtat

SEQ ID NO: 5318603 - DNA, 20 bp, Homo sapiens
tgagaaaagttcaatactct

SEQ ID NO: 5318604 - DNA, 16 bp, Homo sapiens
tgagaaaatgcctcaa

SEQ ID NO: 5318605 - DNA, 19 bp, Homo sapiens
tgagaaaatggctttaatc

SEQ ID NO: 5318606 - DNA, 21 bp, Homo sapiens
tgagaaaattgaaataaagct

SEQ ID NO: 5318607 - DNA, 20 bp, Homo sapiens
tgagaaacaacaatttctac

SEQ ID NO: 5318608 - DNA, 14 bp, Homo sapiens
tgagaaacatagta

SEQ ID NO: 5318609 - DNA, 15 bp, Homo sapiens
tgagaaacccaccag

SEQ ID NO: 5318610 - DNA, 20 bp, Homo sapiens
tgagaaacctgtatctttct

SEQ ID NO: 5318611 - DNA, 22 bp, Homo sapiens
tgagaaacctgtatctttctat

SEQ ID NO: 5318612 - DNA, 11 bp, Homo sapiens
tgagaaactgc

SEQ ID NO: 5318613 - DNA, 16 bp, Homo sapiens
tgagaaactgctgcag

SEQ ID NO: 5318614 - DNA, 23 bp, Homo sapiens
tgagaaactgtttgaaaacttca

SEQ ID NO: 5318615 - DNA, 21 bp, Homo sapiens
tgagaaactttgatctctgct

SEQ ID NO: 5318616 - DNA, 10 bp, Homo sapiens
tgagaaagaa

SEQ ID NO: 5318617 - DNA, 23 bp, Homo sapiens
tgagaaagaaaaggaatgcaaga

SEQ ID NO: 5318618 - DNA, 17 bp, Homo sapiens
tgagaaagaaagtaaaa

SEQ ID NO: 5318619 - DNA, 19 bp, Homo sapiens
tgagaaagaataggggctg

SEQ ID NO: 5318620 - DNA, 16 bp, Homo sapiens
tgagaaagactattca

SEQ ID NO: 5318621 - DNA, 14 bp, Homo sapiens
tgagaaagccttct

SEQ ID NO: 5318622 - DNA, 18 bp, Homo sapiens
tgagaaagctaaagtttg

SEQ ID NO: 5318623 - DNA, 14 bp, Homo sapiens
tgagaaaggacaga

SEQ ID NO: 5318624 - DNA, 15 bp, Homo sapiens
tgagaaaggacagag

SEQ ID NO: 5318625 - DNA, 14 bp, Homo sapiens
tgagaaagggagag

SEQ ID NO: 5318626 - DNA, 22 bp, Homo sapiens
tgagaaagggagaggaagagaa

SEQ ID NO: 5318627 - DNA, 22 bp, Homo sapiens
tgagaaagggattgctgaggca

SEQ ID NO: 5318628 - DNA, 11 bp, Homo sapiens
tgagaaaggtg

SEQ ID NO: 5318629 - DNA, 20 bp, Homo sapiens
tgagaaagtacagcagtaga

SEQ ID NO: 5318630 - DNA, 16 bp, Homo sapiens
tgagaaataggtatca

SEQ ID NO: 5318631 - DNA, 19 bp, Homo sapiens
tgagaaatcacaatgagaa

SEQ ID NO: 5318632 - DNA, 17 bp, Homo sapiens
tgagaaatctaaaaaac

SEQ ID NO: 5318633 - DNA, 12 bp, Homo sapiens
tgagaaatgcat

SEQ ID NO: 5318634 - DNA, 12 bp, Homo sapiens
tgagaaatgtga

SEQ ID NO: 5318635 - DNA, 15 bp, Homo sapiens
tgagaaattgaatgt

SEQ ID NO: 5318636 - DNA, 17 bp, Homo sapiens
tgagaaattgtgccaaa

SEQ ID NO: 5318637 - DNA, 14 bp, Homo sapiens
tgagaaatttaaac

SEQ ID NO: 5318638 - DNA, 18 bp, Homo sapiens
tgagaaatttaaactata

SEQ ID NO: 5318639 - DNA, 15 bp, Homo sapiens
tgagaaatttacaaa

SEQ ID NO: 5318640 - DNA, 15 bp, Homo sapiens
tgagaaatttgaaag

SEQ ID NO: 5318641 - DNA, 15 bp, Homo sapiens
tgagaacaaagctgt

SEQ ID NO: 5318642 - DNA, 22 bp, Homo sapiens
tgagaacaaagctgttaaactg

SEQ ID NO: 5318643 - DNA, 19 bp, Homo sapiens
tgagaacaagtcacagctg

SEQ ID NO: 5318644 - DNA, 21 bp, Homo sapiens
tgagaacaagtcacagctgca

SEQ ID NO: 5318645 - DNA, 23 bp, Homo sapiens
tgagaacaagtcacagctgcagc

SEQ ID NO: 5318646 - DNA, 14 bp, Homo sapiens
tgagaacactgtga

SEQ ID NO: 5318647 - DNA, 16 bp, Homo sapiens
tgagaacactgtgaaa

SEQ ID NO: 5318648 - DNA, 18 bp, Homo sapiens
tgagaacagataaagatt

SEQ ID NO: 5318649 - DNA, 24 bp, Homo sapiens
tgagaacatggtgtgtgtctctga

SEQ ID NO: 5318650 - DNA, 21 bp, Homo sapiens
tgagaacattaaaaaagaact

SEQ ID NO: 5318651 - DNA, 12 bp, Homo sapiens
tgagaaccaaaa

SEQ ID NO: 5318652 - DNA, 17 bp, Homo sapiens
tgagaaccaaaagatgc

SEQ ID NO: 5318653 - DNA, 21 bp, Homo sapiens
tgagaacccttcctttcccaa

SEQ ID NO: 5318654 - DNA, 16 bp, Homo sapiens
tgagaacctggccttc

SEQ ID NO: 5318655 - DNA, 23 bp, Homo sapiens
tgagaacctgggttgcagacagg

SEQ ID NO: 5318656 - DNA, 20 bp, Homo sapiens
tgagaaccttggaccactcc

SEQ ID NO: 5318657 - DNA, 22 bp, Homo sapiens
tgagaaccttggaccactcctg

SEQ ID NO: 5318658 - DNA, 16 bp, Homo sapiens
tgagaaccttttcaaa

SEQ ID NO: 5318659 - DNA, 13 bp, Homo sapiens
tgagaactaaata

SEQ ID NO: 5318660 - DNA, 13 bp, Homo sapiens
tgagaactcagaa

SEQ ID NO: 5318661 - DNA, 23 bp, Homo sapiens
tgagaactccatcagaaaaccaa

SEQ ID NO: 5318662 - DNA, 20 bp, Homo sapiens
tgagaactctctccctggtc

SEQ ID NO: 5318663 - DNA, 15 bp, Homo sapiens
tgagaactgaatttt

SEQ ID NO: 5318664 - DNA, 14 bp, Homo sapiens
tgagaactgacaaa

SEQ ID NO: 5318665 - DNA, 16 bp, Homo sapiens
tgagaactgaggagcg

SEQ ID NO: 5318666 - DNA, 17 bp, Homo sapiens
tgagaactgcttctaag

SEQ ID NO: 5318667 - DNA, 15 bp, Homo sapiens
tgagaactgtgaata

SEQ ID NO: 5318668 - DNA, 19 bp, Homo sapiens
tgagaactgttctcatgga

SEQ ID NO: 5318669 - DNA, 18 bp, Homo sapiens
tgagaacttaagtggcta

SEQ ID NO: 5318670 - DNA, 13 bp, Homo sapiens
tgagaacttcaat

SEQ ID NO: 5318671 - DNA, 21 bp, Homo sapiens
tgagaacttttttgaggcctt

SEQ ID NO: 5318672 - DNA, 17 bp, Homo sapiens
tgagaagaaaacatcta

SEQ ID NO: 5318673 - DNA, 16 bp, Homo sapiens
tgagaagaaagaaact

SEQ ID NO: 5318674 - DNA, 17 bp, Homo sapiens
tgagaagaagctgagga

SEQ ID NO: 5318675 - DNA, 18 bp, Homo sapiens
tgagaagaagtggctgcc

SEQ ID NO: 5318676 - DNA, 12 bp, Homo sapiens
tgagaagaatag

SEQ ID NO: 5318677 - DNA, 17 bp, Homo sapiens
tgagaagagcttgcaca

SEQ ID NO: 5318678 - DNA, 20 bp, Homo sapiens
tgagaagataatcattgctt

SEQ ID NO: 5318679 - DNA, 23 bp, Homo sapiens
tgagaagatggcactgtccaggg

SEQ ID NO: 5318680 - DNA, 21 bp, Homo sapiens
tgagaagatgggggctggagg

SEQ ID NO: 5318681 - DNA, 20 bp, Homo sapiens
tgagaagcagaggaaggaga

SEQ ID NO: 5318682 - DNA, 19 bp, Homo sapiens
tgagaagccaaagccccta

SEQ ID NO: 5318683 - DNA, 17 bp, Homo sapiens
tgagaagccaagcgctc

SEQ ID NO: 5318684 - DNA, 22 bp, Homo sapiens
tgagaagccatgtactcaagta

SEQ ID NO: 5318685 - DNA, 19 bp, Homo sapiens
tgagaagcctcatgggagt

SEQ ID NO: 5318686 - DNA, 13 bp, Homo sapiens
tgagaagccttca

SEQ ID NO: 5318687 - DNA, 19 bp, Homo sapiens
tgagaagccttcagctcca

SEQ ID NO: 5318688 - DNA, 20 bp, Homo sapiens
tgagaagccttcagctccag

SEQ ID NO: 5318689 - DNA, 12 bp, Homo sapiens
tgagaagctctg

SEQ ID NO: 5318690 - DNA, 17 bp, Homo sapiens
tgagaagctgaggccta

SEQ ID NO: 5318691 - DNA, 23 bp, Homo sapiens
tgagaaggaactgatacatctga

SEQ ID NO: 5318692 - DNA, 15 bp, Homo sapiens
tgagaaggagagaaa

SEQ ID NO: 5318693 - DNA, 17 bp, Homo sapiens
tgagaaggcagccacca

SEQ ID NO: 5318694 - DNA, 20 bp, Homo sapiens
tgagaaggcagtagttttca

SEQ ID NO: 5318695 - DNA, 21 bp, Homo sapiens
tgagaaggcagtagttttcaa

SEQ ID NO: 5318696 - DNA, 22 bp, Homo sapiens
tgagaaggccagccctccctgg

SEQ ID NO: 5318697 - DNA, 16 bp, Homo sapiens
tgagaaggccccaggg

SEQ ID NO: 5318698 - DNA, 21 bp, Homo sapiens
tgagaagggaaggccgggtgc

SEQ ID NO: 5318699 - DNA, 16 bp, Homo sapiens
tgagaagggtgttgta

SEQ ID NO: 5318700 - DNA, 15 bp, Homo sapiens
tgagaaggttactga

SEQ ID NO: 5318701 - DNA, 18 bp, Homo sapiens
tgagaaggtttattgtta

SEQ ID NO: 5318702 - DNA, 20 bp, Homo sapiens
tgagaaggtttattgttaat

SEQ ID NO: 5318703 - DNA, 22 bp, Homo sapiens
tgagataaagtcaaatgccaaa

SEQ ID NO: 5318704 - DNA, 14 bp, Homo sapiens
tgagataaatatca

SEQ ID NO: 5318705 - DNA, 16 bp, Homo sapiens
tgagataaatatcatt

SEQ ID NO: 5318706 - DNA, 18 bp, Homo sapiens
tgagataacaatcaggta

SEQ ID NO: 5318707 - DNA, 23 bp, Homo sapiens
tgagataaccacaaccaggaaga

SEQ ID NO: 5318708 - DNA, 15 bp, Homo sapiens
tgagataagaaaagc

SEQ ID NO: 5318709 - DNA, 14 bp, Homo sapiens
tgagataaggtttt

SEQ ID NO: 5318710 - DNA, 18 bp, Homo sapiens
tgagataatatctgtgag

SEQ ID NO: 5318711 - DNA, 19 bp, Homo sapiens
tgagataatatctgtgagg

SEQ ID NO: 5318712 - DNA, 22 bp, Homo sapiens
tgagataatctaaatataaacc

SEQ ID NO: 5318713 - DNA, 20 bp, Homo sapiens
tgagatacaaggcccagaag

SEQ ID NO: 5318714 - DNA, 13 bp, Homo sapiens
tgagatacatttg

SEQ ID NO: 5318715 - DNA, 21 bp, Homo sapiens
tgagatacatttgatcttgta

SEQ ID NO: 5318716 - DNA, 20 bp, Homo sapiens
tgagataccagcgaggaggc

SEQ ID NO: 5318717 - DNA, 18 bp, Homo sapiens
tgagatacccagagagaa

SEQ ID NO: 5318718 - DNA, 20 bp, Homo sapiens
tgagatacccagagagaaaa

SEQ ID NO: 5318719 - DNA, 14 bp, Homo sapiens
tgagatactgaaat

SEQ ID NO: 5318720 - DNA, 12 bp, Homo sapiens
tgagatactgtg

SEQ ID NO: 5318721 - DNA, 13 bp, Homo sapiens
tgagatactgtgt

SEQ ID NO: 5318722 - DNA, 15 bp, Homo sapiens
tgagatactttgcat

SEQ ID NO: 5318723 - DNA, 18 bp, Homo sapiens
tgagatactttgcattgt

SEQ ID NO: 5318724 - DNA, 14 bp, Homo sapiens
tgagatagaagatg

SEQ ID NO: 5318725 - DNA, 16 bp, Homo sapiens
tgagatagaagatgtt

SEQ ID NO: 5318726 - DNA, 18 bp, Homo sapiens
tgagatagaagatgtttg

SEQ ID NO: 5318727 - DNA, 23 bp, Homo sapiens
tgagatagcattgtgaactgaca

SEQ ID NO: 5318728 - DNA, 22 bp, Homo sapiens
tgagatagctggtgttagggct

SEQ ID NO: 5318729 - DNA, 19 bp, Homo sapiens
tgagatagtagcatacatt

SEQ ID NO: 5318730 - DNA, 23 bp, Homo sapiens
tgagatagtagcatacatttata

SEQ ID NO: 5318731 - DNA, 18 bp, Homo sapiens
tgagatagttttcatttt

SEQ ID NO: 5318732 - DNA, 20 bp, Homo sapiens
tgagatataggataaaataa

SEQ ID NO: 5318733 - DNA, 20 bp, Homo sapiens
tgagatatatctttatactt

SEQ ID NO: 5318734 - DNA, 22 bp, Homo sapiens
tgagatatatctttatacttaa

SEQ ID NO: 5318735 - DNA, 12 bp, Homo sapiens
tgagatatgtgt

SEQ ID NO: 5318736 - DNA, 20 bp, Homo sapiens
tgagatattattttaaattt

SEQ ID NO: 5318737 - DNA, 18 bp, Homo sapiens
tgagatatttttacctgc

SEQ ID NO: 5318738 - DNA, 20 bp, Homo sapiens
tgagatcacagcctccaggg

SEQ ID NO: 5318739 - DNA, 22 bp, Homo sapiens
tgagatcacagcctccagggcc

SEQ ID NO: 5318740 - DNA, 18 bp, Homo sapiens
tgagatcagcattcaaaa

SEQ ID NO: 5318741 - DNA, 15 bp, Homo sapiens
tgagatcagcctggg

SEQ ID NO: 5318742 - DNA, 15 bp, Homo sapiens
tgagatcagggcctg

SEQ ID NO: 5318743 - DNA, 22 bp, Homo sapiens
tgagatccaagttgaaatcaga

SEQ ID NO: 5318744 - DNA, 17 bp, Homo sapiens
tgagatccagagaggct

SEQ ID NO: 5318745 - DNA, 23 bp, Homo sapiens
tgagatccagcacaactcagtct

SEQ ID NO: 5318746 - DNA, 13 bp, Homo sapiens
tgagatcctcttt

SEQ ID NO: 5318747 - DNA, 17 bp, Homo sapiens
tgagatcctctttactc

SEQ ID NO: 5318748 - DNA, 21 bp, Homo sapiens
tgagatcctctttactctggg

SEQ ID NO: 5318749 - DNA, 15 bp, Homo sapiens
tgagatcctgtgatt

SEQ ID NO: 5318750 - DNA, 17 bp, Homo sapiens
tgagatcctgtgattcc

SEQ ID NO: 5318751 - DNA, 20 bp, Homo sapiens
tgagatcgtgccactgcact

SEQ ID NO: 5318752 - DNA, 15 bp, Homo sapiens
tgagatctaaaaata

SEQ ID NO: 5318753 - DNA, 23 bp, Homo sapiens
tgagatctaagcctttccataag

SEQ ID NO: 5318754 - DNA, 23 bp, Homo sapiens
tgagatctaatgtgaaaatcatc

SEQ ID NO: 5318755 - DNA, 13 bp, Homo sapiens
tgagatctgggga

SEQ ID NO: 5318756 - DNA, 16 bp, Homo sapiens
tgagatctggggaggc

SEQ ID NO: 5318757 - DNA, 19 bp, Homo sapiens
tgagatctgtataaataag

SEQ ID NO: 5318758 - DNA, 21 bp, Homo sapiens
tgagatcttcctgctgagtcc

SEQ ID NO: 5318759 - DNA, 13 bp, Homo sapiens
tgagatgaagatt

SEQ ID NO: 5318760 - DNA, 21 bp, Homo sapiens
tgagatgaccaccaatcattt

SEQ ID NO: 5318761 - DNA, 15 bp, Homo sapiens
tgagatgagccccac

SEQ ID NO: 5318762 - DNA, 22 bp, Homo sapiens
tgagatgagccccacgtggagc

SEQ ID NO: 5318763 - DNA, 23 bp, Homo sapiens
tgagatgagggatgggcctggca

SEQ ID NO: 5318764 - DNA, 20 bp, Homo sapiens
tgagatgatacatccaaagc

SEQ ID NO: 5318765 - DNA, 14 bp, Homo sapiens
tgagatgatgaaaa

SEQ ID NO: 5318766 - DNA, 16 bp, Homo sapiens
tgagatgattaaaatg

SEQ ID NO: 5318767 - DNA, 19 bp, Homo sapiens
tgagatgattcagaagggg

SEQ ID NO: 5318768 - DNA, 17 bp, Homo sapiens
tgagatgatttgtactt

SEQ ID NO: 5318769 - DNA, 15 bp, Homo sapiens
tgagatgcagctgga

SEQ ID NO: 5318770 - DNA, 20 bp, Homo sapiens
tgagatgcccccccaggcca

SEQ ID NO: 5318771 - DNA, 21 bp, Homo sapiens
tgagatgcctgttgaaggtac

SEQ ID NO: 5318772 - DNA, 13 bp, Homo sapiens
tgagatgctggag

SEQ ID NO: 5318773 - DNA, 15 bp, Homo sapiens
tgagatgctggagaa

SEQ ID NO: 5318774 - DNA, 17 bp, Homo sapiens
tgagatgctggagaaga

SEQ ID NO: 5318775 - DNA, 18 bp, Homo sapiens
tgagatgctggagaagag

SEQ ID NO: 5318776 - DNA, 23 bp, Homo sapiens
tgagatgctggagaagagaggag

SEQ ID NO: 5318777 - DNA, 15 bp, Homo sapiens
tgagatgctgggagg

SEQ ID NO: 5318778 - DNA, 16 bp, Homo sapiens
tgagatggacacactg

SEQ ID NO: 5318779 - DNA, 21 bp, Homo sapiens
tgagatggagtctcactcttg

SEQ ID NO: 5318780 - DNA, 22 bp, Homo sapiens
tgagatggagtctcactcttgt

SEQ ID NO: 5318781 - DNA, 19 bp, Homo sapiens
tgagatggatgtatttgta

SEQ ID NO: 5318782 - DNA, 23 bp, Homo sapiens
tgagatggccagtttgaagcctg

SEQ ID NO: 5318783 - DNA, 15 bp, Homo sapiens
tgagatggccatgct

SEQ ID NO: 5318784 - DNA, 17 bp, Homo sapiens
tgagatggccctctggt

SEQ ID NO: 5318785 - DNA, 23 bp, Homo sapiens
tgagatgggccggcccccttcct

SEQ ID NO: 5318786 - DNA, 22 bp, Homo sapiens
tgagatgggcttcccaagggct

SEQ ID NO: 5318787 - DNA, 22 bp, Homo sapiens
tgagatggtatgcacaattcca

SEQ ID NO: 5318788 - DNA, 15 bp, Homo sapiens
tgagatggttaaaaa

SEQ ID NO: 5318789 - DNA, 23 bp, Homo sapiens
tgagatggttcccaatatcatgt

SEQ ID NO: 5318790 - DNA, 22 bp, Homo sapiens
tgagatgtagcaaattccaata

SEQ ID NO: 5318791 - DNA, 19 bp, Homo sapiens
tgagatgtaggctccacct

SEQ ID NO: 5318792 - DNA, 18 bp, Homo sapiens
tgagatgtgaacacatca

SEQ ID NO: 5318793 - DNA, 19 bp, Homo sapiens
tgagatgtgaacacatcag

SEQ ID NO: 5318794 - DNA, 17 bp, Homo sapiens
tgagatgtgctttgctg

SEQ ID NO: 5318795 - DNA, 15 bp, Homo sapiens
tgagatgtgtatcag

SEQ ID NO: 5318796 - DNA, 17 bp, Homo sapiens
tgagatgtgttcctcct

SEQ ID NO: 5318797 - DNA, 19 bp, Homo sapiens
tgagatgtgttcctcctgc

SEQ ID NO: 5318798 - DNA, 22 bp, Homo sapiens
tgagatgtgttcctcctgctgt

SEQ ID NO: 5318799 - DNA, 20 bp, Homo sapiens
tgagatgttattactgtttt

SEQ ID NO: 5318800 - DNA, 21 bp, Homo sapiens
tgagatgtttagtagctgata

SEQ ID NO: 5318801 - DNA, 14 bp, Homo sapiens
tgagatgtttggca

SEQ ID NO: 5318802 - DNA, 12 bp, Homo sapiens
tgagattacagg

SEQ ID NO: 5318803 - DNA, 16 bp, Homo sapiens
tgagattacaggcatg

SEQ ID NO: 5318804 - DNA, 18 bp, Homo sapiens
tgagattactttgtcccg

SEQ ID NO: 5318805 - DNA, 17 bp, Homo sapiens
tgagattagagggaggt

SEQ ID NO: 5318806 - DNA, 19 bp, Homo sapiens
tgagattcaaacccaggct

SEQ ID NO: 5318807 - DNA, 19 bp, Homo sapiens
tgagattcaagacaagagc

SEQ ID NO: 5318808 - DNA, 22 bp, Homo sapiens
tgagattcaagacaagagctgt

SEQ ID NO: 5318809 - DNA, 21 bp, Homo sapiens
tgagattcacatgctggctcc

SEQ ID NO: 5318810 - DNA, 13 bp, Homo sapiens
tgagattccctct

SEQ ID NO: 5318811 - DNA, 16 bp, Homo sapiens
tgagattctgaagtat

SEQ ID NO: 5318812 - DNA, 15 bp, Homo sapiens
tgagattctgggaaa

SEQ ID NO: 5318813 - DNA, 19 bp, Homo sapiens
tgagattctgggaaaggtg

SEQ ID NO: 5318814 - DNA, 22 bp, Homo sapiens
tgagattctgggaaaggtgctc

SEQ ID NO: 5318815 - DNA, 23 bp, Homo sapiens
tgagattctgggaaaggtgctca

SEQ ID NO: 5318816 - DNA, 17 bp, Homo sapiens
tgagattctttaaggag

SEQ ID NO: 5318817 - DNA, 18 bp, Homo sapiens
tgagattctttaaggaga

SEQ ID NO: 5318818 - DNA, 19 bp, Homo sapiens
tgagattctttaaggagat

SEQ ID NO: 5318819 - DNA, 19 bp, Homo sapiens
tgagattgacctgaggaga

SEQ ID NO: 5318820 - DNA, 18 bp, Homo sapiens
tgagattgcaccactgca

SEQ ID NO: 5318821 - DNA, 22 bp, Homo sapiens
tgagattgtacattttttactt

SEQ ID NO: 5318822 - DNA, 22 bp, Homo sapiens
tgagattgtcctcatttctcca

SEQ ID NO: 5318823 - DNA, 22 bp, Homo sapiens
tgagatttaaatgcaaccagaa

SEQ ID NO: 5318824 - DNA, 18 bp, Homo sapiens
tgagatttaacccctcca

SEQ ID NO: 5318825 - DNA, 20 bp, Homo sapiens
tgagatttaacccctccact

SEQ ID NO: 5318826 - DNA, 21 bp, Homo sapiens
tgagatttaagttcctgctgc

SEQ ID NO: 5318827 - DNA, 23 bp, Homo sapiens
tgagatttaagttcctgctgcct

SEQ ID NO: 5318828 - DNA, 23 bp, Homo sapiens
tgagatttaccagggatgtagat

SEQ ID NO: 5318829 - DNA, 18 bp, Homo sapiens
tgagatttattaaagaaa

SEQ ID NO: 5318830 - DNA, 13 bp, Homo sapiens
tgagatttcttaa

SEQ ID NO: 5318831 - DNA, 17 bp, Homo sapiens
tgagatttcttaaataa

SEQ ID NO: 5318832 - DNA, 16 bp, Homo sapiens
tgagatttctttgaat

SEQ ID NO: 5318833 - DNA, 14 bp, Homo sapiens
tgagatttctttta

SEQ ID NO: 5318834 - DNA, 15 bp, Homo sapiens
tgagatttcttttaa

SEQ ID NO: 5318835 - DNA, 21 bp, Homo sapiens
tgagatttcttttaaagaagt

SEQ ID NO: 5318836 - DNA, 17 bp, Homo sapiens
tgagatttgtaaatctt

SEQ ID NO: 5318837 - DNA, 12 bp, Homo sapiens
tgagattttcct

SEQ ID NO: 5318838 - DNA, 21 bp, Homo sapiens
tgagattttcctccattttta

SEQ ID NO: 5318839 - DNA, 22 bp, Homo sapiens
tgagattttggaagaagttttt

SEQ ID NO: 5318840 - DNA, 14 bp, Homo sapiens
tgagattttggtat

SEQ ID NO: 5318841 - DNA, 16 bp, Homo sapiens
tgagatttttcatgta

SEQ ID NO: 5318842 - DNA, 19 bp, Homo sapiens
tgagattttttattgctag

SEQ ID NO: 5318843 - DNA, 23 bp, Homo sapiens
tgagattttttattgctagtatt

SEQ ID NO: 5318844 - DNA, 19 bp, Homo sapiens
tgagatttttttgtgtatg

SEQ ID NO: 5318845 - DNA, 19 bp, Homo sapiens
tgagattttttttccgtgt

SEQ ID NO: 5318846 - DNA, 19 bp, Homo sapiens
tgagcaaaatatgcccctt

SEQ ID NO: 5318847 - DNA, 20 bp, Homo sapiens
tgagcaaaatatgccccttc

SEQ ID NO: 5318848 - DNA, 17 bp, Homo sapiens
tgagcaaacctgcccca

SEQ ID NO: 5318849 - DNA, 16 bp, Homo sapiens
tgagcaaatcaccaca

SEQ ID NO: 5318850 - DNA, 18 bp, Homo sapiens
tgagcaaatgtggctcct

SEQ ID NO: 5318851 - DNA, 21 bp, Homo sapiens
tgagcaacgctattccagctg

SEQ ID NO: 5318852 - DNA, 22 bp, Homo sapiens
tgagcaactaactaaccacatt

SEQ ID NO: 5318853 - DNA, 17 bp, Homo sapiens
tgagcaagcaagggact

SEQ ID NO: 5318854 - DNA, 13 bp, Homo sapiens
tgagcaaggacat

SEQ ID NO: 5318855 - DNA, 15 bp, Homo sapiens
tgagcaaggacattg

SEQ ID NO: 5318856 - DNA, 16 bp, Homo sapiens
tgagcaagggggccca

SEQ ID NO: 5318857 - DNA, 21 bp, Homo sapiens
tgagcaagtaacattaactca

SEQ ID NO: 5318858 - DNA, 17 bp, Homo sapiens
tgagcaagtatgctgtg

SEQ ID NO: 5318859 - DNA, 15 bp, Homo sapiens
tgagcaagtcccatc

SEQ ID NO: 5318860 - DNA, 15 bp, Homo sapiens
tgagcaataacttct

SEQ ID NO: 5318861 - DNA, 17 bp, Homo sapiens
tgagcaataacttctat

SEQ ID NO: 5318862 - DNA, 18 bp, Homo sapiens
tgagcaatgtataacccc

SEQ ID NO: 5318863 - DNA, 16 bp, Homo sapiens
tgagcaatgtctgtgc

SEQ ID NO: 5318864 - DNA, 17 bp, Homo sapiens
tgagcaatgtctgtgct

SEQ ID NO: 5318865 - DNA, 18 bp, Homo sapiens
tgagcaatgtctgtgcta

SEQ ID NO: 5318866 - DNA, 13 bp, Homo sapiens
tgagcaatgtttt

SEQ ID NO: 5318867 - DNA, 19 bp, Homo sapiens
tgagcaatgtttttctcaa

SEQ ID NO: 5318868 - DNA, 14 bp, Homo sapiens
tgagcaattcattt

SEQ ID NO: 5318869 - DNA, 20 bp, Homo sapiens
tgagcaattcatttcacttt

SEQ ID NO: 5318870 - DNA, 13 bp, Homo sapiens
tgagcacaaagaa

SEQ ID NO: 5318871 - DNA, 17 bp, Homo sapiens
tgagcacaaagaagaaa

SEQ ID NO: 5318872 - DNA, 19 bp, Homo sapiens
tgagcacaaagaagaaagc

SEQ ID NO: 5318873 - DNA, 21 bp, Homo sapiens
tgagcacaactttaagaggac

SEQ ID NO: 5318874 - DNA, 13 bp, Homo sapiens
tgagcacaatctg

SEQ ID NO: 5318875 - DNA, 19 bp, Homo sapiens
tgagcacaatctgttctac

SEQ ID NO: 5318876 - DNA, 21 bp, Homo sapiens
tgagcacagacggaggaagcc

SEQ ID NO: 5318877 - DNA, 18 bp, Homo sapiens
tgagcacaggcaacatta

SEQ ID NO: 5318878 - DNA, 19 bp, Homo sapiens
tgagcctgtgaccttggga

SEQ ID NO: 5318879 - DNA, 18 bp, Homo sapiens
tgagcctgtgtcctgaag

SEQ ID NO: 5318880 - DNA, 19 bp, Homo sapiens
tgagcctgtttattgccat

SEQ ID NO: 5318881 - DNA, 22 bp, Homo sapiens
tgagccttagtttcagctgacc

SEQ ID NO: 5318882 - DNA, 14 bp, Homo sapiens
tgagccttattaaa

SEQ ID NO: 5318883 - DNA, 16 bp, Homo sapiens
tgagccttattaaaat

SEQ ID NO: 5318884 - DNA, 14 bp, Homo sapiens
tgagccttcagtct

SEQ ID NO: 5318885 - DNA, 15 bp, Homo sapiens
tgagccttctactta

SEQ ID NO: 5318886 - DNA, 22 bp, Homo sapiens
tgagccttgcagatatctgcat

SEQ ID NO: 5318887 - DNA, 20 bp, Homo sapiens
tgagccttgcatgtacttga

SEQ ID NO: 5318888 - DNA, 22 bp, Homo sapiens
tgagccttgcatgtacttgaag

SEQ ID NO: 5318889 - DNA, 13 bp, Homo sapiens
tgagccttgctgc

SEQ ID NO: 5318890 - DNA, 17 bp, Homo sapiens
tgagccttgctgccaag

SEQ ID NO: 5318891 - DNA, 18 bp, Homo sapiens
tgagccttgctgccaagt

SEQ ID NO: 5318892 - DNA, 13 bp, Homo sapiens
tgagccttggccc

SEQ ID NO: 5318893 - DNA, 15 bp, Homo sapiens
tgagcctttgtgctt

SEQ ID NO: 5318894 - DNA, 16 bp, Homo sapiens
tgagcctttgtgcttt

SEQ ID NO: 5318895 - DNA, 22 bp, Homo sapiens
tgagcctttgtgctttttgtca

SEQ ID NO: 5318896 - DNA, 16 bp, Homo sapiens
tgagcgacagtgagac

SEQ ID NO: 5318897 - DNA, 20 bp, Homo sapiens
tgagcgacagtgagactctg

SEQ ID NO: 5318898 - DNA, 22 bp, Homo sapiens
tgagcgacatctctgactttct

SEQ ID NO: 5318899 - DNA, 15 bp, Homo sapiens
tgagcgaggaaaaac

SEQ ID NO: 5318900 - DNA, 19 bp, Homo sapiens
tgagcgaggaaaaacaaca

SEQ ID NO: 5318901 - DNA, 21 bp, Homo sapiens
tgagcgaggaaaaacaacaaa

SEQ ID NO: 5318902 - DNA, 17 bp, Homo sapiens
tgagcgaggacattctc

SEQ ID NO: 5318903 - DNA, 12 bp, Homo sapiens
tgagcgagtgga

SEQ ID NO: 5318904 - DNA, 21 bp, Homo sapiens
tgagcgagtggagtctgccac

SEQ ID NO: 5318905 - DNA, 16 bp, Homo sapiens
tgagcgagtggatgct

SEQ ID NO: 5318906 - DNA, 21 bp, Homo sapiens
tgagcgagtggatgctgtgct

SEQ ID NO: 5318907 - DNA, 22 bp, Homo sapiens
tgagcgagtggatgctgtgcta

SEQ ID NO: 5318908 - DNA, 21 bp, Homo sapiens
tgagcgatcatttatttcatg

SEQ ID NO: 5318909 - DNA, 19 bp, Homo sapiens
tgagcgcagagtaaaataa

SEQ ID NO: 5318910 - DNA, 22 bp, Homo sapiens
tgagcgcagcgcctccaccctg

SEQ ID NO: 5318911 - DNA, 12 bp, Homo sapiens
tgagcgccagga

SEQ ID NO: 5318912 - DNA, 18 bp, Homo sapiens
tgagcgcccccgagccct

SEQ ID NO: 5318913 - DNA, 19 bp, Homo sapiens
tgagcgcccccgagccctg

SEQ ID NO: 5318914 - DNA, 23 bp, Homo sapiens
tgagcgcccccgagccctgactc

SEQ ID NO: 5318915 - DNA, 18 bp, Homo sapiens
tgagcgcctggatttctg

SEQ ID NO: 5318916 - DNA, 20 bp, Homo sapiens
tgagcgcctgtgcacacaca

SEQ ID NO: 5318917 - DNA, 14 bp, Homo sapiens
tgagcgctgtggac

SEQ ID NO: 5318918 - DNA, 13 bp, Homo sapiens
tgagcgcttgggc

SEQ ID NO: 5318919 - DNA, 13 bp, Homo sapiens
tgagcggaggctc

SEQ ID NO: 5318920 - DNA, 16 bp, Homo sapiens
tgagcggcaccctggt

SEQ ID NO: 5318921 - DNA, 18 bp, Homo sapiens
tgagcggccgcagagact

SEQ ID NO: 5318922 - DNA, 19 bp, Homo sapiens
tgagcggccgcagagactg

SEQ ID NO: 5318923 - DNA, 20 bp, Homo sapiens
tgagcggccgcctgtccttg

SEQ ID NO: 5318924 - DNA, 13 bp, Homo sapiens
tgagcgggaggca

SEQ ID NO: 5318925 - DNA, 15 bp, Homo sapiens
tgagcgggaggcaga

SEQ ID NO: 5318926 - DNA, 22 bp, Homo sapiens
tgagcgggtggggtgcttgctg

SEQ ID NO: 5318927 - DNA, 21 bp, Homo sapiens
tgagcgtcactgcccaccaaa

SEQ ID NO: 5318928 - DNA, 22 bp, Homo sapiens
tgagcgtcactgcccaccaaag

SEQ ID NO: 5318929 - DNA, 23 bp, Homo sapiens
tgagcgtgcgtctgtgtgtgcct

SEQ ID NO: 5318930 - DNA, 18 bp, Homo sapiens
tgagcgtggaagggggag

SEQ ID NO: 5318931 - DNA, 13 bp, Homo sapiens
tgagcgtggcctt

SEQ ID NO: 5318932 - DNA, 18 bp, Homo sapiens
tgagcgtggccttgggag

SEQ ID NO: 5318933 - DNA, 18 bp, Homo sapiens
tgagcgtgtccacagagt

SEQ ID NO: 5318934 - DNA, 13 bp, Homo sapiens
tgagctacaaatg

SEQ ID NO: 5318935 - DNA, 16 bp, Homo sapiens
tgagctacaaatgcat

SEQ ID NO: 5318936 - DNA, 18 bp, Homo sapiens
tgagctacagaacacttt

SEQ ID NO: 5318937 - DNA, 15 bp, Homo sapiens
tgagctaccaggaag

SEQ ID NO: 5318938 - DNA, 19 bp, Homo sapiens
tgagctaccgtggatctcc

SEQ ID NO: 5318939 - DNA, 18 bp, Homo sapiens
tgagctacgcctgcctcc

SEQ ID NO: 5318940 - DNA, 24 bp, Homo sapiens
tgagctactgccgtcagtgctgtg

SEQ ID NO: 5318941 - DNA, 21 bp, Homo sapiens
tgagctacttcttattcactt

SEQ ID NO: 5318942 - DNA, 15 bp, Homo sapiens
tgagctagaaatcac

SEQ ID NO: 5318943 - DNA, 23 bp, Homo sapiens
tgagctagacccaacccttagct

SEQ ID NO: 5318944 - DNA, 12 bp, Homo sapiens
tgagctagcctc

SEQ ID NO: 5318945 - DNA, 13 bp, Homo sapiens
tgagctagcctcc

SEQ ID NO: 5318946 - DNA, 17 bp, Homo sapiens
tgagctagcgatttcag

SEQ ID NO: 5318947 - DNA, 18 bp, Homo sapiens
tgagctagcgatttcaga

SEQ ID NO: 5318948 - DNA, 17 bp, Homo sapiens
tgagctagctagcgcac

SEQ ID NO: 5318949 - DNA, 22 bp, Homo sapiens
tgagctagtgtcacctgcacag

SEQ ID NO: 5318950 - DNA, 21 bp, Homo sapiens
tgagctagttaaggcaaatca

SEQ ID NO: 5318951 - DNA, 21 bp, Homo sapiens
tgagctagttggttgaatttt

SEQ ID NO: 5318952 - DNA, 17 bp, Homo sapiens
tgagctatagtgaagaa

SEQ ID NO: 5318953 - DNA, 18 bp, Homo sapiens
tgagctatagtgaagaat

SEQ ID NO: 5318954 - DNA, 17 bp, Homo sapiens
tgagctatcctttcaaa

SEQ ID NO: 5318955 - DNA, 17 bp, Homo sapiens
tgagctatgataagatt

SEQ ID NO: 5318956 - DNA, 21 bp, Homo sapiens
tgagctattaaaactcagcct

SEQ ID NO: 5318957 - DNA, 21 bp, Homo sapiens
tgagctatttccattccagaa

SEQ ID NO: 5318958 - DNA, 22 bp, Homo sapiens
tgagctatttccttccagcctt

SEQ ID NO: 5318959 - DNA, 19 bp, Homo sapiens
tgagctattttcctctggc

SEQ ID NO: 5318960 - DNA, 24 bp, Homo sapiens
tgagctattttcctctggccgcag

SEQ ID NO: 5318961 - DNA, 17 bp, Homo sapiens
tgagctcacaaggcagc

SEQ ID NO: 5318962 - DNA, 18 bp, Homo sapiens
tgagctcacatgggactg

SEQ ID NO: 5318963 - DNA, 23 bp, Homo sapiens
tgagctcagaaaatatccctcct

SEQ ID NO: 5318964 - DNA, 18 bp, Homo sapiens
tgagctcagacccccact

SEQ ID NO: 5318965 - DNA, 19 bp, Homo sapiens
tgagctcagacccccactc

SEQ ID NO: 5318966 - DNA, 11 bp, Homo sapiens
tgagctcagcc

SEQ ID NO: 5318967 - DNA, 20 bp, Homo sapiens
tgagctcagccctggtgggc

SEQ ID NO: 5318968 - DNA, 11 bp, Homo sapiens
tgagctcagct

SEQ ID NO: 5318969 - DNA, 14 bp, Homo sapiens
tgagctcaggaggt

SEQ ID NO: 5318970 - DNA, 22 bp, Homo sapiens
tgagctcaggagtttgagacca

SEQ ID NO: 5318971 - DNA, 12 bp, Homo sapiens
tgagctcaggct

SEQ ID NO: 5318972 - DNA, 13 bp, Homo sapiens
tgagctcaggctg

SEQ ID NO: 5318973 - DNA, 15 bp, Homo sapiens
tgagctcaggctgag

SEQ ID NO: 5318974 - DNA, 15 bp, Homo sapiens
tgagctcatgtagca

SEQ ID NO: 5318975 - DNA, 13 bp, Homo sapiens
tgagctccaccct

SEQ ID NO: 5318976 - DNA, 17 bp, Homo sapiens
tgagctccaccctcccc

SEQ ID NO: 5318977 - DNA, 16 bp, Homo sapiens
tgagctccacctctgg

SEQ ID NO: 5318978 - DNA, 17 bp, Homo sapiens
tgagctccagaccccca

SEQ ID NO: 5318979 - DNA, 18 bp, Homo sapiens
tgagctcccacaagcctg

SEQ ID NO: 5318980 - DNA, 19 bp, Homo sapiens
tgagctcccacaagcctga

SEQ ID NO: 5318981 - DNA, 17 bp, Homo sapiens
tgagctcccacctccct

SEQ ID NO: 5318982 - DNA, 19 bp, Homo sapiens
tgagctcccacctcccttc

SEQ ID NO: 5318983 - DNA, 20 bp, Homo sapiens
tgagctcccacctcccttcc

SEQ ID NO: 5318984 - DNA, 21 bp, Homo sapiens
tgagctcccacctcccttccc

SEQ ID NO: 5318985 - DNA, 16 bp, Homo sapiens
tgagctccccaaaaac

SEQ ID NO: 5318986 - DNA, 22 bp, Homo sapiens
tgagctccccagatctcccact

SEQ ID NO: 5318987 - DNA, 15 bp, Homo sapiens
tgagctccccatcac

SEQ ID NO: 5318988 - DNA, 20 bp, Homo sapiens
tgagctcctaagctgccagc

SEQ ID NO: 5318989 - DNA, 15 bp, Homo sapiens
tgagctcctgatcag

SEQ ID NO: 5318990 - DNA, 18 bp, Homo sapiens
tgagctcctgatcagagg

SEQ ID NO: 5318991 - DNA, 18 bp, Homo sapiens
tgagctcctgtcccctgc

SEQ ID NO: 5318992 - DNA, 21 bp, Homo sapiens
tgagctcctgtcccctgctac

SEQ ID NO: 5318993 - DNA, 22 bp, Homo sapiens
tgagctcggggggctctgcctt

SEQ ID NO: 5318994 - DNA, 20 bp, Homo sapiens
tgagctcggtggacccaggg

SEQ ID NO: 5318995 - DNA, 14 bp, Homo sapiens
tgagctctccaggc

SEQ ID NO: 5318996 - DNA, 17 bp, Homo sapiens
tgagctctctaatagaa

SEQ ID NO: 5318997 - DNA, 17 bp, Homo sapiens
tgagctctctcagaccc

SEQ ID NO: 5318998 - DNA, 18 bp, Homo sapiens
tgagctctctcagaccct

SEQ ID NO: 5318999 - DNA, 13 bp, Homo sapiens
tgagctctctgcc

SEQ ID NO: 5319000 - DNA, 12 bp, Homo sapiens
tgagctctctgt

SEQ ID NO: 5319001 - DNA, 20 bp, Homo sapiens
tgagctctgaacaaacactg

SEQ ID NO: 5319002 - DNA, 18 bp, Homo sapiens
tgagctctgacctgcccc

SEQ ID NO: 5319003 - DNA, 17 bp, Homo sapiens
tgagctctgagaggccc

SEQ ID NO: 5319004 - DNA, 18 bp, Homo sapiens
tgagctctgagaggccct

SEQ ID NO: 5319005 - DNA, 20 bp, Homo sapiens
tgagctctgagaggccctgg

SEQ ID NO: 5319006 - DNA, 21 bp, Homo sapiens
tgagctctgagaggccctgga

SEQ ID NO: 5319007 - DNA, 22 bp, Homo sapiens
tgagctctgagaggccctggat

SEQ ID NO: 5319008 - DNA, 21 bp, Homo sapiens
tgagctctggttatttttctc

SEQ ID NO: 5319009 - DNA, 16 bp, Homo sapiens
tgagctctttgcacta

SEQ ID NO: 5319010 - DNA, 18 bp, Homo sapiens
tgagctgaaatgctgcat

SEQ ID NO: 5319011 - DNA, 20 bp, Homo sapiens
tgagctgaaatgctgcattt

SEQ ID NO: 5319012 - DNA, 21 bp, Homo sapiens
tgagctgaacacatttgccca

SEQ ID NO: 5319013 - DNA, 15 bp, Homo sapiens
tgagctgaagaaatt

SEQ ID NO: 5319014 - DNA, 16 bp, Homo sapiens
tgagctgaagaaatta

SEQ ID NO: 5319015 - DNA, 12 bp, Homo sapiens
tgagctgaatgt

SEQ ID NO: 5319016 - DNA, 24 bp, Homo sapiens
tgagctgaccagccgtgagcatgt

SEQ ID NO: 5319017 - DNA, 17 bp, Homo sapiens
tgagctgagatcgtgcc

SEQ ID NO: 5319018 - DNA, 13 bp, Homo sapiens
tgagctgagccag

SEQ ID NO: 5319019 - DNA, 14 bp, Homo sapiens
tgagctgcagcccc

SEQ ID NO: 5319020 - DNA, 23 bp, Homo sapiens
tgagctgcagcctggctggtcct

SEQ ID NO: 5319021 - DNA, 14 bp, Homo sapiens
tgagctgccagtgg

SEQ ID NO: 5319022 - DNA, 21 bp, Homo sapiens
tgagctgcccggcgcctgccc

SEQ ID NO: 5319023 - DNA, 23 bp, Homo sapiens
tgagctgcccggcgcctgccctg

SEQ ID NO: 5319024 - DNA, 16 bp, Homo sapiens
tgagctgcctccagcc

SEQ ID NO: 5319025 - DNA, 19 bp, Homo sapiens
tgagctgcctccagcctgg

SEQ ID NO: 5319026 - DNA, 23 bp, Homo sapiens
tgagctgcctccagcctggtggc

SEQ ID NO: 5319027 - DNA, 19 bp, Homo sapiens
tgagctgcctgctctgcag

SEQ ID NO: 5319028 - DNA, 22 bp, Homo sapiens
tgagctgcctgctctgcagccc

SEQ ID NO: 5319029 - DNA, 11 bp, Homo sapiens
tgagctgcctt

SEQ ID NO: 5319030 - DNA, 17 bp, Homo sapiens
tgagctgccttccctag

SEQ ID NO: 5319031 - DNA, 19 bp, Homo sapiens
tgagctgccttccctagct

SEQ ID NO: 5319032 - DNA, 14 bp, Homo sapiens
tgagctgcttcact

SEQ ID NO: 5319033 - DNA, 12 bp, Homo sapiens
tgagctggaagg

SEQ ID NO: 5319034 - DNA, 12 bp, Homo sapiens
tgagctggagct

SEQ ID NO: 5319035 - DNA, 19 bp, Homo sapiens
tgagctggcaaccagccag

SEQ ID NO: 5319036 - DNA, 15 bp, Homo sapiens
tgagctggccaggcc

SEQ ID NO: 5319037 - DNA, 18 bp, Homo sapiens
tgagctggccaggccctg

SEQ ID NO: 5319038 - DNA, 16 bp, Homo sapiens
tgagctggcccttggg

SEQ ID NO: 5319039 - DNA, 19 bp, Homo sapiens
tgagctggccctttccagc

SEQ ID NO: 5319040 - DNA, 22 bp, Homo sapiens
tgagctggcctcacctgggttc

SEQ ID NO: 5319041 - DNA, 18 bp, Homo sapiens
tgagctggcctctctagc

SEQ ID NO: 5319042 - DNA, 13 bp, Homo sapiens
tgagctgggatga

SEQ ID NO: 5319043 - DNA, 21 bp, Homo sapiens
tgagctgggcaccacaggctg

SEQ ID NO: 5319044 - DNA, 15 bp, Homo sapiens
tgagctgggcccagc

SEQ ID NO: 5319045 - DNA, 16 bp, Homo sapiens
tgagctgggcccagcc

SEQ ID NO: 5319046 - DNA, 19 bp, Homo sapiens
tgagctgggcccagcccct

SEQ ID NO: 5319047 - DNA, 14 bp, Homo sapiens
tgagctgggccgga

SEQ ID NO: 5319048 - DNA, 18 bp, Homo sapiens
tgagctggggactcaggg

SEQ ID NO: 5319049 - DNA, 20 bp, Homo sapiens
tgagctggggactcagggac

SEQ ID NO: 5319050 - DNA, 21 bp, Homo sapiens
tgagctggggactcagggacc

SEQ ID NO: 5319051 - DNA, 21 bp, Homo sapiens
tgagctggggaggtgggaggc

SEQ ID NO: 5319052 - DNA, 23 bp, Homo sapiens
tgagctggggaggtgggaggcca

SEQ ID NO: 5319053 - DNA, 15 bp, Homo sapiens
tgagctggggccaca

SEQ ID NO: 5319054 - DNA, 12 bp, Homo sapiens
tgaggcctggac

SEQ ID NO: 5319055 - DNA, 17 bp, Homo sapiens
tgaggcctggccaggca

SEQ ID NO: 5319056 - DNA, 12 bp, Homo sapiens
tgaggcctgggc

SEQ ID NO: 5319057 - DNA, 13 bp, Homo sapiens
tgaggcctgggcc

SEQ ID NO: 5319058 - DNA, 14 bp, Homo sapiens
tgaggcctgggctg

SEQ ID NO: 5319059 - DNA, 12 bp, Homo sapiens
tgaggcctgtgc

SEQ ID NO: 5319060 - DNA, 22 bp, Homo sapiens
tgaggcctgtgcctgtcaggct

SEQ ID NO: 5319061 - DNA, 12 bp, Homo sapiens
tgaggccttgct

SEQ ID NO: 5319062 - DNA, 18 bp, Homo sapiens
tgaggccttgtgtgtcag

SEQ ID NO: 5319063 - DNA, 22 bp, Homo sapiens
tgaggccttgtgtgtcaggccc

SEQ ID NO: 5319064 - DNA, 23 bp, Homo sapiens
tgaggccttgtgtgtcaggccct

SEQ ID NO: 5319065 - DNA, 21 bp, Homo sapiens
tgaggcctttccccagtgtgg

SEQ ID NO: 5319066 - DNA, 22 bp, Homo sapiens
tgaggcctttccccagtgtggc

SEQ ID NO: 5319067 - DNA, 20 bp, Homo sapiens
tgaggcgagaagggctgctt

SEQ ID NO: 5319068 - DNA, 21 bp, Homo sapiens
tgaggcgagaagggctgcttc

SEQ ID NO: 5319069 - DNA, 16 bp, Homo sapiens
tgaggcgagcagggca

SEQ ID NO: 5319070 - DNA, 17 bp, Homo sapiens
tgaggcgagcagggcag

SEQ ID NO: 5319071 - DNA, 23 bp, Homo sapiens
tgaggcgccccaacccgtggagg

SEQ ID NO: 5319072 - DNA, 15 bp, Homo sapiens
tgaggcggagctcca

SEQ ID NO: 5319073 - DNA, 14 bp, Homo sapiens
tgaggcggaggctg

SEQ ID NO: 5319074 - DNA, 16 bp, Homo sapiens
tgaggcggcagctggg

SEQ ID NO: 5319075 - DNA, 22 bp, Homo sapiens
tgaggcggcagctggggccgga

SEQ ID NO: 5319076 - DNA, 15 bp, Homo sapiens
tgaggcgggaaccct

SEQ ID NO: 5319077 - DNA, 23 bp, Homo sapiens
tgaggcgggaaccctctggggcc

SEQ ID NO: 5319078 - DNA, 23 bp, Homo sapiens
tgaggcgggtggatcacctgagg

SEQ ID NO: 5319079 - DNA, 17 bp, Homo sapiens
tgaggcggtttcctgaa

SEQ ID NO: 5319080 - DNA, 18 bp, Homo sapiens
tgaggcggtttcctgaat

SEQ ID NO: 5319081 - DNA, 22 bp, Homo sapiens
tgaggcgtgggatccagagaga

SEQ ID NO: 5319082 - DNA, 16 bp, Homo sapiens
tgaggcgttctcctgc

SEQ ID NO: 5319083 - DNA, 16 bp, Homo sapiens
tgaggctaagttggga

SEQ ID NO: 5319084 - DNA, 20 bp, Homo sapiens
tgaggctcaagaggcccagg

SEQ ID NO: 5319085 - DNA, 22 bp, Homo sapiens
tgaggctcaagaggcccaggga

SEQ ID NO: 5319086 - DNA, 23 bp, Homo sapiens
tgaggctcaagaggcccagggag

SEQ ID NO: 5319087 - DNA, 14 bp, Homo sapiens
tgaggctcagccct

SEQ ID NO: 5319088 - DNA, 15 bp, Homo sapiens
tgaggctcagcccta

SEQ ID NO: 5319089 - DNA, 21 bp, Homo sapiens
tgaggctcaggggtgtgcctg

SEQ ID NO: 5319090 - DNA, 20 bp, Homo sapiens
tgaggctccacttggtctgt

SEQ ID NO: 5319091 - DNA, 22 bp, Homo sapiens
tgaggctctctaagaaaagaga

SEQ ID NO: 5319092 - DNA, 18 bp, Homo sapiens
tgaggctctgcccttggt

SEQ ID NO: 5319093 - DNA, 17 bp, Homo sapiens
tgaggctgaataaagcc

SEQ ID NO: 5319094 - DNA, 14 bp, Homo sapiens
tgaggctgagaaag

SEQ ID NO: 5319095 - DNA, 13 bp, Homo sapiens
tgaggctgagact

SEQ ID NO: 5319096 - DNA, 15 bp, Homo sapiens
tgaggctgaggcagg

SEQ ID NO: 5319097 - DNA, 19 bp, Homo sapiens
tgaggctgcagcaggtgct

SEQ ID NO: 5319098 - DNA, 13 bp, Homo sapiens
tgaggctgctgcc

SEQ ID NO: 5319099 - DNA, 14 bp, Homo sapiens
tgaggctgctgcca

SEQ ID NO: 5319100 - DNA, 16 bp, Homo sapiens
tgaggctgctgccagg

SEQ ID NO: 5319101 - DNA, 18 bp, Homo sapiens
tgaggctgctgccaggcc

SEQ ID NO: 5319102 - DNA, 20 bp, Homo sapiens
tgaggctgctgccaggcccg

SEQ ID NO: 5319103 - DNA, 15 bp, Homo sapiens
tgaggctgctgccat

SEQ ID NO: 5319104 - DNA, 16 bp, Homo sapiens
tgaggctgctttccaa

SEQ ID NO: 5319105 - DNA, 11 bp, Homo sapiens
tgaggctggca

SEQ ID NO: 5319106 - DNA, 20 bp, Homo sapiens
tgaggctggctgggggcagg

SEQ ID NO: 5319107 - DNA, 11 bp, Homo sapiens
tgaggctggga

SEQ ID NO: 5319108 - DNA, 11 bp, Homo sapiens
tgaggctgggc

SEQ ID NO: 5319109 - DNA, 13 bp, Homo sapiens
tgaggctgggcag

SEQ ID NO: 5319110 - DNA, 15 bp, Homo sapiens
tgaggctgggccagc

SEQ ID NO: 5319111 - DNA, 15 bp, Homo sapiens
tgaggctgggctccc

SEQ ID NO: 5319112 - DNA, 22 bp, Homo sapiens
tgaggctgtaactgagagaaag

SEQ ID NO: 5319113 - DNA, 13 bp, Homo sapiens
tgaggctgtgtct

SEQ ID NO: 5319114 - DNA, 14 bp, Homo sapiens
tgaggctgtgtctc

SEQ ID NO: 5319115 - DNA, 19 bp, Homo sapiens
tgaggctgtttttggctgt

SEQ ID NO: 5319116 - DNA, 13 bp, Homo sapiens
tgaggcttagaaa

SEQ ID NO: 5319117 - DNA, 17 bp, Homo sapiens
tgaggcttagagagagg

SEQ ID NO: 5319118 - DNA, 18 bp, Homo sapiens
tgaggcttaggcctctct

SEQ ID NO: 5319119 - DNA, 21 bp, Homo sapiens
tgaggcttccaggctcttcct

SEQ ID NO: 5319120 - DNA, 14 bp, Homo sapiens
tgaggcttcttcct

SEQ ID NO: 5319121 - DNA, 15 bp, Homo sapiens
tgaggcttcttcctg

SEQ ID NO: 5319122 - DNA, 15 bp, Homo sapiens
tgaggcttgcccagg

SEQ ID NO: 5319123 - DNA, 17 bp, Homo sapiens
tgaggcttgcccaggag

SEQ ID NO: 5319124 - DNA, 23 bp, Homo sapiens
tgaggcttgcccaggagcaagtg

SEQ ID NO: 5319125 - DNA, 14 bp, Homo sapiens
tgaggcttgctgag

SEQ ID NO: 5319126 - DNA, 20 bp, Homo sapiens
tgaggcttgctgagaggggc

SEQ ID NO: 5319127 - DNA, 21 bp, Homo sapiens
tgaggcttgctgagaggggct

SEQ ID NO: 5319128 - DNA, 13 bp, Homo sapiens
tgaggctttggat

SEQ ID NO: 5319129 - DNA, 14 bp, Homo sapiens
tgaggctttgtgtt

SEQ ID NO: 5319130 - DNA, 13 bp, Homo sapiens
tgagggaaatgtt

SEQ ID NO: 5319131 - DNA, 22 bp, Homo sapiens
tgagggaacagacaggagaaat

SEQ ID NO: 5319132 - DNA, 17 bp, Homo sapiens
tgagggaacagagaggt

SEQ ID NO: 5319133 - DNA, 21 bp, Homo sapiens
tgagggaagaacattattcat

SEQ ID NO: 5319134 - DNA, 21 bp, Homo sapiens
tgagggaagaataaagagctg

SEQ ID NO: 5319135 - DNA, 21 bp, Homo sapiens
tgagggaagcaataggtagct

SEQ ID NO: 5319136 - DNA, 21 bp, Homo sapiens
tgagggaagcccacccgcccc

SEQ ID NO: 5319137 - DNA, 12 bp, Homo sapiens
tgagggaagctt

SEQ ID NO: 5319138 - DNA, 24 bp, Homo sapiens
tgagggaaggagcccagccagaaa

SEQ ID NO: 5319139 - DNA, 15 bp, Homo sapiens
tgagggaatccattg

SEQ ID NO: 5319140 - DNA, 22 bp, Homo sapiens
tgagggaccaaaaaaggacgta

SEQ ID NO: 5319141 - DNA, 19 bp, Homo sapiens
tgagggaccgagcccagca

SEQ ID NO: 5319142 - DNA, 18 bp, Homo sapiens
tgagggaccttggagagc

SEQ ID NO: 5319143 - DNA, 20 bp, Homo sapiens
tgagggaccttggagagctc

SEQ ID NO: 5319144 - DNA, 19 bp, Homo sapiens
tgagggactgcctctgcca

SEQ ID NO: 5319145 - DNA, 19 bp, Homo sapiens
tgagggagaacctctccaa

SEQ ID NO: 5319146 - DNA, 23 bp, Homo sapiens
tgagggagaatcctcccttccca

SEQ ID NO: 5319147 - DNA, 20 bp, Homo sapiens
tgagggaggacctggggcac

SEQ ID NO: 5319148 - DNA, 15 bp, Homo sapiens
tgagggaggagggct

SEQ ID NO: 5319149 - DNA, 22 bp, Homo sapiens
tgagggaggcagaaagggaaag

SEQ ID NO: 5319150 - DNA, 17 bp, Homo sapiens
tgagggagggagccatg

SEQ ID NO: 5319151 - DNA, 16 bp, Homo sapiens
tgagggagggctgggc

SEQ ID NO: 5319152 - DNA, 19 bp, Homo sapiens
tgagggagggggcgctcag

SEQ ID NO: 5319153 - DNA, 22 bp, Homo sapiens
tgagggagggggcgctcaggac

SEQ ID NO: 5319154 - DNA, 15 bp, Homo sapiens
tgagggagtgcagaa

SEQ ID NO: 5319155 - DNA, 17 bp, Homo sapiens
tgagggagtgcagaaca

SEQ ID NO: 5319156 - DNA, 23 bp, Homo sapiens
tgagggagtgcagaacacctggc

SEQ ID NO: 5319157 - DNA, 18 bp, Homo sapiens
tgagggagttagggagag

SEQ ID NO: 5319158 - DNA, 19 bp, Homo sapiens
tgagggagttagggagaga

SEQ ID NO: 5319159 - DNA, 14 bp, Homo sapiens
tgagggataagcaa

SEQ ID NO: 5319160 - DNA, 17 bp, Homo sapiens
tgagggatcactgccaa

SEQ ID NO: 5319161 - DNA, 21 bp, Homo sapiens
tgagggatctgagtaggtctg

SEQ ID NO: 5319162 - DNA, 22 bp, Homo sapiens
tgagggatctgagtaggtctgg

SEQ ID NO: 5319163 - DNA, 18 bp, Homo sapiens
tgagggatggggagcagc

SEQ ID NO: 5319164 - DNA, 14 bp, Homo sapiens
tgagggattctatt

SEQ ID NO: 5319165 - DNA, 19 bp, Homo sapiens
tgagggcaagaggtgcctg

SEQ ID NO: 5319166 - DNA, 15 bp, Homo sapiens
tgagggcaagccacc

SEQ ID NO: 5319167 - DNA, 16 bp, Homo sapiens
tgagggcaagccacca

SEQ ID NO: 5319168 - DNA, 17 bp, Homo sapiens
tgagggcaccaccaaga

SEQ ID NO: 5319169 - DNA, 23 bp, Homo sapiens
tgagggcactctctgccagctcc

SEQ ID NO: 5319170 - DNA, 15 bp, Homo sapiens
tgagggcagcactgg

SEQ ID NO: 5319171 - DNA, 21 bp, Homo sapiens
tgagggcagggttctagaagg

SEQ ID NO: 5319172 - DNA, 11 bp, Homo sapiens
tgagggcagtc

SEQ ID NO: 5319173 - DNA, 15 bp, Homo sapiens
tgagggcagtgccct

SEQ ID NO: 5319174 - DNA, 15 bp, Homo sapiens
tgagggcatctctga

SEQ ID NO: 5319175 - DNA, 16 bp, Homo sapiens
tgagggcatctctgag

SEQ ID NO: 5319176 - DNA, 21 bp, Homo sapiens
tgagggcatcttggtccagga

SEQ ID NO: 5319177 - DNA, 18 bp, Homo sapiens
tgagggcatgtgcggctg

SEQ ID NO: 5319178 - DNA, 17 bp, Homo sapiens
tgagggcattaaaaata

SEQ ID NO: 5319179 - DNA, 23 bp, Homo sapiens
tgagggcatttggcttcctctgc

SEQ ID NO: 5319180 - DNA, 13 bp, Homo sapiens
tgagggccaagag

SEQ ID NO: 5319181 - DNA, 23 bp, Homo sapiens
tgagggccaataccctactgtgg

SEQ ID NO: 5319182 - DNA, 20 bp, Homo sapiens
tgagggccaccggtgggcag

SEQ ID NO: 5319183 - DNA, 21 bp, Homo sapiens
tgagggccactttttttttat

SEQ ID NO: 5319184 - DNA, 16 bp, Homo sapiens
tgagggccagggaccc

SEQ ID NO: 5319185 - DNA, 18 bp, Homo sapiens
tgagggccagggacccag

SEQ ID NO: 5319186 - DNA, 23 bp, Homo sapiens
tgagggccagggacccaggtgtg

SEQ ID NO: 5319187 - DNA, 15 bp, Homo sapiens
tgagggcccagagca

SEQ ID NO: 5319188 - DNA, 20 bp, Homo sapiens
tgagggcccagagcaggaag

SEQ ID NO: 5319189 - DNA, 21 bp, Homo sapiens
tgagggcccagagcaggaagc

SEQ ID NO: 5319190 - DNA, 14 bp, Homo sapiens
tgagggcccctctg

SEQ ID NO: 5319191 - DNA, 19 bp, Homo sapiens
tgagggcccctctgcccag

SEQ ID NO: 5319192 - DNA, 21 bp, Homo sapiens
tgagggcccctctgcccagct

SEQ ID NO: 5319193 - DNA, 23 bp, Homo sapiens
tgagggccggttctaaggctcag

SEQ ID NO: 5319194 - DNA, 15 bp, Homo sapiens
tgagggcctcagagc

SEQ ID NO: 5319195 - DNA, 16 bp, Homo sapiens
tgagggcctcagagcc

SEQ ID NO: 5319196 - DNA, 22 bp, Homo sapiens
tgagggcctcagagcctgacct

SEQ ID NO: 5319197 - DNA, 22 bp, Homo sapiens
tgagggcctgctggaggcctca

SEQ ID NO: 5319198 - DNA, 20 bp, Homo sapiens
tgagggccttgcacatagga

SEQ ID NO: 5319199 - DNA, 18 bp, Homo sapiens
tgagggcgagcggcaaag

SEQ ID NO: 5319200 - DNA, 16 bp, Homo sapiens
tgagggcgtgaaacac

SEQ ID NO: 5319201 - DNA, 15 bp, Homo sapiens
tgagggctccatgct

SEQ ID NO: 5319202 - DNA, 19 bp, Homo sapiens
tgagggctccctgctccct

SEQ ID NO: 5319203 - DNA, 14 bp, Homo sapiens
tgagggctgccagc

SEQ ID NO: 5319204 - DNA, 15 bp, Homo sapiens
tgagggctgccagca

SEQ ID NO: 5319205 - DNA, 20 bp, Homo sapiens
tgagggctgccagcagcccc

SEQ ID NO: 5319206 - DNA, 16 bp, Homo sapiens
tgagggctgctcccct

SEQ ID NO: 5319207 - DNA, 15 bp, Homo sapiens
tgagggctgggcagc

SEQ ID NO: 5319208 - DNA, 14 bp, Homo sapiens
tgagggctgggccc

SEQ ID NO: 5319209 - DNA, 17 bp, Homo sapiens
tgaggggaatctggaac

SEQ ID NO: 5319210 - DNA, 14 bp, Homo sapiens
tgaggggaccagga

SEQ ID NO: 5319211 - DNA, 22 bp, Homo sapiens
tgaggggaccaggagtgggtgg

SEQ ID NO: 5319212 - DNA, 11 bp, Homo sapiens
tgaggggaccc

SEQ ID NO: 5319213 - DNA, 16 bp, Homo sapiens
tgaggggacccagcgc

SEQ ID NO: 5319214 - DNA, 17 bp, Homo sapiens
tgaggggacccagcgcc

SEQ ID NO: 5319215 - DNA, 23 bp, Homo sapiens
tgaggggagacagagcaacccct

SEQ ID NO: 5319216 - DNA, 15 bp, Homo sapiens
tgaggggagcatgct

SEQ ID NO: 5319217 - DNA, 15 bp, Homo sapiens
tgaggggagccagga

SEQ ID NO: 5319218 - DNA, 13 bp, Homo sapiens
tgaggggaggagg

SEQ ID NO: 5319219 - DNA, 15 bp, Homo sapiens
tgaggggaggcacct

SEQ ID NO: 5319220 - DNA, 17 bp, Homo sapiens
tgaggggaggggcctcc

SEQ ID NO: 5319221 - DNA, 18 bp, Homo sapiens
tgaggggaggggcctccc

SEQ ID NO: 5319222 - DNA, 17 bp, Homo sapiens
tgaggggaggtggccag

SEQ ID NO: 5319223 - DNA, 21 bp, Homo sapiens
tgaggggattctctactgcca

SEQ ID NO: 5319224 - DNA, 17 bp, Homo sapiens
tgaggggcaacgaagaa

SEQ ID NO: 5319225 - DNA, 17 bp, Homo sapiens
tgaggggcactctcccc

SEQ ID NO: 5319226 - DNA, 14 bp, Homo sapiens
tgaggggcaggtct

SEQ ID NO: 5319227 - DNA, 15 bp, Homo sapiens
tgaggggcaggtcta

SEQ ID NO: 5319228 - DNA, 16 bp, Homo sapiens
tgaggggccaggccat

SEQ ID NO: 5319229 - DNA, 17 bp, Homo sapiens
tgaggggccaggggcag

SEQ ID NO: 5319230 - DNA, 16 bp, Homo sapiens
tgaggggcccgagcag

SEQ ID NO: 5319231 - DNA, 18 bp, Homo sapiens
tgagttgaaatgttctgt

SEQ ID NO: 5319232 - DNA, 21 bp, Homo sapiens
tgagttgagccttcaggccag

SEQ ID NO: 5319233 - DNA, 22 bp, Homo sapiens
tgagttgaggggcttccctctg

SEQ ID NO: 5319234 - DNA, 20 bp, Homo sapiens
tgagttgatagcacagaccc

SEQ ID NO: 5319235 - DNA, 21 bp, Homo sapiens
tgagttgatagcacagaccct

SEQ ID NO: 5319236 - DNA, 20 bp, Homo sapiens
tgagttgcaccattctttct

SEQ ID NO: 5319237 - DNA, 23 bp, Homo sapiens
tgagttgcaccattctttcttgg

SEQ ID NO: 5319238 - DNA, 20 bp, Homo sapiens
tgagttgcatgtttttgaaa

SEQ ID NO: 5319239 - DNA, 18 bp, Homo sapiens
tgagttgccaagacaaat

SEQ ID NO: 5319240 - DNA, 23 bp, Homo sapiens
tgagttgccaagacaaatcaaca

SEQ ID NO: 5319241 - DNA, 19 bp, Homo sapiens
tgagttgctggaaaatcat

SEQ ID NO: 5319242 - DNA, 13 bp, Homo sapiens
tgagttggacaca

SEQ ID NO: 5319243 - DNA, 20 bp, Homo sapiens
tgagttggacacactgtaaa

SEQ ID NO: 5319244 - DNA, 24 bp, Homo sapiens
tgagttggccagattgtggggtgc

SEQ ID NO: 5319245 - DNA, 16 bp, Homo sapiens
tgagttggctgggaat

SEQ ID NO: 5319246 - DNA, 17 bp, Homo sapiens
tgagttggctgggaata

SEQ ID NO: 5319247 - DNA, 22 bp, Homo sapiens
tgagttggcttacctggcccat

SEQ ID NO: 5319248 - DNA, 16 bp, Homo sapiens
tgagttgggcagccag

SEQ ID NO: 5319249 - DNA, 18 bp, Homo sapiens
tgagttgggcagccagga

SEQ ID NO: 5319250 - DNA, 20 bp, Homo sapiens
tgagttgggggtattttcta

SEQ ID NO: 5319251 - DNA, 22 bp, Homo sapiens
tgagttgggggtattttctaat

SEQ ID NO: 5319252 - DNA, 17 bp, Homo sapiens
tgagttggggtctggca

SEQ ID NO: 5319253 - DNA, 21 bp, Homo sapiens
tgagttggttacctattgctg

SEQ ID NO: 5319254 - DNA, 14 bp, Homo sapiens
tgagttgttctaac

SEQ ID NO: 5319255 - DNA, 21 bp, Homo sapiens
tgagttgttttggtgcctgcc

SEQ ID NO: 5319256 - DNA, 15 bp, Homo sapiens
tgagttgtttttgta

SEQ ID NO: 5319257 - DNA, 12 bp, Homo sapiens
tgagtttaaaaa

SEQ ID NO: 5319258 - DNA, 20 bp, Homo sapiens
tgagtttaaaaaaataacat

SEQ ID NO: 5319259 - DNA, 21 bp, Homo sapiens
tgagtttaaaaaaataacatc

SEQ ID NO: 5319260 - DNA, 17 bp, Homo sapiens
tgagtttaagtctctga

SEQ ID NO: 5319261 - DNA, 15 bp, Homo sapiens
tgagtttaccatttg

SEQ ID NO: 5319262 - DNA, 20 bp, Homo sapiens
tgagtttaccatttgtaata

SEQ ID NO: 5319263 - DNA, 16 bp, Homo sapiens
tgagtttaggcagctt

SEQ ID NO: 5319264 - DNA, 21 bp, Homo sapiens
tgagtttaggcagcttctctg

SEQ ID NO: 5319265 - DNA, 21 bp, Homo sapiens
tgagtttagtgatctgaacag

SEQ ID NO: 5319266 - DNA, 14 bp, Homo sapiens
tgagtttattctga

SEQ ID NO: 5319267 - DNA, 15 bp, Homo sapiens
tgagtttcactgtac

SEQ ID NO: 5319268 - DNA, 19 bp, Homo sapiens
tgagtttcagaaattctca

SEQ ID NO: 5319269 - DNA, 16 bp, Homo sapiens
tgagtttcagctggaa

SEQ ID NO: 5319270 - DNA, 18 bp, Homo sapiens
tgagtttccagctaagcc

SEQ ID NO: 5319271 - DNA, 11 bp, Homo sapiens
tgagtttccta

SEQ ID NO: 5319272 - DNA, 17 bp, Homo sapiens
tgagtttcctcaggctg

SEQ ID NO: 5319273 - DNA, 22 bp, Homo sapiens
tgagtttcctcaggctgctgga

SEQ ID NO: 5319274 - DNA, 19 bp, Homo sapiens
tgagtttgagctgccttcc

SEQ ID NO: 5319275 - DNA, 22 bp, Homo sapiens
tgagtttgccctggtttcactg

SEQ ID NO: 5319276 - DNA, 19 bp, Homo sapiens
tgagtttgctggttgtaaa

SEQ ID NO: 5319277 - DNA, 18 bp, Homo sapiens
tgagtttgtaggtaaaat

SEQ ID NO: 5319278 - DNA, 13 bp, Homo sapiens
tgagttttaccaa

SEQ ID NO: 5319279 - DNA, 22 bp, Homo sapiens
tgagttttagttggtctttcca

SEQ ID NO: 5319280 - DNA, 18 bp, Homo sapiens
tgagttttattgagaatt

SEQ ID NO: 5319281 - DNA, 22 bp, Homo sapiens
tgagttttcaaagatcccgtga

SEQ ID NO: 5319282 - DNA, 19 bp, Homo sapiens
tgagttttccatggcagga

SEQ ID NO: 5319283 - DNA, 13 bp, Homo sapiens
tgagttttctcct

SEQ ID NO: 5319284 - DNA, 14 bp, Homo sapiens
tgagttttctcctt

SEQ ID NO: 5319285 - DNA, 23 bp, Homo sapiens
tgagttttcttatatatatattg

SEQ ID NO: 5319286 - DNA, 17 bp, Homo sapiens
tgagttttcttctgtga

SEQ ID NO: 5319287 - DNA, 18 bp, Homo sapiens
tgagttttcttctgtgat

SEQ ID NO: 5319288 - DNA, 23 bp, Homo sapiens
tgagttttgatgctgtatttgct

SEQ ID NO: 5319289 - DNA, 17 bp, Homo sapiens
tgagttttgtgtttgtt

SEQ ID NO: 5319290 - DNA, 20 bp, Homo sapiens
tgagttttgttttaaaatta

SEQ ID NO: 5319291 - DNA, 19 bp, Homo sapiens
tgagtttttacaagatgta

SEQ ID NO: 5319292 - DNA, 18 bp, Homo sapiens
tgagtttttatggggctg

SEQ ID NO: 5319293 - DNA, 18 bp, Homo sapiens
tgagtttttgatagcttt

SEQ ID NO: 5319294 - DNA, 18 bp, Homo sapiens
tgagttttttaaattttt

SEQ ID NO: 5319295 - DNA, 20 bp, Homo sapiens
tgataaaaaatttattatgt

SEQ ID NO: 5319296 - DNA, 22 bp, Homo sapiens
tgataaaaaatttattatgtcc

SEQ ID NO: 5319297 - DNA, 14 bp, Homo sapiens
tgataaaaaatttt

SEQ ID NO: 5319298 - DNA, 16 bp, Homo sapiens
tgataaaaaattttgt

SEQ ID NO: 5319299 - DNA, 22 bp, Homo sapiens
tgataaaaaattttgtaatttt

SEQ ID NO: 5319300 - DNA, 14 bp, Homo sapiens
tgataaaaactcag

SEQ ID NO: 5319301 - DNA, 16 bp, Homo sapiens
tgataaaaccatgtag

SEQ ID NO: 5319302 - DNA, 16 bp, Homo sapiens
tgataaaactgggttg

SEQ ID NO: 5319303 - DNA, 20 bp, Homo sapiens
tgataaaagggcaaatctgc

SEQ ID NO: 5319304 - DNA, 19 bp, Homo sapiens
tgataaaataaataatttt

SEQ ID NO: 5319305 - DNA, 14 bp, Homo sapiens
tgataaaataagta

SEQ ID NO: 5319306 - DNA, 12 bp, Homo sapiens
tgataaaatatt

SEQ ID NO: 5319307 - DNA, 13 bp, Homo sapiens
tgataaaatcata

SEQ ID NO: 5319308 - DNA, 18 bp, Homo sapiens
tgataaaatgttcctttt

SEQ ID NO: 5319309 - DNA, 13 bp, Homo sapiens
tgataaaattgtg

SEQ ID NO: 5319310 - DNA, 13 bp, Homo sapiens
tgataaacacaga

SEQ ID NO: 5319311 - DNA, 15 bp, Homo sapiens
tgataaacacagagg

SEQ ID NO: 5319312 - DNA, 14 bp, Homo sapiens
tgataaacatttaa

SEQ ID NO: 5319313 - DNA, 14 bp, Homo sapiens
tgataaacctgtct

SEQ ID NO: 5319314 - DNA, 13 bp, Homo sapiens
tgataaactcaga

SEQ ID NO: 5319315 - DNA, 13 bp, Homo sapiens
tgataaactgaat

SEQ ID NO: 5319316 - DNA, 16 bp, Homo sapiens
tgataaagaggcatct

SEQ ID NO: 5319317 - DNA, 21 bp, Homo sapiens
tgataaagaggcatcttttct

SEQ ID NO: 5319318 - DNA, 13 bp, Homo sapiens
tgataaaggagag

SEQ ID NO: 5319319 - DNA, 17 bp, Homo sapiens
tgataaaggccagatta

SEQ ID NO: 5319320 - DNA, 20 bp, Homo sapiens
tgataaagtaattcatacaa

SEQ ID NO: 5319321 - DNA, 13 bp, Homo sapiens
tgataaagtttct

SEQ ID NO: 5319322 - DNA, 18 bp, Homo sapiens
tgataaagtttctcagat

SEQ ID NO: 5319323 - DNA, 21 bp, Homo sapiens
tgataaagtttctcagatcct

SEQ ID NO: 5319324 - DNA, 12 bp, Homo sapiens
tgataaatatat

SEQ ID NO: 5319325 - DNA, 11 bp, Homo sapiens
tgataaatatt

SEQ ID NO: 5319326 - DNA, 18 bp, Homo sapiens
tgataaatatttatgctt

SEQ ID NO: 5319327 - DNA, 20 bp, Homo sapiens
tgataaatcattttatgtca

SEQ ID NO: 5319328 - DNA, 13 bp, Homo sapiens
tgataaatccatc

SEQ ID NO: 5319329 - DNA, 15 bp, Homo sapiens
tgataaatttaatcc

SEQ ID NO: 5319330 - DNA, 17 bp, Homo sapiens
tgataaatttgactgtt

SEQ ID NO: 5319331 - DNA, 12 bp, Homo sapiens
tgataacaaaaa

SEQ ID NO: 5319332 - DNA, 16 bp, Homo sapiens
tgataacaaaaaataa

SEQ ID NO: 5319333 - DNA, 20 bp, Homo sapiens
tgataacaacccaaggcaat

SEQ ID NO: 5319334 - DNA, 22 bp, Homo sapiens
tgataacaacccaaggcaatga

SEQ ID NO: 5319335 - DNA, 23 bp, Homo sapiens
tgataacaacccaaggcaatgat

SEQ ID NO: 5319336 - DNA, 17 bp, Homo sapiens
tgataacaacctggaga

SEQ ID NO: 5319337 - DNA, 23 bp, Homo sapiens
tgataacaagcaaggatatcaga

SEQ ID NO: 5319338 - DNA, 16 bp, Homo sapiens
tgataacactggagtg

SEQ ID NO: 5319339 - DNA, 16 bp, Homo sapiens
tgataacagaactttt

SEQ ID NO: 5319340 - DNA, 15 bp, Homo sapiens
tgataacagctacca

SEQ ID NO: 5319341 - DNA, 23 bp, Homo sapiens
tgataacagctaccatgacaacc

SEQ ID NO: 5319342 - DNA, 15 bp, Homo sapiens
tgataacattttgtt

SEQ ID NO: 5319343 - DNA, 19 bp, Homo sapiens
tgataaccagtaaggaaat

SEQ ID NO: 5319344 - DNA, 23 bp, Homo sapiens
tgataactctgagcagtttcatt

SEQ ID NO: 5319345 - DNA, 23 bp, Homo sapiens
tgataactctgcaaaggcctggg

SEQ ID NO: 5319346 - DNA, 19 bp, Homo sapiens
tgataactgcaattttaat

SEQ ID NO: 5319347 - DNA, 16 bp, Homo sapiens
tgataactggaaactt

SEQ ID NO: 5319348 - DNA, 23 bp, Homo sapiens
tgataacttgttttgacttgaat

SEQ ID NO: 5319349 - DNA, 15 bp, Homo sapiens
tgataactttgcttg

SEQ ID NO: 5319350 - DNA, 14 bp, Homo sapiens
tgataagacatttt

SEQ ID NO: 5319351 - DNA, 15 bp, Homo sapiens
tgataagacattttg

SEQ ID NO: 5319352 - DNA, 17 bp, Homo sapiens
tgataagagaatcaaca

SEQ ID NO: 5319353 - DNA, 12 bp, Homo sapiens
tgataagaggaa

SEQ ID NO: 5319354 - DNA, 14 bp, Homo sapiens
tgataagaggaatt

SEQ ID NO: 5319355 - DNA, 19 bp, Homo sapiens
tgataagaggaatttggta

SEQ ID NO: 5319356 - DNA, 21 bp, Homo sapiens
tgataagagggcacacactgt

SEQ ID NO: 5319357 - DNA, 17 bp, Homo sapiens
tgataagagtgtaacat

SEQ ID NO: 5319358 - DNA, 22 bp, Homo sapiens
tgataagatcttttattttgcc

SEQ ID NO: 5319359 - DNA, 14 bp, Homo sapiens
tgataagatggttt

SEQ ID NO: 5319360 - DNA, 15 bp, Homo sapiens
tgataagatttacct

SEQ ID NO: 5319361 - DNA, 17 bp, Homo sapiens
tgataaggaaactttat

SEQ ID NO: 5319362 - DNA, 19 bp, Homo sapiens
tgataaggaaactttattt

SEQ ID NO: 5319363 - DNA, 13 bp, Homo sapiens
tgataaggaacat

SEQ ID NO: 5319364 - DNA, 14 bp, Homo sapiens
tgataaggaacatt

SEQ ID NO: 5319365 - DNA, 20 bp, Homo sapiens
tgataaggaacatttatcca

SEQ ID NO: 5319366 - DNA, 19 bp, Homo sapiens
tgataagggaaaagataaa

SEQ ID NO: 5319367 - DNA, 15 bp, Homo sapiens
tgataagggagaggg

SEQ ID NO: 5319368 - DNA, 14 bp, Homo sapiens
tgataaggggcctt

SEQ ID NO: 5319369 - DNA, 22 bp, Homo sapiens
tgataaggggccttgctctgag

SEQ ID NO: 5319370 - DNA, 20 bp, Homo sapiens
tgataaggtttagaatgaca

SEQ ID NO: 5319371 - DNA, 14 bp, Homo sapiens
tgataagtaatgaa

SEQ ID NO: 5319372 - DNA, 14 bp, Homo sapiens
tgataagtagcatg

SEQ ID NO: 5319373 - DNA, 12 bp, Homo sapiens
tgataagtggaa

SEQ ID NO: 5319374 - DNA, 13 bp, Homo sapiens
tgataagtggaaa

SEQ ID NO: 5319375 - DNA, 19 bp, Homo sapiens
tgataagttcatacattgt

SEQ ID NO: 5319376 - DNA, 23 bp, Homo sapiens
tgataagttcctttccttttctt

SEQ ID NO: 5319377 - DNA, 21 bp, Homo sapiens
tgataagttgaggaaagaaat

SEQ ID NO: 5319378 - DNA, 17 bp, Homo sapiens
tgataataaaattcatt

SEQ ID NO: 5319379 - DNA, 15 bp, Homo sapiens
tgataataaatgtat

SEQ ID NO: 5319380 - DNA, 15 bp, Homo sapiens
tgataataaattgaa

SEQ ID NO: 5319381 - DNA, 21 bp, Homo sapiens
tgataataatgcctaccttgt

SEQ ID NO: 5319382 - DNA, 15 bp, Homo sapiens
tgataataatgctta

SEQ ID NO: 5319383 - DNA, 22 bp, Homo sapiens
tgataatacagatttgtaacat

SEQ ID NO: 5319384 - DNA, 13 bp, Homo sapiens
tgataatagaaga

SEQ ID NO: 5319385 - DNA, 15 bp, Homo sapiens
tgataatagattctc

SEQ ID NO: 5319386 - DNA, 23 bp, Homo sapiens
tgataataggtgggggaaaatga

SEQ ID NO: 5319387 - DNA, 20 bp, Homo sapiens
tgataatatatacaaacctt

SEQ ID NO: 5319388 - DNA, 23 bp, Homo sapiens
tgataatattagtgattctgatt

SEQ ID NO: 5319389 - DNA, 20 bp, Homo sapiens
tgataatattgtttccctcg

SEQ ID NO: 5319390 - DNA, 14 bp, Homo sapiens
tgataatcaactgg

SEQ ID NO: 5319391 - DNA, 19 bp, Homo sapiens
tgataatcattttgagttt

SEQ ID NO: 5319392 - DNA, 23 bp, Homo sapiens
tgataatcattttgagtttgcct

SEQ ID NO: 5319393 - DNA, 17 bp, Homo sapiens
tgataatcccatactct

SEQ ID NO: 5319394 - DNA, 18 bp, Homo sapiens
tgataatctggtgacaaa

SEQ ID NO: 5319395 - DNA, 21 bp, Homo sapiens
tgataatctggtgacaaatat

SEQ ID NO: 5319396 - DNA, 13 bp, Homo sapiens
tgataatcttcag

SEQ ID NO: 5319397 - DNA, 14 bp, Homo sapiens
tgataatcttcagg

SEQ ID NO: 5319398 - DNA, 22 bp, Homo sapiens
tgataatcttcaggtgaacact

SEQ ID NO: 5319399 - DNA, 16 bp, Homo sapiens
tgataatgaactttat

SEQ ID NO: 5319400 - DNA, 12 bp, Homo sapiens
tgataatgacac

SEQ ID NO: 5319401 - DNA, 16 bp, Homo sapiens
tgataatgacactgtt

SEQ ID NO: 5319402 - DNA, 19 bp, Homo sapiens
tgataatgagttttacatt

SEQ ID NO: 5319403 - DNA, 21 bp, Homo sapiens
tgataatgataaaacacctca

SEQ ID NO: 5319404 - DNA, 17 bp, Homo sapiens
tgataatgatttcctct

SEQ ID NO: 5319405 - DNA, 16 bp, Homo sapiens
tgataatgcagataaa

SEQ ID NO: 5319406 - DNA, 18 bp, Homo sapiens
tgataatgtattgcagtg

SEQ ID NO: 5319407 - DNA, 15 bp, Homo sapiens
tgataatgttaaatt

SEQ ID NO: 5319408 - DNA, 21 bp, Homo sapiens
tgatccagcagattattcact

SEQ ID NO: 5319409 - DNA, 22 bp, Homo sapiens
tgatccagcagattattcactg

SEQ ID NO: 5319410 - DNA, 14 bp, Homo sapiens
tgatccagccctgg

SEQ ID NO: 5319411 - DNA, 16 bp, Homo sapiens
tgatccagccctggtt

SEQ ID NO: 5319412 - DNA, 18 bp, Homo sapiens
tgatccagcctctcccct

SEQ ID NO: 5319413 - DNA, 22 bp, Homo sapiens
tgatccaggaaagatgtcccac

SEQ ID NO: 5319414 - DNA, 16 bp, Homo sapiens
tgatccatccagcttg

SEQ ID NO: 5319415 - DNA, 18 bp, Homo sapiens
tgatccatccatctccag

SEQ ID NO: 5319416 - DNA, 19 bp, Homo sapiens
tgatccatcctgtttttcc

SEQ ID NO: 5319417 - DNA, 12 bp, Homo sapiens
tgatccatgtaa

SEQ ID NO: 5319418 - DNA, 19 bp, Homo sapiens
tgatccatgtaactgccta

SEQ ID NO: 5319419 - DNA, 15 bp, Homo sapiens
tgatccatttctaat

SEQ ID NO: 5319420 - DNA, 16 bp, Homo sapiens
tgatccatttctaatt

SEQ ID NO: 5319421 - DNA, 14 bp, Homo sapiens
tgatccatttgaac

SEQ ID NO: 5319422 - DNA, 17 bp, Homo sapiens
tgatcccaccccctcct

SEQ ID NO: 5319423 - DNA, 22 bp, Homo sapiens
tgatcccaccccctcctccccc

SEQ ID NO: 5319424 - DNA, 15 bp, Homo sapiens
tgatcccacttcact

SEQ ID NO: 5319425 - DNA, 18 bp, Homo sapiens
tgatcccacttcactgtg

SEQ ID NO: 5319426 - DNA, 17 bp, Homo sapiens
tgatcccagacccattc

SEQ ID NO: 5319427 - DNA, 12 bp, Homo sapiens
tgatcccagctc

SEQ ID NO: 5319428 - DNA, 17 bp, Homo sapiens
tgatcccagctcactgc

SEQ ID NO: 5319429 - DNA, 15 bp, Homo sapiens
tgatcccataaagaa

SEQ ID NO: 5319430 - DNA, 16 bp, Homo sapiens
tgatcccataaagaaa

SEQ ID NO: 5319431 - DNA, 17 bp, Homo sapiens
tgatcccataaagaaag

SEQ ID NO: 5319432 - DNA, 20 bp, Homo sapiens
tgatccccaagtggtgaatg

SEQ ID NO: 5319433 - DNA, 18 bp, Homo sapiens
tgatccccaagtgtgaac

SEQ ID NO: 5319434 - DNA, 21 bp, Homo sapiens
tgatcccccaaacagcatgtg

SEQ ID NO: 5319435 - DNA, 23 bp, Homo sapiens
tgatcccggccggccctggcttg

SEQ ID NO: 5319436 - DNA, 17 bp, Homo sapiens
tgatcccgttttcccca

SEQ ID NO: 5319437 - DNA, 21 bp, Homo sapiens
tgatcccgttttccccatgac

SEQ ID NO: 5319438 - DNA, 14 bp, Homo sapiens
tgatccctccaccc

SEQ ID NO: 5319439 - DNA, 14 bp, Homo sapiens
tgatccctctgggg

SEQ ID NO: 5319440 - DNA, 19 bp, Homo sapiens
tgatccctgaacccctggc

SEQ ID NO: 5319441 - DNA, 20 bp, Homo sapiens
tgatccctgaacccctggcc

SEQ ID NO: 5319442 - DNA, 21 bp, Homo sapiens
tgatccctgctctctgagttt

SEQ ID NO: 5319443 - DNA, 20 bp, Homo sapiens
tgatcccttccacctgctct

SEQ ID NO: 5319444 - DNA, 23 bp, Homo sapiens
tgatcccttccacctgctctgct

SEQ ID NO: 5319445 - DNA, 13 bp, Homo sapiens
tgatcccttcccc

SEQ ID NO: 5319446 - DNA, 19 bp, Homo sapiens
tgatcccttctcctgccct

SEQ ID NO: 5319447 - DNA, 21 bp, Homo sapiens
tgatccgcccacctcagcctc

SEQ ID NO: 5319448 - DNA, 12 bp, Homo sapiens
tgatccgcctgc

SEQ ID NO: 5319449 - DNA, 17 bp, Homo sapiens
tgatccgcctgcctctg

SEQ ID NO: 5319450 - DNA, 23 bp, Homo sapiens
tgatccgcctgcctctgcctccc

SEQ ID NO: 5319451 - DNA, 21 bp, Homo sapiens
tgatccggctgctcctccagc

SEQ ID NO: 5319452 - DNA, 18 bp, Homo sapiens
tgatccgtccgaggctgc

SEQ ID NO: 5319453 - DNA, 22 bp, Homo sapiens
tgatccgttccattgcaagctt

SEQ ID NO: 5319454 - DNA, 17 bp, Homo sapiens
tgatcctaaaattgttt

SEQ ID NO: 5319455 - DNA, 17 bp, Homo sapiens
tgatcctaaccctgggc

SEQ ID NO: 5319456 - DNA, 18 bp, Homo sapiens
tgatcctaaccctgggct

SEQ ID NO: 5319457 - DNA, 21 bp, Homo sapiens
tgatcctcagcccctccagtc

SEQ ID NO: 5319458 - DNA, 22 bp, Homo sapiens
tgatcctcagtgcaaaatgtct

SEQ ID NO: 5319459 - DNA, 18 bp, Homo sapiens
tgatcctcatatggccca

SEQ ID NO: 5319460 - DNA, 14 bp, Homo sapiens
tgatcctccaatgt

SEQ ID NO: 5319461 - DNA, 15 bp, Homo sapiens
tgatcctccaatgtc

SEQ ID NO: 5319462 - DNA, 16 bp, Homo sapiens
tgatcctccaatgtct

SEQ ID NO: 5319463 - DNA, 19 bp, Homo sapiens
tgatcctccaatgtctaat

SEQ ID NO: 5319464 - DNA, 16 bp, Homo sapiens
tgatcctcccacctca

SEQ ID NO: 5319465 - DNA, 20 bp, Homo sapiens
tgatcctcccacctcagcct

SEQ ID NO: 5319466 - DNA, 19 bp, Homo sapiens
tgatcctcccgccccagcc

SEQ ID NO: 5319467 - DNA, 22 bp, Homo sapiens
tgatcctcccgccccagcctcc

SEQ ID NO: 5319468 - DNA, 24 bp, Homo sapiens
tgatcctcccgccccagcctcctg

SEQ ID NO: 5319469 - DNA, 18 bp, Homo sapiens
tgatcctctactgtgcat

SEQ ID NO: 5319470 - DNA, 14 bp, Homo sapiens
tgatcctctatttt

SEQ ID NO: 5319471 - DNA, 19 bp, Homo sapiens
tgatcctgaacaagaaaga

SEQ ID NO: 5319472 - DNA, 22 bp, Homo sapiens
tgatcctgaacaagaaagagta

SEQ ID NO: 5319473 - DNA, 15 bp, Homo sapiens
tgatcctgctccagc

SEQ ID NO: 5319474 - DNA, 20 bp, Homo sapiens
tgatcctgctgacctcactg

SEQ ID NO: 5319475 - DNA, 17 bp, Homo sapiens
tgatcctggaggcccag

SEQ ID NO: 5319476 - DNA, 23 bp, Homo sapiens
tgatcctggaggtcttttctagt

SEQ ID NO: 5319477 - DNA, 18 bp, Homo sapiens
tgatcctgttctgcgctg

SEQ ID NO: 5319478 - DNA, 15 bp, Homo sapiens
tgatccttacaagtt

SEQ ID NO: 5319479 - DNA, 15 bp, Homo sapiens
tgatccttcaactct

SEQ ID NO: 5319480 - DNA, 18 bp, Homo sapiens
tgatccttccacctcagt

SEQ ID NO: 5319481 - DNA, 22 bp, Homo sapiens
tgatccttctgagctccacctc

SEQ ID NO: 5319482 - DNA, 18 bp, Homo sapiens
tgatccttgcacagacaa

SEQ ID NO: 5319483 - DNA, 17 bp, Homo sapiens
tgatccttggtgctgtg

SEQ ID NO: 5319484 - DNA, 23 bp, Homo sapiens
tgatccttttttgtcattttatg

SEQ ID NO: 5319485 - DNA, 17 bp, Homo sapiens
tgatcgaaaaaataatt

SEQ ID NO: 5319486 - DNA, 15 bp, Homo sapiens
tgatcgagccactgc

SEQ ID NO: 5319487 - DNA, 16 bp, Homo sapiens
tgatcgagccactgca

SEQ ID NO: 5319488 - DNA, 21 bp, Homo sapiens
tgatcgatgattcaggtgcag

SEQ ID NO: 5319489 - DNA, 19 bp, Homo sapiens
tgatcgatgttaaacgtca

SEQ ID NO: 5319490 - DNA, 18 bp, Homo sapiens
tgatcgcccgataaagac

SEQ ID NO: 5319491 - DNA, 19 bp, Homo sapiens
tgatcgcccgataaagacg

SEQ ID NO: 5319492 - DNA, 23 bp, Homo sapiens
tgatcgccttatttatattcatc

SEQ ID NO: 5319493 - DNA, 14 bp, Homo sapiens
tgatcgccttcccc

SEQ ID NO: 5319494 - DNA, 15 bp, Homo sapiens
tgatcgcttggttat

SEQ ID NO: 5319495 - DNA, 23 bp, Homo sapiens
tgatcgcttttaataaactgcaa

SEQ ID NO: 5319496 - DNA, 16 bp, Homo sapiens
tgatcggaaagctctt

SEQ ID NO: 5319497 - DNA, 23 bp, Homo sapiens
tgatcgggataacaaaatcacaa

SEQ ID NO: 5319498 - DNA, 20 bp, Homo sapiens
tgatcgtagaaaatttgctt

SEQ ID NO: 5319499 - DNA, 21 bp, Homo sapiens
tgatcgtctcggcccctctga

SEQ ID NO: 5319500 - DNA, 23 bp, Homo sapiens
tgatcgtgacgctgaataaatgt

SEQ ID NO: 5319501 - DNA, 15 bp, Homo sapiens
tgatcgtgctaaatt

SEQ ID NO: 5319502 - DNA, 22 bp, Homo sapiens
tgatcgtgctaaattttcagta

SEQ ID NO: 5319503 - DNA, 14 bp, Homo sapiens
tgatctaaaatttg

SEQ ID NO: 5319504 - DNA, 17 bp, Homo sapiens
tgatctaaggaccccag

SEQ ID NO: 5319505 - DNA, 16 bp, Homo sapiens
tgatctaaggcatgct

SEQ ID NO: 5319506 - DNA, 12 bp, Homo sapiens
tgatctaataaa

SEQ ID NO: 5319507 - DNA, 15 bp, Homo sapiens
tgatctaataaactt

SEQ ID NO: 5319508 - DNA, 18 bp, Homo sapiens
tgatctaatacaaagatg

SEQ ID NO: 5319509 - DNA, 21 bp, Homo sapiens
tgatctaatgaagtgtttcct

SEQ ID NO: 5319510 - DNA, 19 bp, Homo sapiens
tgatctacccgtgcctggg

SEQ ID NO: 5319511 - DNA, 22 bp, Homo sapiens
tgatctacttcatagctccttg

SEQ ID NO: 5319512 - DNA, 23 bp, Homo sapiens
tgatctacttcatagctccttgg

SEQ ID NO: 5319513 - DNA, 20 bp, Homo sapiens
tgatctacttctgtaattgt

SEQ ID NO: 5319514 - DNA, 19 bp, Homo sapiens
tgatctacttgcctcattt

SEQ ID NO: 5319515 - DNA, 13 bp, Homo sapiens
tgatctagataca

SEQ ID NO: 5319516 - DNA, 20 bp, Homo sapiens
tgatctaggtttaactcaga

SEQ ID NO: 5319517 - DNA, 22 bp, Homo sapiens
tgatctaggtttaactcagatc

SEQ ID NO: 5319518 - DNA, 22 bp, Homo sapiens
tgatctagtccttgtcttgtaa

SEQ ID NO: 5319519 - DNA, 21 bp, Homo sapiens
tgatctatagatgacctagaa

SEQ ID NO: 5319520 - DNA, 11 bp, Homo sapiens
tgatctattgc

SEQ ID NO: 5319521 - DNA, 14 bp, Homo sapiens
tgatctattgctca

SEQ ID NO: 5319522 - DNA, 16 bp, Homo sapiens
tgatctcaaatccact

SEQ ID NO: 5319523 - DNA, 15 bp, Homo sapiens
tgatctcaagtatat

SEQ ID NO: 5319524 - DNA, 18 bp, Homo sapiens
tgatctcagcatcctgga

SEQ ID NO: 5319525 - DNA, 19 bp, Homo sapiens
tgatctcagctcactgcaa

SEQ ID NO: 5319526 - DNA, 14 bp, Homo sapiens
tgatctcaggagct

SEQ ID NO: 5319527 - DNA, 12 bp, Homo sapiens
tgatctcaggga

SEQ ID NO: 5319528 - DNA, 16 bp, Homo sapiens
tgatctcagggaagcc

SEQ ID NO: 5319529 - DNA, 14 bp, Homo sapiens
tgatctcagggcag

SEQ ID NO: 5319530 - DNA, 23 bp, Homo sapiens
tgatctcatcccaataaaatgat

SEQ ID NO: 5319531 - DNA, 22 bp, Homo sapiens
tgatctcatttaatcctctcaa

SEQ ID NO: 5319532 - DNA, 17 bp, Homo sapiens
tgatctccatggcttcc

SEQ ID NO: 5319533 - DNA, 15 bp, Homo sapiens
tgatctccctgccgc

SEQ ID NO: 5319534 - DNA, 16 bp, Homo sapiens
tgatctccctgccgcc

SEQ ID NO: 5319535 - DNA, 17 bp, Homo sapiens
tgatctccctgccgcct

SEQ ID NO: 5319536 - DNA, 18 bp, Homo sapiens
tgatctcccttggtcttc

SEQ ID NO: 5319537 - DNA, 20 bp, Homo sapiens
tgatctcccttggtcttcca

SEQ ID NO: 5319538 - DNA, 12 bp, Homo sapiens
tgatctcctgag

SEQ ID NO: 5319539 - DNA, 13 bp, Homo sapiens
tgatctcctgagc

SEQ ID NO: 5319540 - DNA, 18 bp, Homo sapiens
tgatctcctggtagcatg

SEQ ID NO: 5319541 - DNA, 19 bp, Homo sapiens
tgatctcctggtagcatga

SEQ ID NO: 5319542 - DNA, 23 bp, Homo sapiens
tgatctcctgtggctcatcggtg

SEQ ID NO: 5319543 - DNA, 17 bp, Homo sapiens
tgatctcggatgaccaa

SEQ ID NO: 5319544 - DNA, 14 bp, Homo sapiens
tgatctcggctcac

SEQ ID NO: 5319545 - DNA, 16 bp, Homo sapiens
tgatctcggctcactg

SEQ ID NO: 5319546 - DNA, 18 bp, Homo sapiens
tgatctcggctcactgca

SEQ ID NO: 5319547 - DNA, 20 bp, Homo sapiens
tgatctcggctcactgcaaa

SEQ ID NO: 5319548 - DNA, 14 bp, Homo sapiens
tgatctcggctcat

SEQ ID NO: 5319549 - DNA, 23 bp, Homo sapiens
tgatctctactaccacaaggaaa

SEQ ID NO: 5319550 - DNA, 12 bp, Homo sapiens
tgatctctccac

SEQ ID NO: 5319551 - DNA, 17 bp, Homo sapiens
tgatctctcgtgattga

SEQ ID NO: 5319552 - DNA, 16 bp, Homo sapiens
tgatctctcttgtcct

SEQ ID NO: 5319553 - DNA, 19 bp, Homo sapiens
tgatctctgacctctgctg

SEQ ID NO: 5319554 - DNA, 21 bp, Homo sapiens
tgatctctgttacaaaagaaa

SEQ ID NO: 5319555 - DNA, 15 bp, Homo sapiens
tgatctcttagaagc

SEQ ID NO: 5319556 - DNA, 20 bp, Homo sapiens
tgatctcttctggtgttgac

SEQ ID NO: 5319557 - DNA, 19 bp, Homo sapiens
tgatctgattttttattca

SEQ ID NO: 5319558 - DNA, 18 bp, Homo sapiens
tgatctgcctgccttggt

SEQ ID NO: 5319559 - DNA, 18 bp, Homo sapiens
tgatctgctcagccctgg

SEQ ID NO: 5319560 - DNA, 20 bp, Homo sapiens
tgatctgctcagccctggag

SEQ ID NO: 5319561 - DNA, 12 bp, Homo sapiens
tgatctgctctg

SEQ ID NO: 5319562 - DNA, 18 bp, Homo sapiens
tgatctggacagaacatt

SEQ ID NO: 5319563 - DNA, 15 bp, Homo sapiens
tgatctggacttcct

SEQ ID NO: 5319564 - DNA, 12 bp, Homo sapiens
tgatctggccca

SEQ ID NO: 5319565 - DNA, 24 bp, Homo sapiens
tgatctggccctccccagaacaat

SEQ ID NO: 5319566 - DNA, 22 bp, Homo sapiens
tgatctgggaactcccaagaac

SEQ ID NO: 5319567 - DNA, 17 bp, Homo sapiens
tgatctgggtctctaat

SEQ ID NO: 5319568 - DNA, 22 bp, Homo sapiens
tgatctggtgcgtgtggccctg

SEQ ID NO: 5319569 - DNA, 18 bp, Homo sapiens
tgatctggtggtctcctc

SEQ ID NO: 5319570 - DNA, 14 bp, Homo sapiens
tgatctgtactttg

SEQ ID NO: 5319571 - DNA, 16 bp, Homo sapiens
tgatctgtactttgtg

SEQ ID NO: 5319572 - DNA, 19 bp, Homo sapiens
tgatctgtataaaaatgta

SEQ ID NO: 5319573 - DNA, 22 bp, Homo sapiens
tgatctgtatatacaataacat

SEQ ID NO: 5319574 - DNA, 23 bp, Homo sapiens
tgatctgtatttaatggttttta

SEQ ID NO: 5319575 - DNA, 15 bp, Homo sapiens
tgatctgtcatccat

SEQ ID NO: 5319576 - DNA, 13 bp, Homo sapiens
tgatctgtcccct

SEQ ID NO: 5319577 - DNA, 15 bp, Homo sapiens
tgatctgtccttcca

SEQ ID NO: 5319578 - DNA, 13 bp, Homo sapiens
tgatctgtcttgt

SEQ ID NO: 5319579 - DNA, 18 bp, Homo sapiens
tgatctgtgatttcttct

SEQ ID NO: 5319580 - DNA, 12 bp, Homo sapiens
tgatctgtgcag

SEQ ID NO: 5319581 - DNA, 14 bp, Homo sapiens
tgatctgtgcaggg

SEQ ID NO: 5319582 - DNA, 20 bp, Homo sapiens
tgatctgtgcagggtattaa

SEQ ID NO: 5319583 - DNA, 12 bp, Homo sapiens
tgatctgtgctt

SEQ ID NO: 5319584 - DNA, 17 bp, Homo sapiens
tgatgtacagattcttt

SEQ ID NO: 5319585 - DNA, 16 bp, Homo sapiens
tgatgtacagatttta

SEQ ID NO: 5319586 - DNA, 16 bp, Homo sapiens
tgatgtacagtctgtc

SEQ ID NO: 5319587 - DNA, 11 bp, Homo sapiens
tgatgtacatg

SEQ ID NO: 5319588 - DNA, 13 bp, Homo sapiens
tgatgtacatgtg

SEQ ID NO: 5319589 - DNA, 18 bp, Homo sapiens
tgatgtaccatgaaacaa

SEQ ID NO: 5319590 - DNA, 18 bp, Homo sapiens
tgatgtacgctgcgtgcc

SEQ ID NO: 5319591 - DNA, 12 bp, Homo sapiens
tgatgtactgta

SEQ ID NO: 5319592 - DNA, 16 bp, Homo sapiens
tgatgtagacatttta

SEQ ID NO: 5319593 - DNA, 13 bp, Homo sapiens
tgatgtaggagct

SEQ ID NO: 5319594 - DNA, 18 bp, Homo sapiens
tgatgtagtgcctctttc

SEQ ID NO: 5319595 - DNA, 15 bp, Homo sapiens
tgatgtagttttctt

SEQ ID NO: 5319596 - DNA, 13 bp, Homo sapiens
tgatgtataatgt

SEQ ID NO: 5319597 - DNA, 20 bp, Homo sapiens
tgatgtataatgtaatgttt

SEQ ID NO: 5319598 - DNA, 16 bp, Homo sapiens
tgatgtatacatctta

SEQ ID NO: 5319599 - DNA, 14 bp, Homo sapiens
tgatgtatatgttt

SEQ ID NO: 5319600 - DNA, 22 bp, Homo sapiens
tgatgtatatttaattaaagca

SEQ ID NO: 5319601 - DNA, 19 bp, Homo sapiens
tgatgtatggtatctttag

SEQ ID NO: 5319602 - DNA, 16 bp, Homo sapiens
tgatgtatgtaataca

SEQ ID NO: 5319603 - DNA, 11 bp, Homo sapiens
tgatgtatgtg

SEQ ID NO: 5319604 - DNA, 14 bp, Homo sapiens
tgatgtatgtgtga

SEQ ID NO: 5319605 - DNA, 15 bp, Homo sapiens
tgatgtatgtgtgaa

SEQ ID NO: 5319606 - DNA, 21 bp, Homo sapiens
tgatgtatgtgtgaaacaatg

SEQ ID NO: 5319607 - DNA, 20 bp, Homo sapiens
tgatgtattattatatatgt

SEQ ID NO: 5319608 - DNA, 20 bp, Homo sapiens
tgatgtattctagctaatgt

SEQ ID NO: 5319609 - DNA, 14 bp, Homo sapiens
tgatgtattctgtg

SEQ ID NO: 5319610 - DNA, 17 bp, Homo sapiens
tgatgtattttcatagt

SEQ ID NO: 5319611 - DNA, 19 bp, Homo sapiens
tgatgtcacagtttgttca

SEQ ID NO: 5319612 - DNA, 18 bp, Homo sapiens
tgatgtcacatcttggca

SEQ ID NO: 5319613 - DNA, 23 bp, Homo sapiens
tgatgtcagcagttgctggtaaa

SEQ ID NO: 5319614 - DNA, 15 bp, Homo sapiens
tgatgtcagccttgc

SEQ ID NO: 5319615 - DNA, 18 bp, Homo sapiens
tgatgtcagccttgcatc

SEQ ID NO: 5319616 - DNA, 17 bp, Homo sapiens
tgatgtcagtatttcaa

SEQ ID NO: 5319617 - DNA, 22 bp, Homo sapiens
tgatgtcataataaagttgttt

SEQ ID NO: 5319618 - DNA, 16 bp, Homo sapiens
tgatgtcatacagaga

SEQ ID NO: 5319619 - DNA, 17 bp, Homo sapiens
tgatgtcatacagagaa

SEQ ID NO: 5319620 - DNA, 19 bp, Homo sapiens
tgatgtcatacagagaagt

SEQ ID NO: 5319621 - DNA, 21 bp, Homo sapiens
tgatgtcatatcatttcactg

SEQ ID NO: 5319622 - DNA, 15 bp, Homo sapiens
tgatgtcatgaaact

SEQ ID NO: 5319623 - DNA, 15 bp, Homo sapiens
tgatgtcatgtactt

SEQ ID NO: 5319624 - DNA, 13 bp, Homo sapiens
tgatgtcatgtgt

SEQ ID NO: 5319625 - DNA, 17 bp, Homo sapiens
tgatgtcattaatgtgt

SEQ ID NO: 5319626 - DNA, 19 bp, Homo sapiens
tgatgtccagggggagaag

SEQ ID NO: 5319627 - DNA, 15 bp, Homo sapiens
tgatgtccatttgtc

SEQ ID NO: 5319628 - DNA, 23 bp, Homo sapiens
tgatgtcccaccacagtccctca

SEQ ID NO: 5319629 - DNA, 15 bp, Homo sapiens
tgatgtccccaaagt

SEQ ID NO: 5319630 - DNA, 20 bp, Homo sapiens
tgatgtccctccttttcacg

SEQ ID NO: 5319631 - DNA, 13 bp, Homo sapiens
tgatgtccttgga

SEQ ID NO: 5319632 - DNA, 17 bp, Homo sapiens
tgatgtctacagaaaat

SEQ ID NO: 5319633 - DNA, 21 bp, Homo sapiens
tgatgtctacagaaaatgctg

SEQ ID NO: 5319634 - DNA, 16 bp, Homo sapiens
tgatgtctagataaca

SEQ ID NO: 5319635 - DNA, 18 bp, Homo sapiens
tgatgtctagataacatt

SEQ ID NO: 5319636 - DNA, 22 bp, Homo sapiens
tgatgtctccaagtagtccacc

SEQ ID NO: 5319637 - DNA, 17 bp, Homo sapiens
tgatgtctcttgtagaa

SEQ ID NO: 5319638 - DNA, 18 bp, Homo sapiens
tgatgtcttttcttggca

SEQ ID NO: 5319639 - DNA, 23 bp, Homo sapiens
tgatgtgaaaagcacagctgtat

SEQ ID NO: 5319640 - DNA, 20 bp, Homo sapiens
tgatgtgaaagataaatgat

SEQ ID NO: 5319641 - DNA, 18 bp, Homo sapiens
tgatgtgaagagtttcac

SEQ ID NO: 5319642 - DNA, 20 bp, Homo sapiens
tgatgtgaagagtttcacaa

SEQ ID NO: 5319643 - DNA, 21 bp, Homo sapiens
tgatgtgaagataatttgcat

SEQ ID NO: 5319644 - DNA, 15 bp, Homo sapiens
tgatgtgaattattt

SEQ ID NO: 5319645 - DNA, 17 bp, Homo sapiens
tgatgtgacaataatat

SEQ ID NO: 5319646 - DNA, 18 bp, Homo sapiens
tgatgtgacatttgtcat

SEQ ID NO: 5319647 - DNA, 15 bp, Homo sapiens
tgatgtgacttttat

SEQ ID NO: 5319648 - DNA, 13 bp, Homo sapiens
tgatgtgatttat

SEQ ID NO: 5319649 - DNA, 18 bp, Homo sapiens
tgatgtgatttatgcatt

SEQ ID NO: 5319650 - DNA, 21 bp, Homo sapiens
tgatgtgcaaaaatttttgga

SEQ ID NO: 5319651 - DNA, 22 bp, Homo sapiens
tgatgtgcaaaaatttttggat

SEQ ID NO: 5319652 - DNA, 20 bp, Homo sapiens
tgatgtgcctaaataagtta

SEQ ID NO: 5319653 - DNA, 22 bp, Homo sapiens
tgatgtgctggagctggctttg

SEQ ID NO: 5319654 - DNA, 22 bp, Homo sapiens
tgatgtggaggaagagccacct

SEQ ID NO: 5319655 - DNA, 16 bp, Homo sapiens
tgatgtggcaactgct

SEQ ID NO: 5319656 - DNA, 18 bp, Homo sapiens
tgatgtgggaagaagtaa

SEQ ID NO: 5319657 - DNA, 16 bp, Homo sapiens
tgatgtggtgaaaagc

SEQ ID NO: 5319658 - DNA, 20 bp, Homo sapiens
tgatgtggtgaggcaggctt

SEQ ID NO: 5319659 - DNA, 15 bp, Homo sapiens
tgatgtggtgcctga

SEQ ID NO: 5319660 - DNA, 16 bp, Homo sapiens
tgatgtggtgcctgag

SEQ ID NO: 5319661 - DNA, 18 bp, Homo sapiens
tgatgtgtcctgtacaca

SEQ ID NO: 5319662 - DNA, 14 bp, Homo sapiens
tgatgtgtgaaacc

SEQ ID NO: 5319663 - DNA, 17 bp, Homo sapiens
tgatgtgtgaaacctga

SEQ ID NO: 5319664 - DNA, 17 bp, Homo sapiens
tgatgtgtgtgtgtctc

SEQ ID NO: 5319665 - DNA, 22 bp, Homo sapiens
tgatgtgttgttcttggcaata

SEQ ID NO: 5319666 - DNA, 18 bp, Homo sapiens
tgatgtgtttatttatag

SEQ ID NO: 5319667 - DNA, 13 bp, Homo sapiens
tgatgttaaaaaa

SEQ ID NO: 5319668 - DNA, 15 bp, Homo sapiens
tgatgttaaagcatt

SEQ ID NO: 5319669 - DNA, 10 bp, Homo sapiens
tgatgttaac

SEQ ID NO: 5319670 - DNA, 15 bp, Homo sapiens
tgatgttaacacatt

SEQ ID NO: 5319671 - DNA, 22 bp, Homo sapiens
tgatgttaacacattttgtata

SEQ ID NO: 5319672 - DNA, 20 bp, Homo sapiens
tgatgttaactttgtggtct

SEQ ID NO: 5319673 - DNA, 15 bp, Homo sapiens
tgatgttactgagat

SEQ ID NO: 5319674 - DNA, 15 bp, Homo sapiens
tgatgttagaagaag

SEQ ID NO: 5319675 - DNA, 16 bp, Homo sapiens
tgatgttagcagaccc

SEQ ID NO: 5319676 - DNA, 16 bp, Homo sapiens
tgatgttatagaatta

SEQ ID NO: 5319677 - DNA, 19 bp, Homo sapiens
tgatgttattttgtacgtg

SEQ ID NO: 5319678 - DNA, 18 bp, Homo sapiens
tgatgttcagtgtaattt

SEQ ID NO: 5319679 - DNA, 20 bp, Homo sapiens
tgatgttcagtgtaatttct

SEQ ID NO: 5319680 - DNA, 21 bp, Homo sapiens
tgatgttcagtgtaatttctt

SEQ ID NO: 5319681 - DNA, 16 bp, Homo sapiens
tgatgttccacctgcc

SEQ ID NO: 5319682 - DNA, 17 bp, Homo sapiens
tgatgttccacctgcca

SEQ ID NO: 5319683 - DNA, 12 bp, Homo sapiens
tgatgttctaag

SEQ ID NO: 5319684 - DNA, 17 bp, Homo sapiens
tgatgttctaaggctct

SEQ ID NO: 5319685 - DNA, 18 bp, Homo sapiens
tgatgttctaaggctctg

SEQ ID NO: 5319686 - DNA, 19 bp, Homo sapiens
tgatgttctaaggctctga

SEQ ID NO: 5319687 - DNA, 16 bp, Homo sapiens
tgatgttgagctgagt

SEQ ID NO: 5319688 - DNA, 18 bp, Homo sapiens
tgatgttgataatagtaa

SEQ ID NO: 5319689 - DNA, 13 bp, Homo sapiens
tgatgttggaaga

SEQ ID NO: 5319690 - DNA, 17 bp, Homo sapiens
tgatgttgggaagctat

SEQ ID NO: 5319691 - DNA, 22 bp, Homo sapiens
tgatgttgggaagctatttcct

SEQ ID NO: 5319692 - DNA, 16 bp, Homo sapiens
tgatgttgtgttgtta

SEQ ID NO: 5319693 - DNA, 17 bp, Homo sapiens
tgatgttgtgttgttat

SEQ ID NO: 5319694 - DNA, 18 bp, Homo sapiens
tgatgttgtttaacataa

SEQ ID NO: 5319695 - DNA, 11 bp, Homo sapiens
tgatgtttaaa

SEQ ID NO: 5319696 - DNA, 15 bp, Homo sapiens
tgatgtttaaagaga

SEQ ID NO: 5319697 - DNA, 12 bp, Homo sapiens
tgatgtttacat

SEQ ID NO: 5319698 - DNA, 22 bp, Homo sapiens
tgatgtttagaaacacaactat

SEQ ID NO: 5319699 - DNA, 19 bp, Homo sapiens
tgatgtttataaactgaga

SEQ ID NO: 5319700 - DNA, 15 bp, Homo sapiens
tgatgtttccagaaa

SEQ ID NO: 5319701 - DNA, 20 bp, Homo sapiens
tgatgtttccagaaaatata

SEQ ID NO: 5319702 - DNA, 17 bp, Homo sapiens
tgatgtttccctctcct

SEQ ID NO: 5319703 - DNA, 13 bp, Homo sapiens
tgatgtttcctgg

SEQ ID NO: 5319704 - DNA, 14 bp, Homo sapiens
tgatgtttctgtga

SEQ ID NO: 5319705 - DNA, 19 bp, Homo sapiens
tgatgtttgcccaaaattt

SEQ ID NO: 5319706 - DNA, 13 bp, Homo sapiens
tgatgtttgctct

SEQ ID NO: 5319707 - DNA, 11 bp, Homo sapiens
tgatgtttgtg

SEQ ID NO: 5319708 - DNA, 17 bp, Homo sapiens
tgatgtttgtggcctca

SEQ ID NO: 5319709 - DNA, 18 bp, Homo sapiens
tgatgtttgtggcctcag

SEQ ID NO: 5319710 - DNA, 20 bp, Homo sapiens
tgatgttttacgtgcaaaca

SEQ ID NO: 5319711 - DNA, 18 bp, Homo sapiens
tgatgttttatttgcact

SEQ ID NO: 5319712 - DNA, 12 bp, Homo sapiens
tgatgttttcag

SEQ ID NO: 5319713 - DNA, 17 bp, Homo sapiens
tgatgttttcaggtgtc

SEQ ID NO: 5319714 - DNA, 17 bp, Homo sapiens
tgatgttttccatgagt

SEQ ID NO: 5319715 - DNA, 13 bp, Homo sapiens
tgatgttttctaa

SEQ ID NO: 5319716 - DNA, 17 bp, Homo sapiens
tgatgttttgatattta

SEQ ID NO: 5319717 - DNA, 14 bp, Homo sapiens
tgatgttttgccgt

SEQ ID NO: 5319718 - DNA, 15 bp, Homo sapiens
tgatgttttgttcaa

SEQ ID NO: 5319719 - DNA, 18 bp, Homo sapiens
tgatgtttttaaaatctt

SEQ ID NO: 5319720 - DNA, 17 bp, Homo sapiens
tgatgttttttctgtaa

SEQ ID NO: 5319721 - DNA, 18 bp, Homo sapiens
tgatgttttttctgtaat

SEQ ID NO: 5319722 - DNA, 15 bp, Homo sapiens
tgattaaaaatatca

SEQ ID NO: 5319723 - DNA, 22 bp, Homo sapiens
tgattaaaaatatcaaattaat

SEQ ID NO: 5319724 - DNA, 13 bp, Homo sapiens
tgattaaaaatgt

SEQ ID NO: 5319725 - DNA, 14 bp, Homo sapiens
tgattaaaatgagt

SEQ ID NO: 5319726 - DNA, 16 bp, Homo sapiens
tgattaaaatgagttt

SEQ ID NO: 5319727 - DNA, 18 bp, Homo sapiens
tgattaaaattcaggaag

SEQ ID NO: 5319728 - DNA, 12 bp, Homo sapiens
tgattaaacacc

SEQ ID NO: 5319729 - DNA, 14 bp, Homo sapiens
tgattaaacacctg

SEQ ID NO: 5319730 - DNA, 15 bp, Homo sapiens
tgattaaacacctga

SEQ ID NO: 5319731 - DNA, 21 bp, Homo sapiens
tgattaaacacctgacacatc

SEQ ID NO: 5319732 - DNA, 20 bp, Homo sapiens
tgattaaacagcaaagccat

SEQ ID NO: 5319733 - DNA, 12 bp, Homo sapiens
tgattaaaccaa

SEQ ID NO: 5319734 - DNA, 19 bp, Homo sapiens
tgattaaactgggaaatga

SEQ ID NO: 5319735 - DNA, 13 bp, Homo sapiens
tgattaaagaaaa

SEQ ID NO: 5319736 - DNA, 16 bp, Homo sapiens
tgattaaagactgtga

SEQ ID NO: 5319737 - DNA, 15 bp, Homo sapiens
tgattaaagatgagc

SEQ ID NO: 5319738 - DNA, 23 bp, Homo sapiens
tgattaaaggcagcatttgatga

SEQ ID NO: 5319739 - DNA, 20 bp, Homo sapiens
tgattaaagtgccttcagcc

SEQ ID NO: 5319740 - DNA, 17 bp, Homo sapiens
tgattaaataagattct

SEQ ID NO: 5319741 - DNA, 22 bp, Homo sapiens
tgattaaataagattctaacgg

SEQ ID NO: 5319742 - DNA, 12 bp, Homo sapiens
tgattaaatctc

SEQ ID NO: 5319743 - DNA, 19 bp, Homo sapiens
tgattaaatgtctgacaca

SEQ ID NO: 5319744 - DNA, 16 bp, Homo sapiens
tgattaacaaataaat

SEQ ID NO: 5319745 - DNA, 14 bp, Homo sapiens
tgattaacaatgta

SEQ ID NO: 5319746 - DNA, 15 bp, Homo sapiens
tgattaacaatgtat

SEQ ID NO: 5319747 - DNA, 19 bp, Homo sapiens
tgattaacaatgtatttta

SEQ ID NO: 5319748 - DNA, 14 bp, Homo sapiens
tgattaacagagag

SEQ ID NO: 5319749 - DNA, 17 bp, Homo sapiens
tgattaaccttttcaaa

SEQ ID NO: 5319750 - DNA, 18 bp, Homo sapiens
tgattaaccttttcaaat

SEQ ID NO: 5319751 - DNA, 19 bp, Homo sapiens
tgattaaccttttcaaatt

SEQ ID NO: 5319752 - DNA, 14 bp, Homo sapiens
tgattaactcttag

SEQ ID NO: 5319753 - DNA, 21 bp, Homo sapiens
tgattaactgtgaataataaa

SEQ ID NO: 5319754 - DNA, 16 bp, Homo sapiens
tgattaacttatactg

SEQ ID NO: 5319755 - DNA, 13 bp, Homo sapiens
tgattaacttgga

SEQ ID NO: 5319756 - DNA, 14 bp, Homo sapiens
tgattaacttggat

SEQ ID NO: 5319757 - DNA, 13 bp, Homo sapiens
tgattaagaaagg

SEQ ID NO: 5319758 - DNA, 16 bp, Homo sapiens
tgattaagaaaggaag

SEQ ID NO: 5319759 - DNA, 20 bp, Homo sapiens
tgattaaggactacagaatt

SEQ ID NO: 5319760 - DNA, 13 bp, Homo sapiens
tgattaaggcagt

SEQ ID NO: 5319761 - DNA, 17 bp, Homo sapiens
tgattaaggcagtacaa

SEQ ID NO: 5319762 - DNA, 18 bp, Homo sapiens
tgattaagggacatttct

SEQ ID NO: 5319763 - DNA, 18 bp, Homo sapiens
tgattaaggtcctgcttg

SEQ ID NO: 5319764 - DNA, 20 bp, Homo sapiens
tgatttcccccctccgcctc

SEQ ID NO: 5319765 - DNA, 17 bp, Homo sapiens
tgatttccgtcatgctc

SEQ ID NO: 5319766 - DNA, 22 bp, Homo sapiens
tgatttccgttaaaataccagc

SEQ ID NO: 5319767 - DNA, 14 bp, Homo sapiens
tgatttcctaaaca

SEQ ID NO: 5319768 - DNA, 15 bp, Homo sapiens
tgatttcctaaacat

SEQ ID NO: 5319769 - DNA, 22 bp, Homo sapiens
tgatttcctaaacataattgtg

SEQ ID NO: 5319770 - DNA, 17 bp, Homo sapiens
tgatttcctcccaaagt

SEQ ID NO: 5319771 - DNA, 18 bp, Homo sapiens
tgatttcctctaaagaaa

SEQ ID NO: 5319772 - DNA, 16 bp, Homo sapiens
tgatttccttcaatgt

SEQ ID NO: 5319773 - DNA, 23 bp, Homo sapiens
tgatttccttgaatgtggcttga

SEQ ID NO: 5319774 - DNA, 22 bp, Homo sapiens
tgatttcgatgtacagtctcaa

SEQ ID NO: 5319775 - DNA, 18 bp, Homo sapiens
tgatttctaagtgtttca

SEQ ID NO: 5319776 - DNA, 12 bp, Homo sapiens
tgatttctaatt

SEQ ID NO: 5319777 - DNA, 22 bp, Homo sapiens
tgatttctaattgtaagtgaaa

SEQ ID NO: 5319778 - DNA, 17 bp, Homo sapiens
tgatttctacaactgat

SEQ ID NO: 5319779 - DNA, 13 bp, Homo sapiens
tgatttctagaac

SEQ ID NO: 5319780 - DNA, 19 bp, Homo sapiens
tgatttctagtatctattg

SEQ ID NO: 5319781 - DNA, 12 bp, Homo sapiens
tgatttctatgc

SEQ ID NO: 5319782 - DNA, 15 bp, Homo sapiens
tgatttctatggctt

SEQ ID NO: 5319783 - DNA, 16 bp, Homo sapiens
tgatttctatggcttt

SEQ ID NO: 5319784 - DNA, 18 bp, Homo sapiens
tgatttctatggctttca

SEQ ID NO: 5319785 - DNA, 19 bp, Homo sapiens
tgatttctatggctttcaa

SEQ ID NO: 5319786 - DNA, 23 bp, Homo sapiens
tgatttctcagtgatttcctaca

SEQ ID NO: 5319787 - DNA, 17 bp, Homo sapiens
tgatttctccagaaatt

SEQ ID NO: 5319788 - DNA, 21 bp, Homo sapiens
tgatttctctgaacagaaaac

SEQ ID NO: 5319789 - DNA, 14 bp, Homo sapiens
tgatttctgagatt

SEQ ID NO: 5319790 - DNA, 17 bp, Homo sapiens
tgatttctgccttcctt

SEQ ID NO: 5319791 - DNA, 12 bp, Homo sapiens
tgatttctgtgc

SEQ ID NO: 5319792 - DNA, 13 bp, Homo sapiens
tgatttcttcttc

SEQ ID NO: 5319793 - DNA, 12 bp, Homo sapiens
tgatttcttgct

SEQ ID NO: 5319794 - DNA, 19 bp, Homo sapiens
tgatttcttgctttgggga

SEQ ID NO: 5319795 - DNA, 21 bp, Homo sapiens
tgatttctttaaaagaatgac

SEQ ID NO: 5319796 - DNA, 15 bp, Homo sapiens
tgatttctttccaga

SEQ ID NO: 5319797 - DNA, 21 bp, Homo sapiens
tgatttcttttcttcctggct

SEQ ID NO: 5319798 - DNA, 18 bp, Homo sapiens
tgatttgaaaagaatttg

SEQ ID NO: 5319799 - DNA, 20 bp, Homo sapiens
tgatttgaaaagaatttgtt

SEQ ID NO: 5319800 - DNA, 21 bp, Homo sapiens
tgatttgaaaagaatttgtta

SEQ ID NO: 5319801 - DNA, 19 bp, Homo sapiens
tgatttgaagaacatgtga

SEQ ID NO: 5319802 - DNA, 13 bp, Homo sapiens
tgatttgaattct

SEQ ID NO: 5319803 - DNA, 13 bp, Homo sapiens
tgatttgagattt

SEQ ID NO: 5319804 - DNA, 22 bp, Homo sapiens
tgatttgagttgattgagaaga

SEQ ID NO: 5319805 - DNA, 15 bp, Homo sapiens
tgatttgatctttgt

SEQ ID NO: 5319806 - DNA, 17 bp, Homo sapiens
tgatttgcaataaaaat

SEQ ID NO: 5319807 - DNA, 14 bp, Homo sapiens
tgatttgcaggatt

SEQ ID NO: 5319808 - DNA, 22 bp, Homo sapiens
tgatttgcatggattttggata

SEQ ID NO: 5319809 - DNA, 12 bp, Homo sapiens
tgatttgcatgt

SEQ ID NO: 5319810 - DNA, 16 bp, Homo sapiens
tgatttgcatgtgtaa

SEQ ID NO: 5319811 - DNA, 12 bp, Homo sapiens
tgatttgcattg

SEQ ID NO: 5319812 - DNA, 14 bp, Homo sapiens
tgatttgcattgaa

SEQ ID NO: 5319813 - DNA, 22 bp, Homo sapiens
tgatttgccactgatattcaga

SEQ ID NO: 5319814 - DNA, 17 bp, Homo sapiens
tgatttgctctttgaca

SEQ ID NO: 5319815 - DNA, 20 bp, Homo sapiens
tgatttggaagagaggcacc

SEQ ID NO: 5319816 - DNA, 21 bp, Homo sapiens
tgatttggggattcagatttc

SEQ ID NO: 5319817 - DNA, 23 bp, Homo sapiens
tgatttggtcctgcctaaatttc

SEQ ID NO: 5319818 - DNA, 13 bp, Homo sapiens
tgatttggtgacc

SEQ ID NO: 5319819 - DNA, 12 bp, Homo sapiens
tgatttgtaaag

SEQ ID NO: 5319820 - DNA, 16 bp, Homo sapiens
tgatttgtaaatagct

SEQ ID NO: 5319821 - DNA, 16 bp, Homo sapiens
tgatttgtaacattca

SEQ ID NO: 5319822 - DNA, 20 bp, Homo sapiens
tgatttgtaacccactgaga

SEQ ID NO: 5319823 - DNA, 16 bp, Homo sapiens
tgatttgtaatatgat

SEQ ID NO: 5319824 - DNA, 15 bp, Homo sapiens
tgatttgtaccattc

SEQ ID NO: 5319825 - DNA, 17 bp, Homo sapiens
tgatttgtaccattcct

SEQ ID NO: 5319826 - DNA, 15 bp, Homo sapiens
tgatttgtactgaaa

SEQ ID NO: 5319827 - DNA, 21 bp, Homo sapiens
tgatttgtagtgattcattgt

SEQ ID NO: 5319828 - DNA, 12 bp, Homo sapiens
tgatttgtcctg

SEQ ID NO: 5319829 - DNA, 14 bp, Homo sapiens
tgatttgtcctgca

SEQ ID NO: 5319830 - DNA, 18 bp, Homo sapiens
tgatttgtctcatatatt

SEQ ID NO: 5319831 - DNA, 16 bp, Homo sapiens
tgatttgtctctgagc

SEQ ID NO: 5319832 - DNA, 15 bp, Homo sapiens
tgatttgtggaaatg

SEQ ID NO: 5319833 - DNA, 12 bp, Homo sapiens
tgatttgttcat

SEQ ID NO: 5319834 - DNA, 21 bp, Homo sapiens
tgatttgttcctgccccaccc

SEQ ID NO: 5319835 - DNA, 17 bp, Homo sapiens
tgatttgttcctttctg

SEQ ID NO: 5319836 - DNA, 15 bp, Homo sapiens
tgatttgttcttaca

SEQ ID NO: 5319837 - DNA, 23 bp, Homo sapiens
tgatttgtttagttttgattgtt

SEQ ID NO: 5319838 - DNA, 15 bp, Homo sapiens
tgatttgttttgaat

SEQ ID NO: 5319839 - DNA, 22 bp, Homo sapiens
tgattttaaaccataaaaagct

SEQ ID NO: 5319840 - DNA, 13 bp, Homo sapiens
tgattttaaatat

SEQ ID NO: 5319841 - DNA, 16 bp, Homo sapiens
tgattttaaatataag

SEQ ID NO: 5319842 - DNA, 13 bp, Homo sapiens
tgattttaaatgt

SEQ ID NO: 5319843 - DNA, 12 bp, Homo sapiens
tgattttaacag

SEQ ID NO: 5319844 - DNA, 17 bp, Homo sapiens
tgattttaacagtttta

SEQ ID NO: 5319845 - DNA, 14 bp, Homo sapiens
tgattttaactctg

SEQ ID NO: 5319846 - DNA, 19 bp, Homo sapiens
tgattttaagtttctctgc

SEQ ID NO: 5319847 - DNA, 22 bp, Homo sapiens
tgattttaagtttctctgcaga

SEQ ID NO: 5319848 - DNA, 15 bp, Homo sapiens
tgattttaatttgac

SEQ ID NO: 5319849 - DNA, 15 bp, Homo sapiens
tgattttaattttat

SEQ ID NO: 5319850 - DNA, 17 bp, Homo sapiens
tgattttacaaattaat

SEQ ID NO: 5319851 - DNA, 22 bp, Homo sapiens
tgattttacaaattaatatttg

SEQ ID NO: 5319852 - DNA, 21 bp, Homo sapiens
tgattttacagagaatctgaa

SEQ ID NO: 5319853 - DNA, 23 bp, Homo sapiens
tgattttacatttatctgtacat

SEQ ID NO: 5319854 - DNA, 15 bp, Homo sapiens
tgattttagccttct

SEQ ID NO: 5319855 - DNA, 20 bp, Homo sapiens
tgattttaggagctaaggct

SEQ ID NO: 5319856 - DNA, 18 bp, Homo sapiens
tgattttatacatagtca

SEQ ID NO: 5319857 - DNA, 22 bp, Homo sapiens
tgattttatacatagtcacaaa

SEQ ID NO: 5319858 - DNA, 15 bp, Homo sapiens
tgattttatatccac

SEQ ID NO: 5319859 - DNA, 16 bp, Homo sapiens
tgattttatctgtgaa

SEQ ID NO: 5319860 - DNA, 12 bp, Homo sapiens
tgattttatgat

SEQ ID NO: 5319861 - DNA, 12 bp, Homo sapiens
tgattttattct

SEQ ID NO: 5319862 - DNA, 14 bp, Homo sapiens
tgattttattcttg

SEQ ID NO: 5319863 - DNA, 16 bp, Homo sapiens
tgattttattcttgat

SEQ ID NO: 5319864 - DNA, 19 bp, Homo sapiens
tgattttatttttgcaaaa

SEQ ID NO: 5319865 - DNA, 14 bp, Homo sapiens
tgattttcaaaatc

SEQ ID NO: 5319866 - DNA, 20 bp, Homo sapiens
tgattttcaaatatgtaaac

SEQ ID NO: 5319867 - DNA, 19 bp, Homo sapiens
tgattttcacagctttgag

SEQ ID NO: 5319868 - DNA, 21 bp, Homo sapiens
tgattttcatatcccgtgaaa

SEQ ID NO: 5319869 - DNA, 14 bp, Homo sapiens
tgattttcatcaat

SEQ ID NO: 5319870 - DNA, 16 bp, Homo sapiens
tgattttcatttcatg

SEQ ID NO: 5319871 - DNA, 17 bp, Homo sapiens
tgattttcatttcatga

SEQ ID NO: 5319872 - DNA, 14 bp, Homo sapiens
tgattttccctcta

SEQ ID NO: 5319873 - DNA, 23 bp, Homo sapiens
tgattttcctttgtagctacttt

SEQ ID NO: 5319874 - DNA, 14 bp, Homo sapiens
tgattttctaaaaa

SEQ ID NO: 5319875 - DNA, 13 bp, Homo sapiens
tgattttctttct

SEQ ID NO: 5319876 - DNA, 11 bp, Homo sapiens
tgattttgaac

SEQ ID NO: 5319877 - DNA, 13 bp, Homo sapiens
tgattttgaactt

SEQ ID NO: 5319878 - DNA, 15 bp, Homo sapiens
tgattttgaactttt

SEQ ID NO: 5319879 - DNA, 23 bp, Homo sapiens
tgattttgagcaaaccacataat

SEQ ID NO: 5319880 - DNA, 15 bp, Homo sapiens
tgattttgccctcct

SEQ ID NO: 5319881 - DNA, 17 bp, Homo sapiens
tgattttgctgtagaag

SEQ ID NO: 5319882 - DNA, 12 bp, Homo sapiens
tgattttgcttt

SEQ ID NO: 5319883 - DNA, 17 bp, Homo sapiens
tgattttggctcactgc

SEQ ID NO: 5319884 - DNA, 14 bp, Homo sapiens
tgattttgtatatg

SEQ ID NO: 5319885 - DNA, 19 bp, Homo sapiens
tgattttgtatgtaaatac

SEQ ID NO: 5319886 - DNA, 17 bp, Homo sapiens
tgattttgtcactgtct

SEQ ID NO: 5319887 - DNA, 14 bp, Homo sapiens
tgatttttaagaaa

SEQ ID NO: 5319888 - DNA, 16 bp, Homo sapiens
tgatttttaagaaagt

SEQ ID NO: 5319889 - DNA, 16 bp, Homo sapiens
tgatttttaagatttc

SEQ ID NO: 5319890 - DNA, 23 bp, Homo sapiens
tgatttttaatttttttaaattt

SEQ ID NO: 5319891 - DNA, 22 bp, Homo sapiens
tgatttttaccgtttcttccct

SEQ ID NO: 5319892 - DNA, 20 bp, Homo sapiens
tgatttttagatgagattgt

SEQ ID NO: 5319893 - DNA, 16 bp, Homo sapiens
tgatttttatcacaag

SEQ ID NO: 5319894 - DNA, 16 bp, Homo sapiens
tgatttttatctccaa

SEQ ID NO: 5319895 - DNA, 20 bp, Homo sapiens
tgatttttattaactgcttt

SEQ ID NO: 5319896 - DNA, 15 bp, Homo sapiens
tgatttttcatatgt

SEQ ID NO: 5319897 - DNA, 17 bp, Homo sapiens
tgatttttccgtccctt

SEQ ID NO: 5319898 - DNA, 22 bp, Homo sapiens
tgatttttctaaccttgaatgc

SEQ ID NO: 5319899 - DNA, 15 bp, Homo sapiens
tgatttttctagcat

SEQ ID NO: 5319900 - DNA, 15 bp, Homo sapiens
tgatttttctcttca

SEQ ID NO: 5319901 - DNA, 13 bp, Homo sapiens
tgatttttctgga

SEQ ID NO: 5319902 - DNA, 20 bp, Homo sapiens
tgatttttcttcttttactt

SEQ ID NO: 5319903 - DNA, 14 bp, Homo sapiens
tgatttttctttac

SEQ ID NO: 5319904 - DNA, 21 bp, Homo sapiens
tgatttttgagcccttgtttc

SEQ ID NO: 5319905 - DNA, 22 bp, Homo sapiens
tgatttttgcctcttccagtct

SEQ ID NO: 5319906 - DNA, 17 bp, Homo sapiens
tgatttttggtatttat

SEQ ID NO: 5319907 - DNA, 10 bp, Homo sapiens
tgatttttgt

SEQ ID NO: 5319908 - DNA, 18 bp, Homo sapiens
tgatttttgtaagacaat

SEQ ID NO: 5319909 - DNA, 14 bp, Homo sapiens
tgatttttgtaata

SEQ ID NO: 5319910 - DNA, 12 bp, Homo sapiens
tgatttttgtgt

SEQ ID NO: 5319911 - DNA, 13 bp, Homo sapiens
tgatttttgtgta

SEQ ID NO: 5319912 - DNA, 15 bp, Homo sapiens
tgatttttgtgtatc

SEQ ID NO: 5319913 - DNA, 19 bp, Homo sapiens
tgatttttgttgattaaaa

SEQ ID NO: 5319914 - DNA, 17 bp, Homo sapiens
tgattttttaaaagaaa

SEQ ID NO: 5319915 - DNA, 14 bp, Homo sapiens
tgattttttaaagc

SEQ ID NO: 5319916 - DNA, 13 bp, Homo sapiens
tgattttttaaga

SEQ ID NO: 5319917 - DNA, 23 bp, Homo sapiens
tgattttttaaggagctggggga

SEQ ID NO: 5319918 - DNA, 14 bp, Homo sapiens
tgattttttacaaa

SEQ ID NO: 5319919 - DNA, 21 bp, Homo sapiens
tgattttttacaaattatgtt

SEQ ID NO: 5319920 - DNA, 18 bp, Homo sapiens
tgattttttgaaagttaa

SEQ ID NO: 5319921 - DNA, 22 bp, Homo sapiens
tgattttttttcccatttagaa

SEQ ID NO: 5319922 - DNA, 21 bp, Homo sapiens
tgattttttttcttggtttct

SEQ ID NO: 5319923 - DNA, 22 bp, Homo sapiens
tgatttttttttagaacagaaa

SEQ ID NO: 5319924 - DNA, 16 bp, Homo sapiens
tgatttttttttcctt

SEQ ID NO: 5319925 - DNA, 20 bp, Homo sapiens
tgatttttttttccttcagt

SEQ ID NO: 5319926 - DNA, 22 bp, Homo sapiens
tgatttttttttccttcagtgc

SEQ ID NO: 5319927 - DNA, 21 bp, Homo sapiens
tgattttttttttaacttgaa

SEQ ID NO: 5319928 - DNA, 16 bp, Homo sapiens
tgatttttttttttca

SEQ ID NO: 5319929 - DNA, 21 bp, Homo sapiens
tgatttttttttttttttcct

SEQ ID NO: 5319930 - DNA, 17 bp, Homo sapiens
tgcaaaaaaaaaaatgt

SEQ ID NO: 5319931 - DNA, 15 bp, Homo sapiens
tgcaaaaaaaaactt

SEQ ID NO: 5319932 - DNA, 13 bp, Homo sapiens
tgcaaaaaaagaa

SEQ ID NO: 5319933 - DNA, 14 bp, Homo sapiens
tgcaaaaaaagcct

SEQ ID NO: 5319934 - DNA, 21 bp, Homo sapiens
tgcaaaaaaagcctccaaggg

SEQ ID NO: 5319935 - DNA, 22 bp, Homo sapiens
tgcaaaaaaagcctccaagggt

SEQ ID NO: 5319936 - DNA, 22 bp, Homo sapiens
tgcaaaaaatactttttctaat

SEQ ID NO: 5319937 - DNA, 16 bp, Homo sapiens
tgcaaaaaatcttaat

SEQ ID NO: 5319938 - DNA, 21 bp, Homo sapiens
tgcaaaaactctttgagaggg

SEQ ID NO: 5319939 - DNA, 18 bp, Homo sapiens
tgcaaaaagaaaaaaaga

SEQ ID NO: 5319940 - DNA, 22 bp, Homo sapiens
tgcaaaaagaaatgactaatta

SEQ ID NO: 5319941 - DNA, 17 bp, Homo sapiens
tgcaaaaagaggatccg

SEQ ID NO: 5319942 - DNA, 18 bp, Homo sapiens
tgcaaaaagatttaacaa

SEQ ID NO: 5319943 - DNA, 19 bp, Homo sapiens
tgcaaggactcccggagcc

SEQ ID NO: 5319944 - DNA, 20 bp, Homo sapiens
tgcaaggactcccggagcct

SEQ ID NO: 5319945 - DNA, 17 bp, Homo sapiens
tgcaaggattacagaaa

SEQ ID NO: 5319946 - DNA, 19 bp, Homo sapiens
tgcaaggattacagaaact

SEQ ID NO: 5319947 - DNA, 22 bp, Homo sapiens
tgcaaggattacagaaactgat

SEQ ID NO: 5319948 - DNA, 22 bp, Homo sapiens
tgcaaggatttttccatgtgtg

SEQ ID NO: 5319949 - DNA, 22 bp, Homo sapiens
tgcaaggattttttaaaaattg

SEQ ID NO: 5319950 - DNA, 14 bp, Homo sapiens
tgcaaggcagccgt

SEQ ID NO: 5319951 - DNA, 22 bp, Homo sapiens
tgcaaggccctctatttctctc

SEQ ID NO: 5319952 - DNA, 12 bp, Homo sapiens
tgcaagggaaga

SEQ ID NO: 5319953 - DNA, 16 bp, Homo sapiens
tgcaagggactgtgtg

SEQ ID NO: 5319954 - DNA, 22 bp, Homo sapiens
tgcaagggatgaattgtaaaag

SEQ ID NO: 5319955 - DNA, 20 bp, Homo sapiens
tgcaagggcagaacactaac

SEQ ID NO: 5319956 - DNA, 16 bp, Homo sapiens
tgcaagggccagagtt

SEQ ID NO: 5319957 - DNA, 22 bp, Homo sapiens
tgcaagggcccagagtgaaccg

SEQ ID NO: 5319958 - DNA, 15 bp, Homo sapiens
tgcaagggtgctgtg

SEQ ID NO: 5319959 - DNA, 22 bp, Homo sapiens
tgcaaggtattacactctgtaa

SEQ ID NO: 5319960 - DNA, 17 bp, Homo sapiens
tgcaaggtgctggtggg

SEQ ID NO: 5319961 - DNA, 18 bp, Homo sapiens
tgcaaggtgctggtgggt

SEQ ID NO: 5319962 - DNA, 16 bp, Homo sapiens
tgcaaggtggcctctg

SEQ ID NO: 5319963 - DNA, 21 bp, Homo sapiens
tgcaaggtggcctctgcctgg

SEQ ID NO: 5319964 - DNA, 15 bp, Homo sapiens
tgcaaggtggctcca

SEQ ID NO: 5319965 - DNA, 13 bp, Homo sapiens
tgcaaggttccac

SEQ ID NO: 5319966 - DNA, 15 bp, Homo sapiens
tgcaaggttccacag

SEQ ID NO: 5319967 - DNA, 19 bp, Homo sapiens
tgcaagtactgctgtaaat

SEQ ID NO: 5319968 - DNA, 21 bp, Homo sapiens
tgcaagtagcacatggtttaa

SEQ ID NO: 5319969 - DNA, 21 bp, Homo sapiens
tgcaagtagctggctgtactg

SEQ ID NO: 5319970 - DNA, 20 bp, Homo sapiens
tgcaagtatactagggagcc

SEQ ID NO: 5319971 - DNA, 21 bp, Homo sapiens
tgcaagtcactaaatttctca

SEQ ID NO: 5319972 - DNA, 21 bp, Homo sapiens
tgcaagtcagattgctgggag

SEQ ID NO: 5319973 - DNA, 17 bp, Homo sapiens
tgcaagtcaggaatcat

SEQ ID NO: 5319974 - DNA, 23 bp, Homo sapiens
tgcaagtcagtccaggatgctaa

SEQ ID NO: 5319975 - DNA, 23 bp, Homo sapiens
tgcaagtccatagctgagctgga

SEQ ID NO: 5319976 - DNA, 18 bp, Homo sapiens
tgcaagtccttttgtaaa

SEQ ID NO: 5319977 - DNA, 19 bp, Homo sapiens
tgcaagtccttttgtaaag

SEQ ID NO: 5319978 - DNA, 12 bp, Homo sapiens
tgcaagtctctt

SEQ ID NO: 5319979 - DNA, 15 bp, Homo sapiens
tgcaagtctgccgat

SEQ ID NO: 5319980 - DNA, 14 bp, Homo sapiens
tgcaagtctgtgag

SEQ ID NO: 5319981 - DNA, 17 bp, Homo sapiens
tgcaagtctgtggcccc

SEQ ID NO: 5319982 - DNA, 13 bp, Homo sapiens
tgcaagtgaaata

SEQ ID NO: 5319983 - DNA, 13 bp, Homo sapiens
tgcaagtgaaggt

SEQ ID NO: 5319984 - DNA, 18 bp, Homo sapiens
tgcaagtgaaggtttaca

SEQ ID NO: 5319985 - DNA, 17 bp, Homo sapiens
tgcaagtgagaaagaca

SEQ ID NO: 5319986 - DNA, 18 bp, Homo sapiens
tgcaagtgcccgccctgc

SEQ ID NO: 5319987 - DNA, 19 bp, Homo sapiens
tgcaagtgcccgccctgcc

SEQ ID NO: 5319988 - DNA, 21 bp, Homo sapiens
tgcaagtgcccgccctgcccc

SEQ ID NO: 5319989 - DNA, 12 bp, Homo sapiens
tgcaagtgctgg

SEQ ID NO: 5319990 - DNA, 13 bp, Homo sapiens
tgcaagtgctgga

SEQ ID NO: 5319991 - DNA, 20 bp, Homo sapiens
tgcaagtggagctgtctgtc

SEQ ID NO: 5319992 - DNA, 17 bp, Homo sapiens
tgcaagtgggagatgaa

SEQ ID NO: 5319993 - DNA, 21 bp, Homo sapiens
tgcaagtgggagatgaaaacc

SEQ ID NO: 5319994 - DNA, 21 bp, Homo sapiens
tgcaagtgtctggagcggctg

SEQ ID NO: 5319995 - DNA, 16 bp, Homo sapiens
tgcaagtgtctgtgtg

SEQ ID NO: 5319996 - DNA, 13 bp, Homo sapiens
tgcaagtgtgtgc

SEQ ID NO: 5319997 - DNA, 23 bp, Homo sapiens
tgcaagtgtgtgcatgtgtgcga

SEQ ID NO: 5319998 - DNA, 21 bp, Homo sapiens
tgcaagtgtgttcatccccaa

SEQ ID NO: 5319999 - DNA, 15 bp, Homo sapiens
tgcaagtgtttctgt

SEQ ID NO: 5320000 - DNA, 16 bp, Homo sapiens
tgcaagtgtttctgtt

SEQ ID NO: 5320001 - DNA, 21 bp, Homo sapiens
tgcaagtgtttgaagtctgct

SEQ ID NO: 5320002 - DNA, 20 bp, Homo sapiens
tgcaagttattttatttgct

SEQ ID NO: 5320003 - DNA, 19 bp, Homo sapiens
tgcaagttcaagactgaaa

SEQ ID NO: 5320004 - DNA, 13 bp, Homo sapiens
tgcaagttcattt

SEQ ID NO: 5320005 - DNA, 19 bp, Homo sapiens
tgcaagtttctgtttcaaa

SEQ ID NO: 5320006 - DNA, 22 bp, Homo sapiens
tgcaataaaaaatatattttta

SEQ ID NO: 5320007 - DNA, 24 bp, Homo sapiens
tgcaataaaaatgatactgatggt

SEQ ID NO: 5320008 - DNA, 15 bp, Homo sapiens
tgcaataaaatttaa

SEQ ID NO: 5320009 - DNA, 16 bp, Homo sapiens
tgcaataaaatttaaa

SEQ ID NO: 5320010 - DNA, 10 bp, Homo sapiens
tgcaataaag

SEQ ID NO: 5320011 - DNA, 13 bp, Homo sapiens
tgcaataaagagt

SEQ ID NO: 5320012 - DNA, 14 bp, Homo sapiens
tgcaataaagtata

SEQ ID NO: 5320013 - DNA, 16 bp, Homo sapiens
tgcaataaagtataat

SEQ ID NO: 5320014 - DNA, 15 bp, Homo sapiens
tgcaataaatattat

SEQ ID NO: 5320015 - DNA, 18 bp, Homo sapiens
tgcaataaatattatttg

SEQ ID NO: 5320016 - DNA, 19 bp, Homo sapiens
tgcaataaatctgacccag

SEQ ID NO: 5320017 - DNA, 21 bp, Homo sapiens
tgcaataaatctgacccagtg

SEQ ID NO: 5320018 - DNA, 15 bp, Homo sapiens
tgcaataacaagcat

SEQ ID NO: 5320019 - DNA, 16 bp, Homo sapiens
tgcaataacagtttta

SEQ ID NO: 5320020 - DNA, 19 bp, Homo sapiens
tgcaataacagttttaaga

SEQ ID NO: 5320021 - DNA, 15 bp, Homo sapiens
tgcaataactctggg

SEQ ID NO: 5320022 - DNA, 14 bp, Homo sapiens
tgcaataacttctg

SEQ ID NO: 5320023 - DNA, 16 bp, Homo sapiens
tgcaataacttctgac

SEQ ID NO: 5320024 - DNA, 20 bp, Homo sapiens
tgcaataagatattaccctc

SEQ ID NO: 5320025 - DNA, 22 bp, Homo sapiens
tgcaataaggatttattctcag

SEQ ID NO: 5320026 - DNA, 14 bp, Homo sapiens
tgcaataatacttc

SEQ ID NO: 5320027 - DNA, 21 bp, Homo sapiens
tgcaataatatcaaaacaagt

SEQ ID NO: 5320028 - DNA, 19 bp, Homo sapiens
tgcaataatgatcaaagtt

SEQ ID NO: 5320029 - DNA, 14 bp, Homo sapiens
tgcaataatgcagt

SEQ ID NO: 5320030 - DNA, 14 bp, Homo sapiens
tgcaatacatacca

SEQ ID NO: 5320031 - DNA, 18 bp, Homo sapiens
tgcaatacatttcttcct

SEQ ID NO: 5320032 - DNA, 22 bp, Homo sapiens
tgcaatacatttcttccttcaa

SEQ ID NO: 5320033 - DNA, 13 bp, Homo sapiens
tgcaatacatttt

SEQ ID NO: 5320034 - DNA, 14 bp, Homo sapiens
tgcaatacattttt

SEQ ID NO: 5320035 - DNA, 21 bp, Homo sapiens
tgcaatacggaacactgtcaa

SEQ ID NO: 5320036 - DNA, 20 bp, Homo sapiens
tgcaatagaacagagaaaga

SEQ ID NO: 5320037 - DNA, 14 bp, Homo sapiens
tgcaatagagactg

SEQ ID NO: 5320038 - DNA, 22 bp, Homo sapiens
tgcaatagattactgatgtgat

SEQ ID NO: 5320039 - DNA, 16 bp, Homo sapiens
tgcaatataaaaatgt

SEQ ID NO: 5320040 - DNA, 15 bp, Homo sapiens
tgcaatatactggaa

SEQ ID NO: 5320041 - DNA, 16 bp, Homo sapiens
tgcaatatactggaaa

SEQ ID NO: 5320042 - DNA, 20 bp, Homo sapiens
tgcaatatatctaaattgaa

SEQ ID NO: 5320043 - DNA, 21 bp, Homo sapiens
tgcaatatatctaaattgaat

SEQ ID NO: 5320044 - DNA, 23 bp, Homo sapiens
tgcaatatatctaaattgaataa

SEQ ID NO: 5320045 - DNA, 16 bp, Homo sapiens
tgcaatatattttgta

SEQ ID NO: 5320046 - DNA, 15 bp, Homo sapiens
tgcaatatctgaagc

SEQ ID NO: 5320047 - DNA, 13 bp, Homo sapiens
tgcaatatcttcg

SEQ ID NO: 5320048 - DNA, 23 bp, Homo sapiens
tgcaatatgaggggactgcatgc

SEQ ID NO: 5320049 - DNA, 18 bp, Homo sapiens
tgcaatatgggcgggcag

SEQ ID NO: 5320050 - DNA, 15 bp, Homo sapiens
tgcaatattcttgac

SEQ ID NO: 5320051 - DNA, 14 bp, Homo sapiens
tgcaatatttgtaa

SEQ ID NO: 5320052 - DNA, 23 bp, Homo sapiens
tgcaatcaaaaatatgtgttttt

SEQ ID NO: 5320053 - DNA, 14 bp, Homo sapiens
tgcaatcagacaag

SEQ ID NO: 5320054 - DNA, 15 bp, Homo sapiens
tgcaatcatatgtga

SEQ ID NO: 5320055 - DNA, 16 bp, Homo sapiens
tgcaatcatatgtgat

SEQ ID NO: 5320056 - DNA, 17 bp, Homo sapiens
tgcaatccaaataaaga

SEQ ID NO: 5320057 - DNA, 21 bp, Homo sapiens
tgcaatccaatgcactgatgt

SEQ ID NO: 5320058 - DNA, 16 bp, Homo sapiens
tgcaatccaggctgtt

SEQ ID NO: 5320059 - DNA, 22 bp, Homo sapiens
tgcaatccaggctgttctcagc

SEQ ID NO: 5320060 - DNA, 14 bp, Homo sapiens
tgcaatccatgcca

SEQ ID NO: 5320061 - DNA, 14 bp, Homo sapiens
tgcaatccatttat

SEQ ID NO: 5320062 - DNA, 22 bp, Homo sapiens
tgcaatccatttatttcattta

SEQ ID NO: 5320063 - DNA, 19 bp, Homo sapiens
tgcaatcctgtctttctga

SEQ ID NO: 5320064 - DNA, 16 bp, Homo sapiens
tgcaatccttacaaat

SEQ ID NO: 5320065 - DNA, 17 bp, Homo sapiens
tgcaatctaatctgaac

SEQ ID NO: 5320066 - DNA, 18 bp, Homo sapiens
tgcaatctaatctgaact

SEQ ID NO: 5320067 - DNA, 14 bp, Homo sapiens
tgcaatctgtccag

SEQ ID NO: 5320068 - DNA, 14 bp, Homo sapiens
tgcaatcttatgtt

SEQ ID NO: 5320069 - DNA, 19 bp, Homo sapiens
tgcaatcttggctcactgc

SEQ ID NO: 5320070 - DNA, 14 bp, Homo sapiens
tgcaatgaaaacaa

SEQ ID NO: 5320071 - DNA, 15 bp, Homo sapiens
tgcaatgaaaacaaa

SEQ ID NO: 5320072 - DNA, 16 bp, Homo sapiens
tgcaatgaaaacaaaa

SEQ ID NO: 5320073 - DNA, 21 bp, Homo sapiens
tgcaatgaaaggtactatatt

SEQ ID NO: 5320074 - DNA, 22 bp, Homo sapiens
tgcaatgaaaggtactatattt

SEQ ID NO: 5320075 - DNA, 17 bp, Homo sapiens
tgcaatgaaagtcaaat

SEQ ID NO: 5320076 - DNA, 22 bp, Homo sapiens
tgcaatgaaagtcaaatttact

SEQ ID NO: 5320077 - DNA, 15 bp, Homo sapiens
tgcaatgaaggaaat

SEQ ID NO: 5320078 - DNA, 12 bp, Homo sapiens
tgcaatgaatta

SEQ ID NO: 5320079 - DNA, 17 bp, Homo sapiens
tgcaatgacataaccaa

SEQ ID NO: 5320080 - DNA, 17 bp, Homo sapiens
tgcaatgacatcttcaa

SEQ ID NO: 5320081 - DNA, 13 bp, Homo sapiens
tgcaatgactgtg

SEQ ID NO: 5320082 - DNA, 15 bp, Homo sapiens
tgcaatgagccaaga

SEQ ID NO: 5320083 - DNA, 15 bp, Homo sapiens
tgcaatgagccatga

SEQ ID NO: 5320084 - DNA, 13 bp, Homo sapiens
tgcaatgatcaga

SEQ ID NO: 5320085 - DNA, 12 bp, Homo sapiens
tgcaatgccctc

SEQ ID NO: 5320086 - DNA, 18 bp, Homo sapiens
tgcaatgcgtcttgtgaa

SEQ ID NO: 5320087 - DNA, 20 bp, Homo sapiens
tgcaatgcgtcttgtgaaat

SEQ ID NO: 5320088 - DNA, 23 bp, Homo sapiens
tgcaatgcgtcttgtgaaattgt

SEQ ID NO: 5320089 - DNA, 14 bp, Homo sapiens
tgcaatgcttctgt

SEQ ID NO: 5320090 - DNA, 17 bp, Homo sapiens
tgcaatgcttctgtagc

SEQ ID NO: 5320091 - DNA, 20 bp, Homo sapiens
tgcaatgcttctgtagcttc

SEQ ID NO: 5320092 - DNA, 22 bp, Homo sapiens
tgcaatgcttctgtagcttcta

SEQ ID NO: 5320093 - DNA, 12 bp, Homo sapiens
tgcaatgcttgt

SEQ ID NO: 5320094 - DNA, 16 bp, Homo sapiens
tgcaatgcttgtagaa

SEQ ID NO: 5320095 - DNA, 12 bp, Homo sapiens
tgcaatggaata

SEQ ID NO: 5320096 - DNA, 17 bp, Homo sapiens
tgcaatggaatataaat

SEQ ID NO: 5320097 - DNA, 18 bp, Homo sapiens
tgcaatggaatataaata

SEQ ID NO: 5320098 - DNA, 13 bp, Homo sapiens
tgcaatggcagcc

SEQ ID NO: 5320099 - DNA, 14 bp, Homo sapiens
tgcaatggcagcct

SEQ ID NO: 5320100 - DNA, 15 bp, Homo sapiens
tgcaatggcagcctt

SEQ ID NO: 5320101 - DNA, 18 bp, Homo sapiens
tgcaatggctatatggca

SEQ ID NO: 5320102 - DNA, 19 bp, Homo sapiens
tgcaatgggtaagggaggg

SEQ ID NO: 5320103 - DNA, 20 bp, Homo sapiens
tgcaatgggtaagggaggga

SEQ ID NO: 5320104 - DNA, 16 bp, Homo sapiens
tgcaatggtgactgat

SEQ ID NO: 5320105 - DNA, 19 bp, Homo sapiens
tgcaatggtgactgatttc

SEQ ID NO: 5320106 - DNA, 17 bp, Homo sapiens
tgcaatggttaacatct

SEQ ID NO: 5320107 - DNA, 22 bp, Homo sapiens
tgcaatgtagaggggaaaagag

SEQ ID NO: 5320108 - DNA, 17 bp, Homo sapiens
tgcaatgtatagtgtct

SEQ ID NO: 5320109 - DNA, 19 bp, Homo sapiens
tgcaatgtatcccttctca

SEQ ID NO: 5320110 - DNA, 16 bp, Homo sapiens
tgcaatgtatttagct

SEQ ID NO: 5320111 - DNA, 23 bp, Homo sapiens
tgcaatgtctgtccctaaacata

SEQ ID NO: 5320112 - DNA, 21 bp, Homo sapiens
tgcaatgtcttaaataaaact

SEQ ID NO: 5320113 - DNA, 16 bp, Homo sapiens
tgcaatgtgctactga

SEQ ID NO: 5320114 - DNA, 13 bp, Homo sapiens
tgcaatgtgtata

SEQ ID NO: 5320115 - DNA, 18 bp, Homo sapiens
tgcaatgtgtataaacaa

SEQ ID NO: 5320116 - DNA, 19 bp, Homo sapiens
tgcaatgtgtgtatatgga

SEQ ID NO: 5320117 - DNA, 12 bp, Homo sapiens
tgcaatgttttt

SEQ ID NO: 5320118 - DNA, 19 bp, Homo sapiens
tgcaatgtttttgtgtaga

SEQ ID NO: 5320119 - DNA, 15 bp, Homo sapiens
tgcaattaactctgg

SEQ ID NO: 5320120 - DNA, 17 bp, Homo sapiens
tgcaattaactctggac

SEQ ID NO: 5320121 - DNA, 15 bp, Homo sapiens
tgcaccgcctgccct

SEQ ID NO: 5320122 - DNA, 15 bp, Homo sapiens
tgcaccggctggcct

SEQ ID NO: 5320123 - DNA, 18 bp, Homo sapiens
tgcaccggctggcctggc

SEQ ID NO: 5320124 - DNA, 19 bp, Homo sapiens
tgcaccggtttcatagacg

SEQ ID NO: 5320125 - DNA, 13 bp, Homo sapiens
tgcaccgtcctca

SEQ ID NO: 5320126 - DNA, 15 bp, Homo sapiens
tgcaccgtcctcagc

SEQ ID NO: 5320127 - DNA, 13 bp, Homo sapiens
tgcacctaaagaa

SEQ ID NO: 5320128 - DNA, 15 bp, Homo sapiens
tgcacctaaagaaaa

SEQ ID NO: 5320129 - DNA, 21 bp, Homo sapiens
tgcacctaaagaaaaacaaac

SEQ ID NO: 5320130 - DNA, 17 bp, Homo sapiens
tgcacctagctgtgcaa

SEQ ID NO: 5320131 - DNA, 18 bp, Homo sapiens
tgcacctatctcagccat

SEQ ID NO: 5320132 - DNA, 19 bp, Homo sapiens
tgcacctatggcccagcca

SEQ ID NO: 5320133 - DNA, 16 bp, Homo sapiens
tgcacctattctgtag

SEQ ID NO: 5320134 - DNA, 15 bp, Homo sapiens
tgcacctcattccaa

SEQ ID NO: 5320135 - DNA, 15 bp, Homo sapiens
tgcacctccccaaag

SEQ ID NO: 5320136 - DNA, 17 bp, Homo sapiens
tgcacctccccccactg

SEQ ID NO: 5320137 - DNA, 20 bp, Homo sapiens
tgcacctccccccactgcag

SEQ ID NO: 5320138 - DNA, 17 bp, Homo sapiens
tgcacctcctaccctcc

SEQ ID NO: 5320139 - DNA, 19 bp, Homo sapiens
tgcacctctggctagagcc

SEQ ID NO: 5320140 - DNA, 22 bp, Homo sapiens
tgcacctcttgttactccctgt

SEQ ID NO: 5320141 - DNA, 20 bp, Homo sapiens
tgcacctgacctgctgaatt

SEQ ID NO: 5320142 - DNA, 19 bp, Homo sapiens
tgcacctgagaccctactg

SEQ ID NO: 5320143 - DNA, 14 bp, Homo sapiens
tgcacctgagcctg

SEQ ID NO: 5320144 - DNA, 11 bp, Homo sapiens
tgcacctgcaa

SEQ ID NO: 5320145 - DNA, 14 bp, Homo sapiens
tgcacctgcagcca

SEQ ID NO: 5320146 - DNA, 15 bp, Homo sapiens
tgcacctgcaggctt

SEQ ID NO: 5320147 - DNA, 16 bp, Homo sapiens
tgcacctgcagggagc

SEQ ID NO: 5320148 - DNA, 18 bp, Homo sapiens
tgcacctgcagggagcag

SEQ ID NO: 5320149 - DNA, 16 bp, Homo sapiens
tgcacctgccagcctg

SEQ ID NO: 5320150 - DNA, 19 bp, Homo sapiens
tgcacctgcccagctcccc

SEQ ID NO: 5320151 - DNA, 16 bp, Homo sapiens
tgcacctgcctcagct

SEQ ID NO: 5320152 - DNA, 15 bp, Homo sapiens
tgcacctgcctccac

SEQ ID NO: 5320153 - DNA, 19 bp, Homo sapiens
tgcacctgcctccaccagc

SEQ ID NO: 5320154 - DNA, 12 bp, Homo sapiens
tgcacctgcctg

SEQ ID NO: 5320155 - DNA, 21 bp, Homo sapiens
tgcacctgcctgccgctgcag

SEQ ID NO: 5320156 - DNA, 13 bp, Homo sapiens
tgcacctgctgcg

SEQ ID NO: 5320157 - DNA, 22 bp, Homo sapiens
tgcacctgctgcgtccccactc

SEQ ID NO: 5320158 - DNA, 17 bp, Homo sapiens
tgcacctggaatatata

SEQ ID NO: 5320159 - DNA, 14 bp, Homo sapiens
tgcacctggcctgg

SEQ ID NO: 5320160 - DNA, 17 bp, Homo sapiens
tgcacctggcctgggcc

SEQ ID NO: 5320161 - DNA, 18 bp, Homo sapiens
tgcacctggcctgggcca

SEQ ID NO: 5320162 - DNA, 19 bp, Homo sapiens
tgcacctggcctgggccac

SEQ ID NO: 5320163 - DNA, 18 bp, Homo sapiens
tgcacctgggcagctcct

SEQ ID NO: 5320164 - DNA, 17 bp, Homo sapiens
tgcacctgtactcagga

SEQ ID NO: 5320165 - DNA, 20 bp, Homo sapiens
tgcacctgtactcaggaggc

SEQ ID NO: 5320166 - DNA, 13 bp, Homo sapiens
tgcacctgtctca

SEQ ID NO: 5320167 - DNA, 12 bp, Homo sapiens
tgcacctgtgca

SEQ ID NO: 5320168 - DNA, 19 bp, Homo sapiens
tgcacctgtggcctctcag

SEQ ID NO: 5320169 - DNA, 19 bp, Homo sapiens
tgcaccttaccaactttct

SEQ ID NO: 5320170 - DNA, 13 bp, Homo sapiens
tgcaccttagaaa

SEQ ID NO: 5320171 - DNA, 20 bp, Homo sapiens
tgcaccttagaaaaaaaaag

SEQ ID NO: 5320172 - DNA, 19 bp, Homo sapiens
tgcaccttatatttctgtg

SEQ ID NO: 5320173 - DNA, 21 bp, Homo sapiens
tgcaccttatatttctgtgta

SEQ ID NO: 5320174 - DNA, 22 bp, Homo sapiens
tgcaccttatcttaaagcactt

SEQ ID NO: 5320175 - DNA, 17 bp, Homo sapiens
tgcaccttccagcccgg

SEQ ID NO: 5320176 - DNA, 21 bp, Homo sapiens
tgcaccttctgacgcagcctg

SEQ ID NO: 5320177 - DNA, 22 bp, Homo sapiens
tgcaccttctgacgcagcctga

SEQ ID NO: 5320178 - DNA, 14 bp, Homo sapiens
tgcaccttgggcac

SEQ ID NO: 5320179 - DNA, 15 bp, Homo sapiens
tgcaccttgtgtctg

SEQ ID NO: 5320180 - DNA, 22 bp, Homo sapiens
tgcacctttttgcatgatatct

SEQ ID NO: 5320181 - DNA, 17 bp, Homo sapiens
tgcacgaactggactgt

SEQ ID NO: 5320182 - DNA, 18 bp, Homo sapiens
tgcacgaccgccccagtt

SEQ ID NO: 5320183 - DNA, 15 bp, Homo sapiens
tgcacgacgccctct

SEQ ID NO: 5320184 - DNA, 19 bp, Homo sapiens
tgcacgacgccctctcccc

SEQ ID NO: 5320185 - DNA, 15 bp, Homo sapiens
tgcacgcaccccgcc

SEQ ID NO: 5320186 - DNA, 21 bp, Homo sapiens
tgcacgcaccccgcccctgca

SEQ ID NO: 5320187 - DNA, 22 bp, Homo sapiens
tgcacgcaccccgcccctgcat

SEQ ID NO: 5320188 - DNA, 21 bp, Homo sapiens
tgcacgccaccacacctggct

SEQ ID NO: 5320189 - DNA, 23 bp, Homo sapiens
tgcacgcgtatgttcgttgcagc

SEQ ID NO: 5320190 - DNA, 24 bp, Homo sapiens
tgcacgctcaatgcccagtaaaat

SEQ ID NO: 5320191 - DNA, 17 bp, Homo sapiens
tgcacgctcccctccat

SEQ ID NO: 5320192 - DNA, 15 bp, Homo sapiens
tgcacggcagcttga

SEQ ID NO: 5320193 - DNA, 22 bp, Homo sapiens
tgcacggcagcttgagcctgtc

SEQ ID NO: 5320194 - DNA, 20 bp, Homo sapiens
tgcacggcggcagggtgggg

SEQ ID NO: 5320195 - DNA, 21 bp, Homo sapiens
tgcacggcggcagggtggggg

SEQ ID NO: 5320196 - DNA, 14 bp, Homo sapiens
tgcacggctgctga

SEQ ID NO: 5320197 - DNA, 23 bp, Homo sapiens
tgcacgggatgcgtgggaggcag

SEQ ID NO: 5320198 - DNA, 15 bp, Homo sapiens
tgcacgggcatgcac

SEQ ID NO: 5320199 - DNA, 21 bp, Homo sapiens
tgcacgggcatgcacacggct

SEQ ID NO: 5320200 - DNA, 13 bp, Homo sapiens
tgcacggggccag

SEQ ID NO: 5320201 - DNA, 22 bp, Homo sapiens
tgcacggtgaatggctttgtat

SEQ ID NO: 5320202 - DNA, 23 bp, Homo sapiens
tgcacggtgggccttgctgggga

SEQ ID NO: 5320203 - DNA, 19 bp, Homo sapiens
tgcacggtttctgttctgc

SEQ ID NO: 5320204 - DNA, 22 bp, Homo sapiens
tgcacggtttctgttctgcccc

SEQ ID NO: 5320205 - DNA, 15 bp, Homo sapiens
tgcacgtaaacttca

SEQ ID NO: 5320206 - DNA, 19 bp, Homo sapiens
tgcacgtaaagtacttgta

SEQ ID NO: 5320207 - DNA, 21 bp, Homo sapiens
tgcacgtaggttccccagaga

SEQ ID NO: 5320208 - DNA, 22 bp, Homo sapiens
tgcacgtagtagggtcaggcca

SEQ ID NO: 5320209 - DNA, 18 bp, Homo sapiens
tgcacgtatacacccaga

SEQ ID NO: 5320210 - DNA, 23 bp, Homo sapiens
tgcacgtatgagaaacctatatt

SEQ ID NO: 5320211 - DNA, 17 bp, Homo sapiens
tgcacgtattttaatag

SEQ ID NO: 5320212 - DNA, 18 bp, Homo sapiens
tgcacgtcaccctcctga

SEQ ID NO: 5320213 - DNA, 22 bp, Homo sapiens
tgcacgtcaccctcctgagcct

SEQ ID NO: 5320214 - DNA, 14 bp, Homo sapiens
tgcacgtgcaatac

SEQ ID NO: 5320215 - DNA, 14 bp, Homo sapiens
tgcacgtgcacaca

SEQ ID NO: 5320216 - DNA, 15 bp, Homo sapiens
tgcacgtgcacacac

SEQ ID NO: 5320217 - DNA, 16 bp, Homo sapiens
tgcacgtgcacacacc

SEQ ID NO: 5320218 - DNA, 18 bp, Homo sapiens
tgcacgtgcacacacctg

SEQ ID NO: 5320219 - DNA, 19 bp, Homo sapiens
tgcacgtgcacacacctgc

SEQ ID NO: 5320220 - DNA, 22 bp, Homo sapiens
tgcacgtgcacacacctgcaca

SEQ ID NO: 5320221 - DNA, 20 bp, Homo sapiens
tgcacgtggagagctggtgc

SEQ ID NO: 5320222 - DNA, 21 bp, Homo sapiens
tgcacgtggagagctggtgcc

SEQ ID NO: 5320223 - DNA, 16 bp, Homo sapiens
tgcacgtggcatgtgg

SEQ ID NO: 5320224 - DNA, 14 bp, Homo sapiens
tgcacgtggcctct

SEQ ID NO: 5320225 - DNA, 16 bp, Homo sapiens
tgcacgtggcctcttg

SEQ ID NO: 5320226 - DNA, 15 bp, Homo sapiens
tgcacgtggggccca

SEQ ID NO: 5320227 - DNA, 17 bp, Homo sapiens
tgcacgtggggcccact

SEQ ID NO: 5320228 - DNA, 13 bp, Homo sapiens
tgcacgtgtgttt

SEQ ID NO: 5320229 - DNA, 15 bp, Homo sapiens
tgcacgttatggtgt

SEQ ID NO: 5320230 - DNA, 14 bp, Homo sapiens
tgcacgttcataac

SEQ ID NO: 5320231 - DNA, 22 bp, Homo sapiens
tgcacgttcataaccaacaata

SEQ ID NO: 5320232 - DNA, 22 bp, Homo sapiens
tgcacgttctatattgtgccaa

SEQ ID NO: 5320233 - DNA, 17 bp, Homo sapiens
tgcacgttgctgaaggt

SEQ ID NO: 5320234 - DNA, 15 bp, Homo sapiens
tgcacgttgcttcag

SEQ ID NO: 5320235 - DNA, 16 bp, Homo sapiens
tgcacgtttggtttgc

SEQ ID NO: 5320236 - DNA, 16 bp, Homo sapiens
tgcacgttttcatctc

SEQ ID NO: 5320237 - DNA, 16 bp, Homo sapiens
tgcactaaaagtgatg

SEQ ID NO: 5320238 - DNA, 19 bp, Homo sapiens
tgcactaaagccagcctga

SEQ ID NO: 5320239 - DNA, 18 bp, Homo sapiens
tgcactaaataaactact

SEQ ID NO: 5320240 - DNA, 17 bp, Homo sapiens
tgcactaacagagtggc

SEQ ID NO: 5320241 - DNA, 15 bp, Homo sapiens
tgcactaactgctgg

SEQ ID NO: 5320242 - DNA, 13 bp, Homo sapiens
tgcactaagacaa

SEQ ID NO: 5320243 - DNA, 15 bp, Homo sapiens
tgcactaagacaaga

SEQ ID NO: 5320244 - DNA, 22 bp, Homo sapiens
tgcactaagagaaaattgcact

SEQ ID NO: 5320245 - DNA, 16 bp, Homo sapiens
tgcactactgacatgt

SEQ ID NO: 5320246 - DNA, 17 bp, Homo sapiens
tgcactagagaaaataa

SEQ ID NO: 5320247 - DNA, 14 bp, Homo sapiens
tgcactagccaacc

SEQ ID NO: 5320248 - DNA, 16 bp, Homo sapiens
tgcactagccaaccca

SEQ ID NO: 5320249 - DNA, 23 bp, Homo sapiens
tgcactaggaattctttgcattc

SEQ ID NO: 5320250 - DNA, 19 bp, Homo sapiens
tgcactatagccatttgcc

SEQ ID NO: 5320251 - DNA, 14 bp, Homo sapiens
tgcactatatacat

SEQ ID NO: 5320252 - DNA, 16 bp, Homo sapiens
tgcactatatgcaaac

SEQ ID NO: 5320253 - DNA, 18 bp, Homo sapiens
tgcactatatgcaaacag

SEQ ID NO: 5320254 - DNA, 21 bp, Homo sapiens
tgcactatatgtttacacaat

SEQ ID NO: 5320255 - DNA, 14 bp, Homo sapiens
tgcactatatttgt

SEQ ID NO: 5320256 - DNA, 16 bp, Homo sapiens
tgcactattcttaata

SEQ ID NO: 5320257 - DNA, 22 bp, Homo sapiens
tgcactcaaatcttaagaaata

SEQ ID NO: 5320258 - DNA, 21 bp, Homo sapiens
tgcactcaagttgtttaactg

SEQ ID NO: 5320259 - DNA, 17 bp, Homo sapiens
tgcactcacaggctaca

SEQ ID NO: 5320260 - DNA, 20 bp, Homo sapiens
tgcactcacccctagccctg

SEQ ID NO: 5320261 - DNA, 14 bp, Homo sapiens
tgcactcagctctt

SEQ ID NO: 5320262 - DNA, 22 bp, Homo sapiens
tgcactcagggtcagcagtgga

SEQ ID NO: 5320263 - DNA, 18 bp, Homo sapiens
tgcactcatagggtgctc

SEQ ID NO: 5320264 - DNA, 11 bp, Homo sapiens
tgcactccaga

SEQ ID NO: 5320265 - DNA, 15 bp, Homo sapiens
tgcactccagcctga

SEQ ID NO: 5320266 - DNA, 20 bp, Homo sapiens
tgcactccagcctgggcaac

SEQ ID NO: 5320267 - DNA, 20 bp, Homo sapiens
tgcactccagcctgggcgac

SEQ ID NO: 5320268 - DNA, 14 bp, Homo sapiens
tgcactccatccag

SEQ ID NO: 5320269 - DNA, 14 bp, Homo sapiens
tgcactccatggcc

SEQ ID NO: 5320270 - DNA, 16 bp, Homo sapiens
tgcactccatggccac

SEQ ID NO: 5320271 - DNA, 12 bp, Homo sapiens
tgcactcccctg

SEQ ID NO: 5320272 - DNA, 15 bp, Homo sapiens
tgcactcccctgctg

SEQ ID NO: 5320273 - DNA, 15 bp, Homo sapiens
tgcactcccgcctgg

SEQ ID NO: 5320274 - DNA, 19 bp, Homo sapiens
tgcactcccgcctgggcga

SEQ ID NO: 5320275 - DNA, 13 bp, Homo sapiens
tgcactccctggc

SEQ ID NO: 5320276 - DNA, 15 bp, Homo sapiens
tgcactcctcacaca

SEQ ID NO: 5320277 - DNA, 16 bp, Homo sapiens
tgcactcctcagggca

SEQ ID NO: 5320278 - DNA, 13 bp, Homo sapiens
tgcactcctgtct

SEQ ID NO: 5320279 - DNA, 19 bp, Homo sapiens
tgcactcgccatttcctca

SEQ ID NO: 5320280 - DNA, 16 bp, Homo sapiens
tgcactctaacactcg

SEQ ID NO: 5320281 - DNA, 14 bp, Homo sapiens
tgcactctactctg

SEQ ID NO: 5320282 - DNA, 14 bp, Homo sapiens
tgcactctgctaat

SEQ ID NO: 5320283 - DNA, 12 bp, Homo sapiens
tgcactctgtaa

SEQ ID NO: 5320284 - DNA, 15 bp, Homo sapiens
tgcactctgtgccca

SEQ ID NO: 5320285 - DNA, 12 bp, Homo sapiens
tgcactcttgaa

SEQ ID NO: 5320286 - DNA, 19 bp, Homo sapiens
tgcactcttgtacaaaaga

SEQ ID NO: 5320287 - DNA, 23 bp, Homo sapiens
tgcactcttgtttctcccgtgct

SEQ ID NO: 5320288 - DNA, 21 bp, Homo sapiens
tgcactcttttgagcagtaaa

SEQ ID NO: 5320289 - DNA, 19 bp, Homo sapiens
tgcactgaaaacttagcca

SEQ ID NO: 5320290 - DNA, 19 bp, Homo sapiens
tgcactgaagagagcattt

SEQ ID NO: 5320291 - DNA, 19 bp, Homo sapiens
tgcactgaagagctcttgg

SEQ ID NO: 5320292 - DNA, 20 bp, Homo sapiens
tgcactgaagagctcttggc

SEQ ID NO: 5320293 - DNA, 23 bp, Homo sapiens
tgcactgaagccggacagctgcc

SEQ ID NO: 5320294 - DNA, 24 bp, Homo sapiens
tgcactgaagtttgataaatagtg

SEQ ID NO: 5320295 - DNA, 19 bp, Homo sapiens
tgcactgaagtttttgaaa

SEQ ID NO: 5320296 - DNA, 23 bp, Homo sapiens
tgcactgaagtttttgaaatacc

SEQ ID NO: 5320297 - DNA, 20 bp, Homo sapiens
tgcactgaatcgtttcatgt

SEQ ID NO: 5320298 - DNA, 22 bp, Homo sapiens
tgcagcaggtggtaatgataaa

SEQ ID NO: 5320299 - DNA, 18 bp, Homo sapiens
tgcagcagtcgcccaagc

SEQ ID NO: 5320300 - DNA, 23 bp, Homo sapiens
tgcagcagtcgcccaagcagaca

SEQ ID NO: 5320301 - DNA, 18 bp, Homo sapiens
tgcagcagtgagtctctt

SEQ ID NO: 5320302 - DNA, 17 bp, Homo sapiens
tgcagcatacaaaaata

SEQ ID NO: 5320303 - DNA, 17 bp, Homo sapiens
tgcagcatgacctgtga

SEQ ID NO: 5320304 - DNA, 19 bp, Homo sapiens
tgcagcatgacctgtgacc

SEQ ID NO: 5320305 - DNA, 22 bp, Homo sapiens
tgcagcatgacctgtgaccagc

SEQ ID NO: 5320306 - DNA, 17 bp, Homo sapiens
tgcagcatgttgctgag

SEQ ID NO: 5320307 - DNA, 20 bp, Homo sapiens
tgcagcatgttgctgaggag

SEQ ID NO: 5320308 - DNA, 23 bp, Homo sapiens
tgcagcatgttgctgaggagtga

SEQ ID NO: 5320309 - DNA, 14 bp, Homo sapiens
tgcagcattgaagt

SEQ ID NO: 5320310 - DNA, 19 bp, Homo sapiens
tgcagccaaaggggagcca

SEQ ID NO: 5320311 - DNA, 14 bp, Homo sapiens
tgcagccacatggc

SEQ ID NO: 5320312 - DNA, 16 bp, Homo sapiens
tgcagccacatggccc

SEQ ID NO: 5320313 - DNA, 18 bp, Homo sapiens
tgcagccacatggcccca

SEQ ID NO: 5320314 - DNA, 22 bp, Homo sapiens
tgcagccacatggccccatccc

SEQ ID NO: 5320315 - DNA, 18 bp, Homo sapiens
tgcagccacgattggaga

SEQ ID NO: 5320316 - DNA, 20 bp, Homo sapiens
tgcagccacgattggagaat

SEQ ID NO: 5320317 - DNA, 21 bp, Homo sapiens
tgcagccacgattggagaata

SEQ ID NO: 5320318 - DNA, 16 bp, Homo sapiens
tgcagccactgattct

SEQ ID NO: 5320319 - DNA, 16 bp, Homo sapiens
tgcagccacttaggac

SEQ ID NO: 5320320 - DNA, 13 bp, Homo sapiens
tgcagccagacct

SEQ ID NO: 5320321 - DNA, 23 bp, Homo sapiens
tgcagccagacctattcctcctg

SEQ ID NO: 5320322 - DNA, 12 bp, Homo sapiens
tgcagccagccc

SEQ ID NO: 5320323 - DNA, 17 bp, Homo sapiens
tgcagccagcccagccc

SEQ ID NO: 5320324 - DNA, 14 bp, Homo sapiens
tgcagccaggactg

SEQ ID NO: 5320325 - DNA, 23 bp, Homo sapiens
tgcagccaggcctcgcctgccct

SEQ ID NO: 5320326 - DNA, 17 bp, Homo sapiens
tgcagccagggctgggg

SEQ ID NO: 5320327 - DNA, 20 bp, Homo sapiens
tgcagccagggctggggttg

SEQ ID NO: 5320328 - DNA, 12 bp, Homo sapiens
tgcagcccaagg

SEQ ID NO: 5320329 - DNA, 10 bp, Homo sapiens
tgcagcccac

SEQ ID NO: 5320330 - DNA, 15 bp, Homo sapiens
tgcagcccacagagg

SEQ ID NO: 5320331 - DNA, 22 bp, Homo sapiens
tgcagcccaccagacgtcaggc

SEQ ID NO: 5320332 - DNA, 17 bp, Homo sapiens
tgcagcccaccaggagc

SEQ ID NO: 5320333 - DNA, 19 bp, Homo sapiens
tgcagcccaccaggagcac

SEQ ID NO: 5320334 - DNA, 11 bp, Homo sapiens
tgcagcccaga

SEQ ID NO: 5320335 - DNA, 20 bp, Homo sapiens
tgcagcccagaacgggcctc

SEQ ID NO: 5320336 - DNA, 21 bp, Homo sapiens
tgcagcccatgcccacctgcc

SEQ ID NO: 5320337 - DNA, 21 bp, Homo sapiens
tgcagccccctcctgacccca

SEQ ID NO: 5320338 - DNA, 20 bp, Homo sapiens
tgcagccccgcctccaggcc

SEQ ID NO: 5320339 - DNA, 23 bp, Homo sapiens
tgcagccccgcctccaggccaca

SEQ ID NO: 5320340 - DNA, 21 bp, Homo sapiens
tgcagccccgcgcctccttcc

SEQ ID NO: 5320341 - DNA, 19 bp, Homo sapiens
tgcagcccctcctcctcgg

SEQ ID NO: 5320342 - DNA, 17 bp, Homo sapiens
tgcagcccctctcacag

SEQ ID NO: 5320343 - DNA, 14 bp, Homo sapiens
tgcagcccctggga

SEQ ID NO: 5320344 - DNA, 14 bp, Homo sapiens
tgcagcccctgggc

SEQ ID NO: 5320345 - DNA, 22 bp, Homo sapiens
tgcagcccgatgtccctgtccc

SEQ ID NO: 5320346 - DNA, 23 bp, Homo sapiens
tgcagcccgatgtccctgtcccc

SEQ ID NO: 5320347 - DNA, 17 bp, Homo sapiens
tgcagccctcgggaccc

SEQ ID NO: 5320348 - DNA, 22 bp, Homo sapiens
tgcagccctgagaaagccctgt

SEQ ID NO: 5320349 - DNA, 15 bp, Homo sapiens
tgcagcccttcctcc

SEQ ID NO: 5320350 - DNA, 16 bp, Homo sapiens
tgcagcccttcctccc

SEQ ID NO: 5320351 - DNA, 16 bp, Homo sapiens
tgcagcccttgggcag

SEQ ID NO: 5320352 - DNA, 16 bp, Homo sapiens
tgcagccgcagagaaa

SEQ ID NO: 5320353 - DNA, 14 bp, Homo sapiens
tgcagccgctgagc

SEQ ID NO: 5320354 - DNA, 19 bp, Homo sapiens
tgcagccggaggaggagat

SEQ ID NO: 5320355 - DNA, 18 bp, Homo sapiens
tgcagccggcacagggtc

SEQ ID NO: 5320356 - DNA, 20 bp, Homo sapiens
tgcagccggggagctgaggg

SEQ ID NO: 5320357 - DNA, 23 bp, Homo sapiens
tgcagccggggagctgaggggca

SEQ ID NO: 5320358 - DNA, 15 bp, Homo sapiens
tgcagccgtgcagga

SEQ ID NO: 5320359 - DNA, 17 bp, Homo sapiens
tgcagccgtgcaggact

SEQ ID NO: 5320360 - DNA, 13 bp, Homo sapiens
tgcagcctaagaa

SEQ ID NO: 5320361 - DNA, 19 bp, Homo sapiens
tgcagcctaagaagaaggc

SEQ ID NO: 5320362 - DNA, 22 bp, Homo sapiens
tgcagcctaagaagaaggccag

SEQ ID NO: 5320363 - DNA, 19 bp, Homo sapiens
tgcagcctagtaggagctg

SEQ ID NO: 5320364 - DNA, 20 bp, Homo sapiens
tgcagcctcaacctcctggg

SEQ ID NO: 5320365 - DNA, 21 bp, Homo sapiens
tgcagcctcaacctcctgggc

SEQ ID NO: 5320366 - DNA, 21 bp, Homo sapiens
tgcagcctcacagtccttacc

SEQ ID NO: 5320367 - DNA, 17 bp, Homo sapiens
tgcagcctcaggactgg

SEQ ID NO: 5320368 - DNA, 22 bp, Homo sapiens
tgcagcctcaggactgggagcc

SEQ ID NO: 5320369 - DNA, 17 bp, Homo sapiens
tgcagcctccacttccc

SEQ ID NO: 5320370 - DNA, 14 bp, Homo sapiens
tgcagcctccgcct

SEQ ID NO: 5320371 - DNA, 20 bp, Homo sapiens
tgcagcctccgcctcccggg

SEQ ID NO: 5320372 - DNA, 19 bp, Homo sapiens
tgcagcctccgcttccctg

SEQ ID NO: 5320373 - DNA, 19 bp, Homo sapiens
tgcagcctcgacctccctg

SEQ ID NO: 5320374 - DNA, 22 bp, Homo sapiens
tgcagcctcgacctccctggct

SEQ ID NO: 5320375 - DNA, 14 bp, Homo sapiens
tgcagcctctctgg

SEQ ID NO: 5320376 - DNA, 21 bp, Homo sapiens
tgcagcctctctggctggtct

SEQ ID NO: 5320377 - DNA, 13 bp, Homo sapiens
tgcagcctctgcc

SEQ ID NO: 5320378 - DNA, 20 bp, Homo sapiens
tgcagcctctgcctcccagg

SEQ ID NO: 5320379 - DNA, 19 bp, Homo sapiens
tgcagcctgagctccaccc

SEQ ID NO: 5320380 - DNA, 20 bp, Homo sapiens
tgcagcctgagctccaccct

SEQ ID NO: 5320381 - DNA, 21 bp, Homo sapiens
tgcagcctgagctccaccctc

SEQ ID NO: 5320382 - DNA, 17 bp, Homo sapiens
tgcagcctgcaggacct

SEQ ID NO: 5320383 - DNA, 19 bp, Homo sapiens
tgcagcctgcccctagaca

SEQ ID NO: 5320384 - DNA, 12 bp, Homo sapiens
tgcagcctgctc

SEQ ID NO: 5320385 - DNA, 14 bp, Homo sapiens
tgcagcctgctctt

SEQ ID NO: 5320386 - DNA, 17 bp, Homo sapiens
tgcagcctgctggggct

SEQ ID NO: 5320387 - DNA, 15 bp, Homo sapiens
tgcagcctggaggcc

SEQ ID NO: 5320388 - DNA, 21 bp, Homo sapiens
tgcagcctggctggtcctccc

SEQ ID NO: 5320389 - DNA, 13 bp, Homo sapiens
tgcagcctgggtc

SEQ ID NO: 5320390 - DNA, 23 bp, Homo sapiens
tgcagcctgggtctggatgggag

SEQ ID NO: 5320391 - DNA, 17 bp, Homo sapiens
tgcagccttcatcagaa

SEQ ID NO: 5320392 - DNA, 20 bp, Homo sapiens
tgcagccttcccctccctgt

SEQ ID NO: 5320393 - DNA, 20 bp, Homo sapiens
tgcagccttgcgctgtccca

SEQ ID NO: 5320394 - DNA, 22 bp, Homo sapiens
tgcagccttgcgctgtcccagg

SEQ ID NO: 5320395 - DNA, 23 bp, Homo sapiens
tgcagcctttgcctccccggctc

SEQ ID NO: 5320396 - DNA, 19 bp, Homo sapiens
tgcagccttttctggtccc

SEQ ID NO: 5320397 - DNA, 12 bp, Homo sapiens
tgcagcgaccct

SEQ ID NO: 5320398 - DNA, 12 bp, Homo sapiens
tgcagcgcagct

SEQ ID NO: 5320399 - DNA, 16 bp, Homo sapiens
tgcagcgccacccagt

SEQ ID NO: 5320400 - DNA, 22 bp, Homo sapiens
tgcagcggaagggactctgggc

SEQ ID NO: 5320401 - DNA, 23 bp, Homo sapiens
tgcagcggcagagcaattccagg

SEQ ID NO: 5320402 - DNA, 14 bp, Homo sapiens
tgcagcggctcctg

SEQ ID NO: 5320403 - DNA, 16 bp, Homo sapiens
tgcagcggctcctgca

SEQ ID NO: 5320404 - DNA, 20 bp, Homo sapiens
tgcagcggctgccctctggg

SEQ ID NO: 5320405 - DNA, 23 bp, Homo sapiens
tgcagcgtctgagcggccgcctg

SEQ ID NO: 5320406 - DNA, 19 bp, Homo sapiens
tgcagctaagctcaaatgt

SEQ ID NO: 5320407 - DNA, 21 bp, Homo sapiens
tgcagctaagctcaaatgtat

SEQ ID NO: 5320408 - DNA, 16 bp, Homo sapiens
tgcagctaatttgtga

SEQ ID NO: 5320409 - DNA, 17 bp, Homo sapiens
tgcagctaatttgtgaa

SEQ ID NO: 5320410 - DNA, 19 bp, Homo sapiens
tgcagctagtcctagtgaa

SEQ ID NO: 5320411 - DNA, 21 bp, Homo sapiens
tgcagctagtcctagtgaacc

SEQ ID NO: 5320412 - DNA, 13 bp, Homo sapiens
tgcagctatctgg

SEQ ID NO: 5320413 - DNA, 19 bp, Homo sapiens
tgcagctatggacaattta

SEQ ID NO: 5320414 - DNA, 13 bp, Homo sapiens
tgcagctcactgc

SEQ ID NO: 5320415 - DNA, 14 bp, Homo sapiens
tgcagctcatgttt

SEQ ID NO: 5320416 - DNA, 20 bp, Homo sapiens
tgcagctccctggcttctgt

SEQ ID NO: 5320417 - DNA, 15 bp, Homo sapiens
tgcagctcctcagcg

SEQ ID NO: 5320418 - DNA, 20 bp, Homo sapiens
tgcagctcctcagcggctcc

SEQ ID NO: 5320419 - DNA, 13 bp, Homo sapiens
tgcagctcctgga

SEQ ID NO: 5320420 - DNA, 16 bp, Homo sapiens
tgcagctcttcctgga

SEQ ID NO: 5320421 - DNA, 18 bp, Homo sapiens
tgcagctgaaattgaaaa

SEQ ID NO: 5320422 - DNA, 22 bp, Homo sapiens
tgcagctgaaattgaaaagtta

SEQ ID NO: 5320423 - DNA, 20 bp, Homo sapiens
tgcagctgacctctgttgtc

SEQ ID NO: 5320424 - DNA, 23 bp, Homo sapiens
tgcagctgagattccagaacgcc

SEQ ID NO: 5320425 - DNA, 15 bp, Homo sapiens
tgcagctgagcctga

SEQ ID NO: 5320426 - DNA, 16 bp, Homo sapiens
tgcagctgatgttgga

SEQ ID NO: 5320427 - DNA, 14 bp, Homo sapiens
tgcagctgatttta

SEQ ID NO: 5320428 - DNA, 16 bp, Homo sapiens
tgcagctgattttaac

SEQ ID NO: 5320429 - DNA, 23 bp, Homo sapiens
tgcagctgcaccatcacacatgc

SEQ ID NO: 5320430 - DNA, 13 bp, Homo sapiens
tgcagctgcctgg

SEQ ID NO: 5320431 - DNA, 14 bp, Homo sapiens
tgcagctgcctggg

SEQ ID NO: 5320432 - DNA, 12 bp, Homo sapiens
tgcagctgctcc

SEQ ID NO: 5320433 - DNA, 18 bp, Homo sapiens
tgcagctgctccccaggc

SEQ ID NO: 5320434 - DNA, 15 bp, Homo sapiens
tgcagctgctcttgc

SEQ ID NO: 5320435 - DNA, 13 bp, Homo sapiens
tgcagctgctggt

SEQ ID NO: 5320436 - DNA, 14 bp, Homo sapiens
tgcagctgctggtt

SEQ ID NO: 5320437 - DNA, 18 bp, Homo sapiens
tgcagctgctggttttgg

SEQ ID NO: 5320438 - DNA, 15 bp, Homo sapiens
tgcagctgctgtctg

SEQ ID NO: 5320439 - DNA, 16 bp, Homo sapiens
tgcagctgctgtctga

SEQ ID NO: 5320440 - DNA, 22 bp, Homo sapiens
tgcagctggaatgtgccacaga

SEQ ID NO: 5320441 - DNA, 23 bp, Homo sapiens
tgcagctggaatgtgccacagag

SEQ ID NO: 5320442 - DNA, 12 bp, Homo sapiens
tgcagctggaca

SEQ ID NO: 5320443 - DNA, 13 bp, Homo sapiens
tgcagctggacag

SEQ ID NO: 5320444 - DNA, 16 bp, Homo sapiens
tgcagctggacagagg

SEQ ID NO: 5320445 - DNA, 12 bp, Homo sapiens
tgcagctggccc

SEQ ID NO: 5320446 - DNA, 13 bp, Homo sapiens
tgcagctggccca

SEQ ID NO: 5320447 - DNA, 17 bp, Homo sapiens
tgcagctgggaagagga

SEQ ID NO: 5320448 - DNA, 23 bp, Homo sapiens
tgcagctgggccccatgctctgc

SEQ ID NO: 5320449 - DNA, 23 bp, Homo sapiens
tgcagctgggcttggcctggaga

SEQ ID NO: 5320450 - DNA, 12 bp, Homo sapiens
tgcagctgtcac

SEQ ID NO: 5320451 - DNA, 13 bp, Homo sapiens
tgcagctgtcacc

SEQ ID NO: 5320452 - DNA, 14 bp, Homo sapiens
tgcagctgtcacca

SEQ ID NO: 5320453 - DNA, 22 bp, Homo sapiens
tgcagctgtgagaagtcactca

SEQ ID NO: 5320454 - DNA, 20 bp, Homo sapiens
tgcagctgtggcagagttac

SEQ ID NO: 5320455 - DNA, 14 bp, Homo sapiens
tgcagctgttgaga

SEQ ID NO: 5320456 - DNA, 16 bp, Homo sapiens
tgcagctgttgagaaa

SEQ ID NO: 5320457 - DNA, 18 bp, Homo sapiens
tgcagctgttttgttgac

SEQ ID NO: 5320458 - DNA, 15 bp, Homo sapiens
tgcagcttcacccac

SEQ ID NO: 5320459 - DNA, 17 bp, Homo sapiens
tgcagcttcacccacca

SEQ ID NO: 5320460 - DNA, 19 bp, Homo sapiens
tgcagcttcacccaccagg

SEQ ID NO: 5320461 - DNA, 15 bp, Homo sapiens
tgcagcttcaggtga

SEQ ID NO: 5320462 - DNA, 11 bp, Homo sapiens
tgcagcttcat

SEQ ID NO: 5320463 - DNA, 17 bp, Homo sapiens
tgcagcttcatcaattt

SEQ ID NO: 5320464 - DNA, 18 bp, Homo sapiens
tgcagcttcatcaatttt

SEQ ID NO: 5320465 - DNA, 20 bp, Homo sapiens
tgcagcttccaaatctcata

SEQ ID NO: 5320466 - DNA, 15 bp, Homo sapiens
tgcagcttcctgtca

SEQ ID NO: 5320467 - DNA, 17 bp, Homo sapiens
tgcagcttcgaggacag

SEQ ID NO: 5320468 - DNA, 15 bp, Homo sapiens
tgcagcttctgtcct

SEQ ID NO: 5320469 - DNA, 16 bp, Homo sapiens
tgcagcttctgtcctg

SEQ ID NO: 5320470 - DNA, 22 bp, Homo sapiens
tgcagcttgacattatgtttta

SEQ ID NO: 5320471 - DNA, 15 bp, Homo sapiens
tgcagcttgcagtcc

SEQ ID NO: 5320472 - DNA, 17 bp, Homo sapiens
tgcagcttgtagccagc

SEQ ID NO: 5320473 - DNA, 20 bp, Homo sapiens
tgcagcttgtagccagccgg

SEQ ID NO: 5320474 - DNA, 21 bp, Homo sapiens
tgcagcttgtccttgctcctg

SEQ ID NO: 5320475 - DNA, 15 bp, Homo sapiens
tgcatcattactgtt

SEQ ID NO: 5320476 - DNA, 17 bp, Homo sapiens
tgcatccaactccagga

SEQ ID NO: 5320477 - DNA, 17 bp, Homo sapiens
tgcatccaatctgctca

SEQ ID NO: 5320478 - DNA, 22 bp, Homo sapiens
tgcatccacaggattccagttg

SEQ ID NO: 5320479 - DNA, 14 bp, Homo sapiens
tgcatccagaggca

SEQ ID NO: 5320480 - DNA, 14 bp, Homo sapiens
tgcatccagcagca

SEQ ID NO: 5320481 - DNA, 21 bp, Homo sapiens
tgcatccagcagtacaataaa

SEQ ID NO: 5320482 - DNA, 17 bp, Homo sapiens
tgcatccattcctcagg

SEQ ID NO: 5320483 - DNA, 19 bp, Homo sapiens
tgcatccattcctcaggga

SEQ ID NO: 5320484 - DNA, 20 bp, Homo sapiens
tgcatccattcctcagggac

SEQ ID NO: 5320485 - DNA, 21 bp, Homo sapiens
tgcatccattcctcagggaca

SEQ ID NO: 5320486 - DNA, 13 bp, Homo sapiens
tgcatccatttga

SEQ ID NO: 5320487 - DNA, 21 bp, Homo sapiens
tgcatccatttgaacacatta

SEQ ID NO: 5320488 - DNA, 18 bp, Homo sapiens
tgcatcccacgttctgtt

SEQ ID NO: 5320489 - DNA, 14 bp, Homo sapiens
tgcatcccagcacc

SEQ ID NO: 5320490 - DNA, 19 bp, Homo sapiens
tgcatcccagcacctgcct

SEQ ID NO: 5320491 - DNA, 17 bp, Homo sapiens
tgcatcccccctgctca

SEQ ID NO: 5320492 - DNA, 18 bp, Homo sapiens
tgcatcccccctgctcag

SEQ ID NO: 5320493 - DNA, 16 bp, Homo sapiens
tgcatcccccttagaa

SEQ ID NO: 5320494 - DNA, 18 bp, Homo sapiens
tgcatccccttccagctc

SEQ ID NO: 5320495 - DNA, 24 bp, Homo sapiens
tgcatccccttccagctccctccc

SEQ ID NO: 5320496 - DNA, 19 bp, Homo sapiens
tgcatcccgatacctcagc

SEQ ID NO: 5320497 - DNA, 20 bp, Homo sapiens
tgcatcccgatacctcagcc

SEQ ID NO: 5320498 - DNA, 16 bp, Homo sapiens
tgcatccctccacccc

SEQ ID NO: 5320499 - DNA, 14 bp, Homo sapiens
tgcatccctgagac

SEQ ID NO: 5320500 - DNA, 19 bp, Homo sapiens
tgcatcccttggcccctct

SEQ ID NO: 5320501 - DNA, 20 bp, Homo sapiens
tgcatcccttggcccctctc

SEQ ID NO: 5320502 - DNA, 22 bp, Homo sapiens
tgcatcccttggcccctctctg

SEQ ID NO: 5320503 - DNA, 17 bp, Homo sapiens
tgcatccgcctgaaagt

SEQ ID NO: 5320504 - DNA, 19 bp, Homo sapiens
tgcatccgcctgaaagtgt

SEQ ID NO: 5320505 - DNA, 16 bp, Homo sapiens
tgcatccggagaattg

SEQ ID NO: 5320506 - DNA, 16 bp, Homo sapiens
tgcatccgtgagcagt

SEQ ID NO: 5320507 - DNA, 20 bp, Homo sapiens
tgcatcctactcctacctgg

SEQ ID NO: 5320508 - DNA, 16 bp, Homo sapiens
tgcatcctatttggtg

SEQ ID NO: 5320509 - DNA, 12 bp, Homo sapiens
tgcatcctcagc

SEQ ID NO: 5320510 - DNA, 14 bp, Homo sapiens
tgcatcctcagccc

SEQ ID NO: 5320511 - DNA, 16 bp, Homo sapiens
tgcatcctcagcccca

SEQ ID NO: 5320512 - DNA, 17 bp, Homo sapiens
tgcatcctcagccccag

SEQ ID NO: 5320513 - DNA, 21 bp, Homo sapiens
tgcatcctcagccccagggcc

SEQ ID NO: 5320514 - DNA, 14 bp, Homo sapiens
tgcatcctcccctc

SEQ ID NO: 5320515 - DNA, 13 bp, Homo sapiens
tgcatcctcctca

SEQ ID NO: 5320516 - DNA, 15 bp, Homo sapiens
tgcatcctgaggcca

SEQ ID NO: 5320517 - DNA, 18 bp, Homo sapiens
tgcatcctgaggccagtg

SEQ ID NO: 5320518 - DNA, 13 bp, Homo sapiens
tgcatcctgctgg

SEQ ID NO: 5320519 - DNA, 14 bp, Homo sapiens
tgcatcctgctggg

SEQ ID NO: 5320520 - DNA, 17 bp, Homo sapiens
tgcatcctggcttgaaa

SEQ ID NO: 5320521 - DNA, 20 bp, Homo sapiens
tgcatccttcatcacagcat

SEQ ID NO: 5320522 - DNA, 15 bp, Homo sapiens
tgcatccttcctata

SEQ ID NO: 5320523 - DNA, 14 bp, Homo sapiens
tgcatccttcctgg

SEQ ID NO: 5320524 - DNA, 15 bp, Homo sapiens
tgcatccttcctggg

SEQ ID NO: 5320525 - DNA, 17 bp, Homo sapiens
tgcatccttcctgggga

SEQ ID NO: 5320526 - DNA, 16 bp, Homo sapiens
tgcatccttgtaatac

SEQ ID NO: 5320527 - DNA, 18 bp, Homo sapiens
tgcatccttgtaatacct

SEQ ID NO: 5320528 - DNA, 21 bp, Homo sapiens
tgcatcgacactaaaaactga

SEQ ID NO: 5320529 - DNA, 18 bp, Homo sapiens
tgcatcgagtcaaaactc

SEQ ID NO: 5320530 - DNA, 21 bp, Homo sapiens
tgcatcgctgtccaagtgttt

SEQ ID NO: 5320531 - DNA, 20 bp, Homo sapiens
tgcatcgggaaagaagaaac

SEQ ID NO: 5320532 - DNA, 15 bp, Homo sapiens
tgcatcgtggagaca

SEQ ID NO: 5320533 - DNA, 15 bp, Homo sapiens
tgcatctaagcccat

SEQ ID NO: 5320534 - DNA, 17 bp, Homo sapiens
tgcatctaagcccatgg

SEQ ID NO: 5320535 - DNA, 19 bp, Homo sapiens
tgcatctcaaaattattct

SEQ ID NO: 5320536 - DNA, 21 bp, Homo sapiens
tgcatctcactggatgcaaag

SEQ ID NO: 5320537 - DNA, 14 bp, Homo sapiens
tgcatctccacctg

SEQ ID NO: 5320538 - DNA, 13 bp, Homo sapiens
tgcatctcccaga

SEQ ID NO: 5320539 - DNA, 18 bp, Homo sapiens
tgcatctcccagataatg

SEQ ID NO: 5320540 - DNA, 12 bp, Homo sapiens
tgcatctctgtg

SEQ ID NO: 5320541 - DNA, 13 bp, Homo sapiens
tgcatctgaaagt

SEQ ID NO: 5320542 - DNA, 21 bp, Homo sapiens
tgcatctgaccagcagcgcct

SEQ ID NO: 5320543 - DNA, 23 bp, Homo sapiens
tgcatctgaccccggggggctgg

SEQ ID NO: 5320544 - DNA, 16 bp, Homo sapiens
tgcatctgataaagtt

SEQ ID NO: 5320545 - DNA, 20 bp, Homo sapiens
tgcatctggcacgtggccag

SEQ ID NO: 5320546 - DNA, 21 bp, Homo sapiens
tgcatctggcctatgaccctg

SEQ ID NO: 5320547 - DNA, 22 bp, Homo sapiens
tgcatctggcctatgaccctgt

SEQ ID NO: 5320548 - DNA, 13 bp, Homo sapiens
tgcatctggcctg

SEQ ID NO: 5320549 - DNA, 14 bp, Homo sapiens
tgcatctggcctgg

SEQ ID NO: 5320550 - DNA, 15 bp, Homo sapiens
tgcatctggcctggg

SEQ ID NO: 5320551 - DNA, 20 bp, Homo sapiens
tgcatctgggattcccacca

SEQ ID NO: 5320552 - DNA, 13 bp, Homo sapiens
tgcatctgggcca

SEQ ID NO: 5320553 - DNA, 23 bp, Homo sapiens
tgcatctgggccagaagtcctcc

SEQ ID NO: 5320554 - DNA, 12 bp, Homo sapiens
tgcatctggtgt

SEQ ID NO: 5320555 - DNA, 22 bp, Homo sapiens
tgcatctgtataagtaagaaaa

SEQ ID NO: 5320556 - DNA, 14 bp, Homo sapiens
tgcatctgtcctca

SEQ ID NO: 5320557 - DNA, 20 bp, Homo sapiens
tgcatctgtctgctctgcat

SEQ ID NO: 5320558 - DNA, 13 bp, Homo sapiens
tgcatctgtgcat

SEQ ID NO: 5320559 - DNA, 13 bp, Homo sapiens
tgcatctgtggcc

SEQ ID NO: 5320560 - DNA, 19 bp, Homo sapiens
tgcatctgtgtgtgtgtgc

SEQ ID NO: 5320561 - DNA, 23 bp, Homo sapiens
tgcatctgtgtgtgtgtgcgtgt

SEQ ID NO: 5320562 - DNA, 13 bp, Homo sapiens
tgcatcttaacat

SEQ ID NO: 5320563 - DNA, 14 bp, Homo sapiens
tgcatcttaacatg

SEQ ID NO: 5320564 - DNA, 17 bp, Homo sapiens
tgcatcttactgaaggt

SEQ ID NO: 5320565 - DNA, 18 bp, Homo sapiens
tgcatcttactgaaggta

SEQ ID NO: 5320566 - DNA, 18 bp, Homo sapiens
tgcatcttatagcacttt

SEQ ID NO: 5320567 - DNA, 17 bp, Homo sapiens
tgcatcttgctctgtgg

SEQ ID NO: 5320568 - DNA, 20 bp, Homo sapiens
tgcatcttggggacatctct

SEQ ID NO: 5320569 - DNA, 21 bp, Homo sapiens
tgcatctttccctgccctccc

SEQ ID NO: 5320570 - DNA, 16 bp, Homo sapiens
tgcatctttctcttcc

SEQ ID NO: 5320571 - DNA, 18 bp, Homo sapiens
tgcatctttctcttccca

SEQ ID NO: 5320572 - DNA, 12 bp, Homo sapiens
tgcatctttgat

SEQ ID NO: 5320573 - DNA, 18 bp, Homo sapiens
tgcatctttgatgtgttg

SEQ ID NO: 5320574 - DNA, 20 bp, Homo sapiens
tgcatctttgttacttcctt

SEQ ID NO: 5320575 - DNA, 15 bp, Homo sapiens
tgcatgaaaaaccat

SEQ ID NO: 5320576 - DNA, 20 bp, Homo sapiens
tgcatgaaaaatcatgggcc

SEQ ID NO: 5320577 - DNA, 14 bp, Homo sapiens
tgcatgaaaaggat

SEQ ID NO: 5320578 - DNA, 11 bp, Homo sapiens
tgcatgaaaat

SEQ ID NO: 5320579 - DNA, 15 bp, Homo sapiens
tgcatgaaagcacaa

SEQ ID NO: 5320580 - DNA, 13 bp, Homo sapiens
tgcatgaaagcat

SEQ ID NO: 5320581 - DNA, 14 bp, Homo sapiens
tgcatgaaagcgtt

SEQ ID NO: 5320582 - DNA, 14 bp, Homo sapiens
tgcatgaaatgaat

SEQ ID NO: 5320583 - DNA, 15 bp, Homo sapiens
tgcatgaaatgaatg

SEQ ID NO: 5320584 - DNA, 19 bp, Homo sapiens
tgcatgaaattttgcctgc

SEQ ID NO: 5320585 - DNA, 20 bp, Homo sapiens
tgcatgaagagaagcaattt

SEQ ID NO: 5320586 - DNA, 11 bp, Homo sapiens
tgcatgaagca

SEQ ID NO: 5320587 - DNA, 13 bp, Homo sapiens
tgcatgaaggttt

SEQ ID NO: 5320588 - DNA, 18 bp, Homo sapiens
tgcatgaaggtttctgaa

SEQ ID NO: 5320589 - DNA, 16 bp, Homo sapiens
tgcatgaatccatcga

SEQ ID NO: 5320590 - DNA, 16 bp, Homo sapiens
tgcatgacctaccagg

SEQ ID NO: 5320591 - DNA, 22 bp, Homo sapiens
tgcatgagaactaaatagattt

SEQ ID NO: 5320592 - DNA, 17 bp, Homo sapiens
tgcatgagaatgtcatt

SEQ ID NO: 5320593 - DNA, 20 bp, Homo sapiens
tgcatgagaatgtcatttgc

SEQ ID NO: 5320594 - DNA, 22 bp, Homo sapiens
tgcatgagctgatcagcctgtg

SEQ ID NO: 5320595 - DNA, 21 bp, Homo sapiens
tgcatgatatcttcaagcctg

SEQ ID NO: 5320596 - DNA, 14 bp, Homo sapiens
tgcatgatattgta

SEQ ID NO: 5320597 - DNA, 17 bp, Homo sapiens
tgcatgatattgtatgt

SEQ ID NO: 5320598 - DNA, 16 bp, Homo sapiens
tgcatgatctgtcaaa

SEQ ID NO: 5320599 - DNA, 17 bp, Homo sapiens
tgcatgatgactcttct

SEQ ID NO: 5320600 - DNA, 24 bp, Homo sapiens
tgcatgatgactcttcttatcaca

SEQ ID NO: 5320601 - DNA, 16 bp, Homo sapiens
tgcatgatggtgagag

SEQ ID NO: 5320602 - DNA, 18 bp, Homo sapiens
tgcatgatgtttgcccaa

SEQ ID NO: 5320603 - DNA, 14 bp, Homo sapiens
tgcatgattagtgc

SEQ ID NO: 5320604 - DNA, 17 bp, Homo sapiens
tgcatgattcttctctt

SEQ ID NO: 5320605 - DNA, 19 bp, Homo sapiens
tgcatgatttactcttaga

SEQ ID NO: 5320606 - DNA, 13 bp, Homo sapiens
tgcatgattttat

SEQ ID NO: 5320607 - DNA, 16 bp, Homo sapiens
tgcatgattttataca

SEQ ID NO: 5320608 - DNA, 19 bp, Homo sapiens
tgcatgattttatacatag

SEQ ID NO: 5320609 - DNA, 20 bp, Homo sapiens
tgcatgattttatacatagt

SEQ ID NO: 5320610 - DNA, 21 bp, Homo sapiens
tgcatgattttatacatagtc

SEQ ID NO: 5320611 - DNA, 14 bp, Homo sapiens
tgcatgattttgta

SEQ ID NO: 5320612 - DNA, 15 bp, Homo sapiens
tgcatgcaaacaaga

SEQ ID NO: 5320613 - DNA, 19 bp, Homo sapiens
tgcatgcaaaccaggagca

SEQ ID NO: 5320614 - DNA, 13 bp, Homo sapiens
tgcatgcaactaa

SEQ ID NO: 5320615 - DNA, 18 bp, Homo sapiens
tgcatgcactgtctcagc

SEQ ID NO: 5320616 - DNA, 15 bp, Homo sapiens
tgcatgcagcaacac

SEQ ID NO: 5320617 - DNA, 21 bp, Homo sapiens
tgcatgcagcaacacccaagt

SEQ ID NO: 5320618 - DNA, 14 bp, Homo sapiens
tgcatgcagggccc

SEQ ID NO: 5320619 - DNA, 15 bp, Homo sapiens
tgcatgcagtcttgt

SEQ ID NO: 5320620 - DNA, 16 bp, Homo sapiens
tgcatgcagtcttgta

SEQ ID NO: 5320621 - DNA, 18 bp, Homo sapiens
tgcatgcattgagctgcc

SEQ ID NO: 5320622 - DNA, 21 bp, Homo sapiens
tgcatgccaaggggttaatga

SEQ ID NO: 5320623 - DNA, 16 bp, Homo sapiens
tgcatgccctaagagt

SEQ ID NO: 5320624 - DNA, 23 bp, Homo sapiens
tgcatgccctaagagtgtcactg

SEQ ID NO: 5320625 - DNA, 13 bp, Homo sapiens
tgcatgccctctc

SEQ ID NO: 5320626 - DNA, 14 bp, Homo sapiens
tgcatgccctctca

SEQ ID NO: 5320627 - DNA, 16 bp, Homo sapiens
tgcatgccctctcagg

SEQ ID NO: 5320628 - DNA, 16 bp, Homo sapiens
tgcatgccctctctga

SEQ ID NO: 5320629 - DNA, 19 bp, Homo sapiens
tgcatgcccttcctttcta

SEQ ID NO: 5320630 - DNA, 14 bp, Homo sapiens
tgcatgcctggccc

SEQ ID NO: 5320631 - DNA, 12 bp, Homo sapiens
tgcatgcctggg

SEQ ID NO: 5320632 - DNA, 16 bp, Homo sapiens
tgcatgcgcaggctca

SEQ ID NO: 5320633 - DNA, 13 bp, Homo sapiens
tgcatgcggccca

SEQ ID NO: 5320634 - DNA, 15 bp, Homo sapiens
tgcatgcggcccagc

SEQ ID NO: 5320635 - DNA, 18 bp, Homo sapiens
tgcatgcggcccagcccg

SEQ ID NO: 5320636 - DNA, 17 bp, Homo sapiens
tgcatgctagtgttgta

SEQ ID NO: 5320637 - DNA, 22 bp, Homo sapiens
tgcatgctagtgttgtatttct

SEQ ID NO: 5320638 - DNA, 21 bp, Homo sapiens
tgcatgctattcacaattatt

SEQ ID NO: 5320639 - DNA, 14 bp, Homo sapiens
tgcatgctcctctg

SEQ ID NO: 5320640 - DNA, 16 bp, Homo sapiens
tgcatgctcctctgcc

SEQ ID NO: 5320641 - DNA, 20 bp, Homo sapiens
tgcatgctcctctgcctgtg

SEQ ID NO: 5320642 - DNA, 23 bp, Homo sapiens
tgcatgctcctctgcctgtgccc

SEQ ID NO: 5320643 - DNA, 17 bp, Homo sapiens
tgcatgctctctgcagc

SEQ ID NO: 5320644 - DNA, 13 bp, Homo sapiens
tgcatgctctgga

SEQ ID NO: 5320645 - DNA, 14 bp, Homo sapiens
tgcatgctctggaa

SEQ ID NO: 5320646 - DNA, 15 bp, Homo sapiens
tgcatgctctggaag

SEQ ID NO: 5320647 - DNA, 17 bp, Homo sapiens
tgcatgctgataatcat

SEQ ID NO: 5320648 - DNA, 15 bp, Homo sapiens
tgcatgctgcccagc

SEQ ID NO: 5320649 - DNA, 17 bp, Homo sapiens
tgcatgctgctttaatt

SEQ ID NO: 5320650 - DNA, 23 bp, Homo sapiens
tgcatgctgctttaattgtgaat

SEQ ID NO: 5320651 - DNA, 17 bp, Homo sapiens
tgcatgcttagagcatg

SEQ ID NO: 5320652 - DNA, 17 bp, Homo sapiens
tgcatgcttctttataa

SEQ ID NO: 5320653 - DNA, 14 bp, Homo sapiens
tgcatggaaatcag

SEQ ID NO: 5320654 - DNA, 17 bp, Homo sapiens
tgccaaataaaatgttt

SEQ ID NO: 5320655 - DNA, 22 bp, Homo sapiens
tgccaaataaaatgtttacatt

SEQ ID NO: 5320656 - DNA, 17 bp, Homo sapiens
tgccaaataaacagcta

SEQ ID NO: 5320657 - DNA, 21 bp, Homo sapiens
tgccaaataaacagctattta

SEQ ID NO: 5320658 - DNA, 15 bp, Homo sapiens
tgccaaataaatgct

SEQ ID NO: 5320659 - DNA, 16 bp, Homo sapiens
tgccaaatagccccag

SEQ ID NO: 5320660 - DNA, 17 bp, Homo sapiens
tgccaaatagccccaga

SEQ ID NO: 5320661 - DNA, 17 bp, Homo sapiens
tgccaaatataaataaa

SEQ ID NO: 5320662 - DNA, 19 bp, Homo sapiens
tgccaaatataaataaaaa

SEQ ID NO: 5320663 - DNA, 22 bp, Homo sapiens
tgccaaatataaataaaaataa

SEQ ID NO: 5320664 - DNA, 17 bp, Homo sapiens
tgccaaatcctgggcat

SEQ ID NO: 5320665 - DNA, 19 bp, Homo sapiens
tgccaaattccatgtccct

SEQ ID NO: 5320666 - DNA, 15 bp, Homo sapiens
tgccaaattgagata

SEQ ID NO: 5320667 - DNA, 15 bp, Homo sapiens
tgccaaattgctgca

SEQ ID NO: 5320668 - DNA, 23 bp, Homo sapiens
tgccaaattttggccaaagtgtt

SEQ ID NO: 5320669 - DNA, 19 bp, Homo sapiens
tgccaacaagaatgcattg

SEQ ID NO: 5320670 - DNA, 20 bp, Homo sapiens
tgccaacaagaatgcattga

SEQ ID NO: 5320671 - DNA, 23 bp, Homo sapiens
tgccaacaagaatgcattgatat

SEQ ID NO: 5320672 - DNA, 18 bp, Homo sapiens
tgccaacaccacagaaat

SEQ ID NO: 5320673 - DNA, 21 bp, Homo sapiens
tgccaacaccacagaaatggg

SEQ ID NO: 5320674 - DNA, 21 bp, Homo sapiens
tgccaacactcaagaagcagg

SEQ ID NO: 5320675 - DNA, 23 bp, Homo sapiens
tgccaacacttaatcattttatg

SEQ ID NO: 5320676 - DNA, 21 bp, Homo sapiens
tgccaacagtgttaggcctgg

SEQ ID NO: 5320677 - DNA, 23 bp, Homo sapiens
tgccaacatacccttctttaaat

SEQ ID NO: 5320678 - DNA, 17 bp, Homo sapiens
tgccaacatgaggacag

SEQ ID NO: 5320679 - DNA, 18 bp, Homo sapiens
tgccaacatgaggacaga

SEQ ID NO: 5320680 - DNA, 19 bp, Homo sapiens
tgccaacatgaggacagaa

SEQ ID NO: 5320681 - DNA, 20 bp, Homo sapiens
tgccaacatgaggacagaag

SEQ ID NO: 5320682 - DNA, 15 bp, Homo sapiens
tgccaacatggtgaa

SEQ ID NO: 5320683 - DNA, 14 bp, Homo sapiens
tgccaacattgcct

SEQ ID NO: 5320684 - DNA, 22 bp, Homo sapiens
tgccaaccataccttccttccc

SEQ ID NO: 5320685 - DNA, 21 bp, Homo sapiens
tgccaaccccacccagctcca

SEQ ID NO: 5320686 - DNA, 13 bp, Homo sapiens
tgccaacccctct

SEQ ID NO: 5320687 - DNA, 16 bp, Homo sapiens
tgccaaccctgggcta

SEQ ID NO: 5320688 - DNA, 16 bp, Homo sapiens
tgccaaccctgtgtca

SEQ ID NO: 5320689 - DNA, 12 bp, Homo sapiens
tgccaacctaaa

SEQ ID NO: 5320690 - DNA, 21 bp, Homo sapiens
tgccaacctcgctccaactcc

SEQ ID NO: 5320691 - DNA, 21 bp, Homo sapiens
tgccaacctgtaataaatatg

SEQ ID NO: 5320692 - DNA, 23 bp, Homo sapiens
tgccaacctgttcttagagtgta

SEQ ID NO: 5320693 - DNA, 15 bp, Homo sapiens
tgccaacgcctcctg

SEQ ID NO: 5320694 - DNA, 20 bp, Homo sapiens
tgccaactccatgaccaggc

SEQ ID NO: 5320695 - DNA, 20 bp, Homo sapiens
tgccaactccatgtcaggga

SEQ ID NO: 5320696 - DNA, 15 bp, Homo sapiens
tgccaactcgggagc

SEQ ID NO: 5320697 - DNA, 17 bp, Homo sapiens
tgccaactcgggagcat

SEQ ID NO: 5320698 - DNA, 22 bp, Homo sapiens
tgccaactgaagccttcttctg

SEQ ID NO: 5320699 - DNA, 15 bp, Homo sapiens
tgccaactggtcact

SEQ ID NO: 5320700 - DNA, 15 bp, Homo sapiens
tgccaacttcccaca

SEQ ID NO: 5320701 - DNA, 21 bp, Homo sapiens
tgccaacttcttcagagctga

SEQ ID NO: 5320702 - DNA, 13 bp, Homo sapiens
tgccaagaaatcg

SEQ ID NO: 5320703 - DNA, 22 bp, Homo sapiens
tgccaagaacagaaaacaagaa

SEQ ID NO: 5320704 - DNA, 17 bp, Homo sapiens
tgccaagacaaatcaac

SEQ ID NO: 5320705 - DNA, 19 bp, Homo sapiens
tgccaagacaaatcaacag

SEQ ID NO: 5320706 - DNA, 22 bp, Homo sapiens
tgccaagacaaatcaacagaag

SEQ ID NO: 5320707 - DNA, 23 bp, Homo sapiens
tgccaagacaaatcaacagaagc

SEQ ID NO: 5320708 - DNA, 20 bp, Homo sapiens
tgccaagaccatttcacaga

SEQ ID NO: 5320709 - DNA, 17 bp, Homo sapiens
tgccaagactgctgtgg

SEQ ID NO: 5320710 - DNA, 21 bp, Homo sapiens
tgccaagactgctgtggccag

SEQ ID NO: 5320711 - DNA, 14 bp, Homo sapiens
tgccaagagccgac

SEQ ID NO: 5320712 - DNA, 20 bp, Homo sapiens
tgccaagagtcaacaggtca

SEQ ID NO: 5320713 - DNA, 17 bp, Homo sapiens
tgccaagagtgaaggga

SEQ ID NO: 5320714 - DNA, 18 bp, Homo sapiens
tgccaagattctactctt

SEQ ID NO: 5320715 - DNA, 19 bp, Homo sapiens
tgccaagattctactcttg

SEQ ID NO: 5320716 - DNA, 22 bp, Homo sapiens
tgccaagattctactcttgtca

SEQ ID NO: 5320717 - DNA, 14 bp, Homo sapiens
tgccaagatttaaa

SEQ ID NO: 5320718 - DNA, 19 bp, Homo sapiens
tgccaagcacagtgcctgc

SEQ ID NO: 5320719 - DNA, 14 bp, Homo sapiens
tgccaagcactcga

SEQ ID NO: 5320720 - DNA, 14 bp, Homo sapiens
tgccaagcactgtg

SEQ ID NO: 5320721 - DNA, 13 bp, Homo sapiens
tgccaagccagat

SEQ ID NO: 5320722 - DNA, 22 bp, Homo sapiens
tgccaagccagattctcttgaa

SEQ ID NO: 5320723 - DNA, 15 bp, Homo sapiens
tgccaagcctggagc

SEQ ID NO: 5320724 - DNA, 20 bp, Homo sapiens
tgccaagcctggagcccctg

SEQ ID NO: 5320725 - DNA, 12 bp, Homo sapiens
tgccaagccttc

SEQ ID NO: 5320726 - DNA, 20 bp, Homo sapiens
tgccaagcgagaatgcaggc

SEQ ID NO: 5320727 - DNA, 19 bp, Homo sapiens
tgccaagctaatctgcctg

SEQ ID NO: 5320728 - DNA, 19 bp, Homo sapiens
tgccaagctcacacagcag

SEQ ID NO: 5320729 - DNA, 15 bp, Homo sapiens
tgccaagctcaggac

SEQ ID NO: 5320730 - DNA, 22 bp, Homo sapiens
tgccaagctcaggaccaggcaa

SEQ ID NO: 5320731 - DNA, 13 bp, Homo sapiens
tgccaaggagcat

SEQ ID NO: 5320732 - DNA, 14 bp, Homo sapiens
tgccaaggagcccc

SEQ ID NO: 5320733 - DNA, 15 bp, Homo sapiens
tgccaaggagcccct

SEQ ID NO: 5320734 - DNA, 22 bp, Homo sapiens
tgccaaggaggtcccaggaagt

SEQ ID NO: 5320735 - DNA, 17 bp, Homo sapiens
tgccaaggcagaggcct

SEQ ID NO: 5320736 - DNA, 15 bp, Homo sapiens
tgccaaggcatcccc

SEQ ID NO: 5320737 - DNA, 16 bp, Homo sapiens
tgccaaggcatcccca

SEQ ID NO: 5320738 - DNA, 15 bp, Homo sapiens
tgccaaggccgccca

SEQ ID NO: 5320739 - DNA, 19 bp, Homo sapiens
tgccaaggccgcccacctg

SEQ ID NO: 5320740 - DNA, 18 bp, Homo sapiens
tgccaaggcctccctcag

SEQ ID NO: 5320741 - DNA, 18 bp, Homo sapiens
tgccaaggctctcccctc

SEQ ID NO: 5320742 - DNA, 17 bp, Homo sapiens
tgccaaggctgatgcag

SEQ ID NO: 5320743 - DNA, 22 bp, Homo sapiens
tgccaagggcaggaccaatggc

SEQ ID NO: 5320744 - DNA, 17 bp, Homo sapiens
tgccaagggccccaggg

SEQ ID NO: 5320745 - DNA, 18 bp, Homo sapiens
tgccaagggggtgactgg

SEQ ID NO: 5320746 - DNA, 15 bp, Homo sapiens
tgccaaggtacctag

SEQ ID NO: 5320747 - DNA, 14 bp, Homo sapiens
tgccaagtccctgg

SEQ ID NO: 5320748 - DNA, 18 bp, Homo sapiens
tgccaagtccctggaaaa

SEQ ID NO: 5320749 - DNA, 16 bp, Homo sapiens
tgccaagtcctgcctt

SEQ ID NO: 5320750 - DNA, 17 bp, Homo sapiens
tgccaagtctcagaaga

SEQ ID NO: 5320751 - DNA, 18 bp, Homo sapiens
tgccaagtggccctcaga

SEQ ID NO: 5320752 - DNA, 20 bp, Homo sapiens
tgccaagtggtttctatgag

SEQ ID NO: 5320753 - DNA, 22 bp, Homo sapiens
tgccaagttagctattgggagc

SEQ ID NO: 5320754 - DNA, 18 bp, Homo sapiens
tgccaagttgctgtcact

SEQ ID NO: 5320755 - DNA, 21 bp, Homo sapiens
tgccaagttgctgtcactgtt

SEQ ID NO: 5320756 - DNA, 15 bp, Homo sapiens
tgccaagtttttcag

SEQ ID NO: 5320757 - DNA, 18 bp, Homo sapiens
tgccaagtttttcagaaa

SEQ ID NO: 5320758 - DNA, 20 bp, Homo sapiens
tgccaagtttttcagaaagt

SEQ ID NO: 5320759 - DNA, 18 bp, Homo sapiens
tgccaataaaagttttct

SEQ ID NO: 5320760 - DNA, 13 bp, Homo sapiens
tgccaataaagct

SEQ ID NO: 5320761 - DNA, 14 bp, Homo sapiens
tgccaataaagtga

SEQ ID NO: 5320762 - DNA, 19 bp, Homo sapiens
tgccaataaattctaaatt

SEQ ID NO: 5320763 - DNA, 20 bp, Homo sapiens
tgccaataaattctaaatta

SEQ ID NO: 5320764 - DNA, 22 bp, Homo sapiens
tgccaataaattctaaattaca

SEQ ID NO: 5320765 - DNA, 21 bp, Homo sapiens
tgccaataataatacctccct

SEQ ID NO: 5320766 - DNA, 15 bp, Homo sapiens
tgccaatatcctaat

SEQ ID NO: 5320767 - DNA, 23 bp, Homo sapiens
tgccaatatcctaataaaaaggt

SEQ ID NO: 5320768 - DNA, 19 bp, Homo sapiens
tgccaatatgacacagctt

SEQ ID NO: 5320769 - DNA, 19 bp, Homo sapiens
tgccaatatgccagcttgg

SEQ ID NO: 5320770 - DNA, 21 bp, Homo sapiens
tgccaatattaaatctgctgg

SEQ ID NO: 5320771 - DNA, 18 bp, Homo sapiens
tgccaatcctgtaggcac

SEQ ID NO: 5320772 - DNA, 20 bp, Homo sapiens
tgccaatcggctacccctcg

SEQ ID NO: 5320773 - DNA, 19 bp, Homo sapiens
tgccaatgaactctttccc

SEQ ID NO: 5320774 - DNA, 22 bp, Homo sapiens
tgccaatgaactctttccccag

SEQ ID NO: 5320775 - DNA, 15 bp, Homo sapiens
tgccaatgacaggac

SEQ ID NO: 5320776 - DNA, 20 bp, Homo sapiens
tgccaatgaggtctgaaatg

SEQ ID NO: 5320777 - DNA, 21 bp, Homo sapiens
tgccaatgaggtctgaaatgg

SEQ ID NO: 5320778 - DNA, 15 bp, Homo sapiens
tgccaatgccacagc

SEQ ID NO: 5320779 - DNA, 16 bp, Homo sapiens
tgccaatgccatgact

SEQ ID NO: 5320780 - DNA, 16 bp, Homo sapiens
tgccaatgctccagct

SEQ ID NO: 5320781 - DNA, 19 bp, Homo sapiens
tgccaatggaacctccttt

SEQ ID NO: 5320782 - DNA, 13 bp, Homo sapiens
tgccaatggacta

SEQ ID NO: 5320783 - DNA, 14 bp, Homo sapiens
tgccaatgttgtgt

SEQ ID NO: 5320784 - DNA, 20 bp, Homo sapiens
tgccaatgttgtgtgttgca

SEQ ID NO: 5320785 - DNA, 13 bp, Homo sapiens
tgccaatttcaag

SEQ ID NO: 5320786 - DNA, 15 bp, Homo sapiens
tgccaatttcctctc

SEQ ID NO: 5320787 - DNA, 21 bp, Homo sapiens
tgccaatttcttactagtact

SEQ ID NO: 5320788 - DNA, 17 bp, Homo sapiens
tgccaatttgcacatta

SEQ ID NO: 5320789 - DNA, 22 bp, Homo sapiens
tgccacaaattgaaagcttcca

SEQ ID NO: 5320790 - DNA, 22 bp, Homo sapiens
tgccacaacagaataaagcagc

SEQ ID NO: 5320791 - DNA, 18 bp, Homo sapiens
tgccacaacgcctggcta

SEQ ID NO: 5320792 - DNA, 13 bp, Homo sapiens
tgccacaagcaca

SEQ ID NO: 5320793 - DNA, 15 bp, Homo sapiens
tgccacaatgcctct

SEQ ID NO: 5320794 - DNA, 17 bp, Homo sapiens
tgccacaatgcctctcc

SEQ ID NO: 5320795 - DNA, 21 bp, Homo sapiens
tgccacaatgcctctcccacg

SEQ ID NO: 5320796 - DNA, 18 bp, Homo sapiens
tgccacaatgtgatatgt

SEQ ID NO: 5320797 - DNA, 22 bp, Homo sapiens
tgccacacaaggatagatgctg

SEQ ID NO: 5320798 - DNA, 20 bp, Homo sapiens
tgccacacagagtggtcttt

SEQ ID NO: 5320799 - DNA, 17 bp, Homo sapiens
tgccacacagtgggccg

SEQ ID NO: 5320800 - DNA, 18 bp, Homo sapiens
tgccacaccaatcagaga

SEQ ID NO: 5320801 - DNA, 20 bp, Homo sapiens
tgccacaccaatcagagagc

SEQ ID NO: 5320802 - DNA, 20 bp, Homo sapiens
tgccacaccctccccattca

SEQ ID NO: 5320803 - DNA, 17 bp, Homo sapiens
tgccacaccggtaccct

SEQ ID NO: 5320804 - DNA, 21 bp, Homo sapiens
tgccacaccggtaccctcctc

SEQ ID NO: 5320805 - DNA, 22 bp, Homo sapiens
tgccacaccggtaccctcctcc

SEQ ID NO: 5320806 - DNA, 15 bp, Homo sapiens
tgccacacctggcct

SEQ ID NO: 5320807 - DNA, 22 bp, Homo sapiens
tgccacactcagtcccccacca

SEQ ID NO: 5320808 - DNA, 14 bp, Homo sapiens
tgccacactctcca

SEQ ID NO: 5320809 - DNA, 21 bp, Homo sapiens
tgccacactttcactggggat

SEQ ID NO: 5320810 - DNA, 22 bp, Homo sapiens
tgccacactttcactggggatc

SEQ ID NO: 5320811 - DNA, 17 bp, Homo sapiens
tgccacagacaactcac

SEQ ID NO: 5320812 - DNA, 13 bp, Homo sapiens
tgccacagagaag

SEQ ID NO: 5320813 - DNA, 14 bp, Homo sapiens
tgccacagagcggg

SEQ ID NO: 5320814 - DNA, 16 bp, Homo sapiens
tgccacagagcgggga

SEQ ID NO: 5320815 - DNA, 16 bp, Homo sapiens
tgccacagaggcccca

SEQ ID NO: 5320816 - DNA, 17 bp, Homo sapiens
tgccacagaggccccac

SEQ ID NO: 5320817 - DNA, 20 bp, Homo sapiens
tgccacagaggccccacctg

SEQ ID NO: 5320818 - DNA, 18 bp, Homo sapiens
tgccacagagtgtagcca

SEQ ID NO: 5320819 - DNA, 15 bp, Homo sapiens
tgccacagcaaggct

SEQ ID NO: 5320820 - DNA, 17 bp, Homo sapiens
tgccacagccaagccca

SEQ ID NO: 5320821 - DNA, 18 bp, Homo sapiens
tgccacagccaagcccac

SEQ ID NO: 5320822 - DNA, 22 bp, Homo sapiens
tgccacagccaagcccaccctg

SEQ ID NO: 5320823 - DNA, 15 bp, Homo sapiens
tgccacagccagagg

SEQ ID NO: 5320824 - DNA, 12 bp, Homo sapiens
tgccacagccct

SEQ ID NO: 5320825 - DNA, 17 bp, Homo sapiens
tgccacagcctcccctg

SEQ ID NO: 5320826 - DNA, 17 bp, Homo sapiens
tgccacagcctgctggc

SEQ ID NO: 5320827 - DNA, 18 bp, Homo sapiens
tgccacagcctgctggca

SEQ ID NO: 5320828 - DNA, 17 bp, Homo sapiens
tgccacagcttttgcaa

SEQ ID NO: 5320829 - DNA, 14 bp, Homo sapiens
tgccatattgtgta

SEQ ID NO: 5320830 - DNA, 14 bp, Homo sapiens
tgccatatttttga

SEQ ID NO: 5320831 - DNA, 13 bp, Homo sapiens
tgccatcaaatga

SEQ ID NO: 5320832 - DNA, 15 bp, Homo sapiens
tgccatcaaatgaat

SEQ ID NO: 5320833 - DNA, 14 bp, Homo sapiens
tgccatcaataaaa

SEQ ID NO: 5320834 - DNA, 16 bp, Homo sapiens
tgccatcaccgctggg

SEQ ID NO: 5320835 - DNA, 16 bp, Homo sapiens
tgccatcagcccctgc

SEQ ID NO: 5320836 - DNA, 18 bp, Homo sapiens
tgccatcagcccctgctg

SEQ ID NO: 5320837 - DNA, 19 bp, Homo sapiens
tgccatcagcccctgctgc

SEQ ID NO: 5320838 - DNA, 17 bp, Homo sapiens
tgccatcagcccctggg

SEQ ID NO: 5320839 - DNA, 15 bp, Homo sapiens
tgccatcagtgaaaa

SEQ ID NO: 5320840 - DNA, 16 bp, Homo sapiens
tgccatcatctcctgc

SEQ ID NO: 5320841 - DNA, 19 bp, Homo sapiens
tgccatcatgcccagctaa

SEQ ID NO: 5320842 - DNA, 14 bp, Homo sapiens
tgccatcatgcctg

SEQ ID NO: 5320843 - DNA, 15 bp, Homo sapiens
tgccatcatgcctga

SEQ ID NO: 5320844 - DNA, 16 bp, Homo sapiens
tgccatcatgcctgac

SEQ ID NO: 5320845 - DNA, 22 bp, Homo sapiens
tgccatcatgtttacagaggac

SEQ ID NO: 5320846 - DNA, 22 bp, Homo sapiens
tgccatcattgatgatcactgt

SEQ ID NO: 5320847 - DNA, 21 bp, Homo sapiens
tgccatcattgctgtctgcag

SEQ ID NO: 5320848 - DNA, 12 bp, Homo sapiens
tgccatccaagt

SEQ ID NO: 5320849 - DNA, 15 bp, Homo sapiens
tgccatccaggttca

SEQ ID NO: 5320850 - DNA, 17 bp, Homo sapiens
tgccatccattctgccg

SEQ ID NO: 5320851 - DNA, 16 bp, Homo sapiens
tgccatccattctgga

SEQ ID NO: 5320852 - DNA, 15 bp, Homo sapiens
tgccatccccctctc

SEQ ID NO: 5320853 - DNA, 16 bp, Homo sapiens
tgccatccccctctca

SEQ ID NO: 5320854 - DNA, 11 bp, Homo sapiens
tgccatccctc

SEQ ID NO: 5320855 - DNA, 12 bp, Homo sapiens
tgccatccctcc

SEQ ID NO: 5320856 - DNA, 14 bp, Homo sapiens
tgccatccctgaga

SEQ ID NO: 5320857 - DNA, 21 bp, Homo sapiens
tgccatcctaaaagccacccc

SEQ ID NO: 5320858 - DNA, 11 bp, Homo sapiens
tgccatcctca

SEQ ID NO: 5320859 - DNA, 19 bp, Homo sapiens
tgccatcctcaaacactgc

SEQ ID NO: 5320860 - DNA, 13 bp, Homo sapiens
tgccatcctcttt

SEQ ID NO: 5320861 - DNA, 17 bp, Homo sapiens
tgccatcctctttctct

SEQ ID NO: 5320862 - DNA, 13 bp, Homo sapiens
tgccatcctgatg

SEQ ID NO: 5320863 - DNA, 21 bp, Homo sapiens
tgccatcctgatggacctgcc

SEQ ID NO: 5320864 - DNA, 18 bp, Homo sapiens
tgccatcctggcccaggg

SEQ ID NO: 5320865 - DNA, 17 bp, Homo sapiens
tgccatcggacaggagg

SEQ ID NO: 5320866 - DNA, 15 bp, Homo sapiens
tgccatctatgcaga

SEQ ID NO: 5320867 - DNA, 13 bp, Homo sapiens
tgccatctctgct

SEQ ID NO: 5320868 - DNA, 16 bp, Homo sapiens
tgccatctctgctcca

SEQ ID NO: 5320869 - DNA, 22 bp, Homo sapiens
tgccatctgcgtgacaataaaa

SEQ ID NO: 5320870 - DNA, 14 bp, Homo sapiens
tgccatctgtggga

SEQ ID NO: 5320871 - DNA, 15 bp, Homo sapiens
tgccatctgtgggaa

SEQ ID NO: 5320872 - DNA, 18 bp, Homo sapiens
tgccatctgtgggcacgc

SEQ ID NO: 5320873 - DNA, 16 bp, Homo sapiens
tgccatctgtgtcctg

SEQ ID NO: 5320874 - DNA, 20 bp, Homo sapiens
tgccatctgtgtcctggtta

SEQ ID NO: 5320875 - DNA, 15 bp, Homo sapiens
tgccatctgttttca

SEQ ID NO: 5320876 - DNA, 16 bp, Homo sapiens
tgccatctgttttcaa

SEQ ID NO: 5320877 - DNA, 13 bp, Homo sapiens
tgccatcttccca

SEQ ID NO: 5320878 - DNA, 14 bp, Homo sapiens
tgccatcttcccag

SEQ ID NO: 5320879 - DNA, 14 bp, Homo sapiens
tgccatcttctccc

SEQ ID NO: 5320880 - DNA, 15 bp, Homo sapiens
tgccatgaacaaatt

SEQ ID NO: 5320881 - DNA, 20 bp, Homo sapiens
tgccatgaacaaattcttta

SEQ ID NO: 5320882 - DNA, 16 bp, Homo sapiens
tgccatgaatttctac

SEQ ID NO: 5320883 - DNA, 17 bp, Homo sapiens
tgccatgacagaggctg

SEQ ID NO: 5320884 - DNA, 22 bp, Homo sapiens
tgccatgacatttcatctgggt

SEQ ID NO: 5320885 - DNA, 15 bp, Homo sapiens
tgccatgactgctca

SEQ ID NO: 5320886 - DNA, 15 bp, Homo sapiens
tgccatgaggccttt

SEQ ID NO: 5320887 - DNA, 23 bp, Homo sapiens
tgccatgaggcctttccccagtg

SEQ ID NO: 5320888 - DNA, 18 bp, Homo sapiens
tgccatgagtccatgtcc

SEQ ID NO: 5320889 - DNA, 19 bp, Homo sapiens
tgccatgagtccatgtcct

SEQ ID NO: 5320890 - DNA, 15 bp, Homo sapiens
tgccatgatctgtat

SEQ ID NO: 5320891 - DNA, 17 bp, Homo sapiens
tgccatgatgcctctgt

SEQ ID NO: 5320892 - DNA, 20 bp, Homo sapiens
tgccatgatgcctctgtctt

SEQ ID NO: 5320893 - DNA, 17 bp, Homo sapiens
tgccatgatgtttacaa

SEQ ID NO: 5320894 - DNA, 21 bp, Homo sapiens
tgccatgatgtttacaagatg

SEQ ID NO: 5320895 - DNA, 19 bp, Homo sapiens
tgccatgcaggaagaggcc

SEQ ID NO: 5320896 - DNA, 23 bp, Homo sapiens
tgccatgcaggaagaggcccact

SEQ ID NO: 5320897 - DNA, 14 bp, Homo sapiens
tgccatgccactgc

SEQ ID NO: 5320898 - DNA, 20 bp, Homo sapiens
tgccatgccactgccaggca

SEQ ID NO: 5320899 - DNA, 14 bp, Homo sapiens
tgccatgcccagag

SEQ ID NO: 5320900 - DNA, 13 bp, Homo sapiens
tgccatgcctgct

SEQ ID NO: 5320901 - DNA, 22 bp, Homo sapiens
tgccatgcctgctccctgtctg

SEQ ID NO: 5320902 - DNA, 17 bp, Homo sapiens
tgccatgctcagaaatg

SEQ ID NO: 5320903 - DNA, 15 bp, Homo sapiens
tgccatgctgggcca

SEQ ID NO: 5320904 - DNA, 20 bp, Homo sapiens
tgccatgctttgagtccacg

SEQ ID NO: 5320905 - DNA, 20 bp, Homo sapiens
tgccatggaactgtttcctt

SEQ ID NO: 5320906 - DNA, 20 bp, Homo sapiens
tgccatggaattccctcctg

SEQ ID NO: 5320907 - DNA, 23 bp, Homo sapiens
tgccatggacagaagaaggcagc

SEQ ID NO: 5320908 - DNA, 18 bp, Homo sapiens
tgccatggagatctgaag

SEQ ID NO: 5320909 - DNA, 12 bp, Homo sapiens
tgccatggaggc

SEQ ID NO: 5320910 - DNA, 17 bp, Homo sapiens
tgccatggaggcgcctt

SEQ ID NO: 5320911 - DNA, 18 bp, Homo sapiens
tgccatggatctgatctg

SEQ ID NO: 5320912 - DNA, 14 bp, Homo sapiens
tgccatggcccccc

SEQ ID NO: 5320913 - DNA, 20 bp, Homo sapiens
tgccatggccccccactccc

SEQ ID NO: 5320914 - DNA, 12 bp, Homo sapiens
tgccatggctgg

SEQ ID NO: 5320915 - DNA, 20 bp, Homo sapiens
tgccatggctgtgacacaga

SEQ ID NO: 5320916 - DNA, 19 bp, Homo sapiens
tgccatgggagagtccagg

SEQ ID NO: 5320917 - DNA, 22 bp, Homo sapiens
tgccatgggagagtccaggcct

SEQ ID NO: 5320918 - DNA, 17 bp, Homo sapiens
tgccatgggccagccta

SEQ ID NO: 5320919 - DNA, 20 bp, Homo sapiens
tgccatgggccagcctagcc

SEQ ID NO: 5320920 - DNA, 21 bp, Homo sapiens
tgccatgggccagcctagccc

SEQ ID NO: 5320921 - DNA, 15 bp, Homo sapiens
tgccatgggcctgct

SEQ ID NO: 5320922 - DNA, 18 bp, Homo sapiens
tgccatgggcttcactgt

SEQ ID NO: 5320923 - DNA, 19 bp, Homo sapiens
tgccatgggcttcactgta

SEQ ID NO: 5320924 - DNA, 20 bp, Homo sapiens
tgccatggtaaccagccaca

SEQ ID NO: 5320925 - DNA, 15 bp, Homo sapiens
tgccatggtgttgga

SEQ ID NO: 5320926 - DNA, 23 bp, Homo sapiens
tgccatggtgttggaggggcagg

SEQ ID NO: 5320927 - DNA, 15 bp, Homo sapiens
tgccatgtagcagac

SEQ ID NO: 5320928 - DNA, 16 bp, Homo sapiens
tgccatgtatgttgca

SEQ ID NO: 5320929 - DNA, 15 bp, Homo sapiens
tgccatgtccatagc

SEQ ID NO: 5320930 - DNA, 13 bp, Homo sapiens
tgccatgtcgctt

SEQ ID NO: 5320931 - DNA, 13 bp, Homo sapiens
tgccatgtcttta

SEQ ID NO: 5320932 - DNA, 15 bp, Homo sapiens
tgccatgtgaagagg

SEQ ID NO: 5320933 - DNA, 15 bp, Homo sapiens
tgccatgtgcacctt

SEQ ID NO: 5320934 - DNA, 20 bp, Homo sapiens
tgccatgtgcttctgccacc

SEQ ID NO: 5320935 - DNA, 13 bp, Homo sapiens
tgccatgtggcag

SEQ ID NO: 5320936 - DNA, 14 bp, Homo sapiens
tgccatgtggcaga

SEQ ID NO: 5320937 - DNA, 21 bp, Homo sapiens
tgccatgttgcccctttctct

SEQ ID NO: 5320938 - DNA, 12 bp, Homo sapiens
tgccatgttggc

SEQ ID NO: 5320939 - DNA, 20 bp, Homo sapiens
tgccatgttggccaggctgg

SEQ ID NO: 5320940 - DNA, 21 bp, Homo sapiens
tgccatgtttagattccagga

SEQ ID NO: 5320941 - DNA, 18 bp, Homo sapiens
tgccatgttttgccaccc

SEQ ID NO: 5320942 - DNA, 18 bp, Homo sapiens
tgccatgtttttgccaaa

SEQ ID NO: 5320943 - DNA, 22 bp, Homo sapiens
tgccattaaatccgcaaacagc

SEQ ID NO: 5320944 - DNA, 16 bp, Homo sapiens
tgccattacactccag

SEQ ID NO: 5320945 - DNA, 17 bp, Homo sapiens
tgccattacagaaccaa

SEQ ID NO: 5320946 - DNA, 16 bp, Homo sapiens
tgccattacccagtgc

SEQ ID NO: 5320947 - DNA, 16 bp, Homo sapiens
tgccattactactgta

SEQ ID NO: 5320948 - DNA, 17 bp, Homo sapiens
tgccattactactgtac

SEQ ID NO: 5320949 - DNA, 13 bp, Homo sapiens
tgccattactctg

SEQ ID NO: 5320950 - DNA, 21 bp, Homo sapiens
tgccattatagcgcctgtata

SEQ ID NO: 5320951 - DNA, 22 bp, Homo sapiens
tgccattattaacccatttttg

SEQ ID NO: 5320952 - DNA, 16 bp, Homo sapiens
tgccattattctatgt

SEQ ID NO: 5320953 - DNA, 18 bp, Homo sapiens
tgccattattttctgtca

SEQ ID NO: 5320954 - DNA, 17 bp, Homo sapiens
tgccattcatcctttaa

SEQ ID NO: 5320955 - DNA, 15 bp, Homo sapiens
tgccattccactcca

SEQ ID NO: 5320956 - DNA, 20 bp, Homo sapiens
tgccattccactccactcag

SEQ ID NO: 5320957 - DNA, 12 bp, Homo sapiens
tgccattcccac

SEQ ID NO: 5320958 - DNA, 14 bp, Homo sapiens
tgccattcccagcg

SEQ ID NO: 5320959 - DNA, 18 bp, Homo sapiens
tgccattctcttgcattg

SEQ ID NO: 5320960 - DNA, 13 bp, Homo sapiens
tgccattctgcct

SEQ ID NO: 5320961 - DNA, 15 bp, Homo sapiens
tgccattctgtgcag

SEQ ID NO: 5320962 - DNA, 17 bp, Homo sapiens
tgccattgcactccagc

SEQ ID NO: 5320963 - DNA, 12 bp, Homo sapiens
tgccattggcct

SEQ ID NO: 5320964 - DNA, 17 bp, Homo sapiens
tgccattggcctcttgt

SEQ ID NO: 5320965 - DNA, 20 bp, Homo sapiens
tgccattggcctcttgtccc

SEQ ID NO: 5320966 - DNA, 21 bp, Homo sapiens
tgccattgggaccctccagtg

SEQ ID NO: 5320967 - DNA, 19 bp, Homo sapiens
tgccattggtccacccttt

SEQ ID NO: 5320968 - DNA, 20 bp, Homo sapiens
tgccattgtactccagcctg

SEQ ID NO: 5320969 - DNA, 22 bp, Homo sapiens
tgccattgtactccagcctggg

SEQ ID NO: 5320970 - DNA, 15 bp, Homo sapiens
tgccattgtccagga

SEQ ID NO: 5320971 - DNA, 17 bp, Homo sapiens
tgccattgtctttatat

SEQ ID NO: 5320972 - DNA, 16 bp, Homo sapiens
tgccattgtctttcct

SEQ ID NO: 5320973 - DNA, 14 bp, Homo sapiens
tgccattgtgcaga

SEQ ID NO: 5320974 - DNA, 14 bp, Homo sapiens
tgccatttaaaaag

SEQ ID NO: 5320975 - DNA, 22 bp, Homo sapiens
tgccatttaaagcttattaaaa

SEQ ID NO: 5320976 - DNA, 22 bp, Homo sapiens
tgccatttagaatctagaaatg

SEQ ID NO: 5320977 - DNA, 16 bp, Homo sapiens
tgccatttagcaataa

SEQ ID NO: 5320978 - DNA, 17 bp, Homo sapiens
tgccatttagcaataaa

SEQ ID NO: 5320979 - DNA, 18 bp, Homo sapiens
tgccatttcagtggcttc

SEQ ID NO: 5320980 - DNA, 14 bp, Homo sapiens
tgccatttccctga

SEQ ID NO: 5320981 - DNA, 18 bp, Homo sapiens
tgccatttccctgaacag

SEQ ID NO: 5320982 - DNA, 14 bp, Homo sapiens
tgccatttcccttc

SEQ ID NO: 5320983 - DNA, 17 bp, Homo sapiens
tgccatttctgaactgt

SEQ ID NO: 5320984 - DNA, 12 bp, Homo sapiens
tgccatttcttc

SEQ ID NO: 5320985 - DNA, 14 bp, Homo sapiens
tgccatttcttccc

SEQ ID NO: 5320986 - DNA, 13 bp, Homo sapiens
tgccatttgatac

SEQ ID NO: 5320987 - DNA, 14 bp, Homo sapiens
tgccatttgatacc

SEQ ID NO: 5320988 - DNA, 18 bp, Homo sapiens
tgccatttgatttttcta

SEQ ID NO: 5320989 - DNA, 16 bp, Homo sapiens
tgccatttgcaccctc

SEQ ID NO: 5320990 - DNA, 19 bp, Homo sapiens
tgccatttgcaccctccgc

SEQ ID NO: 5320991 - DNA, 22 bp, Homo sapiens
tgccatttgcaccctccgcctt

SEQ ID NO: 5320992 - DNA, 22 bp, Homo sapiens
tgccatttgcttgtactgggac

SEQ ID NO: 5320993 - DNA, 23 bp, Homo sapiens
tgccatttgcttgtactgggaca

SEQ ID NO: 5320994 - DNA, 15 bp, Homo sapiens
tgccatttgtactga

SEQ ID NO: 5320995 - DNA, 14 bp, Homo sapiens
tgccatttgtcttt

SEQ ID NO: 5320996 - DNA, 19 bp, Homo sapiens
tgccatttgtcttttgtaa

SEQ ID NO: 5320997 - DNA, 17 bp, Homo sapiens
tgccattttaaatttta

SEQ ID NO: 5320998 - DNA, 14 bp, Homo sapiens
tgccattttaaggt

SEQ ID NO: 5320999 - DNA, 19 bp, Homo sapiens
tgccattttaataaaatga

SEQ ID NO: 5321000 - DNA, 23 bp, Homo sapiens
tgccattttattaaacattttca

SEQ ID NO: 5321001 - DNA, 14 bp, Homo sapiens
tgccattttgtctg

SEQ ID NO: 5321002 - DNA, 19 bp, Homo sapiens
tgccattttgtctggctgt

SEQ ID NO: 5321003 - DNA, 15 bp, Homo sapiens
tgccatttttcaaaa

SEQ ID NO: 5321004 - DNA, 13 bp, Homo sapiens
tgccatttttcta

SEQ ID NO: 5321005 - DNA, 20 bp, Homo sapiens
tgccatttttctataaatca

SEQ ID NO: 5321006 - DNA, 23 bp, Homo sapiens
tgccatttttctataaatcagta

SEQ ID NO: 5321007 - DNA, 16 bp, Homo sapiens
tgccatttttgcaaac

SEQ ID NO: 5321008 - DNA, 20 bp, Homo sapiens
tgccattttttaagagacag

SEQ ID NO: 5321009 - DNA, 18 bp, Homo sapiens
tgccccaccagccacctc

SEQ ID NO: 5321010 - DNA, 11 bp, Homo sapiens
tgccccaccca

SEQ ID NO: 5321011 - DNA, 23 bp, Homo sapiens
tgccccacccaactccacagggc

SEQ ID NO: 5321012 - DNA, 12 bp, Homo sapiens
tgccccacccac

SEQ ID NO: 5321013 - DNA, 14 bp, Homo sapiens
tgccccacccatca

SEQ ID NO: 5321014 - DNA, 12 bp, Homo sapiens
tgccccacccca

SEQ ID NO: 5321015 - DNA, 18 bp, Homo sapiens
tgccccaccccacctcca

SEQ ID NO: 5321016 - DNA, 21 bp, Homo sapiens
tgccccaccccatccagccag

SEQ ID NO: 5321017 - DNA, 17 bp, Homo sapiens
tgccccacccccctcct

SEQ ID NO: 5321018 - DNA, 18 bp, Homo sapiens
tgccccacccccctcctc

SEQ ID NO: 5321019 - DNA, 19 bp, Homo sapiens
tgccccacccccctcctcc

SEQ ID NO: 5321020 - DNA, 20 bp, Homo sapiens
tgccccacccccctcctccc

SEQ ID NO: 5321021 - DNA, 22 bp, Homo sapiens
tgccccacccccctcctccccc

SEQ ID NO: 5321022 - DNA, 20 bp, Homo sapiens
tgccccacctccccacacac

SEQ ID NO: 5321023 - DNA, 14 bp, Homo sapiens
tgccccacctgcca

SEQ ID NO: 5321024 - DNA, 15 bp, Homo sapiens
tgccccacctgccac

SEQ ID NO: 5321025 - DNA, 17 bp, Homo sapiens
tgccccacctgccacta

SEQ ID NO: 5321026 - DNA, 21 bp, Homo sapiens
tgccccacctgccactaggct

SEQ ID NO: 5321027 - DNA, 14 bp, Homo sapiens
tgccccacctgcct

SEQ ID NO: 5321028 - DNA, 15 bp, Homo sapiens
tgccccacctgcctg

SEQ ID NO: 5321029 - DNA, 17 bp, Homo sapiens
tgccccaccttgccagg

SEQ ID NO: 5321030 - DNA, 20 bp, Homo sapiens
tgccccaccttgccagggca

SEQ ID NO: 5321031 - DNA, 16 bp, Homo sapiens
tgccccacgttgtccc

SEQ ID NO: 5321032 - DNA, 17 bp, Homo sapiens
tgccccactacaggccc

SEQ ID NO: 5321033 - DNA, 13 bp, Homo sapiens
tgccccactccag

SEQ ID NO: 5321034 - DNA, 16 bp, Homo sapiens
tgccccactctgctga

SEQ ID NO: 5321035 - DNA, 15 bp, Homo sapiens
tgccccacttctggc

SEQ ID NO: 5321036 - DNA, 19 bp, Homo sapiens
tgccccacttctggcatgg

SEQ ID NO: 5321037 - DNA, 19 bp, Homo sapiens
tgccccacttctggccaca

SEQ ID NO: 5321038 - DNA, 14 bp, Homo sapiens
tgccccacttgtcc

SEQ ID NO: 5321039 - DNA, 18 bp, Homo sapiens
tgccccacttgtccttag

SEQ ID NO: 5321040 - DNA, 11 bp, Homo sapiens
tgccccagaga

SEQ ID NO: 5321041 - DNA, 12 bp, Homo sapiens
tgccccagagaa

SEQ ID NO: 5321042 - DNA, 19 bp, Homo sapiens
tgccccagagaagcctcag

SEQ ID NO: 5321043 - DNA, 16 bp, Homo sapiens
tgccccagagatgggc

SEQ ID NO: 5321044 - DNA, 14 bp, Homo sapiens
tgccccagagctgt

SEQ ID NO: 5321045 - DNA, 22 bp, Homo sapiens
tgccccagaggtcgcagctacc

SEQ ID NO: 5321046 - DNA, 24 bp, Homo sapiens
tgccccagaggtcgcagctaccct

SEQ ID NO: 5321047 - DNA, 13 bp, Homo sapiens
tgccccagagtgg

SEQ ID NO: 5321048 - DNA, 14 bp, Homo sapiens
tgccccagcactca

SEQ ID NO: 5321049 - DNA, 13 bp, Homo sapiens
tgccccagcccaa

SEQ ID NO: 5321050 - DNA, 18 bp, Homo sapiens
tgccccagcccctaagcc

SEQ ID NO: 5321051 - DNA, 21 bp, Homo sapiens
tgccccagcccctaagccccg

SEQ ID NO: 5321052 - DNA, 13 bp, Homo sapiens
tgccccagcgcgg

SEQ ID NO: 5321053 - DNA, 20 bp, Homo sapiens
tgccccagcgcggcttggcc

SEQ ID NO: 5321054 - DNA, 17 bp, Homo sapiens
tgccccagcgtcttgac

SEQ ID NO: 5321055 - DNA, 20 bp, Homo sapiens
tgccccagctctcttctggc

SEQ ID NO: 5321056 - DNA, 13 bp, Homo sapiens
tgccccagctctg

SEQ ID NO: 5321057 - DNA, 23 bp, Homo sapiens
tgccccagctctggatgaaggca

SEQ ID NO: 5321058 - DNA, 16 bp, Homo sapiens
tgccccagctgccagg

SEQ ID NO: 5321059 - DNA, 19 bp, Homo sapiens
tgccccagctgccaggcgg

SEQ ID NO: 5321060 - DNA, 13 bp, Homo sapiens
tgccccaggacca

SEQ ID NO: 5321061 - DNA, 20 bp, Homo sapiens
tgccccaggactctggcact

SEQ ID NO: 5321062 - DNA, 22 bp, Homo sapiens
tgccccaggatcactctctgct

SEQ ID NO: 5321063 - DNA, 12 bp, Homo sapiens
tgccccaggcca

SEQ ID NO: 5321064 - DNA, 15 bp, Homo sapiens
tgccccaggccctgc

SEQ ID NO: 5321065 - DNA, 13 bp, Homo sapiens
tgccccaggccgg

SEQ ID NO: 5321066 - DNA, 14 bp, Homo sapiens
tgccccaggccgga

SEQ ID NO: 5321067 - DNA, 22 bp, Homo sapiens
tgccccaggccggagcccagat

SEQ ID NO: 5321068 - DNA, 13 bp, Homo sapiens
tgccccaggcctg

SEQ ID NO: 5321069 - DNA, 12 bp, Homo sapiens
tgccccaggctc

SEQ ID NO: 5321070 - DNA, 17 bp, Homo sapiens
tgccccagggagtccag

SEQ ID NO: 5321071 - DNA, 19 bp, Homo sapiens
tgccccagggagtccaggg

SEQ ID NO: 5321072 - DNA, 12 bp, Homo sapiens
tgccccaggggg

SEQ ID NO: 5321073 - DNA, 19 bp, Homo sapiens
tgccccaggtacacctccc

SEQ ID NO: 5321074 - DNA, 19 bp, Homo sapiens
tgccccagtcctggttcag

SEQ ID NO: 5321075 - DNA, 20 bp, Homo sapiens
tgccccagtcgttagaatat

SEQ ID NO: 5321076 - DNA, 15 bp, Homo sapiens
tgccccagtggtgcg

SEQ ID NO: 5321077 - DNA, 12 bp, Homo sapiens
tgccccagtgtt

SEQ ID NO: 5321078 - DNA, 14 bp, Homo sapiens
tgccccagtttggg

SEQ ID NO: 5321079 - DNA, 17 bp, Homo sapiens
tgccccagtttggggtg

SEQ ID NO: 5321080 - DNA, 21 bp, Homo sapiens
tgccccatcattgcacctgca

SEQ ID NO: 5321081 - DNA, 23 bp, Homo sapiens
tgccccatcattgcacctgcagg

SEQ ID NO: 5321082 - DNA, 21 bp, Homo sapiens
tgccccatccagacctggctc

SEQ ID NO: 5321083 - DNA, 17 bp, Homo sapiens
tgccccatcccatgctg

SEQ ID NO: 5321084 - DNA, 21 bp, Homo sapiens
tgccccatcctccagcaggga

SEQ ID NO: 5321085 - DNA, 23 bp, Homo sapiens
tgccccatcctgggccttacctc

SEQ ID NO: 5321086 - DNA, 16 bp, Homo sapiens
tgccccatctcccctc

SEQ ID NO: 5321087 - DNA, 17 bp, Homo sapiens
tgccccatctcctccca

SEQ ID NO: 5321088 - DNA, 17 bp, Homo sapiens
tgccccatgataaaata

SEQ ID NO: 5321089 - DNA, 15 bp, Homo sapiens
tgccccatgcctgtc

SEQ ID NO: 5321090 - DNA, 23 bp, Homo sapiens
tgccccatgcctgtccagcctgg

SEQ ID NO: 5321091 - DNA, 18 bp, Homo sapiens
tgccccatgtgtcctggt

SEQ ID NO: 5321092 - DNA, 20 bp, Homo sapiens
tgccccatgtgtcctggtga

SEQ ID NO: 5321093 - DNA, 16 bp, Homo sapiens
tgccccattcaacatc

SEQ ID NO: 5321094 - DNA, 16 bp, Homo sapiens
tgccccattcctaaga

SEQ ID NO: 5321095 - DNA, 19 bp, Homo sapiens
tgcccccaactcccggagg

SEQ ID NO: 5321096 - DNA, 19 bp, Homo sapiens
tgcccccaaggaggcagcc

SEQ ID NO: 5321097 - DNA, 12 bp, Homo sapiens
tgcccccaagtc

SEQ ID NO: 5321098 - DNA, 18 bp, Homo sapiens
tgcccccacacctggccc

SEQ ID NO: 5321099 - DNA, 19 bp, Homo sapiens
tgcccccacacctggccct

SEQ ID NO: 5321100 - DNA, 12 bp, Homo sapiens
tgcccccacaga

SEQ ID NO: 5321101 - DNA, 16 bp, Homo sapiens
tgcccccacagctcct

SEQ ID NO: 5321102 - DNA, 19 bp, Homo sapiens
tgcccccacagctccttgc

SEQ ID NO: 5321103 - DNA, 15 bp, Homo sapiens
tgcccccaccccagg

SEQ ID NO: 5321104 - DNA, 16 bp, Homo sapiens
tgcccccaccccaggc

SEQ ID NO: 5321105 - DNA, 17 bp, Homo sapiens
tgcccccaccccaggct

SEQ ID NO: 5321106 - DNA, 21 bp, Homo sapiens
tgcccccaccccaggctgggc

SEQ ID NO: 5321107 - DNA, 17 bp, Homo sapiens
tgcccccaccccattcc

SEQ ID NO: 5321108 - DNA, 22 bp, Homo sapiens
tgcccccaccccattcccgcag

SEQ ID NO: 5321109 - DNA, 14 bp, Homo sapiens
tgcccccaccccca

SEQ ID NO: 5321110 - DNA, 15 bp, Homo sapiens
tgcccccacccccac

SEQ ID NO: 5321111 - DNA, 20 bp, Homo sapiens
tgcccccacccccaccctcg

SEQ ID NO: 5321112 - DNA, 23 bp, Homo sapiens
tgcccccaccccggggaccctgt

SEQ ID NO: 5321113 - DNA, 17 bp, Homo sapiens
tgcccccaccccttcct

SEQ ID NO: 5321114 - DNA, 18 bp, Homo sapiens
tgcccccaccccttcctg

SEQ ID NO: 5321115 - DNA, 23 bp, Homo sapiens
tgcccccaccccttcctgtctca

SEQ ID NO: 5321116 - DNA, 16 bp, Homo sapiens
tgcccccactcagcat

SEQ ID NO: 5321117 - DNA, 19 bp, Homo sapiens
tgcccccagaaagcctcct

SEQ ID NO: 5321118 - DNA, 15 bp, Homo sapiens
tgcccccagacccca

SEQ ID NO: 5321119 - DNA, 14 bp, Homo sapiens
tgcccccagagcca

SEQ ID NO: 5321120 - DNA, 16 bp, Homo sapiens
tgcccccagagccaca

SEQ ID NO: 5321121 - DNA, 17 bp, Homo sapiens
tgcccccagagccacag

SEQ ID NO: 5321122 - DNA, 20 bp, Homo sapiens
tgcccccagagcgtccttgg

SEQ ID NO: 5321123 - DNA, 14 bp, Homo sapiens
tgcccccagccccg

SEQ ID NO: 5321124 - DNA, 19 bp, Homo sapiens
tgcccccagcctcagccca

SEQ ID NO: 5321125 - DNA, 14 bp, Homo sapiens
tgcccccagctggc

SEQ ID NO: 5321126 - DNA, 11 bp, Homo sapiens
tgcccccagga

SEQ ID NO: 5321127 - DNA, 14 bp, Homo sapiens
tgcccccaggactg

SEQ ID NO: 5321128 - DNA, 15 bp, Homo sapiens
tgcccccagggcact

SEQ ID NO: 5321129 - DNA, 11 bp, Homo sapiens
tgcccccaggt

SEQ ID NO: 5321130 - DNA, 23 bp, Homo sapiens
tgcccccatccagccacggaggg

SEQ ID NO: 5321131 - DNA, 13 bp, Homo sapiens
tgcccccatccca

SEQ ID NO: 5321132 - DNA, 14 bp, Homo sapiens
tgcccccatcccac

SEQ ID NO: 5321133 - DNA, 16 bp, Homo sapiens
tgcccccatcccacat

SEQ ID NO: 5321134 - DNA, 18 bp, Homo sapiens
tgcccccatctccccagg

SEQ ID NO: 5321135 - DNA, 20 bp, Homo sapiens
tgcccccatctccccaggcc

SEQ ID NO: 5321136 - DNA, 21 bp, Homo sapiens
tgcccccatctccccaggcct

SEQ ID NO: 5321137 - DNA, 20 bp, Homo sapiens
tgcccccattctcccagtct

SEQ ID NO: 5321138 - DNA, 17 bp, Homo sapiens
tgcccccatttcaccca

SEQ ID NO: 5321139 - DNA, 18 bp, Homo sapiens
tgccccccacattctggc

SEQ ID NO: 5321140 - DNA, 20 bp, Homo sapiens
tgccccccacattctggctc

SEQ ID NO: 5321141 - DNA, 23 bp, Homo sapiens
tgccccccaccccaccctcccta

SEQ ID NO: 5321142 - DNA, 17 bp, Homo sapiens
tgccccccaccccagcc

SEQ ID NO: 5321143 - DNA, 18 bp, Homo sapiens
tgccccccaccccagcct

SEQ ID NO: 5321144 - DNA, 14 bp, Homo sapiens
tgccccccagcctc

SEQ ID NO: 5321145 - DNA, 15 bp, Homo sapiens
tgccccccagggcta

SEQ ID NO: 5321146 - DNA, 20 bp, Homo sapiens
tgccccccatcctggcccat

SEQ ID NO: 5321147 - DNA, 23 bp, Homo sapiens
tgccccccatcctggcccatcag

SEQ ID NO: 5321148 - DNA, 14 bp, Homo sapiens
tgccccccatgccc

SEQ ID NO: 5321149 - DNA, 15 bp, Homo sapiens
tgccccccgccctca

SEQ ID NO: 5321150 - DNA, 15 bp, Homo sapiens
tgcccccctcctccc

SEQ ID NO: 5321151 - DNA, 18 bp, Homo sapiens
tgccccccttcccacccc

SEQ ID NO: 5321152 - DNA, 15 bp, Homo sapiens
tgcccccgccacctc

SEQ ID NO: 5321153 - DNA, 16 bp, Homo sapiens
tgcccccgccacctcc

SEQ ID NO: 5321154 - DNA, 15 bp, Homo sapiens
tgcccccgccctgct

SEQ ID NO: 5321155 - DNA, 17 bp, Homo sapiens
tgcccccgcctgccacc

SEQ ID NO: 5321156 - DNA, 20 bp, Homo sapiens
tgcccccgcgggttctagac

SEQ ID NO: 5321157 - DNA, 22 bp, Homo sapiens
tgcccccgcttagccccgctga

SEQ ID NO: 5321158 - DNA, 17 bp, Homo sapiens
tgcccccggccccctgg

SEQ ID NO: 5321159 - DNA, 13 bp, Homo sapiens
tgcccccgtgggg

SEQ ID NO: 5321160 - DNA, 19 bp, Homo sapiens
tgcccccgttccagctgac

SEQ ID NO: 5321161 - DNA, 23 bp, Homo sapiens
tgccccctaatccccttctcccc

SEQ ID NO: 5321162 - DNA, 13 bp, Homo sapiens
tgccccctacccg

SEQ ID NO: 5321163 - DNA, 17 bp, Homo sapiens
tgccccctacccggctc

SEQ ID NO: 5321164 - DNA, 19 bp, Homo sapiens
tgccccctatcttgtcctg

SEQ ID NO: 5321165 - DNA, 23 bp, Homo sapiens
tgccccctatcttgtcctggaat

SEQ ID NO: 5321166 - DNA, 13 bp, Homo sapiens
tgccccctccagg

SEQ ID NO: 5321167 - DNA, 23 bp, Homo sapiens
tgccccctccaggagagagccag

SEQ ID NO: 5321168 - DNA, 17 bp, Homo sapiens
tgccccctcccaccctg

SEQ ID NO: 5321169 - DNA, 19 bp, Homo sapiens
tgccccctcccactcttga

SEQ ID NO: 5321170 - DNA, 20 bp, Homo sapiens
tgccccctcccccatgggct

SEQ ID NO: 5321171 - DNA, 17 bp, Homo sapiens
tgccccctcccccgcag

SEQ ID NO: 5321172 - DNA, 18 bp, Homo sapiens
tgccccctcccccgcaga

SEQ ID NO: 5321173 - DNA, 16 bp, Homo sapiens
tgccccctcctctccc

SEQ ID NO: 5321174 - DNA, 19 bp, Homo sapiens
tgccccctcgggggcctgt

SEQ ID NO: 5321175 - DNA, 21 bp, Homo sapiens
tgccccctcgggggcctgtgg

SEQ ID NO: 5321176 - DNA, 15 bp, Homo sapiens
tgccccctcgtgcca

SEQ ID NO: 5321177 - DNA, 16 bp, Homo sapiens
tgccccctcgtgccag

SEQ ID NO: 5321178 - DNA, 18 bp, Homo sapiens
tgccccctgaaacttatt

SEQ ID NO: 5321179 - DNA, 12 bp, Homo sapiens
tgccccctgcag

SEQ ID NO: 5321180 - DNA, 13 bp, Homo sapiens
tgccccctgcaga

SEQ ID NO: 5321181 - DNA, 22 bp, Homo sapiens
tgccccctgctggctcttctgc

SEQ ID NO: 5321182 - DNA, 20 bp, Homo sapiens
tgccccctgcttggccagga

SEQ ID NO: 5321183 - DNA, 22 bp, Homo sapiens
tgccccctggctgactggccag

SEQ ID NO: 5321184 - DNA, 16 bp, Homo sapiens
tgcccccttccccagc

SEQ ID NO: 5321185 - DNA, 12 bp, Homo sapiens
tgcccccttctc

SEQ ID NO: 5321186 - DNA, 15 bp, Homo sapiens
tgcccccttctccca

SEQ ID NO: 5321187 - DNA, 18 bp, Homo sapiens
tgcccccttctcccacac

SEQ ID NO: 5321188 - DNA, 19 bp, Homo sapiens
tgcccttttttctgcctcc

SEQ ID NO: 5321189 - DNA, 20 bp, Homo sapiens
tgcccttttttctgcctcct

SEQ ID NO: 5321190 - DNA, 21 bp, Homo sapiens
tgccgaaacccttgactgtta

SEQ ID NO: 5321191 - DNA, 18 bp, Homo sapiens
tgccgaaactggaagtta

SEQ ID NO: 5321192 - DNA, 18 bp, Homo sapiens
tgccgaacattaggaatt

SEQ ID NO: 5321193 - DNA, 13 bp, Homo sapiens
tgccgaaccagga

SEQ ID NO: 5321194 - DNA, 17 bp, Homo sapiens
tgccgaagaattgtctt

SEQ ID NO: 5321195 - DNA, 18 bp, Homo sapiens
tgccgaagaattgtcttg

SEQ ID NO: 5321196 - DNA, 18 bp, Homo sapiens
tgccgaagtccagctttc

SEQ ID NO: 5321197 - DNA, 12 bp, Homo sapiens
tgccgaagtgtt

SEQ ID NO: 5321198 - DNA, 16 bp, Homo sapiens
tgccgaagtgtttctg

SEQ ID NO: 5321199 - DNA, 20 bp, Homo sapiens
tgccgaatttggtacacatg

SEQ ID NO: 5321200 - DNA, 15 bp, Homo sapiens
tgccgacatcagcat

SEQ ID NO: 5321201 - DNA, 17 bp, Homo sapiens
tgccgaccacgccccag

SEQ ID NO: 5321202 - DNA, 15 bp, Homo sapiens
tgccgaccagagccc

SEQ ID NO: 5321203 - DNA, 16 bp, Homo sapiens
tgccgaccgcctgctt

SEQ ID NO: 5321204 - DNA, 23 bp, Homo sapiens
tgccgaccgcctgcttcacaccc

SEQ ID NO: 5321205 - DNA, 17 bp, Homo sapiens
tgccgacctcgtcctcc

SEQ ID NO: 5321206 - DNA, 22 bp, Homo sapiens
tgccgacctcgtcctccccctg

SEQ ID NO: 5321207 - DNA, 16 bp, Homo sapiens
tgccgacggagccact

SEQ ID NO: 5321208 - DNA, 15 bp, Homo sapiens
tgccgacgtccccaa

SEQ ID NO: 5321209 - DNA, 13 bp, Homo sapiens
tgccgagagaggc

SEQ ID NO: 5321210 - DNA, 23 bp, Homo sapiens
tgccgagagaggcgcgtctgccc

SEQ ID NO: 5321211 - DNA, 14 bp, Homo sapiens
tgccgaggagccag

SEQ ID NO: 5321212 - DNA, 20 bp, Homo sapiens
tgccgaggtgcgtcccccgt

SEQ ID NO: 5321213 - DNA, 21 bp, Homo sapiens
tgccgattacacccaaatatt

SEQ ID NO: 5321214 - DNA, 18 bp, Homo sapiens
tgccgatttctgtaaact

SEQ ID NO: 5321215 - DNA, 20 bp, Homo sapiens
tgccgatttctgtaaactct

SEQ ID NO: 5321216 - DNA, 17 bp, Homo sapiens
tgccgcaaggccctgtc

SEQ ID NO: 5321217 - DNA, 17 bp, Homo sapiens
tgccgcaatacaggaac

SEQ ID NO: 5321218 - DNA, 16 bp, Homo sapiens
tgccgcacatgaaaca

SEQ ID NO: 5321219 - DNA, 12 bp, Homo sapiens
tgccgcaccagc

SEQ ID NO: 5321220 - DNA, 22 bp, Homo sapiens
tgccgcactagcctccctctcc

SEQ ID NO: 5321221 - DNA, 15 bp, Homo sapiens
tgccgcagacgggca

SEQ ID NO: 5321222 - DNA, 17 bp, Homo sapiens
tgccgcagacgggcaca

SEQ ID NO: 5321223 - DNA, 18 bp, Homo sapiens
tgccgcagacgggcacag

SEQ ID NO: 5321224 - DNA, 14 bp, Homo sapiens
tgccgcagccctgc

SEQ ID NO: 5321225 - DNA, 20 bp, Homo sapiens
tgccgcagccctgcagaggg

SEQ ID NO: 5321226 - DNA, 21 bp, Homo sapiens
tgccgcaggcgcggcggctct

SEQ ID NO: 5321227 - DNA, 13 bp, Homo sapiens
tgccgcagggagg

SEQ ID NO: 5321228 - DNA, 19 bp, Homo sapiens
tgccgcatctgcctggagc

SEQ ID NO: 5321229 - DNA, 21 bp, Homo sapiens
tgccgcatgacaactgaaggc

SEQ ID NO: 5321230 - DNA, 22 bp, Homo sapiens
tgccgcccacctcgctcccctc

SEQ ID NO: 5321231 - DNA, 16 bp, Homo sapiens
tgccgccccacccaga

SEQ ID NO: 5321232 - DNA, 18 bp, Homo sapiens
tgccgccccctcctgaac

SEQ ID NO: 5321233 - DNA, 18 bp, Homo sapiens
tgccgccccgtgcctgta

SEQ ID NO: 5321234 - DNA, 20 bp, Homo sapiens
tgccgcccgaggtggctgcc

SEQ ID NO: 5321235 - DNA, 14 bp, Homo sapiens
tgccgccctgtggg

SEQ ID NO: 5321236 - DNA, 18 bp, Homo sapiens
tgccgcccttcctggagg

SEQ ID NO: 5321237 - DNA, 14 bp, Homo sapiens
tgccgccgcccgct

SEQ ID NO: 5321238 - DNA, 16 bp, Homo sapiens
tgccgccgcccgctgg

SEQ ID NO: 5321239 - DNA, 16 bp, Homo sapiens
tgccgccgcctcgccc

SEQ ID NO: 5321240 - DNA, 18 bp, Homo sapiens
tgccgccgctaggtagag

SEQ ID NO: 5321241 - DNA, 18 bp, Homo sapiens
tgccgccgtctctgtccc

SEQ ID NO: 5321242 - DNA, 13 bp, Homo sapiens
tgccgcctcccag

SEQ ID NO: 5321243 - DNA, 14 bp, Homo sapiens
tgccgcctcccagc

SEQ ID NO: 5321244 - DNA, 17 bp, Homo sapiens
tgccgcctcccagcctg

SEQ ID NO: 5321245 - DNA, 12 bp, Homo sapiens
tgccgcctcccg

SEQ ID NO: 5321246 - DNA, 14 bp, Homo sapiens
tgccgcctcccggg

SEQ ID NO: 5321247 - DNA, 10 bp, Homo sapiens
tgccgcctgc

SEQ ID NO: 5321248 - DNA, 16 bp, Homo sapiens
tgccgcctgcactcct

SEQ ID NO: 5321249 - DNA, 15 bp, Homo sapiens
tgccgcctgctcctc

SEQ ID NO: 5321250 - DNA, 14 bp, Homo sapiens
tgccgcctgtcaat

SEQ ID NO: 5321251 - DNA, 22 bp, Homo sapiens
tgccgcctgtgcccttgctggg

SEQ ID NO: 5321252 - DNA, 23 bp, Homo sapiens
tgccgcctgtgcccttgctgggt

SEQ ID NO: 5321253 - DNA, 13 bp, Homo sapiens
tgccgccttcccc

SEQ ID NO: 5321254 - DNA, 17 bp, Homo sapiens
tgccgcgggcggccagg

SEQ ID NO: 5321255 - DNA, 18 bp, Homo sapiens
tgccgcgggcggccaggc

SEQ ID NO: 5321256 - DNA, 19 bp, Homo sapiens
tgccgcgtgcgaccagagg

SEQ ID NO: 5321257 - DNA, 12 bp, Homo sapiens
tgccgctcccct

SEQ ID NO: 5321258 - DNA, 16 bp, Homo sapiens
tgccgctccccttgga

SEQ ID NO: 5321259 - DNA, 15 bp, Homo sapiens
tgccgctcctctcta

SEQ ID NO: 5321260 - DNA, 15 bp, Homo sapiens
tgccgctctaaattg

SEQ ID NO: 5321261 - DNA, 15 bp, Homo sapiens
tgccgctctctctga

SEQ ID NO: 5321262 - DNA, 16 bp, Homo sapiens
tgccgctctctctgag

SEQ ID NO: 5321263 - DNA, 13 bp, Homo sapiens
tgccgctcttctg

SEQ ID NO: 5321264 - DNA, 16 bp, Homo sapiens
tgccgctcttctgtca

SEQ ID NO: 5321265 - DNA, 17 bp, Homo sapiens
tgccgctcttctgtcat

SEQ ID NO: 5321266 - DNA, 19 bp, Homo sapiens
tgccgctcttctgtcatcc

SEQ ID NO: 5321267 - DNA, 17 bp, Homo sapiens
tgccgctgcaccacggc

SEQ ID NO: 5321268 - DNA, 18 bp, Homo sapiens
tgccgctgccgctgcacc

SEQ ID NO: 5321269 - DNA, 23 bp, Homo sapiens
tgccgctgcttgagtggacagca

SEQ ID NO: 5321270 - DNA, 15 bp, Homo sapiens
tgccgctgggagagc

SEQ ID NO: 5321271 - DNA, 16 bp, Homo sapiens
tgccgctgtataaagc

SEQ ID NO: 5321272 - DNA, 20 bp, Homo sapiens
tgccgctgtcaaggccgagg

SEQ ID NO: 5321273 - DNA, 13 bp, Homo sapiens
tgccgctgtctct

SEQ ID NO: 5321274 - DNA, 17 bp, Homo sapiens
tgccgctgtctctgagg

SEQ ID NO: 5321275 - DNA, 13 bp, Homo sapiens
tgccgctgtgtcc

SEQ ID NO: 5321276 - DNA, 23 bp, Homo sapiens
tgccgcttaaacatttccctgct

SEQ ID NO: 5321277 - DNA, 17 bp, Homo sapiens
tgccgctttctctgagg

SEQ ID NO: 5321278 - DNA, 20 bp, Homo sapiens
tgccgctttgtctgtccagc

SEQ ID NO: 5321279 - DNA, 21 bp, Homo sapiens
tgccggagaggaagagacact

SEQ ID NO: 5321280 - DNA, 15 bp, Homo sapiens
tgccggagggagccc

SEQ ID NO: 5321281 - DNA, 14 bp, Homo sapiens
tgccggatgtgctt

SEQ ID NO: 5321282 - DNA, 13 bp, Homo sapiens
tgccggcacagct

SEQ ID NO: 5321283 - DNA, 17 bp, Homo sapiens
tgccggcccccaggaca

SEQ ID NO: 5321284 - DNA, 14 bp, Homo sapiens
tgccggccctgggg

SEQ ID NO: 5321285 - DNA, 13 bp, Homo sapiens
tgccggctctggg

SEQ ID NO: 5321286 - DNA, 16 bp, Homo sapiens
tgccggctgtggagca

SEQ ID NO: 5321287 - DNA, 19 bp, Homo sapiens
tgccgggagactgccagtg

SEQ ID NO: 5321288 - DNA, 18 bp, Homo sapiens
tgccgggaggcagccaca

SEQ ID NO: 5321289 - DNA, 15 bp, Homo sapiens
tgccgggcctggact

SEQ ID NO: 5321290 - DNA, 19 bp, Homo sapiens
tgccgggcgccaggacagc

SEQ ID NO: 5321291 - DNA, 16 bp, Homo sapiens
tgccggggcagccccc

SEQ ID NO: 5321292 - DNA, 20 bp, Homo sapiens
tgccgggtggggggagggca

SEQ ID NO: 5321293 - DNA, 22 bp, Homo sapiens
tgccgggtggggggagggcacc

SEQ ID NO: 5321294 - DNA, 19 bp, Homo sapiens
tgccgggttctagtctcct

SEQ ID NO: 5321295 - DNA, 14 bp, Homo sapiens
tgccgggttttata

SEQ ID NO: 5321296 - DNA, 15 bp, Homo sapiens
tgccggtcacactct

SEQ ID NO: 5321297 - DNA, 21 bp, Homo sapiens
tgccggtcttgacagctcagt

SEQ ID NO: 5321298 - DNA, 17 bp, Homo sapiens
tgccggtgcacaggcct

SEQ ID NO: 5321299 - DNA, 22 bp, Homo sapiens
tgccggtgcacaggcctctgcc

SEQ ID NO: 5321300 - DNA, 19 bp, Homo sapiens
tgccggtggggccagcgct

SEQ ID NO: 5321301 - DNA, 20 bp, Homo sapiens
tgccggtggggccagcgctg

SEQ ID NO: 5321302 - DNA, 23 bp, Homo sapiens
tgccgtagtcctttttgtaacta

SEQ ID NO: 5321303 - DNA, 16 bp, Homo sapiens
tgccgtcaccaccacc

SEQ ID NO: 5321304 - DNA, 22 bp, Homo sapiens
tgccgtcacctctccctcctca

SEQ ID NO: 5321305 - DNA, 19 bp, Homo sapiens
tgccgtcagtgctgtgctg

SEQ ID NO: 5321306 - DNA, 15 bp, Homo sapiens
tgccgtcctgctgga

SEQ ID NO: 5321307 - DNA, 20 bp, Homo sapiens
tgccgtctaggattgggcct

SEQ ID NO: 5321308 - DNA, 20 bp, Homo sapiens
tgccgtctcatcttctctca

SEQ ID NO: 5321309 - DNA, 20 bp, Homo sapiens
tgccgtctctcctgctctca

SEQ ID NO: 5321310 - DNA, 23 bp, Homo sapiens
tgccgtctttggttcctcatggc

SEQ ID NO: 5321311 - DNA, 16 bp, Homo sapiens
tgccgtgagcaggctt

SEQ ID NO: 5321312 - DNA, 16 bp, Homo sapiens
tgccgtgagcatgcac

SEQ ID NO: 5321313 - DNA, 21 bp, Homo sapiens
tgccgtgcacggggccagcat

SEQ ID NO: 5321314 - DNA, 16 bp, Homo sapiens
tgccgtgcatggctcc

SEQ ID NO: 5321315 - DNA, 20 bp, Homo sapiens
tgccgtggattgcacgtggc

SEQ ID NO: 5321316 - DNA, 14 bp, Homo sapiens
tgccgtggcaactg

SEQ ID NO: 5321317 - DNA, 23 bp, Homo sapiens
tgccgtggggccgccgcctcttt

SEQ ID NO: 5321318 - DNA, 21 bp, Homo sapiens
tgccgtgtcccctgacagggc

SEQ ID NO: 5321319 - DNA, 19 bp, Homo sapiens
tgccgtgtgagtgtgacag

SEQ ID NO: 5321320 - DNA, 20 bp, Homo sapiens
tgccgtgtgagtgtgacagg

SEQ ID NO: 5321321 - DNA, 20 bp, Homo sapiens
tgccgtgtgccctcgggcga

SEQ ID NO: 5321322 - DNA, 22 bp, Homo sapiens
tgccgttactctccaacctgga

SEQ ID NO: 5321323 - DNA, 14 bp, Homo sapiens
tgccgttctgttcc

SEQ ID NO: 5321324 - DNA, 14 bp, Homo sapiens
tgccgtttcccctc

SEQ ID NO: 5321325 - DNA, 20 bp, Homo sapiens
tgcctaaaaattcccttcct

SEQ ID NO: 5321326 - DNA, 23 bp, Homo sapiens
tgcctaaaaattcccttcctgtt

SEQ ID NO: 5321327 - DNA, 12 bp, Homo sapiens
tgcctaaaataa

SEQ ID NO: 5321328 - DNA, 14 bp, Homo sapiens
tgcctaaagcccat

SEQ ID NO: 5321329 - DNA, 18 bp, Homo sapiens
tgcctaaagcccattgct

SEQ ID NO: 5321330 - DNA, 20 bp, Homo sapiens
tgcctaaataagttataaag

SEQ ID NO: 5321331 - DNA, 20 bp, Homo sapiens
tgcctaaatttaatgctgcc

SEQ ID NO: 5321332 - DNA, 16 bp, Homo sapiens
tgcctaacaaaatatt

SEQ ID NO: 5321333 - DNA, 14 bp, Homo sapiens
tgcctaacaccagc

SEQ ID NO: 5321334 - DNA, 17 bp, Homo sapiens
tgcctaaccaggcccag

SEQ ID NO: 5321335 - DNA, 20 bp, Homo sapiens
tgcctaaccaggcccagcca

SEQ ID NO: 5321336 - DNA, 21 bp, Homo sapiens
tgcctaaccaggcccagccag

SEQ ID NO: 5321337 - DNA, 22 bp, Homo sapiens
tgcctaaccaggcccagccagt

SEQ ID NO: 5321338 - DNA, 20 bp, Homo sapiens
tgcctaaccatgggctcagg

SEQ ID NO: 5321339 - DNA, 14 bp, Homo sapiens
tgcctaacttgtaa

SEQ ID NO: 5321340 - DNA, 18 bp, Homo sapiens
tgcctaagaataaacatt

SEQ ID NO: 5321341 - DNA, 19 bp, Homo sapiens
tgcctaagcattgcctggc

SEQ ID NO: 5321342 - DNA, 20 bp, Homo sapiens
tgcctaaggacttctttaat

SEQ ID NO: 5321343 - DNA, 23 bp, Homo sapiens
tgcctaaggacttctttaatttt

SEQ ID NO: 5321344 - DNA, 21 bp, Homo sapiens
tgcctaagtattaaaacattg

SEQ ID NO: 5321345 - DNA, 22 bp, Homo sapiens
tgcctaagtattaaaacattgg

SEQ ID NO: 5321346 - DNA, 23 bp, Homo sapiens
tgcctaagtattaaaacattgga

SEQ ID NO: 5321347 - DNA, 17 bp, Homo sapiens
tgcctaagtattccttt

SEQ ID NO: 5321348 - DNA, 17 bp, Homo sapiens
tgcctaagtggctgctg

SEQ ID NO: 5321349 - DNA, 18 bp, Homo sapiens
tgcctaataaacatcctt

SEQ ID NO: 5321350 - DNA, 21 bp, Homo sapiens
tgcctaataaacatccttcaa

SEQ ID NO: 5321351 - DNA, 18 bp, Homo sapiens
tgcctaatacattaaagc

SEQ ID NO: 5321352 - DNA, 22 bp, Homo sapiens
tgcctaatacattaaagcagtc

SEQ ID NO: 5321353 - DNA, 15 bp, Homo sapiens
tgcctaattatgaat

SEQ ID NO: 5321354 - DNA, 15 bp, Homo sapiens
tgcctaattggaaag

SEQ ID NO: 5321355 - DNA, 19 bp, Homo sapiens
tgcctacaaccatccctgc

SEQ ID NO: 5321356 - DNA, 20 bp, Homo sapiens
tgcctacaaccatccctgcc

SEQ ID NO: 5321357 - DNA, 17 bp, Homo sapiens
tgcctacaatgggaaaa

SEQ ID NO: 5321358 - DNA, 15 bp, Homo sapiens
tgcctacagccaggt

SEQ ID NO: 5321359 - DNA, 14 bp, Homo sapiens
tgcctacagctgtc

SEQ ID NO: 5321360 - DNA, 22 bp, Homo sapiens
tgcctacatcccgggcctcagt

SEQ ID NO: 5321361 - DNA, 22 bp, Homo sapiens
tgcctacatgttctcatgcatg

SEQ ID NO: 5321362 - DNA, 20 bp, Homo sapiens
tgcctacattagtgagattt

SEQ ID NO: 5321363 - DNA, 20 bp, Homo sapiens
tgcctacattccctggcctg

SEQ ID NO: 5321364 - DNA, 17 bp, Homo sapiens
tgcctacatttatcatg

SEQ ID NO: 5321365 - DNA, 19 bp, Homo sapiens
tgcctccagccgccggctg

SEQ ID NO: 5321366 - DNA, 12 bp, Homo sapiens
tgcctccagcct

SEQ ID NO: 5321367 - DNA, 13 bp, Homo sapiens
tgcctccagcctg

SEQ ID NO: 5321368 - DNA, 18 bp, Homo sapiens
tgcctccagcctggtggc

SEQ ID NO: 5321369 - DNA, 22 bp, Homo sapiens
tgcctccagcctggtggcccag

SEQ ID NO: 5321370 - DNA, 14 bp, Homo sapiens
tgcctccaggaacc

SEQ ID NO: 5321371 - DNA, 13 bp, Homo sapiens
tgcctccaggagg

SEQ ID NO: 5321372 - DNA, 14 bp, Homo sapiens
tgcctccaggaggg

SEQ ID NO: 5321373 - DNA, 19 bp, Homo sapiens
tgcctccagggctggactg

SEQ ID NO: 5321374 - DNA, 23 bp, Homo sapiens
tgcctccagggctggactgaggc

SEQ ID NO: 5321375 - DNA, 15 bp, Homo sapiens
tgcctccaggtgcag

SEQ ID NO: 5321376 - DNA, 13 bp, Homo sapiens
tgcctccaggtgt

SEQ ID NO: 5321377 - DNA, 15 bp, Homo sapiens
tgcctccaggtgtgc

SEQ ID NO: 5321378 - DNA, 17 bp, Homo sapiens
tgcctccaggtgtgcac

SEQ ID NO: 5321379 - DNA, 14 bp, Homo sapiens
tgcctccaggttgc

SEQ ID NO: 5321380 - DNA, 16 bp, Homo sapiens
tgcctccataatttgg

SEQ ID NO: 5321381 - DNA, 12 bp, Homo sapiens
tgcctccatcct

SEQ ID NO: 5321382 - DNA, 12 bp, Homo sapiens
tgcctccatctt

SEQ ID NO: 5321383 - DNA, 13 bp, Homo sapiens
tgcctccatcttt

SEQ ID NO: 5321384 - DNA, 15 bp, Homo sapiens
tgcctccatcttttt

SEQ ID NO: 5321385 - DNA, 22 bp, Homo sapiens
tgcctccatctttttcttgggt

SEQ ID NO: 5321386 - DNA, 23 bp, Homo sapiens
tgcctccatctttttcttgggtg

SEQ ID NO: 5321387 - DNA, 19 bp, Homo sapiens
tgcctccatggcagcagcc

SEQ ID NO: 5321388 - DNA, 22 bp, Homo sapiens
tgcctccatggtgcctctggag

SEQ ID NO: 5321389 - DNA, 22 bp, Homo sapiens
tgcctccatgtagaacttgaac

SEQ ID NO: 5321390 - DNA, 13 bp, Homo sapiens
tgcctcccacact

SEQ ID NO: 5321391 - DNA, 18 bp, Homo sapiens
tgcctcccacgctgggac

SEQ ID NO: 5321392 - DNA, 20 bp, Homo sapiens
tgcctcccagccctgccagg

SEQ ID NO: 5321393 - DNA, 19 bp, Homo sapiens
tgcctcccagctagactgt

SEQ ID NO: 5321394 - DNA, 15 bp, Homo sapiens
tgcctcccaggcaag

SEQ ID NO: 5321395 - DNA, 16 bp, Homo sapiens
tgcctcccaggccacc

SEQ ID NO: 5321396 - DNA, 11 bp, Homo sapiens
tgcctcccagt

SEQ ID NO: 5321397 - DNA, 13 bp, Homo sapiens
tgcctcccatcac

SEQ ID NO: 5321398 - DNA, 19 bp, Homo sapiens
tgcctcccatcacccgcta

SEQ ID NO: 5321399 - DNA, 16 bp, Homo sapiens
tgcctcccatgcctgg

SEQ ID NO: 5321400 - DNA, 16 bp, Homo sapiens
tgcctcccattctgca

SEQ ID NO: 5321401 - DNA, 19 bp, Homo sapiens
tgcctcccattctgcacca

SEQ ID NO: 5321402 - DNA, 15 bp, Homo sapiens
tgcctccccaaccct

SEQ ID NO: 5321403 - DNA, 19 bp, Homo sapiens
tgcctccccaaccctgccc

SEQ ID NO: 5321404 - DNA, 17 bp, Homo sapiens
tgcctccccatttccca

SEQ ID NO: 5321405 - DNA, 22 bp, Homo sapiens
tgcctccccatttcccatctgc

SEQ ID NO: 5321406 - DNA, 22 bp, Homo sapiens
tgcctcccccgccacctgtgtg

SEQ ID NO: 5321407 - DNA, 18 bp, Homo sapiens
tgcctccccggctcgagc

SEQ ID NO: 5321408 - DNA, 11 bp, Homo sapiens
tgcctcccctc

SEQ ID NO: 5321409 - DNA, 16 bp, Homo sapiens
tgcctcccctcctctg

SEQ ID NO: 5321410 - DNA, 13 bp, Homo sapiens
tgcctcccctgtg

SEQ ID NO: 5321411 - DNA, 16 bp, Homo sapiens
tgcctcccgccccctt

SEQ ID NO: 5321412 - DNA, 14 bp, Homo sapiens
tgcctccctctcca

SEQ ID NO: 5321413 - DNA, 13 bp, Homo sapiens
tgcctccctctct

SEQ ID NO: 5321414 - DNA, 14 bp, Homo sapiens
tgcctccctctctt

SEQ ID NO: 5321415 - DNA, 14 bp, Homo sapiens
tgcctccctgagct

SEQ ID NO: 5321416 - DNA, 18 bp, Homo sapiens
tgcctccctgcacttcat

SEQ ID NO: 5321417 - DNA, 19 bp, Homo sapiens
tgcctccctgcacttcatc

SEQ ID NO: 5321418 - DNA, 13 bp, Homo sapiens
tgcctccctgggc

SEQ ID NO: 5321419 - DNA, 19 bp, Homo sapiens
tgcctccctgggccacctc

SEQ ID NO: 5321420 - DNA, 21 bp, Homo sapiens
tgcctccctgggccacctcct

SEQ ID NO: 5321421 - DNA, 22 bp, Homo sapiens
tgcctccctggtgagagggccg

SEQ ID NO: 5321422 - DNA, 11 bp, Homo sapiens
tgcctcccttc

SEQ ID NO: 5321423 - DNA, 16 bp, Homo sapiens
tgcctcccttcatgca

SEQ ID NO: 5321424 - DNA, 23 bp, Homo sapiens
tgcctcccttcccagtgggctgt

SEQ ID NO: 5321425 - DNA, 22 bp, Homo sapiens
tgcctcccttccgctgcgggcc

SEQ ID NO: 5321426 - DNA, 19 bp, Homo sapiens
tgcctcccttcctccgctc

SEQ ID NO: 5321427 - DNA, 19 bp, Homo sapiens
tgcctccctttctgggagg

SEQ ID NO: 5321428 - DNA, 21 bp, Homo sapiens
tgcctccgaaggggctctgag

SEQ ID NO: 5321429 - DNA, 23 bp, Homo sapiens
tgcctccgaggcctacctgctcc

SEQ ID NO: 5321430 - DNA, 16 bp, Homo sapiens
tgcctccgctggcttt

SEQ ID NO: 5321431 - DNA, 19 bp, Homo sapiens
tgcctccggcctgcactcc

SEQ ID NO: 5321432 - DNA, 16 bp, Homo sapiens
tgcctccgggcaggca

SEQ ID NO: 5321433 - DNA, 19 bp, Homo sapiens
tgcctccgggcaggcaagg

SEQ ID NO: 5321434 - DNA, 13 bp, Homo sapiens
tgcctccgggcct

SEQ ID NO: 5321435 - DNA, 21 bp, Homo sapiens
tgcctccgggcctcggcctgg

SEQ ID NO: 5321436 - DNA, 18 bp, Homo sapiens
tgcctcctactccagtat

SEQ ID NO: 5321437 - DNA, 16 bp, Homo sapiens
tgcctcctaggctgga

SEQ ID NO: 5321438 - DNA, 10 bp, Homo sapiens
tgcctcctca

SEQ ID NO: 5321439 - DNA, 21 bp, Homo sapiens
tgcctcctcaaacccagtctc

SEQ ID NO: 5321440 - DNA, 16 bp, Homo sapiens
tgcctcctcaggagcc

SEQ ID NO: 5321441 - DNA, 11 bp, Homo sapiens
tgcctcctccc

SEQ ID NO: 5321442 - DNA, 13 bp, Homo sapiens
tgcctcctcccat

SEQ ID NO: 5321443 - DNA, 18 bp, Homo sapiens
tgcctcctccccaggtgg

SEQ ID NO: 5321444 - DNA, 21 bp, Homo sapiens
tgcctcctccccaggtggagg

SEQ ID NO: 5321445 - DNA, 19 bp, Homo sapiens
tgcctcctccctcccagct

SEQ ID NO: 5321446 - DNA, 22 bp, Homo sapiens
tgcctcctccctcccagctgca

SEQ ID NO: 5321447 - DNA, 16 bp, Homo sapiens
tgcctcctctcctcct

SEQ ID NO: 5321448 - DNA, 22 bp, Homo sapiens
tgcctcctgacacacctgcagc

SEQ ID NO: 5321449 - DNA, 15 bp, Homo sapiens
tgcctcctgatgttt

SEQ ID NO: 5321450 - DNA, 14 bp, Homo sapiens
tgcctcctgccggc

SEQ ID NO: 5321451 - DNA, 20 bp, Homo sapiens
tgcctcctgccggctccttg

SEQ ID NO: 5321452 - DNA, 16 bp, Homo sapiens
tgcctcctgctctctg

SEQ ID NO: 5321453 - DNA, 12 bp, Homo sapiens
tgcctcctggag

SEQ ID NO: 5321454 - DNA, 13 bp, Homo sapiens
tgcctcctggagg

SEQ ID NO: 5321455 - DNA, 21 bp, Homo sapiens
tgcctcctggctcaggcccag

SEQ ID NO: 5321456 - DNA, 20 bp, Homo sapiens
tgcctcctgggaagatgagg

SEQ ID NO: 5321457 - DNA, 18 bp, Homo sapiens
tgcctcctggtttccttt

SEQ ID NO: 5321458 - DNA, 17 bp, Homo sapiens
tgcctcctgtgcctccc

SEQ ID NO: 5321459 - DNA, 14 bp, Homo sapiens
tgcctcctgtgggg

SEQ ID NO: 5321460 - DNA, 18 bp, Homo sapiens
tgcctcctgtggggaaag

SEQ ID NO: 5321461 - DNA, 21 bp, Homo sapiens
tgcctcctgtgtactgtgtca

SEQ ID NO: 5321462 - DNA, 20 bp, Homo sapiens
tgcctcctgtgtgtctgcag

SEQ ID NO: 5321463 - DNA, 17 bp, Homo sapiens
tgcctcctgttttctcc

SEQ ID NO: 5321464 - DNA, 14 bp, Homo sapiens
tgcctccttcagtg

SEQ ID NO: 5321465 - DNA, 17 bp, Homo sapiens
tgcctccttccacctcc

SEQ ID NO: 5321466 - DNA, 16 bp, Homo sapiens
tgcctccttgccagcc

SEQ ID NO: 5321467 - DNA, 16 bp, Homo sapiens
tgcctcctttgtgagg

SEQ ID NO: 5321468 - DNA, 18 bp, Homo sapiens
tgcctcctttgtgaggaa

SEQ ID NO: 5321469 - DNA, 22 bp, Homo sapiens
tgcctcctttgtgaggaagccg

SEQ ID NO: 5321470 - DNA, 23 bp, Homo sapiens
tgcctcgaaacacagaaaccttt

SEQ ID NO: 5321471 - DNA, 22 bp, Homo sapiens
tgcctcgagccatagagcctga

SEQ ID NO: 5321472 - DNA, 23 bp, Homo sapiens
tgcctcgaggcaccggcgctgca

SEQ ID NO: 5321473 - DNA, 20 bp, Homo sapiens
tgcctcgagggccgcctgcc

SEQ ID NO: 5321474 - DNA, 23 bp, Homo sapiens
tgcctcgagggccgcctgcctta

SEQ ID NO: 5321475 - DNA, 16 bp, Homo sapiens
tgcctcgaggggccca

SEQ ID NO: 5321476 - DNA, 13 bp, Homo sapiens
tgcctcgccttgt

SEQ ID NO: 5321477 - DNA, 17 bp, Homo sapiens
tgcctcgccttgtgtta

SEQ ID NO: 5321478 - DNA, 17 bp, Homo sapiens
tgcctcgctcaccgctg

SEQ ID NO: 5321479 - DNA, 19 bp, Homo sapiens
tgcctcgctcaccgctggc

SEQ ID NO: 5321480 - DNA, 17 bp, Homo sapiens
tgcctcgctcagtcagt

SEQ ID NO: 5321481 - DNA, 23 bp, Homo sapiens
tgcctcgctcagtcagtgcacta

SEQ ID NO: 5321482 - DNA, 16 bp, Homo sapiens
tgcctcgctcccttca

SEQ ID NO: 5321483 - DNA, 12 bp, Homo sapiens
tgcctcggacag

SEQ ID NO: 5321484 - DNA, 19 bp, Homo sapiens
tgcctcggacagtccgcag

SEQ ID NO: 5321485 - DNA, 14 bp, Homo sapiens
tgcctcggactcca

SEQ ID NO: 5321486 - DNA, 16 bp, Homo sapiens
tgcctcggactccatg

SEQ ID NO: 5321487 - DNA, 16 bp, Homo sapiens
tgcctcggatcccctt

SEQ ID NO: 5321488 - DNA, 18 bp, Homo sapiens
tgcctcggatccccttcc

SEQ ID NO: 5321489 - DNA, 20 bp, Homo sapiens
tgcctcggcctcccaaagtg

SEQ ID NO: 5321490 - DNA, 14 bp, Homo sapiens
tgcctcggctcctg

SEQ ID NO: 5321491 - DNA, 16 bp, Homo sapiens
tgcctcggctcctgct

SEQ ID NO: 5321492 - DNA, 17 bp, Homo sapiens
tgcctcggctcctgctg

SEQ ID NO: 5321493 - DNA, 21 bp, Homo sapiens
tgcctcggcttttctcagctg

SEQ ID NO: 5321494 - DNA, 21 bp, Homo sapiens
tgcctcggttgattgtgcatg

SEQ ID NO: 5321495 - DNA, 19 bp, Homo sapiens
tgcctcgtagagtgacctc

SEQ ID NO: 5321496 - DNA, 20 bp, Homo sapiens
tgcctctaactccctcctca

SEQ ID NO: 5321497 - DNA, 22 bp, Homo sapiens
tgcctctaactccctcctcaca

SEQ ID NO: 5321498 - DNA, 20 bp, Homo sapiens
tgcctctaagctgctctaaa

SEQ ID NO: 5321499 - DNA, 21 bp, Homo sapiens
tgcctctaaggccaaggcctc

SEQ ID NO: 5321500 - DNA, 19 bp, Homo sapiens
tgcctctaccagttggcag

SEQ ID NO: 5321501 - DNA, 20 bp, Homo sapiens
tgcctctaccagttggcaga

SEQ ID NO: 5321502 - DNA, 16 bp, Homo sapiens
tgcctctactgggaag

SEQ ID NO: 5321503 - DNA, 19 bp, Homo sapiens
tgcctctactgggaaggct

SEQ ID NO: 5321504 - DNA, 13 bp, Homo sapiens
tgcctctagctga

SEQ ID NO: 5321505 - DNA, 17 bp, Homo sapiens
tgcctctagtccccaag

SEQ ID NO: 5321506 - DNA, 13 bp, Homo sapiens
tgcctctattttt

SEQ ID NO: 5321507 - DNA, 16 bp, Homo sapiens
tgcctctcaattcgct

SEQ ID NO: 5321508 - DNA, 15 bp, Homo sapiens
tgcctctcacacaca

SEQ ID NO: 5321509 - DNA, 18 bp, Homo sapiens
tgcctctcacagctgagt

SEQ ID NO: 5321510 - DNA, 17 bp, Homo sapiens
tgcctctcacaggcgcc

SEQ ID NO: 5321511 - DNA, 13 bp, Homo sapiens
tgcctctcccagg

SEQ ID NO: 5321512 - DNA, 21 bp, Homo sapiens
tgcctctcccaggctgtcccc

SEQ ID NO: 5321513 - DNA, 20 bp, Homo sapiens
tgcctctccctgctgctcct

SEQ ID NO: 5321514 - DNA, 19 bp, Homo sapiens
tgcctctcctccacagccc

SEQ ID NO: 5321515 - DNA, 17 bp, Homo sapiens
tgcctctcctttgtata

SEQ ID NO: 5321516 - DNA, 12 bp, Homo sapiens
tgcctctctagg

SEQ ID NO: 5321517 - DNA, 16 bp, Homo sapiens
tgcctctctcaggcca

SEQ ID NO: 5321518 - DNA, 12 bp, Homo sapiens
tgcctctctctc

SEQ ID NO: 5321519 - DNA, 11 bp, Homo sapiens
tgcctctctgc

SEQ ID NO: 5321520 - DNA, 15 bp, Homo sapiens
tgcctctctgcaggt

SEQ ID NO: 5321521 - DNA, 18 bp, Homo sapiens
tgcctctctgcaggtccc

SEQ ID NO: 5321522 - DNA, 20 bp, Homo sapiens
tgcctctctgcaggtcccta

SEQ ID NO: 5321523 - DNA, 19 bp, Homo sapiens
tgcctctctgctccagaga

SEQ ID NO: 5321524 - DNA, 16 bp, Homo sapiens
tgcctctctggaaaga

SEQ ID NO: 5321525 - DNA, 13 bp, Homo sapiens
tgcctctctttga

SEQ ID NO: 5321526 - DNA, 17 bp, Homo sapiens
tgcctctgaactgctgc

SEQ ID NO: 5321527 - DNA, 21 bp, Homo sapiens
tgcctctgaactgctgctggt

SEQ ID NO: 5321528 - DNA, 16 bp, Homo sapiens
tgcctctgacagcagc

SEQ ID NO: 5321529 - DNA, 19 bp, Homo sapiens
tgcctctgacagcagcctg

SEQ ID NO: 5321530 - DNA, 20 bp, Homo sapiens
tgcctctgacagcagcctgt

SEQ ID NO: 5321531 - DNA, 19 bp, Homo sapiens
tgcctctgacagtccacag

SEQ ID NO: 5321532 - DNA, 20 bp, Homo sapiens
tgcctctgacagtccacagg

SEQ ID NO: 5321533 - DNA, 13 bp, Homo sapiens
tgcctctgagctt

SEQ ID NO: 5321534 - DNA, 20 bp, Homo sapiens
tgcctctgaggccagcctgg

SEQ ID NO: 5321535 - DNA, 21 bp, Homo sapiens
tgcctctgatatgggactgag

SEQ ID NO: 5321536 - DNA, 17 bp, Homo sapiens
tgcctctgatgtatttt

SEQ ID NO: 5321537 - DNA, 16 bp, Homo sapiens
tgcctctgcacgtgca

SEQ ID NO: 5321538 - DNA, 24 bp, Homo sapiens
tgcctctgcagtctcatttctcat

SEQ ID NO: 5321539 - DNA, 15 bp, Homo sapiens
tgcctctgcctctga

SEQ ID NO: 5321540 - DNA, 17 bp, Homo sapiens
tgcctctgcctctgaca

SEQ ID NO: 5321541 - DNA, 18 bp, Homo sapiens
tgcctctgcctctgacac

SEQ ID NO: 5321542 - DNA, 12 bp, Homo sapiens
tgcctctgcctg

SEQ ID NO: 5321543 - DNA, 13 bp, Homo sapiens
tgcctgcctggga

SEQ ID NO: 5321544 - DNA, 14 bp, Homo sapiens
tgcctgcctgggcc

SEQ ID NO: 5321545 - DNA, 21 bp, Homo sapiens
tgcctgcctgtctgtctctcc

SEQ ID NO: 5321546 - DNA, 21 bp, Homo sapiens
tgcctgcctgtggagacagcc

SEQ ID NO: 5321547 - DNA, 18 bp, Homo sapiens
tgcctgcgaaacccagcg

SEQ ID NO: 5321548 - DNA, 21 bp, Homo sapiens
tgcctgcgagagaccctacag

SEQ ID NO: 5321549 - DNA, 19 bp, Homo sapiens
tgcctgcgcagctccttcc

SEQ ID NO: 5321550 - DNA, 20 bp, Homo sapiens
tgcctgcgcccaccccgctc

SEQ ID NO: 5321551 - DNA, 18 bp, Homo sapiens
tgcctgcggtcaaggcca

SEQ ID NO: 5321552 - DNA, 19 bp, Homo sapiens
tgcctgcggtcaaggccag

SEQ ID NO: 5321553 - DNA, 13 bp, Homo sapiens
tgcctgcgtcttc

SEQ ID NO: 5321554 - DNA, 18 bp, Homo sapiens
tgcctgcgtcttccgccc

SEQ ID NO: 5321555 - DNA, 13 bp, Homo sapiens
tgcctgctagagc

SEQ ID NO: 5321556 - DNA, 18 bp, Homo sapiens
tgcctgctatccagccgc

SEQ ID NO: 5321557 - DNA, 19 bp, Homo sapiens
tgcctgctcagcagccagt

SEQ ID NO: 5321558 - DNA, 15 bp, Homo sapiens
tgcctgctcccatcc

SEQ ID NO: 5321559 - DNA, 18 bp, Homo sapiens
tgcctgctcccatcctgt

SEQ ID NO: 5321560 - DNA, 20 bp, Homo sapiens
tgcctgctcccatcctgtgt

SEQ ID NO: 5321561 - DNA, 12 bp, Homo sapiens
tgcctgctccct

SEQ ID NO: 5321562 - DNA, 16 bp, Homo sapiens
tgcctgctccctgtct

SEQ ID NO: 5321563 - DNA, 21 bp, Homo sapiens
tgcctgctccctgtctgtgtc

SEQ ID NO: 5321564 - DNA, 23 bp, Homo sapiens
tgcctgctccctgtctgtgtccc

SEQ ID NO: 5321565 - DNA, 13 bp, Homo sapiens
tgcctgctcctgt

SEQ ID NO: 5321566 - DNA, 21 bp, Homo sapiens
tgcctgctcgctccctgcaga

SEQ ID NO: 5321567 - DNA, 21 bp, Homo sapiens
tgcctgctctcgaggcagcag

SEQ ID NO: 5321568 - DNA, 20 bp, Homo sapiens
tgcctgctctgtgagcccca

SEQ ID NO: 5321569 - DNA, 12 bp, Homo sapiens
tgcctgctgggc

SEQ ID NO: 5321570 - DNA, 14 bp, Homo sapiens
tgcctgctgggcac

SEQ ID NO: 5321571 - DNA, 18 bp, Homo sapiens
tgcctgctgggcactggg

SEQ ID NO: 5321572 - DNA, 19 bp, Homo sapiens
tgcctgctgggcactgggc

SEQ ID NO: 5321573 - DNA, 13 bp, Homo sapiens
tgcctgctgggct

SEQ ID NO: 5321574 - DNA, 14 bp, Homo sapiens
tgcctgctgggctc

SEQ ID NO: 5321575 - DNA, 13 bp, Homo sapiens
tgcctgctgttcg

SEQ ID NO: 5321576 - DNA, 15 bp, Homo sapiens
tgcctgcttcctgga

SEQ ID NO: 5321577 - DNA, 18 bp, Homo sapiens
tgcctgcttcctggaccg

SEQ ID NO: 5321578 - DNA, 17 bp, Homo sapiens
tgcctgcttctgtgtac

SEQ ID NO: 5321579 - DNA, 19 bp, Homo sapiens
tgcctgcttctgtgtacca

SEQ ID NO: 5321580 - DNA, 14 bp, Homo sapiens
tgcctgcttgataa

SEQ ID NO: 5321581 - DNA, 19 bp, Homo sapiens
tgcctgcttggcccggccg

SEQ ID NO: 5321582 - DNA, 22 bp, Homo sapiens
tgcctgctttgacgggccaggc

SEQ ID NO: 5321583 - DNA, 19 bp, Homo sapiens
tgcctgcttttcactgctg

SEQ ID NO: 5321584 - DNA, 20 bp, Homo sapiens
tgcctgctttttatggcctg

SEQ ID NO: 5321585 - DNA, 15 bp, Homo sapiens
tgcctgctttttgga

SEQ ID NO: 5321586 - DNA, 16 bp, Homo sapiens
tgcctgctttttggaa

SEQ ID NO: 5321587 - DNA, 18 bp, Homo sapiens
tgcctggaaagtcctcct

SEQ ID NO: 5321588 - DNA, 20 bp, Homo sapiens
tgcctggaagagcagcccta

SEQ ID NO: 5321589 - DNA, 23 bp, Homo sapiens
tgcctggaagctttgtcccctgc

SEQ ID NO: 5321590 - DNA, 18 bp, Homo sapiens
tgcctggactcagcaact

SEQ ID NO: 5321591 - DNA, 20 bp, Homo sapiens
tgcctggagccccactgccc

SEQ ID NO: 5321592 - DNA, 18 bp, Homo sapiens
tgcctggagcctgggcag

SEQ ID NO: 5321593 - DNA, 20 bp, Homo sapiens
tgcctggagcctgggcagca

SEQ ID NO: 5321594 - DNA, 16 bp, Homo sapiens
tgcctggaggacctga

SEQ ID NO: 5321595 - DNA, 21 bp, Homo sapiens
tgcctggaggacctgagcctg

SEQ ID NO: 5321596 - DNA, 22 bp, Homo sapiens
tgcctggaggagaaggaggaac

SEQ ID NO: 5321597 - DNA, 22 bp, Homo sapiens
tgcctggaggatagcagagaag

SEQ ID NO: 5321598 - DNA, 17 bp, Homo sapiens
tgcctggaggctcctct

SEQ ID NO: 5321599 - DNA, 24 bp, Homo sapiens
tgcctggaggctcctctaggccct

SEQ ID NO: 5321600 - DNA, 17 bp, Homo sapiens
tgcctggagggaatcca

SEQ ID NO: 5321601 - DNA, 22 bp, Homo sapiens
tgcctggagggtaactgggggg

SEQ ID NO: 5321602 - DNA, 20 bp, Homo sapiens
tgcctggagtcagtagccag

SEQ ID NO: 5321603 - DNA, 21 bp, Homo sapiens
tgcctggagtgcccaccctgg

SEQ ID NO: 5321604 - DNA, 22 bp, Homo sapiens
tgcctggatccagctctgggag

SEQ ID NO: 5321605 - DNA, 15 bp, Homo sapiens
tgcctggatggggct

SEQ ID NO: 5321606 - DNA, 16 bp, Homo sapiens
tgcctggatggggctg

SEQ ID NO: 5321607 - DNA, 21 bp, Homo sapiens
tgcctggatggggctgcaccg

SEQ ID NO: 5321608 - DNA, 21 bp, Homo sapiens
tgcctggcacagaccaggcct

SEQ ID NO: 5321609 - DNA, 22 bp, Homo sapiens
tgcctggcacagcttttgtata

SEQ ID NO: 5321610 - DNA, 22 bp, Homo sapiens
tgcctggcacttactggtcctt

SEQ ID NO: 5321611 - DNA, 17 bp, Homo sapiens
tgcctggccaacataat

SEQ ID NO: 5321612 - DNA, 23 bp, Homo sapiens
tgcctggccactgctccctaagc

SEQ ID NO: 5321613 - DNA, 16 bp, Homo sapiens
tgcctggccaggccct

SEQ ID NO: 5321614 - DNA, 16 bp, Homo sapiens
tgcctggccatgctgt

SEQ ID NO: 5321615 - DNA, 20 bp, Homo sapiens
tgcctggccatgctgtccct

SEQ ID NO: 5321616 - DNA, 20 bp, Homo sapiens
tgcctggccatgtcacctgg

SEQ ID NO: 5321617 - DNA, 19 bp, Homo sapiens
tgcctggcccagggaggaa

SEQ ID NO: 5321618 - DNA, 14 bp, Homo sapiens
tgcctggcccttgc

SEQ ID NO: 5321619 - DNA, 21 bp, Homo sapiens
tgcctggccgcagggcggggc

SEQ ID NO: 5321620 - DNA, 11 bp, Homo sapiens
tgcctggcctc

SEQ ID NO: 5321621 - DNA, 13 bp, Homo sapiens
tgcctggcctctg

SEQ ID NO: 5321622 - DNA, 15 bp, Homo sapiens
tgcctggcctgagga

SEQ ID NO: 5321623 - DNA, 16 bp, Homo sapiens
tgcctggcctgaggac

SEQ ID NO: 5321624 - DNA, 13 bp, Homo sapiens
tgcctggcctggc

SEQ ID NO: 5321625 - DNA, 20 bp, Homo sapiens
tgcctggcctggcacacatc

SEQ ID NO: 5321626 - DNA, 22 bp, Homo sapiens
tgcctggcctggcacacatcag

SEQ ID NO: 5321627 - DNA, 17 bp, Homo sapiens
tgcctggcgggcagccc

SEQ ID NO: 5321628 - DNA, 20 bp, Homo sapiens
tgcctggcgggcagcccctg

SEQ ID NO: 5321629 - DNA, 22 bp, Homo sapiens
tgcctggcgggcagcccctgct

SEQ ID NO: 5321630 - DNA, 15 bp, Homo sapiens
tgcctggcggggtgg

SEQ ID NO: 5321631 - DNA, 16 bp, Homo sapiens
tgcctggctagaaaac

SEQ ID NO: 5321632 - DNA, 11 bp, Homo sapiens
tgcctggctca

SEQ ID NO: 5321633 - DNA, 14 bp, Homo sapiens
tgcctggctccctg

SEQ ID NO: 5321634 - DNA, 22 bp, Homo sapiens
tgcctggctgattcagcatttt

SEQ ID NO: 5321635 - DNA, 13 bp, Homo sapiens
tgcctggctgtgg

SEQ ID NO: 5321636 - DNA, 19 bp, Homo sapiens
tgcctgggaagcccaccca

SEQ ID NO: 5321637 - DNA, 16 bp, Homo sapiens
tgcctgggaatcctgc

SEQ ID NO: 5321638 - DNA, 20 bp, Homo sapiens
tgcctgggaatcctgctgcc

SEQ ID NO: 5321639 - DNA, 14 bp, Homo sapiens
tgcctgggacagcc

SEQ ID NO: 5321640 - DNA, 11 bp, Homo sapiens
tgcctgggagg

SEQ ID NO: 5321641 - DNA, 14 bp, Homo sapiens
tgcctgggaggagt

SEQ ID NO: 5321642 - DNA, 14 bp, Homo sapiens
tgcctgggaggctt

SEQ ID NO: 5321643 - DNA, 16 bp, Homo sapiens
tgcctgggatgccctt

SEQ ID NO: 5321644 - DNA, 20 bp, Homo sapiens
tgcctgggatgggctcccac

SEQ ID NO: 5321645 - DNA, 14 bp, Homo sapiens
tgcctgggattcta

SEQ ID NO: 5321646 - DNA, 19 bp, Homo sapiens
tgcctgggcaatggccagg

SEQ ID NO: 5321647 - DNA, 22 bp, Homo sapiens
tgcctgggcaatggccaggggc

SEQ ID NO: 5321648 - DNA, 21 bp, Homo sapiens
tgcctgggccatgcgaggggc

SEQ ID NO: 5321649 - DNA, 18 bp, Homo sapiens
tgcctgggcccaggccca

SEQ ID NO: 5321650 - DNA, 17 bp, Homo sapiens
tgcctgggcccctcccc

SEQ ID NO: 5321651 - DNA, 20 bp, Homo sapiens
tgcctgggcccctcccctca

SEQ ID NO: 5321652 - DNA, 14 bp, Homo sapiens
tgcctgggcccgga

SEQ ID NO: 5321653 - DNA, 14 bp, Homo sapiens
tgcctgggccctgg

SEQ ID NO: 5321654 - DNA, 21 bp, Homo sapiens
tgcctgggccgtggcacagct

SEQ ID NO: 5321655 - DNA, 23 bp, Homo sapiens
tgcctgggccgtggcacagctgg

SEQ ID NO: 5321656 - DNA, 17 bp, Homo sapiens
tgcctgggcctcccaaa

SEQ ID NO: 5321657 - DNA, 15 bp, Homo sapiens
tgcctgggcctgtgc

SEQ ID NO: 5321658 - DNA, 17 bp, Homo sapiens
tgcctgggcctgtgcag

SEQ ID NO: 5321659 - DNA, 20 bp, Homo sapiens
tgcctgggcctgtgcagcag

SEQ ID NO: 5321660 - DNA, 22 bp, Homo sapiens
tgcctgggcctgtgcagcagcc

SEQ ID NO: 5321661 - DNA, 16 bp, Homo sapiens
tgcctgggccttggct

SEQ ID NO: 5321662 - DNA, 17 bp, Homo sapiens
tgcctgggccttggctg

SEQ ID NO: 5321663 - DNA, 20 bp, Homo sapiens
tgcctgggccttggctgggc

SEQ ID NO: 5321664 - DNA, 21 bp, Homo sapiens
tgcctgggccttggctgggcc

SEQ ID NO: 5321665 - DNA, 14 bp, Homo sapiens
tgcctgggctcagc

SEQ ID NO: 5321666 - DNA, 17 bp, Homo sapiens
tgcctgggctgggcagc

SEQ ID NO: 5321667 - DNA, 17 bp, Homo sapiens
tgcctgggctgttggca

SEQ ID NO: 5321668 - DNA, 18 bp, Homo sapiens
tgcctggggattgggagg

SEQ ID NO: 5321669 - DNA, 20 bp, Homo sapiens
tgcctggggattgggaggga

SEQ ID NO: 5321670 - DNA, 21 bp, Homo sapiens
tgcctggggcccaagttgcag

SEQ ID NO: 5321671 - DNA, 22 bp, Homo sapiens
tgcctggggcccaagttgcagt

SEQ ID NO: 5321672 - DNA, 22 bp, Homo sapiens
tgcctggggcctccagaagctg

SEQ ID NO: 5321673 - DNA, 23 bp, Homo sapiens
tgcctggggcctccagaagctgc

SEQ ID NO: 5321674 - DNA, 22 bp, Homo sapiens
tgcctggggcggcatgaaccct

SEQ ID NO: 5321675 - DNA, 19 bp, Homo sapiens
tgcctggggctggctgcag

SEQ ID NO: 5321676 - DNA, 19 bp, Homo sapiens
tgcctgggggagagaggca

SEQ ID NO: 5321677 - DNA, 20 bp, Homo sapiens
tgcctgggggagttttcctc

SEQ ID NO: 5321678 - DNA, 23 bp, Homo sapiens
tgcctgggggcttttgccactcc

SEQ ID NO: 5321679 - DNA, 12 bp, Homo sapiens
tgcctggggtct

SEQ ID NO: 5321680 - DNA, 17 bp, Homo sapiens
tgcctggggtctgagca

SEQ ID NO: 5321681 - DNA, 15 bp, Homo sapiens
tgcctggggtggagg

SEQ ID NO: 5321682 - DNA, 21 bp, Homo sapiens
tgcctggggtggaggctaagc

SEQ ID NO: 5321683 - DNA, 21 bp, Homo sapiens
tgcctggggtggcctggccct

SEQ ID NO: 5321684 - DNA, 22 bp, Homo sapiens
tgcctggggtggcctggccctc

SEQ ID NO: 5321685 - DNA, 16 bp, Homo sapiens
tgcctgggtaggcccc

SEQ ID NO: 5321686 - DNA, 18 bp, Homo sapiens
tgcctgggtaggccccac

SEQ ID NO: 5321687 - DNA, 19 bp, Homo sapiens
tgcctgggtaggccccaca

SEQ ID NO: 5321688 - DNA, 21 bp, Homo sapiens
tgcctgggtggacatggcccc

SEQ ID NO: 5321689 - DNA, 17 bp, Homo sapiens
tgcctgggtggccatcc

SEQ ID NO: 5321690 - DNA, 16 bp, Homo sapiens
tgcctgggtgggacag

SEQ ID NO: 5321691 - DNA, 18 bp, Homo sapiens
tgcctgggtgggacagcc

SEQ ID NO: 5321692 - DNA, 22 bp, Homo sapiens
tgcctgggtggggctgctcctc

SEQ ID NO: 5321693 - DNA, 23 bp, Homo sapiens
tgcctgggtggggctgctcctcc

SEQ ID NO: 5321694 - DNA, 22 bp, Homo sapiens
tgcctgggttccaatcctggct

SEQ ID NO: 5321695 - DNA, 20 bp, Homo sapiens
tgcctgggttttctaactgt

SEQ ID NO: 5321696 - DNA, 22 bp, Homo sapiens
tgcctgggttttctaactgtaa

SEQ ID NO: 5321697 - DNA, 14 bp, Homo sapiens
tgcctggtaagtgg

SEQ ID NO: 5321698 - DNA, 17 bp, Homo sapiens
tgcctggtactctggca

SEQ ID NO: 5321699 - DNA, 20 bp, Homo sapiens
tgcctggtatatccaaaagc

SEQ ID NO: 5321700 - DNA, 14 bp, Homo sapiens
tgcctggtattttc

SEQ ID NO: 5321701 - DNA, 17 bp, Homo sapiens
tgcctggtcacagggca

SEQ ID NO: 5321702 - DNA, 15 bp, Homo sapiens
tgcctggtcaccctg

SEQ ID NO: 5321703 - DNA, 19 bp, Homo sapiens
tgcctggtcccagagtggc

SEQ ID NO: 5321704 - DNA, 20 bp, Homo sapiens
tgcctggtctcctgccccca

SEQ ID NO: 5321705 - DNA, 20 bp, Homo sapiens
tgcctggtgcattgctgtgt

SEQ ID NO: 5321706 - DNA, 18 bp, Homo sapiens
tgcctggtgcgctgtgct

SEQ ID NO: 5321707 - DNA, 20 bp, Homo sapiens
tgcctggtgcttccaaatat

SEQ ID NO: 5321708 - DNA, 14 bp, Homo sapiens
tgcctggtggcagc

SEQ ID NO: 5321709 - DNA, 17 bp, Homo sapiens
tgcctggtggcagctgc

SEQ ID NO: 5321710 - DNA, 17 bp, Homo sapiens
tgcctggtgggccacgt

SEQ ID NO: 5321711 - DNA, 21 bp, Homo sapiens
tgcctggtgggggaaggggag

SEQ ID NO: 5321712 - DNA, 23 bp, Homo sapiens
tgcctggtgggggaaggggagga

SEQ ID NO: 5321713 - DNA, 16 bp, Homo sapiens
tgcctggtgttctgaa

SEQ ID NO: 5321714 - DNA, 15 bp, Homo sapiens
tgcctggttcgtgcc

SEQ ID NO: 5321715 - DNA, 16 bp, Homo sapiens
tgcctggttcgtgcca

SEQ ID NO: 5321716 - DNA, 16 bp, Homo sapiens
tgcctggttctaggct

SEQ ID NO: 5321717 - DNA, 17 bp, Homo sapiens
tgcctggttctaggctg

SEQ ID NO: 5321718 - DNA, 16 bp, Homo sapiens
tgccttctacttttaa

SEQ ID NO: 5321719 - DNA, 22 bp, Homo sapiens
tgccttctagattcactgtctt

SEQ ID NO: 5321720 - DNA, 22 bp, Homo sapiens
tgccttctcaactccaaactga

SEQ ID NO: 5321721 - DNA, 18 bp, Homo sapiens
tgccttctcaccagctgc

SEQ ID NO: 5321722 - DNA, 21 bp, Homo sapiens
tgccttctcaccagctgcaaa

SEQ ID NO: 5321723 - DNA, 20 bp, Homo sapiens
tgccttctcactagctgtct

SEQ ID NO: 5321724 - DNA, 22 bp, Homo sapiens
tgccttctcctctctgggcctt

SEQ ID NO: 5321725 - DNA, 24 bp, Homo sapiens
tgccttctccttccccaggatgga

SEQ ID NO: 5321726 - DNA, 16 bp, Homo sapiens
tgccttctctcagctc

SEQ ID NO: 5321727 - DNA, 20 bp, Homo sapiens
tgccttctctcagctcccag

SEQ ID NO: 5321728 - DNA, 23 bp, Homo sapiens
tgccttctctcagctcccaggcc

SEQ ID NO: 5321729 - DNA, 13 bp, Homo sapiens
tgccttctctctc

SEQ ID NO: 5321730 - DNA, 18 bp, Homo sapiens
tgccttctcttctatcct

SEQ ID NO: 5321731 - DNA, 20 bp, Homo sapiens
tgccttctgaaatgtgaccc

SEQ ID NO: 5321732 - DNA, 17 bp, Homo sapiens
tgccttctgacggccct

SEQ ID NO: 5321733 - DNA, 18 bp, Homo sapiens
tgccttctgacggccctg

SEQ ID NO: 5321734 - DNA, 17 bp, Homo sapiens
tgccttctgagctgtct

SEQ ID NO: 5321735 - DNA, 22 bp, Homo sapiens
tgccttctgccaacgcctcctg

SEQ ID NO: 5321736 - DNA, 15 bp, Homo sapiens
tgccttctggagctg

SEQ ID NO: 5321737 - DNA, 13 bp, Homo sapiens
tgccttctgggct

SEQ ID NO: 5321738 - DNA, 12 bp, Homo sapiens
tgccttctgggg

SEQ ID NO: 5321739 - DNA, 20 bp, Homo sapiens
tgccttctggggagggacac

SEQ ID NO: 5321740 - DNA, 22 bp, Homo sapiens
tgccttctggggagggacacag

SEQ ID NO: 5321741 - DNA, 15 bp, Homo sapiens
tgccttctgtctctt

SEQ ID NO: 5321742 - DNA, 18 bp, Homo sapiens
tgccttctgtctcttgca

SEQ ID NO: 5321743 - DNA, 14 bp, Homo sapiens
tgccttctgtgggg

SEQ ID NO: 5321744 - DNA, 22 bp, Homo sapiens
tgccttctgtggggactccggc

SEQ ID NO: 5321745 - DNA, 16 bp, Homo sapiens
tgccttctgttttcca

SEQ ID NO: 5321746 - DNA, 17 bp, Homo sapiens
tgccttcttcagggcct

SEQ ID NO: 5321747 - DNA, 21 bp, Homo sapiens
tgccttcttctttttgctgtt

SEQ ID NO: 5321748 - DNA, 13 bp, Homo sapiens
tgccttctttcca

SEQ ID NO: 5321749 - DNA, 13 bp, Homo sapiens
tgccttctttgaa

SEQ ID NO: 5321750 - DNA, 15 bp, Homo sapiens
tgccttctttgaaga

SEQ ID NO: 5321751 - DNA, 20 bp, Homo sapiens
tgccttctttgaagaaggtg

SEQ ID NO: 5321752 - DNA, 18 bp, Homo sapiens
tgccttgaaaaatgacaa

SEQ ID NO: 5321753 - DNA, 20 bp, Homo sapiens
tgccttgaaatttacacagt

SEQ ID NO: 5321754 - DNA, 19 bp, Homo sapiens
tgccttgaaccacttccct

SEQ ID NO: 5321755 - DNA, 21 bp, Homo sapiens
tgccttgaaccacttccctca

SEQ ID NO: 5321756 - DNA, 17 bp, Homo sapiens
tgccttgaacctgtgag

SEQ ID NO: 5321757 - DNA, 18 bp, Homo sapiens
tgccttgaacctgtgagt

SEQ ID NO: 5321758 - DNA, 12 bp, Homo sapiens
tgccttgaataa

SEQ ID NO: 5321759 - DNA, 23 bp, Homo sapiens
tgccttgaatatcccctcccagt

SEQ ID NO: 5321760 - DNA, 23 bp, Homo sapiens
tgccttgagacccccaagcttcc

SEQ ID NO: 5321761 - DNA, 17 bp, Homo sapiens
tgccttgatgaagcctg

SEQ ID NO: 5321762 - DNA, 15 bp, Homo sapiens
tgccttgatgattta

SEQ ID NO: 5321763 - DNA, 14 bp, Homo sapiens
tgccttgattttaa

SEQ ID NO: 5321764 - DNA, 18 bp, Homo sapiens
tgccttgattttaattca

SEQ ID NO: 5321765 - DNA, 14 bp, Homo sapiens
tgccttgcagaact

SEQ ID NO: 5321766 - DNA, 19 bp, Homo sapiens
tgccttgcagaactgccat

SEQ ID NO: 5321767 - DNA, 15 bp, Homo sapiens
tgccttgcagccaca

SEQ ID NO: 5321768 - DNA, 20 bp, Homo sapiens
tgccttgcataatggtcaga

SEQ ID NO: 5321769 - DNA, 12 bp, Homo sapiens
tgccttgcattt

SEQ ID NO: 5321770 - DNA, 14 bp, Homo sapiens
tgccttgcccacag

SEQ ID NO: 5321771 - DNA, 17 bp, Homo sapiens
tgccttgccctcctggg

SEQ ID NO: 5321772 - DNA, 15 bp, Homo sapiens
tgccttgccgctccc

SEQ ID NO: 5321773 - DNA, 16 bp, Homo sapiens
tgccttgcctcctcag

SEQ ID NO: 5321774 - DNA, 15 bp, Homo sapiens
tgccttgctcatttg

SEQ ID NO: 5321775 - DNA, 18 bp, Homo sapiens
tgccttgctgccttcacc

SEQ ID NO: 5321776 - DNA, 22 bp, Homo sapiens
tgccttgctgtttgtcctgaga

SEQ ID NO: 5321777 - DNA, 13 bp, Homo sapiens
tgccttgcttctc

SEQ ID NO: 5321778 - DNA, 15 bp, Homo sapiens
tgccttgcttctccc

SEQ ID NO: 5321779 - DNA, 21 bp, Homo sapiens
tgccttgcttctgtatttcct

SEQ ID NO: 5321780 - DNA, 19 bp, Homo sapiens
tgccttggagagggcccag

SEQ ID NO: 5321781 - DNA, 21 bp, Homo sapiens
tgccttggaggaaatgtgctc

SEQ ID NO: 5321782 - DNA, 21 bp, Homo sapiens
tgccttggagggtcccaagct

SEQ ID NO: 5321783 - DNA, 23 bp, Homo sapiens
tgccttggccccccaaagtgctg

SEQ ID NO: 5321784 - DNA, 14 bp, Homo sapiens
tgccttggcccctc

SEQ ID NO: 5321785 - DNA, 17 bp, Homo sapiens
tgccttggcctcccaaa

SEQ ID NO: 5321786 - DNA, 13 bp, Homo sapiens
tgccttggcctcg

SEQ ID NO: 5321787 - DNA, 16 bp, Homo sapiens
tgccttgggcaaggac

SEQ ID NO: 5321788 - DNA, 17 bp, Homo sapiens
tgccttgggccttgctg

SEQ ID NO: 5321789 - DNA, 19 bp, Homo sapiens
tgccttgggccttgctgct

SEQ ID NO: 5321790 - DNA, 16 bp, Homo sapiens
tgccttggggacaaga

SEQ ID NO: 5321791 - DNA, 17 bp, Homo sapiens
tgccttggttctggcca

SEQ ID NO: 5321792 - DNA, 22 bp, Homo sapiens
tgccttggttctggccacccca

SEQ ID NO: 5321793 - DNA, 16 bp, Homo sapiens
tgccttggttcttcct

SEQ ID NO: 5321794 - DNA, 15 bp, Homo sapiens
tgccttgtcacgcca

SEQ ID NO: 5321795 - DNA, 14 bp, Homo sapiens
tgccttgtccagga

SEQ ID NO: 5321796 - DNA, 23 bp, Homo sapiens
tgccttgtccaggaactgcctgg

SEQ ID NO: 5321797 - DNA, 21 bp, Homo sapiens
tgccttgtgtatgtgactcca

SEQ ID NO: 5321798 - DNA, 23 bp, Homo sapiens
tgccttgttgatgggccttcaga

SEQ ID NO: 5321799 - DNA, 23 bp, Homo sapiens
tgccttgttgtattcctgccttt

SEQ ID NO: 5321800 - DNA, 17 bp, Homo sapiens
tgccttgtttaatgtta

SEQ ID NO: 5321801 - DNA, 16 bp, Homo sapiens
tgccttgtttcatagt

SEQ ID NO: 5321802 - DNA, 23 bp, Homo sapiens
tgccttgtttgagtttttcctcc

SEQ ID NO: 5321803 - DNA, 16 bp, Homo sapiens
tgcctttaaagtatga

SEQ ID NO: 5321804 - DNA, 18 bp, Homo sapiens
tgcctttaaatctgtgat

SEQ ID NO: 5321805 - DNA, 19 bp, Homo sapiens
tgcctttaaatctgtgatg

SEQ ID NO: 5321806 - DNA, 14 bp, Homo sapiens
tgcctttaagccaa

SEQ ID NO: 5321807 - DNA, 17 bp, Homo sapiens
tgcctttaatgttgccc

SEQ ID NO: 5321808 - DNA, 16 bp, Homo sapiens
tgcctttagaaaatat

SEQ ID NO: 5321809 - DNA, 17 bp, Homo sapiens
tgcctttagatgtgagc

SEQ ID NO: 5321810 - DNA, 23 bp, Homo sapiens
tgcctttagcctggaccaaaggg

SEQ ID NO: 5321811 - DNA, 21 bp, Homo sapiens
tgcctttagcgtgtaaatgga

SEQ ID NO: 5321812 - DNA, 15 bp, Homo sapiens
tgcctttaggcagga

SEQ ID NO: 5321813 - DNA, 17 bp, Homo sapiens
tgcctttaggcaggaag

SEQ ID NO: 5321814 - DNA, 18 bp, Homo sapiens
tgcctttaggcaggaagt

SEQ ID NO: 5321815 - DNA, 22 bp, Homo sapiens
tgcctttagtccacggaccccc

SEQ ID NO: 5321816 - DNA, 17 bp, Homo sapiens
tgcctttatatttcaca

SEQ ID NO: 5321817 - DNA, 19 bp, Homo sapiens
tgcctttatctcagccatc

SEQ ID NO: 5321818 - DNA, 22 bp, Homo sapiens
tgcctttatgatgctaagctga

SEQ ID NO: 5321819 - DNA, 14 bp, Homo sapiens
tgcctttattgtgt

SEQ ID NO: 5321820 - DNA, 21 bp, Homo sapiens
tgcctttattgtgtttgtcat

SEQ ID NO: 5321821 - DNA, 18 bp, Homo sapiens
tgcctttatttgctgtta

SEQ ID NO: 5321822 - DNA, 21 bp, Homo sapiens
tgcctttatttgctgttaact

SEQ ID NO: 5321823 - DNA, 11 bp, Homo sapiens
tgcctttcaaa

SEQ ID NO: 5321824 - DNA, 21 bp, Homo sapiens
tgcctttcaaacattgagact

SEQ ID NO: 5321825 - DNA, 22 bp, Homo sapiens
tgcctttcaaagtgcacacaca

SEQ ID NO: 5321826 - DNA, 13 bp, Homo sapiens
tgcctttcaaatt

SEQ ID NO: 5321827 - DNA, 16 bp, Homo sapiens
tgcctttcaggatcta

SEQ ID NO: 5321828 - DNA, 18 bp, Homo sapiens
tgcctttcatagtttatt

SEQ ID NO: 5321829 - DNA, 13 bp, Homo sapiens
tgcctttccaggg

SEQ ID NO: 5321830 - DNA, 20 bp, Homo sapiens
tgcctttccagtgctgctcc

SEQ ID NO: 5321831 - DNA, 22 bp, Homo sapiens
tgcctttccatccatggccagc

SEQ ID NO: 5321832 - DNA, 23 bp, Homo sapiens
tgcctttccccattcattcctga

SEQ ID NO: 5321833 - DNA, 12 bp, Homo sapiens
tgcctttccccc

SEQ ID NO: 5321834 - DNA, 14 bp, Homo sapiens
tgcctttcccccct

SEQ ID NO: 5321835 - DNA, 22 bp, Homo sapiens
tgcctttcccgggccctcagcc

SEQ ID NO: 5321836 - DNA, 10 bp, Homo sapiens
tgcctttcct

SEQ ID NO: 5321837 - DNA, 12 bp, Homo sapiens
tgcctttcctgt

SEQ ID NO: 5321838 - DNA, 16 bp, Homo sapiens
tgcctttcctgttcag

SEQ ID NO: 5321839 - DNA, 20 bp, Homo sapiens
tgcctttcctgttcagcatt

SEQ ID NO: 5321840 - DNA, 16 bp, Homo sapiens
tgcctttcgaggcctg

SEQ ID NO: 5321841 - DNA, 15 bp, Homo sapiens
tgcctttctagcaat

SEQ ID NO: 5321842 - DNA, 20 bp, Homo sapiens
tgcctttctcgattttatct

SEQ ID NO: 5321843 - DNA, 20 bp, Homo sapiens
tgcctttctgggagcagaaa

SEQ ID NO: 5321844 - DNA, 11 bp, Homo sapiens
tgcctttctgt

SEQ ID NO: 5321845 - DNA, 16 bp, Homo sapiens
tgcctttctgtgttta

SEQ ID NO: 5321846 - DNA, 23 bp, Homo sapiens
tgcctttcttatttgcaataaaa

SEQ ID NO: 5321847 - DNA, 14 bp, Homo sapiens
tgcctttcttccat

SEQ ID NO: 5321848 - DNA, 18 bp, Homo sapiens
tgcctttctttgcctctg

SEQ ID NO: 5321849 - DNA, 19 bp, Homo sapiens
tgcctttctttgcctctgc

SEQ ID NO: 5321850 - DNA, 12 bp, Homo sapiens
tgcctttgaatg

SEQ ID NO: 5321851 - DNA, 22 bp, Homo sapiens
tgcctttgagcttctcctctgc

SEQ ID NO: 5321852 - DNA, 19 bp, Homo sapiens
tgcctttgagtttcctcag

SEQ ID NO: 5321853 - DNA, 14 bp, Homo sapiens
tgcctttgcagaaa

SEQ ID NO: 5321854 - DNA, 17 bp, Homo sapiens
tgcctttgcagaaacag

SEQ ID NO: 5321855 - DNA, 16 bp, Homo sapiens
tgcctttgctcttata

SEQ ID NO: 5321856 - DNA, 16 bp, Homo sapiens
tgcctttgctgccttc

SEQ ID NO: 5321857 - DNA, 22 bp, Homo sapiens
tgcctttggaagggtctctctc

SEQ ID NO: 5321858 - DNA, 15 bp, Homo sapiens
tgcctttgggagcag

SEQ ID NO: 5321859 - DNA, 14 bp, Homo sapiens
tgcctttggttccc

SEQ ID NO: 5321860 - DNA, 12 bp, Homo sapiens
tgcctttgtaac

SEQ ID NO: 5321861 - DNA, 14 bp, Homo sapiens
tgcctttgtatgtg

SEQ ID NO: 5321862 - DNA, 14 bp, Homo sapiens
tgcctttgtggcct

SEQ ID NO: 5321863 - DNA, 19 bp, Homo sapiens
tgcctttgtggtgggcgct

SEQ ID NO: 5321864 - DNA, 21 bp, Homo sapiens
tgccttttaaaaatactatgt

SEQ ID NO: 5321865 - DNA, 18 bp, Homo sapiens
tgccttttaaattctttt

SEQ ID NO: 5321866 - DNA, 17 bp, Homo sapiens
tgccttttaagtttgaa

SEQ ID NO: 5321867 - DNA, 18 bp, Homo sapiens
tgccttttagttcctgtg

SEQ ID NO: 5321868 - DNA, 13 bp, Homo sapiens
tgccttttatagc

SEQ ID NO: 5321869 - DNA, 14 bp, Homo sapiens
tgccttttatccca

SEQ ID NO: 5321870 - DNA, 17 bp, Homo sapiens
tgccttttcccaactcc

SEQ ID NO: 5321871 - DNA, 19 bp, Homo sapiens
tgccttttcccaactccag

SEQ ID NO: 5321872 - DNA, 21 bp, Homo sapiens
tgccttttctgtgattgggtg

SEQ ID NO: 5321873 - DNA, 19 bp, Homo sapiens
tgccttttgcagaagaggg

SEQ ID NO: 5321874 - DNA, 22 bp, Homo sapiens
tgccttttgcagaagagggtgt

SEQ ID NO: 5321875 - DNA, 17 bp, Homo sapiens
tgccttttgctgctgct

SEQ ID NO: 5321876 - DNA, 18 bp, Homo sapiens
tgccttttggtttcacct

SEQ ID NO: 5321877 - DNA, 11 bp, Homo sapiens
tgccttttgta

SEQ ID NO: 5321878 - DNA, 12 bp, Homo sapiens
tgccttttgtag

SEQ ID NO: 5321879 - DNA, 20 bp, Homo sapiens
tgccttttgtagctgtcatg

SEQ ID NO: 5321880 - DNA, 18 bp, Homo sapiens
tgccttttgtaggctgtt

SEQ ID NO: 5321881 - DNA, 21 bp, Homo sapiens
tgccttttgtaggctgttccc

SEQ ID NO: 5321882 - DNA, 14 bp, Homo sapiens
tgccttttgtgtga

SEQ ID NO: 5321883 - DNA, 17 bp, Homo sapiens
tgccttttgttaatgca

SEQ ID NO: 5321884 - DNA, 18 bp, Homo sapiens
tgccttttgtttccagga

SEQ ID NO: 5321885 - DNA, 13 bp, Homo sapiens
tgcctttttaagt

SEQ ID NO: 5321886 - DNA, 20 bp, Homo sapiens
tgcctttttaagtaaaaaag

SEQ ID NO: 5321887 - DNA, 19 bp, Homo sapiens
tgcctttttatttatatgt

SEQ ID NO: 5321888 - DNA, 13 bp, Homo sapiens
tgcctttttcatt

SEQ ID NO: 5321889 - DNA, 21 bp, Homo sapiens
tgcctttttcattattttatt

SEQ ID NO: 5321890 - DNA, 14 bp, Homo sapiens
tgcctttttcctta

SEQ ID NO: 5321891 - DNA, 18 bp, Homo sapiens
tgcctttttgtttttgta

SEQ ID NO: 5321892 - DNA, 21 bp, Homo sapiens
tgccttttttcacggaagttt

SEQ ID NO: 5321893 - DNA, 21 bp, Homo sapiens
tgccttttttctatatcaaaa

SEQ ID NO: 5321894 - DNA, 17 bp, Homo sapiens
tgccttttttttcatga

SEQ ID NO: 5321895 - DNA, 14 bp, Homo sapiens
tgcgtgttcagcag

SEQ ID NO: 5321896 - DNA, 16 bp, Homo sapiens
tgcgttaggcagggca

SEQ ID NO: 5321897 - DNA, 13 bp, Homo sapiens
tgcgttcagcccc

SEQ ID NO: 5321898 - DNA, 21 bp, Homo sapiens
tgcgttcctaaactctgaaat

SEQ ID NO: 5321899 - DNA, 14 bp, Homo sapiens
tgcgttctcccagc

SEQ ID NO: 5321900 - DNA, 24 bp, Homo sapiens
tgcgttctcccagcactgcctcct

SEQ ID NO: 5321901 - DNA, 23 bp, Homo sapiens
tgcgttggaatcacctggagggc

SEQ ID NO: 5321902 - DNA, 19 bp, Homo sapiens
tgcgttggagccactcctg

SEQ ID NO: 5321903 - DNA, 18 bp, Homo sapiens
tgcgtttataattggctt

SEQ ID NO: 5321904 - DNA, 23 bp, Homo sapiens
tgcgtttcttccactgagtcttt

SEQ ID NO: 5321905 - DNA, 13 bp, Homo sapiens
tgcgttttagagt

SEQ ID NO: 5321906 - DNA, 13 bp, Homo sapiens
tgcgtttttacag

SEQ ID NO: 5321907 - DNA, 14 bp, Homo sapiens
tgcgtttttacagt

SEQ ID NO: 5321908 - DNA, 15 bp, Homo sapiens
tgctaaaaaaagtgc

SEQ ID NO: 5321909 - DNA, 20 bp, Homo sapiens
tgctaaaaaaagtgcatgat

SEQ ID NO: 5321910 - DNA, 23 bp, Homo sapiens
tgctaaaaaagcatatataacta

SEQ ID NO: 5321911 - DNA, 15 bp, Homo sapiens
tgctaaaaatgggac

SEQ ID NO: 5321912 - DNA, 13 bp, Homo sapiens
tgctaaaacctga

SEQ ID NO: 5321913 - DNA, 17 bp, Homo sapiens
tgctaaaacctgaaatt

SEQ ID NO: 5321914 - DNA, 11 bp, Homo sapiens
tgctaaaagaa

SEQ ID NO: 5321915 - DNA, 13 bp, Homo sapiens
tgctaaaagaaga

SEQ ID NO: 5321916 - DNA, 14 bp, Homo sapiens
tgctaaaagaagag

SEQ ID NO: 5321917 - DNA, 20 bp, Homo sapiens
tgctaaaatagaatatagca

SEQ ID NO: 5321918 - DNA, 21 bp, Homo sapiens
tgctaaaattctatagagata

SEQ ID NO: 5321919 - DNA, 21 bp, Homo sapiens
tgctaaacaagtaagaaaaat

SEQ ID NO: 5321920 - DNA, 23 bp, Homo sapiens
tgctaaacaagtaagaaaaataa

SEQ ID NO: 5321921 - DNA, 13 bp, Homo sapiens
tgctaaacactgc

SEQ ID NO: 5321922 - DNA, 22 bp, Homo sapiens
tgctaaacatggcttaatctta

SEQ ID NO: 5321923 - DNA, 15 bp, Homo sapiens
tgctaaacctatctg

SEQ ID NO: 5321924 - DNA, 16 bp, Homo sapiens
tgctaaacctatctgt

SEQ ID NO: 5321925 - DNA, 23 bp, Homo sapiens
tgctaaacgtgtatgtttttcag

SEQ ID NO: 5321926 - DNA, 22 bp, Homo sapiens
tgctaaacttggctgtatgtca

SEQ ID NO: 5321927 - DNA, 22 bp, Homo sapiens
tgctaaagaaaaagtcatccaa

SEQ ID NO: 5321928 - DNA, 22 bp, Homo sapiens
tgctaaagcactttgcacttaa

SEQ ID NO: 5321929 - DNA, 16 bp, Homo sapiens
tgctaaagcctgtggg

SEQ ID NO: 5321930 - DNA, 17 bp, Homo sapiens
tgctaaaggagcatcta

SEQ ID NO: 5321931 - DNA, 17 bp, Homo sapiens
tgctaaagttggaaagt

SEQ ID NO: 5321932 - DNA, 17 bp, Homo sapiens
tgctaaagttttcttcc

SEQ ID NO: 5321933 - DNA, 21 bp, Homo sapiens
tgctaaataaaatttgttgca

SEQ ID NO: 5321934 - DNA, 22 bp, Homo sapiens
tgctaaataaaatttgttgcat

SEQ ID NO: 5321935 - DNA, 13 bp, Homo sapiens
tgctaaataaaca

SEQ ID NO: 5321936 - DNA, 14 bp, Homo sapiens
tgctaaatatttct

SEQ ID NO: 5321937 - DNA, 16 bp, Homo sapiens
tgctaaatgacttatt

SEQ ID NO: 5321938 - DNA, 17 bp, Homo sapiens
tgctaaatgcactgacc

SEQ ID NO: 5321939 - DNA, 17 bp, Homo sapiens
tgctaaatgccatgttt

SEQ ID NO: 5321940 - DNA, 21 bp, Homo sapiens
tgctaaatggtcgcccaggag

SEQ ID NO: 5321941 - DNA, 16 bp, Homo sapiens
tgctaaatgtaacagt

SEQ ID NO: 5321942 - DNA, 17 bp, Homo sapiens
tgctaaatgtaacagtc

SEQ ID NO: 5321943 - DNA, 18 bp, Homo sapiens
tgctaaatgtaagaatca

SEQ ID NO: 5321944 - DNA, 19 bp, Homo sapiens
tgctaaatgtgagtatttc

SEQ ID NO: 5321945 - DNA, 14 bp, Homo sapiens
tgctaaatgtgtaa

SEQ ID NO: 5321946 - DNA, 15 bp, Homo sapiens
tgctaaattataaaa

SEQ ID NO: 5321947 - DNA, 18 bp, Homo sapiens
tgctaaattataaaattg

SEQ ID NO: 5321948 - DNA, 18 bp, Homo sapiens
tgctaaattctatgttaa

SEQ ID NO: 5321949 - DNA, 16 bp, Homo sapiens
tgctaaattgatgttg

SEQ ID NO: 5321950 - DNA, 17 bp, Homo sapiens
tgctaaattgatgttga

SEQ ID NO: 5321951 - DNA, 18 bp, Homo sapiens
tgctaacaaactgaaaaa

SEQ ID NO: 5321952 - DNA, 13 bp, Homo sapiens
tgctaacatctaa

SEQ ID NO: 5321953 - DNA, 17 bp, Homo sapiens
tgctaacatgaagacct

SEQ ID NO: 5321954 - DNA, 15 bp, Homo sapiens
tgctaacctggaaag

SEQ ID NO: 5321955 - DNA, 14 bp, Homo sapiens
tgctaaccttttca

SEQ ID NO: 5321956 - DNA, 19 bp, Homo sapiens
tgctaacggtgctcagggg

SEQ ID NO: 5321957 - DNA, 22 bp, Homo sapiens
tgctaacgttttttcttctttt

SEQ ID NO: 5321958 - DNA, 13 bp, Homo sapiens
tgctaactgggtt

SEQ ID NO: 5321959 - DNA, 19 bp, Homo sapiens
tgctaactgggttaaatat

SEQ ID NO: 5321960 - DNA, 16 bp, Homo sapiens
tgctaactttgccctt

SEQ ID NO: 5321961 - DNA, 11 bp, Homo sapiens
tgctaagaaat

SEQ ID NO: 5321962 - DNA, 22 bp, Homo sapiens
tgctaagaagcgagcactgacc

SEQ ID NO: 5321963 - DNA, 19 bp, Homo sapiens
tgctaagaattttttattt

SEQ ID NO: 5321964 - DNA, 16 bp, Homo sapiens
tgctaagatgctctat

SEQ ID NO: 5321965 - DNA, 15 bp, Homo sapiens
tgctaagcattccaa

SEQ ID NO: 5321966 - DNA, 15 bp, Homo sapiens
tgctaagccccagca

SEQ ID NO: 5321967 - DNA, 21 bp, Homo sapiens
tgctaagctaaagaaactgct

SEQ ID NO: 5321968 - DNA, 23 bp, Homo sapiens
tgctaagctaaagaaactgctta

SEQ ID NO: 5321969 - DNA, 22 bp, Homo sapiens
tgctaaggacttgttagatcta

SEQ ID NO: 5321970 - DNA, 14 bp, Homo sapiens
tgctaaggcagctg

SEQ ID NO: 5321971 - DNA, 23 bp, Homo sapiens
tgctaaggcagctgatccaggca

SEQ ID NO: 5321972 - DNA, 16 bp, Homo sapiens
tgctaaggctcctcct

SEQ ID NO: 5321973 - DNA, 19 bp, Homo sapiens
tgctaaggctcctccttgc

SEQ ID NO: 5321974 - DNA, 12 bp, Homo sapiens
tgctaaggctgc

SEQ ID NO: 5321975 - DNA, 15 bp, Homo sapiens
tgctaaggctgctgg

SEQ ID NO: 5321976 - DNA, 17 bp, Homo sapiens
tgctaaggctgctggct

SEQ ID NO: 5321977 - DNA, 18 bp, Homo sapiens
tgctaaggctgctggctt

SEQ ID NO: 5321978 - DNA, 22 bp, Homo sapiens
tgctaaggctgctggcttcagg

SEQ ID NO: 5321979 - DNA, 14 bp, Homo sapiens
tgctaaggttctaa

SEQ ID NO: 5321980 - DNA, 15 bp, Homo sapiens
tgctaaggttctaag

SEQ ID NO: 5321981 - DNA, 21 bp, Homo sapiens
tgctaagtaatttagaagata

SEQ ID NO: 5321982 - DNA, 12 bp, Homo sapiens
tgctaagtattt

SEQ ID NO: 5321983 - DNA, 17 bp, Homo sapiens
tgctaagtatttcccag

SEQ ID NO: 5321984 - DNA, 20 bp, Homo sapiens
tgctaagtcattggcaaagt

SEQ ID NO: 5321985 - DNA, 23 bp, Homo sapiens
tgctaagtgcttattacatttta

SEQ ID NO: 5321986 - DNA, 12 bp, Homo sapiens
tgctaagtggaa

SEQ ID NO: 5321987 - DNA, 14 bp, Homo sapiens
tgctaagtggaaga

SEQ ID NO: 5321988 - DNA, 21 bp, Homo sapiens
tgctaagtggacctggaatct

SEQ ID NO: 5321989 - DNA, 15 bp, Homo sapiens
tgctaagtgtaggat

SEQ ID NO: 5321990 - DNA, 15 bp, Homo sapiens
tgctaagtgtgaact

SEQ ID NO: 5321991 - DNA, 21 bp, Homo sapiens
tgctaagtgtgcttagtttta

SEQ ID NO: 5321992 - DNA, 18 bp, Homo sapiens
tgctaagtgttgactttt

SEQ ID NO: 5321993 - DNA, 18 bp, Homo sapiens
tgctaagttctcccaaca

SEQ ID NO: 5321994 - DNA, 17 bp, Homo sapiens
tgctaataaacactggc

SEQ ID NO: 5321995 - DNA, 21 bp, Homo sapiens
tgctaataaacactggctctg

SEQ ID NO: 5321996 - DNA, 16 bp, Homo sapiens
tgctaataaatgacca

SEQ ID NO: 5321997 - DNA, 18 bp, Homo sapiens
tgctaataaatgaccagt

SEQ ID NO: 5321998 - DNA, 23 bp, Homo sapiens
tgctaataaatgaccagtttacc

SEQ ID NO: 5321999 - DNA, 22 bp, Homo sapiens
tgctaataagtttgaaatatat

SEQ ID NO: 5322000 - DNA, 19 bp, Homo sapiens
tgctaataccaactatttc

SEQ ID NO: 5322001 - DNA, 20 bp, Homo sapiens
tgctaataccaactatttca

SEQ ID NO: 5322002 - DNA, 22 bp, Homo sapiens
tgctaatatactttttttgtta

SEQ ID NO: 5322003 - DNA, 17 bp, Homo sapiens
tgctaatattaaacctt

SEQ ID NO: 5322004 - DNA, 16 bp, Homo sapiens
tgctaatcaaaacttt

SEQ ID NO: 5322005 - DNA, 20 bp, Homo sapiens
tgctaatcaaagccagggtc

SEQ ID NO: 5322006 - DNA, 14 bp, Homo sapiens
tgctaatcagtgtc

SEQ ID NO: 5322007 - DNA, 19 bp, Homo sapiens
tgctaatcagtgtctcaca

SEQ ID NO: 5322008 - DNA, 20 bp, Homo sapiens
tgctaatcgggttgtcactc

SEQ ID NO: 5322009 - DNA, 19 bp, Homo sapiens
tgctaatctctcttttgtt

SEQ ID NO: 5322010 - DNA, 16 bp, Homo sapiens
tgctaatcttgtccct

SEQ ID NO: 5322011 - DNA, 19 bp, Homo sapiens
tgctaatcttgtgaaaata

SEQ ID NO: 5322012 - DNA, 21 bp, Homo sapiens
tgctaatcttgtgaaaataat

SEQ ID NO: 5322013 - DNA, 23 bp, Homo sapiens
tgctaatcttgtgaaaataattg

SEQ ID NO: 5322014 - DNA, 13 bp, Homo sapiens
tgctaatgaattt

SEQ ID NO: 5322015 - DNA, 23 bp, Homo sapiens
tgctaatgcaaattaaaacatat

SEQ ID NO: 5322016 - DNA, 13 bp, Homo sapiens
tgctaatgtaatc

SEQ ID NO: 5322017 - DNA, 14 bp, Homo sapiens
tgctaatgtaatca

SEQ ID NO: 5322018 - DNA, 18 bp, Homo sapiens
tgctaatgtaatcattta

SEQ ID NO: 5322019 - DNA, 18 bp, Homo sapiens
tgctaatgtgtctgtgga

SEQ ID NO: 5322020 - DNA, 17 bp, Homo sapiens
tgctaattaaaaagtta

SEQ ID NO: 5322021 - DNA, 19 bp, Homo sapiens
tgctaattcccaacatttc

SEQ ID NO: 5322022 - DNA, 12 bp, Homo sapiens
tgctaattctga

SEQ ID NO: 5322023 - DNA, 13 bp, Homo sapiens
tgctaattctgag

SEQ ID NO: 5322024 - DNA, 13 bp, Homo sapiens
tgctaattctttg

SEQ ID NO: 5322025 - DNA, 21 bp, Homo sapiens
tgctaattctttgcaaaaatc

SEQ ID NO: 5322026 - DNA, 16 bp, Homo sapiens
tgctaattgctgttga

SEQ ID NO: 5322027 - DNA, 18 bp, Homo sapiens
tgctaattgctgttgaaa

SEQ ID NO: 5322028 - DNA, 15 bp, Homo sapiens
tgctaatttatgaag

SEQ ID NO: 5322029 - DNA, 16 bp, Homo sapiens
tgctaattttattata

SEQ ID NO: 5322030 - DNA, 17 bp, Homo sapiens
tgctaattttctcaaaa

SEQ ID NO: 5322031 - DNA, 22 bp, Homo sapiens
tgctaattttctcaaaagcatt

SEQ ID NO: 5322032 - DNA, 16 bp, Homo sapiens
tgctaattttgaaaaa

SEQ ID NO: 5322033 - DNA, 15 bp, Homo sapiens
tgctacaaaatgtgt

SEQ ID NO: 5322034 - DNA, 20 bp, Homo sapiens
tgctacaaagaagacatgtt

SEQ ID NO: 5322035 - DNA, 23 bp, Homo sapiens
tgctacaaagaagacatgtttta

SEQ ID NO: 5322036 - DNA, 20 bp, Homo sapiens
tgctacaaatagtgctaata

SEQ ID NO: 5322037 - DNA, 21 bp, Homo sapiens
tgctacaaatagtgctaataa

SEQ ID NO: 5322038 - DNA, 15 bp, Homo sapiens
tgctacaaatttatg

SEQ ID NO: 5322039 - DNA, 19 bp, Homo sapiens
tgctacaaatttatgcatt

SEQ ID NO: 5322040 - DNA, 13 bp, Homo sapiens
tgctacaacttca

SEQ ID NO: 5322041 - DNA, 19 bp, Homo sapiens
tgctacaataaatgctgaa

SEQ ID NO: 5322042 - DNA, 11 bp, Homo sapiens
tgctacacact

SEQ ID NO: 5322043 - DNA, 22 bp, Homo sapiens
tgctacacctattatcccagct

SEQ ID NO: 5322044 - DNA, 11 bp, Homo sapiens
tgctacacttc

SEQ ID NO: 5322045 - DNA, 12 bp, Homo sapiens
tgctacacttct

SEQ ID NO: 5322046 - DNA, 15 bp, Homo sapiens
tgctacagagaaaat

SEQ ID NO: 5322047 - DNA, 21 bp, Homo sapiens
tgctacaggggccagaagatg

SEQ ID NO: 5322048 - DNA, 13 bp, Homo sapiens
tgctacagtaata

SEQ ID NO: 5322049 - DNA, 17 bp, Homo sapiens
tgctacagtactatgta

SEQ ID NO: 5322050 - DNA, 18 bp, Homo sapiens
tgctacagtactatgtaa

SEQ ID NO: 5322051 - DNA, 18 bp, Homo sapiens
tgctacagtagctgtggg

SEQ ID NO: 5322052 - DNA, 15 bp, Homo sapiens
tgctacatcagagtg

SEQ ID NO: 5322053 - DNA, 19 bp, Homo sapiens
tgctacatcagagtgtatt

SEQ ID NO: 5322054 - DNA, 21 bp, Homo sapiens
tgctacattataatgtacaga

SEQ ID NO: 5322055 - DNA, 15 bp, Homo sapiens
tgctacattttgtgg

SEQ ID NO: 5322056 - DNA, 14 bp, Homo sapiens
tgctaccaaagaat

SEQ ID NO: 5322057 - DNA, 15 bp, Homo sapiens
tgctaccaaagaatg

SEQ ID NO: 5322058 - DNA, 13 bp, Homo sapiens
tgctaccaaagca

SEQ ID NO: 5322059 - DNA, 16 bp, Homo sapiens
tgctaccaaggcccag

SEQ ID NO: 5322060 - DNA, 18 bp, Homo sapiens
tgctaccaaggcccagct

SEQ ID NO: 5322061 - DNA, 21 bp, Homo sapiens
tgctaccaaggcccagctatg

SEQ ID NO: 5322062 - DNA, 16 bp, Homo sapiens
tgctaccaatctgtga

SEQ ID NO: 5322063 - DNA, 18 bp, Homo sapiens
tgctaccaatctgtgaga

SEQ ID NO: 5322064 - DNA, 13 bp, Homo sapiens
tgctaccagcgcc

SEQ ID NO: 5322065 - DNA, 18 bp, Homo sapiens
tgctaccaggatgctaaa

SEQ ID NO: 5322066 - DNA, 15 bp, Homo sapiens
tgctaccagtattta

SEQ ID NO: 5322067 - DNA, 24 bp, Homo sapiens
tgctacccagcatgctacctgaat

SEQ ID NO: 5322068 - DNA, 13 bp, Homo sapiens
tgctacccagcca

SEQ ID NO: 5322069 - DNA, 23 bp, Homo sapiens
tgctacccatgactttatatgga

SEQ ID NO: 5322070 - DNA, 17 bp, Homo sapiens
tgctaccctccctgctg

SEQ ID NO: 5322071 - DNA, 18 bp, Homo sapiens
tgctaccctccctgctgt

SEQ ID NO: 5322072 - DNA, 19 bp, Homo sapiens
tgctaccctccctgctgtc

SEQ ID NO: 5322073 - DNA, 20 bp, Homo sapiens
tgctatctcccccagcccca

SEQ ID NO: 5322074 - DNA, 23 bp, Homo sapiens
tgctatctggaggccttccagct

SEQ ID NO: 5322075 - DNA, 16 bp, Homo sapiens
tgctatcttaattttg

SEQ ID NO: 5322076 - DNA, 22 bp, Homo sapiens
tgctatcttttttagtgttaaa

SEQ ID NO: 5322077 - DNA, 20 bp, Homo sapiens
tgctatgaagccaactgaca

SEQ ID NO: 5322078 - DNA, 13 bp, Homo sapiens
tgctatgaatgat

SEQ ID NO: 5322079 - DNA, 15 bp, Homo sapiens
tgctatgactacatt

SEQ ID NO: 5322080 - DNA, 16 bp, Homo sapiens
tgctatgagctgggga

SEQ ID NO: 5322081 - DNA, 19 bp, Homo sapiens
tgctatgagctggggatgt

SEQ ID NO: 5322082 - DNA, 20 bp, Homo sapiens
tgctatgagttttctccttg

SEQ ID NO: 5322083 - DNA, 18 bp, Homo sapiens
tgctatgcatgtctgacc

SEQ ID NO: 5322084 - DNA, 16 bp, Homo sapiens
tgctatgctgaagaca

SEQ ID NO: 5322085 - DNA, 17 bp, Homo sapiens
tgctatgctgaagacat

SEQ ID NO: 5322086 - DNA, 17 bp, Homo sapiens
tgctatggaaatacatt

SEQ ID NO: 5322087 - DNA, 20 bp, Homo sapiens
tgctatggcaggataagaaa

SEQ ID NO: 5322088 - DNA, 22 bp, Homo sapiens
tgctatggggagaaaagacatg

SEQ ID NO: 5322089 - DNA, 15 bp, Homo sapiens
tgctatggtgctctg

SEQ ID NO: 5322090 - DNA, 13 bp, Homo sapiens
tgctatgtaaggg

SEQ ID NO: 5322091 - DNA, 17 bp, Homo sapiens
tgctatgtaagggtctt

SEQ ID NO: 5322092 - DNA, 15 bp, Homo sapiens
tgctatgtcatttca

SEQ ID NO: 5322093 - DNA, 16 bp, Homo sapiens
tgctatgtcatttcat

SEQ ID NO: 5322094 - DNA, 17 bp, Homo sapiens
tgctatgtcatttcatg

SEQ ID NO: 5322095 - DNA, 19 bp, Homo sapiens
tgctatgtcatttcatgtc

SEQ ID NO: 5322096 - DNA, 15 bp, Homo sapiens
tgctatgtcccaaga

SEQ ID NO: 5322097 - DNA, 13 bp, Homo sapiens
tgctatgtctgtg

SEQ ID NO: 5322098 - DNA, 15 bp, Homo sapiens
tgctatgtctgtgat

SEQ ID NO: 5322099 - DNA, 15 bp, Homo sapiens
tgctatgtgcacagc

SEQ ID NO: 5322100 - DNA, 16 bp, Homo sapiens
tgctatgtgcacagcc

SEQ ID NO: 5322101 - DNA, 22 bp, Homo sapiens
tgctatgtgtttggtttataat

SEQ ID NO: 5322102 - DNA, 18 bp, Homo sapiens
tgctatgttcttctgtta

SEQ ID NO: 5322103 - DNA, 20 bp, Homo sapiens
tgctatgttttgacattttt

SEQ ID NO: 5322104 - DNA, 18 bp, Homo sapiens
tgctattaaaaaaaaaga

SEQ ID NO: 5322105 - DNA, 13 bp, Homo sapiens
tgctattaagaag

SEQ ID NO: 5322106 - DNA, 16 bp, Homo sapiens
tgctattaatatttgt

SEQ ID NO: 5322107 - DNA, 21 bp, Homo sapiens
tgctattaatatttgtttagt

SEQ ID NO: 5322108 - DNA, 14 bp, Homo sapiens
tgctattacatgtg

SEQ ID NO: 5322109 - DNA, 18 bp, Homo sapiens
tgctattacgaagttcaa

SEQ ID NO: 5322110 - DNA, 19 bp, Homo sapiens
tgctattacgaagttcaag

SEQ ID NO: 5322111 - DNA, 19 bp, Homo sapiens
tgctattatactgttatcc

SEQ ID NO: 5322112 - DNA, 20 bp, Homo sapiens
tgctattatcccttcttata

SEQ ID NO: 5322113 - DNA, 15 bp, Homo sapiens
tgctattatgatgtt

SEQ ID NO: 5322114 - DNA, 16 bp, Homo sapiens
tgctattatgatgttt

SEQ ID NO: 5322115 - DNA, 15 bp, Homo sapiens
tgctattatgtaaca

SEQ ID NO: 5322116 - DNA, 21 bp, Homo sapiens
tgctattatgtaacatccaga

SEQ ID NO: 5322117 - DNA, 18 bp, Homo sapiens
tgctattcgtaagttctg

SEQ ID NO: 5322118 - DNA, 21 bp, Homo sapiens
tgctattcgtaagttctgtgc

SEQ ID NO: 5322119 - DNA, 13 bp, Homo sapiens
tgctattctgtcc

SEQ ID NO: 5322120 - DNA, 16 bp, Homo sapiens
tgctattctgtcccta

SEQ ID NO: 5322121 - DNA, 17 bp, Homo sapiens
tgctattctgtccctag

SEQ ID NO: 5322122 - DNA, 18 bp, Homo sapiens
tgctattctttctgatgt

SEQ ID NO: 5322123 - DNA, 14 bp, Homo sapiens
tgctattgaactga

SEQ ID NO: 5322124 - DNA, 15 bp, Homo sapiens
tgctattgaactgag

SEQ ID NO: 5322125 - DNA, 16 bp, Homo sapiens
tgctattgacaataaa

SEQ ID NO: 5322126 - DNA, 18 bp, Homo sapiens
tgctattgacaataaaat

SEQ ID NO: 5322127 - DNA, 20 bp, Homo sapiens
tgctattgacaataaaatat

SEQ ID NO: 5322128 - DNA, 17 bp, Homo sapiens
tgctattgctgtctggt

SEQ ID NO: 5322129 - DNA, 17 bp, Homo sapiens
tgctattgtaaggtctt

SEQ ID NO: 5322130 - DNA, 22 bp, Homo sapiens
tgctattgtaaggtctttgtaa

SEQ ID NO: 5322131 - DNA, 13 bp, Homo sapiens
tgctattgtctga

SEQ ID NO: 5322132 - DNA, 20 bp, Homo sapiens
tgctattgttactcttacga

SEQ ID NO: 5322133 - DNA, 14 bp, Homo sapiens
tgctattgtttata

SEQ ID NO: 5322134 - DNA, 15 bp, Homo sapiens
tgctatttaacattt

SEQ ID NO: 5322135 - DNA, 13 bp, Homo sapiens
tgctatttatgca

SEQ ID NO: 5322136 - DNA, 14 bp, Homo sapiens
tgctatttcagcaa

SEQ ID NO: 5322137 - DNA, 16 bp, Homo sapiens
tgctatttcaggccct

SEQ ID NO: 5322138 - DNA, 18 bp, Homo sapiens
tgctatttccacccattt

SEQ ID NO: 5322139 - DNA, 18 bp, Homo sapiens
tgctatttctggcctcag

SEQ ID NO: 5322140 - DNA, 11 bp, Homo sapiens
tgctatttgaa

SEQ ID NO: 5322141 - DNA, 20 bp, Homo sapiens
tgctatttgaacaagtgggc

SEQ ID NO: 5322142 - DNA, 21 bp, Homo sapiens
tgctatttgagcatgcacagc

SEQ ID NO: 5322143 - DNA, 13 bp, Homo sapiens
tgctatttgcaat

SEQ ID NO: 5322144 - DNA, 19 bp, Homo sapiens
tgctatttgctttagagac

SEQ ID NO: 5322145 - DNA, 14 bp, Homo sapiens
tgctatttgtacaa

SEQ ID NO: 5322146 - DNA, 15 bp, Homo sapiens
tgctatttgtacaaa

SEQ ID NO: 5322147 - DNA, 18 bp, Homo sapiens
tgctatttgtacaaataa

SEQ ID NO: 5322148 - DNA, 18 bp, Homo sapiens
tgctatttgtcagtagcc

SEQ ID NO: 5322149 - DNA, 15 bp, Homo sapiens
tgctatttgtgtaac

SEQ ID NO: 5322150 - DNA, 19 bp, Homo sapiens
tgctatttgttgtttttaa

SEQ ID NO: 5322151 - DNA, 21 bp, Homo sapiens
tgctattttaaaattcatgga

SEQ ID NO: 5322152 - DNA, 15 bp, Homo sapiens
tgctattttactgtc

SEQ ID NO: 5322153 - DNA, 19 bp, Homo sapiens
tgctattttactgtcttaa

SEQ ID NO: 5322154 - DNA, 19 bp, Homo sapiens
tgctattttatttgtattc

SEQ ID NO: 5322155 - DNA, 17 bp, Homo sapiens
tgctattttcttatcct

SEQ ID NO: 5322156 - DNA, 15 bp, Homo sapiens
tgctatttttgtaaa

SEQ ID NO: 5322157 - DNA, 17 bp, Homo sapiens
tgctatttttgtaaagt

SEQ ID NO: 5322158 - DNA, 19 bp, Homo sapiens
tgctatttttgtttttaga

SEQ ID NO: 5322159 - DNA, 15 bp, Homo sapiens
tgctcaaaaagaaat

SEQ ID NO: 5322160 - DNA, 15 bp, Homo sapiens
tgctcaaaatgcaaa

SEQ ID NO: 5322161 - DNA, 21 bp, Homo sapiens
tgctcaaaatttgaagaatga

SEQ ID NO: 5322162 - DNA, 17 bp, Homo sapiens
tgctcaaagatgtaatg

SEQ ID NO: 5322163 - DNA, 15 bp, Homo sapiens
tgctcaaatcattta

SEQ ID NO: 5322164 - DNA, 18 bp, Homo sapiens
tgctcaaatcatttaaga

SEQ ID NO: 5322165 - DNA, 14 bp, Homo sapiens
tgctcaaccactgt

SEQ ID NO: 5322166 - DNA, 15 bp, Homo sapiens
tgctcaaccactgtg

SEQ ID NO: 5322167 - DNA, 22 bp, Homo sapiens
tgctcaaccagacagatagtga

SEQ ID NO: 5322168 - DNA, 13 bp, Homo sapiens
tgctcaacccccc

SEQ ID NO: 5322169 - DNA, 22 bp, Homo sapiens
tgctcaacccccctcccagaca

SEQ ID NO: 5322170 - DNA, 15 bp, Homo sapiens
tgctcaacctacagt

SEQ ID NO: 5322171 - DNA, 16 bp, Homo sapiens
tgctcaacctctctcc

SEQ ID NO: 5322172 - DNA, 21 bp, Homo sapiens
tgctcaacctctctccttctg

SEQ ID NO: 5322173 - DNA, 20 bp, Homo sapiens
tgctcaactctacccctgct

SEQ ID NO: 5322174 - DNA, 15 bp, Homo sapiens
tgctcaagaagacat

SEQ ID NO: 5322175 - DNA, 17 bp, Homo sapiens
tgctcaagccgcaagct

SEQ ID NO: 5322176 - DNA, 20 bp, Homo sapiens
tgctcaagccgcaagctctc

SEQ ID NO: 5322177 - DNA, 22 bp, Homo sapiens
tgctcaagccgcaagctctcag

SEQ ID NO: 5322178 - DNA, 16 bp, Homo sapiens
tgctcaaggccagctt

SEQ ID NO: 5322179 - DNA, 13 bp, Homo sapiens
tgctcaataaact

SEQ ID NO: 5322180 - DNA, 14 bp, Homo sapiens
tgctcaataaactt

SEQ ID NO: 5322181 - DNA, 16 bp, Homo sapiens
tgctcaataaacttgt

SEQ ID NO: 5322182 - DNA, 18 bp, Homo sapiens
tgctcaataaagaagccc

SEQ ID NO: 5322183 - DNA, 16 bp, Homo sapiens
tgctcaataaaggtca

SEQ ID NO: 5322184 - DNA, 19 bp, Homo sapiens
tgctcaatacctggcctca

SEQ ID NO: 5322185 - DNA, 15 bp, Homo sapiens
tgctcaatagcttga

SEQ ID NO: 5322186 - DNA, 16 bp, Homo sapiens
tgctcaatcatgtgcc

SEQ ID NO: 5322187 - DNA, 18 bp, Homo sapiens
tgctcaatcatgtgccag

SEQ ID NO: 5322188 - DNA, 15 bp, Homo sapiens
tgctcaatgaaacct

SEQ ID NO: 5322189 - DNA, 13 bp, Homo sapiens
tgctcaatttcag

SEQ ID NO: 5322190 - DNA, 17 bp, Homo sapiens
tgctcacaacttagtgt

SEQ ID NO: 5322191 - DNA, 14 bp, Homo sapiens
tgctcacaatgttc

SEQ ID NO: 5322192 - DNA, 16 bp, Homo sapiens
tgctcacaatgttctg

SEQ ID NO: 5322193 - DNA, 16 bp, Homo sapiens
tgctcacacaatcaga

SEQ ID NO: 5322194 - DNA, 21 bp, Homo sapiens
tgctcacacgctgcctcctca

SEQ ID NO: 5322195 - DNA, 13 bp, Homo sapiens
tgctcacagctgt

SEQ ID NO: 5322196 - DNA, 14 bp, Homo sapiens
tgctcacagctgta

SEQ ID NO: 5322197 - DNA, 12 bp, Homo sapiens
tgctcacaggca

SEQ ID NO: 5322198 - DNA, 15 bp, Homo sapiens
tgctcacagggatgc

SEQ ID NO: 5322199 - DNA, 17 bp, Homo sapiens
tgctcacatatctgtca

SEQ ID NO: 5322200 - DNA, 23 bp, Homo sapiens
tgctcacatctgaatctccttgt

SEQ ID NO: 5322201 - DNA, 21 bp, Homo sapiens
tgctcaccaattccacttcct

SEQ ID NO: 5322202 - DNA, 16 bp, Homo sapiens
tgctcacccaggacct

SEQ ID NO: 5322203 - DNA, 14 bp, Homo sapiens
tgctcacccagtgc

SEQ ID NO: 5322204 - DNA, 20 bp, Homo sapiens
tgctcacccattgtctcatt

SEQ ID NO: 5322205 - DNA, 13 bp, Homo sapiens
tgctcaccctctc

SEQ ID NO: 5322206 - DNA, 19 bp, Homo sapiens
tgctcaccgactcacctgc

SEQ ID NO: 5322207 - DNA, 14 bp, Homo sapiens
tgctcacctggggt

SEQ ID NO: 5322208 - DNA, 23 bp, Homo sapiens
tgctcacctggggtgtgggaggc

SEQ ID NO: 5322209 - DNA, 21 bp, Homo sapiens
tgctcacgtctctgccgcctg

SEQ ID NO: 5322210 - DNA, 18 bp, Homo sapiens
tgctcactacctcctcag

SEQ ID NO: 5322211 - DNA, 20 bp, Homo sapiens
tgctcactacctcctcaggg

SEQ ID NO: 5322212 - DNA, 19 bp, Homo sapiens
tgctcactcactcactcca

SEQ ID NO: 5322213 - DNA, 23 bp, Homo sapiens
tgctcactcactcactccaagac

SEQ ID NO: 5322214 - DNA, 20 bp, Homo sapiens
tgctcactccctaaagccct

SEQ ID NO: 5322215 - DNA, 13 bp, Homo sapiens
tgctcactgggcc

SEQ ID NO: 5322216 - DNA, 15 bp, Homo sapiens
tgctcactgggcccg

SEQ ID NO: 5322217 - DNA, 17 bp, Homo sapiens
tgctcacttttgtgaaa

SEQ ID NO: 5322218 - DNA, 20 bp, Homo sapiens
tgctcagaaatgttggttac

SEQ ID NO: 5322219 - DNA, 20 bp, Homo sapiens
tgctcagaacttgctgctgt

SEQ ID NO: 5322220 - DNA, 16 bp, Homo sapiens
tgctcagaagagaatc

SEQ ID NO: 5322221 - DNA, 16 bp, Homo sapiens
tgctcagaagaggaaa

SEQ ID NO: 5322222 - DNA, 15 bp, Homo sapiens
tgctcagaagccagt

SEQ ID NO: 5322223 - DNA, 17 bp, Homo sapiens
tgctcagaagccagtct

SEQ ID NO: 5322224 - DNA, 21 bp, Homo sapiens
tgctcagaagccagtctgcgt

SEQ ID NO: 5322225 - DNA, 13 bp, Homo sapiens
tgctcagaatcca

SEQ ID NO: 5322226 - DNA, 16 bp, Homo sapiens
tgctcagaccagctct

SEQ ID NO: 5322227 - DNA, 17 bp, Homo sapiens
tgctcagaccagctctt

SEQ ID NO: 5322228 - DNA, 17 bp, Homo sapiens
tgctcagacccaacagc

SEQ ID NO: 5322229 - DNA, 14 bp, Homo sapiens
tgctcagagaagga

SEQ ID NO: 5322230 - DNA, 17 bp, Homo sapiens
tgctcagagtctatcaa

SEQ ID NO: 5322231 - DNA, 17 bp, Homo sapiens
tgctcagagtgaagagt

SEQ ID NO: 5322232 - DNA, 19 bp, Homo sapiens
tgctcagagtgaagagtga

SEQ ID NO: 5322233 - DNA, 18 bp, Homo sapiens
tgctcagatgctggtcat

SEQ ID NO: 5322234 - DNA, 15 bp, Homo sapiens
tgctcagcagccagt

SEQ ID NO: 5322235 - DNA, 16 bp, Homo sapiens
tgctcagcagccagtc

SEQ ID NO: 5322236 - DNA, 16 bp, Homo sapiens
tgctcagcagccccac

SEQ ID NO: 5322237 - DNA, 15 bp, Homo sapiens
tgctcagcaggccct

SEQ ID NO: 5322238 - DNA, 20 bp, Homo sapiens
tgctcagcagtgagagcaga

SEQ ID NO: 5322239 - DNA, 17 bp, Homo sapiens
tgctcagccaaatttcc

SEQ ID NO: 5322240 - DNA, 14 bp, Homo sapiens
tgctcagccaagct

SEQ ID NO: 5322241 - DNA, 17 bp, Homo sapiens
tgctcagcccaggcaca

SEQ ID NO: 5322242 - DNA, 15 bp, Homo sapiens
tgctcagcccatccc

SEQ ID NO: 5322243 - DNA, 24 bp, Homo sapiens
tgctcagcccatcccctgcctcta

SEQ ID NO: 5322244 - DNA, 17 bp, Homo sapiens
tgctcagccccagacct

SEQ ID NO: 5322245 - DNA, 20 bp, Homo sapiens
tgctcagccccagacctgcc

SEQ ID NO: 5322246 - DNA, 22 bp, Homo sapiens
tgctcagccccagcttatctcc

SEQ ID NO: 5322247 - DNA, 13 bp, Homo sapiens
tgctcagcccgct

SEQ ID NO: 5322248 - DNA, 17 bp, Homo sapiens
tgctcagcccgcttggc

SEQ ID NO: 5322249 - DNA, 19 bp, Homo sapiens
tgctcagcccgcttggcca

SEQ ID NO: 5322250 - DNA, 12 bp, Homo sapiens
tgctcagccctg

SEQ ID NO: 5322251 - DNA, 19 bp, Homo sapiens
tgctcagccttgctgctct

SEQ ID NO: 5322252 - DNA, 23 bp, Homo sapiens
tgctcgggcccaggccatcttcc

SEQ ID NO: 5322253 - DNA, 20 bp, Homo sapiens
tgctcgggtgctgccagctg

SEQ ID NO: 5322254 - DNA, 19 bp, Homo sapiens
tgctcgtttacactgcaca

SEQ ID NO: 5322255 - DNA, 12 bp, Homo sapiens
tgctctaaaata

SEQ ID NO: 5322256 - DNA, 14 bp, Homo sapiens
tgctctaaaatatt

SEQ ID NO: 5322257 - DNA, 16 bp, Homo sapiens
tgctctaaataaagac

SEQ ID NO: 5322258 - DNA, 12 bp, Homo sapiens
tgctctaaatta

SEQ ID NO: 5322259 - DNA, 11 bp, Homo sapiens
tgctctaacac

SEQ ID NO: 5322260 - DNA, 21 bp, Homo sapiens
tgctctaacacctgcctaggt

SEQ ID NO: 5322261 - DNA, 21 bp, Homo sapiens
tgctctaagaagctcgtttct

SEQ ID NO: 5322262 - DNA, 19 bp, Homo sapiens
tgctctaagaagctgcaat

SEQ ID NO: 5322263 - DNA, 20 bp, Homo sapiens
tgctctaagaggctcctaca

SEQ ID NO: 5322264 - DNA, 18 bp, Homo sapiens
tgctctaagcacacggag

SEQ ID NO: 5322265 - DNA, 14 bp, Homo sapiens
tgctctaagcccag

SEQ ID NO: 5322266 - DNA, 17 bp, Homo sapiens
tgctctaagcccaggat

SEQ ID NO: 5322267 - DNA, 21 bp, Homo sapiens
tgctctaagcccaggatctct

SEQ ID NO: 5322268 - DNA, 18 bp, Homo sapiens
tgctctaattcttttcaa

SEQ ID NO: 5322269 - DNA, 14 bp, Homo sapiens
tgctctacatctcg

SEQ ID NO: 5322270 - DNA, 20 bp, Homo sapiens
tgctctaccaaatagtgatt

SEQ ID NO: 5322271 - DNA, 17 bp, Homo sapiens
tgctctaccatgtttaa

SEQ ID NO: 5322272 - DNA, 23 bp, Homo sapiens
tgctctacccatgagcctgcccg

SEQ ID NO: 5322273 - DNA, 14 bp, Homo sapiens
tgctctacctggcc

SEQ ID NO: 5322274 - DNA, 16 bp, Homo sapiens
tgctctacctggccgg

SEQ ID NO: 5322275 - DNA, 15 bp, Homo sapiens
tgctctactttgaga

SEQ ID NO: 5322276 - DNA, 14 bp, Homo sapiens
tgctctagctggca

SEQ ID NO: 5322277 - DNA, 16 bp, Homo sapiens
tgctctagctggcagg

SEQ ID NO: 5322278 - DNA, 15 bp, Homo sapiens
tgctctaggaagaca

SEQ ID NO: 5322279 - DNA, 21 bp, Homo sapiens
tgctctaggcccacaagtgta

SEQ ID NO: 5322280 - DNA, 22 bp, Homo sapiens
tgctctaggcccacaagtgtaa

SEQ ID NO: 5322281 - DNA, 20 bp, Homo sapiens
tgctctagggaatctggatt

SEQ ID NO: 5322282 - DNA, 21 bp, Homo sapiens
tgctctagtcttgctttgctg

SEQ ID NO: 5322283 - DNA, 22 bp, Homo sapiens
tgctctagtcttgctttgctgt

SEQ ID NO: 5322284 - DNA, 13 bp, Homo sapiens
tgctctagtgcct

SEQ ID NO: 5322285 - DNA, 16 bp, Homo sapiens
tgctctagtgccttct

SEQ ID NO: 5322286 - DNA, 16 bp, Homo sapiens
tgctctataaatagta

SEQ ID NO: 5322287 - DNA, 21 bp, Homo sapiens
tgctctatactgtggcctgca

SEQ ID NO: 5322288 - DNA, 14 bp, Homo sapiens
tgctctatatgtaa

SEQ ID NO: 5322289 - DNA, 20 bp, Homo sapiens
tgctctatcttgctctgtaa

SEQ ID NO: 5322290 - DNA, 14 bp, Homo sapiens
tgctctatgccagg

SEQ ID NO: 5322291 - DNA, 20 bp, Homo sapiens
tgctctatgtgcttgtaaaa

SEQ ID NO: 5322292 - DNA, 20 bp, Homo sapiens
tgctctattaagattggaaa

SEQ ID NO: 5322293 - DNA, 21 bp, Homo sapiens
tgctctattaagattggaaat

SEQ ID NO: 5322294 - DNA, 21 bp, Homo sapiens
tgctctattgtagcatttctt

SEQ ID NO: 5322295 - DNA, 20 bp, Homo sapiens
tgctctcaaacccctgacct

SEQ ID NO: 5322296 - DNA, 20 bp, Homo sapiens
tgctctcaaggcttggagag

SEQ ID NO: 5322297 - DNA, 15 bp, Homo sapiens
tgctctcaattaaag

SEQ ID NO: 5322298 - DNA, 20 bp, Homo sapiens
tgctctcaccttggttcctg

SEQ ID NO: 5322299 - DNA, 14 bp, Homo sapiens
tgctctcactgttt

SEQ ID NO: 5322300 - DNA, 17 bp, Homo sapiens
tgctctcagcctcccac

SEQ ID NO: 5322301 - DNA, 17 bp, Homo sapiens
tgctctcagctggcagt

SEQ ID NO: 5322302 - DNA, 13 bp, Homo sapiens
tgctctcaggctg

SEQ ID NO: 5322303 - DNA, 19 bp, Homo sapiens
tgctctcatgcctgcctga

SEQ ID NO: 5322304 - DNA, 20 bp, Homo sapiens
tgctctccagcctgggaggc

SEQ ID NO: 5322305 - DNA, 15 bp, Homo sapiens
tgctctccatctctt

SEQ ID NO: 5322306 - DNA, 20 bp, Homo sapiens
tgctctccattctgctcctt

SEQ ID NO: 5322307 - DNA, 14 bp, Homo sapiens
tgctctcccaaggg

SEQ ID NO: 5322308 - DNA, 12 bp, Homo sapiens
tgctctcccagg

SEQ ID NO: 5322309 - DNA, 23 bp, Homo sapiens
tgctctcccctccctttttaaac

SEQ ID NO: 5322310 - DNA, 15 bp, Homo sapiens
tgctctcccctgccc

SEQ ID NO: 5322311 - DNA, 19 bp, Homo sapiens
tgctctcctaccccacctc

SEQ ID NO: 5322312 - DNA, 10 bp, Homo sapiens
tgctctcctc

SEQ ID NO: 5322313 - DNA, 17 bp, Homo sapiens
tgctctcctcgggccct

SEQ ID NO: 5322314 - DNA, 18 bp, Homo sapiens
tgctctcctcgggccctg

SEQ ID NO: 5322315 - DNA, 11 bp, Homo sapiens
tgctctcctct

SEQ ID NO: 5322316 - DNA, 12 bp, Homo sapiens
tgctctcctctt

SEQ ID NO: 5322317 - DNA, 14 bp, Homo sapiens
tgctctcctcttct

SEQ ID NO: 5322318 - DNA, 18 bp, Homo sapiens
tgctctcctcttgccact

SEQ ID NO: 5322319 - DNA, 22 bp, Homo sapiens
tgctctcctcttgccactgcct

SEQ ID NO: 5322320 - DNA, 16 bp, Homo sapiens
tgctctccttgccctg

SEQ ID NO: 5322321 - DNA, 20 bp, Homo sapiens
tgctctccttgccctgggcc

SEQ ID NO: 5322322 - DNA, 22 bp, Homo sapiens
tgctctcgcacctttccaaagt

SEQ ID NO: 5322323 - DNA, 16 bp, Homo sapiens
tgctctctacccagcc

SEQ ID NO: 5322324 - DNA, 20 bp, Homo sapiens
tgctctctacccagcccatc

SEQ ID NO: 5322325 - DNA, 17 bp, Homo sapiens
tgctctctcaaattgtc

SEQ ID NO: 5322326 - DNA, 20 bp, Homo sapiens
tgctctctcaaattgtcagc

SEQ ID NO: 5322327 - DNA, 17 bp, Homo sapiens
tgctctctcatcttgtt

SEQ ID NO: 5322328 - DNA, 20 bp, Homo sapiens
tgctctctcatcttgttctt

SEQ ID NO: 5322329 - DNA, 13 bp, Homo sapiens
tgctctctctccc

SEQ ID NO: 5322330 - DNA, 12 bp, Homo sapiens
tgctctctctga

SEQ ID NO: 5322331 - DNA, 14 bp, Homo sapiens
tgctctctctgagg

SEQ ID NO: 5322332 - DNA, 14 bp, Homo sapiens
tgctctctcttctt

SEQ ID NO: 5322333 - DNA, 14 bp, Homo sapiens
tgctctctgaggca

SEQ ID NO: 5322334 - DNA, 14 bp, Homo sapiens
tgctctctgcagcc

SEQ ID NO: 5322335 - DNA, 15 bp, Homo sapiens
tgctctctgcagcca

SEQ ID NO: 5322336 - DNA, 20 bp, Homo sapiens
tgctctctgcagccagccca

SEQ ID NO: 5322337 - DNA, 13 bp, Homo sapiens
tgctctctgggct

SEQ ID NO: 5322338 - DNA, 20 bp, Homo sapiens
tgctctctgtggtgcctctc

SEQ ID NO: 5322339 - DNA, 13 bp, Homo sapiens
tgctctctgtgtc

SEQ ID NO: 5322340 - DNA, 18 bp, Homo sapiens
tgctctctgttctcttgc

SEQ ID NO: 5322341 - DNA, 15 bp, Homo sapiens
tgctctctttctgtc

SEQ ID NO: 5322342 - DNA, 17 bp, Homo sapiens
tgctctgaaatctcctt

SEQ ID NO: 5322343 - DNA, 17 bp, Homo sapiens
tgctctgaagtgtccta

SEQ ID NO: 5322344 - DNA, 22 bp, Homo sapiens
tgctctgaattagtccttgctt

SEQ ID NO: 5322345 - DNA, 21 bp, Homo sapiens
tgctctgaccatgaggtgggg

SEQ ID NO: 5322346 - DNA, 17 bp, Homo sapiens
tgctctgacctcctctg

SEQ ID NO: 5322347 - DNA, 21 bp, Homo sapiens
tgctctgacctcctctgggcc

SEQ ID NO: 5322348 - DNA, 22 bp, Homo sapiens
tgctctgacctcctctgggccc

SEQ ID NO: 5322349 - DNA, 18 bp, Homo sapiens
tgctctgacgtagaaaga

SEQ ID NO: 5322350 - DNA, 19 bp, Homo sapiens
tgctctgacgtagaaagat

SEQ ID NO: 5322351 - DNA, 11 bp, Homo sapiens
tgctctgagaa

SEQ ID NO: 5322352 - DNA, 13 bp, Homo sapiens
tgctctgagaaat

SEQ ID NO: 5322353 - DNA, 14 bp, Homo sapiens
tgctctgagcacag

SEQ ID NO: 5322354 - DNA, 19 bp, Homo sapiens
tgctctgagcacaggtgac

SEQ ID NO: 5322355 - DNA, 16 bp, Homo sapiens
tgctctgagccacaga

SEQ ID NO: 5322356 - DNA, 17 bp, Homo sapiens
tgctctgaggcctcact

SEQ ID NO: 5322357 - DNA, 19 bp, Homo sapiens
tgctctgaggtcaataaag

SEQ ID NO: 5322358 - DNA, 19 bp, Homo sapiens
tgctctgatcatccactgt

SEQ ID NO: 5322359 - DNA, 18 bp, Homo sapiens
tgctctgatgaagaggag

SEQ ID NO: 5322360 - DNA, 17 bp, Homo sapiens
tgctctgatgcagtgcc

SEQ ID NO: 5322361 - DNA, 17 bp, Homo sapiens
tgctctgatgcatcaga

SEQ ID NO: 5322362 - DNA, 16 bp, Homo sapiens
tgctctgatttccttc

SEQ ID NO: 5322363 - DNA, 20 bp, Homo sapiens
tgctctgcagcattgaagta

SEQ ID NO: 5322364 - DNA, 18 bp, Homo sapiens
tgctctgcagcccacaga

SEQ ID NO: 5322365 - DNA, 23 bp, Homo sapiens
tgctctgcagcccacagaggaca

SEQ ID NO: 5322366 - DNA, 16 bp, Homo sapiens
tgctctgcaggcacct

SEQ ID NO: 5322367 - DNA, 19 bp, Homo sapiens
tgctctgcaggcaccttag

SEQ ID NO: 5322368 - DNA, 16 bp, Homo sapiens
tgctctgccatcttca

SEQ ID NO: 5322369 - DNA, 18 bp, Homo sapiens
tgctctgccatcttcagg

SEQ ID NO: 5322370 - DNA, 15 bp, Homo sapiens
tgctctgcccagagc

SEQ ID NO: 5322371 - DNA, 22 bp, Homo sapiens
tgctctgcccagagctgggtga

SEQ ID NO: 5322372 - DNA, 19 bp, Homo sapiens
tgctctgcccaggcaagga

SEQ ID NO: 5322373 - DNA, 16 bp, Homo sapiens
tgctctgccccaagcc

SEQ ID NO: 5322374 - DNA, 12 bp, Homo sapiens
tgctctgcccct

SEQ ID NO: 5322375 - DNA, 11 bp, Homo sapiens
tgctctgccct

SEQ ID NO: 5322376 - DNA, 12 bp, Homo sapiens
tgctctgcctca

SEQ ID NO: 5322377 - DNA, 15 bp, Homo sapiens
tgctctgcctggagt

SEQ ID NO: 5322378 - DNA, 17 bp, Homo sapiens
tgctctgcctggagtgt

SEQ ID NO: 5322379 - DNA, 23 bp, Homo sapiens
tgctctgcgtgtcacctgtgctt

SEQ ID NO: 5322380 - DNA, 14 bp, Homo sapiens
tgctctgctcgcct

SEQ ID NO: 5322381 - DNA, 18 bp, Homo sapiens
tgctctgctctaccatgt

SEQ ID NO: 5322382 - DNA, 15 bp, Homo sapiens
tgctctgctgacaga

SEQ ID NO: 5322383 - DNA, 12 bp, Homo sapiens
tgctctgcttca

SEQ ID NO: 5322384 - DNA, 12 bp, Homo sapiens
tgctctgcttcc

SEQ ID NO: 5322385 - DNA, 13 bp, Homo sapiens
tgctctgcttcct

SEQ ID NO: 5322386 - DNA, 20 bp, Homo sapiens
tgctctgcttcctcagggcc

SEQ ID NO: 5322387 - DNA, 18 bp, Homo sapiens
tgctctggaaaacctgag

SEQ ID NO: 5322388 - DNA, 19 bp, Homo sapiens
tgctctggaaaatgtgacc

SEQ ID NO: 5322389 - DNA, 14 bp, Homo sapiens
tgctctggaagcct

SEQ ID NO: 5322390 - DNA, 18 bp, Homo sapiens
tgctctggaagcctgctg

SEQ ID NO: 5322391 - DNA, 23 bp, Homo sapiens
tgctctggaataaagttgcagat

SEQ ID NO: 5322392 - DNA, 14 bp, Homo sapiens
tgctctggaatttg

SEQ ID NO: 5322393 - DNA, 16 bp, Homo sapiens
tgctctggacctgccc

SEQ ID NO: 5322394 - DNA, 20 bp, Homo sapiens
tgctctggacctgcccccgc

SEQ ID NO: 5322395 - DNA, 14 bp, Homo sapiens
tgctctggagcagc

SEQ ID NO: 5322396 - DNA, 15 bp, Homo sapiens
tgctctggagcagcc

SEQ ID NO: 5322397 - DNA, 21 bp, Homo sapiens
tgctctggagcagccaaggcc

SEQ ID NO: 5322398 - DNA, 15 bp, Homo sapiens
tgctctggaggctgc

SEQ ID NO: 5322399 - DNA, 20 bp, Homo sapiens
tgctctggagtgtgcatttc

SEQ ID NO: 5322400 - DNA, 12 bp, Homo sapiens
tgctctggcacc

SEQ ID NO: 5322401 - DNA, 15 bp, Homo sapiens
tgctctggcaccatc

SEQ ID NO: 5322402 - DNA, 19 bp, Homo sapiens
tgctctggcaccatcagcc

SEQ ID NO: 5322403 - DNA, 13 bp, Homo sapiens
tgctctggcggct

SEQ ID NO: 5322404 - DNA, 14 bp, Homo sapiens
tgctctgggaaggg

SEQ ID NO: 5322405 - DNA, 20 bp, Homo sapiens
tgctctgggacgtggacatg

SEQ ID NO: 5322406 - DNA, 19 bp, Homo sapiens
tgctctgggagacttactg

SEQ ID NO: 5322407 - DNA, 19 bp, Homo sapiens
tgctctggggatttctggg

SEQ ID NO: 5322408 - DNA, 18 bp, Homo sapiens
tgctctggttgtttctgt

SEQ ID NO: 5322409 - DNA, 19 bp, Homo sapiens
tgctctggttgtttctgtt

SEQ ID NO: 5322410 - DNA, 21 bp, Homo sapiens
tgctctggttgtttctgttcc

SEQ ID NO: 5322411 - DNA, 22 bp, Homo sapiens
tgctctgtaatctcgtttcaaa

SEQ ID NO: 5322412 - DNA, 21 bp, Homo sapiens
tgctctgtagccacctccttg

SEQ ID NO: 5322413 - DNA, 23 bp, Homo sapiens
tgctctgtagccacctccttggc

SEQ ID NO: 5322414 - DNA, 14 bp, Homo sapiens
tgctctgtagccta

SEQ ID NO: 5322415 - DNA, 20 bp, Homo sapiens
tgctctgtaggagctaccct

SEQ ID NO: 5322416 - DNA, 16 bp, Homo sapiens
tgctctgtcacccaga

SEQ ID NO: 5322417 - DNA, 19 bp, Homo sapiens
tgctctgtcccccaggctg

SEQ ID NO: 5322418 - DNA, 12 bp, Homo sapiens
tgctctgtctcc

SEQ ID NO: 5322419 - DNA, 19 bp, Homo sapiens
tgctctgtctcccaggctg

SEQ ID NO: 5322420 - DNA, 22 bp, Homo sapiens
tgctctgtcttctttgcccaca

SEQ ID NO: 5322421 - DNA, 15 bp, Homo sapiens
tgctctgtcttggtc

SEQ ID NO: 5322422 - DNA, 20 bp, Homo sapiens
tgctctgtgagccccacagc

SEQ ID NO: 5322423 - DNA, 22 bp, Homo sapiens
tgctctgtggccttggccctga

SEQ ID NO: 5322424 - DNA, 11 bp, Homo sapiens
tgctctgtgtc

SEQ ID NO: 5322425 - DNA, 14 bp, Homo sapiens
tgctctgtgtcaag

SEQ ID NO: 5322426 - DNA, 17 bp, Homo sapiens
tgctctgtgttcccaga

SEQ ID NO: 5322427 - DNA, 21 bp, Homo sapiens
tgctctgttaataatctcaca

SEQ ID NO: 5322428 - DNA, 13 bp, Homo sapiens
tgctctgttccca

SEQ ID NO: 5322429 - DNA, 14 bp, Homo sapiens
tgctctgttcccag

SEQ ID NO: 5322430 - DNA, 17 bp, Homo sapiens
tgctcttaagtaccaga

SEQ ID NO: 5322431 - DNA, 15 bp, Homo sapiens
tgctgagcaccctct

SEQ ID NO: 5322432 - DNA, 19 bp, Homo sapiens
tgctgagcaccctctccgg

SEQ ID NO: 5322433 - DNA, 12 bp, Homo sapiens
tgctgagccact

SEQ ID NO: 5322434 - DNA, 13 bp, Homo sapiens
tgctgagccactc

SEQ ID NO: 5322435 - DNA, 17 bp, Homo sapiens
tgctgagccagccatct

SEQ ID NO: 5322436 - DNA, 14 bp, Homo sapiens
tgctgagccagctg

SEQ ID NO: 5322437 - DNA, 15 bp, Homo sapiens
tgctgagccagctgc

SEQ ID NO: 5322438 - DNA, 17 bp, Homo sapiens
tgctgagccagctgcag

SEQ ID NO: 5322439 - DNA, 19 bp, Homo sapiens
tgctgagcctcacagcagt

SEQ ID NO: 5322440 - DNA, 16 bp, Homo sapiens
tgctgagcctctgctc

SEQ ID NO: 5322441 - DNA, 15 bp, Homo sapiens
tgctgagctctgaga

SEQ ID NO: 5322442 - DNA, 21 bp, Homo sapiens
tgctgagctctgagaggccct

SEQ ID NO: 5322443 - DNA, 22 bp, Homo sapiens
tgctgagctctgagaggccctg

SEQ ID NO: 5322444 - DNA, 10 bp, Homo sapiens
tgctgagctg

SEQ ID NO: 5322445 - DNA, 16 bp, Homo sapiens
tgctgagctgaagaaa

SEQ ID NO: 5322446 - DNA, 16 bp, Homo sapiens
tgctgagctgcccctg

SEQ ID NO: 5322447 - DNA, 19 bp, Homo sapiens
tgctgagctgcccctgctg

SEQ ID NO: 5322448 - DNA, 20 bp, Homo sapiens
tgctgagctgcccctgctgc

SEQ ID NO: 5322449 - DNA, 21 bp, Homo sapiens
tgctgagctgcccctgctgct

SEQ ID NO: 5322450 - DNA, 14 bp, Homo sapiens
tgctgagctggccc

SEQ ID NO: 5322451 - DNA, 16 bp, Homo sapiens
tgctgagctgggccca

SEQ ID NO: 5322452 - DNA, 18 bp, Homo sapiens
tgctgagctgggcccagc

SEQ ID NO: 5322453 - DNA, 13 bp, Homo sapiens
tgctgagctgtga

SEQ ID NO: 5322454 - DNA, 14 bp, Homo sapiens
tgctgagctgtgcc

SEQ ID NO: 5322455 - DNA, 15 bp, Homo sapiens
tgctgagctgtgccc

SEQ ID NO: 5322456 - DNA, 15 bp, Homo sapiens
tgctgagctgtttat

SEQ ID NO: 5322457 - DNA, 10 bp, Homo sapiens
tgctgagctt

SEQ ID NO: 5322458 - DNA, 18 bp, Homo sapiens
tgctgagcttagccttgt

SEQ ID NO: 5322459 - DNA, 22 bp, Homo sapiens
tgctgaggactccctccatgtg

SEQ ID NO: 5322460 - DNA, 14 bp, Homo sapiens
tgctgaggagtctg

SEQ ID NO: 5322461 - DNA, 16 bp, Homo sapiens
tgctgaggagtctgag

SEQ ID NO: 5322462 - DNA, 21 bp, Homo sapiens
tgctgaggatacagctcttct

SEQ ID NO: 5322463 - DNA, 22 bp, Homo sapiens
tgctgaggccacccactgaccc

SEQ ID NO: 5322464 - DNA, 19 bp, Homo sapiens
tgctgaggccagaggaagg

SEQ ID NO: 5322465 - DNA, 21 bp, Homo sapiens
tgctgaggccagaggaaggga

SEQ ID NO: 5322466 - DNA, 16 bp, Homo sapiens
tgctgaggccagggct

SEQ ID NO: 5322467 - DNA, 16 bp, Homo sapiens
tgctgaggcccagtgc

SEQ ID NO: 5322468 - DNA, 17 bp, Homo sapiens
tgctgaggcctccagct

SEQ ID NO: 5322469 - DNA, 13 bp, Homo sapiens
tgctgaggcctgg

SEQ ID NO: 5322470 - DNA, 14 bp, Homo sapiens
tgctgaggccttct

SEQ ID NO: 5322471 - DNA, 15 bp, Homo sapiens
tgctgaggccttctc

SEQ ID NO: 5322472 - DNA, 23 bp, Homo sapiens
tgctgagggaccgagcccagcag

SEQ ID NO: 5322473 - DNA, 22 bp, Homo sapiens
tgctgagggaccttggagagct

SEQ ID NO: 5322474 - DNA, 16 bp, Homo sapiens
tgctgaggggcactct

SEQ ID NO: 5322475 - DNA, 13 bp, Homo sapiens
tgctgagggtcca

SEQ ID NO: 5322476 - DNA, 17 bp, Homo sapiens
tgctgaggtaataatta

SEQ ID NO: 5322477 - DNA, 17 bp, Homo sapiens
tgctgaggttttgaata

SEQ ID NO: 5322478 - DNA, 19 bp, Homo sapiens
tgctgagtaaggaacacga

SEQ ID NO: 5322479 - DNA, 24 bp, Homo sapiens
tgctgagtagatgcgcagccccat

SEQ ID NO: 5322480 - DNA, 21 bp, Homo sapiens
tgctgagtatgttaagctctt

SEQ ID NO: 5322481 - DNA, 17 bp, Homo sapiens
tgctgagtcatctgtta

SEQ ID NO: 5322482 - DNA, 19 bp, Homo sapiens
tgctgagtcatctgttagg

SEQ ID NO: 5322483 - DNA, 15 bp, Homo sapiens
tgctgagtcccaggc

SEQ ID NO: 5322484 - DNA, 15 bp, Homo sapiens
tgctgagtctcccaa

SEQ ID NO: 5322485 - DNA, 16 bp, Homo sapiens
tgctgagtctgaaggc

SEQ ID NO: 5322486 - DNA, 16 bp, Homo sapiens
tgctgagtctgttctg

SEQ ID NO: 5322487 - DNA, 16 bp, Homo sapiens
tgctgagtgacagctt

SEQ ID NO: 5322488 - DNA, 19 bp, Homo sapiens
tgctgagtgctatgtgtgc

SEQ ID NO: 5322489 - DNA, 13 bp, Homo sapiens
tgctgagtgctgg

SEQ ID NO: 5322490 - DNA, 20 bp, Homo sapiens
tgctgagtgctgggcactgc

SEQ ID NO: 5322491 - DNA, 19 bp, Homo sapiens
tgctgagtggcgcaaggcc

SEQ ID NO: 5322492 - DNA, 17 bp, Homo sapiens
tgctgagtggctcgtgt

SEQ ID NO: 5322493 - DNA, 18 bp, Homo sapiens
tgctgagttccggggtgc

SEQ ID NO: 5322494 - DNA, 14 bp, Homo sapiens
tgctgagttggcct

SEQ ID NO: 5322495 - DNA, 15 bp, Homo sapiens
tgctgagttggcctg

SEQ ID NO: 5322496 - DNA, 15 bp, Homo sapiens
tgctgagttggtgtt

SEQ ID NO: 5322497 - DNA, 17 bp, Homo sapiens
tgctgagttgttctaac

SEQ ID NO: 5322498 - DNA, 13 bp, Homo sapiens
tgctgataaaata

SEQ ID NO: 5322499 - DNA, 23 bp, Homo sapiens
tgctgataattgtgtattttctt

SEQ ID NO: 5322500 - DNA, 20 bp, Homo sapiens
tgctgataccatatgaatga

SEQ ID NO: 5322501 - DNA, 21 bp, Homo sapiens
tgctgataccatatgaatgaa

SEQ ID NO: 5322502 - DNA, 21 bp, Homo sapiens
tgctgatattttctctaggaa

SEQ ID NO: 5322503 - DNA, 17 bp, Homo sapiens
tgctgatcaatgaaatg

SEQ ID NO: 5322504 - DNA, 19 bp, Homo sapiens
tgctgatcagagttcctcc

SEQ ID NO: 5322505 - DNA, 14 bp, Homo sapiens
tgctgatccccaac

SEQ ID NO: 5322506 - DNA, 19 bp, Homo sapiens
tgctgatccggctgctcct

SEQ ID NO: 5322507 - DNA, 20 bp, Homo sapiens
tgctgatcctgctgacctca

SEQ ID NO: 5322508 - DNA, 15 bp, Homo sapiens
tgctgatccttccta

SEQ ID NO: 5322509 - DNA, 21 bp, Homo sapiens
tgctgatcgccttatttatat

SEQ ID NO: 5322510 - DNA, 17 bp, Homo sapiens
tgctgatcgccttcccc

SEQ ID NO: 5322511 - DNA, 22 bp, Homo sapiens
tgctgatcgtagaaaatttgct

SEQ ID NO: 5322512 - DNA, 15 bp, Homo sapiens
tgctgatctttgtct

SEQ ID NO: 5322513 - DNA, 20 bp, Homo sapiens
tgctgatcttttaaaatcat

SEQ ID NO: 5322514 - DNA, 16 bp, Homo sapiens
tgctgatgctcatggt

SEQ ID NO: 5322515 - DNA, 15 bp, Homo sapiens
tgctgatgctcctcc

SEQ ID NO: 5322516 - DNA, 19 bp, Homo sapiens
tgctgatgctcctccgggt

SEQ ID NO: 5322517 - DNA, 16 bp, Homo sapiens
tgctgatggagccttc

SEQ ID NO: 5322518 - DNA, 17 bp, Homo sapiens
tgctgatggagccttcc

SEQ ID NO: 5322519 - DNA, 14 bp, Homo sapiens
tgctgatggcccct

SEQ ID NO: 5322520 - DNA, 19 bp, Homo sapiens
tgctgatggcccctccagc

SEQ ID NO: 5322521 - DNA, 22 bp, Homo sapiens
tgctgatggcccctccagcaca

SEQ ID NO: 5322522 - DNA, 15 bp, Homo sapiens
tgctgatggctgctg

SEQ ID NO: 5322523 - DNA, 19 bp, Homo sapiens
tgctgatggcttgacatgt

SEQ ID NO: 5322524 - DNA, 23 bp, Homo sapiens
tgctgatggcttgacatgtgcaa

SEQ ID NO: 5322525 - DNA, 13 bp, Homo sapiens
tgctgatgggaag

SEQ ID NO: 5322526 - DNA, 19 bp, Homo sapiens
tgctgatgggttcttagag

SEQ ID NO: 5322527 - DNA, 16 bp, Homo sapiens
tgctgatgtaggagct

SEQ ID NO: 5322528 - DNA, 19 bp, Homo sapiens
tgctgatgtatcctttcat

SEQ ID NO: 5322529 - DNA, 15 bp, Homo sapiens
tgctgatgtcaaagt

SEQ ID NO: 5322530 - DNA, 20 bp, Homo sapiens
tgctgatgttcagtgtaatt

SEQ ID NO: 5322531 - DNA, 16 bp, Homo sapiens
tgctgatgtttataaa

SEQ ID NO: 5322532 - DNA, 13 bp, Homo sapiens
tgctgattattta

SEQ ID NO: 5322533 - DNA, 14 bp, Homo sapiens
tgctgattcaaacc

SEQ ID NO: 5322534 - DNA, 15 bp, Homo sapiens
tgctgattcaaacca

SEQ ID NO: 5322535 - DNA, 14 bp, Homo sapiens
tgctgattcttgta

SEQ ID NO: 5322536 - DNA, 17 bp, Homo sapiens
tgctgattcttgtaaat

SEQ ID NO: 5322537 - DNA, 20 bp, Homo sapiens
tgctgattcttgtaaatctt

SEQ ID NO: 5322538 - DNA, 15 bp, Homo sapiens
tgctgattgctaagg

SEQ ID NO: 5322539 - DNA, 23 bp, Homo sapiens
tgctgattgtctgaaattttcta

SEQ ID NO: 5322540 - DNA, 15 bp, Homo sapiens
tgctgatttaaacac

SEQ ID NO: 5322541 - DNA, 16 bp, Homo sapiens
tgctgatttcccctct

SEQ ID NO: 5322542 - DNA, 14 bp, Homo sapiens
tgctgattttcttc

SEQ ID NO: 5322543 - DNA, 16 bp, Homo sapiens
tgctgattttgacctt

SEQ ID NO: 5322544 - DNA, 19 bp, Homo sapiens
tgctgattttgaccttgta

SEQ ID NO: 5322545 - DNA, 20 bp, Homo sapiens
tgctgattttgaccttgtat

SEQ ID NO: 5322546 - DNA, 17 bp, Homo sapiens
tgctgcaaacccatgaa

SEQ ID NO: 5322547 - DNA, 14 bp, Homo sapiens
tgctgcaaacctga

SEQ ID NO: 5322548 - DNA, 17 bp, Homo sapiens
tgctgcaaagtgcaaat

SEQ ID NO: 5322549 - DNA, 18 bp, Homo sapiens
tgctgcaaagtgcaaata

SEQ ID NO: 5322550 - DNA, 13 bp, Homo sapiens
tgctgcaaatgca

SEQ ID NO: 5322551 - DNA, 19 bp, Homo sapiens
tgctgcaacaagctcatcc

SEQ ID NO: 5322552 - DNA, 22 bp, Homo sapiens
tgctgcaacaagctcatccctg

SEQ ID NO: 5322553 - DNA, 14 bp, Homo sapiens
tgctgcaacccaag

SEQ ID NO: 5322554 - DNA, 15 bp, Homo sapiens
tgctgcaaggccttt

SEQ ID NO: 5322555 - DNA, 20 bp, Homo sapiens
tgctgcacaccaaggccctg

SEQ ID NO: 5322556 - DNA, 14 bp, Homo sapiens
tgctgcacatagca

SEQ ID NO: 5322557 - DNA, 14 bp, Homo sapiens
tgctgcaccaaccc

SEQ ID NO: 5322558 - DNA, 22 bp, Homo sapiens
tgctgcaccaacccagccgctg

SEQ ID NO: 5322559 - DNA, 17 bp, Homo sapiens
tgctgcaccccatgtgg

SEQ ID NO: 5322560 - DNA, 22 bp, Homo sapiens
tgctgcaccctgcgcctccaga

SEQ ID NO: 5322561 - DNA, 22 bp, Homo sapiens
tgctgcacctgaggcccagcag

SEQ ID NO: 5322562 - DNA, 13 bp, Homo sapiens
tgctgcaccttgt

SEQ ID NO: 5322563 - DNA, 18 bp, Homo sapiens
tgctgcaccttgtaaatg

SEQ ID NO: 5322564 - DNA, 12 bp, Homo sapiens
tgctgcactagg

SEQ ID NO: 5322565 - DNA, 16 bp, Homo sapiens
tgctgcactaggactt

SEQ ID NO: 5322566 - DNA, 14 bp, Homo sapiens
tgctgcactgccct

SEQ ID NO: 5322567 - DNA, 13 bp, Homo sapiens
tgctgcagagatc

SEQ ID NO: 5322568 - DNA, 23 bp, Homo sapiens
tgctgcagaggggcaggccctgc

SEQ ID NO: 5322569 - DNA, 23 bp, Homo sapiens
tgctgcagcaccgaggggccttt

SEQ ID NO: 5322570 - DNA, 20 bp, Homo sapiens
tgctgcagccaaagacagag

SEQ ID NO: 5322571 - DNA, 23 bp, Homo sapiens
tgctgcagccaggaggagaggaa

SEQ ID NO: 5322572 - DNA, 17 bp, Homo sapiens
tgctgcagccctgccag

SEQ ID NO: 5322573 - DNA, 12 bp, Homo sapiens
tgctgcagcctg

SEQ ID NO: 5322574 - DNA, 16 bp, Homo sapiens
tgctgcagctccctgg

SEQ ID NO: 5322575 - DNA, 20 bp, Homo sapiens
tgctgcagcttctaactggt

SEQ ID NO: 5322576 - DNA, 14 bp, Homo sapiens
tgctgcaggaaaag

SEQ ID NO: 5322577 - DNA, 19 bp, Homo sapiens
tgctgcaggccctccctct

SEQ ID NO: 5322578 - DNA, 16 bp, Homo sapiens
tgctgcagggctttaa

SEQ ID NO: 5322579 - DNA, 13 bp, Homo sapiens
tgctgcaggggct

SEQ ID NO: 5322580 - DNA, 15 bp, Homo sapiens
tgctgcaggtggcag

SEQ ID NO: 5322581 - DNA, 16 bp, Homo sapiens
tgctgcaggtggcaga

SEQ ID NO: 5322582 - DNA, 16 bp, Homo sapiens
tgctgcagttgccagt

SEQ ID NO: 5322583 - DNA, 14 bp, Homo sapiens
tgctgcataaaatt

SEQ ID NO: 5322584 - DNA, 19 bp, Homo sapiens
tgctgcataaaattctaga

SEQ ID NO: 5322585 - DNA, 13 bp, Homo sapiens
tgctgcataaatt

SEQ ID NO: 5322586 - DNA, 17 bp, Homo sapiens
tgctgcataaatttgta

SEQ ID NO: 5322587 - DNA, 14 bp, Homo sapiens
tgctgcatactttg

SEQ ID NO: 5322588 - DNA, 22 bp, Homo sapiens
tgctgcatactttgacaaggaa

SEQ ID NO: 5322589 - DNA, 23 bp, Homo sapiens
tgctgcatatttgtgccgtaatt

SEQ ID NO: 5322590 - DNA, 15 bp, Homo sapiens
tgctgcatcccacca

SEQ ID NO: 5322591 - DNA, 17 bp, Homo sapiens
tgctgcatccccttcca

SEQ ID NO: 5322592 - DNA, 15 bp, Homo sapiens
tgctgcatccctgtg

SEQ ID NO: 5322593 - DNA, 19 bp, Homo sapiens
tgctgcatccctgtgtcca

SEQ ID NO: 5322594 - DNA, 21 bp, Homo sapiens
tgctgcatgggttaattgaga

SEQ ID NO: 5322595 - DNA, 12 bp, Homo sapiens
tgctgcattcca

SEQ ID NO: 5322596 - DNA, 17 bp, Homo sapiens
tgctgcattgagtccag

SEQ ID NO: 5322597 - DNA, 20 bp, Homo sapiens
tgctgcatttggctggagcc

SEQ ID NO: 5322598 - DNA, 23 bp, Homo sapiens
tgctgcattttaattttaaccaa

SEQ ID NO: 5322599 - DNA, 14 bp, Homo sapiens
tgctgcattttata

SEQ ID NO: 5322600 - DNA, 12 bp, Homo sapiens
tgctgccaaaac

SEQ ID NO: 5322601 - DNA, 17 bp, Homo sapiens
tgctgccaaaaccacat

SEQ ID NO: 5322602 - DNA, 21 bp, Homo sapiens
tgctgccaaccataccttcct

SEQ ID NO: 5322603 - DNA, 19 bp, Homo sapiens
tgctgccaaggtggaggga

SEQ ID NO: 5322604 - DNA, 23 bp, Homo sapiens
tgctgccaaggtggagggaagga

SEQ ID NO: 5322605 - DNA, 22 bp, Homo sapiens
tgctgccaccacttttggattt

SEQ ID NO: 5322606 - DNA, 20 bp, Homo sapiens
tgctgccaccccttggcact

SEQ ID NO: 5322607 - DNA, 17 bp, Homo sapiens
tgctgccactctgctgc

SEQ ID NO: 5322608 - DNA, 19 bp, Homo sapiens
tgctgccactctgctgcct

SEQ ID NO: 5322609 - DNA, 19 bp, Homo sapiens
tgctgccacttaaaaagac

SEQ ID NO: 5322610 - DNA, 19 bp, Homo sapiens
tgctggctgttggctgggg

SEQ ID NO: 5322611 - DNA, 13 bp, Homo sapiens
tgctggcttcagg

SEQ ID NO: 5322612 - DNA, 16 bp, Homo sapiens
tgctggcttcagggag

SEQ ID NO: 5322613 - DNA, 16 bp, Homo sapiens
tgctggcttccagctt

SEQ ID NO: 5322614 - DNA, 17 bp, Homo sapiens
tgctggcttccagcttc

SEQ ID NO: 5322615 - DNA, 13 bp, Homo sapiens
tgctggcttgcac

SEQ ID NO: 5322616 - DNA, 23 bp, Homo sapiens
tgctggcttttcaccccagagga

SEQ ID NO: 5322617 - DNA, 19 bp, Homo sapiens
tgctgggaacctagcacac

SEQ ID NO: 5322618 - DNA, 15 bp, Homo sapiens
tgctgggaagagctc

SEQ ID NO: 5322619 - DNA, 22 bp, Homo sapiens
tgctgggacagctaggctgaga

SEQ ID NO: 5322620 - DNA, 22 bp, Homo sapiens
tgctgggactcagccttcagac

SEQ ID NO: 5322621 - DNA, 17 bp, Homo sapiens
tgctgggactgagccag

SEQ ID NO: 5322622 - DNA, 23 bp, Homo sapiens
tgctgggacttgaacaaagacat

SEQ ID NO: 5322623 - DNA, 16 bp, Homo sapiens
tgctgggagaggcagc

SEQ ID NO: 5322624 - DNA, 20 bp, Homo sapiens
tgctgggagatgctctctga

SEQ ID NO: 5322625 - DNA, 18 bp, Homo sapiens
tgctgggagctccactct

SEQ ID NO: 5322626 - DNA, 20 bp, Homo sapiens
tgctgggagctccactctgc

SEQ ID NO: 5322627 - DNA, 18 bp, Homo sapiens
tgctgggagctgaaaaat

SEQ ID NO: 5322628 - DNA, 18 bp, Homo sapiens
tgctgggaggactggacc

SEQ ID NO: 5322629 - DNA, 20 bp, Homo sapiens
tgctgggaggagggagaggg

SEQ ID NO: 5322630 - DNA, 15 bp, Homo sapiens
tgctgggagggctga

SEQ ID NO: 5322631 - DNA, 16 bp, Homo sapiens
tgctgggagggctgaa

SEQ ID NO: 5322632 - DNA, 14 bp, Homo sapiens
tgctgggaggtccc

SEQ ID NO: 5322633 - DNA, 22 bp, Homo sapiens
tgctgggaggtcccagggccct

SEQ ID NO: 5322634 - DNA, 16 bp, Homo sapiens
tgctgggatggtgggc

SEQ ID NO: 5322635 - DNA, 15 bp, Homo sapiens
tgctgggattacagg

SEQ ID NO: 5322636 - DNA, 19 bp, Homo sapiens
tgctgggattacaggtgtg

SEQ ID NO: 5322637 - DNA, 20 bp, Homo sapiens
tgctgggattacaggtgtga

SEQ ID NO: 5322638 - DNA, 23 bp, Homo sapiens
tgctgggattacaggtgtgagcc

SEQ ID NO: 5322639 - DNA, 13 bp, Homo sapiens
tgctgggcaatga

SEQ ID NO: 5322640 - DNA, 18 bp, Homo sapiens
tgctgggcactgggcact

SEQ ID NO: 5322641 - DNA, 15 bp, Homo sapiens
tgctgggcagcccgc

SEQ ID NO: 5322642 - DNA, 14 bp, Homo sapiens
tgctgggccaggga

SEQ ID NO: 5322643 - DNA, 19 bp, Homo sapiens
tgctgggccagtggctggg

SEQ ID NO: 5322644 - DNA, 15 bp, Homo sapiens
tgctgggcccagccg

SEQ ID NO: 5322645 - DNA, 18 bp, Homo sapiens
tgctgggccccatctcca

SEQ ID NO: 5322646 - DNA, 15 bp, Homo sapiens
tgctgggcccccagc

SEQ ID NO: 5322647 - DNA, 21 bp, Homo sapiens
tgctgggcccccagcctggcc

SEQ ID NO: 5322648 - DNA, 17 bp, Homo sapiens
tgctgggcccctgcctc

SEQ ID NO: 5322649 - DNA, 18 bp, Homo sapiens
tgctgggcccctgcctct

SEQ ID NO: 5322650 - DNA, 23 bp, Homo sapiens
tgctgggcccctgcctctctgca

SEQ ID NO: 5322651 - DNA, 23 bp, Homo sapiens
tgctgggccggggtgtggaatca

SEQ ID NO: 5322652 - DNA, 22 bp, Homo sapiens
tgctgggcctcattctagcacc

SEQ ID NO: 5322653 - DNA, 12 bp, Homo sapiens
tgctgggcctgg

SEQ ID NO: 5322654 - DNA, 13 bp, Homo sapiens
tgctgggcctggg

SEQ ID NO: 5322655 - DNA, 15 bp, Homo sapiens
tgctgggcctggggg

SEQ ID NO: 5322656 - DNA, 24 bp, Homo sapiens
tgctgggcgaaaacccttatgact

SEQ ID NO: 5322657 - DNA, 13 bp, Homo sapiens
tgctgggctcagt

SEQ ID NO: 5322658 - DNA, 22 bp, Homo sapiens
tgctgggctctccacctcagcc

SEQ ID NO: 5322659 - DNA, 23 bp, Homo sapiens
tgctgggctggcggccatccccg

SEQ ID NO: 5322660 - DNA, 16 bp, Homo sapiens
tgctgggctgggccct

SEQ ID NO: 5322661 - DNA, 14 bp, Homo sapiens
tgctgggctggggc

SEQ ID NO: 5322662 - DNA, 17 bp, Homo sapiens
tgctgggctggggcctg

SEQ ID NO: 5322663 - DNA, 19 bp, Homo sapiens
tgctgggctgtctctccct

SEQ ID NO: 5322664 - DNA, 23 bp, Homo sapiens
tgctgggctgtctctcccttcca

SEQ ID NO: 5322665 - DNA, 23 bp, Homo sapiens
tgctggggaagaacagccccggg

SEQ ID NO: 5322666 - DNA, 23 bp, Homo sapiens
tgctggggaagggttttcttttc

SEQ ID NO: 5322667 - DNA, 11 bp, Homo sapiens
tgctggggaca

SEQ ID NO: 5322668 - DNA, 23 bp, Homo sapiens
tgctggggacacacattctgcct

SEQ ID NO: 5322669 - DNA, 14 bp, Homo sapiens
tgctggggacacag

SEQ ID NO: 5322670 - DNA, 22 bp, Homo sapiens
tgctggggacggggggccccag

SEQ ID NO: 5322671 - DNA, 15 bp, Homo sapiens
tgctggggagtccct

SEQ ID NO: 5322672 - DNA, 17 bp, Homo sapiens
tgctggggagtccctgc

SEQ ID NO: 5322673 - DNA, 18 bp, Homo sapiens
tgctggggcaagtccctg

SEQ ID NO: 5322674 - DNA, 23 bp, Homo sapiens
tgctggggcaagtccctgactct

SEQ ID NO: 5322675 - DNA, 12 bp, Homo sapiens
tgctggggcagg

SEQ ID NO: 5322676 - DNA, 16 bp, Homo sapiens
tgctggggcagggccc

SEQ ID NO: 5322677 - DNA, 18 bp, Homo sapiens
tgctggggcagggcccag

SEQ ID NO: 5322678 - DNA, 19 bp, Homo sapiens
tgctggggcagggcccagg

SEQ ID NO: 5322679 - DNA, 21 bp, Homo sapiens
tgctggggcagggcccaggga

SEQ ID NO: 5322680 - DNA, 12 bp, Homo sapiens
tgctggggcatg

SEQ ID NO: 5322681 - DNA, 19 bp, Homo sapiens
tgctggggcatgtgtgcct

SEQ ID NO: 5322682 - DNA, 16 bp, Homo sapiens
tgctggggccagggca

SEQ ID NO: 5322683 - DNA, 17 bp, Homo sapiens
tgctggggccagggcag

SEQ ID NO: 5322684 - DNA, 18 bp, Homo sapiens
tgctggggccagggcaga

SEQ ID NO: 5322685 - DNA, 22 bp, Homo sapiens
tgctggggccgccacggcctgg

SEQ ID NO: 5322686 - DNA, 17 bp, Homo sapiens
tgctggggcctgggaca

SEQ ID NO: 5322687 - DNA, 21 bp, Homo sapiens
tgctgggggaatgagcccaga

SEQ ID NO: 5322688 - DNA, 22 bp, Homo sapiens
tgctgggggaatgagcccagag

SEQ ID NO: 5322689 - DNA, 23 bp, Homo sapiens
tgctgggggaatgagcccagaga

SEQ ID NO: 5322690 - DNA, 13 bp, Homo sapiens
tgctgggggaggc

SEQ ID NO: 5322691 - DNA, 22 bp, Homo sapiens
tgctgggggaggccatccaaga

SEQ ID NO: 5322692 - DNA, 15 bp, Homo sapiens
tgctgggggcaactg

SEQ ID NO: 5322693 - DNA, 14 bp, Homo sapiens
tgctgggggcacag

SEQ ID NO: 5322694 - DNA, 16 bp, Homo sapiens
tgctgggggcacagct

SEQ ID NO: 5322695 - DNA, 17 bp, Homo sapiens
tgctgggggcacagctg

SEQ ID NO: 5322696 - DNA, 21 bp, Homo sapiens
tgctgggggcacagctgtctg

SEQ ID NO: 5322697 - DNA, 22 bp, Homo sapiens
tgctgggggcacagctgtctgc

SEQ ID NO: 5322698 - DNA, 20 bp, Homo sapiens
tgctgggggggattgtaaaa

SEQ ID NO: 5322699 - DNA, 18 bp, Homo sapiens
tgctgggggtgagctgta

SEQ ID NO: 5322700 - DNA, 18 bp, Homo sapiens
tgctggggtacacagtga

SEQ ID NO: 5322701 - DNA, 15 bp, Homo sapiens
tgctggggtccaggg

SEQ ID NO: 5322702 - DNA, 16 bp, Homo sapiens
tgctggggtccagggc

SEQ ID NO: 5322703 - DNA, 17 bp, Homo sapiens
tgctggggtccagggct

SEQ ID NO: 5322704 - DNA, 20 bp, Homo sapiens
tgctggggttatctgaagtc

SEQ ID NO: 5322705 - DNA, 21 bp, Homo sapiens
tgctgggtataagcagagagg

SEQ ID NO: 5322706 - DNA, 20 bp, Homo sapiens
tgctgggtatgctctgtgac

SEQ ID NO: 5322707 - DNA, 22 bp, Homo sapiens
tgctgggtccatatcacacaca

SEQ ID NO: 5322708 - DNA, 16 bp, Homo sapiens
tgctgggtcccagcct

SEQ ID NO: 5322709 - DNA, 17 bp, Homo sapiens
tgctgggtcccagcctg

SEQ ID NO: 5322710 - DNA, 14 bp, Homo sapiens
tgctgggtgccagg

SEQ ID NO: 5322711 - DNA, 16 bp, Homo sapiens
tgctgggtgccaggtg

SEQ ID NO: 5322712 - DNA, 16 bp, Homo sapiens
tgctgggtgcctccca

SEQ ID NO: 5322713 - DNA, 18 bp, Homo sapiens
tgctgggtgcctcccaca

SEQ ID NO: 5322714 - DNA, 16 bp, Homo sapiens
tgctgggtggcagggg

SEQ ID NO: 5322715 - DNA, 13 bp, Homo sapiens
tgctgggtggccc

SEQ ID NO: 5322716 - DNA, 15 bp, Homo sapiens
tgctgggtggcccat

SEQ ID NO: 5322717 - DNA, 20 bp, Homo sapiens
tgctgggtggcccatccccc

SEQ ID NO: 5322718 - DNA, 19 bp, Homo sapiens
tgctgggtggttctctggg

SEQ ID NO: 5322719 - DNA, 13 bp, Homo sapiens
tgctgggtgtggc

SEQ ID NO: 5322720 - DNA, 13 bp, Homo sapiens
tgctgggttctgg

SEQ ID NO: 5322721 - DNA, 17 bp, Homo sapiens
tgctgggttctggggct

SEQ ID NO: 5322722 - DNA, 22 bp, Homo sapiens
tgctgggttctggggctgagag

SEQ ID NO: 5322723 - DNA, 13 bp, Homo sapiens
tgctgggtttcca

SEQ ID NO: 5322724 - DNA, 16 bp, Homo sapiens
tgctggtaaaataatg

SEQ ID NO: 5322725 - DNA, 17 bp, Homo sapiens
tgctggtaaaatgaaga

SEQ ID NO: 5322726 - DNA, 19 bp, Homo sapiens
tgctggtaacagtggctgc

SEQ ID NO: 5322727 - DNA, 14 bp, Homo sapiens
tgctggtagagacc

SEQ ID NO: 5322728 - DNA, 18 bp, Homo sapiens
tgctggtagatgctgagg

SEQ ID NO: 5322729 - DNA, 16 bp, Homo sapiens
tgctggtatttctaat

SEQ ID NO: 5322730 - DNA, 18 bp, Homo sapiens
tgctggtcacccccaccc

SEQ ID NO: 5322731 - DNA, 17 bp, Homo sapiens
tgctggtcccctcctca

SEQ ID NO: 5322732 - DNA, 18 bp, Homo sapiens
tgctggtcccctcctcag

SEQ ID NO: 5322733 - DNA, 14 bp, Homo sapiens
tgctggtcctgcac

SEQ ID NO: 5322734 - DNA, 16 bp, Homo sapiens
tgctggtcctgcacat

SEQ ID NO: 5322735 - DNA, 23 bp, Homo sapiens
tgctggtcctgcacatgagtgga

SEQ ID NO: 5322736 - DNA, 19 bp, Homo sapiens
tgctggtctctaggcctga

SEQ ID NO: 5322737 - DNA, 19 bp, Homo sapiens
tgctggtctctggctctac

SEQ ID NO: 5322738 - DNA, 13 bp, Homo sapiens
tgctggtgaacac

SEQ ID NO: 5322739 - DNA, 20 bp, Homo sapiens
tgctggtgaacactgtgacc

SEQ ID NO: 5322740 - DNA, 14 bp, Homo sapiens
tgctggtgcaaaga

SEQ ID NO: 5322741 - DNA, 16 bp, Homo sapiens
tgctggtgccagggtg

SEQ ID NO: 5322742 - DNA, 17 bp, Homo sapiens
tgctggtgccagggtgg

SEQ ID NO: 5322743 - DNA, 14 bp, Homo sapiens
tgctggtggaggaa

SEQ ID NO: 5322744 - DNA, 23 bp, Homo sapiens
tgctggtggctggtgagaccccg

SEQ ID NO: 5322745 - DNA, 13 bp, Homo sapiens
tgctggtggtttt

SEQ ID NO: 5322746 - DNA, 18 bp, Homo sapiens
tgctggtgtagtcttttt

SEQ ID NO: 5322747 - DNA, 13 bp, Homo sapiens
tgctggtgtatgt

SEQ ID NO: 5322748 - DNA, 16 bp, Homo sapiens
tgctggtgtcctgacc

SEQ ID NO: 5322749 - DNA, 15 bp, Homo sapiens
tgctggtgtttatgt

SEQ ID NO: 5322750 - DNA, 22 bp, Homo sapiens
tgctggtgtttatgtgaacatt

SEQ ID NO: 5322751 - DNA, 18 bp, Homo sapiens
tgctggttctccaacaga

SEQ ID NO: 5322752 - DNA, 16 bp, Homo sapiens
tgctggttgctgggcc

SEQ ID NO: 5322753 - DNA, 13 bp, Homo sapiens
tgctggttgctgt

SEQ ID NO: 5322754 - DNA, 16 bp, Homo sapiens
tgctggttgctgtgtg

SEQ ID NO: 5322755 - DNA, 17 bp, Homo sapiens
tgctggttgctgtgtgg

SEQ ID NO: 5322756 - DNA, 17 bp, Homo sapiens
tgctggttgttgccagg

SEQ ID NO: 5322757 - DNA, 22 bp, Homo sapiens
tgctggtttatttgttgttttc

SEQ ID NO: 5322758 - DNA, 20 bp, Homo sapiens
tgctggttttatctgagtga

SEQ ID NO: 5322759 - DNA, 13 bp, Homo sapiens
tgctggttttcta

SEQ ID NO: 5322760 - DNA, 16 bp, Homo sapiens
tgctggtttttcagtt

SEQ ID NO: 5322761 - DNA, 18 bp, Homo sapiens
tgctggtttttcagtttt

SEQ ID NO: 5322762 - DNA, 16 bp, Homo sapiens
tgctgtaaaattataa

SEQ ID NO: 5322763 - DNA, 19 bp, Homo sapiens
tgctgtaaaattataaact

SEQ ID NO: 5322764 - DNA, 14 bp, Homo sapiens
tgctgtaaaatttg

SEQ ID NO: 5322765 - DNA, 21 bp, Homo sapiens
tgctgtaaaatttgtgtaaat

SEQ ID NO: 5322766 - DNA, 20 bp, Homo sapiens
tgctgtaaataaatgcttta

SEQ ID NO: 5322767 - DNA, 22 bp, Homo sapiens
tgctgtaaatatttcataaatt

SEQ ID NO: 5322768 - DNA, 19 bp, Homo sapiens
tgctgtaaatttggcttct

SEQ ID NO: 5322769 - DNA, 17 bp, Homo sapiens
tgctgtaacctgaagtc

SEQ ID NO: 5322770 - DNA, 16 bp, Homo sapiens
tgctgtaactgctgag

SEQ ID NO: 5322771 - DNA, 18 bp, Homo sapiens
tgctgtaactttctgaaa

SEQ ID NO: 5322772 - DNA, 15 bp, Homo sapiens
tgctgtaagatgtct

SEQ ID NO: 5322773 - DNA, 16 bp, Homo sapiens
tgctgtaagcacctgg

SEQ ID NO: 5322774 - DNA, 17 bp, Homo sapiens
tgctgtaataaatgtat

SEQ ID NO: 5322775 - DNA, 18 bp, Homo sapiens
tgctgtaataaatgtatt

SEQ ID NO: 5322776 - DNA, 16 bp, Homo sapiens
tgctgtaataatattt

SEQ ID NO: 5322777 - DNA, 20 bp, Homo sapiens
tgctgtacacatatttgaag

SEQ ID NO: 5322778 - DNA, 23 bp, Homo sapiens
tgctgtacacatatttgaagggt

SEQ ID NO: 5322779 - DNA, 15 bp, Homo sapiens
tgctgtacatctatt

SEQ ID NO: 5322780 - DNA, 17 bp, Homo sapiens
tgctgtacatctatttt

SEQ ID NO: 5322781 - DNA, 13 bp, Homo sapiens
tgctgtacccaga

SEQ ID NO: 5322782 - DNA, 21 bp, Homo sapiens
tgctgtacccagatgcctaca

SEQ ID NO: 5322783 - DNA, 19 bp, Homo sapiens
tgctgtactctttgctagt

SEQ ID NO: 5322784 - DNA, 15 bp, Homo sapiens
tgctgtagacatttg

SEQ ID NO: 5322785 - DNA, 16 bp, Homo sapiens
tgctgtagagacttcc

SEQ ID NO: 5322786 - DNA, 16 bp, Homo sapiens
tgctgtagatgacaac

SEQ ID NO: 5322787 - DNA, 19 bp, Homo sapiens
tgctgttatgttttttcat

SEQ ID NO: 5322788 - DNA, 21 bp, Homo sapiens
tgctgttatgttttttcatgg

SEQ ID NO: 5322789 - DNA, 19 bp, Homo sapiens
tgctgttcacagcttttct

SEQ ID NO: 5322790 - DNA, 16 bp, Homo sapiens
tgctgttcatgaaaga

SEQ ID NO: 5322791 - DNA, 23 bp, Homo sapiens
tgctgttcccccaggtgttgtaa

SEQ ID NO: 5322792 - DNA, 19 bp, Homo sapiens
tgctgttctctttgctgac

SEQ ID NO: 5322793 - DNA, 16 bp, Homo sapiens
tgctgttctggagctg

SEQ ID NO: 5322794 - DNA, 16 bp, Homo sapiens
tgctgttcttcacttc

SEQ ID NO: 5322795 - DNA, 13 bp, Homo sapiens
tgctgttcttcag

SEQ ID NO: 5322796 - DNA, 14 bp, Homo sapiens
tgctgttcttcagt

SEQ ID NO: 5322797 - DNA, 22 bp, Homo sapiens
tgctgttcttcagtcctttgtc

SEQ ID NO: 5322798 - DNA, 23 bp, Homo sapiens
tgctgttcttcagtcctttgtct

SEQ ID NO: 5322799 - DNA, 22 bp, Homo sapiens
tgctgttcttgaagctgggctg

SEQ ID NO: 5322800 - DNA, 17 bp, Homo sapiens
tgctgttgaaagcaaaa

SEQ ID NO: 5322801 - DNA, 20 bp, Homo sapiens
tgctgttgagatggtaacag

SEQ ID NO: 5322802 - DNA, 18 bp, Homo sapiens
tgctgttgattctttcaa

SEQ ID NO: 5322803 - DNA, 12 bp, Homo sapiens
tgctgttgattg

SEQ ID NO: 5322804 - DNA, 16 bp, Homo sapiens
tgctgttgattgctaa

SEQ ID NO: 5322805 - DNA, 17 bp, Homo sapiens
tgctgttgattgctaaa

SEQ ID NO: 5322806 - DNA, 19 bp, Homo sapiens
tgctgttgatttctttcca

SEQ ID NO: 5322807 - DNA, 22 bp, Homo sapiens
tgctgttgctgctactgtctta

SEQ ID NO: 5322808 - DNA, 15 bp, Homo sapiens
tgctgttgctggact

SEQ ID NO: 5322809 - DNA, 13 bp, Homo sapiens
tgctgttgctgtt

SEQ ID NO: 5322810 - DNA, 14 bp, Homo sapiens
tgctgttgcttgaa

SEQ ID NO: 5322811 - DNA, 13 bp, Homo sapiens
tgctgttggcctc

SEQ ID NO: 5322812 - DNA, 15 bp, Homo sapiens
tgctgttggcctcaa

SEQ ID NO: 5322813 - DNA, 19 bp, Homo sapiens
tgctgttgggtttttgctg

SEQ ID NO: 5322814 - DNA, 16 bp, Homo sapiens
tgctgttggtcatgtg

SEQ ID NO: 5322815 - DNA, 17 bp, Homo sapiens
tgctgttggtcctctct

SEQ ID NO: 5322816 - DNA, 22 bp, Homo sapiens
tgctgttgtcattgctttactg

SEQ ID NO: 5322817 - DNA, 18 bp, Homo sapiens
tgctgttgtccaactatt

SEQ ID NO: 5322818 - DNA, 14 bp, Homo sapiens
tgctgttgtctgcc

SEQ ID NO: 5322819 - DNA, 17 bp, Homo sapiens
tgctgttgtctgccgtg

SEQ ID NO: 5322820 - DNA, 18 bp, Homo sapiens
tgctgttgtgaagctaat

SEQ ID NO: 5322821 - DNA, 22 bp, Homo sapiens
tgctgttgtgaagctaatgtca

SEQ ID NO: 5322822 - DNA, 22 bp, Homo sapiens
tgctgttgttatgatgtgctta

SEQ ID NO: 5322823 - DNA, 23 bp, Homo sapiens
tgctgttgttgttacttccctcc

SEQ ID NO: 5322824 - DNA, 23 bp, Homo sapiens
tgctgttgtttaaaataaaagta

SEQ ID NO: 5322825 - DNA, 24 bp, Homo sapiens
tgctgtttaaagtcacatccctgt

SEQ ID NO: 5322826 - DNA, 21 bp, Homo sapiens
tgctgtttaattcctggaaaa

SEQ ID NO: 5322827 - DNA, 16 bp, Homo sapiens
tgctgtttaccgccca

SEQ ID NO: 5322828 - DNA, 22 bp, Homo sapiens
tgctgtttagagtaaataaact

SEQ ID NO: 5322829 - DNA, 16 bp, Homo sapiens
tgctgtttatacttga

SEQ ID NO: 5322830 - DNA, 15 bp, Homo sapiens
tgctgtttatatata

SEQ ID NO: 5322831 - DNA, 23 bp, Homo sapiens
tgctgtttattaatcttagtgta

SEQ ID NO: 5322832 - DNA, 13 bp, Homo sapiens
tgctgtttcacaa

SEQ ID NO: 5322833 - DNA, 12 bp, Homo sapiens
tgctgtttccta

SEQ ID NO: 5322834 - DNA, 13 bp, Homo sapiens
tgctgtttcctag

SEQ ID NO: 5322835 - DNA, 17 bp, Homo sapiens
tgctgtttgacacctct

SEQ ID NO: 5322836 - DNA, 14 bp, Homo sapiens
tgctgtttgcttgt

SEQ ID NO: 5322837 - DNA, 23 bp, Homo sapiens
tgctgttttaaacattaatagca

SEQ ID NO: 5322838 - DNA, 16 bp, Homo sapiens
tgctgttttcctccct

SEQ ID NO: 5322839 - DNA, 16 bp, Homo sapiens
tgctgttttgttatat

SEQ ID NO: 5322840 - DNA, 14 bp, Homo sapiens
tgcttaaaaaagag

SEQ ID NO: 5322841 - DNA, 15 bp, Homo sapiens
tgcttaaaaaagagt

SEQ ID NO: 5322842 - DNA, 20 bp, Homo sapiens
tgcttaaaaaataatacaac

SEQ ID NO: 5322843 - DNA, 16 bp, Homo sapiens
tgcttaaaaatacttc

SEQ ID NO: 5322844 - DNA, 13 bp, Homo sapiens
tgcttaaaaatgc

SEQ ID NO: 5322845 - DNA, 15 bp, Homo sapiens
tgcttaaaaatgtag

SEQ ID NO: 5322846 - DNA, 21 bp, Homo sapiens
tgcttaaaagaaagttaactg

SEQ ID NO: 5322847 - DNA, 22 bp, Homo sapiens
tgcttaaaaggtataattaaac

SEQ ID NO: 5322848 - DNA, 15 bp, Homo sapiens
tgcttaaaatatata

SEQ ID NO: 5322849 - DNA, 13 bp, Homo sapiens
tgcttaaaatatg

SEQ ID NO: 5322850 - DNA, 15 bp, Homo sapiens
tgcttaaaatatgta

SEQ ID NO: 5322851 - DNA, 23 bp, Homo sapiens
tgcttaaaatatgtgaagttttc

SEQ ID NO: 5322852 - DNA, 17 bp, Homo sapiens
tgcttaaacaaaactgg

SEQ ID NO: 5322853 - DNA, 13 bp, Homo sapiens
tgcttaaacaaag

SEQ ID NO: 5322854 - DNA, 16 bp, Homo sapiens
tgcttaaacaaagtga

SEQ ID NO: 5322855 - DNA, 19 bp, Homo sapiens
tgcttaaacacaagaagga

SEQ ID NO: 5322856 - DNA, 20 bp, Homo sapiens
tgcttaaactaaataatgaa

SEQ ID NO: 5322857 - DNA, 15 bp, Homo sapiens
tgcttaaagcaaggc

SEQ ID NO: 5322858 - DNA, 14 bp, Homo sapiens
tgcttaaataaaaa

SEQ ID NO: 5322859 - DNA, 13 bp, Homo sapiens
tgcttaaatcagt

SEQ ID NO: 5322860 - DNA, 14 bp, Homo sapiens
tgcttaaatgtgaa

SEQ ID NO: 5322861 - DNA, 21 bp, Homo sapiens
tgcttaaattatttttataca

SEQ ID NO: 5322862 - DNA, 15 bp, Homo sapiens
tgcttaaatttcaga

SEQ ID NO: 5322863 - DNA, 13 bp, Homo sapiens
tgcttaaatttct

SEQ ID NO: 5322864 - DNA, 22 bp, Homo sapiens
tgcttaaatttcttatgtgaca

SEQ ID NO: 5322865 - DNA, 21 bp, Homo sapiens
tgcttaacagttgctttggat

SEQ ID NO: 5322866 - DNA, 18 bp, Homo sapiens
tgcttaacatttgttgaa

SEQ ID NO: 5322867 - DNA, 19 bp, Homo sapiens
tgcttaacatttgttgaat

SEQ ID NO: 5322868 - DNA, 20 bp, Homo sapiens
tgcttaacctttttatttca

SEQ ID NO: 5322869 - DNA, 17 bp, Homo sapiens
tgcttaacgttttctta

SEQ ID NO: 5322870 - DNA, 19 bp, Homo sapiens
tgcttaacgttttcttaaa

SEQ ID NO: 5322871 - DNA, 14 bp, Homo sapiens
tgcttaacttcaca

SEQ ID NO: 5322872 - DNA, 17 bp, Homo sapiens
tgcttaacttcacatat

SEQ ID NO: 5322873 - DNA, 18 bp, Homo sapiens
tgcttaacttcacatatt

SEQ ID NO: 5322874 - DNA, 14 bp, Homo sapiens
tgcttaagatgcta

SEQ ID NO: 5322875 - DNA, 16 bp, Homo sapiens
tgcttaagcagaagca

SEQ ID NO: 5322876 - DNA, 21 bp, Homo sapiens
tgcttaaggcatacttttaat

SEQ ID NO: 5322877 - DNA, 20 bp, Homo sapiens
tgcttaaggtttgttttcat

SEQ ID NO: 5322878 - DNA, 13 bp, Homo sapiens
tgcttaagttcca

SEQ ID NO: 5322879 - DNA, 11 bp, Homo sapiens
tgcttaataaa

SEQ ID NO: 5322880 - DNA, 17 bp, Homo sapiens
tgcttaataaaagaaca

SEQ ID NO: 5322881 - DNA, 14 bp, Homo sapiens
tgcttaataaacat

SEQ ID NO: 5322882 - DNA, 20 bp, Homo sapiens
tgcttaataataattgaaga

SEQ ID NO: 5322883 - DNA, 23 bp, Homo sapiens
tgcttaatctagagctatgcaca

SEQ ID NO: 5322884 - DNA, 14 bp, Homo sapiens
tgcttaatcttcaa

SEQ ID NO: 5322885 - DNA, 15 bp, Homo sapiens
tgcttaatcttcaaa

SEQ ID NO: 5322886 - DNA, 16 bp, Homo sapiens
tgcttaatcttcaaag

SEQ ID NO: 5322887 - DNA, 14 bp, Homo sapiens
tgcttaatgaaaag

SEQ ID NO: 5322888 - DNA, 18 bp, Homo sapiens
tgcttaatttaaatagca

SEQ ID NO: 5322889 - DNA, 20 bp, Homo sapiens
tgcttaatttccttctgtta

SEQ ID NO: 5322890 - DNA, 14 bp, Homo sapiens
tgcttaatttctaa

SEQ ID NO: 5322891 - DNA, 20 bp, Homo sapiens
tgcttaatttctaaagataa

SEQ ID NO: 5322892 - DNA, 15 bp, Homo sapiens
tgcttacaatcttta

SEQ ID NO: 5322893 - DNA, 21 bp, Homo sapiens
tgcttacaattccctgctgtc

SEQ ID NO: 5322894 - DNA, 14 bp, Homo sapiens
tgcttacaattttt

SEQ ID NO: 5322895 - DNA, 21 bp, Homo sapiens
tgcttacagtaactaattttg

SEQ ID NO: 5322896 - DNA, 15 bp, Homo sapiens
tgcttacagtgactg

SEQ ID NO: 5322897 - DNA, 16 bp, Homo sapiens
tgcttacattttaata

SEQ ID NO: 5322898 - DNA, 18 bp, Homo sapiens
tgcttacatttttacaat

SEQ ID NO: 5322899 - DNA, 14 bp, Homo sapiens
tgcttaccaaaaca

SEQ ID NO: 5322900 - DNA, 15 bp, Homo sapiens
tgcttacccttcacc

SEQ ID NO: 5322901 - DNA, 19 bp, Homo sapiens
tgcttacctactttcttca

SEQ ID NO: 5322902 - DNA, 22 bp, Homo sapiens
tgcttacctctcagccttagct

SEQ ID NO: 5322903 - DNA, 14 bp, Homo sapiens
tgcttaccttttcc

SEQ ID NO: 5322904 - DNA, 15 bp, Homo sapiens
tgcttaccttttcct

SEQ ID NO: 5322905 - DNA, 22 bp, Homo sapiens
tgcttaccttttcctattctgt

SEQ ID NO: 5322906 - DNA, 23 bp, Homo sapiens
tgcttactaagctttgccagctg

SEQ ID NO: 5322907 - DNA, 16 bp, Homo sapiens
tgcttactcattaaaa

SEQ ID NO: 5322908 - DNA, 15 bp, Homo sapiens
tgcttactcttgctt

SEQ ID NO: 5322909 - DNA, 21 bp, Homo sapiens
tgcttactgtcggtgtcccct

SEQ ID NO: 5322910 - DNA, 16 bp, Homo sapiens
tgcttactgtgttaaa

SEQ ID NO: 5322911 - DNA, 14 bp, Homo sapiens
tgcttacttatgcc

SEQ ID NO: 5322912 - DNA, 14 bp, Homo sapiens
tgcttactttggaa

SEQ ID NO: 5322913 - DNA, 18 bp, Homo sapiens
tgcttactttggaataca

SEQ ID NO: 5322914 - DNA, 15 bp, Homo sapiens
tgcttactttttaat

SEQ ID NO: 5322915 - DNA, 12 bp, Homo sapiens
tgcttagaaagt

SEQ ID NO: 5322916 - DNA, 15 bp, Homo sapiens
tgcttagaaagttat

SEQ ID NO: 5322917 - DNA, 13 bp, Homo sapiens
tgcttagaaccct

SEQ ID NO: 5322918 - DNA, 19 bp, Homo sapiens
tgcttagaacccttctgct

SEQ ID NO: 5322919 - DNA, 17 bp, Homo sapiens
tgcttagaattctgaga

SEQ ID NO: 5322920 - DNA, 23 bp, Homo sapiens
tgcttagagggatttctttgctg

SEQ ID NO: 5322921 - DNA, 22 bp, Homo sapiens
tgcttagaggggtgaaaattat

SEQ ID NO: 5322922 - DNA, 21 bp, Homo sapiens
tgcttagaggttctgcctcta

SEQ ID NO: 5322923 - DNA, 21 bp, Homo sapiens
tgcttagagtgcccagcagag

SEQ ID NO: 5322924 - DNA, 19 bp, Homo sapiens
tgcttagctgccttgagct

SEQ ID NO: 5322925 - DNA, 23 bp, Homo sapiens
tgcttaggagacagatcactcct

SEQ ID NO: 5322926 - DNA, 14 bp, Homo sapiens
tgcttaggatgttt

SEQ ID NO: 5322927 - DNA, 23 bp, Homo sapiens
tgcttaggatgtttttcatgaaa

SEQ ID NO: 5322928 - DNA, 17 bp, Homo sapiens
tgcttaggggaatgttt

SEQ ID NO: 5322929 - DNA, 17 bp, Homo sapiens
tgcttaggtctcatgga

SEQ ID NO: 5322930 - DNA, 14 bp, Homo sapiens
tgcttagtaaaatt

SEQ ID NO: 5322931 - DNA, 16 bp, Homo sapiens
tgcttagtaaaattta

SEQ ID NO: 5322932 - DNA, 12 bp, Homo sapiens
tgcttagtaagt

SEQ ID NO: 5322933 - DNA, 13 bp, Homo sapiens
tgcttagtaatgc

SEQ ID NO: 5322934 - DNA, 18 bp, Homo sapiens
tgcttagtcactgcctgc

SEQ ID NO: 5322935 - DNA, 16 bp, Homo sapiens
tgcttagttggctttg

SEQ ID NO: 5322936 - DNA, 23 bp, Homo sapiens
tgcttagttggctttgcccaccc

SEQ ID NO: 5322937 - DNA, 14 bp, Homo sapiens
tgcttataaactgg

SEQ ID NO: 5322938 - DNA, 16 bp, Homo sapiens
tgcttataagagagag

SEQ ID NO: 5322939 - DNA, 13 bp, Homo sapiens
tgcttataggctg

SEQ ID NO: 5322940 - DNA, 18 bp, Homo sapiens
tgcttataggtggcctct

SEQ ID NO: 5322941 - DNA, 15 bp, Homo sapiens
tgcttatctgaaact

SEQ ID NO: 5322942 - DNA, 22 bp, Homo sapiens
tgcttatgcagtttttcagagt

SEQ ID NO: 5322943 - DNA, 18 bp, Homo sapiens
tgcttatgctcttaattg

SEQ ID NO: 5322944 - DNA, 22 bp, Homo sapiens
tgcttatgtgttgcataaacaa

SEQ ID NO: 5322945 - DNA, 12 bp, Homo sapiens
tgcttatgttgt

SEQ ID NO: 5322946 - DNA, 17 bp, Homo sapiens
tgcttattaagaccaaa

SEQ ID NO: 5322947 - DNA, 16 bp, Homo sapiens
tgcttattctatccac

SEQ ID NO: 5322948 - DNA, 21 bp, Homo sapiens
tgcttattgcttagtaaaatt

SEQ ID NO: 5322949 - DNA, 21 bp, Homo sapiens
tgcttattgttccaagacatt

SEQ ID NO: 5322950 - DNA, 18 bp, Homo sapiens
tgcttatttattgtattc

SEQ ID NO: 5322951 - DNA, 21 bp, Homo sapiens
tgcttatttattgtattctgg

SEQ ID NO: 5322952 - DNA, 18 bp, Homo sapiens
tgcttatttccctcatct

SEQ ID NO: 5322953 - DNA, 15 bp, Homo sapiens
tgcttattttaaaat

SEQ ID NO: 5322954 - DNA, 20 bp, Homo sapiens
tgcttattttatgatagttt

SEQ ID NO: 5322955 - DNA, 17 bp, Homo sapiens
tgcttattttgtttcaa

SEQ ID NO: 5322956 - DNA, 16 bp, Homo sapiens
tgcttatttttataat

SEQ ID NO: 5322957 - DNA, 17 bp, Homo sapiens
tgcttatttttataatt

SEQ ID NO: 5322958 - DNA, 20 bp, Homo sapiens
tgcttatttttataattaaa

SEQ ID NO: 5322959 - DNA, 21 bp, Homo sapiens
tgcttcaaaaacattcttaca

SEQ ID NO: 5322960 - DNA, 21 bp, Homo sapiens
tgcttcaaactcaaacacaga

SEQ ID NO: 5322961 - DNA, 17 bp, Homo sapiens
tgcttcaaactgagaca

SEQ ID NO: 5322962 - DNA, 19 bp, Homo sapiens
tgcttcaaatgatccttcc

SEQ ID NO: 5322963 - DNA, 21 bp, Homo sapiens
tgcttcaaatgatccttccta

SEQ ID NO: 5322964 - DNA, 16 bp, Homo sapiens
tgcttcaagagaaaat

SEQ ID NO: 5322965 - DNA, 16 bp, Homo sapiens
tgcttctgcccacccc

SEQ ID NO: 5322966 - DNA, 19 bp, Homo sapiens
tgcttctgcccaccccgcc

SEQ ID NO: 5322967 - DNA, 23 bp, Homo sapiens
tgcttctgcccaccccgcctctg

SEQ ID NO: 5322968 - DNA, 23 bp, Homo sapiens
tgcttctgctcacattccctctc

SEQ ID NO: 5322969 - DNA, 15 bp, Homo sapiens
tgcttctgctccagc

SEQ ID NO: 5322970 - DNA, 19 bp, Homo sapiens
tgcttctgctccagcccct

SEQ ID NO: 5322971 - DNA, 12 bp, Homo sapiens
tgcttctgctgc

SEQ ID NO: 5322972 - DNA, 14 bp, Homo sapiens
tgcttctgctgccc

SEQ ID NO: 5322973 - DNA, 21 bp, Homo sapiens
tgcttctgctgtacaagatgt

SEQ ID NO: 5322974 - DNA, 20 bp, Homo sapiens
tgcttctggctacctgtttg

SEQ ID NO: 5322975 - DNA, 14 bp, Homo sapiens
tgcttctggctcct

SEQ ID NO: 5322976 - DNA, 15 bp, Homo sapiens
tgcttctgggcctga

SEQ ID NO: 5322977 - DNA, 19 bp, Homo sapiens
tgcttctgggcctgatgga

SEQ ID NO: 5322978 - DNA, 24 bp, Homo sapiens
tgcttctggggctccctgcctgga

SEQ ID NO: 5322979 - DNA, 20 bp, Homo sapiens
tgcttctgtagtactcctta

SEQ ID NO: 5322980 - DNA, 20 bp, Homo sapiens
tgcttctgtatttccttgga

SEQ ID NO: 5322981 - DNA, 15 bp, Homo sapiens
tgcttctgtccagga

SEQ ID NO: 5322982 - DNA, 18 bp, Homo sapiens
tgcttctgtccaggacat

SEQ ID NO: 5322983 - DNA, 12 bp, Homo sapiens
tgcttctgtgca

SEQ ID NO: 5322984 - DNA, 22 bp, Homo sapiens
tgcttctgttttataattttgt

SEQ ID NO: 5322985 - DNA, 19 bp, Homo sapiens
tgcttcttaaccccagtaa

SEQ ID NO: 5322986 - DNA, 15 bp, Homo sapiens
tgcttcttactgata

SEQ ID NO: 5322987 - DNA, 16 bp, Homo sapiens
tgcttcttagagaggc

SEQ ID NO: 5322988 - DNA, 20 bp, Homo sapiens
tgcttcttatggtataataa

SEQ ID NO: 5322989 - DNA, 21 bp, Homo sapiens
tgcttcttcaagcacctgcag

SEQ ID NO: 5322990 - DNA, 24 bp, Homo sapiens
tgcttcttcaatggcaccttcatt

SEQ ID NO: 5322991 - DNA, 18 bp, Homo sapiens
tgcttcttcatcttgaca

SEQ ID NO: 5322992 - DNA, 21 bp, Homo sapiens
tgcttcttcccttaaaattta

SEQ ID NO: 5322993 - DNA, 22 bp, Homo sapiens
tgcttcttcccttaaaatttat

SEQ ID NO: 5322994 - DNA, 21 bp, Homo sapiens
tgcttcttctcctatgtgtaa

SEQ ID NO: 5322995 - DNA, 18 bp, Homo sapiens
tgcttcttgctggtgaaa

SEQ ID NO: 5322996 - DNA, 12 bp, Homo sapiens
tgcttcttgtaa

SEQ ID NO: 5322997 - DNA, 15 bp, Homo sapiens
tgcttctttcatttt

SEQ ID NO: 5322998 - DNA, 22 bp, Homo sapiens
tgcttctttctactttgtttat

SEQ ID NO: 5322999 - DNA, 12 bp, Homo sapiens
tgcttctttgta

SEQ ID NO: 5323000 - DNA, 13 bp, Homo sapiens
tgcttctttgtaa

SEQ ID NO: 5323001 - DNA, 17 bp, Homo sapiens
tgcttgaaaaatgtgca

SEQ ID NO: 5323002 - DNA, 16 bp, Homo sapiens
tgcttgaaattactgt

SEQ ID NO: 5323003 - DNA, 20 bp, Homo sapiens
tgcttgaaattactgtgtaa

SEQ ID NO: 5323004 - DNA, 23 bp, Homo sapiens
tgcttgaaattactgtgtaaata

SEQ ID NO: 5323005 - DNA, 17 bp, Homo sapiens
tgcttgaacacagtatt

SEQ ID NO: 5323006 - DNA, 20 bp, Homo sapiens
tgcttgaacacagtattttc

SEQ ID NO: 5323007 - DNA, 20 bp, Homo sapiens
tgcttgaacctgtgaggaag

SEQ ID NO: 5323008 - DNA, 22 bp, Homo sapiens
tgcttgaacctgtgaggaagag

SEQ ID NO: 5323009 - DNA, 22 bp, Homo sapiens
tgcttgaactgctgccaactcc

SEQ ID NO: 5323010 - DNA, 14 bp, Homo sapiens
tgcttgaacttaca

SEQ ID NO: 5323011 - DNA, 19 bp, Homo sapiens
tgcttgaagcaaacagttg

SEQ ID NO: 5323012 - DNA, 16 bp, Homo sapiens
tgcttgaaggaacagt

SEQ ID NO: 5323013 - DNA, 22 bp, Homo sapiens
tgcttgaaggaacagtgctgtt

SEQ ID NO: 5323014 - DNA, 15 bp, Homo sapiens
tgcttgaatcaggag

SEQ ID NO: 5323015 - DNA, 21 bp, Homo sapiens
tgcttgacaaatattttcatg

SEQ ID NO: 5323016 - DNA, 15 bp, Homo sapiens
tgcttgacaacatct

SEQ ID NO: 5323017 - DNA, 20 bp, Homo sapiens
tgcttgacataatttcactg

SEQ ID NO: 5323018 - DNA, 16 bp, Homo sapiens
tgcttgactatcacat

SEQ ID NO: 5323019 - DNA, 20 bp, Homo sapiens
tgcttgactatcacatacaa

SEQ ID NO: 5323020 - DNA, 14 bp, Homo sapiens
tgcttgactctcac

SEQ ID NO: 5323021 - DNA, 15 bp, Homo sapiens
tgcttgactttccag

SEQ ID NO: 5323022 - DNA, 18 bp, Homo sapiens
tgcttgactttccagaat

SEQ ID NO: 5323023 - DNA, 19 bp, Homo sapiens
tgcttgagaatattgaagt

SEQ ID NO: 5323024 - DNA, 14 bp, Homo sapiens
tgcttgagaatcct

SEQ ID NO: 5323025 - DNA, 21 bp, Homo sapiens
tgcttgagcaataaagtggaa

SEQ ID NO: 5323026 - DNA, 17 bp, Homo sapiens
tgcttgagcatcaggat

SEQ ID NO: 5323027 - DNA, 19 bp, Homo sapiens
tgcttgagctttctgtgca

SEQ ID NO: 5323028 - DNA, 21 bp, Homo sapiens
tgcttgagctttctgtgcatg

SEQ ID NO: 5323029 - DNA, 23 bp, Homo sapiens
tgcttgagctttctgtgcatgtg

SEQ ID NO: 5323030 - DNA, 12 bp, Homo sapiens
tgcttgaggaaa

SEQ ID NO: 5323031 - DNA, 16 bp, Homo sapiens
tgcttgaggaaaacaa

SEQ ID NO: 5323032 - DNA, 18 bp, Homo sapiens
tgcttgaggccaaatgag

SEQ ID NO: 5323033 - DNA, 14 bp, Homo sapiens
tgcttgagtcaggt

SEQ ID NO: 5323034 - DNA, 20 bp, Homo sapiens
tgcttgagtggacagcagct

SEQ ID NO: 5323035 - DNA, 18 bp, Homo sapiens
tgcttgatagaaatgcca

SEQ ID NO: 5323036 - DNA, 22 bp, Homo sapiens
tgcttgatccagaagagcccat

SEQ ID NO: 5323037 - DNA, 14 bp, Homo sapiens
tgcttgatctatct

SEQ ID NO: 5323038 - DNA, 15 bp, Homo sapiens
tgcttgatctatcta

SEQ ID NO: 5323039 - DNA, 18 bp, Homo sapiens
tgcttgatggtttatgtt

SEQ ID NO: 5323040 - DNA, 14 bp, Homo sapiens
tgcttgatgtttgg

SEQ ID NO: 5323041 - DNA, 17 bp, Homo sapiens
tgcttgcacacttcccc

SEQ ID NO: 5323042 - DNA, 22 bp, Homo sapiens
tgcttgcagccaggagaaggtc

SEQ ID NO: 5323043 - DNA, 16 bp, Homo sapiens
tgcttgcaggaggcca

SEQ ID NO: 5323044 - DNA, 15 bp, Homo sapiens
tgcttgcagtagatt

SEQ ID NO: 5323045 - DNA, 17 bp, Homo sapiens
tgcttgcagtagatttt

SEQ ID NO: 5323046 - DNA, 19 bp, Homo sapiens
tgcttgcagtagattttct

SEQ ID NO: 5323047 - DNA, 19 bp, Homo sapiens
tgcttgcatctgcacatag

SEQ ID NO: 5323048 - DNA, 14 bp, Homo sapiens
tgcttgcatttctt

SEQ ID NO: 5323049 - DNA, 13 bp, Homo sapiens
tgcttgccagcca

SEQ ID NO: 5323050 - DNA, 23 bp, Homo sapiens
tgcttgcccaagtcacacagcta

SEQ ID NO: 5323051 - DNA, 18 bp, Homo sapiens
tgcttgcccccatgctgg

SEQ ID NO: 5323052 - DNA, 16 bp, Homo sapiens
tgcttgcccccatgtg

SEQ ID NO: 5323053 - DNA, 12 bp, Homo sapiens
tgcttgccccgc

SEQ ID NO: 5323054 - DNA, 18 bp, Homo sapiens
tgcttgcccgctcccaca

SEQ ID NO: 5323055 - DNA, 14 bp, Homo sapiens
tgcttgccgagcct

SEQ ID NO: 5323056 - DNA, 20 bp, Homo sapiens
tgcttgccgagcctaatgaa

SEQ ID NO: 5323057 - DNA, 19 bp, Homo sapiens
tgcttgcggcaaaaggaaa

SEQ ID NO: 5323058 - DNA, 21 bp, Homo sapiens
tgcttgcggcaaaaggaaagc

SEQ ID NO: 5323059 - DNA, 18 bp, Homo sapiens
tgcttgctcatatgcatg

SEQ ID NO: 5323060 - DNA, 19 bp, Homo sapiens
tgcttgctggccacaagga

SEQ ID NO: 5323061 - DNA, 22 bp, Homo sapiens
tgcttgctggtactaagaggct

SEQ ID NO: 5323062 - DNA, 15 bp, Homo sapiens
tgcttgctggtgcct

SEQ ID NO: 5323063 - DNA, 19 bp, Homo sapiens
tgcttgcttacaatcttta

SEQ ID NO: 5323064 - DNA, 15 bp, Homo sapiens
tgcttgcttgtgaat

SEQ ID NO: 5323065 - DNA, 23 bp, Homo sapiens
tgcttgcttttcatgcaaactct

SEQ ID NO: 5323066 - DNA, 23 bp, Homo sapiens
tgcttggaaattccttgccccac

SEQ ID NO: 5323067 - DNA, 14 bp, Homo sapiens
tgcttggaagccag

SEQ ID NO: 5323068 - DNA, 15 bp, Homo sapiens
tgcttggagcaatca

SEQ ID NO: 5323069 - DNA, 17 bp, Homo sapiens
tgcttggagcaatcaga

SEQ ID NO: 5323070 - DNA, 17 bp, Homo sapiens
tgcttggagctgagcaa

SEQ ID NO: 5323071 - DNA, 15 bp, Homo sapiens
tgcttggaggaagga

SEQ ID NO: 5323072 - DNA, 16 bp, Homo sapiens
tgcttggagtgcccca

SEQ ID NO: 5323073 - DNA, 17 bp, Homo sapiens
tgcttggagtgccccaa

SEQ ID NO: 5323074 - DNA, 16 bp, Homo sapiens
tgcttggatccataca

SEQ ID NO: 5323075 - DNA, 18 bp, Homo sapiens
tgcttggatccatacaaa

SEQ ID NO: 5323076 - DNA, 20 bp, Homo sapiens
tgcttggatccatacaaaac

SEQ ID NO: 5323077 - DNA, 20 bp, Homo sapiens
tgcttggattctctgagaaa

SEQ ID NO: 5323078 - DNA, 22 bp, Homo sapiens
tgcttggcagttgcagtgctgc

SEQ ID NO: 5323079 - DNA, 12 bp, Homo sapiens
tgcttggcccag

SEQ ID NO: 5323080 - DNA, 15 bp, Homo sapiens
tgcttggcccaggag

SEQ ID NO: 5323081 - DNA, 18 bp, Homo sapiens
tgcttggcccggccggcc

SEQ ID NO: 5323082 - DNA, 23 bp, Homo sapiens
tgcttggcccggccggcctggca

SEQ ID NO: 5323083 - DNA, 23 bp, Homo sapiens
tgcttggcccttcaagggtcagg

SEQ ID NO: 5323084 - DNA, 16 bp, Homo sapiens
tgcttggctgccccac

SEQ ID NO: 5323085 - DNA, 17 bp, Homo sapiens
tgcttggcttatgaaaa

SEQ ID NO: 5323086 - DNA, 22 bp, Homo sapiens
tgcttgggaccagaagtgtttc

SEQ ID NO: 5323087 - DNA, 15 bp, Homo sapiens
tgcttgggccactgc

SEQ ID NO: 5323088 - DNA, 19 bp, Homo sapiens
tgcttgggccactgccctc

SEQ ID NO: 5323089 - DNA, 15 bp, Homo sapiens
tgcttgggccctgca

SEQ ID NO: 5323090 - DNA, 17 bp, Homo sapiens
tgcttgggccctgcatt

SEQ ID NO: 5323091 - DNA, 22 bp, Homo sapiens
tgcttgggccctgcattggcct

SEQ ID NO: 5323092 - DNA, 15 bp, Homo sapiens
tgcttgggctccacg

SEQ ID NO: 5323093 - DNA, 13 bp, Homo sapiens
tgcttgggctgac

SEQ ID NO: 5323094 - DNA, 12 bp, Homo sapiens
tgcttgggcttc

SEQ ID NO: 5323095 - DNA, 23 bp, Homo sapiens
tgcttgggcttctgcggtgaggc

SEQ ID NO: 5323096 - DNA, 21 bp, Homo sapiens
tgcttgggtcctactcctgga

SEQ ID NO: 5323097 - DNA, 20 bp, Homo sapiens
tgcttgggtggagaagccat

SEQ ID NO: 5323098 - DNA, 23 bp, Homo sapiens
tgcttggtctagaatggattttt

SEQ ID NO: 5323099 - DNA, 13 bp, Homo sapiens
tgcttggtgctgg

SEQ ID NO: 5323100 - DNA, 19 bp, Homo sapiens
tgcttggtgctggtttatt

SEQ ID NO: 5323101 - DNA, 15 bp, Homo sapiens
tgcttggtgtgaccc

SEQ ID NO: 5323102 - DNA, 20 bp, Homo sapiens
tgcttggtttagctgtgcag

SEQ ID NO: 5323103 - DNA, 14 bp, Homo sapiens
tgcttggttttctt

SEQ ID NO: 5323104 - DNA, 21 bp, Homo sapiens
tgcttgtaacaagaaaacata

SEQ ID NO: 5323105 - DNA, 23 bp, Homo sapiens
tgcttgtaacaagaaaacataag

SEQ ID NO: 5323106 - DNA, 13 bp, Homo sapiens
tgcttgtacataa

SEQ ID NO: 5323107 - DNA, 14 bp, Homo sapiens
tgcttgtacataat

SEQ ID NO: 5323108 - DNA, 18 bp, Homo sapiens
tgcttgtacctctggctg

SEQ ID NO: 5323109 - DNA, 16 bp, Homo sapiens
tgcttgtattgtaaat

SEQ ID NO: 5323110 - DNA, 13 bp, Homo sapiens
tgcttgtcatctg

SEQ ID NO: 5323111 - DNA, 20 bp, Homo sapiens
tgcttgtcattccagagtgc

SEQ ID NO: 5323112 - DNA, 17 bp, Homo sapiens
tgcttgtcctgctctct

SEQ ID NO: 5323113 - DNA, 17 bp, Homo sapiens
tgcttgtcgctttctca

SEQ ID NO: 5323114 - DNA, 20 bp, Homo sapiens
tgcttgtcgctttctcagtg

SEQ ID NO: 5323115 - DNA, 22 bp, Homo sapiens
tgcttgtcttctggtactttct

SEQ ID NO: 5323116 - DNA, 12 bp, Homo sapiens
tgcttgtgcctc

SEQ ID NO: 5323117 - DNA, 23 bp, Homo sapiens
tgcttgtgcctcccttcccagtg

SEQ ID NO: 5323118 - DNA, 24 bp, Homo sapiens
tgcttgtgctcatgtgtgtggtca

SEQ ID NO: 5323119 - DNA, 17 bp, Homo sapiens
tgcttgtggaagacaag

SEQ ID NO: 5323120 - DNA, 12 bp, Homo sapiens
tgcttgtgggcc

SEQ ID NO: 5323121 - DNA, 14 bp, Homo sapiens
tgcttgtgtgtatg

SEQ ID NO: 5323122 - DNA, 16 bp, Homo sapiens
tgcttgtgtgtatgtc

SEQ ID NO: 5323123 - DNA, 22 bp, Homo sapiens
tgcttgtgtgtatgtctatgtg

SEQ ID NO: 5323124 - DNA, 15 bp, Homo sapiens
tgcttgtgttaagta

SEQ ID NO: 5323125 - DNA, 17 bp, Homo sapiens
tgcttgtgttgggcccc

SEQ ID NO: 5323126 - DNA, 15 bp, Homo sapiens
tgcttgtgtttgttt

SEQ ID NO: 5323127 - DNA, 14 bp, Homo sapiens
tgcttgttaactga

SEQ ID NO: 5323128 - DNA, 16 bp, Homo sapiens
tgcttgttaactgagt

SEQ ID NO: 5323129 - DNA, 18 bp, Homo sapiens
tgcttgttaactgagtgc

SEQ ID NO: 5323130 - DNA, 16 bp, Homo sapiens
tgcttgttccctctcc

SEQ ID NO: 5323131 - DNA, 19 bp, Homo sapiens
tgcttgttgaatgtcaatc

SEQ ID NO: 5323132 - DNA, 14 bp, Homo sapiens
tgcttgttggattt

SEQ ID NO: 5323133 - DNA, 19 bp, Homo sapiens
tgcttgttgggattcctga

SEQ ID NO: 5323134 - DNA, 22 bp, Homo sapiens
tgcttgttgggattcctgaccc

SEQ ID NO: 5323135 - DNA, 15 bp, Homo sapiens
tgcttgttgtcaagt

SEQ ID NO: 5323136 - DNA, 13 bp, Homo sapiens
tgcttgtttatga

SEQ ID NO: 5323137 - DNA, 14 bp, Homo sapiens
tgcttgtttatgat

SEQ ID NO: 5323138 - DNA, 13 bp, Homo sapiens
tgcttgttttaca

SEQ ID NO: 5323139 - DNA, 12 bp, Homo sapiens
tgctttaaaaaa

SEQ ID NO: 5323140 - DNA, 14 bp, Homo sapiens
tgctttaaaacaaa

SEQ ID NO: 5323141 - DNA, 17 bp, Homo sapiens
tgctttaaagtgtaata

SEQ ID NO: 5323142 - DNA, 20 bp, Homo sapiens
tggaaacattttatactgta

SEQ ID NO: 5323143 - DNA, 21 bp, Homo sapiens
tggaaacattttatactgtac

SEQ ID NO: 5323144 - DNA, 21 bp, Homo sapiens
tggaaaccacacttcttgaaa

SEQ ID NO: 5323145 - DNA, 12 bp, Homo sapiens
tggaaaccacag

SEQ ID NO: 5323146 - DNA, 17 bp, Homo sapiens
tggaaaccaccttaaaa

SEQ ID NO: 5323147 - DNA, 21 bp, Homo sapiens
tggaaaccagaatgattttga

SEQ ID NO: 5323148 - DNA, 17 bp, Homo sapiens
tggaaacccataggccc

SEQ ID NO: 5323149 - DNA, 22 bp, Homo sapiens
tggaaaccgtgtgtccagcatt

SEQ ID NO: 5323150 - DNA, 15 bp, Homo sapiens
tggaaacctgaaaaa

SEQ ID NO: 5323151 - DNA, 17 bp, Homo sapiens
tggaaacctgccctgcc

SEQ ID NO: 5323152 - DNA, 22 bp, Homo sapiens
tggaaacctgccctgcctgagg

SEQ ID NO: 5323153 - DNA, 20 bp, Homo sapiens
tggaaacctgttatgccaaa

SEQ ID NO: 5323154 - DNA, 14 bp, Homo sapiens
tggaaactaataaa

SEQ ID NO: 5323155 - DNA, 16 bp, Homo sapiens
tggaaactaataaaat

SEQ ID NO: 5323156 - DNA, 21 bp, Homo sapiens
tggaaactaataaaatatttt

SEQ ID NO: 5323157 - DNA, 23 bp, Homo sapiens
tggaaactaccagtgggcatgta

SEQ ID NO: 5323158 - DNA, 14 bp, Homo sapiens
tggaaactgaatgc

SEQ ID NO: 5323159 - DNA, 15 bp, Homo sapiens
tggaaactgaatgct

SEQ ID NO: 5323160 - DNA, 21 bp, Homo sapiens
tggaaactgctaaattctatg

SEQ ID NO: 5323161 - DNA, 22 bp, Homo sapiens
tggaaactgctaaattctatgt

SEQ ID NO: 5323162 - DNA, 21 bp, Homo sapiens
tggaaactggatgaggtcata

SEQ ID NO: 5323163 - DNA, 13 bp, Homo sapiens
tggaaactggcca

SEQ ID NO: 5323164 - DNA, 14 bp, Homo sapiens
tggaaactgtaaaa

SEQ ID NO: 5323165 - DNA, 19 bp, Homo sapiens
tggaaactgttggttgaga

SEQ ID NO: 5323166 - DNA, 17 bp, Homo sapiens
tggaaagaacatttaaa

SEQ ID NO: 5323167 - DNA, 11 bp, Homo sapiens
tggaaagaagg

SEQ ID NO: 5323168 - DNA, 18 bp, Homo sapiens
tggaaagaaggaaaaaag

SEQ ID NO: 5323169 - DNA, 19 bp, Homo sapiens
tggaaagacagcttctcat

SEQ ID NO: 5323170 - DNA, 23 bp, Homo sapiens
tggaaagacagcttctcatcctg

SEQ ID NO: 5323171 - DNA, 15 bp, Homo sapiens
tggaaagagaaatga

SEQ ID NO: 5323172 - DNA, 12 bp, Homo sapiens
tggaaagagacc

SEQ ID NO: 5323173 - DNA, 15 bp, Homo sapiens
tggaaagagctgttt

SEQ ID NO: 5323174 - DNA, 20 bp, Homo sapiens
tggaaagaggttctgcactc

SEQ ID NO: 5323175 - DNA, 14 bp, Homo sapiens
tggaaagagtactc

SEQ ID NO: 5323176 - DNA, 20 bp, Homo sapiens
tggaaagagtaggaagactt

SEQ ID NO: 5323177 - DNA, 18 bp, Homo sapiens
tggaaagatagagattgt

SEQ ID NO: 5323178 - DNA, 15 bp, Homo sapiens
tggaaagattgtgtc

SEQ ID NO: 5323179 - DNA, 17 bp, Homo sapiens
tggaaagcaaacaggaa

SEQ ID NO: 5323180 - DNA, 15 bp, Homo sapiens
tggaaagcaaagggc

SEQ ID NO: 5323181 - DNA, 17 bp, Homo sapiens
tggaaagcacaagactg

SEQ ID NO: 5323182 - DNA, 22 bp, Homo sapiens
tggaaagcacaagactggccca

SEQ ID NO: 5323183 - DNA, 14 bp, Homo sapiens
tggaaagcactttt

SEQ ID NO: 5323184 - DNA, 16 bp, Homo sapiens
tggaaagcaggatgta

SEQ ID NO: 5323185 - DNA, 16 bp, Homo sapiens
tggaaagcatcacctc

SEQ ID NO: 5323186 - DNA, 23 bp, Homo sapiens
tggaaagccagttagttagaatt

SEQ ID NO: 5323187 - DNA, 14 bp, Homo sapiens
tggaaagcctctgc

SEQ ID NO: 5323188 - DNA, 18 bp, Homo sapiens
tggaaagcctctgctgcc

SEQ ID NO: 5323189 - DNA, 21 bp, Homo sapiens
tggaaagcttttcagtgttcc

SEQ ID NO: 5323190 - DNA, 16 bp, Homo sapiens
tggaaaggaaacattg

SEQ ID NO: 5323191 - DNA, 15 bp, Homo sapiens
tggaaaggaatgcaa

SEQ ID NO: 5323192 - DNA, 14 bp, Homo sapiens
tggaaaggagagga

SEQ ID NO: 5323193 - DNA, 16 bp, Homo sapiens
tggaaaggagaggaaa

SEQ ID NO: 5323194 - DNA, 17 bp, Homo sapiens
tggaaaggctcagtctc

SEQ ID NO: 5323195 - DNA, 23 bp, Homo sapiens
tggaaaggggagagcctgctggc

SEQ ID NO: 5323196 - DNA, 23 bp, Homo sapiens
tggaaagggtgctgcttccctct

SEQ ID NO: 5323197 - DNA, 13 bp, Homo sapiens
tggaaagggtgtg

SEQ ID NO: 5323198 - DNA, 21 bp, Homo sapiens
tggaaagggtgtggcttggaa

SEQ ID NO: 5323199 - DNA, 16 bp, Homo sapiens
tggaaaggtcctgctg

SEQ ID NO: 5323200 - DNA, 22 bp, Homo sapiens
tggaaaggtgtgagactgggaa

SEQ ID NO: 5323201 - DNA, 20 bp, Homo sapiens
tggaaagtacactctgctgt

SEQ ID NO: 5323202 - DNA, 13 bp, Homo sapiens
tggaaagtagctg

SEQ ID NO: 5323203 - DNA, 22 bp, Homo sapiens
tggaaagtcacctacaggactg

SEQ ID NO: 5323204 - DNA, 12 bp, Homo sapiens
tggaaagtcaga

SEQ ID NO: 5323205 - DNA, 13 bp, Homo sapiens
tggaaagtcagaa

SEQ ID NO: 5323206 - DNA, 17 bp, Homo sapiens
tggaaagtgaatttgaa

SEQ ID NO: 5323207 - DNA, 21 bp, Homo sapiens
tggaaagtgaatttgaatgaa

SEQ ID NO: 5323208 - DNA, 17 bp, Homo sapiens
tggaaagtgattttatt

SEQ ID NO: 5323209 - DNA, 13 bp, Homo sapiens
tggaaagtgtaaa

SEQ ID NO: 5323210 - DNA, 18 bp, Homo sapiens
tggaaagtgttcattgca

SEQ ID NO: 5323211 - DNA, 16 bp, Homo sapiens
tggaaagttcagccag

SEQ ID NO: 5323212 - DNA, 15 bp, Homo sapiens
tggaaagtttttgta

SEQ ID NO: 5323213 - DNA, 14 bp, Homo sapiens
tggaaataaaagat

SEQ ID NO: 5323214 - DNA, 20 bp, Homo sapiens
tggaaataaacctggagatg

SEQ ID NO: 5323215 - DNA, 21 bp, Homo sapiens
tggaaataaacctggagatga

SEQ ID NO: 5323216 - DNA, 16 bp, Homo sapiens
tggaaataaactgtgc

SEQ ID NO: 5323217 - DNA, 20 bp, Homo sapiens
tggaaataaagtaggaaaga

SEQ ID NO: 5323218 - DNA, 22 bp, Homo sapiens
tggaaataaagtaggaaagaat

SEQ ID NO: 5323219 - DNA, 18 bp, Homo sapiens
tggaaataaatcttccta

SEQ ID NO: 5323220 - DNA, 17 bp, Homo sapiens
tggaaataataaaagat

SEQ ID NO: 5323221 - DNA, 16 bp, Homo sapiens
tggaaataataaatta

SEQ ID NO: 5323222 - DNA, 22 bp, Homo sapiens
tggaaataataaattaacatta

SEQ ID NO: 5323223 - DNA, 15 bp, Homo sapiens
tggaaataatttgaa

SEQ ID NO: 5323224 - DNA, 16 bp, Homo sapiens
tggaaataatttgaat

SEQ ID NO: 5323225 - DNA, 19 bp, Homo sapiens
tggaaataatttgaatgta

SEQ ID NO: 5323226 - DNA, 21 bp, Homo sapiens
tggaaatacagttatttcatc

SEQ ID NO: 5323227 - DNA, 18 bp, Homo sapiens
tggaaatacagttgttgg

SEQ ID NO: 5323228 - DNA, 20 bp, Homo sapiens
tggaaataccaggaccagtt

SEQ ID NO: 5323229 - DNA, 21 bp, Homo sapiens
tggaaatactttatctgtgac

SEQ ID NO: 5323230 - DNA, 21 bp, Homo sapiens
tggaaatagaaagaagccata

SEQ ID NO: 5323231 - DNA, 20 bp, Homo sapiens
tggaaatatacctacctctt

SEQ ID NO: 5323232 - DNA, 19 bp, Homo sapiens
tggaaatataggctatgta

SEQ ID NO: 5323233 - DNA, 14 bp, Homo sapiens
tggaaatatgttct

SEQ ID NO: 5323234 - DNA, 20 bp, Homo sapiens
tggaaatattaagaaagact

SEQ ID NO: 5323235 - DNA, 13 bp, Homo sapiens
tggaaatattatg

SEQ ID NO: 5323236 - DNA, 15 bp, Homo sapiens
tggaaatattatgca

SEQ ID NO: 5323237 - DNA, 23 bp, Homo sapiens
tggaaatattcatgcttcttcct

SEQ ID NO: 5323238 - DNA, 16 bp, Homo sapiens
tggaaatattctatga

SEQ ID NO: 5323239 - DNA, 14 bp, Homo sapiens
tggaaatattttga

SEQ ID NO: 5323240 - DNA, 21 bp, Homo sapiens
tggaaatattttgataataaa

SEQ ID NO: 5323241 - DNA, 19 bp, Homo sapiens
tggaaatcaaatgtaaagt

SEQ ID NO: 5323242 - DNA, 18 bp, Homo sapiens
tggaaatcagtagaaagc

SEQ ID NO: 5323243 - DNA, 23 bp, Homo sapiens
tggaaatcagttgtgaatacatt

SEQ ID NO: 5323244 - DNA, 14 bp, Homo sapiens
tggaaatcattgtg

SEQ ID NO: 5323245 - DNA, 22 bp, Homo sapiens
tggaaatcctgttacttaaata

SEQ ID NO: 5323246 - DNA, 15 bp, Homo sapiens
tggaaatcgcttata

SEQ ID NO: 5323247 - DNA, 22 bp, Homo sapiens
tggaaatcgcttatatgtcctt

SEQ ID NO: 5323248 - DNA, 22 bp, Homo sapiens
tggaaatctcagattcttcact

SEQ ID NO: 5323249 - DNA, 19 bp, Homo sapiens
tggaaatggatgcaaagta

SEQ ID NO: 5323250 - DNA, 22 bp, Homo sapiens
tggaaatggcccatttaatgat

SEQ ID NO: 5323251 - DNA, 18 bp, Homo sapiens
tggaaatgggcagagcag

SEQ ID NO: 5323252 - DNA, 13 bp, Homo sapiens
tggaaatggtttc

SEQ ID NO: 5323253 - DNA, 17 bp, Homo sapiens
tggaaatgtaataataa

SEQ ID NO: 5323254 - DNA, 18 bp, Homo sapiens
tggaaattaaaactcatt

SEQ ID NO: 5323255 - DNA, 19 bp, Homo sapiens
tggaaattagccacatgta

SEQ ID NO: 5323256 - DNA, 21 bp, Homo sapiens
tggaaattaggttgaaacata

SEQ ID NO: 5323257 - DNA, 21 bp, Homo sapiens
tggaaattccaggaaccaaaa

SEQ ID NO: 5323258 - DNA, 22 bp, Homo sapiens
tggaaattcctgtactgtgtct

SEQ ID NO: 5323259 - DNA, 15 bp, Homo sapiens
tggaaattccttgcc

SEQ ID NO: 5323260 - DNA, 20 bp, Homo sapiens
tggaaattcttccctggggg

SEQ ID NO: 5323261 - DNA, 15 bp, Homo sapiens
tggaaattgaaataa

SEQ ID NO: 5323262 - DNA, 24 bp, Homo sapiens
tggaaattgttgtatatcactaaa

SEQ ID NO: 5323263 - DNA, 14 bp, Homo sapiens
tggaaatttaaagc

SEQ ID NO: 5323264 - DNA, 16 bp, Homo sapiens
tggaaatttaaagcag

SEQ ID NO: 5323265 - DNA, 21 bp, Homo sapiens
tggaaatttaaagcaggttct

SEQ ID NO: 5323266 - DNA, 17 bp, Homo sapiens
tggaaatttaaatgaca

SEQ ID NO: 5323267 - DNA, 12 bp, Homo sapiens
tggaaatttcac

SEQ ID NO: 5323268 - DNA, 21 bp, Homo sapiens
tggaaatttgttataatgaat

SEQ ID NO: 5323269 - DNA, 21 bp, Homo sapiens
tggaacaaaagttcgaaagaa

SEQ ID NO: 5323270 - DNA, 12 bp, Homo sapiens
tggaacaaatgc

SEQ ID NO: 5323271 - DNA, 18 bp, Homo sapiens
tggaacaagacagccttc

SEQ ID NO: 5323272 - DNA, 20 bp, Homo sapiens
tggaacaattattttattgt

SEQ ID NO: 5323273 - DNA, 19 bp, Homo sapiens
tggaacacaaacacattgt

SEQ ID NO: 5323274 - DNA, 20 bp, Homo sapiens
tggaacacaaatgaaaatga

SEQ ID NO: 5323275 - DNA, 14 bp, Homo sapiens
tggaacacaataat

SEQ ID NO: 5323276 - DNA, 13 bp, Homo sapiens
tggaacacacaca

SEQ ID NO: 5323277 - DNA, 16 bp, Homo sapiens
tggaacacagaactga

SEQ ID NO: 5323278 - DNA, 15 bp, Homo sapiens
tggaacaccaggctg

SEQ ID NO: 5323279 - DNA, 18 bp, Homo sapiens
tggaacaccctggatgct

SEQ ID NO: 5323280 - DNA, 22 bp, Homo sapiens
tggaacacctaccaaaaaataa

SEQ ID NO: 5323281 - DNA, 17 bp, Homo sapiens
tggaacacggccacatc

SEQ ID NO: 5323282 - DNA, 16 bp, Homo sapiens
tggaacactactctta

SEQ ID NO: 5323283 - DNA, 20 bp, Homo sapiens
tggaacactagacaagccag

SEQ ID NO: 5323284 - DNA, 16 bp, Homo sapiens
tggaacagaatgtttt

SEQ ID NO: 5323285 - DNA, 22 bp, Homo sapiens
tggaacagatatttagctctgt

SEQ ID NO: 5323286 - DNA, 19 bp, Homo sapiens
tggaacagattcacactgt

SEQ ID NO: 5323287 - DNA, 12 bp, Homo sapiens
tggaacagattt

SEQ ID NO: 5323288 - DNA, 14 bp, Homo sapiens
tggaacagccctgc

SEQ ID NO: 5323289 - DNA, 13 bp, Homo sapiens
tggaacagcggga

SEQ ID NO: 5323290 - DNA, 16 bp, Homo sapiens
tggaacagcgggagac

SEQ ID NO: 5323291 - DNA, 13 bp, Homo sapiens
tggaacaggagga

SEQ ID NO: 5323292 - DNA, 20 bp, Homo sapiens
tggaacagtcacccttctgg

SEQ ID NO: 5323293 - DNA, 21 bp, Homo sapiens
tggaacagtcacccttctggg

SEQ ID NO: 5323294 - DNA, 13 bp, Homo sapiens
tggaacagtgttt

SEQ ID NO: 5323295 - DNA, 14 bp, Homo sapiens
tggaacagtgttta

SEQ ID NO: 5323296 - DNA, 20 bp, Homo sapiens
tggaacataaaaaggacatc

SEQ ID NO: 5323297 - DNA, 23 bp, Homo sapiens
tggaacatcatcaaggcactgcc

SEQ ID NO: 5323298 - DNA, 21 bp, Homo sapiens
tggaacatgtcggagtagaaa

SEQ ID NO: 5323299 - DNA, 21 bp, Homo sapiens
tggaacattctgtcatcaccc

SEQ ID NO: 5323300 - DNA, 13 bp, Homo sapiens
tggaacattggaa

SEQ ID NO: 5323301 - DNA, 17 bp, Homo sapiens
tggaacatttctttctt

SEQ ID NO: 5323302 - DNA, 14 bp, Homo sapiens
tggaacattttcat

SEQ ID NO: 5323303 - DNA, 17 bp, Homo sapiens
tggaaccaaagctggcc

SEQ ID NO: 5323304 - DNA, 18 bp, Homo sapiens
tggaaccaaagtctaaac

SEQ ID NO: 5323305 - DNA, 19 bp, Homo sapiens
tggaaccaaagtctaaact

SEQ ID NO: 5323306 - DNA, 17 bp, Homo sapiens
tggaaccacattgaaga

SEQ ID NO: 5323307 - DNA, 15 bp, Homo sapiens
tggaaccaccagtct

SEQ ID NO: 5323308 - DNA, 22 bp, Homo sapiens
tggaaccacctgatgacatggt

SEQ ID NO: 5323309 - DNA, 13 bp, Homo sapiens
tggaaccacctgg

SEQ ID NO: 5323310 - DNA, 11 bp, Homo sapiens
tggaaccactg

SEQ ID NO: 5323311 - DNA, 15 bp, Homo sapiens
tggaaccagagccac

SEQ ID NO: 5323312 - DNA, 19 bp, Homo sapiens
tggaaccagcaagtcccag

SEQ ID NO: 5323313 - DNA, 12 bp, Homo sapiens
tggaaccagccc

SEQ ID NO: 5323314 - DNA, 15 bp, Homo sapiens
tggaaccagccccat

SEQ ID NO: 5323315 - DNA, 20 bp, Homo sapiens
tggaaccaggcttgcctggg

SEQ ID NO: 5323316 - DNA, 18 bp, Homo sapiens
tggaaccagggaggagag

SEQ ID NO: 5323317 - DNA, 21 bp, Homo sapiens
tggaaccagggaggagaggaa

SEQ ID NO: 5323318 - DNA, 17 bp, Homo sapiens
tggaaccatggaggagg

SEQ ID NO: 5323319 - DNA, 14 bp, Homo sapiens
tggaatctgatgaa

SEQ ID NO: 5323320 - DNA, 13 bp, Homo sapiens
tggaatctggaga

SEQ ID NO: 5323321 - DNA, 17 bp, Homo sapiens
tggaatctggagaccag

SEQ ID NO: 5323322 - DNA, 18 bp, Homo sapiens
tggaatctggagaccagg

SEQ ID NO: 5323323 - DNA, 17 bp, Homo sapiens
tggaatcttcacctcag

SEQ ID NO: 5323324 - DNA, 23 bp, Homo sapiens
tggaatcttcacctcagagtgga

SEQ ID NO: 5323325 - DNA, 15 bp, Homo sapiens
tggaatcttgctgca

SEQ ID NO: 5323326 - DNA, 17 bp, Homo sapiens
tggaatgaattaaataa

SEQ ID NO: 5323327 - DNA, 21 bp, Homo sapiens
tggaatgactgaagacaggca

SEQ ID NO: 5323328 - DNA, 15 bp, Homo sapiens
tggaatgagggaggc

SEQ ID NO: 5323329 - DNA, 21 bp, Homo sapiens
tggaatgagtgtgcatggagg

SEQ ID NO: 5323330 - DNA, 21 bp, Homo sapiens
tggaatgattggttaaaatgt

SEQ ID NO: 5323331 - DNA, 15 bp, Homo sapiens
tggaatgcagaggtc

SEQ ID NO: 5323332 - DNA, 20 bp, Homo sapiens
tggaatgccgctgtctctga

SEQ ID NO: 5323333 - DNA, 17 bp, Homo sapiens
tggaatgcttcctagaa

SEQ ID NO: 5323334 - DNA, 13 bp, Homo sapiens
tggaatgcttgaa

SEQ ID NO: 5323335 - DNA, 18 bp, Homo sapiens
tggaatggaactactgta

SEQ ID NO: 5323336 - DNA, 16 bp, Homo sapiens
tggaatggactgggtg

SEQ ID NO: 5323337 - DNA, 18 bp, Homo sapiens
tggaatgggagtctgaaa

SEQ ID NO: 5323338 - DNA, 20 bp, Homo sapiens
tggaatgggagtctgaaatg

SEQ ID NO: 5323339 - DNA, 17 bp, Homo sapiens
tggaatggggacctggg

SEQ ID NO: 5323340 - DNA, 18 bp, Homo sapiens
tggaatgggggccaggct

SEQ ID NO: 5323341 - DNA, 23 bp, Homo sapiens
tggaatgggggccaggctgagcc

SEQ ID NO: 5323342 - DNA, 14 bp, Homo sapiens
tggaatggttgagt

SEQ ID NO: 5323343 - DNA, 14 bp, Homo sapiens
tggaatgtcagtgt

SEQ ID NO: 5323344 - DNA, 20 bp, Homo sapiens
tggaatgtgccacagaggcc

SEQ ID NO: 5323345 - DNA, 16 bp, Homo sapiens
tggaatgttggataag

SEQ ID NO: 5323346 - DNA, 21 bp, Homo sapiens
tggaatgttggataaggaatt

SEQ ID NO: 5323347 - DNA, 19 bp, Homo sapiens
tggaatgttgttaaatgct

SEQ ID NO: 5323348 - DNA, 23 bp, Homo sapiens
tggaatgtttttccctccccaga

SEQ ID NO: 5323349 - DNA, 15 bp, Homo sapiens
tggaattaaaacaat

SEQ ID NO: 5323350 - DNA, 17 bp, Homo sapiens
tggaattaaaacaatgt

SEQ ID NO: 5323351 - DNA, 19 bp, Homo sapiens
tggaattaaccatttaata

SEQ ID NO: 5323352 - DNA, 21 bp, Homo sapiens
tggaattaaccatttaataaa

SEQ ID NO: 5323353 - DNA, 19 bp, Homo sapiens
tggaattacaagccctggg

SEQ ID NO: 5323354 - DNA, 13 bp, Homo sapiens
tggaattacataa

SEQ ID NO: 5323355 - DNA, 19 bp, Homo sapiens
tggaattacataacaggca

SEQ ID NO: 5323356 - DNA, 14 bp, Homo sapiens
tggaattactccaa

SEQ ID NO: 5323357 - DNA, 15 bp, Homo sapiens
tggaattactccaaa

SEQ ID NO: 5323358 - DNA, 17 bp, Homo sapiens
tggaattactccaaaaa

SEQ ID NO: 5323359 - DNA, 23 bp, Homo sapiens
tggaattactccaaaaagacaag

SEQ ID NO: 5323360 - DNA, 14 bp, Homo sapiens
tggaattacttaaa

SEQ ID NO: 5323361 - DNA, 15 bp, Homo sapiens
tggaattagatgttt

SEQ ID NO: 5323362 - DNA, 14 bp, Homo sapiens
tggaattatgtata

SEQ ID NO: 5323363 - DNA, 17 bp, Homo sapiens
tggaattattgtagaca

SEQ ID NO: 5323364 - DNA, 18 bp, Homo sapiens
tggaattattgtagacat

SEQ ID NO: 5323365 - DNA, 15 bp, Homo sapiens
tggaattattttaaa

SEQ ID NO: 5323366 - DNA, 20 bp, Homo sapiens
tggaattattttaaaagata

SEQ ID NO: 5323367 - DNA, 22 bp, Homo sapiens
tggaattcaatgggtaaataaa

SEQ ID NO: 5323368 - DNA, 16 bp, Homo sapiens
tggaattcacaaagta

SEQ ID NO: 5323369 - DNA, 11 bp, Homo sapiens
tggaattcagc

SEQ ID NO: 5323370 - DNA, 17 bp, Homo sapiens
tggaattcagcaccctg

SEQ ID NO: 5323371 - DNA, 22 bp, Homo sapiens
tggaattcagtgacaaaatggg

SEQ ID NO: 5323372 - DNA, 19 bp, Homo sapiens
tggaattccaacttgaagg

SEQ ID NO: 5323373 - DNA, 19 bp, Homo sapiens
tggaattcctctttaacaa

SEQ ID NO: 5323374 - DNA, 20 bp, Homo sapiens
tggaattcctctttaacaag

SEQ ID NO: 5323375 - DNA, 21 bp, Homo sapiens
tggaattccttggagccactg

SEQ ID NO: 5323376 - DNA, 20 bp, Homo sapiens
tggaattcgtgttatgaatc

SEQ ID NO: 5323377 - DNA, 22 bp, Homo sapiens
tggaattcttagtcacaaaata

SEQ ID NO: 5323378 - DNA, 19 bp, Homo sapiens
tggaattcttcctcctctg

SEQ ID NO: 5323379 - DNA, 17 bp, Homo sapiens
tggaattgacattctct

SEQ ID NO: 5323380 - DNA, 18 bp, Homo sapiens
tggaattgactgcctatg

SEQ ID NO: 5323381 - DNA, 16 bp, Homo sapiens
tggaattgatttgcat

SEQ ID NO: 5323382 - DNA, 18 bp, Homo sapiens
tggaattgatttgcattg

SEQ ID NO: 5323383 - DNA, 19 bp, Homo sapiens
tggaattgatttgcattga

SEQ ID NO: 5323384 - DNA, 20 bp, Homo sapiens
tggaattgatttgcattgaa

SEQ ID NO: 5323385 - DNA, 18 bp, Homo sapiens
tggaattgctgctctctg

SEQ ID NO: 5323386 - DNA, 11 bp, Homo sapiens
tggaattgctt

SEQ ID NO: 5323387 - DNA, 23 bp, Homo sapiens
tggaattgcttaccaaaggatag

SEQ ID NO: 5323388 - DNA, 18 bp, Homo sapiens
tggaattgcttctgtgta

SEQ ID NO: 5323389 - DNA, 19 bp, Homo sapiens
tggaattggcaaactagaa

SEQ ID NO: 5323390 - DNA, 22 bp, Homo sapiens
tggaattgggtggggggcttca

SEQ ID NO: 5323391 - DNA, 17 bp, Homo sapiens
tggaattggtgtatatc

SEQ ID NO: 5323392 - DNA, 20 bp, Homo sapiens
tggaattgtgctccaaatgt

SEQ ID NO: 5323393 - DNA, 23 bp, Homo sapiens
tggaattgtgctccaaatgtcta

SEQ ID NO: 5323394 - DNA, 14 bp, Homo sapiens
tggaatttaaaaat

SEQ ID NO: 5323395 - DNA, 13 bp, Homo sapiens
tggaatttaagaa

SEQ ID NO: 5323396 - DNA, 15 bp, Homo sapiens
tggaatttaattcaa

SEQ ID NO: 5323397 - DNA, 17 bp, Homo sapiens
tggaatttatgaatggt

SEQ ID NO: 5323398 - DNA, 14 bp, Homo sapiens
tggaatttctggcc

SEQ ID NO: 5323399 - DNA, 17 bp, Homo sapiens
tggaatttgtaacctca

SEQ ID NO: 5323400 - DNA, 19 bp, Homo sapiens
tggaatttgtaacctcagc

SEQ ID NO: 5323401 - DNA, 13 bp, Homo sapiens
tggaatttgttca

SEQ ID NO: 5323402 - DNA, 17 bp, Homo sapiens
tggaattttaagtcttt

SEQ ID NO: 5323403 - DNA, 15 bp, Homo sapiens
tggaattttcagtca

SEQ ID NO: 5323404 - DNA, 22 bp, Homo sapiens
tggaattttcagtcatctcatg

SEQ ID NO: 5323405 - DNA, 11 bp, Homo sapiens
tggaattttct

SEQ ID NO: 5323406 - DNA, 21 bp, Homo sapiens
tggaattttctttcatacatt

SEQ ID NO: 5323407 - DNA, 23 bp, Homo sapiens
tggaattttctttcatacattat

SEQ ID NO: 5323408 - DNA, 15 bp, Homo sapiens
tggaattttgcaaag

SEQ ID NO: 5323409 - DNA, 22 bp, Homo sapiens
tggaattttgcaaagatttaat

SEQ ID NO: 5323410 - DNA, 23 bp, Homo sapiens
tggaatttttattatgcataact

SEQ ID NO: 5323411 - DNA, 12 bp, Homo sapiens
tggaatttttct

SEQ ID NO: 5323412 - DNA, 23 bp, Homo sapiens
tggaattttttcctgctagtgta

SEQ ID NO: 5323413 - DNA, 22 bp, Homo sapiens
tggaattttttgaatatgcctt

SEQ ID NO: 5323414 - DNA, 18 bp, Homo sapiens
tggaatttttttgtacga

SEQ ID NO: 5323415 - DNA, 20 bp, Homo sapiens
tggacaaaagtttatctttg

SEQ ID NO: 5323416 - DNA, 14 bp, Homo sapiens
tggacaaaatgact

SEQ ID NO: 5323417 - DNA, 14 bp, Homo sapiens
tggacaaaatggaa

SEQ ID NO: 5323418 - DNA, 17 bp, Homo sapiens
tggacaaaatggaatac

SEQ ID NO: 5323419 - DNA, 21 bp, Homo sapiens
tggacaaaattaatacattct

SEQ ID NO: 5323420 - DNA, 21 bp, Homo sapiens
tggacaaacctagaattttct

SEQ ID NO: 5323421 - DNA, 16 bp, Homo sapiens
tggacaaactggagtc

SEQ ID NO: 5323422 - DNA, 18 bp, Homo sapiens
tggacaaactggagtctg

SEQ ID NO: 5323423 - DNA, 14 bp, Homo sapiens
tggacaaagaaaac

SEQ ID NO: 5323424 - DNA, 23 bp, Homo sapiens
tggacaaatcacatattttaaaa

SEQ ID NO: 5323425 - DNA, 14 bp, Homo sapiens
tggacaagaagagt

SEQ ID NO: 5323426 - DNA, 13 bp, Homo sapiens
tggacaagaagct

SEQ ID NO: 5323427 - DNA, 16 bp, Homo sapiens
tggacaagaggtacag

SEQ ID NO: 5323428 - DNA, 22 bp, Homo sapiens
tggacaagcagtgtctgtcagc

SEQ ID NO: 5323429 - DNA, 17 bp, Homo sapiens
tggacaagccaacttgt

SEQ ID NO: 5323430 - DNA, 16 bp, Homo sapiens
tggacaagcttctgag

SEQ ID NO: 5323431 - DNA, 14 bp, Homo sapiens
tggacaaggagctg

SEQ ID NO: 5323432 - DNA, 14 bp, Homo sapiens
tggacaaggaggtc

SEQ ID NO: 5323433 - DNA, 21 bp, Homo sapiens
tggacaataaacatctgagca

SEQ ID NO: 5323434 - DNA, 17 bp, Homo sapiens
tggacaatataaactga

SEQ ID NO: 5323435 - DNA, 16 bp, Homo sapiens
tggacaatcttatgtt

SEQ ID NO: 5323436 - DNA, 16 bp, Homo sapiens
tggacaatttaccaca

SEQ ID NO: 5323437 - DNA, 19 bp, Homo sapiens
tggacacaaattttcaagt

SEQ ID NO: 5323438 - DNA, 19 bp, Homo sapiens
tggacacaacagcagtctc

SEQ ID NO: 5323439 - DNA, 20 bp, Homo sapiens
tggacacaacagcagtctcc

SEQ ID NO: 5323440 - DNA, 22 bp, Homo sapiens
tggacacaacagcagtctcctt

SEQ ID NO: 5323441 - DNA, 17 bp, Homo sapiens
tggacacacaaggtgca

SEQ ID NO: 5323442 - DNA, 11 bp, Homo sapiens
tggacacacac

SEQ ID NO: 5323443 - DNA, 24 bp, Homo sapiens
tggacacacactcaccagtggcct

SEQ ID NO: 5323444 - DNA, 19 bp, Homo sapiens
tggacacactaaactctgg

SEQ ID NO: 5323445 - DNA, 21 bp, Homo sapiens
tggacacactaaactctgggg

SEQ ID NO: 5323446 - DNA, 11 bp, Homo sapiens
tggacacactc

SEQ ID NO: 5323447 - DNA, 15 bp, Homo sapiens
tggacacactgtaaa

SEQ ID NO: 5323448 - DNA, 20 bp, Homo sapiens
tggacacactgtaaacccct

SEQ ID NO: 5323449 - DNA, 14 bp, Homo sapiens
tggacacagaagtc

SEQ ID NO: 5323450 - DNA, 20 bp, Homo sapiens
tggacacagacccacacatg

SEQ ID NO: 5323451 - DNA, 23 bp, Homo sapiens
tggacacagatcccactggaaga

SEQ ID NO: 5323452 - DNA, 14 bp, Homo sapiens
tggacacagctctt

SEQ ID NO: 5323453 - DNA, 15 bp, Homo sapiens
tggacacagctcttc

SEQ ID NO: 5323454 - DNA, 16 bp, Homo sapiens
tggacacagctcttct

SEQ ID NO: 5323455 - DNA, 23 bp, Homo sapiens
tggacacagctcttctccaggct

SEQ ID NO: 5323456 - DNA, 13 bp, Homo sapiens
tggacacaggcct

SEQ ID NO: 5323457 - DNA, 12 bp, Homo sapiens
tggacaccaccc

SEQ ID NO: 5323458 - DNA, 17 bp, Homo sapiens
tggacaccacccagagc

SEQ ID NO: 5323459 - DNA, 16 bp, Homo sapiens
tggacaccccacggga

SEQ ID NO: 5323460 - DNA, 14 bp, Homo sapiens
tggacaccccagac

SEQ ID NO: 5323461 - DNA, 13 bp, Homo sapiens
tggacacccccag

SEQ ID NO: 5323462 - DNA, 14 bp, Homo sapiens
tggacacccccagc

SEQ ID NO: 5323463 - DNA, 15 bp, Homo sapiens
tggacacccccagct

SEQ ID NO: 5323464 - DNA, 12 bp, Homo sapiens
tggacaccccct

SEQ ID NO: 5323465 - DNA, 22 bp, Homo sapiens
tggacaccccttatccaggact

SEQ ID NO: 5323466 - DNA, 15 bp, Homo sapiens
tggacaccctcacca

SEQ ID NO: 5323467 - DNA, 17 bp, Homo sapiens
tggacaccgctcagtat

SEQ ID NO: 5323468 - DNA, 18 bp, Homo sapiens
tggacaccgctcagtatt

SEQ ID NO: 5323469 - DNA, 14 bp, Homo sapiens
tggacacctcccag

SEQ ID NO: 5323470 - DNA, 14 bp, Homo sapiens
tggacacctgccct

SEQ ID NO: 5323471 - DNA, 17 bp, Homo sapiens
tggacacctgccctgcc

SEQ ID NO: 5323472 - DNA, 23 bp, Homo sapiens
tggacacctgccctgccctgcca

SEQ ID NO: 5323473 - DNA, 18 bp, Homo sapiens
tggacaccttgtgtttag

SEQ ID NO: 5323474 - DNA, 16 bp, Homo sapiens
tggacacgagccacaa

SEQ ID NO: 5323475 - DNA, 20 bp, Homo sapiens
tggacacgagccacaagctg

SEQ ID NO: 5323476 - DNA, 15 bp, Homo sapiens
tggacacgctcagtg

SEQ ID NO: 5323477 - DNA, 22 bp, Homo sapiens
tggacacgctcagtggggcaga

SEQ ID NO: 5323478 - DNA, 17 bp, Homo sapiens
tggacactacacccagc

SEQ ID NO: 5323479 - DNA, 20 bp, Homo sapiens
tggacactacacccagcaat

SEQ ID NO: 5323480 - DNA, 19 bp, Homo sapiens
tggacactacacgtttcaa

SEQ ID NO: 5323481 - DNA, 15 bp, Homo sapiens
tggacactcagacct

SEQ ID NO: 5323482 - DNA, 16 bp, Homo sapiens
tggacactcagacctg

SEQ ID NO: 5323483 - DNA, 13 bp, Homo sapiens
tggacactccagg

SEQ ID NO: 5323484 - DNA, 21 bp, Homo sapiens
tggacactccagtgccagcaa

SEQ ID NO: 5323485 - DNA, 12 bp, Homo sapiens
tggacactgcct

SEQ ID NO: 5323486 - DNA, 15 bp, Homo sapiens
tggacactgtgacaa

SEQ ID NO: 5323487 - DNA, 19 bp, Homo sapiens
tggacactgtgacaatgac

SEQ ID NO: 5323488 - DNA, 23 bp, Homo sapiens
tggacacttaatactaccttgaa

SEQ ID NO: 5323489 - DNA, 20 bp, Homo sapiens
tggacacttaattctgttct

SEQ ID NO: 5323490 - DNA, 21 bp, Homo sapiens
tggacactttgaaatgtgttt

SEQ ID NO: 5323491 - DNA, 16 bp, Homo sapiens
tggacacttttcacct

SEQ ID NO: 5323492 - DNA, 18 bp, Homo sapiens
tggacagaaaatgcaatg

SEQ ID NO: 5323493 - DNA, 12 bp, Homo sapiens
tggacagaagat

SEQ ID NO: 5323494 - DNA, 15 bp, Homo sapiens
tggacagaagcagct

SEQ ID NO: 5323495 - DNA, 22 bp, Homo sapiens
tggacagaagcttgtggggtac

SEQ ID NO: 5323496 - DNA, 21 bp, Homo sapiens
tggacagaatgtggtctgtca

SEQ ID NO: 5323497 - DNA, 13 bp, Homo sapiens
tggacagacacct

SEQ ID NO: 5323498 - DNA, 14 bp, Homo sapiens
tggacagacacctc

SEQ ID NO: 5323499 - DNA, 16 bp, Homo sapiens
tggacagacagaggat

SEQ ID NO: 5323500 - DNA, 21 bp, Homo sapiens
tggacagacccacccccagcc

SEQ ID NO: 5323501 - DNA, 14 bp, Homo sapiens
tggacagacccagg

SEQ ID NO: 5323502 - DNA, 19 bp, Homo sapiens
tggacagagggagaaggga

SEQ ID NO: 5323503 - DNA, 18 bp, Homo sapiens
tggacagaggggactctg

SEQ ID NO: 5323504 - DNA, 16 bp, Homo sapiens
tggacagatggaccaa

SEQ ID NO: 5323505 - DNA, 17 bp, Homo sapiens
tggacagatggaccaaa

SEQ ID NO: 5323506 - DNA, 18 bp, Homo sapiens
tggacagatggcccaagg

SEQ ID NO: 5323507 - DNA, 21 bp, Homo sapiens
tggacagatgggtgtcccctg

SEQ ID NO: 5323508 - DNA, 16 bp, Homo sapiens
tggacagatttcagta

SEQ ID NO: 5323509 - DNA, 18 bp, Homo sapiens
tggacagatttcagtaat

SEQ ID NO: 5323510 - DNA, 21 bp, Homo sapiens
tggacagatttcagtaatgtc

SEQ ID NO: 5323511 - DNA, 21 bp, Homo sapiens
tggacagcaaaaccattgctt

SEQ ID NO: 5323512 - DNA, 16 bp, Homo sapiens
tggacagcagaagcct

SEQ ID NO: 5323513 - DNA, 13 bp, Homo sapiens
tggacagccaggg

SEQ ID NO: 5323514 - DNA, 13 bp, Homo sapiens
tggacagccagtg

SEQ ID NO: 5323515 - DNA, 14 bp, Homo sapiens
tggacagccagtga

SEQ ID NO: 5323516 - DNA, 18 bp, Homo sapiens
tggacagcccgccgtcag

SEQ ID NO: 5323517 - DNA, 22 bp, Homo sapiens
tggacagcctcttctgtcccaa

SEQ ID NO: 5323518 - DNA, 17 bp, Homo sapiens
tggacagcggcagtggg

SEQ ID NO: 5323519 - DNA, 22 bp, Homo sapiens
tggacagcggttgtaaatacaa

SEQ ID NO: 5323520 - DNA, 23 bp, Homo sapiens
tggacagcggttgtaaatacaat

SEQ ID NO: 5323521 - DNA, 21 bp, Homo sapiens
tggacagctacttctgggaaa

SEQ ID NO: 5323522 - DNA, 12 bp, Homo sapiens
tggacagctgct

SEQ ID NO: 5323523 - DNA, 13 bp, Homo sapiens
tggacagctgctt

SEQ ID NO: 5323524 - DNA, 16 bp, Homo sapiens
tggacagctgcttgtg

SEQ ID NO: 5323525 - DNA, 14 bp, Homo sapiens
tggacagctgtgcc

SEQ ID NO: 5323526 - DNA, 15 bp, Homo sapiens
tggacagctgtgcct

SEQ ID NO: 5323527 - DNA, 16 bp, Homo sapiens
tggacagctgtgcctc

SEQ ID NO: 5323528 - DNA, 22 bp, Homo sapiens
tggacagcttacctagtcttgt

SEQ ID NO: 5323529 - DNA, 12 bp, Homo sapiens
tggacagcttgt

SEQ ID NO: 5323530 - DNA, 18 bp, Homo sapiens
tggacaggagatcagcag

SEQ ID NO: 5323531 - DNA, 21 bp, Homo sapiens
tggacaggagatcagcagcgt

SEQ ID NO: 5323532 - DNA, 16 bp, Homo sapiens
tggacaggagtcagtg

SEQ ID NO: 5323533 - DNA, 17 bp, Homo sapiens
tggacaggagtcagtgt

SEQ ID NO: 5323534 - DNA, 19 bp, Homo sapiens
tggacaggagtcagtgtct

SEQ ID NO: 5323535 - DNA, 23 bp, Homo sapiens
tggacaggatgaggacagagggc

SEQ ID NO: 5323536 - DNA, 15 bp, Homo sapiens
tggacaggcagcctc

SEQ ID NO: 5323537 - DNA, 21 bp, Homo sapiens
tggacaggcagcctcctttgt

SEQ ID NO: 5323538 - DNA, 17 bp, Homo sapiens
tggacaggcttcgtctc

SEQ ID NO: 5323539 - DNA, 23 bp, Homo sapiens
tggacaggcttcgtctcagaagg

SEQ ID NO: 5323540 - DNA, 23 bp, Homo sapiens
tggacagggcccccggccacgct

SEQ ID NO: 5323541 - DNA, 15 bp, Homo sapiens
tggacaggggattgg

SEQ ID NO: 5323542 - DNA, 22 bp, Homo sapiens
tggacaggtctgggagaggcag

SEQ ID NO: 5323543 - DNA, 22 bp, Homo sapiens
tggacagtacctgattgtattt

SEQ ID NO: 5323544 - DNA, 15 bp, Homo sapiens
tggacagtagaattt

SEQ ID NO: 5323545 - DNA, 18 bp, Homo sapiens
tggacagtagaatttcaa

SEQ ID NO: 5323546 - DNA, 23 bp, Homo sapiens
tggacagtatcactgtctttcct

SEQ ID NO: 5323547 - DNA, 20 bp, Homo sapiens
tggacagtcactgccacttt

SEQ ID NO: 5323548 - DNA, 15 bp, Homo sapiens
tggacagtcctggga

SEQ ID NO: 5323549 - DNA, 12 bp, Homo sapiens
tggacagtgaga

SEQ ID NO: 5323550 - DNA, 22 bp, Homo sapiens
tggacagtgcctaactccttac

SEQ ID NO: 5323551 - DNA, 15 bp, Homo sapiens
tggacagtgctgttg

SEQ ID NO: 5323552 - DNA, 14 bp, Homo sapiens
tggacagtggcctc

SEQ ID NO: 5323553 - DNA, 15 bp, Homo sapiens
tggacagtggcctct

SEQ ID NO: 5323554 - DNA, 22 bp, Homo sapiens
tggacagttcacaccctgcaag

SEQ ID NO: 5323555 - DNA, 17 bp, Homo sapiens
tggacatactgctggag

SEQ ID NO: 5323556 - DNA, 14 bp, Homo sapiens
tggacatagagagg

SEQ ID NO: 5323557 - DNA, 19 bp, Homo sapiens
tggacatagagagggagaa

SEQ ID NO: 5323558 - DNA, 22 bp, Homo sapiens
tggacatagatattttcacaat

SEQ ID NO: 5323559 - DNA, 14 bp, Homo sapiens
tggacatatgtata

SEQ ID NO: 5323560 - DNA, 14 bp, Homo sapiens
tggacatcaaaatc

SEQ ID NO: 5323561 - DNA, 18 bp, Homo sapiens
tggacatcacagcagaat

SEQ ID NO: 5323562 - DNA, 13 bp, Homo sapiens
tggacatcagtgt

SEQ ID NO: 5323563 - DNA, 14 bp, Homo sapiens
tggacatcctcctc

SEQ ID NO: 5323564 - DNA, 16 bp, Homo sapiens
tggacatcgatatgaa

SEQ ID NO: 5323565 - DNA, 18 bp, Homo sapiens
tggacatcgtaggcagcc

SEQ ID NO: 5323566 - DNA, 16 bp, Homo sapiens
tggacatctctctggc

SEQ ID NO: 5323567 - DNA, 16 bp, Homo sapiens
tggacatctgacccca

SEQ ID NO: 5323568 - DNA, 15 bp, Homo sapiens
tggacatgaaggaaa

SEQ ID NO: 5323569 - DNA, 23 bp, Homo sapiens
tggacatgagagtagggccctga

SEQ ID NO: 5323570 - DNA, 13 bp, Homo sapiens
tggacatgcacag

SEQ ID NO: 5323571 - DNA, 14 bp, Homo sapiens
tggacatgcctcaa

SEQ ID NO: 5323572 - DNA, 16 bp, Homo sapiens
tggacatgcctgtcct

SEQ ID NO: 5323573 - DNA, 17 bp, Homo sapiens
tggacatgcctgtcctg

SEQ ID NO: 5323574 - DNA, 21 bp, Homo sapiens
tggacatgcctgtcctgaaag

SEQ ID NO: 5323575 - DNA, 22 bp, Homo sapiens
tggacatggcaggccgatttgg

SEQ ID NO: 5323576 - DNA, 12 bp, Homo sapiens
tggacatggccc

SEQ ID NO: 5323577 - DNA, 17 bp, Homo sapiens
tggacatggcccattgg

SEQ ID NO: 5323578 - DNA, 18 bp, Homo sapiens
tggacatggcccattgga

SEQ ID NO: 5323579 - DNA, 21 bp, Homo sapiens
tggacatggcccattggagca

SEQ ID NO: 5323580 - DNA, 19 bp, Homo sapiens
tggacatggtcacagtcct

SEQ ID NO: 5323581 - DNA, 17 bp, Homo sapiens
tggacatggtctcctct

SEQ ID NO: 5323582 - DNA, 23 bp, Homo sapiens
tggacattaagcatcacaaatga

SEQ ID NO: 5323583 - DNA, 22 bp, Homo sapiens
tggacattctctttgataacaa

SEQ ID NO: 5323584 - DNA, 19 bp, Homo sapiens
tggacattgagatactatc

SEQ ID NO: 5323585 - DNA, 21 bp, Homo sapiens
tggacatttaacttttctacc

SEQ ID NO: 5323586 - DNA, 17 bp, Homo sapiens
tggacatttagaagaaa

SEQ ID NO: 5323587 - DNA, 16 bp, Homo sapiens
tggacatttatgtaca

SEQ ID NO: 5323588 - DNA, 23 bp, Homo sapiens
tggacatttcatataaatggaat

SEQ ID NO: 5323589 - DNA, 19 bp, Homo sapiens
tggacatttgccttgctgg

SEQ ID NO: 5323590 - DNA, 16 bp, Homo sapiens
tggacatttgtggcag

SEQ ID NO: 5323591 - DNA, 18 bp, Homo sapiens
tggacatttgtggcagtg

SEQ ID NO: 5323592 - DNA, 22 bp, Homo sapiens
tggaccaaaaaccagtattgta

SEQ ID NO: 5323593 - DNA, 17 bp, Homo sapiens
tggaccaaagccacctg

SEQ ID NO: 5323594 - DNA, 21 bp, Homo sapiens
tggaccaaagccacctgctgc

SEQ ID NO: 5323595 - DNA, 19 bp, Homo sapiens
tggaccaaaggaaggaagc

SEQ ID NO: 5323596 - DNA, 22 bp, Homo sapiens
tggaccaaagggaagtgaggcc

SEQ ID NO: 5323597 - DNA, 13 bp, Homo sapiens
tggaccaaatgta

SEQ ID NO: 5323598 - DNA, 14 bp, Homo sapiens
tggaccaaatgtaa

SEQ ID NO: 5323599 - DNA, 18 bp, Homo sapiens
tggaccaaatgtaaaata

SEQ ID NO: 5323600 - DNA, 16 bp, Homo sapiens
tggaccaaatgtgcca

SEQ ID NO: 5323601 - DNA, 17 bp, Homo sapiens
tggaccaacctgctctg

SEQ ID NO: 5323602 - DNA, 16 bp, Homo sapiens
tggaccaactgctttg

SEQ ID NO: 5323603 - DNA, 12 bp, Homo sapiens
tggaccaagaat

SEQ ID NO: 5323604 - DNA, 15 bp, Homo sapiens
tggaccaaggagcat

SEQ ID NO: 5323605 - DNA, 22 bp, Homo sapiens
tggaccaattattgatatatat

SEQ ID NO: 5323606 - DNA, 15 bp, Homo sapiens
tggaccacaggcatc

SEQ ID NO: 5323607 - DNA, 22 bp, Homo sapiens
tggaccacaggcatctacacag

SEQ ID NO: 5323608 - DNA, 19 bp, Homo sapiens
tggaccaccagccccagca

SEQ ID NO: 5323609 - DNA, 20 bp, Homo sapiens
tggaccaccagccccagcaa

SEQ ID NO: 5323610 - DNA, 22 bp, Homo sapiens
tggaccacgccgccctccatcc

SEQ ID NO: 5323611 - DNA, 15 bp, Homo sapiens
tggaccactcctcat

SEQ ID NO: 5323612 - DNA, 22 bp, Homo sapiens
tggaccactcctgaatgagact

SEQ ID NO: 5323613 - DNA, 18 bp, Homo sapiens
tggaccactgtttcttgc

SEQ ID NO: 5323614 - DNA, 20 bp, Homo sapiens
tggaccactgtttcttgctt

SEQ ID NO: 5323615 - DNA, 14 bp, Homo sapiens
tggaccagagactt

SEQ ID NO: 5323616 - DNA, 13 bp, Homo sapiens
tggaccagccgcc

SEQ ID NO: 5323617 - DNA, 15 bp, Homo sapiens
tggaccagctggcct

SEQ ID NO: 5323618 - DNA, 18 bp, Homo sapiens
tggaccagctggcctggg

SEQ ID NO: 5323619 - DNA, 18 bp, Homo sapiens
tggaccaggacaggacca

SEQ ID NO: 5323620 - DNA, 15 bp, Homo sapiens
tggaccaggcccata

SEQ ID NO: 5323621 - DNA, 16 bp, Homo sapiens
tggaccaggtcctgct

SEQ ID NO: 5323622 - DNA, 20 bp, Homo sapiens
tggaccagtcccgtcgtgca

SEQ ID NO: 5323623 - DNA, 18 bp, Homo sapiens
tggaccagtggtctcaca

SEQ ID NO: 5323624 - DNA, 19 bp, Homo sapiens
tggaccagtggtttccagt

SEQ ID NO: 5323625 - DNA, 14 bp, Homo sapiens
tggaccagttccct

SEQ ID NO: 5323626 - DNA, 19 bp, Homo sapiens
tggaccagttccctcagcc

SEQ ID NO: 5323627 - DNA, 22 bp, Homo sapiens
tggaccagttccctcagccctc

SEQ ID NO: 5323628 - DNA, 17 bp, Homo sapiens
tggaccatacgcggagg

SEQ ID NO: 5323629 - DNA, 22 bp, Homo sapiens
tggaccatagtcgggatgtcag

SEQ ID NO: 5323630 - DNA, 15 bp, Homo sapiens
tggaccatctctgta

SEQ ID NO: 5323631 - DNA, 22 bp, Homo sapiens
tggaccatgccagattctgcct

SEQ ID NO: 5323632 - DNA, 15 bp, Homo sapiens
tggaccatgctgaga

SEQ ID NO: 5323633 - DNA, 17 bp, Homo sapiens
tggaccatgctgagaca

SEQ ID NO: 5323634 - DNA, 19 bp, Homo sapiens
tggaccatggagtggcagc

SEQ ID NO: 5323635 - DNA, 15 bp, Homo sapiens
tggaccattcctgtc

SEQ ID NO: 5323636 - DNA, 21 bp, Homo sapiens
tggaccatttgattgttttat

SEQ ID NO: 5323637 - DNA, 14 bp, Homo sapiens
tggaccattttcct

SEQ ID NO: 5323638 - DNA, 15 bp, Homo sapiens
tggaccattttcctg

SEQ ID NO: 5323639 - DNA, 21 bp, Homo sapiens
tggacccaaggaaaactgcat

SEQ ID NO: 5323640 - DNA, 12 bp, Homo sapiens
tggacccacctg

SEQ ID NO: 5323641 - DNA, 14 bp, Homo sapiens
tggacccagacaca

SEQ ID NO: 5323642 - DNA, 18 bp, Homo sapiens
tggacccatgactctgta

SEQ ID NO: 5323643 - DNA, 13 bp, Homo sapiens
tggaccccagaga

SEQ ID NO: 5323644 - DNA, 13 bp, Homo sapiens
tggaccccagcct

SEQ ID NO: 5323645 - DNA, 16 bp, Homo sapiens
tggaccccagccttgg

SEQ ID NO: 5323646 - DNA, 15 bp, Homo sapiens
tggaccccaggctct

SEQ ID NO: 5323647 - DNA, 18 bp, Homo sapiens
tggaccccatctgtgaat

SEQ ID NO: 5323648 - DNA, 13 bp, Homo sapiens
tggacccccagct

SEQ ID NO: 5323649 - DNA, 20 bp, Homo sapiens
tggacccccctttcacaggc

SEQ ID NO: 5323650 - DNA, 22 bp, Homo sapiens
tggacccccctttcacaggcag

SEQ ID NO: 5323651 - DNA, 23 bp, Homo sapiens
tggacccccctttcacaggcagc

SEQ ID NO: 5323652 - DNA, 14 bp, Homo sapiens
tggaccccctgccc

SEQ ID NO: 5323653 - DNA, 13 bp, Homo sapiens
tggacccctgcat

SEQ ID NO: 5323654 - DNA, 16 bp, Homo sapiens
tggacccctgcattgg

SEQ ID NO: 5323655 - DNA, 13 bp, Homo sapiens
tggacccctggac

SEQ ID NO: 5323656 - DNA, 20 bp, Homo sapiens
tggacccctggggtggccag

SEQ ID NO: 5323657 - DNA, 20 bp, Homo sapiens
tggacccgcccgcggccctc

SEQ ID NO: 5323658 - DNA, 14 bp, Homo sapiens
tggacccgctctgg

SEQ ID NO: 5323659 - DNA, 16 bp, Homo sapiens
tggacccgctctggac

SEQ ID NO: 5323660 - DNA, 20 bp, Homo sapiens
tggacccgttcatgggggag

SEQ ID NO: 5323661 - DNA, 21 bp, Homo sapiens
tggacccgttcatgggggagg

SEQ ID NO: 5323662 - DNA, 15 bp, Homo sapiens
tggaccctgaccagc

SEQ ID NO: 5323663 - DNA, 18 bp, Homo sapiens
tggaccctgaccagctcc

SEQ ID NO: 5323664 - DNA, 13 bp, Homo sapiens
tggaccctgaggc

SEQ ID NO: 5323665 - DNA, 18 bp, Homo sapiens
tggaccctgaggcccaga

SEQ ID NO: 5323666 - DNA, 19 bp, Homo sapiens
tggaccctgaggcccagag

SEQ ID NO: 5323667 - DNA, 20 bp, Homo sapiens
tggaccctgaggcccagagg

SEQ ID NO: 5323668 - DNA, 21 bp, Homo sapiens
tggaccctgaggcccagaggg

SEQ ID NO: 5323669 - DNA, 16 bp, Homo sapiens
tggaccctgcttcacc

SEQ ID NO: 5323670 - DNA, 20 bp, Homo sapiens
tggaccctggtgacctcctg

SEQ ID NO: 5323671 - DNA, 21 bp, Homo sapiens
tggaccctggtgacctcctgt

SEQ ID NO: 5323672 - DNA, 23 bp, Homo sapiens
tggaccctggtgacctcctgtca

SEQ ID NO: 5323673 - DNA, 22 bp, Homo sapiens
tggagaccagaacagcatggcc

SEQ ID NO: 5323674 - DNA, 20 bp, Homo sapiens
tggagaccatgcagagcgcc

SEQ ID NO: 5323675 - DNA, 15 bp, Homo sapiens
tggagacccacaaag

SEQ ID NO: 5323676 - DNA, 19 bp, Homo sapiens
tggagaccctgccacagcc

SEQ ID NO: 5323677 - DNA, 16 bp, Homo sapiens
tggagaccctgcgccc

SEQ ID NO: 5323678 - DNA, 17 bp, Homo sapiens
tggagaccgaggccaga

SEQ ID NO: 5323679 - DNA, 15 bp, Homo sapiens
tggagaccggaattg

SEQ ID NO: 5323680 - DNA, 18 bp, Homo sapiens
tggagacctttctagaca

SEQ ID NO: 5323681 - DNA, 22 bp, Homo sapiens
tggagacgtggaacctctgtct

SEQ ID NO: 5323682 - DNA, 24 bp, Homo sapiens
tggagacgtggaacctctgtctca

SEQ ID NO: 5323683 - DNA, 17 bp, Homo sapiens
tggagacgtggtgggac

SEQ ID NO: 5323684 - DNA, 15 bp, Homo sapiens
tggagactaacttat

SEQ ID NO: 5323685 - DNA, 18 bp, Homo sapiens
tggagactaacttatttt

SEQ ID NO: 5323686 - DNA, 18 bp, Homo sapiens
tggagactaagccctgtc

SEQ ID NO: 5323687 - DNA, 22 bp, Homo sapiens
tggagactactggccccgcccg

SEQ ID NO: 5323688 - DNA, 18 bp, Homo sapiens
tggagactcctaggcagg

SEQ ID NO: 5323689 - DNA, 13 bp, Homo sapiens
tggagactcctgc

SEQ ID NO: 5323690 - DNA, 16 bp, Homo sapiens
tggagactcctggtct

SEQ ID NO: 5323691 - DNA, 19 bp, Homo sapiens
tggagactgatggccaggc

SEQ ID NO: 5323692 - DNA, 21 bp, Homo sapiens
tggagactgatggccaggcaa

SEQ ID NO: 5323693 - DNA, 22 bp, Homo sapiens
tggagactgcaagtaaggcttt

SEQ ID NO: 5323694 - DNA, 20 bp, Homo sapiens
tggagactgctcctgagccc

SEQ ID NO: 5323695 - DNA, 22 bp, Homo sapiens
tggagactgctcctgagccccc

SEQ ID NO: 5323696 - DNA, 18 bp, Homo sapiens
tggagactggggtggcct

SEQ ID NO: 5323697 - DNA, 22 bp, Homo sapiens
tggagactggggtggcctcaag

SEQ ID NO: 5323698 - DNA, 21 bp, Homo sapiens
tggagacttagggcaccaggg

SEQ ID NO: 5323699 - DNA, 14 bp, Homo sapiens
tggagactttctga

SEQ ID NO: 5323700 - DNA, 16 bp, Homo sapiens
tggagagaaaatacaa

SEQ ID NO: 5323701 - DNA, 21 bp, Homo sapiens
tggagagaaacaataaagaga

SEQ ID NO: 5323702 - DNA, 22 bp, Homo sapiens
tggagagaaacaataaagagat

SEQ ID NO: 5323703 - DNA, 13 bp, Homo sapiens
tggagagaaatat

SEQ ID NO: 5323704 - DNA, 13 bp, Homo sapiens
tggagagaagctg

SEQ ID NO: 5323705 - DNA, 20 bp, Homo sapiens
tggagagaagttgacatgga

SEQ ID NO: 5323706 - DNA, 13 bp, Homo sapiens
tggagagaagttt

SEQ ID NO: 5323707 - DNA, 20 bp, Homo sapiens
tggagagaccagcctttctt

SEQ ID NO: 5323708 - DNA, 21 bp, Homo sapiens
tggagagaccagcctttcttc

SEQ ID NO: 5323709 - DNA, 22 bp, Homo sapiens
tggagagaccagcctttcttcc

SEQ ID NO: 5323710 - DNA, 19 bp, Homo sapiens
tggagagagcagactggcg

SEQ ID NO: 5323711 - DNA, 14 bp, Homo sapiens
tggagagagcaggg

SEQ ID NO: 5323712 - DNA, 15 bp, Homo sapiens
tggagagagcagggc

SEQ ID NO: 5323713 - DNA, 17 bp, Homo sapiens
tggagagagcagggcta

SEQ ID NO: 5323714 - DNA, 19 bp, Homo sapiens
tggagagagtggtaaaaaa

SEQ ID NO: 5323715 - DNA, 22 bp, Homo sapiens
tggagagagtggtaaaaaagaa

SEQ ID NO: 5323716 - DNA, 14 bp, Homo sapiens
tggagagataggaa

SEQ ID NO: 5323717 - DNA, 14 bp, Homo sapiens
tggagagatgtttg

SEQ ID NO: 5323718 - DNA, 16 bp, Homo sapiens
tggagagcaaaggccc

SEQ ID NO: 5323719 - DNA, 13 bp, Homo sapiens
tggagagcagcag

SEQ ID NO: 5323720 - DNA, 15 bp, Homo sapiens
tggagagcagcaggt

SEQ ID NO: 5323721 - DNA, 13 bp, Homo sapiens
tggagagcagctg

SEQ ID NO: 5323722 - DNA, 19 bp, Homo sapiens
tggagagccagaacctgga

SEQ ID NO: 5323723 - DNA, 18 bp, Homo sapiens
tggagagccctgggaccg

SEQ ID NO: 5323724 - DNA, 20 bp, Homo sapiens
tggagagccctgggaccgct

SEQ ID NO: 5323725 - DNA, 20 bp, Homo sapiens
tggagagcctcttagtgatt

SEQ ID NO: 5323726 - DNA, 11 bp, Homo sapiens
tggagagcctg

SEQ ID NO: 5323727 - DNA, 21 bp, Homo sapiens
tggagagcgaggaggcgcggc

SEQ ID NO: 5323728 - DNA, 18 bp, Homo sapiens
tggagagctcagtacagg

SEQ ID NO: 5323729 - DNA, 15 bp, Homo sapiens
tggagagctggagcc

SEQ ID NO: 5323730 - DNA, 18 bp, Homo sapiens
tggagagctggagcctgg

SEQ ID NO: 5323731 - DNA, 16 bp, Homo sapiens
tggagagctggtgccc

SEQ ID NO: 5323732 - DNA, 20 bp, Homo sapiens
tggagagctgtcttcctgtg

SEQ ID NO: 5323733 - DNA, 18 bp, Homo sapiens
tggagagctttactttgt

SEQ ID NO: 5323734 - DNA, 11 bp, Homo sapiens
tggagaggaac

SEQ ID NO: 5323735 - DNA, 14 bp, Homo sapiens
tggagaggaagaaa

SEQ ID NO: 5323736 - DNA, 15 bp, Homo sapiens
tggagaggaagaaac

SEQ ID NO: 5323737 - DNA, 16 bp, Homo sapiens
tggagaggaagaaacg

SEQ ID NO: 5323738 - DNA, 21 bp, Homo sapiens
tggagaggacagagcaggggc

SEQ ID NO: 5323739 - DNA, 13 bp, Homo sapiens
tggagaggagaga

SEQ ID NO: 5323740 - DNA, 21 bp, Homo sapiens
tggagaggagagaatgagaga

SEQ ID NO: 5323741 - DNA, 22 bp, Homo sapiens
tggagaggagagaatgagagag

SEQ ID NO: 5323742 - DNA, 23 bp, Homo sapiens
tggagaggagagaatgagagagt

SEQ ID NO: 5323743 - DNA, 17 bp, Homo sapiens
tggagaggagccctgcc

SEQ ID NO: 5323744 - DNA, 18 bp, Homo sapiens
tggagaggagccctgcct

SEQ ID NO: 5323745 - DNA, 22 bp, Homo sapiens
tggagaggagggatgctgcctg

SEQ ID NO: 5323746 - DNA, 23 bp, Homo sapiens
tggagaggagggatgctgcctga

SEQ ID NO: 5323747 - DNA, 20 bp, Homo sapiens
tggagaggaggtgtggagtg

SEQ ID NO: 5323748 - DNA, 15 bp, Homo sapiens
tggagaggcctccct

SEQ ID NO: 5323749 - DNA, 13 bp, Homo sapiens
tggagaggcggcc

SEQ ID NO: 5323750 - DNA, 16 bp, Homo sapiens
tggagaggcttcccta

SEQ ID NO: 5323751 - DNA, 15 bp, Homo sapiens
tggagagggaatgtg

SEQ ID NO: 5323752 - DNA, 17 bp, Homo sapiens
tggagagggaatgtgaa

SEQ ID NO: 5323753 - DNA, 20 bp, Homo sapiens
tggagagggacagcccactg

SEQ ID NO: 5323754 - DNA, 18 bp, Homo sapiens
tggagagggacgaagaaa

SEQ ID NO: 5323755 - DNA, 20 bp, Homo sapiens
tggagagggacgaagaaagg

SEQ ID NO: 5323756 - DNA, 19 bp, Homo sapiens
tggagagggagactcctgg

SEQ ID NO: 5323757 - DNA, 24 bp, Homo sapiens
tggagagggctacaaaggaggaca

SEQ ID NO: 5323758 - DNA, 16 bp, Homo sapiens
tggagaggggcctggg

SEQ ID NO: 5323759 - DNA, 14 bp, Homo sapiens
tggagagggtctcg

SEQ ID NO: 5323760 - DNA, 16 bp, Homo sapiens
tggagaggtggctgcg

SEQ ID NO: 5323761 - DNA, 17 bp, Homo sapiens
tggagaggtggctgcgc

SEQ ID NO: 5323762 - DNA, 22 bp, Homo sapiens
tggagaggttataggtcactcc

SEQ ID NO: 5323763 - DNA, 16 bp, Homo sapiens
tggagaggtttgtcaa

SEQ ID NO: 5323764 - DNA, 21 bp, Homo sapiens
tggagagtacatttgctttaa

SEQ ID NO: 5323765 - DNA, 20 bp, Homo sapiens
tggagagtcttgggcctggc

SEQ ID NO: 5323766 - DNA, 17 bp, Homo sapiens
tggagagtgagagcatg

SEQ ID NO: 5323767 - DNA, 19 bp, Homo sapiens
tggagagtgagagcatgtg

SEQ ID NO: 5323768 - DNA, 13 bp, Homo sapiens
tggagagtgcaca

SEQ ID NO: 5323769 - DNA, 18 bp, Homo sapiens
tggagagtgcactgacct

SEQ ID NO: 5323770 - DNA, 17 bp, Homo sapiens
tggagagtggggagagg

SEQ ID NO: 5323771 - DNA, 19 bp, Homo sapiens
tggagagtggggagaggca

SEQ ID NO: 5323772 - DNA, 15 bp, Homo sapiens
tggagagtttcctga

SEQ ID NO: 5323773 - DNA, 14 bp, Homo sapiens
tggagataataaaa

SEQ ID NO: 5323774 - DNA, 22 bp, Homo sapiens
tggagatatgcattcaagagag

SEQ ID NO: 5323775 - DNA, 22 bp, Homo sapiens
tggagatattataagggagagc

SEQ ID NO: 5323776 - DNA, 23 bp, Homo sapiens
tggagatatttatggggggagaa

SEQ ID NO: 5323777 - DNA, 15 bp, Homo sapiens
tggagatcacagccc

SEQ ID NO: 5323778 - DNA, 23 bp, Homo sapiens
tggagatcacagccccacccttg

SEQ ID NO: 5323779 - DNA, 14 bp, Homo sapiens
tggagatcaggagt

SEQ ID NO: 5323780 - DNA, 18 bp, Homo sapiens
tggagatcaggagtgaca

SEQ ID NO: 5323781 - DNA, 21 bp, Homo sapiens
tggagatcctcctgcagacca

SEQ ID NO: 5323782 - DNA, 19 bp, Homo sapiens
tggagatcgcttttctcag

SEQ ID NO: 5323783 - DNA, 19 bp, Homo sapiens
tggagatctgaacccagct

SEQ ID NO: 5323784 - DNA, 20 bp, Homo sapiens
tggagatctgaacccagctg

SEQ ID NO: 5323785 - DNA, 14 bp, Homo sapiens
tggagatgaggcca

SEQ ID NO: 5323786 - DNA, 11 bp, Homo sapiens
tggagatgatg

SEQ ID NO: 5323787 - DNA, 12 bp, Homo sapiens
tggagatgatga

SEQ ID NO: 5323788 - DNA, 14 bp, Homo sapiens
tggagatgcagagg

SEQ ID NO: 5323789 - DNA, 22 bp, Homo sapiens
tggagatgcatcgggaaagaag

SEQ ID NO: 5323790 - DNA, 15 bp, Homo sapiens
tggagatggaagctt

SEQ ID NO: 5323791 - DNA, 16 bp, Homo sapiens
tggagatggaagcttg

SEQ ID NO: 5323792 - DNA, 22 bp, Homo sapiens
tggagatggaagcttgttgaaa

SEQ ID NO: 5323793 - DNA, 14 bp, Homo sapiens
tggagatggatcct

SEQ ID NO: 5323794 - DNA, 21 bp, Homo sapiens
tggagatggctgctgctcacc

SEQ ID NO: 5323795 - DNA, 14 bp, Homo sapiens
tggagatgggaagg

SEQ ID NO: 5323796 - DNA, 15 bp, Homo sapiens
tggagatggggagaa

SEQ ID NO: 5323797 - DNA, 19 bp, Homo sapiens
tggagatgggtgattctct

SEQ ID NO: 5323798 - DNA, 18 bp, Homo sapiens
tggagatgtaaaatgagt

SEQ ID NO: 5323799 - DNA, 14 bp, Homo sapiens
tggagattaagatg

SEQ ID NO: 5323800 - DNA, 18 bp, Homo sapiens
tggagattaagatgcctt

SEQ ID NO: 5323801 - DNA, 15 bp, Homo sapiens
tggagattataataa

SEQ ID NO: 5323802 - DNA, 22 bp, Homo sapiens
tggagattctaatcccaacaag

SEQ ID NO: 5323803 - DNA, 16 bp, Homo sapiens
tggagattctgattca

SEQ ID NO: 5323804 - DNA, 19 bp, Homo sapiens
tggagatttgaaggtctgc

SEQ ID NO: 5323805 - DNA, 20 bp, Homo sapiens
tggagattttttttttaatc

SEQ ID NO: 5323806 - DNA, 18 bp, Homo sapiens
tggagcaaaacaaagctg

SEQ ID NO: 5323807 - DNA, 18 bp, Homo sapiens
tggagcaaaaggcagctc

SEQ ID NO: 5323808 - DNA, 21 bp, Homo sapiens
tggagcaaagtgagggccgag

SEQ ID NO: 5323809 - DNA, 18 bp, Homo sapiens
tggagcaaagtggtaggt

SEQ ID NO: 5323810 - DNA, 21 bp, Homo sapiens
tggagcaacctactgtctaag

SEQ ID NO: 5323811 - DNA, 13 bp, Homo sapiens
tggagcaactgaa

SEQ ID NO: 5323812 - DNA, 15 bp, Homo sapiens
tggagcaagaaggaa

SEQ ID NO: 5323813 - DNA, 18 bp, Homo sapiens
tggagcaagaaggaagga

SEQ ID NO: 5323814 - DNA, 14 bp, Homo sapiens
tggagcaagagaga

SEQ ID NO: 5323815 - DNA, 16 bp, Homo sapiens
tggagcaagagagagc

SEQ ID NO: 5323816 - DNA, 15 bp, Homo sapiens
tggagcaagccctga

SEQ ID NO: 5323817 - DNA, 15 bp, Homo sapiens
tggagcaagctctgc

SEQ ID NO: 5323818 - DNA, 20 bp, Homo sapiens
tggagcaagctctgccctgg

SEQ ID NO: 5323819 - DNA, 23 bp, Homo sapiens
tggagcaagctcttcccttgctc

SEQ ID NO: 5323820 - DNA, 18 bp, Homo sapiens
tggagcaatcacagatga

SEQ ID NO: 5323821 - DNA, 23 bp, Homo sapiens
tggagcacatgttactgcttcat

SEQ ID NO: 5323822 - DNA, 14 bp, Homo sapiens
tggagcacctgggc

SEQ ID NO: 5323823 - DNA, 17 bp, Homo sapiens
tggagcactgggctccc

SEQ ID NO: 5323824 - DNA, 21 bp, Homo sapiens
tggagcacttgttttaaaatg

SEQ ID NO: 5323825 - DNA, 19 bp, Homo sapiens
tggagcagaaagccagggt

SEQ ID NO: 5323826 - DNA, 22 bp, Homo sapiens
tggagcagaaagccagggtcct

SEQ ID NO: 5323827 - DNA, 14 bp, Homo sapiens
tggagcagaagcag

SEQ ID NO: 5323828 - DNA, 15 bp, Homo sapiens
tggagcagaagcagc

SEQ ID NO: 5323829 - DNA, 14 bp, Homo sapiens
tggagcagaatcag

SEQ ID NO: 5323830 - DNA, 15 bp, Homo sapiens
tggagcagaatcagt

SEQ ID NO: 5323831 - DNA, 13 bp, Homo sapiens
tggagcagaccac

SEQ ID NO: 5323832 - DNA, 17 bp, Homo sapiens
tggagcagaccaccccg

SEQ ID NO: 5323833 - DNA, 18 bp, Homo sapiens
tggagcagagacggcagc

SEQ ID NO: 5323834 - DNA, 21 bp, Homo sapiens
tggagcagagacggcagcccc

SEQ ID NO: 5323835 - DNA, 22 bp, Homo sapiens
tggagcagagacggcagcccca

SEQ ID NO: 5323836 - DNA, 22 bp, Homo sapiens
tggagcagagcaagtctgcagg

SEQ ID NO: 5323837 - DNA, 17 bp, Homo sapiens
tggagcagaggggctga

SEQ ID NO: 5323838 - DNA, 15 bp, Homo sapiens
tggagcagaggtggg

SEQ ID NO: 5323839 - DNA, 14 bp, Homo sapiens
tggagcagccagag

SEQ ID NO: 5323840 - DNA, 16 bp, Homo sapiens
tggagcagccagagct

SEQ ID NO: 5323841 - DNA, 21 bp, Homo sapiens
tggagcagccagagctgtgcc

SEQ ID NO: 5323842 - DNA, 14 bp, Homo sapiens
tggagcagccccca

SEQ ID NO: 5323843 - DNA, 15 bp, Homo sapiens
tggagcaggactccc

SEQ ID NO: 5323844 - DNA, 13 bp, Homo sapiens
tggagcaggagcc

SEQ ID NO: 5323845 - DNA, 18 bp, Homo sapiens
tggagcaggagccccgcc

SEQ ID NO: 5323846 - DNA, 12 bp, Homo sapiens
tggagcaggccc

SEQ ID NO: 5323847 - DNA, 18 bp, Homo sapiens
tggagcaggcggtgggga

SEQ ID NO: 5323848 - DNA, 22 bp, Homo sapiens
tggagcaggcggtggggagaga

SEQ ID NO: 5323849 - DNA, 19 bp, Homo sapiens
tggagcagggacagatcat

SEQ ID NO: 5323850 - DNA, 23 bp, Homo sapiens
tggagcaggggttggtcaaggcc

SEQ ID NO: 5323851 - DNA, 19 bp, Homo sapiens
tggagcagtaatgcagcat

SEQ ID NO: 5323852 - DNA, 19 bp, Homo sapiens
tggagcagtttggggcagg

SEQ ID NO: 5323853 - DNA, 15 bp, Homo sapiens
tggagcatctgactc

SEQ ID NO: 5323854 - DNA, 19 bp, Homo sapiens
tggagcatttatgtagaca

SEQ ID NO: 5323855 - DNA, 21 bp, Homo sapiens
tggagcatttctcatcagtag

SEQ ID NO: 5323856 - DNA, 18 bp, Homo sapiens
tggagccaacacttgaac

SEQ ID NO: 5323857 - DNA, 17 bp, Homo sapiens
tggagccaatggagact

SEQ ID NO: 5323858 - DNA, 22 bp, Homo sapiens
tggagccacctgtcccacctca

SEQ ID NO: 5323859 - DNA, 18 bp, Homo sapiens
tggagccactcctgtccc

SEQ ID NO: 5323860 - DNA, 19 bp, Homo sapiens
tggagccactcctgtcccg

SEQ ID NO: 5323861 - DNA, 16 bp, Homo sapiens
tggagccactctgttc

SEQ ID NO: 5323862 - DNA, 11 bp, Homo sapiens
tggagccagag

SEQ ID NO: 5323863 - DNA, 13 bp, Homo sapiens
tggagccagagag

SEQ ID NO: 5323864 - DNA, 13 bp, Homo sapiens
tggagccagcagg

SEQ ID NO: 5323865 - DNA, 20 bp, Homo sapiens
tggagccagcagggctgtga

SEQ ID NO: 5323866 - DNA, 13 bp, Homo sapiens
tggagccagctcc

SEQ ID NO: 5323867 - DNA, 11 bp, Homo sapiens
tggagccaggc

SEQ ID NO: 5323868 - DNA, 13 bp, Homo sapiens
tggagccaggcgt

SEQ ID NO: 5323869 - DNA, 15 bp, Homo sapiens
tggagccaggcgtgt

SEQ ID NO: 5323870 - DNA, 18 bp, Homo sapiens
tggagccagggcagagga

SEQ ID NO: 5323871 - DNA, 22 bp, Homo sapiens
tggagccagggcagaggaatgt

SEQ ID NO: 5323872 - DNA, 23 bp, Homo sapiens
tggagccattgaacagctgtgag

SEQ ID NO: 5323873 - DNA, 17 bp, Homo sapiens
tggagcccacagcgagc

SEQ ID NO: 5323874 - DNA, 19 bp, Homo sapiens
tggagcccacagcgagcct

SEQ ID NO: 5323875 - DNA, 20 bp, Homo sapiens
tggagcccacagcgagcctg

SEQ ID NO: 5323876 - DNA, 22 bp, Homo sapiens
tggagcccacagcgagcctgtg

SEQ ID NO: 5323877 - DNA, 19 bp, Homo sapiens
tggagcccactgtacttgc

SEQ ID NO: 5323878 - DNA, 14 bp, Homo sapiens
tggagcccaggagt

SEQ ID NO: 5323879 - DNA, 18 bp, Homo sapiens
tggagcccaggcgggagc

SEQ ID NO: 5323880 - DNA, 14 bp, Homo sapiens
tggagcccagggca

SEQ ID NO: 5323881 - DNA, 14 bp, Homo sapiens
tggagccccacact

SEQ ID NO: 5323882 - DNA, 15 bp, Homo sapiens
tggagccccacactg

SEQ ID NO: 5323883 - DNA, 18 bp, Homo sapiens
tggagccccaccttgtct

SEQ ID NO: 5323884 - DNA, 22 bp, Homo sapiens
tggagccccaccttgtctgcta

SEQ ID NO: 5323885 - DNA, 18 bp, Homo sapiens
tggagccccactgccctt

SEQ ID NO: 5323886 - DNA, 22 bp, Homo sapiens
tggagccccagccccctttggg

SEQ ID NO: 5323887 - DNA, 15 bp, Homo sapiens
tggagcccccagcag

SEQ ID NO: 5323888 - DNA, 21 bp, Homo sapiens
tggagccccctggcggcaggg

SEQ ID NO: 5323889 - DNA, 22 bp, Homo sapiens
tggagccccctggcggcagggg

SEQ ID NO: 5323890 - DNA, 16 bp, Homo sapiens
tggagcccctcctccc

SEQ ID NO: 5323891 - DNA, 12 bp, Homo sapiens
tggagcccctgg

SEQ ID NO: 5323892 - DNA, 18 bp, Homo sapiens
tggagccccttcgggagc

SEQ ID NO: 5323893 - DNA, 18 bp, Homo sapiens
tggagcccgagggcctga

SEQ ID NO: 5323894 - DNA, 22 bp, Homo sapiens
tggagcccgagggcctgacagg

SEQ ID NO: 5323895 - DNA, 14 bp, Homo sapiens
tggagcccgcactg

SEQ ID NO: 5323896 - DNA, 13 bp, Homo sapiens
tggagccctggag

SEQ ID NO: 5323897 - DNA, 12 bp, Homo sapiens
tggagccgaggc

SEQ ID NO: 5323898 - DNA, 19 bp, Homo sapiens
tggagccgcttccccagct

SEQ ID NO: 5323899 - DNA, 21 bp, Homo sapiens
tggagccgcttccccagctca

SEQ ID NO: 5323900 - DNA, 15 bp, Homo sapiens
tggagcctcagcagc

SEQ ID NO: 5323901 - DNA, 18 bp, Homo sapiens
tggagcctctttttcctt

SEQ ID NO: 5323902 - DNA, 22 bp, Homo sapiens
tggagcctctttttccttcttc

SEQ ID NO: 5323903 - DNA, 16 bp, Homo sapiens
tggagcctgaacatga

SEQ ID NO: 5323904 - DNA, 21 bp, Homo sapiens
tggagcctgaaccgtgtgctc

SEQ ID NO: 5323905 - DNA, 11 bp, Homo sapiens
tggagcctgca

SEQ ID NO: 5323906 - DNA, 23 bp, Homo sapiens
tggagcctgcacggtgaatggct

SEQ ID NO: 5323907 - DNA, 13 bp, Homo sapiens
tggagcctgcagg

SEQ ID NO: 5323908 - DNA, 15 bp, Homo sapiens
tggagcctgcagggt

SEQ ID NO: 5323909 - DNA, 15 bp, Homo sapiens
tggagcctgccaaga

SEQ ID NO: 5323910 - DNA, 20 bp, Homo sapiens
tggagcctgcggggcagcag

SEQ ID NO: 5323911 - DNA, 21 bp, Homo sapiens
tggagcctgcggggcagcagg

SEQ ID NO: 5323912 - DNA, 13 bp, Homo sapiens
tggagcctggaac

SEQ ID NO: 5323913 - DNA, 20 bp, Homo sapiens
tggagcctggaactgcatca

SEQ ID NO: 5323914 - DNA, 18 bp, Homo sapiens
tggagcctggcacaggac

SEQ ID NO: 5323915 - DNA, 15 bp, Homo sapiens
tggagcctgggcagc

SEQ ID NO: 5323916 - DNA, 17 bp, Homo sapiens
tggagcctgggcagcac

SEQ ID NO: 5323917 - DNA, 13 bp, Homo sapiens
tggagcctggtgc

SEQ ID NO: 5323918 - DNA, 14 bp, Homo sapiens
tggagcctggtgcc

SEQ ID NO: 5323919 - DNA, 18 bp, Homo sapiens
tggagcctgtgtaacagc

SEQ ID NO: 5323920 - DNA, 20 bp, Homo sapiens
tggagcctgtgtaacagctc

SEQ ID NO: 5323921 - DNA, 22 bp, Homo sapiens
tggagcctgtgtaacagctcct

SEQ ID NO: 5323922 - DNA, 23 bp, Homo sapiens
tggagccttccaccggcactcat

SEQ ID NO: 5323923 - DNA, 14 bp, Homo sapiens
tggagcgcacctgc

SEQ ID NO: 5323924 - DNA, 16 bp, Homo sapiens
tggagcggagcttgcc

SEQ ID NO: 5323925 - DNA, 17 bp, Homo sapiens
tggagcggagcttgcct

SEQ ID NO: 5323926 - DNA, 22 bp, Homo sapiens
tggagcggagcttgcctgcctg

SEQ ID NO: 5323927 - DNA, 14 bp, Homo sapiens
tggagcggctctcc

SEQ ID NO: 5323928 - DNA, 14 bp, Homo sapiens
tggagcgtccttgt

SEQ ID NO: 5323929 - DNA, 17 bp, Homo sapiens
tggagcgtttgctgtgc

SEQ ID NO: 5323930 - DNA, 22 bp, Homo sapiens
tggagcgtttgctgtgccagga

SEQ ID NO: 5323931 - DNA, 15 bp, Homo sapiens
tggagctaaggccag

SEQ ID NO: 5323932 - DNA, 14 bp, Homo sapiens
tggagctagaaaat

SEQ ID NO: 5323933 - DNA, 14 bp, Homo sapiens
tggagctagagagg

SEQ ID NO: 5323934 - DNA, 20 bp, Homo sapiens
tggagctagtgtctcctctc

SEQ ID NO: 5323935 - DNA, 13 bp, Homo sapiens
tggagctcaagcc

SEQ ID NO: 5323936 - DNA, 21 bp, Homo sapiens
tggagctcaggtttctggaca

SEQ ID NO: 5323937 - DNA, 22 bp, Homo sapiens
tggagctcattttccacatggc

SEQ ID NO: 5323938 - DNA, 15 bp, Homo sapiens
tggagctccagcctg

SEQ ID NO: 5323939 - DNA, 16 bp, Homo sapiens
tggagctccagcctga

SEQ ID NO: 5323940 - DNA, 18 bp, Homo sapiens
tggagctcctccctccag

SEQ ID NO: 5323941 - DNA, 19 bp, Homo sapiens
tggagctcctccctccagc

SEQ ID NO: 5323942 - DNA, 13 bp, Homo sapiens
tggagctcctggg

SEQ ID NO: 5323943 - DNA, 22 bp, Homo sapiens
tggagctcgcccctcccctcag

SEQ ID NO: 5323944 - DNA, 14 bp, Homo sapiens
tggagctcgtggaa

SEQ ID NO: 5323945 - DNA, 21 bp, Homo sapiens
tggagctcgtgggacagtcac

SEQ ID NO: 5323946 - DNA, 23 bp, Homo sapiens
tggagctctgtgggtctctggaa

SEQ ID NO: 5323947 - DNA, 23 bp, Homo sapiens
tggagctcttggaagagctcttc

SEQ ID NO: 5323948 - DNA, 16 bp, Homo sapiens
tggagctcttgttgca

SEQ ID NO: 5323949 - DNA, 19 bp, Homo sapiens
tggagctgaatttgataaa

SEQ ID NO: 5323950 - DNA, 20 bp, Homo sapiens
tggagctgagaagaggagga

SEQ ID NO: 5323951 - DNA, 20 bp, Homo sapiens
tggagctgagatgagcccca

SEQ ID NO: 5323952 - DNA, 12 bp, Homo sapiens
tggagctgagca

SEQ ID NO: 5323953 - DNA, 15 bp, Homo sapiens
tggagctgagcctct

SEQ ID NO: 5323954 - DNA, 22 bp, Homo sapiens
tggagctgagctacctggggtg

SEQ ID NO: 5323955 - DNA, 21 bp, Homo sapiens
tggagctgaggactctcacga

SEQ ID NO: 5323956 - DNA, 20 bp, Homo sapiens
tggagctgccagcaccaagc

SEQ ID NO: 5323957 - DNA, 20 bp, Homo sapiens
tggagctgccgtgcctgtgt

SEQ ID NO: 5323958 - DNA, 13 bp, Homo sapiens
tggagctgcctga

SEQ ID NO: 5323959 - DNA, 15 bp, Homo sapiens
tggagctgcctgata

SEQ ID NO: 5323960 - DNA, 13 bp, Homo sapiens
tggagctgctgtt

SEQ ID NO: 5323961 - DNA, 23 bp, Homo sapiens
tggagctgggagacaaaggagga

SEQ ID NO: 5323962 - DNA, 21 bp, Homo sapiens
tggagctgtcacctctcagct

SEQ ID NO: 5323963 - DNA, 12 bp, Homo sapiens
tggagctgtcct

SEQ ID NO: 5323964 - DNA, 17 bp, Homo sapiens
tggagctgtctgtctct

SEQ ID NO: 5323965 - DNA, 14 bp, Homo sapiens
tggagctgttccat

SEQ ID NO: 5323966 - DNA, 16 bp, Homo sapiens
tggagcttaagccact

SEQ ID NO: 5323967 - DNA, 19 bp, Homo sapiens
tggagcttcagccaggtct

SEQ ID NO: 5323968 - DNA, 20 bp, Homo sapiens
tggagcttcagccaggtctg

SEQ ID NO: 5323969 - DNA, 17 bp, Homo sapiens
tggagcttcatcggggt

SEQ ID NO: 5323970 - DNA, 21 bp, Homo sapiens
tggagcttcatggcagaaggc

SEQ ID NO: 5323971 - DNA, 13 bp, Homo sapiens
tggagcttggagc

SEQ ID NO: 5323972 - DNA, 20 bp, Homo sapiens
tggagcttggagccccctgg

SEQ ID NO: 5323973 - DNA, 18 bp, Homo sapiens
tggagcttgtacatattg

SEQ ID NO: 5323974 - DNA, 21 bp, Homo sapiens
tggagcttgtggagttgatga

SEQ ID NO: 5323975 - DNA, 22 bp, Homo sapiens
tggagctttagcttctctgcca

SEQ ID NO: 5323976 - DNA, 15 bp, Homo sapiens
tggagctttctgtat

SEQ ID NO: 5323977 - DNA, 16 bp, Homo sapiens
tggagctttgcagcca

SEQ ID NO: 5323978 - DNA, 16 bp, Homo sapiens
tggagctttggaatat

SEQ ID NO: 5323979 - DNA, 22 bp, Homo sapiens
tggagcttttaaaaatgtttgg

SEQ ID NO: 5323980 - DNA, 21 bp, Homo sapiens
tggagcttttttctttaagat

SEQ ID NO: 5323981 - DNA, 23 bp, Homo sapiens
tggaggaaaaccaagccgtggct

SEQ ID NO: 5323982 - DNA, 13 bp, Homo sapiens
tggaggaaagcaa

SEQ ID NO: 5323983 - DNA, 14 bp, Homo sapiens
tggaggaaagcaac

SEQ ID NO: 5323984 - DNA, 19 bp, Homo sapiens
tggaggaacaactctccag

SEQ ID NO: 5323985 - DNA, 20 bp, Homo sapiens
tggaggaacaatcggctgca

SEQ ID NO: 5323986 - DNA, 12 bp, Homo sapiens
tggaggaacagc

SEQ ID NO: 5323987 - DNA, 22 bp, Homo sapiens
tggaggaaccacatataacact

SEQ ID NO: 5323988 - DNA, 22 bp, Homo sapiens
tggaggaacttgctgctgtgcc

SEQ ID NO: 5323989 - DNA, 23 bp, Homo sapiens
tggaggaacttgctgctgtgcct

SEQ ID NO: 5323990 - DNA, 18 bp, Homo sapiens
tggaggaagagggacaga

SEQ ID NO: 5323991 - DNA, 22 bp, Homo sapiens
tggaggaagatccaaacagaaa

SEQ ID NO: 5323992 - DNA, 21 bp, Homo sapiens
tggaggaagcatccaaagatt

SEQ ID NO: 5323993 - DNA, 14 bp, Homo sapiens
tggaggaagcccac

SEQ ID NO: 5323994 - DNA, 15 bp, Homo sapiens
tggaggaaggaaaca

SEQ ID NO: 5323995 - DNA, 18 bp, Homo sapiens
tggaggaaggctctgtca

SEQ ID NO: 5323996 - DNA, 19 bp, Homo sapiens
tggaggaaggctctgtcac

SEQ ID NO: 5323997 - DNA, 17 bp, Homo sapiens
tggaggaagtggggtct

SEQ ID NO: 5323998 - DNA, 18 bp, Homo sapiens
tggaggaagtggggtctg

SEQ ID NO: 5323999 - DNA, 22 bp, Homo sapiens
tggaggaagttctccagcttca

SEQ ID NO: 5324000 - DNA, 18 bp, Homo sapiens
tggaggaatacattttat

SEQ ID NO: 5324001 - DNA, 21 bp, Homo sapiens
tggaggaatacattttattct

SEQ ID NO: 5324002 - DNA, 17 bp, Homo sapiens
tggaggaatcaccccat

SEQ ID NO: 5324003 - DNA, 17 bp, Homo sapiens
tggaggaatgctccccc

SEQ ID NO: 5324004 - DNA, 22 bp, Homo sapiens
tggaggaatgctcccccatcct

SEQ ID NO: 5324005 - DNA, 18 bp, Homo sapiens
tggaggaattcagctcag

SEQ ID NO: 5324006 - DNA, 18 bp, Homo sapiens
tggaggaattgggacctg

SEQ ID NO: 5324007 - DNA, 21 bp, Homo sapiens
tggaggaattgggacctggtt

SEQ ID NO: 5324008 - DNA, 12 bp, Homo sapiens
tggaggacagac

SEQ ID NO: 5324009 - DNA, 11 bp, Homo sapiens
tggaggacagt

SEQ ID NO: 5324010 - DNA, 13 bp, Homo sapiens
tggaggacagtgg

SEQ ID NO: 5324011 - DNA, 21 bp, Homo sapiens
tggaggacagtggcacaatca

SEQ ID NO: 5324012 - DNA, 20 bp, Homo sapiens
tggaggaccaaaaaaataag

SEQ ID NO: 5324013 - DNA, 21 bp, Homo sapiens
tggaggaccccgagggctgag

SEQ ID NO: 5324014 - DNA, 21 bp, Homo sapiens
tggaggaccgaggctacagct

SEQ ID NO: 5324015 - DNA, 14 bp, Homo sapiens
tggaggacctgagc

SEQ ID NO: 5324016 - DNA, 17 bp, Homo sapiens
tggaggacctgagcctg

SEQ ID NO: 5324017 - DNA, 20 bp, Homo sapiens
tggaggactagaacctggag

SEQ ID NO: 5324018 - DNA, 14 bp, Homo sapiens
tggaggagaaataa

SEQ ID NO: 5324019 - DNA, 15 bp, Homo sapiens
tggaggagaaataaa

SEQ ID NO: 5324020 - DNA, 17 bp, Homo sapiens
tggaggagaaggaggaa

SEQ ID NO: 5324021 - DNA, 17 bp, Homo sapiens
tggaggagacaggaagc

SEQ ID NO: 5324022 - DNA, 20 bp, Homo sapiens
tggaggagacgtccaccctg

SEQ ID NO: 5324023 - DNA, 13 bp, Homo sapiens
tggaggagactgg

SEQ ID NO: 5324024 - DNA, 11 bp, Homo sapiens
tggaggagaga

SEQ ID NO: 5324025 - DNA, 16 bp, Homo sapiens
tggaggagagagaccc

SEQ ID NO: 5324026 - DNA, 17 bp, Homo sapiens
tggaggagagagccttg

SEQ ID NO: 5324027 - DNA, 22 bp, Homo sapiens
tggccccctcagctctgtcctg

SEQ ID NO: 5324028 - DNA, 18 bp, Homo sapiens
tggccccctcgcgcccct

SEQ ID NO: 5324029 - DNA, 13 bp, Homo sapiens
tggccccctgtcc

SEQ ID NO: 5324030 - DNA, 17 bp, Homo sapiens
tggccccctgtgccagc

SEQ ID NO: 5324031 - DNA, 24 bp, Homo sapiens
tggccccctgtgccagctcaggtg

SEQ ID NO: 5324032 - DNA, 19 bp, Homo sapiens
tggcccccttcaggagcct

SEQ ID NO: 5324033 - DNA, 20 bp, Homo sapiens
tggcccccttcaggagcctg

SEQ ID NO: 5324034 - DNA, 17 bp, Homo sapiens
tggccccctttcccggg

SEQ ID NO: 5324035 - DNA, 17 bp, Homo sapiens
tggccccgcccgagccc

SEQ ID NO: 5324036 - DNA, 20 bp, Homo sapiens
tggccccgcccgagcccctg

SEQ ID NO: 5324037 - DNA, 19 bp, Homo sapiens
tggccccgcctgcctgcca

SEQ ID NO: 5324038 - DNA, 19 bp, Homo sapiens
tggccccgggctctggcca

SEQ ID NO: 5324039 - DNA, 23 bp, Homo sapiens
tggccccgggctctggccaccct

SEQ ID NO: 5324040 - DNA, 16 bp, Homo sapiens
tggccccgtttctggt

SEQ ID NO: 5324041 - DNA, 17 bp, Homo sapiens
tggcccctcacatcctc

SEQ ID NO: 5324042 - DNA, 18 bp, Homo sapiens
tggcccctcacatcctct

SEQ ID NO: 5324043 - DNA, 21 bp, Homo sapiens
tggcccctcacctgggcacct

SEQ ID NO: 5324044 - DNA, 18 bp, Homo sapiens
tggcccctcacctgggcc

SEQ ID NO: 5324045 - DNA, 19 bp, Homo sapiens
tggcccctcacctgggcct

SEQ ID NO: 5324046 - DNA, 20 bp, Homo sapiens
tggcccctcagggtccctgg

SEQ ID NO: 5324047 - DNA, 21 bp, Homo sapiens
tggcccctcagggtccctggt

SEQ ID NO: 5324048 - DNA, 11 bp, Homo sapiens
tggcccctcca

SEQ ID NO: 5324049 - DNA, 21 bp, Homo sapiens
tggcccctccagaccctgcct

SEQ ID NO: 5324050 - DNA, 16 bp, Homo sapiens
tggcccctccagcaca

SEQ ID NO: 5324051 - DNA, 16 bp, Homo sapiens
tggcccctcccacatc

SEQ ID NO: 5324052 - DNA, 17 bp, Homo sapiens
tggcccctcccacatcc

SEQ ID NO: 5324053 - DNA, 19 bp, Homo sapiens
tggcccctcccacatcccc

SEQ ID NO: 5324054 - DNA, 20 bp, Homo sapiens
tggcccctcccacatccccc

SEQ ID NO: 5324055 - DNA, 19 bp, Homo sapiens
tggcccctccccctgccag

SEQ ID NO: 5324056 - DNA, 14 bp, Homo sapiens
tggcccctcccctg

SEQ ID NO: 5324057 - DNA, 17 bp, Homo sapiens
tggcccctccttctccc

SEQ ID NO: 5324058 - DNA, 13 bp, Homo sapiens
tggcccctcgcct

SEQ ID NO: 5324059 - DNA, 18 bp, Homo sapiens
tggcccctctgacctgca

SEQ ID NO: 5324060 - DNA, 14 bp, Homo sapiens
tggcccctgaacaa

SEQ ID NO: 5324061 - DNA, 15 bp, Homo sapiens
tggcccctgagccca

SEQ ID NO: 5324062 - DNA, 16 bp, Homo sapiens
tggcccctgagcccag

SEQ ID NO: 5324063 - DNA, 19 bp, Homo sapiens
tggcccctgcccccaaagg

SEQ ID NO: 5324064 - DNA, 21 bp, Homo sapiens
tggcccctgctgtctctctgg

SEQ ID NO: 5324065 - DNA, 13 bp, Homo sapiens
tggccccttcact

SEQ ID NO: 5324066 - DNA, 17 bp, Homo sapiens
tggccccttctccagca

SEQ ID NO: 5324067 - DNA, 17 bp, Homo sapiens
tggccccttttactttt

SEQ ID NO: 5324068 - DNA, 20 bp, Homo sapiens
tggcccgaagcgtgcggggc

SEQ ID NO: 5324069 - DNA, 19 bp, Homo sapiens
tggcccgacagcctggcac

SEQ ID NO: 5324070 - DNA, 18 bp, Homo sapiens
tggcccgagagctgggac

SEQ ID NO: 5324071 - DNA, 19 bp, Homo sapiens
tggcccgcaagagggacag

SEQ ID NO: 5324072 - DNA, 21 bp, Homo sapiens
tggcccgcaagagggacagag

SEQ ID NO: 5324073 - DNA, 22 bp, Homo sapiens
tggcccgcgtctagcttagttt

SEQ ID NO: 5324074 - DNA, 14 bp, Homo sapiens
tggcccggatgctg

SEQ ID NO: 5324075 - DNA, 15 bp, Homo sapiens
tggcccggcccctcc

SEQ ID NO: 5324076 - DNA, 16 bp, Homo sapiens
tggcccggccggcctg

SEQ ID NO: 5324077 - DNA, 22 bp, Homo sapiens
tggcccgggaatgaatggggag

SEQ ID NO: 5324078 - DNA, 18 bp, Homo sapiens
tggcccggtcccagtccg

SEQ ID NO: 5324079 - DNA, 19 bp, Homo sapiens
tggcccgtggcctggcatc

SEQ ID NO: 5324080 - DNA, 20 bp, Homo sapiens
tggcccgtggcctggcatct

SEQ ID NO: 5324081 - DNA, 23 bp, Homo sapiens
tggcccgtggcctggcatctgtg

SEQ ID NO: 5324082 - DNA, 16 bp, Homo sapiens
tggccctagtgacagg

SEQ ID NO: 5324083 - DNA, 17 bp, Homo sapiens
tggccctagtgacaggt

SEQ ID NO: 5324084 - DNA, 20 bp, Homo sapiens
tggccctcaaggcctcccac

SEQ ID NO: 5324085 - DNA, 22 bp, Homo sapiens
tggccctcaaggcctcccacag

SEQ ID NO: 5324086 - DNA, 18 bp, Homo sapiens
tggccctcacccctgccc

SEQ ID NO: 5324087 - DNA, 16 bp, Homo sapiens
tggccctcagctccct

SEQ ID NO: 5324088 - DNA, 17 bp, Homo sapiens
tggccctcagctccctg

SEQ ID NO: 5324089 - DNA, 13 bp, Homo sapiens
tggccctcatctc

SEQ ID NO: 5324090 - DNA, 13 bp, Homo sapiens
tggccctcccagg

SEQ ID NO: 5324091 - DNA, 16 bp, Homo sapiens
tggccctccctcccta

SEQ ID NO: 5324092 - DNA, 23 bp, Homo sapiens
tggccctccctccctagcccttc

SEQ ID NO: 5324093 - DNA, 19 bp, Homo sapiens
tggccctcctcagctccct

SEQ ID NO: 5324094 - DNA, 16 bp, Homo sapiens
tggccctcctctggtc

SEQ ID NO: 5324095 - DNA, 17 bp, Homo sapiens
tggccctcctctggtca

SEQ ID NO: 5324096 - DNA, 16 bp, Homo sapiens
tggccctcctggctgt

SEQ ID NO: 5324097 - DNA, 15 bp, Homo sapiens
tggccctcgggccct

SEQ ID NO: 5324098 - DNA, 21 bp, Homo sapiens
tggccctcgggccctctctcc

SEQ ID NO: 5324099 - DNA, 14 bp, Homo sapiens
tggccctctacccc

SEQ ID NO: 5324100 - DNA, 16 bp, Homo sapiens
tggccctctcccctgc

SEQ ID NO: 5324101 - DNA, 19 bp, Homo sapiens
tggccctctcccctgcccc

SEQ ID NO: 5324102 - DNA, 24 bp, Homo sapiens
tggccctctctgaaggaggccacc

SEQ ID NO: 5324103 - DNA, 21 bp, Homo sapiens
tggccctctcttaatgccacg

SEQ ID NO: 5324104 - DNA, 19 bp, Homo sapiens
tggccctcttgcgggcctg

SEQ ID NO: 5324105 - DNA, 19 bp, Homo sapiens
tggccctgccatcttccca

SEQ ID NO: 5324106 - DNA, 14 bp, Homo sapiens
tggccctgcccagc

SEQ ID NO: 5324107 - DNA, 17 bp, Homo sapiens
tggccctgccctccccc

SEQ ID NO: 5324108 - DNA, 17 bp, Homo sapiens
tggccctgcccttggca

SEQ ID NO: 5324109 - DNA, 13 bp, Homo sapiens
tggccctgccgtt

SEQ ID NO: 5324110 - DNA, 13 bp, Homo sapiens
tggccctgcctca

SEQ ID NO: 5324111 - DNA, 13 bp, Homo sapiens
tggccctgcctcc

SEQ ID NO: 5324112 - DNA, 15 bp, Homo sapiens
tggccctgcctcctg

SEQ ID NO: 5324113 - DNA, 16 bp, Homo sapiens
tggccctgcctcctgg

SEQ ID NO: 5324114 - DNA, 12 bp, Homo sapiens
tggccctgctgc

SEQ ID NO: 5324115 - DNA, 14 bp, Homo sapiens
tggccctgctgccc

SEQ ID NO: 5324116 - DNA, 16 bp, Homo sapiens
tggccctgctgccccc

SEQ ID NO: 5324117 - DNA, 17 bp, Homo sapiens
tggccctgctgcccctc

SEQ ID NO: 5324118 - DNA, 22 bp, Homo sapiens
tggccctgctgcccctccctgc

SEQ ID NO: 5324119 - DNA, 13 bp, Homo sapiens
tggccctggagcc

SEQ ID NO: 5324120 - DNA, 16 bp, Homo sapiens
tggccctggagccagg

SEQ ID NO: 5324121 - DNA, 13 bp, Homo sapiens
tggccctggccct

SEQ ID NO: 5324122 - DNA, 18 bp, Homo sapiens
tggccctggcctgctggg

SEQ ID NO: 5324123 - DNA, 21 bp, Homo sapiens
tggccctggcgggtggctgca

SEQ ID NO: 5324124 - DNA, 23 bp, Homo sapiens
tggccctggcgggtggctgcaag

SEQ ID NO: 5324125 - DNA, 21 bp, Homo sapiens
tggccctgggcggggcgtggg

SEQ ID NO: 5324126 - DNA, 13 bp, Homo sapiens
tggccctggggaa

SEQ ID NO: 5324127 - DNA, 18 bp, Homo sapiens
tggccctgggggtctggg

SEQ ID NO: 5324128 - DNA, 20 bp, Homo sapiens
tggccctgggggtctgggcg

SEQ ID NO: 5324129 - DNA, 19 bp, Homo sapiens
tggccctggggtcccacga

SEQ ID NO: 5324130 - DNA, 21 bp, Homo sapiens
tggccctgtagttaggcctgg

SEQ ID NO: 5324131 - DNA, 15 bp, Homo sapiens
tggccctgtcccagg

SEQ ID NO: 5324132 - DNA, 18 bp, Homo sapiens
tggccctgtcccaggccg

SEQ ID NO: 5324133 - DNA, 19 bp, Homo sapiens
tggccctgtccctcccacc

SEQ ID NO: 5324134 - DNA, 21 bp, Homo sapiens
tggccctgtccctcccacctc

SEQ ID NO: 5324135 - DNA, 21 bp, Homo sapiens
tggccctgtctggaggttcct

SEQ ID NO: 5324136 - DNA, 17 bp, Homo sapiens
tggccctgtgcagacct

SEQ ID NO: 5324137 - DNA, 21 bp, Homo sapiens
tggccctgtgcagaccttact

SEQ ID NO: 5324138 - DNA, 14 bp, Homo sapiens
tggccctgtgggag

SEQ ID NO: 5324139 - DNA, 13 bp, Homo sapiens
tggcccttaagcc

SEQ ID NO: 5324140 - DNA, 14 bp, Homo sapiens
tggcccttccagtg

SEQ ID NO: 5324141 - DNA, 19 bp, Homo sapiens
tggcccttcccactggagg

SEQ ID NO: 5324142 - DNA, 20 bp, Homo sapiens
tggcccttcctcctccacca

SEQ ID NO: 5324143 - DNA, 16 bp, Homo sapiens
tggcccttcctggaca

SEQ ID NO: 5324144 - DNA, 16 bp, Homo sapiens
tggcccttccttcacc

SEQ ID NO: 5324145 - DNA, 13 bp, Homo sapiens
tggcccttgccca

SEQ ID NO: 5324146 - DNA, 20 bp, Homo sapiens
tggcccttgcccaactccca

SEQ ID NO: 5324147 - DNA, 19 bp, Homo sapiens
tggcccttgcttacctctc

SEQ ID NO: 5324148 - DNA, 15 bp, Homo sapiens
tggcccttggaataa

SEQ ID NO: 5324149 - DNA, 14 bp, Homo sapiens
tggccctttcccct

SEQ ID NO: 5324150 - DNA, 15 bp, Homo sapiens
tggccctttcccctt

SEQ ID NO: 5324151 - DNA, 16 bp, Homo sapiens
tggccctttccccttc

SEQ ID NO: 5324152 - DNA, 19 bp, Homo sapiens
tggccctttccccttcccc

SEQ ID NO: 5324153 - DNA, 13 bp, Homo sapiens
tggccctttcctt

SEQ ID NO: 5324154 - DNA, 22 bp, Homo sapiens
tggccgaagccccttggagaga

SEQ ID NO: 5324155 - DNA, 18 bp, Homo sapiens
tggccgactcagggacct

SEQ ID NO: 5324156 - DNA, 16 bp, Homo sapiens
tggccgactctgcact

SEQ ID NO: 5324157 - DNA, 13 bp, Homo sapiens
tggccgagctcct

SEQ ID NO: 5324158 - DNA, 21 bp, Homo sapiens
tggccgagctcctggggagct

SEQ ID NO: 5324159 - DNA, 20 bp, Homo sapiens
tggccgagctgaagaactgg

SEQ ID NO: 5324160 - DNA, 16 bp, Homo sapiens
tggccgaggactttga

SEQ ID NO: 5324161 - DNA, 18 bp, Homo sapiens
tggccgagggtcctggct

SEQ ID NO: 5324162 - DNA, 16 bp, Homo sapiens
tggccgagtcagcacg

SEQ ID NO: 5324163 - DNA, 16 bp, Homo sapiens
tggccgatgagctggt

SEQ ID NO: 5324164 - DNA, 15 bp, Homo sapiens
tggccgatggggccc

SEQ ID NO: 5324165 - DNA, 20 bp, Homo sapiens
tggccgatggggcccacatt

SEQ ID NO: 5324166 - DNA, 17 bp, Homo sapiens
tggccgattagaaggca

SEQ ID NO: 5324167 - DNA, 20 bp, Homo sapiens
tggccgcaagtccccagccc

SEQ ID NO: 5324168 - DNA, 23 bp, Homo sapiens
tggccgcacctaaagcagccagc

SEQ ID NO: 5324169 - DNA, 19 bp, Homo sapiens
tggccgcacgcctctccct

SEQ ID NO: 5324170 - DNA, 21 bp, Homo sapiens
tggccgcacgcctctccctgc

SEQ ID NO: 5324171 - DNA, 14 bp, Homo sapiens
tggccgcagaggtg

SEQ ID NO: 5324172 - DNA, 13 bp, Homo sapiens
tggccgccacccc

SEQ ID NO: 5324173 - DNA, 17 bp, Homo sapiens
tggccgccacccccatc

SEQ ID NO: 5324174 - DNA, 18 bp, Homo sapiens
tggccgccacccccatct

SEQ ID NO: 5324175 - DNA, 13 bp, Homo sapiens
tggccgccacctg

SEQ ID NO: 5324176 - DNA, 21 bp, Homo sapiens
tggccgccccctgccccccag

SEQ ID NO: 5324177 - DNA, 15 bp, Homo sapiens
tggccgcccctgagg

SEQ ID NO: 5324178 - DNA, 15 bp, Homo sapiens
tggccgcctccagga

SEQ ID NO: 5324179 - DNA, 14 bp, Homo sapiens
tggccgcctggcag

SEQ ID NO: 5324180 - DNA, 15 bp, Homo sapiens
tggccgcctggcagg

SEQ ID NO: 5324181 - DNA, 16 bp, Homo sapiens
tggccgcctggcaggt

SEQ ID NO: 5324182 - DNA, 15 bp, Homo sapiens
tggccgcctgggtcc

SEQ ID NO: 5324183 - DNA, 16 bp, Homo sapiens
tggccgcgctccgggc

SEQ ID NO: 5324184 - DNA, 22 bp, Homo sapiens
tggccgctgggagaaaagccag

SEQ ID NO: 5324185 - DNA, 14 bp, Homo sapiens
tggccgctgtgcca

SEQ ID NO: 5324186 - DNA, 20 bp, Homo sapiens
tggccgcttccctacccaca

SEQ ID NO: 5324187 - DNA, 16 bp, Homo sapiens
tggccgcttctagagc

SEQ ID NO: 5324188 - DNA, 20 bp, Homo sapiens
tggccgcttctccccagagc

SEQ ID NO: 5324189 - DNA, 23 bp, Homo sapiens
tggccgcttggtgagtgtctggt

SEQ ID NO: 5324190 - DNA, 19 bp, Homo sapiens
tggccggcaaccccagttc

SEQ ID NO: 5324191 - DNA, 20 bp, Homo sapiens
tggccggcccacgtcctggg

SEQ ID NO: 5324192 - DNA, 16 bp, Homo sapiens
tggccggccctgcccc

SEQ ID NO: 5324193 - DNA, 18 bp, Homo sapiens
tggccggccctgcccccc

SEQ ID NO: 5324194 - DNA, 15 bp, Homo sapiens
tggccggcctcctcc

SEQ ID NO: 5324195 - DNA, 18 bp, Homo sapiens
tggccggctctggtggcc

SEQ ID NO: 5324196 - DNA, 12 bp, Homo sapiens
tggccggctggc

SEQ ID NO: 5324197 - DNA, 13 bp, Homo sapiens
tggccggctgtgc

SEQ ID NO: 5324198 - DNA, 20 bp, Homo sapiens
tggccggcttgctgctccgg

SEQ ID NO: 5324199 - DNA, 18 bp, Homo sapiens
tggccgggactgctgctc

SEQ ID NO: 5324200 - DNA, 21 bp, Homo sapiens
tggccgggactgctgctctcc

SEQ ID NO: 5324201 - DNA, 19 bp, Homo sapiens
tggccgggcacagctgtgg

SEQ ID NO: 5324202 - DNA, 16 bp, Homo sapiens
tggccgggcacagtgg

SEQ ID NO: 5324203 - DNA, 13 bp, Homo sapiens
tggccgggcaggc

SEQ ID NO: 5324204 - DNA, 23 bp, Homo sapiens
tggccgggcgcggtggctcacgc

SEQ ID NO: 5324205 - DNA, 15 bp, Homo sapiens
tggccgggctgctgc

SEQ ID NO: 5324206 - DNA, 16 bp, Homo sapiens
tggccgggctgctgct

SEQ ID NO: 5324207 - DNA, 18 bp, Homo sapiens
tggccgggctgctgctga

SEQ ID NO: 5324208 - DNA, 20 bp, Homo sapiens
tggccgggggtgggggcctg

SEQ ID NO: 5324209 - DNA, 20 bp, Homo sapiens
tggccgggttggaggcctca

SEQ ID NO: 5324210 - DNA, 17 bp, Homo sapiens
tggccggtaggctgctg

SEQ ID NO: 5324211 - DNA, 19 bp, Homo sapiens
tggccggtaggctgctggc

SEQ ID NO: 5324212 - DNA, 17 bp, Homo sapiens
tggccggtgccagctgc

SEQ ID NO: 5324213 - DNA, 18 bp, Homo sapiens
tggccggtgccagctgcc

SEQ ID NO: 5324214 - DNA, 20 bp, Homo sapiens
tggccggtgccagctgccct

SEQ ID NO: 5324215 - DNA, 15 bp, Homo sapiens
tggccggtgctgggt

SEQ ID NO: 5324216 - DNA, 18 bp, Homo sapiens
tggccggtgctgggttcc

SEQ ID NO: 5324217 - DNA, 17 bp, Homo sapiens
tggccgtctcctccctc

SEQ ID NO: 5324218 - DNA, 14 bp, Homo sapiens
tggccgtggctcca

SEQ ID NO: 5324219 - DNA, 17 bp, Homo sapiens
tggccgtggtccagctc

SEQ ID NO: 5324220 - DNA, 18 bp, Homo sapiens
tggccgtggtccagctct

SEQ ID NO: 5324221 - DNA, 20 bp, Homo sapiens
tggccgtggtccagctcttg

SEQ ID NO: 5324222 - DNA, 22 bp, Homo sapiens
tggccgttgatgttggctggga

SEQ ID NO: 5324223 - DNA, 23 bp, Homo sapiens
tggccgttgcctctctgccagcc

SEQ ID NO: 5324224 - DNA, 21 bp, Homo sapiens
tggcctaaaactggcctgact

SEQ ID NO: 5324225 - DNA, 17 bp, Homo sapiens
tggcctaaagaatccca

SEQ ID NO: 5324226 - DNA, 22 bp, Homo sapiens
tggcctaaagaatcccaccccc

SEQ ID NO: 5324227 - DNA, 13 bp, Homo sapiens
tggcctaaatttc

SEQ ID NO: 5324228 - DNA, 16 bp, Homo sapiens
tggcctaaatttcttc

SEQ ID NO: 5324229 - DNA, 19 bp, Homo sapiens
tggcctaatcacctttcca

SEQ ID NO: 5324230 - DNA, 18 bp, Homo sapiens
tggcctacaaatcagtaa

SEQ ID NO: 5324231 - DNA, 13 bp, Homo sapiens
tggcctaccacag

SEQ ID NO: 5324232 - DNA, 14 bp, Homo sapiens
tggcctaccacagc

SEQ ID NO: 5324233 - DNA, 15 bp, Homo sapiens
tggcctaccacagct

SEQ ID NO: 5324234 - DNA, 18 bp, Homo sapiens
tggcctaccacagctgcc

SEQ ID NO: 5324235 - DNA, 21 bp, Homo sapiens
tggcctagaccagcagacaga

SEQ ID NO: 5324236 - DNA, 23 bp, Homo sapiens
tggcctagcccaccctgctgcct

SEQ ID NO: 5324237 - DNA, 22 bp, Homo sapiens
tggcctaggagatatctgaggg

SEQ ID NO: 5324238 - DNA, 22 bp, Homo sapiens
tggcctaggatcttcactgtct

SEQ ID NO: 5324239 - DNA, 18 bp, Homo sapiens
tggcctaggggccagggc

SEQ ID NO: 5324240 - DNA, 22 bp, Homo sapiens
tggcctaggtgggagccaccac

SEQ ID NO: 5324241 - DNA, 18 bp, Homo sapiens
tggcctagtcagatggat

SEQ ID NO: 5324242 - DNA, 15 bp, Homo sapiens
tggcctatccgctgc

SEQ ID NO: 5324243 - DNA, 21 bp, Homo sapiens
tggcctatccgctgccagcct

SEQ ID NO: 5324244 - DNA, 20 bp, Homo sapiens
tggcctatgaaactggttta

SEQ ID NO: 5324245 - DNA, 21 bp, Homo sapiens
tggcctatgaccctgtgcctg

SEQ ID NO: 5324246 - DNA, 13 bp, Homo sapiens
tggcctatgcaca

SEQ ID NO: 5324247 - DNA, 14 bp, Homo sapiens
tggcctatgcacat

SEQ ID NO: 5324248 - DNA, 16 bp, Homo sapiens
tggcctatgtggtcta

SEQ ID NO: 5324249 - DNA, 17 bp, Homo sapiens
tggcctattccaggaat

SEQ ID NO: 5324250 - DNA, 16 bp, Homo sapiens
tggcctatttcagctg

SEQ ID NO: 5324251 - DNA, 20 bp, Homo sapiens
tggcctatttcagctgcttt

SEQ ID NO: 5324252 - DNA, 13 bp, Homo sapiens
tggcctcaaccct

SEQ ID NO: 5324253 - DNA, 14 bp, Homo sapiens
tggcctcaaccctc

SEQ ID NO: 5324254 - DNA, 19 bp, Homo sapiens
tggcctcaaccctccctca

SEQ ID NO: 5324255 - DNA, 23 bp, Homo sapiens
tggcctcaactgagaagccaagc

SEQ ID NO: 5324256 - DNA, 15 bp, Homo sapiens
tggcctcaagaaagg

SEQ ID NO: 5324257 - DNA, 19 bp, Homo sapiens
tggcctcaagaaaggcccg

SEQ ID NO: 5324258 - DNA, 16 bp, Homo sapiens
tggcctcaagagcaca

SEQ ID NO: 5324259 - DNA, 18 bp, Homo sapiens
tggcctcaagagcacaca

SEQ ID NO: 5324260 - DNA, 19 bp, Homo sapiens
tggcctcaagcaaggaagc

SEQ ID NO: 5324261 - DNA, 19 bp, Homo sapiens
tggcctcaagccatcttcc

SEQ ID NO: 5324262 - DNA, 19 bp, Homo sapiens
tggcctcaagtgatccacc

SEQ ID NO: 5324263 - DNA, 18 bp, Homo sapiens
tggcctcaagtgattctc

SEQ ID NO: 5324264 - DNA, 19 bp, Homo sapiens
tggcctcacgcccagcctc

SEQ ID NO: 5324265 - DNA, 13 bp, Homo sapiens
tggcctcactggc

SEQ ID NO: 5324266 - DNA, 22 bp, Homo sapiens
tggcctcacttccctgggaact

SEQ ID NO: 5324267 - DNA, 20 bp, Homo sapiens
tggcctcagactgcacccag

SEQ ID NO: 5324268 - DNA, 23 bp, Homo sapiens
tggcctcagactgcacccaggag

SEQ ID NO: 5324269 - DNA, 19 bp, Homo sapiens
tggcctcagagcttcctgg

SEQ ID NO: 5324270 - DNA, 23 bp, Homo sapiens
tggcctcagagcttcctggggac

SEQ ID NO: 5324271 - DNA, 19 bp, Homo sapiens
tggcctcagcagaaggcct

SEQ ID NO: 5324272 - DNA, 16 bp, Homo sapiens
tggcctcagcatctca

SEQ ID NO: 5324273 - DNA, 21 bp, Homo sapiens
tggcctcagccagctgcccac

SEQ ID NO: 5324274 - DNA, 16 bp, Homo sapiens
tggcctcagccctgct

SEQ ID NO: 5324275 - DNA, 19 bp, Homo sapiens
tggcctcagccctgctccc

SEQ ID NO: 5324276 - DNA, 21 bp, Homo sapiens
tggcctcagccctgctccctg

SEQ ID NO: 5324277 - DNA, 17 bp, Homo sapiens
tggcctcagctgcctca

SEQ ID NO: 5324278 - DNA, 18 bp, Homo sapiens
tggcctcagctgcctcac

SEQ ID NO: 5324279 - DNA, 20 bp, Homo sapiens
tggcctcagggccaggaagg

SEQ ID NO: 5324280 - DNA, 16 bp, Homo sapiens
tggcctcagttcccag

SEQ ID NO: 5324281 - DNA, 22 bp, Homo sapiens
tggcctcatccaaactgtatct

SEQ ID NO: 5324282 - DNA, 20 bp, Homo sapiens
tggcctcatgctggagggag

SEQ ID NO: 5324283 - DNA, 13 bp, Homo sapiens
tggcctcatgtgg

SEQ ID NO: 5324284 - DNA, 17 bp, Homo sapiens
tggcctcatgtggctgg

SEQ ID NO: 5324285 - DNA, 15 bp, Homo sapiens
tggcctccagaggag

SEQ ID NO: 5324286 - DNA, 15 bp, Homo sapiens
tggcctccagctccc

SEQ ID NO: 5324287 - DNA, 19 bp, Homo sapiens
tggcctccagctcccactc

SEQ ID NO: 5324288 - DNA, 15 bp, Homo sapiens
tggcctccagctgtt

SEQ ID NO: 5324289 - DNA, 14 bp, Homo sapiens
tggcctccaggccc

SEQ ID NO: 5324290 - DNA, 12 bp, Homo sapiens
tggcctccatcc

SEQ ID NO: 5324291 - DNA, 20 bp, Homo sapiens
tggcctccatcctcatctct

SEQ ID NO: 5324292 - DNA, 16 bp, Homo sapiens
tggcctccatttctgt

SEQ ID NO: 5324293 - DNA, 18 bp, Homo sapiens
tggcctcccaaagtgctg

SEQ ID NO: 5324294 - DNA, 23 bp, Homo sapiens
tggcctcccaactcaccccagcc

SEQ ID NO: 5324295 - DNA, 22 bp, Homo sapiens
tggcctcccaataaagctggac

SEQ ID NO: 5324296 - DNA, 11 bp, Homo sapiens
tggcctcccac

SEQ ID NO: 5324297 - DNA, 18 bp, Homo sapiens
tggcctcccacagactca

SEQ ID NO: 5324298 - DNA, 13 bp, Homo sapiens
tggcctcccagaa

SEQ ID NO: 5324299 - DNA, 20 bp, Homo sapiens
tggcctcccagaatgctggg

SEQ ID NO: 5324300 - DNA, 15 bp, Homo sapiens
tggcctcccagccac

SEQ ID NO: 5324301 - DNA, 19 bp, Homo sapiens
tggcctcccagccacccgg

SEQ ID NO: 5324302 - DNA, 12 bp, Homo sapiens
tggcctccccca

SEQ ID NO: 5324303 - DNA, 13 bp, Homo sapiens
tggcctcccccaa

SEQ ID NO: 5324304 - DNA, 15 bp, Homo sapiens
tggcctcccctgcca

SEQ ID NO: 5324305 - DNA, 21 bp, Homo sapiens
tggcctcccctgccaccaggc

SEQ ID NO: 5324306 - DNA, 23 bp, Homo sapiens
tggcctcccctgccaccaggcca

SEQ ID NO: 5324307 - DNA, 22 bp, Homo sapiens
tggcctccctggctcctccgtc

SEQ ID NO: 5324308 - DNA, 23 bp, Homo sapiens
tggcctccctggctcctccgtct

SEQ ID NO: 5324309 - DNA, 14 bp, Homo sapiens
tggcctcccttctc

SEQ ID NO: 5324310 - DNA, 17 bp, Homo sapiens
tggcctccgcagtgtct

SEQ ID NO: 5324311 - DNA, 18 bp, Homo sapiens
tggcctccgcagtgtctc

SEQ ID NO: 5324312 - DNA, 18 bp, Homo sapiens
tggcctccggcctcccct

SEQ ID NO: 5324313 - DNA, 19 bp, Homo sapiens
tggcctccggcgtcagcct

SEQ ID NO: 5324314 - DNA, 16 bp, Homo sapiens
tggcctcctgcctcta

SEQ ID NO: 5324315 - DNA, 18 bp, Homo sapiens
tggcctcctgggggccca

SEQ ID NO: 5324316 - DNA, 20 bp, Homo sapiens
tggcctcctgggggcccatt

SEQ ID NO: 5324317 - DNA, 17 bp, Homo sapiens
tggcctccttttgctgt

SEQ ID NO: 5324318 - DNA, 13 bp, Homo sapiens
tggcctcgcctcc

SEQ ID NO: 5324319 - DNA, 16 bp, Homo sapiens
tggcctcgcctggcct

SEQ ID NO: 5324320 - DNA, 23 bp, Homo sapiens
tggcctcggcgggcttttctggg

SEQ ID NO: 5324321 - DNA, 14 bp, Homo sapiens
tggcctcggggcag

SEQ ID NO: 5324322 - DNA, 20 bp, Homo sapiens
tggcctcggggcagggcagg

SEQ ID NO: 5324323 - DNA, 19 bp, Homo sapiens
tggcctcgtgatctgccct

SEQ ID NO: 5324324 - DNA, 19 bp, Homo sapiens
tggcctcgtgctccgcagg

SEQ ID NO: 5324325 - DNA, 14 bp, Homo sapiens
tggcctctcagtca

SEQ ID NO: 5324326 - DNA, 21 bp, Homo sapiens
tggcctctccttgtggcctgg

SEQ ID NO: 5324327 - DNA, 19 bp, Homo sapiens
tggcctctcgagttctcct

SEQ ID NO: 5324328 - DNA, 13 bp, Homo sapiens
tggcctctctagc

SEQ ID NO: 5324329 - DNA, 14 bp, Homo sapiens
tggcctctctccac

SEQ ID NO: 5324330 - DNA, 16 bp, Homo sapiens
tggcctctctccacta

SEQ ID NO: 5324331 - DNA, 17 bp, Homo sapiens
tggcctctctccactac

SEQ ID NO: 5324332 - DNA, 22 bp, Homo sapiens
tggcctctctccactaccccga

SEQ ID NO: 5324333 - DNA, 15 bp, Homo sapiens
tggcctctctctagg

SEQ ID NO: 5324334 - DNA, 22 bp, Homo sapiens
tggcctctctctctctcctcag

SEQ ID NO: 5324335 - DNA, 18 bp, Homo sapiens
tggcctctgcaaaggaaa

SEQ ID NO: 5324336 - DNA, 19 bp, Homo sapiens
tggcctctgcaactgctca

SEQ ID NO: 5324337 - DNA, 14 bp, Homo sapiens
tggcctctgcactc

SEQ ID NO: 5324338 - DNA, 19 bp, Homo sapiens
tggcctctgcactcccctg

SEQ ID NO: 5324339 - DNA, 12 bp, Homo sapiens
tggcctctgcca

SEQ ID NO: 5324340 - DNA, 17 bp, Homo sapiens
tggcctctgccatcctc

SEQ ID NO: 5324341 - DNA, 18 bp, Homo sapiens
tggcctctgccatcctcc

SEQ ID NO: 5324342 - DNA, 20 bp, Homo sapiens
tggcctctgcctccaccctc

SEQ ID NO: 5324343 - DNA, 15 bp, Homo sapiens
tggcctctgcctggg

SEQ ID NO: 5324344 - DNA, 17 bp, Homo sapiens
tggcctctgcctggggc

SEQ ID NO: 5324345 - DNA, 12 bp, Homo sapiens
tggcctctgctt

SEQ ID NO: 5324346 - DNA, 16 bp, Homo sapiens
tggcctctggccaggc

SEQ ID NO: 5324347 - DNA, 15 bp, Homo sapiens
tggcctctgtcatat

SEQ ID NO: 5324348 - DNA, 15 bp, Homo sapiens
tggcctcttcaggcc

SEQ ID NO: 5324349 - DNA, 19 bp, Homo sapiens
tggcctcttcaggcctgct

SEQ ID NO: 5324350 - DNA, 22 bp, Homo sapiens
tggcctcttcctccctccctgc

SEQ ID NO: 5324351 - DNA, 16 bp, Homo sapiens
tggcctcttcgggaag

SEQ ID NO: 5324352 - DNA, 15 bp, Homo sapiens
tggcctcttgaagag

SEQ ID NO: 5324353 - DNA, 19 bp, Homo sapiens
tggcctcttgagcagtggc

SEQ ID NO: 5324354 - DNA, 20 bp, Homo sapiens
tggcctcttgagcagtggct

SEQ ID NO: 5324355 - DNA, 23 bp, Homo sapiens
tggcctcttgagttcctctgcag

SEQ ID NO: 5324356 - DNA, 21 bp, Homo sapiens
tggcctcttggataccagctc

SEQ ID NO: 5324357 - DNA, 23 bp, Homo sapiens
tggcctcttggataccagctcag

SEQ ID NO: 5324358 - DNA, 19 bp, Homo sapiens
tggcctcttggcacctgcc

SEQ ID NO: 5324359 - DNA, 22 bp, Homo sapiens
tggcctcttggcacctgcctag

SEQ ID NO: 5324360 - DNA, 23 bp, Homo sapiens
tggcctcttggctatttctgtgt

SEQ ID NO: 5324361 - DNA, 12 bp, Homo sapiens
tggcctctttgt

SEQ ID NO: 5324362 - DNA, 23 bp, Homo sapiens
tggcctcttttcagatcatggca

SEQ ID NO: 5324363 - DNA, 19 bp, Homo sapiens
tggcctgaacagatgtaaa

SEQ ID NO: 5324364 - DNA, 17 bp, Homo sapiens
tggcctgaactgaggag

SEQ ID NO: 5324365 - DNA, 14 bp, Homo sapiens
tggcctgaagaagc

SEQ ID NO: 5324366 - DNA, 21 bp, Homo sapiens
tggcctgaagagtcctctgaa

SEQ ID NO: 5324367 - DNA, 12 bp, Homo sapiens
tggcctgacaca

SEQ ID NO: 5324368 - DNA, 15 bp, Homo sapiens
tggcctgacagctct

SEQ ID NO: 5324369 - DNA, 16 bp, Homo sapiens
tggcctgacagctctg

SEQ ID NO: 5324370 - DNA, 14 bp, Homo sapiens
tggcctgactcccc

SEQ ID NO: 5324371 - DNA, 19 bp, Homo sapiens
tggcctgactggttgtcag

SEQ ID NO: 5324372 - DNA, 19 bp, Homo sapiens
tggcctgagaagagtcgag

SEQ ID NO: 5324373 - DNA, 19 bp, Homo sapiens
tggcctgagagtcagctct

SEQ ID NO: 5324374 - DNA, 12 bp, Homo sapiens
tggcctgagctg

SEQ ID NO: 5324375 - DNA, 16 bp, Homo sapiens
tggcctgagctggggc

SEQ ID NO: 5324376 - DNA, 18 bp, Homo sapiens
tggcctgagctggggcca

SEQ ID NO: 5324377 - DNA, 19 bp, Homo sapiens
tggcctgaggacccggcgc

SEQ ID NO: 5324378 - DNA, 19 bp, Homo sapiens
tggcctgagtcctggtccc

SEQ ID NO: 5324379 - DNA, 22 bp, Homo sapiens
tggcctgagtcctggtccctct

SEQ ID NO: 5324380 - DNA, 20 bp, Homo sapiens
tggctcagggatcttctccc

SEQ ID NO: 5324381 - DNA, 21 bp, Homo sapiens
tggctcagggtcaaagacaga

SEQ ID NO: 5324382 - DNA, 14 bp, Homo sapiens
tggctcagggtggt

SEQ ID NO: 5324383 - DNA, 11 bp, Homo sapiens
tggctcataaa

SEQ ID NO: 5324384 - DNA, 22 bp, Homo sapiens
tggctcatggcgtaatgggcct

SEQ ID NO: 5324385 - DNA, 23 bp, Homo sapiens
tggctcatggcgtaatgggcctg

SEQ ID NO: 5324386 - DNA, 18 bp, Homo sapiens
tggctcattctgcacctt

SEQ ID NO: 5324387 - DNA, 18 bp, Homo sapiens
tggctccaaaccctcgag

SEQ ID NO: 5324388 - DNA, 21 bp, Homo sapiens
tggctccaaggtgctctgtgt

SEQ ID NO: 5324389 - DNA, 16 bp, Homo sapiens
tggctccacgccctgg

SEQ ID NO: 5324390 - DNA, 17 bp, Homo sapiens
tggctccacgccctggg

SEQ ID NO: 5324391 - DNA, 13 bp, Homo sapiens
tggctccactctt

SEQ ID NO: 5324392 - DNA, 18 bp, Homo sapiens
tggctccactcttgatct

SEQ ID NO: 5324393 - DNA, 20 bp, Homo sapiens
tggctccactcttgatctct

SEQ ID NO: 5324394 - DNA, 15 bp, Homo sapiens
tggctccactgtaaa

SEQ ID NO: 5324395 - DNA, 20 bp, Homo sapiens
tggctccagaaatgtctaaa

SEQ ID NO: 5324396 - DNA, 23 bp, Homo sapiens
tggctccagatgcagggcagtca

SEQ ID NO: 5324397 - DNA, 13 bp, Homo sapiens
tggctccagcacc

SEQ ID NO: 5324398 - DNA, 17 bp, Homo sapiens
tggctccagctggccgg

SEQ ID NO: 5324399 - DNA, 12 bp, Homo sapiens
tggctccaggag

SEQ ID NO: 5324400 - DNA, 19 bp, Homo sapiens
tggctccagtctcatcctc

SEQ ID NO: 5324401 - DNA, 22 bp, Homo sapiens
tggctccagtctcatcctccca

SEQ ID NO: 5324402 - DNA, 23 bp, Homo sapiens
tggctccagtctgctgccctcca

SEQ ID NO: 5324403 - DNA, 19 bp, Homo sapiens
tggctccatgctttcacct

SEQ ID NO: 5324404 - DNA, 16 bp, Homo sapiens
tggctcccaaggttcc

SEQ ID NO: 5324405 - DNA, 16 bp, Homo sapiens
tggctcccacaggagt

SEQ ID NO: 5324406 - DNA, 14 bp, Homo sapiens
tggctcccacaggc

SEQ ID NO: 5324407 - DNA, 17 bp, Homo sapiens
tggctcccacaggccct

SEQ ID NO: 5324408 - DNA, 23 bp, Homo sapiens
tggctcccacaggtcttcactgc

SEQ ID NO: 5324409 - DNA, 15 bp, Homo sapiens
tggctcccagggcca

SEQ ID NO: 5324410 - DNA, 14 bp, Homo sapiens
tggctcccaggggc

SEQ ID NO: 5324411 - DNA, 19 bp, Homo sapiens
tggctcccaggggctccct

SEQ ID NO: 5324412 - DNA, 13 bp, Homo sapiens
tggctcccagggt

SEQ ID NO: 5324413 - DNA, 16 bp, Homo sapiens
tggctcccagggtgga

SEQ ID NO: 5324414 - DNA, 17 bp, Homo sapiens
tggctcccattcactct

SEQ ID NO: 5324415 - DNA, 20 bp, Homo sapiens
tggctccccaaggctgcaaa

SEQ ID NO: 5324416 - DNA, 16 bp, Homo sapiens
tggctccccacctgga

SEQ ID NO: 5324417 - DNA, 18 bp, Homo sapiens
tggctccccacctggaca

SEQ ID NO: 5324418 - DNA, 23 bp, Homo sapiens
tggctccccacctggacacacac

SEQ ID NO: 5324419 - DNA, 17 bp, Homo sapiens
tggctccccctccccag

SEQ ID NO: 5324420 - DNA, 13 bp, Homo sapiens
tggctccccgagg

SEQ ID NO: 5324421 - DNA, 21 bp, Homo sapiens
tggctcccctctatttagcat

SEQ ID NO: 5324422 - DNA, 23 bp, Homo sapiens
tggctcccctctatttagcatga

SEQ ID NO: 5324423 - DNA, 18 bp, Homo sapiens
tggctcccctgcagccct

SEQ ID NO: 5324424 - DNA, 24 bp, Homo sapiens
tggctcccctgcagccctggccca

SEQ ID NO: 5324425 - DNA, 20 bp, Homo sapiens
tggctcccctgcccagcctg

SEQ ID NO: 5324426 - DNA, 22 bp, Homo sapiens
tggctcccctgcccagcctgct

SEQ ID NO: 5324427 - DNA, 20 bp, Homo sapiens
tggctcccggagggccctga

SEQ ID NO: 5324428 - DNA, 14 bp, Homo sapiens
tggctccctcactc

SEQ ID NO: 5324429 - DNA, 15 bp, Homo sapiens
tggctccctctctcc

SEQ ID NO: 5324430 - DNA, 18 bp, Homo sapiens
tggctccctctctcctgg

SEQ ID NO: 5324431 - DNA, 21 bp, Homo sapiens
tggctccctctctcctggact

SEQ ID NO: 5324432 - DNA, 10 bp, Homo sapiens
tggctccctg

SEQ ID NO: 5324433 - DNA, 23 bp, Homo sapiens
tggctccctgatgggggacagga

SEQ ID NO: 5324434 - DNA, 15 bp, Homo sapiens
tggctccctgcccct

SEQ ID NO: 5324435 - DNA, 17 bp, Homo sapiens
tggctccctgggcagtg

SEQ ID NO: 5324436 - DNA, 20 bp, Homo sapiens
tggctccctgggctggcatg

SEQ ID NO: 5324437 - DNA, 22 bp, Homo sapiens
tggctccctgggctggcatggg

SEQ ID NO: 5324438 - DNA, 21 bp, Homo sapiens
tggctccctgggggcggccag

SEQ ID NO: 5324439 - DNA, 18 bp, Homo sapiens
tggctccggcctctgcct

SEQ ID NO: 5324440 - DNA, 18 bp, Homo sapiens
tggctcctatctgtgttt

SEQ ID NO: 5324441 - DNA, 14 bp, Homo sapiens
tggctcctcaaaca

SEQ ID NO: 5324442 - DNA, 22 bp, Homo sapiens
tggctcctcaaacagtaggttg

SEQ ID NO: 5324443 - DNA, 14 bp, Homo sapiens
tggctcctcaccac

SEQ ID NO: 5324444 - DNA, 12 bp, Homo sapiens
tggctcctccag

SEQ ID NO: 5324445 - DNA, 15 bp, Homo sapiens
tggctcctcccagca

SEQ ID NO: 5324446 - DNA, 14 bp, Homo sapiens
tggctcctcccgaa

SEQ ID NO: 5324447 - DNA, 14 bp, Homo sapiens
tggctcctcctagg

SEQ ID NO: 5324448 - DNA, 14 bp, Homo sapiens
tggctcctcctgga

SEQ ID NO: 5324449 - DNA, 13 bp, Homo sapiens
tggctcctctcag

SEQ ID NO: 5324450 - DNA, 18 bp, Homo sapiens
tggctcctgaagggtgct

SEQ ID NO: 5324451 - DNA, 22 bp, Homo sapiens
tggctcctgaagggtgctcagt

SEQ ID NO: 5324452 - DNA, 17 bp, Homo sapiens
tggctcctgccactgac

SEQ ID NO: 5324453 - DNA, 13 bp, Homo sapiens
tggctcctgccca

SEQ ID NO: 5324454 - DNA, 12 bp, Homo sapiens
tggctcctgcct

SEQ ID NO: 5324455 - DNA, 13 bp, Homo sapiens
tggctcctgcctt

SEQ ID NO: 5324456 - DNA, 15 bp, Homo sapiens
tggctcctgccttga

SEQ ID NO: 5324457 - DNA, 17 bp, Homo sapiens
tggctcctgtttccatg

SEQ ID NO: 5324458 - DNA, 13 bp, Homo sapiens
tggctccttcacc

SEQ ID NO: 5324459 - DNA, 14 bp, Homo sapiens
tggctccttcacca

SEQ ID NO: 5324460 - DNA, 15 bp, Homo sapiens
tggctcctttacaaa

SEQ ID NO: 5324461 - DNA, 14 bp, Homo sapiens
tggctcctttccca

SEQ ID NO: 5324462 - DNA, 21 bp, Homo sapiens
tggctcgaatctctgtgcctt

SEQ ID NO: 5324463 - DNA, 22 bp, Homo sapiens
tggctcgcagggtgcaggagcg

SEQ ID NO: 5324464 - DNA, 23 bp, Homo sapiens
tggctcgctccctgtagctctgc

SEQ ID NO: 5324465 - DNA, 14 bp, Homo sapiens
tggctcgctgtggt

SEQ ID NO: 5324466 - DNA, 20 bp, Homo sapiens
tggctcgctgtggtttctcg

SEQ ID NO: 5324467 - DNA, 18 bp, Homo sapiens
tggctcggacccacccca

SEQ ID NO: 5324468 - DNA, 18 bp, Homo sapiens
tggctcggcgcccccacc

SEQ ID NO: 5324469 - DNA, 21 bp, Homo sapiens
tggctcgtgggctctggctcc

SEQ ID NO: 5324470 - DNA, 19 bp, Homo sapiens
tggctcgtgtttcacagtg

SEQ ID NO: 5324471 - DNA, 19 bp, Homo sapiens
tggctcgttggctagatta

SEQ ID NO: 5324472 - DNA, 22 bp, Homo sapiens
tggctctaacattactgccttc

SEQ ID NO: 5324473 - DNA, 20 bp, Homo sapiens
tggctctaccctgtctgtcc

SEQ ID NO: 5324474 - DNA, 21 bp, Homo sapiens
tggctctaccctgtctgtccc

SEQ ID NO: 5324475 - DNA, 17 bp, Homo sapiens
tggctctaggaccccca

SEQ ID NO: 5324476 - DNA, 13 bp, Homo sapiens
tggctctattgga

SEQ ID NO: 5324477 - DNA, 17 bp, Homo sapiens
tggctctatttcttctt

SEQ ID NO: 5324478 - DNA, 22 bp, Homo sapiens
tggctctatttcttcttcacat

SEQ ID NO: 5324479 - DNA, 15 bp, Homo sapiens
tggctctcacctcta

SEQ ID NO: 5324480 - DNA, 13 bp, Homo sapiens
tggctctccaagt

SEQ ID NO: 5324481 - DNA, 14 bp, Homo sapiens
tggctctccaagtg

SEQ ID NO: 5324482 - DNA, 15 bp, Homo sapiens
tggctctccaagtgc

SEQ ID NO: 5324483 - DNA, 16 bp, Homo sapiens
tggctctccaccttgt

SEQ ID NO: 5324484 - DNA, 16 bp, Homo sapiens
tggctctcccaccccg

SEQ ID NO: 5324485 - DNA, 14 bp, Homo sapiens
tggctctcctctgg

SEQ ID NO: 5324486 - DNA, 14 bp, Homo sapiens
tggctctcctggcc

SEQ ID NO: 5324487 - DNA, 13 bp, Homo sapiens
tggctctctccag

SEQ ID NO: 5324488 - DNA, 15 bp, Homo sapiens
tggctctctccagga

SEQ ID NO: 5324489 - DNA, 22 bp, Homo sapiens
tggctctctcttcctaccctcc

SEQ ID NO: 5324490 - DNA, 14 bp, Homo sapiens
tggctctgacaaga

SEQ ID NO: 5324491 - DNA, 12 bp, Homo sapiens
tggctctgccag

SEQ ID NO: 5324492 - DNA, 19 bp, Homo sapiens
tggctctgccagtcctgtc

SEQ ID NO: 5324493 - DNA, 11 bp, Homo sapiens
tggctctgccc

SEQ ID NO: 5324494 - DNA, 15 bp, Homo sapiens
tggctctgcccctca

SEQ ID NO: 5324495 - DNA, 19 bp, Homo sapiens
tggctctgcccctcagggg

SEQ ID NO: 5324496 - DNA, 11 bp, Homo sapiens
tggctctgctg

SEQ ID NO: 5324497 - DNA, 14 bp, Homo sapiens
tggctctggagaca

SEQ ID NO: 5324498 - DNA, 16 bp, Homo sapiens
tggctctggcccaggc

SEQ ID NO: 5324499 - DNA, 20 bp, Homo sapiens
tggctctgggagagccagct

SEQ ID NO: 5324500 - DNA, 23 bp, Homo sapiens
tggctctgggagagccagctttg

SEQ ID NO: 5324501 - DNA, 23 bp, Homo sapiens
tggctctgggggacccaggtggg

SEQ ID NO: 5324502 - DNA, 13 bp, Homo sapiens
tggctctggggta

SEQ ID NO: 5324503 - DNA, 19 bp, Homo sapiens
tggctctggggtatgtgtg

SEQ ID NO: 5324504 - DNA, 19 bp, Homo sapiens
tggctctgggtgggcgggg

SEQ ID NO: 5324505 - DNA, 18 bp, Homo sapiens
tggctctgggtgggcgtg

SEQ ID NO: 5324506 - DNA, 13 bp, Homo sapiens
tggctctgtgaaa

SEQ ID NO: 5324507 - DNA, 21 bp, Homo sapiens
tggctctgttatgcaagcaca

SEQ ID NO: 5324508 - DNA, 16 bp, Homo sapiens
tggctcttatttctga

SEQ ID NO: 5324509 - DNA, 20 bp, Homo sapiens
tggctcttatttctgaattc

SEQ ID NO: 5324510 - DNA, 21 bp, Homo sapiens
tggctcttatttctgaattca

SEQ ID NO: 5324511 - DNA, 14 bp, Homo sapiens
tggctcttcacctg

SEQ ID NO: 5324512 - DNA, 22 bp, Homo sapiens
tggctcttgaactgagcttgga

SEQ ID NO: 5324513 - DNA, 21 bp, Homo sapiens
tggctcttgatacccccctct

SEQ ID NO: 5324514 - DNA, 17 bp, Homo sapiens
tggctcttggcttccag

SEQ ID NO: 5324515 - DNA, 18 bp, Homo sapiens
tggctcttggcttccaga

SEQ ID NO: 5324516 - DNA, 19 bp, Homo sapiens
tggctctttggagatcaag

SEQ ID NO: 5324517 - DNA, 15 bp, Homo sapiens
tggctgaaaatggtg

SEQ ID NO: 5324518 - DNA, 14 bp, Homo sapiens
tggctgaaagtaaa

SEQ ID NO: 5324519 - DNA, 12 bp, Homo sapiens
tggctgaaatta

SEQ ID NO: 5324520 - DNA, 18 bp, Homo sapiens
tggctgaaattctcctgg

SEQ ID NO: 5324521 - DNA, 22 bp, Homo sapiens
tggctgaacagtgctctgcctc

SEQ ID NO: 5324522 - DNA, 18 bp, Homo sapiens
tggctgaaccctgtgctg

SEQ ID NO: 5324523 - DNA, 19 bp, Homo sapiens
tggctgaagaggaccagag

SEQ ID NO: 5324524 - DNA, 22 bp, Homo sapiens
tggctgaagaggaccagaggag

SEQ ID NO: 5324525 - DNA, 16 bp, Homo sapiens
tggctgaaggactgtg

SEQ ID NO: 5324526 - DNA, 21 bp, Homo sapiens
tggctgaatagcttctccaaa

SEQ ID NO: 5324527 - DNA, 18 bp, Homo sapiens
tggctgacatgaagctgt

SEQ ID NO: 5324528 - DNA, 21 bp, Homo sapiens
tggctgaccaggccctgctca

SEQ ID NO: 5324529 - DNA, 16 bp, Homo sapiens
tggctgacccagtccc

SEQ ID NO: 5324530 - DNA, 19 bp, Homo sapiens
tggctgacccagtccctgg

SEQ ID NO: 5324531 - DNA, 16 bp, Homo sapiens
tggctgacccccctca

SEQ ID NO: 5324532 - DNA, 13 bp, Homo sapiens
tggctgacccctc

SEQ ID NO: 5324533 - DNA, 17 bp, Homo sapiens
tggctgacccctctggt

SEQ ID NO: 5324534 - DNA, 16 bp, Homo sapiens
tggctgacctgggccc

SEQ ID NO: 5324535 - DNA, 15 bp, Homo sapiens
tggctgactaaattt

SEQ ID NO: 5324536 - DNA, 20 bp, Homo sapiens
tggctgactaaatttgggga

SEQ ID NO: 5324537 - DNA, 22 bp, Homo sapiens
tggctgactaaatttggggaca

SEQ ID NO: 5324538 - DNA, 23 bp, Homo sapiens
tggctgactaaatttggggacag

SEQ ID NO: 5324539 - DNA, 15 bp, Homo sapiens
tggctgactgccttg

SEQ ID NO: 5324540 - DNA, 16 bp, Homo sapiens
tggctgactggccagt

SEQ ID NO: 5324541 - DNA, 14 bp, Homo sapiens
tggctgactggggc

SEQ ID NO: 5324542 - DNA, 18 bp, Homo sapiens
tggctgagaatctggggg

SEQ ID NO: 5324543 - DNA, 13 bp, Homo sapiens
tggctgagacctg

SEQ ID NO: 5324544 - DNA, 20 bp, Homo sapiens
tggctgagacctgggatttg

SEQ ID NO: 5324545 - DNA, 13 bp, Homo sapiens
tggctgagccctg

SEQ ID NO: 5324546 - DNA, 19 bp, Homo sapiens
tggctgagcctggctggca

SEQ ID NO: 5324547 - DNA, 15 bp, Homo sapiens
tggctgagcttggcc

SEQ ID NO: 5324548 - DNA, 17 bp, Homo sapiens
tggctgaggaggcctcc

SEQ ID NO: 5324549 - DNA, 23 bp, Homo sapiens
tggctgaggaggcctccatctca

SEQ ID NO: 5324550 - DNA, 13 bp, Homo sapiens
tggctgagggcag

SEQ ID NO: 5324551 - DNA, 14 bp, Homo sapiens
tggctgagggcagc

SEQ ID NO: 5324552 - DNA, 14 bp, Homo sapiens
tggctgagggcagt

SEQ ID NO: 5324553 - DNA, 22 bp, Homo sapiens
tggctgagggcagttcgcagcc

SEQ ID NO: 5324554 - DNA, 16 bp, Homo sapiens
tggctgaggggcttgg

SEQ ID NO: 5324555 - DNA, 17 bp, Homo sapiens
tggctgaggggcttggg

SEQ ID NO: 5324556 - DNA, 17 bp, Homo sapiens
tggctgaggttcctctg

SEQ ID NO: 5324557 - DNA, 18 bp, Homo sapiens
tggctgaggttcctctgc

SEQ ID NO: 5324558 - DNA, 21 bp, Homo sapiens
tggctgaggttcctctgcctg

SEQ ID NO: 5324559 - DNA, 20 bp, Homo sapiens
tggctgagtactggaataaa

SEQ ID NO: 5324560 - DNA, 16 bp, Homo sapiens
tggctgatctatgcct

SEQ ID NO: 5324561 - DNA, 22 bp, Homo sapiens
tggctgatgatccagaacagtg

SEQ ID NO: 5324562 - DNA, 21 bp, Homo sapiens
tggctgatgatgtcttctggt

SEQ ID NO: 5324563 - DNA, 18 bp, Homo sapiens
tggctgattcagcatttt

SEQ ID NO: 5324564 - DNA, 18 bp, Homo sapiens
tggctgattggaaaataa

SEQ ID NO: 5324565 - DNA, 21 bp, Homo sapiens
tggctgatttagaccaaaaga

SEQ ID NO: 5324566 - DNA, 20 bp, Homo sapiens
tggctgatttatttctacta

SEQ ID NO: 5324567 - DNA, 12 bp, Homo sapiens
tggctgcaaagg

SEQ ID NO: 5324568 - DNA, 23 bp, Homo sapiens
tggctgcaaagggtatcaggtgc

SEQ ID NO: 5324569 - DNA, 20 bp, Homo sapiens
tggctgcaagggccagagtt

SEQ ID NO: 5324570 - DNA, 22 bp, Homo sapiens
tggctgcaagtggttaagaatg

SEQ ID NO: 5324571 - DNA, 13 bp, Homo sapiens
tggctgcaattgc

SEQ ID NO: 5324572 - DNA, 16 bp, Homo sapiens
tggctgcacagcccaa

SEQ ID NO: 5324573 - DNA, 19 bp, Homo sapiens
tggctgcacagcccaacca

SEQ ID NO: 5324574 - DNA, 22 bp, Homo sapiens
tggctgcacagcccaaccagga

SEQ ID NO: 5324575 - DNA, 17 bp, Homo sapiens
tggctgcacgtcaccct

SEQ ID NO: 5324576 - DNA, 20 bp, Homo sapiens
tggctgcacgtcaccctcct

SEQ ID NO: 5324577 - DNA, 23 bp, Homo sapiens
tggctgcacgtcaccctcctgag

SEQ ID NO: 5324578 - DNA, 15 bp, Homo sapiens
tggctgcagagcagt

SEQ ID NO: 5324579 - DNA, 18 bp, Homo sapiens
tggctgcagagcagtggg

SEQ ID NO: 5324580 - DNA, 22 bp, Homo sapiens
tggctgcagagcagtgggcctg

SEQ ID NO: 5324581 - DNA, 13 bp, Homo sapiens
tggctgcagcagc

SEQ ID NO: 5324582 - DNA, 12 bp, Homo sapiens
tggctgcagcct

SEQ ID NO: 5324583 - DNA, 16 bp, Homo sapiens
tggctgcagcctcagg

SEQ ID NO: 5324584 - DNA, 20 bp, Homo sapiens
tggctgcagcctcaggactg

SEQ ID NO: 5324585 - DNA, 11 bp, Homo sapiens
tggctgcagct

SEQ ID NO: 5324586 - DNA, 19 bp, Homo sapiens
tggctgcaggaagaaactt

SEQ ID NO: 5324587 - DNA, 19 bp, Homo sapiens
tggctgcaggcaccgctgg

SEQ ID NO: 5324588 - DNA, 14 bp, Homo sapiens
tggctgcaggtgtt

SEQ ID NO: 5324589 - DNA, 22 bp, Homo sapiens
tggctgcaggtgttctgctgat

SEQ ID NO: 5324590 - DNA, 19 bp, Homo sapiens
tggctgcagtccgtgtgga

SEQ ID NO: 5324591 - DNA, 12 bp, Homo sapiens
tggctgcatgcg

SEQ ID NO: 5324592 - DNA, 18 bp, Homo sapiens
tggctgccaatgggagct

SEQ ID NO: 5324593 - DNA, 12 bp, Homo sapiens
tggctgccacac

SEQ ID NO: 5324594 - DNA, 14 bp, Homo sapiens
tggctgccacaccc

SEQ ID NO: 5324595 - DNA, 16 bp, Homo sapiens
tggctgccacacccag

SEQ ID NO: 5324596 - DNA, 11 bp, Homo sapiens
tggctgccagc

SEQ ID NO: 5324597 - DNA, 22 bp, Homo sapiens
tggctgccagctatttttacta

SEQ ID NO: 5324598 - DNA, 20 bp, Homo sapiens
tggctgcccagacccctctg

SEQ ID NO: 5324599 - DNA, 23 bp, Homo sapiens
tggctgcccagacccctctggcc

SEQ ID NO: 5324600 - DNA, 13 bp, Homo sapiens
tggctgcccagga

SEQ ID NO: 5324601 - DNA, 20 bp, Homo sapiens
tggctgccccaacctgctga

SEQ ID NO: 5324602 - DNA, 20 bp, Homo sapiens
tggctgccccacaggccaca

SEQ ID NO: 5324603 - DNA, 18 bp, Homo sapiens
tggctgccccacctgccg

SEQ ID NO: 5324604 - DNA, 22 bp, Homo sapiens
tggctgccccatttatccacct

SEQ ID NO: 5324605 - DNA, 13 bp, Homo sapiens
tggctgccccggc

SEQ ID NO: 5324606 - DNA, 12 bp, Homo sapiens
tggctgcccctc

SEQ ID NO: 5324607 - DNA, 14 bp, Homo sapiens
tggctgccggagga

SEQ ID NO: 5324608 - DNA, 17 bp, Homo sapiens
tggctgcctccactccc

SEQ ID NO: 5324609 - DNA, 20 bp, Homo sapiens
tggctgcctccactcccact

SEQ ID NO: 5324610 - DNA, 15 bp, Homo sapiens
tggctgcctgcatct

SEQ ID NO: 5324611 - DNA, 15 bp, Homo sapiens
tggctgcctggagcc

SEQ ID NO: 5324612 - DNA, 16 bp, Homo sapiens
tggctgcctggcccag

SEQ ID NO: 5324613 - DNA, 17 bp, Homo sapiens
tggctgcctggcccagg

SEQ ID NO: 5324614 - DNA, 16 bp, Homo sapiens
tggctgccttctgcgg

SEQ ID NO: 5324615 - DNA, 13 bp, Homo sapiens
tggctgccttctt

SEQ ID NO: 5324616 - DNA, 13 bp, Homo sapiens
tggctgcgccccc

SEQ ID NO: 5324617 - DNA, 17 bp, Homo sapiens
tggctgcgcccccagct

SEQ ID NO: 5324618 - DNA, 18 bp, Homo sapiens
tggctgcgcccccagctt

SEQ ID NO: 5324619 - DNA, 19 bp, Homo sapiens
tggctgcgctaacccccag

SEQ ID NO: 5324620 - DNA, 17 bp, Homo sapiens
tggctgcggcacccttg

SEQ ID NO: 5324621 - DNA, 20 bp, Homo sapiens
tggctgcgtactccactggt

SEQ ID NO: 5324622 - DNA, 13 bp, Homo sapiens
tggctgctaacaa

SEQ ID NO: 5324623 - DNA, 21 bp, Homo sapiens
tggctgctccccacccgcctc

SEQ ID NO: 5324624 - DNA, 15 bp, Homo sapiens
tggctgctccctgct

SEQ ID NO: 5324625 - DNA, 16 bp, Homo sapiens
tggctgctccctgctc

SEQ ID NO: 5324626 - DNA, 19 bp, Homo sapiens
tggctgctccctgctccca

SEQ ID NO: 5324627 - DNA, 20 bp, Homo sapiens
tggctgctccctgctcccag

SEQ ID NO: 5324628 - DNA, 21 bp, Homo sapiens
tggctgctccctgctcccagg

SEQ ID NO: 5324629 - DNA, 22 bp, Homo sapiens
tggctgctccctgctcccaggg

SEQ ID NO: 5324630 - DNA, 16 bp, Homo sapiens
tggctgctgaaggctc

SEQ ID NO: 5324631 - DNA, 17 bp, Homo sapiens
tggctgctgacaggatg

SEQ ID NO: 5324632 - DNA, 19 bp, Homo sapiens
tggctgctgacaggatgtg

SEQ ID NO: 5324633 - DNA, 20 bp, Homo sapiens
tggctgctgatcgccttccc

SEQ ID NO: 5324634 - DNA, 11 bp, Homo sapiens
tggctgctgcc

SEQ ID NO: 5324635 - DNA, 13 bp, Homo sapiens
tggctgctgccac

SEQ ID NO: 5324636 - DNA, 20 bp, Homo sapiens
tggctgctgcccccaccccg

SEQ ID NO: 5324637 - DNA, 15 bp, Homo sapiens
tggctgctgctcacc

SEQ ID NO: 5324638 - DNA, 22 bp, Homo sapiens
tggctgctggaggggacgctgg

SEQ ID NO: 5324639 - DNA, 12 bp, Homo sapiens
tggctgctggcc

SEQ ID NO: 5324640 - DNA, 22 bp, Homo sapiens
tggctgctggcccacagctctg

SEQ ID NO: 5324641 - DNA, 17 bp, Homo sapiens
tggctgcttgcagccag

SEQ ID NO: 5324642 - DNA, 13 bp, Homo sapiens
tggctgctttgcc

SEQ ID NO: 5324643 - DNA, 23 bp, Homo sapiens
tggctgctttgtagtttgcccag

SEQ ID NO: 5324644 - DNA, 17 bp, Homo sapiens
tggctggaaagcagagc

SEQ ID NO: 5324645 - DNA, 20 bp, Homo sapiens
tggctggaagatcctgcggg

SEQ ID NO: 5324646 - DNA, 18 bp, Homo sapiens
tggctggaaggggtccag

SEQ ID NO: 5324647 - DNA, 22 bp, Homo sapiens
tggctggaatgggggccaggct

SEQ ID NO: 5324648 - DNA, 15 bp, Homo sapiens
tggctggaatttctg

SEQ ID NO: 5324649 - DNA, 14 bp, Homo sapiens
tggctggacaaact

SEQ ID NO: 5324650 - DNA, 13 bp, Homo sapiens
tggctggacccag

SEQ ID NO: 5324651 - DNA, 14 bp, Homo sapiens
tggctggacccagc

SEQ ID NO: 5324652 - DNA, 15 bp, Homo sapiens
tggctggacccagcc

SEQ ID NO: 5324653 - DNA, 16 bp, Homo sapiens
tggctggacccagcca

SEQ ID NO: 5324654 - DNA, 17 bp, Homo sapiens
tggctggagagctgcta

SEQ ID NO: 5324655 - DNA, 21 bp, Homo sapiens
tggctggagatggctgctgct

SEQ ID NO: 5324656 - DNA, 22 bp, Homo sapiens
tggctggagatggctgctgctc

SEQ ID NO: 5324657 - DNA, 16 bp, Homo sapiens
tggctggagccccatc

SEQ ID NO: 5324658 - DNA, 16 bp, Homo sapiens
tggctggaggaaggaa

SEQ ID NO: 5324659 - DNA, 17 bp, Homo sapiens
tggctggaggaaggaaa

SEQ ID NO: 5324660 - DNA, 17 bp, Homo sapiens
tggctggaggagcagca

SEQ ID NO: 5324661 - DNA, 15 bp, Homo sapiens
tggctggaggagctg

SEQ ID NO: 5324662 - DNA, 19 bp, Homo sapiens
tggctggaggagctggcct

SEQ ID NO: 5324663 - DNA, 21 bp, Homo sapiens
tggctggaggagctggcctgt

SEQ ID NO: 5324664 - DNA, 22 bp, Homo sapiens
tggctggaggagctggcctgtg

SEQ ID NO: 5324665 - DNA, 22 bp, Homo sapiens
tggctggcaggcagttctagaa

SEQ ID NO: 5324666 - DNA, 23 bp, Homo sapiens
tggctggcaggcagttctagaag

SEQ ID NO: 5324667 - DNA, 14 bp, Homo sapiens
tggctggcaggtgt

SEQ ID NO: 5324668 - DNA, 12 bp, Homo sapiens
tggctggccagg

SEQ ID NO: 5324669 - DNA, 11 bp, Homo sapiens
tggctggcctg

SEQ ID NO: 5324670 - DNA, 13 bp, Homo sapiens
tggctggcctggt

SEQ ID NO: 5324671 - DNA, 20 bp, Homo sapiens
tggctggcggggtcccccct

SEQ ID NO: 5324672 - DNA, 14 bp, Homo sapiens
tggctggctcctag

SEQ ID NO: 5324673 - DNA, 17 bp, Homo sapiens
tggctggctgagggcag

SEQ ID NO: 5324674 - DNA, 14 bp, Homo sapiens
tggctggctgcagt

SEQ ID NO: 5324675 - DNA, 15 bp, Homo sapiens
tggctggctgtgtcc

SEQ ID NO: 5324676 - DNA, 20 bp, Homo sapiens
tggctgggaacatgacccag

SEQ ID NO: 5324677 - DNA, 17 bp, Homo sapiens
tggctgggaactgcaga

SEQ ID NO: 5324678 - DNA, 16 bp, Homo sapiens
tggctgggacattttc

SEQ ID NO: 5324679 - DNA, 12 bp, Homo sapiens
tggctgggacct

SEQ ID NO: 5324680 - DNA, 17 bp, Homo sapiens
tggctgggactgggaac

SEQ ID NO: 5324681 - DNA, 20 bp, Homo sapiens
tggctgggagtccttacctc

SEQ ID NO: 5324682 - DNA, 17 bp, Homo sapiens
tggctgggatcagagca

SEQ ID NO: 5324683 - DNA, 12 bp, Homo sapiens
tggctgggcatg

SEQ ID NO: 5324684 - DNA, 15 bp, Homo sapiens
tggctgggcccagaa

SEQ ID NO: 5324685 - DNA, 16 bp, Homo sapiens
tggctgggcccagaag

SEQ ID NO: 5324686 - DNA, 14 bp, Homo sapiens
tggctgggcccagc

SEQ ID NO: 5324687 - DNA, 17 bp, Homo sapiens
tggctgggcccctgggg

SEQ ID NO: 5324688 - DNA, 18 bp, Homo sapiens
tggctgggcccctgggga

SEQ ID NO: 5324689 - DNA, 14 bp, Homo sapiens
tggctgggcctctg

SEQ ID NO: 5324690 - DNA, 18 bp, Homo sapiens
tggctgggcgtgctagag

SEQ ID NO: 5324691 - DNA, 21 bp, Homo sapiens
tggctggggacttggccgctt

SEQ ID NO: 5324692 - DNA, 15 bp, Homo sapiens
tggctggggcagagg

SEQ ID NO: 5324693 - DNA, 16 bp, Homo sapiens
tggctggggccgctgg

SEQ ID NO: 5324694 - DNA, 20 bp, Homo sapiens
tggctggggcctatcagtgt

SEQ ID NO: 5324695 - DNA, 15 bp, Homo sapiens
tggctgggggaggga

SEQ ID NO: 5324696 - DNA, 23 bp, Homo sapiens
tggctgggggagggactgctgac

SEQ ID NO: 5324697 - DNA, 23 bp, Homo sapiens
tggctgggggcaggacaacacag

SEQ ID NO: 5324698 - DNA, 22 bp, Homo sapiens
tggctgggggcatgggggaggc

SEQ ID NO: 5324699 - DNA, 14 bp, Homo sapiens
tggctgggggcctc

SEQ ID NO: 5324700 - DNA, 18 bp, Homo sapiens
tggctggggtggagtggg

SEQ ID NO: 5324701 - DNA, 21 bp, Homo sapiens
tggctggggtgggggtgggga

SEQ ID NO: 5324702 - DNA, 14 bp, Homo sapiens
tggctggggtgtca

SEQ ID NO: 5324703 - DNA, 19 bp, Homo sapiens
tggctggggtgtcaataaa

SEQ ID NO: 5324704 - DNA, 21 bp, Homo sapiens
tggctggggtgtcaataaagc

SEQ ID NO: 5324705 - DNA, 20 bp, Homo sapiens
tggctgggtcagggccagac

SEQ ID NO: 5324706 - DNA, 20 bp, Homo sapiens
tggctgggtccttgggcctg

SEQ ID NO: 5324707 - DNA, 23 bp, Homo sapiens
tggctgggtccttgggcctggcc

SEQ ID NO: 5324708 - DNA, 19 bp, Homo sapiens
tggctgggtcgcccctcct

SEQ ID NO: 5324709 - DNA, 16 bp, Homo sapiens
tggctgggtgccctct

SEQ ID NO: 5324710 - DNA, 16 bp, Homo sapiens
tggctgggtgggccca

SEQ ID NO: 5324711 - DNA, 22 bp, Homo sapiens
tggctgggtgggcccagaactg

SEQ ID NO: 5324712 - DNA, 23 bp, Homo sapiens
tggctgggtggtattctggtagg

SEQ ID NO: 5324713 - DNA, 17 bp, Homo sapiens
tggctgggtggtcagca

SEQ ID NO: 5324714 - DNA, 17 bp, Homo sapiens
tggctgggtgttttcaa

SEQ ID NO: 5324715 - DNA, 20 bp, Homo sapiens
tggctgggtttgggcagtgg

SEQ ID NO: 5324716 - DNA, 22 bp, Homo sapiens
tggctgggtttgggcagtggag

SEQ ID NO: 5324717 - DNA, 15 bp, Homo sapiens
tggctggtagaaaaa

SEQ ID NO: 5324718 - DNA, 14 bp, Homo sapiens
tggctggtcaactt

SEQ ID NO: 5324719 - DNA, 13 bp, Homo sapiens
tggctggtccagg

SEQ ID NO: 5324720 - DNA, 15 bp, Homo sapiens
tggctggtccagggc

SEQ ID NO: 5324721 - DNA, 20 bp, Homo sapiens
tggctggtcctcccatttct

SEQ ID NO: 5324722 - DNA, 14 bp, Homo sapiens
tggctggtctcacc

SEQ ID NO: 5324723 - DNA, 16 bp, Homo sapiens
tggctggtcttcactt

SEQ ID NO: 5324724 - DNA, 22 bp, Homo sapiens
tggctggtgagaccccgcactg

SEQ ID NO: 5324725 - DNA, 14 bp, Homo sapiens
tggctggtgcctga

SEQ ID NO: 5324726 - DNA, 15 bp, Homo sapiens
tggctggtgcctgaa

SEQ ID NO: 5324727 - DNA, 16 bp, Homo sapiens
tggctggtgtcccctt

SEQ ID NO: 5324728 - DNA, 15 bp, Homo sapiens
tggctggtgttaaca

SEQ ID NO: 5324729 - DNA, 19 bp, Homo sapiens
tggctggtgttaacagaag

SEQ ID NO: 5324730 - DNA, 21 bp, Homo sapiens
tggctggtgttaacagaaggg

SEQ ID NO: 5324731 - DNA, 22 bp, Homo sapiens
tggctggttagaggttcccttt

SEQ ID NO: 5324732 - DNA, 15 bp, Homo sapiens
tggctgtaacctgct

SEQ ID NO: 5324733 - DNA, 15 bp, Homo sapiens
tggctgtaaggctct

SEQ ID NO: 5324734 - DNA, 16 bp, Homo sapiens
tggctgtaaggctcta

SEQ ID NO: 5324735 - DNA, 19 bp, Homo sapiens
tggctgtaaggctctagat

SEQ ID NO: 5324736 - DNA, 22 bp, Homo sapiens
tgggaagactcaggagtctgcc

SEQ ID NO: 5324737 - DNA, 21 bp, Homo sapiens
tgggaagactgaggcatccgt

SEQ ID NO: 5324738 - DNA, 12 bp, Homo sapiens
tgggaagagaag

SEQ ID NO: 5324739 - DNA, 23 bp, Homo sapiens
tgggaagagaagagggcccagcc

SEQ ID NO: 5324740 - DNA, 14 bp, Homo sapiens
tgggaagagctggg

SEQ ID NO: 5324741 - DNA, 13 bp, Homo sapiens
tgggaagaggact

SEQ ID NO: 5324742 - DNA, 20 bp, Homo sapiens
tgggaagagggggctggcca

SEQ ID NO: 5324743 - DNA, 21 bp, Homo sapiens
tgggaagagggggctggccat

SEQ ID NO: 5324744 - DNA, 22 bp, Homo sapiens
tgggaagagggggctggccatg

SEQ ID NO: 5324745 - DNA, 11 bp, Homo sapiens
tgggaagatga

SEQ ID NO: 5324746 - DNA, 12 bp, Homo sapiens
tgggaagatgct

SEQ ID NO: 5324747 - DNA, 13 bp, Homo sapiens
tgggaagatgctg

SEQ ID NO: 5324748 - DNA, 18 bp, Homo sapiens
tgggaagatgctggcccc

SEQ ID NO: 5324749 - DNA, 18 bp, Homo sapiens
tgggaagatggtagcaga

SEQ ID NO: 5324750 - DNA, 16 bp, Homo sapiens
tgggaagcaagcaggg

SEQ ID NO: 5324751 - DNA, 12 bp, Homo sapiens
tgggaagcagtt

SEQ ID NO: 5324752 - DNA, 24 bp, Homo sapiens
tgggaagccaggaaagcgtttgga

SEQ ID NO: 5324753 - DNA, 21 bp, Homo sapiens
tgggaagcctttactgaccct

SEQ ID NO: 5324754 - DNA, 17 bp, Homo sapiens
tgggaagctatttcctt

SEQ ID NO: 5324755 - DNA, 21 bp, Homo sapiens
tgggaagctgtactcagagca

SEQ ID NO: 5324756 - DNA, 22 bp, Homo sapiens
tgggaagctgtactcagagcag

SEQ ID NO: 5324757 - DNA, 23 bp, Homo sapiens
tgggaagctgtactcagagcaga

SEQ ID NO: 5324758 - DNA, 14 bp, Homo sapiens
tgggaagctgtaga

SEQ ID NO: 5324759 - DNA, 21 bp, Homo sapiens
tgggaagctgtagaggaccag

SEQ ID NO: 5324760 - DNA, 16 bp, Homo sapiens
tgggaagcttgagcct

SEQ ID NO: 5324761 - DNA, 17 bp, Homo sapiens
tgggaagcttgagcctc

SEQ ID NO: 5324762 - DNA, 17 bp, Homo sapiens
tgggaaggaaatatatt

SEQ ID NO: 5324763 - DNA, 22 bp, Homo sapiens
tgggaaggaagcttggctgctc

SEQ ID NO: 5324764 - DNA, 23 bp, Homo sapiens
tgggaaggaagcttggctgctca

SEQ ID NO: 5324765 - DNA, 15 bp, Homo sapiens
tgggaaggccagcct

SEQ ID NO: 5324766 - DNA, 16 bp, Homo sapiens
tgggaaggccagctgc

SEQ ID NO: 5324767 - DNA, 17 bp, Homo sapiens
tgggaaggccggcagcg

SEQ ID NO: 5324768 - DNA, 21 bp, Homo sapiens
tgggaaggcgagtctggggac

SEQ ID NO: 5324769 - DNA, 14 bp, Homo sapiens
tgggaagggagcat

SEQ ID NO: 5324770 - DNA, 22 bp, Homo sapiens
tgggaagggagcattgcagcct

SEQ ID NO: 5324771 - DNA, 15 bp, Homo sapiens
tgggaagggataatt

SEQ ID NO: 5324772 - DNA, 22 bp, Homo sapiens
tgggaaggggacccccgccccc

SEQ ID NO: 5324773 - DNA, 12 bp, Homo sapiens
tgggaaggggct

SEQ ID NO: 5324774 - DNA, 20 bp, Homo sapiens
tgggaagggtcatagaaagg

SEQ ID NO: 5324775 - DNA, 21 bp, Homo sapiens
tgggaaggtgggtgaggctgg

SEQ ID NO: 5324776 - DNA, 21 bp, Homo sapiens
tgggaaggtgtttaaagagtt

SEQ ID NO: 5324777 - DNA, 18 bp, Homo sapiens
tgggaagtccggccccag

SEQ ID NO: 5324778 - DNA, 16 bp, Homo sapiens
tgggaagtcctggcac

SEQ ID NO: 5324779 - DNA, 23 bp, Homo sapiens
tgggaagtcgtccttactcctgt

SEQ ID NO: 5324780 - DNA, 16 bp, Homo sapiens
tgggaagtctcagcct

SEQ ID NO: 5324781 - DNA, 15 bp, Homo sapiens
tgggaagtgaagccc

SEQ ID NO: 5324782 - DNA, 19 bp, Homo sapiens
tgggaagtgtgtttagaag

SEQ ID NO: 5324783 - DNA, 16 bp, Homo sapiens
tgggaagtttgctgtg

SEQ ID NO: 5324784 - DNA, 18 bp, Homo sapiens
tgggaagtttgctgtgct

SEQ ID NO: 5324785 - DNA, 23 bp, Homo sapiens
tgggaataagtgccaggatggaa

SEQ ID NO: 5324786 - DNA, 23 bp, Homo sapiens
tgggaatacaaaaggtttgagat

SEQ ID NO: 5324787 - DNA, 13 bp, Homo sapiens
tgggaatacatct

SEQ ID NO: 5324788 - DNA, 17 bp, Homo sapiens
tgggaatacatctgtgg

SEQ ID NO: 5324789 - DNA, 15 bp, Homo sapiens
tgggaatatttgaat

SEQ ID NO: 5324790 - DNA, 18 bp, Homo sapiens
tgggaatatttgaatctt

SEQ ID NO: 5324791 - DNA, 20 bp, Homo sapiens
tgggaatatttgaatcttgt

SEQ ID NO: 5324792 - DNA, 20 bp, Homo sapiens
tgggaatcatggcctcttga

SEQ ID NO: 5324793 - DNA, 16 bp, Homo sapiens
tgggaatcattccact

SEQ ID NO: 5324794 - DNA, 16 bp, Homo sapiens
tgggaatcattctggc

SEQ ID NO: 5324795 - DNA, 13 bp, Homo sapiens
tgggaatcctgct

SEQ ID NO: 5324796 - DNA, 19 bp, Homo sapiens
tgggaatgaaattaacaca

SEQ ID NO: 5324797 - DNA, 15 bp, Homo sapiens
tgggaatgaagcttg

SEQ ID NO: 5324798 - DNA, 20 bp, Homo sapiens
tgggaatgaagcttgtgtat

SEQ ID NO: 5324799 - DNA, 16 bp, Homo sapiens
tgggaatgaggaaaat

SEQ ID NO: 5324800 - DNA, 18 bp, Homo sapiens
tgggaatgaggcttgctg

SEQ ID NO: 5324801 - DNA, 14 bp, Homo sapiens
tgggaatgaggtgg

SEQ ID NO: 5324802 - DNA, 17 bp, Homo sapiens
tgggaatgaggtgggag

SEQ ID NO: 5324803 - DNA, 20 bp, Homo sapiens
tgggaatgatagcccagaac

SEQ ID NO: 5324804 - DNA, 21 bp, Homo sapiens
tgggaatgcagtgggtggggc

SEQ ID NO: 5324805 - DNA, 23 bp, Homo sapiens
tgggaatggattttttttttcag

SEQ ID NO: 5324806 - DNA, 13 bp, Homo sapiens
tgggaatgggaga

SEQ ID NO: 5324807 - DNA, 14 bp, Homo sapiens
tgggaatgggagag

SEQ ID NO: 5324808 - DNA, 13 bp, Homo sapiens
tgggaatggggtg

SEQ ID NO: 5324809 - DNA, 21 bp, Homo sapiens
tgggaatgtatagtatttgaa

SEQ ID NO: 5324810 - DNA, 22 bp, Homo sapiens
tgggaatgtatagtatttgaaa

SEQ ID NO: 5324811 - DNA, 23 bp, Homo sapiens
tgggaatgtatagtatttgaaaa

SEQ ID NO: 5324812 - DNA, 21 bp, Homo sapiens
tgggaatgtattattctgcag

SEQ ID NO: 5324813 - DNA, 19 bp, Homo sapiens
tgggaatgtcctgtagaga

SEQ ID NO: 5324814 - DNA, 20 bp, Homo sapiens
tgggaatgttacattgtttg

SEQ ID NO: 5324815 - DNA, 21 bp, Homo sapiens
tgggaatgttctttctgctct

SEQ ID NO: 5324816 - DNA, 22 bp, Homo sapiens
tgggaatgttctttctgctcta

SEQ ID NO: 5324817 - DNA, 22 bp, Homo sapiens
tgggaatgtttgtctcatccca

SEQ ID NO: 5324818 - DNA, 23 bp, Homo sapiens
tgggaattagtgagacatcaggg

SEQ ID NO: 5324819 - DNA, 17 bp, Homo sapiens
tgggaattcttgctgtt

SEQ ID NO: 5324820 - DNA, 15 bp, Homo sapiens
tgggaattgcgctca

SEQ ID NO: 5324821 - DNA, 17 bp, Homo sapiens
tgggaattgctggagga

SEQ ID NO: 5324822 - DNA, 23 bp, Homo sapiens
tgggaattggaatcaaaagagtt

SEQ ID NO: 5324823 - DNA, 20 bp, Homo sapiens
tgggaattggggagggagaa

SEQ ID NO: 5324824 - DNA, 13 bp, Homo sapiens
tgggaattgtgtg

SEQ ID NO: 5324825 - DNA, 14 bp, Homo sapiens
tgggaatttattta

SEQ ID NO: 5324826 - DNA, 23 bp, Homo sapiens
tgggacaaaccagagcagagagc

SEQ ID NO: 5324827 - DNA, 19 bp, Homo sapiens
tgggacaaatcaagcttca

SEQ ID NO: 5324828 - DNA, 15 bp, Homo sapiens
tgggacaactgctcc

SEQ ID NO: 5324829 - DNA, 16 bp, Homo sapiens
tgggacaagcagtccc

SEQ ID NO: 5324830 - DNA, 16 bp, Homo sapiens
tgggacaattgtttta

SEQ ID NO: 5324831 - DNA, 20 bp, Homo sapiens
tgggacacagacccaggacc

SEQ ID NO: 5324832 - DNA, 13 bp, Homo sapiens
tgggacacagaga

SEQ ID NO: 5324833 - DNA, 15 bp, Homo sapiens
tgggacacagagacc

SEQ ID NO: 5324834 - DNA, 14 bp, Homo sapiens
tgggacaccctgtg

SEQ ID NO: 5324835 - DNA, 17 bp, Homo sapiens
tgggacacctcagaaaa

SEQ ID NO: 5324836 - DNA, 12 bp, Homo sapiens
tgggacacctgg

SEQ ID NO: 5324837 - DNA, 21 bp, Homo sapiens
tgggacacctgggagaaggtc

SEQ ID NO: 5324838 - DNA, 21 bp, Homo sapiens
tgggacactgcgggacagagg

SEQ ID NO: 5324839 - DNA, 20 bp, Homo sapiens
tgggacactgggcagcaagg

SEQ ID NO: 5324840 - DNA, 22 bp, Homo sapiens
tgggacactgggcagcaaggct

SEQ ID NO: 5324841 - DNA, 20 bp, Homo sapiens
tgggacacttccctgggcct

SEQ ID NO: 5324842 - DNA, 16 bp, Homo sapiens
tgggacagacagcagc

SEQ ID NO: 5324843 - DNA, 20 bp, Homo sapiens
tgggacagacagcagctgga

SEQ ID NO: 5324844 - DNA, 11 bp, Homo sapiens
tgggacagagg

SEQ ID NO: 5324845 - DNA, 22 bp, Homo sapiens
tgggacagaggagcaaggttta

SEQ ID NO: 5324846 - DNA, 11 bp, Homo sapiens
tgggacagcca

SEQ ID NO: 5324847 - DNA, 12 bp, Homo sapiens
tgggacagccag

SEQ ID NO: 5324848 - DNA, 18 bp, Homo sapiens
tgggacagccagagctgg

SEQ ID NO: 5324849 - DNA, 23 bp, Homo sapiens
tgggacagccagagctgggtggg

SEQ ID NO: 5324850 - DNA, 20 bp, Homo sapiens
tgggacagcccagagcctgg

SEQ ID NO: 5324851 - DNA, 15 bp, Homo sapiens
tgggacagccccagg

SEQ ID NO: 5324852 - DNA, 16 bp, Homo sapiens
tgggacagccccaggg

SEQ ID NO: 5324853 - DNA, 20 bp, Homo sapiens
tgggacagccccagggccct

SEQ ID NO: 5324854 - DNA, 12 bp, Homo sapiens
tgggacagcctc

SEQ ID NO: 5324855 - DNA, 23 bp, Homo sapiens
tgggacagctaggctgagatgca

SEQ ID NO: 5324856 - DNA, 16 bp, Homo sapiens
tgggacagctggctgg

SEQ ID NO: 5324857 - DNA, 18 bp, Homo sapiens
tgggacaggcaccatgct

SEQ ID NO: 5324858 - DNA, 17 bp, Homo sapiens
tgggacaggctcttctt

SEQ ID NO: 5324859 - DNA, 12 bp, Homo sapiens
tgggacagggag

SEQ ID NO: 5324860 - DNA, 22 bp, Homo sapiens
tgggacagggagggtgttttgg

SEQ ID NO: 5324861 - DNA, 11 bp, Homo sapiens
tgggacagggc

SEQ ID NO: 5324862 - DNA, 15 bp, Homo sapiens
tgggacagggcttct

SEQ ID NO: 5324863 - DNA, 18 bp, Homo sapiens
tgggacagtcacctcatg

SEQ ID NO: 5324864 - DNA, 20 bp, Homo sapiens
tgggacatggaaaagaaggc

SEQ ID NO: 5324865 - DNA, 21 bp, Homo sapiens
tgggacatttttgtctgtcct

SEQ ID NO: 5324866 - DNA, 18 bp, Homo sapiens
tgggaccacaggcatgca

SEQ ID NO: 5324867 - DNA, 22 bp, Homo sapiens
tgggaccacatgccactgcctg

SEQ ID NO: 5324868 - DNA, 23 bp, Homo sapiens
tgggaccacatgccactgcctgc

SEQ ID NO: 5324869 - DNA, 15 bp, Homo sapiens
tgggaccagagccag

SEQ ID NO: 5324870 - DNA, 18 bp, Homo sapiens
tgggaccaggccaatccc

SEQ ID NO: 5324871 - DNA, 21 bp, Homo sapiens
tgggaccagtcccacaccgct

SEQ ID NO: 5324872 - DNA, 20 bp, Homo sapiens
tgggacccaaaacacaggaa

SEQ ID NO: 5324873 - DNA, 12 bp, Homo sapiens
tgggacccacag

SEQ ID NO: 5324874 - DNA, 16 bp, Homo sapiens
tgggacccacagaact

SEQ ID NO: 5324875 - DNA, 21 bp, Homo sapiens
tgggacccacagaacttgtgg

SEQ ID NO: 5324876 - DNA, 14 bp, Homo sapiens
tgggacccacctcc

SEQ ID NO: 5324877 - DNA, 13 bp, Homo sapiens
tgggacccagcta

SEQ ID NO: 5324878 - DNA, 17 bp, Homo sapiens
tgggacccaggctccca

SEQ ID NO: 5324879 - DNA, 17 bp, Homo sapiens
tgggacccagtggcagg

SEQ ID NO: 5324880 - DNA, 18 bp, Homo sapiens
tgggacccagtggcaggg

SEQ ID NO: 5324881 - DNA, 14 bp, Homo sapiens
tgggaccccagaga

SEQ ID NO: 5324882 - DNA, 13 bp, Homo sapiens
tgggaccccagct

SEQ ID NO: 5324883 - DNA, 22 bp, Homo sapiens
tgggaccccagctagggctgga

SEQ ID NO: 5324884 - DNA, 15 bp, Homo sapiens
tgggaccccagctgc

SEQ ID NO: 5324885 - DNA, 18 bp, Homo sapiens
tgggaccccagctgctct

SEQ ID NO: 5324886 - DNA, 16 bp, Homo sapiens
tgggaccccaggccca

SEQ ID NO: 5324887 - DNA, 20 bp, Homo sapiens
tgggaccccctcgccagctt

SEQ ID NO: 5324888 - DNA, 21 bp, Homo sapiens
tgggaccccctcgccagcttg

SEQ ID NO: 5324889 - DNA, 20 bp, Homo sapiens
tgggacccctcccaacctca

SEQ ID NO: 5324890 - DNA, 21 bp, Homo sapiens
tgggacccgaggatttctggg

SEQ ID NO: 5324891 - DNA, 14 bp, Homo sapiens
tgggacccgggcct

SEQ ID NO: 5324892 - DNA, 18 bp, Homo sapiens
tgggaccctcagcagctc

SEQ ID NO: 5324893 - DNA, 20 bp, Homo sapiens
tgggaccctccagtgctgga

SEQ ID NO: 5324894 - DNA, 22 bp, Homo sapiens
tgggaccctcggggcaggaagt

SEQ ID NO: 5324895 - DNA, 23 bp, Homo sapiens
tgggaccctgctttagagctagg

SEQ ID NO: 5324896 - DNA, 13 bp, Homo sapiens
tgggaccctttcc

SEQ ID NO: 5324897 - DNA, 17 bp, Homo sapiens
tgggaccctttccttcc

SEQ ID NO: 5324898 - DNA, 21 bp, Homo sapiens
tgggaccgccagatggggcct

SEQ ID NO: 5324899 - DNA, 16 bp, Homo sapiens
tgggaccgcctggccc

SEQ ID NO: 5324900 - DNA, 15 bp, Homo sapiens
tgggaccgctacacc

SEQ ID NO: 5324901 - DNA, 22 bp, Homo sapiens
tgggaccgtgccccacctcccc

SEQ ID NO: 5324902 - DNA, 23 bp, Homo sapiens
tgggaccgtgccccacctcccca

SEQ ID NO: 5324903 - DNA, 17 bp, Homo sapiens
tgggacctaaaaaggtc

SEQ ID NO: 5324904 - DNA, 23 bp, Homo sapiens
tgggacctataactgcccagcgg

SEQ ID NO: 5324905 - DNA, 24 bp, Homo sapiens
tgggacctccaccgttggtgttca

SEQ ID NO: 5324906 - DNA, 12 bp, Homo sapiens
tgggacctcctc

SEQ ID NO: 5324907 - DNA, 14 bp, Homo sapiens
tgggacctcctccc

SEQ ID NO: 5324908 - DNA, 19 bp, Homo sapiens
tgggacctgaatgacctgc

SEQ ID NO: 5324909 - DNA, 21 bp, Homo sapiens
tgggacctgaatgacctgcag

SEQ ID NO: 5324910 - DNA, 17 bp, Homo sapiens
tgggacctgatttattg

SEQ ID NO: 5324911 - DNA, 20 bp, Homo sapiens
tgggacctgccaggcagggg

SEQ ID NO: 5324912 - DNA, 21 bp, Homo sapiens
tgggagctttaaagagcagga

SEQ ID NO: 5324913 - DNA, 16 bp, Homo sapiens
tgggaggaaagagagc

SEQ ID NO: 5324914 - DNA, 18 bp, Homo sapiens
tgggaggaaagagagcag

SEQ ID NO: 5324915 - DNA, 14 bp, Homo sapiens
tgggaggaacctga

SEQ ID NO: 5324916 - DNA, 19 bp, Homo sapiens
tgggaggaagcagaataaa

SEQ ID NO: 5324917 - DNA, 11 bp, Homo sapiens
tgggaggacag

SEQ ID NO: 5324918 - DNA, 21 bp, Homo sapiens
tgggaggacatgcgtgtgtca

SEQ ID NO: 5324919 - DNA, 20 bp, Homo sapiens
tgggaggacggtgcaaccca

SEQ ID NO: 5324920 - DNA, 12 bp, Homo sapiens
tgggaggagagc

SEQ ID NO: 5324921 - DNA, 15 bp, Homo sapiens
tgggaggagagccac

SEQ ID NO: 5324922 - DNA, 20 bp, Homo sapiens
tgggaggagagccactgggc

SEQ ID NO: 5324923 - DNA, 17 bp, Homo sapiens
tgggaggagagggcaga

SEQ ID NO: 5324924 - DNA, 15 bp, Homo sapiens
tgggaggaggaaaag

SEQ ID NO: 5324925 - DNA, 14 bp, Homo sapiens
tgggaggagggaga

SEQ ID NO: 5324926 - DNA, 23 bp, Homo sapiens
tgggaggagggaggcggcctcca

SEQ ID NO: 5324927 - DNA, 17 bp, Homo sapiens
tgggaggagggcaggca

SEQ ID NO: 5324928 - DNA, 21 bp, Homo sapiens
tgggaggagggggagggtgat

SEQ ID NO: 5324929 - DNA, 15 bp, Homo sapiens
tgggaggatcctgag

SEQ ID NO: 5324930 - DNA, 12 bp, Homo sapiens
tgggaggattac

SEQ ID NO: 5324931 - DNA, 14 bp, Homo sapiens
tgggaggcaaatgg

SEQ ID NO: 5324932 - DNA, 23 bp, Homo sapiens
tgggaggcagccgaggcctggcc

SEQ ID NO: 5324933 - DNA, 23 bp, Homo sapiens
tgggaggcaggtcccgagccccc

SEQ ID NO: 5324934 - DNA, 19 bp, Homo sapiens
tgggaggcaggtcgggctg

SEQ ID NO: 5324935 - DNA, 11 bp, Homo sapiens
tgggaggccaa

SEQ ID NO: 5324936 - DNA, 14 bp, Homo sapiens
tgggaggccaagga

SEQ ID NO: 5324937 - DNA, 19 bp, Homo sapiens
tgggaggccaaggtgggcg

SEQ ID NO: 5324938 - DNA, 21 bp, Homo sapiens
tgggaggccaaggtgggcgga

SEQ ID NO: 5324939 - DNA, 14 bp, Homo sapiens
tgggaggccaggcg

SEQ ID NO: 5324940 - DNA, 21 bp, Homo sapiens
tgggaggccaggcgagcctga

SEQ ID NO: 5324941 - DNA, 17 bp, Homo sapiens
tgggaggcccctggtgg

SEQ ID NO: 5324942 - DNA, 15 bp, Homo sapiens
tgggaggcccggggc

SEQ ID NO: 5324943 - DNA, 13 bp, Homo sapiens
tgggaggccctgg

SEQ ID NO: 5324944 - DNA, 14 bp, Homo sapiens
tgggaggccgaggc

SEQ ID NO: 5324945 - DNA, 17 bp, Homo sapiens
tgggaggccgaggcacg

SEQ ID NO: 5324946 - DNA, 16 bp, Homo sapiens
tgggaggccgaggcag

SEQ ID NO: 5324947 - DNA, 18 bp, Homo sapiens
tgggaggccgaggcaggt

SEQ ID NO: 5324948 - DNA, 21 bp, Homo sapiens
tgggaggccgaggcaggtgga

SEQ ID NO: 5324949 - DNA, 18 bp, Homo sapiens
tgggaggcctaggcgggc

SEQ ID NO: 5324950 - DNA, 14 bp, Homo sapiens
tgggaggcgcgagc

SEQ ID NO: 5324951 - DNA, 22 bp, Homo sapiens
tgggaggcgtgcccccctcctc

SEQ ID NO: 5324952 - DNA, 15 bp, Homo sapiens
tgggaggctcctggt

SEQ ID NO: 5324953 - DNA, 18 bp, Homo sapiens
tgggaggctcctggtggg

SEQ ID NO: 5324954 - DNA, 22 bp, Homo sapiens
tgggaggctcctgttagctcct

SEQ ID NO: 5324955 - DNA, 22 bp, Homo sapiens
tgggaggctcggggctccccac

SEQ ID NO: 5324956 - DNA, 14 bp, Homo sapiens
tgggaggctgaggc

SEQ ID NO: 5324957 - DNA, 16 bp, Homo sapiens
tgggaggctgaggcag

SEQ ID NO: 5324958 - DNA, 14 bp, Homo sapiens
tgggaggctgaggt

SEQ ID NO: 5324959 - DNA, 18 bp, Homo sapiens
tgggaggctggggaccca

SEQ ID NO: 5324960 - DNA, 19 bp, Homo sapiens
tgggaggctggggacccag

SEQ ID NO: 5324961 - DNA, 17 bp, Homo sapiens
tgggaggctgtggagag

SEQ ID NO: 5324962 - DNA, 17 bp, Homo sapiens
tgggagggacagggctt

SEQ ID NO: 5324963 - DNA, 17 bp, Homo sapiens
tgggagggagcagacag

SEQ ID NO: 5324964 - DNA, 19 bp, Homo sapiens
tgggagggagcagacagga

SEQ ID NO: 5324965 - DNA, 12 bp, Homo sapiens
tgggagggagct

SEQ ID NO: 5324966 - DNA, 11 bp, Homo sapiens
tgggagggagg

SEQ ID NO: 5324967 - DNA, 15 bp, Homo sapiens
tgggagggaggaggg

SEQ ID NO: 5324968 - DNA, 17 bp, Homo sapiens
tgggagggaggctcagg

SEQ ID NO: 5324969 - DNA, 12 bp, Homo sapiens
tgggagggaggg

SEQ ID NO: 5324970 - DNA, 18 bp, Homo sapiens
tgggagggatagaggggg

SEQ ID NO: 5324971 - DNA, 13 bp, Homo sapiens
tgggagggatcag

SEQ ID NO: 5324972 - DNA, 14 bp, Homo sapiens
tgggagggatggcc

SEQ ID NO: 5324973 - DNA, 21 bp, Homo sapiens
tgggagggatggcccttcctc

SEQ ID NO: 5324974 - DNA, 12 bp, Homo sapiens
tgggagggccca

SEQ ID NO: 5324975 - DNA, 13 bp, Homo sapiens
tgggaggggaaga

SEQ ID NO: 5324976 - DNA, 17 bp, Homo sapiens
tgggaggggaagggctg

SEQ ID NO: 5324977 - DNA, 18 bp, Homo sapiens
tgggaggggatggcagac

SEQ ID NO: 5324978 - DNA, 21 bp, Homo sapiens
tgggaggggatggcagacagt

SEQ ID NO: 5324979 - DNA, 15 bp, Homo sapiens
tgggaggggcaggct

SEQ ID NO: 5324980 - DNA, 16 bp, Homo sapiens
tgggaggggcaggctg

SEQ ID NO: 5324981 - DNA, 17 bp, Homo sapiens
tgggaggggcaggctga

SEQ ID NO: 5324982 - DNA, 20 bp, Homo sapiens
tgggaggggcgcccacctcc

SEQ ID NO: 5324983 - DNA, 22 bp, Homo sapiens
tgggagggggacccgtggagaa

SEQ ID NO: 5324984 - DNA, 14 bp, Homo sapiens
tgggagggggagga

SEQ ID NO: 5324985 - DNA, 15 bp, Homo sapiens
tgggagggggaggaa

SEQ ID NO: 5324986 - DNA, 16 bp, Homo sapiens
tgggagggggcacggg

SEQ ID NO: 5324987 - DNA, 13 bp, Homo sapiens
tgggagggggcag

SEQ ID NO: 5324988 - DNA, 16 bp, Homo sapiens
tgggagggggctccat

SEQ ID NO: 5324989 - DNA, 14 bp, Homo sapiens
tgggagggggtgag

SEQ ID NO: 5324990 - DNA, 16 bp, Homo sapiens
tgggaggggtgttcca

SEQ ID NO: 5324991 - DNA, 22 bp, Homo sapiens
tgggagggtggttcctgttctc

SEQ ID NO: 5324992 - DNA, 18 bp, Homo sapiens
tgggagggttcccctggc

SEQ ID NO: 5324993 - DNA, 23 bp, Homo sapiens
tgggaggtagaaggggaggacac

SEQ ID NO: 5324994 - DNA, 20 bp, Homo sapiens
tgggaggtataggggtcctg

SEQ ID NO: 5324995 - DNA, 17 bp, Homo sapiens
tgggaggtatgggctgg

SEQ ID NO: 5324996 - DNA, 22 bp, Homo sapiens
tgggaggtatgggctgggggct

SEQ ID NO: 5324997 - DNA, 19 bp, Homo sapiens
tgggaggtcaaggctgcag

SEQ ID NO: 5324998 - DNA, 23 bp, Homo sapiens
tgggaggtcaaggctgcagtgag

SEQ ID NO: 5324999 - DNA, 16 bp, Homo sapiens
tgggaggtcaggaaac

SEQ ID NO: 5325000 - DNA, 18 bp, Homo sapiens
tgggaggtccaggcagga

SEQ ID NO: 5325001 - DNA, 20 bp, Homo sapiens
tgggaggtccaggcaggagg

SEQ ID NO: 5325002 - DNA, 18 bp, Homo sapiens
tgggaggtcccagggccc

SEQ ID NO: 5325003 - DNA, 14 bp, Homo sapiens
tgggaggtcttgct

SEQ ID NO: 5325004 - DNA, 23 bp, Homo sapiens
tgggaggtgcgtgttcagcagaa

SEQ ID NO: 5325005 - DNA, 13 bp, Homo sapiens
tgggaggtggaaa

SEQ ID NO: 5325006 - DNA, 18 bp, Homo sapiens
tgggaggtggaagaaggg

SEQ ID NO: 5325007 - DNA, 20 bp, Homo sapiens
tgggaggtggaggttgcagt

SEQ ID NO: 5325008 - DNA, 15 bp, Homo sapiens
tgggaggtgtctgtg

SEQ ID NO: 5325009 - DNA, 15 bp, Homo sapiens
tgggaggttaaaaag

SEQ ID NO: 5325010 - DNA, 18 bp, Homo sapiens
tgggagtacatatggtag

SEQ ID NO: 5325011 - DNA, 20 bp, Homo sapiens
tgggagtaggagttgctcct

SEQ ID NO: 5325012 - DNA, 22 bp, Homo sapiens
tgggagtcagagccctggctgg

SEQ ID NO: 5325013 - DNA, 23 bp, Homo sapiens
tgggagtcaggacctccggggag

SEQ ID NO: 5325014 - DNA, 15 bp, Homo sapiens
tgggagtcaggcccg

SEQ ID NO: 5325015 - DNA, 15 bp, Homo sapiens
tgggagtcagggagc

SEQ ID NO: 5325016 - DNA, 19 bp, Homo sapiens
tgggagtcagggagccctg

SEQ ID NO: 5325017 - DNA, 19 bp, Homo sapiens
tgggagtcattaccacgcc

SEQ ID NO: 5325018 - DNA, 14 bp, Homo sapiens
tgggagtccacttt

SEQ ID NO: 5325019 - DNA, 20 bp, Homo sapiens
tgggagtccactttcctctc

SEQ ID NO: 5325020 - DNA, 21 bp, Homo sapiens
tgggagtccactttcctctct

SEQ ID NO: 5325021 - DNA, 18 bp, Homo sapiens
tgggagtccaggcacagg

SEQ ID NO: 5325022 - DNA, 14 bp, Homo sapiens
tgggagtcctctag

SEQ ID NO: 5325023 - DNA, 17 bp, Homo sapiens
tgggagtcttgggtggc

SEQ ID NO: 5325024 - DNA, 12 bp, Homo sapiens
tgggagtgggag

SEQ ID NO: 5325025 - DNA, 13 bp, Homo sapiens
tgggagtgggaga

SEQ ID NO: 5325026 - DNA, 22 bp, Homo sapiens
tgggagtgggcacctcagaaag

SEQ ID NO: 5325027 - DNA, 18 bp, Homo sapiens
tgggagtgggcagaggtg

SEQ ID NO: 5325028 - DNA, 14 bp, Homo sapiens
tgggagtgggccca

SEQ ID NO: 5325029 - DNA, 16 bp, Homo sapiens
tgggagtgtgggctgc

SEQ ID NO: 5325030 - DNA, 20 bp, Homo sapiens
tgggagtgtgggctgccctt

SEQ ID NO: 5325031 - DNA, 16 bp, Homo sapiens
tgggagtgtgtctgct

SEQ ID NO: 5325032 - DNA, 18 bp, Homo sapiens
tgggagtgtgtctgctga

SEQ ID NO: 5325033 - DNA, 14 bp, Homo sapiens
tgggagtgttctgt

SEQ ID NO: 5325034 - DNA, 21 bp, Homo sapiens
tgggagtgttctgtgggcttg

SEQ ID NO: 5325035 - DNA, 19 bp, Homo sapiens
tgggagttcagctgcttct

SEQ ID NO: 5325036 - DNA, 17 bp, Homo sapiens
tgggagttctagaacca

SEQ ID NO: 5325037 - DNA, 22 bp, Homo sapiens
tgggagttgatcgcctttccca

SEQ ID NO: 5325038 - DNA, 16 bp, Homo sapiens
tgggagttgtcattaa

SEQ ID NO: 5325039 - DNA, 20 bp, Homo sapiens
tgggagttttgtattcatct

SEQ ID NO: 5325040 - DNA, 18 bp, Homo sapiens
tgggagtttttgtttgtt

SEQ ID NO: 5325041 - DNA, 14 bp, Homo sapiens
tgggataaacatca

SEQ ID NO: 5325042 - DNA, 16 bp, Homo sapiens
tgggataactggccag

SEQ ID NO: 5325043 - DNA, 18 bp, Homo sapiens
tgggataagagtgtgaga

SEQ ID NO: 5325044 - DNA, 12 bp, Homo sapiens
tgggatagagaa

SEQ ID NO: 5325045 - DNA, 13 bp, Homo sapiens
tgggataggaaaa

SEQ ID NO: 5325046 - DNA, 14 bp, Homo sapiens
tgggataggagggt

SEQ ID NO: 5325047 - DNA, 20 bp, Homo sapiens
tgggatagggtcagatgcac

SEQ ID NO: 5325048 - DNA, 21 bp, Homo sapiens
tgggatatcattttaaaaact

SEQ ID NO: 5325049 - DNA, 23 bp, Homo sapiens
tgggatatctttacaagcaggca

SEQ ID NO: 5325050 - DNA, 16 bp, Homo sapiens
tgggatatgtggtgta

SEQ ID NO: 5325051 - DNA, 17 bp, Homo sapiens
tgggatattttgaaatg

SEQ ID NO: 5325052 - DNA, 18 bp, Homo sapiens
tgggatcagagcaggagc

SEQ ID NO: 5325053 - DNA, 14 bp, Homo sapiens
tgggatcagcctcc

SEQ ID NO: 5325054 - DNA, 14 bp, Homo sapiens
tgggatcaggagcc

SEQ ID NO: 5325055 - DNA, 15 bp, Homo sapiens
tgggatcaggagccc

SEQ ID NO: 5325056 - DNA, 17 bp, Homo sapiens
tgggatcaggagccccc

SEQ ID NO: 5325057 - DNA, 19 bp, Homo sapiens
tgggatcaggggtaggaat

SEQ ID NO: 5325058 - DNA, 22 bp, Homo sapiens
tgggatcagtggggccccaaag

SEQ ID NO: 5325059 - DNA, 14 bp, Homo sapiens
tgggatccaagggg

SEQ ID NO: 5325060 - DNA, 19 bp, Homo sapiens
tgggatccacgctgggcct

SEQ ID NO: 5325061 - DNA, 20 bp, Homo sapiens
tgggatccacgctgggccta

SEQ ID NO: 5325062 - DNA, 15 bp, Homo sapiens
tgggatccagagaga

SEQ ID NO: 5325063 - DNA, 16 bp, Homo sapiens
tgggatccagagagaa

SEQ ID NO: 5325064 - DNA, 13 bp, Homo sapiens
tgggatcccacag

SEQ ID NO: 5325065 - DNA, 18 bp, Homo sapiens
tgggatcctccaggtgca

SEQ ID NO: 5325066 - DNA, 22 bp, Homo sapiens
tgggatcctctccaccctcctc

SEQ ID NO: 5325067 - DNA, 14 bp, Homo sapiens
tgggatctactttc

SEQ ID NO: 5325068 - DNA, 21 bp, Homo sapiens
tgggatctactttccctctgg

SEQ ID NO: 5325069 - DNA, 20 bp, Homo sapiens
tgggatctcgccaacccctc

SEQ ID NO: 5325070 - DNA, 16 bp, Homo sapiens
tgggatctggggagag

SEQ ID NO: 5325071 - DNA, 22 bp, Homo sapiens
tgggatctggggagagcggctg

SEQ ID NO: 5325072 - DNA, 23 bp, Homo sapiens
tgggatctggtggtcagccctag

SEQ ID NO: 5325073 - DNA, 18 bp, Homo sapiens
tgggatctgtcttggcat

SEQ ID NO: 5325074 - DNA, 20 bp, Homo sapiens
tgggatctgtcttggcatta

SEQ ID NO: 5325075 - DNA, 18 bp, Homo sapiens
tgggatctgttttctgga

SEQ ID NO: 5325076 - DNA, 15 bp, Homo sapiens
tgggatcttgaagaa

SEQ ID NO: 5325077 - DNA, 21 bp, Homo sapiens
tgggatgagggagacagacca

SEQ ID NO: 5325078 - DNA, 14 bp, Homo sapiens
tgggatgaggtcac

SEQ ID NO: 5325079 - DNA, 22 bp, Homo sapiens
tgggatgatgtgtgaaacctga

SEQ ID NO: 5325080 - DNA, 18 bp, Homo sapiens
tgggatgattgaagaaac

SEQ ID NO: 5325081 - DNA, 20 bp, Homo sapiens
tgggatgccaatttcctctc

SEQ ID NO: 5325082 - DNA, 23 bp, Homo sapiens
tgggatgccaatttcctctccac

SEQ ID NO: 5325083 - DNA, 21 bp, Homo sapiens
tgggatgccataaaagccgcc

SEQ ID NO: 5325084 - DNA, 22 bp, Homo sapiens
tgggatgcctcaccacacccag

SEQ ID NO: 5325085 - DNA, 17 bp, Homo sapiens
tgggatgctagccccag

SEQ ID NO: 5325086 - DNA, 20 bp, Homo sapiens
tgggatgctagccccagaga

SEQ ID NO: 5325087 - DNA, 17 bp, Homo sapiens
tgggatgctgacccagg

SEQ ID NO: 5325088 - DNA, 19 bp, Homo sapiens
tgggatgcttgcctagggc

SEQ ID NO: 5325089 - DNA, 13 bp, Homo sapiens
tgggatggacagg

SEQ ID NO: 5325090 - DNA, 22 bp, Homo sapiens
tgggcccaaaggcccagggagg

SEQ ID NO: 5325091 - DNA, 17 bp, Homo sapiens
tgggcccaacaggccct

SEQ ID NO: 5325092 - DNA, 16 bp, Homo sapiens
tgggcccaaccctgtc

SEQ ID NO: 5325093 - DNA, 23 bp, Homo sapiens
tgggcccaagacagatgccccag

SEQ ID NO: 5325094 - DNA, 13 bp, Homo sapiens
tgggcccaaggcc

SEQ ID NO: 5325095 - DNA, 13 bp, Homo sapiens
tgggcccaagtga

SEQ ID NO: 5325096 - DNA, 18 bp, Homo sapiens
tgggcccacaaaggcaaa

SEQ ID NO: 5325097 - DNA, 19 bp, Homo sapiens
tgggcccacagagatgcat

SEQ ID NO: 5325098 - DNA, 18 bp, Homo sapiens
tgggcccacagagcctgg

SEQ ID NO: 5325099 - DNA, 19 bp, Homo sapiens
tgggcccacagagcctggc

SEQ ID NO: 5325100 - DNA, 16 bp, Homo sapiens
tgggcccacagccccc

SEQ ID NO: 5325101 - DNA, 20 bp, Homo sapiens
tgggcccacagcccccaccc

SEQ ID NO: 5325102 - DNA, 16 bp, Homo sapiens
tgggcccagaggagag

SEQ ID NO: 5325103 - DNA, 12 bp, Homo sapiens
tgggcccagccc

SEQ ID NO: 5325104 - DNA, 14 bp, Homo sapiens
tgggcccagcccct

SEQ ID NO: 5325105 - DNA, 14 bp, Homo sapiens
tgggcccagccggg

SEQ ID NO: 5325106 - DNA, 13 bp, Homo sapiens
tgggcccagctgg

SEQ ID NO: 5325107 - DNA, 15 bp, Homo sapiens
tgggcccagctgggc

SEQ ID NO: 5325108 - DNA, 20 bp, Homo sapiens
tgggcccagctgggctctgc

SEQ ID NO: 5325109 - DNA, 17 bp, Homo sapiens
tgggcccaggaccagct

SEQ ID NO: 5325110 - DNA, 19 bp, Homo sapiens
tgggcccaggaccagctgg

SEQ ID NO: 5325111 - DNA, 22 bp, Homo sapiens
tgggcccaggaccagctggggc

SEQ ID NO: 5325112 - DNA, 13 bp, Homo sapiens
tgggcccaggagg

SEQ ID NO: 5325113 - DNA, 14 bp, Homo sapiens
tgggcccaggaggt

SEQ ID NO: 5325114 - DNA, 12 bp, Homo sapiens
tgggcccaggca

SEQ ID NO: 5325115 - DNA, 13 bp, Homo sapiens
tgggcccaggcag

SEQ ID NO: 5325116 - DNA, 21 bp, Homo sapiens
tgggcccaggcccagcctctt

SEQ ID NO: 5325117 - DNA, 21 bp, Homo sapiens
tgggcccaggctctgggaagg

SEQ ID NO: 5325118 - DNA, 23 bp, Homo sapiens
tgggcccagggacacccacacag

SEQ ID NO: 5325119 - DNA, 15 bp, Homo sapiens
tgggcccaggggctg

SEQ ID NO: 5325120 - DNA, 14 bp, Homo sapiens
tgggccccacctac

SEQ ID NO: 5325121 - DNA, 14 bp, Homo sapiens
tgggccccactgga

SEQ ID NO: 5325122 - DNA, 16 bp, Homo sapiens
tgggccccactggaca

SEQ ID NO: 5325123 - DNA, 17 bp, Homo sapiens
tgggccccactggacaa

SEQ ID NO: 5325124 - DNA, 15 bp, Homo sapiens
tgggccccagccttc

SEQ ID NO: 5325125 - DNA, 11 bp, Homo sapiens
tgggccccagg

SEQ ID NO: 5325126 - DNA, 14 bp, Homo sapiens
tgggccccaggcac

SEQ ID NO: 5325127 - DNA, 13 bp, Homo sapiens
tgggccccatgct

SEQ ID NO: 5325128 - DNA, 18 bp, Homo sapiens
tgggccccatgctctgcc

SEQ ID NO: 5325129 - DNA, 16 bp, Homo sapiens
tgggcccccaaatgga

SEQ ID NO: 5325130 - DNA, 14 bp, Homo sapiens
tgggcccccagaga

SEQ ID NO: 5325131 - DNA, 17 bp, Homo sapiens
tgggcccccagcctggc

SEQ ID NO: 5325132 - DNA, 18 bp, Homo sapiens
tgggccccctctcttacc

SEQ ID NO: 5325133 - DNA, 14 bp, Homo sapiens
tgggccccctggga

SEQ ID NO: 5325134 - DNA, 15 bp, Homo sapiens
tgggcccctcaacag

SEQ ID NO: 5325135 - DNA, 15 bp, Homo sapiens
tgggcccctcagagc

SEQ ID NO: 5325136 - DNA, 14 bp, Homo sapiens
tgggcccctcagcc

SEQ ID NO: 5325137 - DNA, 21 bp, Homo sapiens
tgggcccctcagccacccttg

SEQ ID NO: 5325138 - DNA, 13 bp, Homo sapiens
tgggcccctcagg

SEQ ID NO: 5325139 - DNA, 22 bp, Homo sapiens
tgggcccctcaggggaagctgc

SEQ ID NO: 5325140 - DNA, 11 bp, Homo sapiens
tgggcccctcc

SEQ ID NO: 5325141 - DNA, 17 bp, Homo sapiens
tgggcccctcccctcag

SEQ ID NO: 5325142 - DNA, 20 bp, Homo sapiens
tgggcccctcccctcagagc

SEQ ID NO: 5325143 - DNA, 21 bp, Homo sapiens
tgggcccctcccctcagagcc

SEQ ID NO: 5325144 - DNA, 16 bp, Homo sapiens
tgggcccctgaggagc

SEQ ID NO: 5325145 - DNA, 21 bp, Homo sapiens
tgggcccctgcctctctgcag

SEQ ID NO: 5325146 - DNA, 14 bp, Homo sapiens
tgggcccctgggga

SEQ ID NO: 5325147 - DNA, 17 bp, Homo sapiens
tgggcccctggggacag

SEQ ID NO: 5325148 - DNA, 19 bp, Homo sapiens
tgggcccctggggacagag

SEQ ID NO: 5325149 - DNA, 19 bp, Homo sapiens
tgggcccctgtccccagtc

SEQ ID NO: 5325150 - DNA, 16 bp, Homo sapiens
tgggcccgctgcctct

SEQ ID NO: 5325151 - DNA, 17 bp, Homo sapiens
tgggcccgctgcctctt

SEQ ID NO: 5325152 - DNA, 19 bp, Homo sapiens
tgggcccgctgcctcttgg

SEQ ID NO: 5325153 - DNA, 23 bp, Homo sapiens
tgggcccgctgcctcttggcttc

SEQ ID NO: 5325154 - DNA, 19 bp, Homo sapiens
tgggcccgctttgcctgct

SEQ ID NO: 5325155 - DNA, 19 bp, Homo sapiens
tgggcccgggcaggccagc

SEQ ID NO: 5325156 - DNA, 20 bp, Homo sapiens
tgggccctaccctcctgctg

SEQ ID NO: 5325157 - DNA, 22 bp, Homo sapiens
tgggccctaccctcctgctgag

SEQ ID NO: 5325158 - DNA, 23 bp, Homo sapiens
tgggccctaccctcctgctgagc

SEQ ID NO: 5325159 - DNA, 14 bp, Homo sapiens
tgggccctagagga

SEQ ID NO: 5325160 - DNA, 13 bp, Homo sapiens
tgggccctctctg

SEQ ID NO: 5325161 - DNA, 16 bp, Homo sapiens
tgggccctctctgctc

SEQ ID NO: 5325162 - DNA, 13 bp, Homo sapiens
tgggccctctgag

SEQ ID NO: 5325163 - DNA, 16 bp, Homo sapiens
tgggccctctggtttg

SEQ ID NO: 5325164 - DNA, 15 bp, Homo sapiens
tgggccctgcaggag

SEQ ID NO: 5325165 - DNA, 21 bp, Homo sapiens
tgggccctgcaggaggcctgg

SEQ ID NO: 5325166 - DNA, 14 bp, Homo sapiens
tgggccctgcaggc

SEQ ID NO: 5325167 - DNA, 22 bp, Homo sapiens
tgggccctgcaggctgcaggag

SEQ ID NO: 5325168 - DNA, 12 bp, Homo sapiens
tgggccctgcat

SEQ ID NO: 5325169 - DNA, 19 bp, Homo sapiens
tgggccctgcattggcctg

SEQ ID NO: 5325170 - DNA, 18 bp, Homo sapiens
tgggccctgcccggggag

SEQ ID NO: 5325171 - DNA, 13 bp, Homo sapiens
tgggccctgcctc

SEQ ID NO: 5325172 - DNA, 14 bp, Homo sapiens
tgggccctgcctgc

SEQ ID NO: 5325173 - DNA, 15 bp, Homo sapiens
tgggccctgcctgca

SEQ ID NO: 5325174 - DNA, 17 bp, Homo sapiens
tgggccctgcctgcagc

SEQ ID NO: 5325175 - DNA, 24 bp, Homo sapiens
tgggccctgcctgcagccagggct

SEQ ID NO: 5325176 - DNA, 13 bp, Homo sapiens
tgggccctggagg

SEQ ID NO: 5325177 - DNA, 11 bp, Homo sapiens
tgggccctggg

SEQ ID NO: 5325178 - DNA, 12 bp, Homo sapiens
tgggccctgggc

SEQ ID NO: 5325179 - DNA, 16 bp, Homo sapiens
tgggccctgggctgga

SEQ ID NO: 5325180 - DNA, 18 bp, Homo sapiens
tgggccctgggctggcac

SEQ ID NO: 5325181 - DNA, 23 bp, Homo sapiens
tgggccctggttcccccaggacc

SEQ ID NO: 5325182 - DNA, 14 bp, Homo sapiens
tgggccctgtccag

SEQ ID NO: 5325183 - DNA, 16 bp, Homo sapiens
tgggcccttagaatgt

SEQ ID NO: 5325184 - DNA, 18 bp, Homo sapiens
tgggcccttcctggctag

SEQ ID NO: 5325185 - DNA, 19 bp, Homo sapiens
tgggcccttcctggctagg

SEQ ID NO: 5325186 - DNA, 14 bp, Homo sapiens
tgggccgaaagaga

SEQ ID NO: 5325187 - DNA, 19 bp, Homo sapiens
tgggccgcaagggcctgga

SEQ ID NO: 5325188 - DNA, 24 bp, Homo sapiens
tgggccgcaccataatgagatgtg

SEQ ID NO: 5325189 - DNA, 21 bp, Homo sapiens
tgggccgcgtgccgggccccc

SEQ ID NO: 5325190 - DNA, 16 bp, Homo sapiens
tgggccggcagcctgg

SEQ ID NO: 5325191 - DNA, 17 bp, Homo sapiens
tgggccggcagcctggt

SEQ ID NO: 5325192 - DNA, 14 bp, Homo sapiens
tgggccggccccag

SEQ ID NO: 5325193 - DNA, 16 bp, Homo sapiens
tgggccggccccaggc

SEQ ID NO: 5325194 - DNA, 17 bp, Homo sapiens
tgggccggccccaggct

SEQ ID NO: 5325195 - DNA, 19 bp, Homo sapiens
tgggccggccccaggctcc

SEQ ID NO: 5325196 - DNA, 22 bp, Homo sapiens
tgggccggccccaggctcccct

SEQ ID NO: 5325197 - DNA, 19 bp, Homo sapiens
tgggccggcccccttcctg

SEQ ID NO: 5325198 - DNA, 20 bp, Homo sapiens
tgggccggcccccttcctgg

SEQ ID NO: 5325199 - DNA, 16 bp, Homo sapiens
tgggccggcgaggggg

SEQ ID NO: 5325200 - DNA, 17 bp, Homo sapiens
tgggccggcgagggggc

SEQ ID NO: 5325201 - DNA, 20 bp, Homo sapiens
tgggccggctgagtggcagc

SEQ ID NO: 5325202 - DNA, 21 bp, Homo sapiens
tgggccggcttcatgccagct

SEQ ID NO: 5325203 - DNA, 19 bp, Homo sapiens
tgggccgggacccagggcc

SEQ ID NO: 5325204 - DNA, 15 bp, Homo sapiens
tgggccgggcccagg

SEQ ID NO: 5325205 - DNA, 20 bp, Homo sapiens
tgggccgggcccagggcctc

SEQ ID NO: 5325206 - DNA, 15 bp, Homo sapiens
tgggccgggcctggg

SEQ ID NO: 5325207 - DNA, 19 bp, Homo sapiens
tgggccgggcctggggctc

SEQ ID NO: 5325208 - DNA, 21 bp, Homo sapiens
tgggccggtcggggaggggga

SEQ ID NO: 5325209 - DNA, 13 bp, Homo sapiens
tgggccggtgctg

SEQ ID NO: 5325210 - DNA, 21 bp, Homo sapiens
tgggccgtatctccggctccc

SEQ ID NO: 5325211 - DNA, 22 bp, Homo sapiens
tgggccgtcccctctccccttg

SEQ ID NO: 5325212 - DNA, 17 bp, Homo sapiens
tgggccgtggcacagct

SEQ ID NO: 5325213 - DNA, 17 bp, Homo sapiens
tgggccgtggcttgggc

SEQ ID NO: 5325214 - DNA, 22 bp, Homo sapiens
tgggcctaattttttaaagaat

SEQ ID NO: 5325215 - DNA, 14 bp, Homo sapiens
tgggcctaggctgc

SEQ ID NO: 5325216 - DNA, 16 bp, Homo sapiens
tgggcctcacctgccc

SEQ ID NO: 5325217 - DNA, 22 bp, Homo sapiens
tgggcctcacctgcccctctgt

SEQ ID NO: 5325218 - DNA, 11 bp, Homo sapiens
tgggcctcagc

SEQ ID NO: 5325219 - DNA, 14 bp, Homo sapiens
tgggcctcagcccc

SEQ ID NO: 5325220 - DNA, 17 bp, Homo sapiens
tgggcctcagcctccag

SEQ ID NO: 5325221 - DNA, 18 bp, Homo sapiens
tgggcctcagcctccagg

SEQ ID NO: 5325222 - DNA, 20 bp, Homo sapiens
tgggcctcagttcaacctgg

SEQ ID NO: 5325223 - DNA, 19 bp, Homo sapiens
tgggcctccacctctgtgc

SEQ ID NO: 5325224 - DNA, 12 bp, Homo sapiens
tgggcctcccac

SEQ ID NO: 5325225 - DNA, 19 bp, Homo sapiens
tgggcctccccccagcccc

SEQ ID NO: 5325226 - DNA, 21 bp, Homo sapiens
tgggcctccccccagcccctc

SEQ ID NO: 5325227 - DNA, 16 bp, Homo sapiens
tgggcctcccctgggc

SEQ ID NO: 5325228 - DNA, 18 bp, Homo sapiens
tgggcctccctggcactg

SEQ ID NO: 5325229 - DNA, 18 bp, Homo sapiens
tgggcctcctctgtccag

SEQ ID NO: 5325230 - DNA, 14 bp, Homo sapiens
tgggcctcctgcct

SEQ ID NO: 5325231 - DNA, 22 bp, Homo sapiens
tgggcctcctgtgtgtgcgcct

SEQ ID NO: 5325232 - DNA, 18 bp, Homo sapiens
tgggcctcgacgtccctt

SEQ ID NO: 5325233 - DNA, 15 bp, Homo sapiens
tgggcctcggcccct

SEQ ID NO: 5325234 - DNA, 16 bp, Homo sapiens
tgggcctctcctgccc

SEQ ID NO: 5325235 - DNA, 13 bp, Homo sapiens
tgggcctctctgg

SEQ ID NO: 5325236 - DNA, 16 bp, Homo sapiens
tgggcctctctggggg

SEQ ID NO: 5325237 - DNA, 18 bp, Homo sapiens
tgggcctctctgggggag

SEQ ID NO: 5325238 - DNA, 23 bp, Homo sapiens
tgggcctctctgggggaggcagg

SEQ ID NO: 5325239 - DNA, 14 bp, Homo sapiens
tgggcctctgatgt

SEQ ID NO: 5325240 - DNA, 15 bp, Homo sapiens
tgggcctctgcccct

SEQ ID NO: 5325241 - DNA, 18 bp, Homo sapiens
tgggcctctttttgccct

SEQ ID NO: 5325242 - DNA, 23 bp, Homo sapiens
tgggcctgactgttgccccccag

SEQ ID NO: 5325243 - DNA, 11 bp, Homo sapiens
tgggcctgagg

SEQ ID NO: 5325244 - DNA, 12 bp, Homo sapiens
tgggcctgaggg

SEQ ID NO: 5325245 - DNA, 13 bp, Homo sapiens
tgggcctgagggt

SEQ ID NO: 5325246 - DNA, 22 bp, Homo sapiens
tgggcctgagggtccacctgga

SEQ ID NO: 5325247 - DNA, 14 bp, Homo sapiens
tgggcctgatggag

SEQ ID NO: 5325248 - DNA, 20 bp, Homo sapiens
tgggcctgatggagaggaga

SEQ ID NO: 5325249 - DNA, 19 bp, Homo sapiens
tgggcctgatggtggggcc

SEQ ID NO: 5325250 - DNA, 12 bp, Homo sapiens
tgggcctgccca

SEQ ID NO: 5325251 - DNA, 20 bp, Homo sapiens
tgggcctgccgggctgaggg

SEQ ID NO: 5325252 - DNA, 13 bp, Homo sapiens
tgggcctgcctgc

SEQ ID NO: 5325253 - DNA, 14 bp, Homo sapiens
tgggcctgcctgcc

SEQ ID NO: 5325254 - DNA, 15 bp, Homo sapiens
tgggcctgcctgcct

SEQ ID NO: 5325255 - DNA, 15 bp, Homo sapiens
tgggcctgctccaga

SEQ ID NO: 5325256 - DNA, 16 bp, Homo sapiens
tgggcctgctccagac

SEQ ID NO: 5325257 - DNA, 22 bp, Homo sapiens
tgggcctgctgctctctaagaa

SEQ ID NO: 5325258 - DNA, 16 bp, Homo sapiens
tgggcctgctgctgag

SEQ ID NO: 5325259 - DNA, 14 bp, Homo sapiens
tgggcctgcttcct

SEQ ID NO: 5325260 - DNA, 18 bp, Homo sapiens
tgggcctgcttttccagg

SEQ ID NO: 5325261 - DNA, 19 bp, Homo sapiens
tgggcctgcttttccagga

SEQ ID NO: 5325262 - DNA, 22 bp, Homo sapiens
tgggcctgcttttccaggatcc

SEQ ID NO: 5325263 - DNA, 12 bp, Homo sapiens
tgggcctggagc

SEQ ID NO: 5325264 - DNA, 15 bp, Homo sapiens
tgggcctggatgcag

SEQ ID NO: 5325265 - DNA, 12 bp, Homo sapiens
tgggcctggcat

SEQ ID NO: 5325266 - DNA, 17 bp, Homo sapiens
tgggcctggcattcttg

SEQ ID NO: 5325267 - DNA, 11 bp, Homo sapiens
tgggcctggcc

SEQ ID NO: 5325268 - DNA, 17 bp, Homo sapiens
tgggcctggccagtctt

SEQ ID NO: 5325269 - DNA, 18 bp, Homo sapiens
tgggcctggccagtcttc

SEQ ID NO: 5325270 - DNA, 20 bp, Homo sapiens
tgggcctggccagtcttcct

SEQ ID NO: 5325271 - DNA, 13 bp, Homo sapiens
tgggcctggcctg

SEQ ID NO: 5325272 - DNA, 17 bp, Homo sapiens
tgggcctggcctgagct

SEQ ID NO: 5325273 - DNA, 16 bp, Homo sapiens
tgggcctggcggcctg

SEQ ID NO: 5325274 - DNA, 17 bp, Homo sapiens
tgggcctgggcctctgc

SEQ ID NO: 5325275 - DNA, 17 bp, Homo sapiens
tgggcctgggctcctgg

SEQ ID NO: 5325276 - DNA, 14 bp, Homo sapiens
tgggcctgtccccc

SEQ ID NO: 5325277 - DNA, 16 bp, Homo sapiens
tgggcctgtcgtgcca

SEQ ID NO: 5325278 - DNA, 13 bp, Homo sapiens
tgggcctgtctca

SEQ ID NO: 5325279 - DNA, 19 bp, Homo sapiens
tgggcctgtgcactgggca

SEQ ID NO: 5325280 - DNA, 22 bp, Homo sapiens
tgggcctgtgcagcagcccagc

SEQ ID NO: 5325281 - DNA, 14 bp, Homo sapiens
tgggcctgtgtgca

SEQ ID NO: 5325282 - DNA, 18 bp, Homo sapiens
tgggcctgtgtgtgggtg

SEQ ID NO: 5325283 - DNA, 22 bp, Homo sapiens
tgggcctgtgtgtgggtggggt

SEQ ID NO: 5325284 - DNA, 11 bp, Homo sapiens
tgggcctgttc

SEQ ID NO: 5325285 - DNA, 14 bp, Homo sapiens
tgggcctgttcacg

SEQ ID NO: 5325286 - DNA, 21 bp, Homo sapiens
tgggcctgttctcttggctgc

SEQ ID NO: 5325287 - DNA, 21 bp, Homo sapiens
tgggccttaactgttgttgac

SEQ ID NO: 5325288 - DNA, 21 bp, Homo sapiens
tgggccttacctcccctgcca

SEQ ID NO: 5325289 - DNA, 13 bp, Homo sapiens
tgggccttcatta

SEQ ID NO: 5325290 - DNA, 22 bp, Homo sapiens
tgggccttcattaaatgtttgt

SEQ ID NO: 5325291 - DNA, 13 bp, Homo sapiens
tgggccttgctac

SEQ ID NO: 5325292 - DNA, 18 bp, Homo sapiens
tgggccttgctttgggct

SEQ ID NO: 5325293 - DNA, 17 bp, Homo sapiens
tgggccttggcctggag

SEQ ID NO: 5325294 - DNA, 16 bp, Homo sapiens
tgggccttggctgggc

SEQ ID NO: 5325295 - DNA, 22 bp, Homo sapiens
tgggccttgtgtgctggcttcc

SEQ ID NO: 5325296 - DNA, 14 bp, Homo sapiens
tgggcctttcagtc

SEQ ID NO: 5325297 - DNA, 19 bp, Homo sapiens
tgggcctttcctgtgccaa

SEQ ID NO: 5325298 - DNA, 23 bp, Homo sapiens
tgggcgaatctacagaacaaaga

SEQ ID NO: 5325299 - DNA, 23 bp, Homo sapiens
tgggcgagcatgggggctgccag

SEQ ID NO: 5325300 - DNA, 13 bp, Homo sapiens
tgggcgagtcccg

SEQ ID NO: 5325301 - DNA, 20 bp, Homo sapiens
tgggcgcaaaggtgcctcat

SEQ ID NO: 5325302 - DNA, 23 bp, Homo sapiens
tgggcgcagaggcttttccagtg

SEQ ID NO: 5325303 - DNA, 15 bp, Homo sapiens
tgggcgcaggcccag

SEQ ID NO: 5325304 - DNA, 20 bp, Homo sapiens
tgggcgccctggaagccggc

SEQ ID NO: 5325305 - DNA, 20 bp, Homo sapiens
tgggcgccggttccacgtgg

SEQ ID NO: 5325306 - DNA, 17 bp, Homo sapiens
tgggcgccgtgctgggc

SEQ ID NO: 5325307 - DNA, 20 bp, Homo sapiens
tgggcgccgtgctgggcagc

SEQ ID NO: 5325308 - DNA, 22 bp, Homo sapiens
tgggcgcctctgtcctggcccg

SEQ ID NO: 5325309 - DNA, 16 bp, Homo sapiens
tgggcgctgcttccag

SEQ ID NO: 5325310 - DNA, 20 bp, Homo sapiens
tgggcggacaaaagggccag

SEQ ID NO: 5325311 - DNA, 20 bp, Homo sapiens
tgggcggcatccctgcagag

SEQ ID NO: 5325312 - DNA, 13 bp, Homo sapiens
tgggcggctcctg

SEQ ID NO: 5325313 - DNA, 14 bp, Homo sapiens
tgggcggctcctgg

SEQ ID NO: 5325314 - DNA, 12 bp, Homo sapiens
tgggcggctgag

SEQ ID NO: 5325315 - DNA, 15 bp, Homo sapiens
tgggcggctgagagc

SEQ ID NO: 5325316 - DNA, 13 bp, Homo sapiens
tgggcgggcagca

SEQ ID NO: 5325317 - DNA, 18 bp, Homo sapiens
tgggcgggcagcacagca

SEQ ID NO: 5325318 - DNA, 19 bp, Homo sapiens
tgggcgggcagcacagcaa

SEQ ID NO: 5325319 - DNA, 12 bp, Homo sapiens
tgggcgggcagt

SEQ ID NO: 5325320 - DNA, 17 bp, Homo sapiens
tgggcgggccatttcac

SEQ ID NO: 5325321 - DNA, 16 bp, Homo sapiens
tgggcgggcccagcac

SEQ ID NO: 5325322 - DNA, 15 bp, Homo sapiens
tgggcggggcactag

SEQ ID NO: 5325323 - DNA, 18 bp, Homo sapiens
tgggcgtacgctggtgct

SEQ ID NO: 5325324 - DNA, 19 bp, Homo sapiens
tgggcgtccagctcagccc

SEQ ID NO: 5325325 - DNA, 20 bp, Homo sapiens
tgggcgtctgactccctccc

SEQ ID NO: 5325326 - DNA, 15 bp, Homo sapiens
tgggcgtctgagctg

SEQ ID NO: 5325327 - DNA, 14 bp, Homo sapiens
tgggcgtctgttct

SEQ ID NO: 5325328 - DNA, 15 bp, Homo sapiens
tgggcgtctgttctt

SEQ ID NO: 5325329 - DNA, 19 bp, Homo sapiens
tgggcgtgagacctgcccc

SEQ ID NO: 5325330 - DNA, 18 bp, Homo sapiens
tgggcgtgtgtgacactg

SEQ ID NO: 5325331 - DNA, 22 bp, Homo sapiens
tgggcgtgtgtgacactgatga

SEQ ID NO: 5325332 - DNA, 17 bp, Homo sapiens
tgggcgttgggagccta

SEQ ID NO: 5325333 - DNA, 15 bp, Homo sapiens
tgggcgtttggggcc

SEQ ID NO: 5325334 - DNA, 14 bp, Homo sapiens
tgggcgtttgtaaa

SEQ ID NO: 5325335 - DNA, 23 bp, Homo sapiens
tgggctaaacccagatggtttcc

SEQ ID NO: 5325336 - DNA, 17 bp, Homo sapiens
tgggctaccatctgcat

SEQ ID NO: 5325337 - DNA, 23 bp, Homo sapiens
tgggctaccccccctcctgctgc

SEQ ID NO: 5325338 - DNA, 17 bp, Homo sapiens
tgggctactgccactgt

SEQ ID NO: 5325339 - DNA, 18 bp, Homo sapiens
tgggctactgccactgtg

SEQ ID NO: 5325340 - DNA, 20 bp, Homo sapiens
tgggctactgccactgtgtg

SEQ ID NO: 5325341 - DNA, 13 bp, Homo sapiens
tgggctactggca

SEQ ID NO: 5325342 - DNA, 14 bp, Homo sapiens
tgggctactggcag

SEQ ID NO: 5325343 - DNA, 19 bp, Homo sapiens
tgggctactgtagatttgt

SEQ ID NO: 5325344 - DNA, 23 bp, Homo sapiens
tgggctagattacagagggctca

SEQ ID NO: 5325345 - DNA, 14 bp, Homo sapiens
tgggctatggacac

SEQ ID NO: 5325346 - DNA, 14 bp, Homo sapiens
tgggctcaaagccc

SEQ ID NO: 5325347 - DNA, 18 bp, Homo sapiens
tgggctcaaccagaaaag

SEQ ID NO: 5325348 - DNA, 20 bp, Homo sapiens
tgggctcaagcaatcctctc

SEQ ID NO: 5325349 - DNA, 20 bp, Homo sapiens
tgggctcaagctttcccgcc

SEQ ID NO: 5325350 - DNA, 17 bp, Homo sapiens
tgggctcacaccagccc

SEQ ID NO: 5325351 - DNA, 19 bp, Homo sapiens
tgggctcacaccagccctg

SEQ ID NO: 5325352 - DNA, 13 bp, Homo sapiens
tgggctcacaccg

SEQ ID NO: 5325353 - DNA, 21 bp, Homo sapiens
tgggctcacaccggcactgtg

SEQ ID NO: 5325354 - DNA, 14 bp, Homo sapiens
tgggctcacaggcc

SEQ ID NO: 5325355 - DNA, 21 bp, Homo sapiens
tgggctcactgtgctggggca

SEQ ID NO: 5325356 - DNA, 17 bp, Homo sapiens
tgggctcagagagtaca

SEQ ID NO: 5325357 - DNA, 16 bp, Homo sapiens
tgggctcagatcctgg

SEQ ID NO: 5325358 - DNA, 14 bp, Homo sapiens
tgggctcagcacat

SEQ ID NO: 5325359 - DNA, 17 bp, Homo sapiens
tgggctcagggccaggt

SEQ ID NO: 5325360 - DNA, 16 bp, Homo sapiens
tgggctcagggctgga

SEQ ID NO: 5325361 - DNA, 17 bp, Homo sapiens
tgggctccacgggcagg

SEQ ID NO: 5325362 - DNA, 19 bp, Homo sapiens
tgggctccacgggcagggg

SEQ ID NO: 5325363 - DNA, 14 bp, Homo sapiens
tgggctccagagta

SEQ ID NO: 5325364 - DNA, 15 bp, Homo sapiens
tgggctccagagtag

SEQ ID NO: 5325365 - DNA, 17 bp, Homo sapiens
tgggctccaggcctgta

SEQ ID NO: 5325366 - DNA, 19 bp, Homo sapiens
tgggctcccacgccctcct

SEQ ID NO: 5325367 - DNA, 13 bp, Homo sapiens
tgggctccccagg

SEQ ID NO: 5325368 - DNA, 13 bp, Homo sapiens
tgggctcccctct

SEQ ID NO: 5325369 - DNA, 19 bp, Homo sapiens
tgggctccctgactgggag

SEQ ID NO: 5325370 - DNA, 15 bp, Homo sapiens
tgggctccctggagg

SEQ ID NO: 5325371 - DNA, 22 bp, Homo sapiens
tgggctccctggaggactctag

SEQ ID NO: 5325372 - DNA, 16 bp, Homo sapiens
tgggctccctggccca

SEQ ID NO: 5325373 - DNA, 11 bp, Homo sapiens
tgggctccctt

SEQ ID NO: 5325374 - DNA, 15 bp, Homo sapiens
tgggctcccttccca

SEQ ID NO: 5325375 - DNA, 21 bp, Homo sapiens
tgggctcccttcccacctctc

SEQ ID NO: 5325376 - DNA, 10 bp, Homo sapiens
tgggctcctc

SEQ ID NO: 5325377 - DNA, 13 bp, Homo sapiens
tgggctcctccag

SEQ ID NO: 5325378 - DNA, 12 bp, Homo sapiens
tgggctcctctt

SEQ ID NO: 5325379 - DNA, 12 bp, Homo sapiens
tgggctcctggc

SEQ ID NO: 5325380 - DNA, 13 bp, Homo sapiens
tgggctcctggct

SEQ ID NO: 5325381 - DNA, 16 bp, Homo sapiens
tgggctcctggctgcc

SEQ ID NO: 5325382 - DNA, 19 bp, Homo sapiens
tgggctcctggctgccagg

SEQ ID NO: 5325383 - DNA, 16 bp, Homo sapiens
tgggctcgcactgccc

SEQ ID NO: 5325384 - DNA, 14 bp, Homo sapiens
tgggctctacctct

SEQ ID NO: 5325385 - DNA, 14 bp, Homo sapiens
tgggctctcaccca

SEQ ID NO: 5325386 - DNA, 14 bp, Homo sapiens
tgggctctccacct

SEQ ID NO: 5325387 - DNA, 15 bp, Homo sapiens
tgggctctccacctc

SEQ ID NO: 5325388 - DNA, 17 bp, Homo sapiens
tgggctctccacctcag

SEQ ID NO: 5325389 - DNA, 19 bp, Homo sapiens
tgggctctccacctcagcc

SEQ ID NO: 5325390 - DNA, 20 bp, Homo sapiens
tgggctctccacctcagcct

SEQ ID NO: 5325391 - DNA, 21 bp, Homo sapiens
tgggctctccacctcagcctt

SEQ ID NO: 5325392 - DNA, 22 bp, Homo sapiens
tgggctctctggacctgaccag

SEQ ID NO: 5325393 - DNA, 19 bp, Homo sapiens
tgggctctgacagaaagca

SEQ ID NO: 5325394 - DNA, 13 bp, Homo sapiens
tgggctctgagga

SEQ ID NO: 5325395 - DNA, 14 bp, Homo sapiens
tgggctctgaggag

SEQ ID NO: 5325396 - DNA, 21 bp, Homo sapiens
tgggctctgagtacccctgct

SEQ ID NO: 5325397 - DNA, 18 bp, Homo sapiens
tgggctctgccaccctac

SEQ ID NO: 5325398 - DNA, 15 bp, Homo sapiens
tgggctctgccccag

SEQ ID NO: 5325399 - DNA, 11 bp, Homo sapiens
tgggctctgcg

SEQ ID NO: 5325400 - DNA, 13 bp, Homo sapiens
tgggctctggacc

SEQ ID NO: 5325401 - DNA, 14 bp, Homo sapiens
tgggctctggcaag

SEQ ID NO: 5325402 - DNA, 14 bp, Homo sapiens
tgggctctggcccc

SEQ ID NO: 5325403 - DNA, 16 bp, Homo sapiens
tgggctctgggagcag

SEQ ID NO: 5325404 - DNA, 12 bp, Homo sapiens
tgggctctggtg

SEQ ID NO: 5325405 - DNA, 14 bp, Homo sapiens
tgggctctggtggg

SEQ ID NO: 5325406 - DNA, 15 bp, Homo sapiens
tgggctctggtgggg

SEQ ID NO: 5325407 - DNA, 19 bp, Homo sapiens
tgggctctggtgggggctc

SEQ ID NO: 5325408 - DNA, 12 bp, Homo sapiens
tgggctctgtgc

SEQ ID NO: 5325409 - DNA, 18 bp, Homo sapiens
tgggctctgtgcagtcac

SEQ ID NO: 5325410 - DNA, 19 bp, Homo sapiens
tgggctcttggccgtggca

SEQ ID NO: 5325411 - DNA, 12 bp, Homo sapiens
tgggctctttta

SEQ ID NO: 5325412 - DNA, 19 bp, Homo sapiens
tgggctgaacactccaatt

SEQ ID NO: 5325413 - DNA, 21 bp, Homo sapiens
tgggctgaactgagcctagct

SEQ ID NO: 5325414 - DNA, 22 bp, Homo sapiens
tgggctgaagggaagcccagcc

SEQ ID NO: 5325415 - DNA, 14 bp, Homo sapiens
tgggctgaagtgtt

SEQ ID NO: 5325416 - DNA, 13 bp, Homo sapiens
tgggctgacacct

SEQ ID NO: 5325417 - DNA, 21 bp, Homo sapiens
tgggctgacacctaccatgct

SEQ ID NO: 5325418 - DNA, 16 bp, Homo sapiens
tgggctgaccaggctt

SEQ ID NO: 5325419 - DNA, 15 bp, Homo sapiens
tgggctgacccagca

SEQ ID NO: 5325420 - DNA, 18 bp, Homo sapiens
tgggctgacggtgcagtc

SEQ ID NO: 5325421 - DNA, 14 bp, Homo sapiens
tgggctgagactgg

SEQ ID NO: 5325422 - DNA, 15 bp, Homo sapiens
tgggctgagactgga

SEQ ID NO: 5325423 - DNA, 12 bp, Homo sapiens
tgggctgagccc

SEQ ID NO: 5325424 - DNA, 19 bp, Homo sapiens
tgggctgagcccctacccc

SEQ ID NO: 5325425 - DNA, 17 bp, Homo sapiens
tgggctgagcccctggt

SEQ ID NO: 5325426 - DNA, 15 bp, Homo sapiens
tgggctgagccctgg

SEQ ID NO: 5325427 - DNA, 17 bp, Homo sapiens
tgggctgagccctggca

SEQ ID NO: 5325428 - DNA, 17 bp, Homo sapiens
tgggctgagcctactgt

SEQ ID NO: 5325429 - DNA, 21 bp, Homo sapiens
tgggctgagcctactgtctcc

SEQ ID NO: 5325430 - DNA, 16 bp, Homo sapiens
tgggctgaggaggcag

SEQ ID NO: 5325431 - DNA, 11 bp, Homo sapiens
tgggctgaggg

SEQ ID NO: 5325432 - DNA, 16 bp, Homo sapiens
tgggctgagggagcct

SEQ ID NO: 5325433 - DNA, 12 bp, Homo sapiens
tgggctgagtga

SEQ ID NO: 5325434 - DNA, 16 bp, Homo sapiens
tgggctgagtgcagcc

SEQ ID NO: 5325435 - DNA, 19 bp, Homo sapiens
tgggctgatgctgggaccc

SEQ ID NO: 5325436 - DNA, 14 bp, Homo sapiens
tgggctgatttaca

SEQ ID NO: 5325437 - DNA, 18 bp, Homo sapiens
tgggctgatttacatgta

SEQ ID NO: 5325438 - DNA, 21 bp, Homo sapiens
tgggctgcaaaatgaagacac

SEQ ID NO: 5325439 - DNA, 22 bp, Homo sapiens
tgggctgcactctgtgcccatg

SEQ ID NO: 5325440 - DNA, 15 bp, Homo sapiens
tgggctgcagaagat

SEQ ID NO: 5325441 - DNA, 12 bp, Homo sapiens
tgggctgcagca

SEQ ID NO: 5325442 - DNA, 13 bp, Homo sapiens
tgggctgcagcag

SEQ ID NO: 5325443 - DNA, 16 bp, Homo sapiens
tgggctgccatgtgaa

SEQ ID NO: 5325444 - DNA, 20 bp, Homo sapiens
tgggctgcccacctggctgc

SEQ ID NO: 5325445 - DNA, 15 bp, Homo sapiens
tgggctgccctggtg

SEQ ID NO: 5325446 - DNA, 22 bp, Homo sapiens
tgggctgcccttgttgcctgca

SEQ ID NO: 5325447 - DNA, 10 bp, Homo sapiens
tgggctgcct

SEQ ID NO: 5325448 - DNA, 15 bp, Homo sapiens
tgggctgcctgctgt

SEQ ID NO: 5325449 - DNA, 13 bp, Homo sapiens
tgggctgctcctg

SEQ ID NO: 5325450 - DNA, 19 bp, Homo sapiens
tgggctgctgcaggccgtg

SEQ ID NO: 5325451 - DNA, 17 bp, Homo sapiens
tggggcagaggggcagc

SEQ ID NO: 5325452 - DNA, 21 bp, Homo sapiens
tggggcagaggggcagccgct

SEQ ID NO: 5325453 - DNA, 13 bp, Homo sapiens
tggggcagagtgg

SEQ ID NO: 5325454 - DNA, 16 bp, Homo sapiens
tggggcagagtggagc

SEQ ID NO: 5325455 - DNA, 14 bp, Homo sapiens
tggggcagcacaga

SEQ ID NO: 5325456 - DNA, 16 bp, Homo sapiens
tggggcagcacagaga

SEQ ID NO: 5325457 - DNA, 12 bp, Homo sapiens
tggggcagcctc

SEQ ID NO: 5325458 - DNA, 14 bp, Homo sapiens
tggggcagcctcca

SEQ ID NO: 5325459 - DNA, 13 bp, Homo sapiens
tggggcagcctct

SEQ ID NO: 5325460 - DNA, 13 bp, Homo sapiens
tggggcagcttga

SEQ ID NO: 5325461 - DNA, 17 bp, Homo sapiens
tggggcaggagtgccag

SEQ ID NO: 5325462 - DNA, 20 bp, Homo sapiens
tggggcaggagtgccaggac

SEQ ID NO: 5325463 - DNA, 22 bp, Homo sapiens
tggggcaggagtgccaggacca

SEQ ID NO: 5325464 - DNA, 12 bp, Homo sapiens
tggggcagggag

SEQ ID NO: 5325465 - DNA, 13 bp, Homo sapiens
tggggcagggagc

SEQ ID NO: 5325466 - DNA, 20 bp, Homo sapiens
tggggcagggcccagggagg

SEQ ID NO: 5325467 - DNA, 14 bp, Homo sapiens
tggggcagggcctg

SEQ ID NO: 5325468 - DNA, 17 bp, Homo sapiens
tggggcagggcctggcc

SEQ ID NO: 5325469 - DNA, 19 bp, Homo sapiens
tggggcagggcctggcctg

SEQ ID NO: 5325470 - DNA, 18 bp, Homo sapiens
tggggcagggcctgggcc

SEQ ID NO: 5325471 - DNA, 20 bp, Homo sapiens
tggggcagtgcttggcccag

SEQ ID NO: 5325472 - DNA, 16 bp, Homo sapiens
tggggcatagaaactg

SEQ ID NO: 5325473 - DNA, 18 bp, Homo sapiens
tggggcatagaactccgg

SEQ ID NO: 5325474 - DNA, 15 bp, Homo sapiens
tggggcatcagccag

SEQ ID NO: 5325475 - DNA, 14 bp, Homo sapiens
tggggcatcctgga

SEQ ID NO: 5325476 - DNA, 17 bp, Homo sapiens
tggggcatcctgtgcca

SEQ ID NO: 5325477 - DNA, 22 bp, Homo sapiens
tggggcatgacccagtgaagat

SEQ ID NO: 5325478 - DNA, 21 bp, Homo sapiens
tggggcatggttccttccctg

SEQ ID NO: 5325479 - DNA, 14 bp, Homo sapiens
tggggcatgtcctt

SEQ ID NO: 5325480 - DNA, 14 bp, Homo sapiens
tggggcatttgtaa

SEQ ID NO: 5325481 - DNA, 16 bp, Homo sapiens
tggggccacagccaga

SEQ ID NO: 5325482 - DNA, 15 bp, Homo sapiens
tggggccacatagct

SEQ ID NO: 5325483 - DNA, 20 bp, Homo sapiens
tggggccaccctggcccggc

SEQ ID NO: 5325484 - DNA, 19 bp, Homo sapiens
tggggccactttcagagcc

SEQ ID NO: 5325485 - DNA, 22 bp, Homo sapiens
tggggccagaatggctgtcctt

SEQ ID NO: 5325486 - DNA, 15 bp, Homo sapiens
tggggccagactggc

SEQ ID NO: 5325487 - DNA, 17 bp, Homo sapiens
tggggccagaggctggg

SEQ ID NO: 5325488 - DNA, 19 bp, Homo sapiens
tggggccagatccagcctg

SEQ ID NO: 5325489 - DNA, 13 bp, Homo sapiens
tggggccagcact

SEQ ID NO: 5325490 - DNA, 14 bp, Homo sapiens
tggggccagcccct

SEQ ID NO: 5325491 - DNA, 19 bp, Homo sapiens
tggggccagcccctccccg

SEQ ID NO: 5325492 - DNA, 11 bp, Homo sapiens
tggggccagga

SEQ ID NO: 5325493 - DNA, 12 bp, Homo sapiens
tggggccaggac

SEQ ID NO: 5325494 - DNA, 14 bp, Homo sapiens
tggggccaggccag

SEQ ID NO: 5325495 - DNA, 20 bp, Homo sapiens
tggggccaggccaggaccac

SEQ ID NO: 5325496 - DNA, 15 bp, Homo sapiens
tggggccaggcccca

SEQ ID NO: 5325497 - DNA, 22 bp, Homo sapiens
tggggccaggccgggcctgtac

SEQ ID NO: 5325498 - DNA, 21 bp, Homo sapiens
tggggccaggctgggtcgccc

SEQ ID NO: 5325499 - DNA, 15 bp, Homo sapiens
tggggccaggtcacc

SEQ ID NO: 5325500 - DNA, 23 bp, Homo sapiens
tggggccataaacggttcctggt

SEQ ID NO: 5325501 - DNA, 14 bp, Homo sapiens
tggggccatgcctc

SEQ ID NO: 5325502 - DNA, 20 bp, Homo sapiens
tggggccatgcctcctcagg

SEQ ID NO: 5325503 - DNA, 21 bp, Homo sapiens
tggggccatggtggagggcac

SEQ ID NO: 5325504 - DNA, 13 bp, Homo sapiens
tggggcccaagca

SEQ ID NO: 5325505 - DNA, 18 bp, Homo sapiens
tggggcccaagcatgccc

SEQ ID NO: 5325506 - DNA, 23 bp, Homo sapiens
tggggcccagcacaactgctgtt

SEQ ID NO: 5325507 - DNA, 18 bp, Homo sapiens
tggggcccagccgatgtg

SEQ ID NO: 5325508 - DNA, 11 bp, Homo sapiens
tggggcccagg

SEQ ID NO: 5325509 - DNA, 17 bp, Homo sapiens
tggggcccaggaagccc

SEQ ID NO: 5325510 - DNA, 19 bp, Homo sapiens
tggggcccaggaagcccac

SEQ ID NO: 5325511 - DNA, 15 bp, Homo sapiens
tggggcccaggcccg

SEQ ID NO: 5325512 - DNA, 15 bp, Homo sapiens
tggggcccaggggct

SEQ ID NO: 5325513 - DNA, 17 bp, Homo sapiens
tggggcccaggggcttt

SEQ ID NO: 5325514 - DNA, 22 bp, Homo sapiens
tggggcccagtccttggctgta

SEQ ID NO: 5325515 - DNA, 18 bp, Homo sapiens
tggggcccatggccccag

SEQ ID NO: 5325516 - DNA, 23 bp, Homo sapiens
tggggcccatggccccagctggc

SEQ ID NO: 5325517 - DNA, 16 bp, Homo sapiens
tggggcccatggggtc

SEQ ID NO: 5325518 - DNA, 21 bp, Homo sapiens
tggggccccaaagcccagccc

SEQ ID NO: 5325519 - DNA, 17 bp, Homo sapiens
tggggccccggctccca

SEQ ID NO: 5325520 - DNA, 19 bp, Homo sapiens
tggggccccgggttcagcc

SEQ ID NO: 5325521 - DNA, 22 bp, Homo sapiens
tggggccccgggttcagcctgg

SEQ ID NO: 5325522 - DNA, 13 bp, Homo sapiens
tggggcccctccc

SEQ ID NO: 5325523 - DNA, 12 bp, Homo sapiens
tggggccctaat

SEQ ID NO: 5325524 - DNA, 17 bp, Homo sapiens
tggggccctcttgccag

SEQ ID NO: 5325525 - DNA, 15 bp, Homo sapiens
tggggccctgcctcc

SEQ ID NO: 5325526 - DNA, 16 bp, Homo sapiens
tggggccctgggcctc

SEQ ID NO: 5325527 - DNA, 18 bp, Homo sapiens
tggggccctgggcctcag

SEQ ID NO: 5325528 - DNA, 19 bp, Homo sapiens
tggggccctgggcctcagt

SEQ ID NO: 5325529 - DNA, 15 bp, Homo sapiens
tggggccctgtccag

SEQ ID NO: 5325530 - DNA, 23 bp, Homo sapiens
tggggccctgtccaggtagaaaa

SEQ ID NO: 5325531 - DNA, 15 bp, Homo sapiens
tggggcccttggccc

SEQ ID NO: 5325532 - DNA, 20 bp, Homo sapiens
tggggcccttggccccagag

SEQ ID NO: 5325533 - DNA, 22 bp, Homo sapiens
tggggcccttgggccacgctct

SEQ ID NO: 5325534 - DNA, 20 bp, Homo sapiens
tggggccgattgggagaaag

SEQ ID NO: 5325535 - DNA, 20 bp, Homo sapiens
tggggccgccacggcctggc

SEQ ID NO: 5325536 - DNA, 19 bp, Homo sapiens
tggggccgccgcctctttc

SEQ ID NO: 5325537 - DNA, 18 bp, Homo sapiens
tggggccgcctgccctgc

SEQ ID NO: 5325538 - DNA, 20 bp, Homo sapiens
tggggccgcctgccctgcct

SEQ ID NO: 5325539 - DNA, 21 bp, Homo sapiens
tggggccgcctgccctgcctt

SEQ ID NO: 5325540 - DNA, 22 bp, Homo sapiens
tggggccggcggggcccacgca

SEQ ID NO: 5325541 - DNA, 15 bp, Homo sapiens
tggggccggggctga

SEQ ID NO: 5325542 - DNA, 22 bp, Homo sapiens
tggggccggttttcctcagctc

SEQ ID NO: 5325543 - DNA, 23 bp, Homo sapiens
tggggccggttttcctcagctct

SEQ ID NO: 5325544 - DNA, 20 bp, Homo sapiens
tggggcctaataaaactgat

SEQ ID NO: 5325545 - DNA, 22 bp, Homo sapiens
tggggcctaataaaactgatgt

SEQ ID NO: 5325546 - DNA, 20 bp, Homo sapiens
tggggcctatcagtgtgccc

SEQ ID NO: 5325547 - DNA, 16 bp, Homo sapiens
tggggcctcacccaga

SEQ ID NO: 5325548 - DNA, 17 bp, Homo sapiens
tggggcctcacccagaa

SEQ ID NO: 5325549 - DNA, 22 bp, Homo sapiens
tggggcctcagaccccctcagc

SEQ ID NO: 5325550 - DNA, 14 bp, Homo sapiens
tggggcctcagacg

SEQ ID NO: 5325551 - DNA, 15 bp, Homo sapiens
tggggcctcagcctg

SEQ ID NO: 5325552 - DNA, 16 bp, Homo sapiens
tggggcctcagcctgc

SEQ ID NO: 5325553 - DNA, 17 bp, Homo sapiens
tggggcctcaggctccg

SEQ ID NO: 5325554 - DNA, 16 bp, Homo sapiens
tggggcctccagaagc

SEQ ID NO: 5325555 - DNA, 20 bp, Homo sapiens
tggggcctccagaagctgct

SEQ ID NO: 5325556 - DNA, 11 bp, Homo sapiens
tggggcctccc

SEQ ID NO: 5325557 - DNA, 18 bp, Homo sapiens
tggggcctccttgtccag

SEQ ID NO: 5325558 - DNA, 13 bp, Homo sapiens
tggggcctgactg

SEQ ID NO: 5325559 - DNA, 18 bp, Homo sapiens
tggggcctgactgctcag

SEQ ID NO: 5325560 - DNA, 13 bp, Homo sapiens
tggggcctgagag

SEQ ID NO: 5325561 - DNA, 13 bp, Homo sapiens
tggggcctgccct

SEQ ID NO: 5325562 - DNA, 15 bp, Homo sapiens
tggggcctggacctg

SEQ ID NO: 5325563 - DNA, 20 bp, Homo sapiens
tggggcctggacctgcctcc

SEQ ID NO: 5325564 - DNA, 18 bp, Homo sapiens
tggggcctggagaggggc

SEQ ID NO: 5325565 - DNA, 22 bp, Homo sapiens
tggggcctggcccacgccctcc

SEQ ID NO: 5325566 - DNA, 14 bp, Homo sapiens
tggggcctggcttg

SEQ ID NO: 5325567 - DNA, 14 bp, Homo sapiens
tggggcctgggagg

SEQ ID NO: 5325568 - DNA, 11 bp, Homo sapiens
tggggcctgta

SEQ ID NO: 5325569 - DNA, 13 bp, Homo sapiens
tggggcctgtgga

SEQ ID NO: 5325570 - DNA, 16 bp, Homo sapiens
tggggccttcctggct

SEQ ID NO: 5325571 - DNA, 20 bp, Homo sapiens
tggggccttcctggctttgg

SEQ ID NO: 5325572 - DNA, 21 bp, Homo sapiens
tggggccttgatgactgcctt

SEQ ID NO: 5325573 - DNA, 12 bp, Homo sapiens
tggggccttggt

SEQ ID NO: 5325574 - DNA, 17 bp, Homo sapiens
tggggcctttgccagca

SEQ ID NO: 5325575 - DNA, 21 bp, Homo sapiens
tggggcctttggtaagggaag

SEQ ID NO: 5325576 - DNA, 13 bp, Homo sapiens
tggggcgaggcag

SEQ ID NO: 5325577 - DNA, 17 bp, Homo sapiens
tggggcgaggcagagga

SEQ ID NO: 5325578 - DNA, 17 bp, Homo sapiens
tggggcgcgtgaggccc

SEQ ID NO: 5325579 - DNA, 19 bp, Homo sapiens
tggggcggagctggggtct

SEQ ID NO: 5325580 - DNA, 19 bp, Homo sapiens
tggggcggcccacgccagc

SEQ ID NO: 5325581 - DNA, 21 bp, Homo sapiens
tggggcggcccacgccagctg

SEQ ID NO: 5325582 - DNA, 13 bp, Homo sapiens
tggggcggcctgc

SEQ ID NO: 5325583 - DNA, 15 bp, Homo sapiens
tggggcggcctgcag

SEQ ID NO: 5325584 - DNA, 20 bp, Homo sapiens
tggggcgggcagccaggctg

SEQ ID NO: 5325585 - DNA, 15 bp, Homo sapiens
tggggcggggcccag

SEQ ID NO: 5325586 - DNA, 15 bp, Homo sapiens
tggggcggggcttct

SEQ ID NO: 5325587 - DNA, 19 bp, Homo sapiens
tggggcgggtggggccata

SEQ ID NO: 5325588 - DNA, 22 bp, Homo sapiens
tggggcggtcaataattgtgga

SEQ ID NO: 5325589 - DNA, 18 bp, Homo sapiens
tggggcggtgagagggga

SEQ ID NO: 5325590 - DNA, 19 bp, Homo sapiens
tggggcgtggggagggccg

SEQ ID NO: 5325591 - DNA, 15 bp, Homo sapiens
tggggctacaggatg

SEQ ID NO: 5325592 - DNA, 20 bp, Homo sapiens
tggggctagactgggctggc

SEQ ID NO: 5325593 - DNA, 23 bp, Homo sapiens
tggggctaggggaagggctttga

SEQ ID NO: 5325594 - DNA, 20 bp, Homo sapiens
tggggctagggggagcccct

SEQ ID NO: 5325595 - DNA, 13 bp, Homo sapiens
tggggctcagagc

SEQ ID NO: 5325596 - DNA, 15 bp, Homo sapiens
tggggctcagagtgg

SEQ ID NO: 5325597 - DNA, 20 bp, Homo sapiens
tggggctcagatggactggg

SEQ ID NO: 5325598 - DNA, 12 bp, Homo sapiens
tggggctcccag

SEQ ID NO: 5325599 - DNA, 19 bp, Homo sapiens
tggggctcccagccaggcc

SEQ ID NO: 5325600 - DNA, 23 bp, Homo sapiens
tggggctcccagccaggcccttg

SEQ ID NO: 5325601 - DNA, 12 bp, Homo sapiens
tggggctccccg

SEQ ID NO: 5325602 - DNA, 13 bp, Homo sapiens
tggggctcccggc

SEQ ID NO: 5325603 - DNA, 15 bp, Homo sapiens
tggggctccctctct

SEQ ID NO: 5325604 - DNA, 23 bp, Homo sapiens
tggggctccggaggggacccagc

SEQ ID NO: 5325605 - DNA, 18 bp, Homo sapiens
tggggctccggtgcggtg

SEQ ID NO: 5325606 - DNA, 22 bp, Homo sapiens
tggggctcctgggagggagact

SEQ ID NO: 5325607 - DNA, 17 bp, Homo sapiens
tggggctcgccatgccg

SEQ ID NO: 5325608 - DNA, 18 bp, Homo sapiens
tggggctcgccccaccca

SEQ ID NO: 5325609 - DNA, 17 bp, Homo sapiens
tggggctctcacagata

SEQ ID NO: 5325610 - DNA, 20 bp, Homo sapiens
tggggctgacacccaggccc

SEQ ID NO: 5325611 - DNA, 17 bp, Homo sapiens
tggggctgatctcaggg

SEQ ID NO: 5325612 - DNA, 18 bp, Homo sapiens
tggggctgatctcaggga

SEQ ID NO: 5325613 - DNA, 14 bp, Homo sapiens
tggggctgcaggca

SEQ ID NO: 5325614 - DNA, 21 bp, Homo sapiens
tggggctgcaggcaggcggct

SEQ ID NO: 5325615 - DNA, 13 bp, Homo sapiens
tggggctgcatcc

SEQ ID NO: 5325616 - DNA, 19 bp, Homo sapiens
tggggctgccagcctgagc

SEQ ID NO: 5325617 - DNA, 21 bp, Homo sapiens
tggggctgcgggacagaggac

SEQ ID NO: 5325618 - DNA, 13 bp, Homo sapiens
tggggctgctccc

SEQ ID NO: 5325619 - DNA, 16 bp, Homo sapiens
tggggctgctcctcca

SEQ ID NO: 5325620 - DNA, 21 bp, Homo sapiens
tggggctgctcctccagggcc

SEQ ID NO: 5325621 - DNA, 12 bp, Homo sapiens
tggggctgctgg

SEQ ID NO: 5325622 - DNA, 13 bp, Homo sapiens
tggggctgctggc

SEQ ID NO: 5325623 - DNA, 14 bp, Homo sapiens
tggggctggcacaa

SEQ ID NO: 5325624 - DNA, 14 bp, Homo sapiens
tggggctggcctcc

SEQ ID NO: 5325625 - DNA, 14 bp, Homo sapiens
tggggctggctgca

SEQ ID NO: 5325626 - DNA, 13 bp, Homo sapiens
tggggctggcttt

SEQ ID NO: 5325627 - DNA, 20 bp, Homo sapiens
tggggctgggcaccgtgtcc

SEQ ID NO: 5325628 - DNA, 17 bp, Homo sapiens
tggggctgggcctgagc

SEQ ID NO: 5325629 - DNA, 11 bp, Homo sapiens
tggggctgggg

SEQ ID NO: 5325630 - DNA, 23 bp, Homo sapiens
tggggctggggaagaggactgtg

SEQ ID NO: 5325631 - DNA, 13 bp, Homo sapiens
tggggctggggga

SEQ ID NO: 5325632 - DNA, 14 bp, Homo sapiens
tggggctggtggga

SEQ ID NO: 5325633 - DNA, 16 bp, Homo sapiens
tggggctggtgggtct

SEQ ID NO: 5325634 - DNA, 15 bp, Homo sapiens
tggggctgtcctgct

SEQ ID NO: 5325635 - DNA, 21 bp, Homo sapiens
tggggctgtcctgctgccctc

SEQ ID NO: 5325636 - DNA, 12 bp, Homo sapiens
tggggctgtgtt

SEQ ID NO: 5325637 - DNA, 20 bp, Homo sapiens
tggggctgtgttatgaaaat

SEQ ID NO: 5325638 - DNA, 13 bp, Homo sapiens
tggggctgttcat

SEQ ID NO: 5325639 - DNA, 20 bp, Homo sapiens
tggggcttagaatggggctt

SEQ ID NO: 5325640 - DNA, 21 bp, Homo sapiens
tggggcttagaatggggcttc

SEQ ID NO: 5325641 - DNA, 13 bp, Homo sapiens
tggggcttatggg

SEQ ID NO: 5325642 - DNA, 20 bp, Homo sapiens
tggggcttcaccagtctgtc

SEQ ID NO: 5325643 - DNA, 21 bp, Homo sapiens
tggggcttcaccagtctgtct

SEQ ID NO: 5325644 - DNA, 12 bp, Homo sapiens
tggggcttcctg

SEQ ID NO: 5325645 - DNA, 14 bp, Homo sapiens
tggggcttcctggg

SEQ ID NO: 5325646 - DNA, 16 bp, Homo sapiens
tggggcttcctgggca

SEQ ID NO: 5325647 - DNA, 16 bp, Homo sapiens
tggggcttctcctgac

SEQ ID NO: 5325648 - DNA, 14 bp, Homo sapiens
tggggcttctttct

SEQ ID NO: 5325649 - DNA, 20 bp, Homo sapiens
tggggcttctttctgctggc

SEQ ID NO: 5325650 - DNA, 18 bp, Homo sapiens
tggggcttggcgtggagc

SEQ ID NO: 5325651 - DNA, 16 bp, Homo sapiens
tggggctttcccagga

SEQ ID NO: 5325652 - DNA, 23 bp, Homo sapiens
tggggctttcgtccacagcttcc

SEQ ID NO: 5325653 - DNA, 21 bp, Homo sapiens
tggggctttgccttgcagcca

SEQ ID NO: 5325654 - DNA, 16 bp, Homo sapiens
tgggggaaaaaaaaga

SEQ ID NO: 5325655 - DNA, 13 bp, Homo sapiens
tgggggaaaaagc

SEQ ID NO: 5325656 - DNA, 21 bp, Homo sapiens
tgggggaacactgagaaagag

SEQ ID NO: 5325657 - DNA, 14 bp, Homo sapiens
tgggggaagaggag

SEQ ID NO: 5325658 - DNA, 22 bp, Homo sapiens
tgggggaagattttatgcacag

SEQ ID NO: 5325659 - DNA, 14 bp, Homo sapiens
tgggggaaggcagg

SEQ ID NO: 5325660 - DNA, 20 bp, Homo sapiens
tgggggaaggcgctgggtgc

SEQ ID NO: 5325661 - DNA, 12 bp, Homo sapiens
tgggggacagag

SEQ ID NO: 5325662 - DNA, 15 bp, Homo sapiens
tgggggacagccttc

SEQ ID NO: 5325663 - DNA, 21 bp, Homo sapiens
tgggggacaggatttggccac

SEQ ID NO: 5325664 - DNA, 15 bp, Homo sapiens
tgggggacagggctg

SEQ ID NO: 5325665 - DNA, 21 bp, Homo sapiens
tgggggacatgctaaataact

SEQ ID NO: 5325666 - DNA, 17 bp, Homo sapiens
tgggggaccccttccca

SEQ ID NO: 5325667 - DNA, 16 bp, Homo sapiens
tgggggacgcccagcc

SEQ ID NO: 5325668 - DNA, 17 bp, Homo sapiens
tgggggacgcccagccc

SEQ ID NO: 5325669 - DNA, 22 bp, Homo sapiens
tgggggacgcccagcccccacc

SEQ ID NO: 5325670 - DNA, 21 bp, Homo sapiens
tgggggactgggagtcagagc

SEQ ID NO: 5325671 - DNA, 14 bp, Homo sapiens
tgggggacttacat

SEQ ID NO: 5325672 - DNA, 23 bp, Homo sapiens
tgggggagaaaaaatcactgttt

SEQ ID NO: 5325673 - DNA, 19 bp, Homo sapiens
tgggggagaatggctctgg

SEQ ID NO: 5325674 - DNA, 20 bp, Homo sapiens
tgggggagacatgctctccc

SEQ ID NO: 5325675 - DNA, 18 bp, Homo sapiens
tgggggagattgaacttt

SEQ ID NO: 5325676 - DNA, 12 bp, Homo sapiens
tgggggagccag

SEQ ID NO: 5325677 - DNA, 16 bp, Homo sapiens
tgggggagccaggaga

SEQ ID NO: 5325678 - DNA, 20 bp, Homo sapiens
tgggggagccaggagacctg

SEQ ID NO: 5325679 - DNA, 12 bp, Homo sapiens
tgggggagcctg

SEQ ID NO: 5325680 - DNA, 20 bp, Homo sapiens
tgggggagcctggagcccct

SEQ ID NO: 5325681 - DNA, 23 bp, Homo sapiens
tgggggaggagggagagagatgt

SEQ ID NO: 5325682 - DNA, 11 bp, Homo sapiens
tgggggaggct

SEQ ID NO: 5325683 - DNA, 15 bp, Homo sapiens
tgggggaggcttcca

SEQ ID NO: 5325684 - DNA, 18 bp, Homo sapiens
tgggggaggcttccagct

SEQ ID NO: 5325685 - DNA, 20 bp, Homo sapiens
tgggggaggcttccagctca

SEQ ID NO: 5325686 - DNA, 18 bp, Homo sapiens
tgggggagggaagaccag

SEQ ID NO: 5325687 - DNA, 21 bp, Homo sapiens
tgggggagggactgctgaccc

SEQ ID NO: 5325688 - DNA, 21 bp, Homo sapiens
tgggggaggggggggtggggt

SEQ ID NO: 5325689 - DNA, 20 bp, Homo sapiens
tgggggaggtccctgccagt

SEQ ID NO: 5325690 - DNA, 16 bp, Homo sapiens
tgggggagtggccaca

SEQ ID NO: 5325691 - DNA, 15 bp, Homo sapiens
tgggggatctgggca

SEQ ID NO: 5325692 - DNA, 13 bp, Homo sapiens
tgggggatgctga

SEQ ID NO: 5325693 - DNA, 15 bp, Homo sapiens
tgggggatgcttcat

SEQ ID NO: 5325694 - DNA, 18 bp, Homo sapiens
tgggggatgggccagggt

SEQ ID NO: 5325695 - DNA, 21 bp, Homo sapiens
tgggggatgggccagggttta

SEQ ID NO: 5325696 - DNA, 14 bp, Homo sapiens
tgggggatttcaaa

SEQ ID NO: 5325697 - DNA, 22 bp, Homo sapiens
tgggggatttcaagggactggg

SEQ ID NO: 5325698 - DNA, 23 bp, Homo sapiens
tgggggcaccgggctccatgcct

SEQ ID NO: 5325699 - DNA, 21 bp, Homo sapiens
tgggggcactgaccaggccca

SEQ ID NO: 5325700 - DNA, 22 bp, Homo sapiens
tgggggcaggaaagccacatct

SEQ ID NO: 5325701 - DNA, 15 bp, Homo sapiens
tgggggcagggctgt

SEQ ID NO: 5325702 - DNA, 12 bp, Homo sapiens
tgggggcagggg

SEQ ID NO: 5325703 - DNA, 19 bp, Homo sapiens
tgggggcaggtcaggacca

SEQ ID NO: 5325704 - DNA, 22 bp, Homo sapiens
tgggggcaggtcaggaccagga

SEQ ID NO: 5325705 - DNA, 19 bp, Homo sapiens
tgggggcagtgactggcag

SEQ ID NO: 5325706 - DNA, 17 bp, Homo sapiens
tgggggcatcctgcttc

SEQ ID NO: 5325707 - DNA, 19 bp, Homo sapiens
tgggggcatcctgcttcct

SEQ ID NO: 5325708 - DNA, 20 bp, Homo sapiens
tgggggcatcctgcttcctg

SEQ ID NO: 5325709 - DNA, 22 bp, Homo sapiens
tgggggcatcctgcttcctgaa

SEQ ID NO: 5325710 - DNA, 16 bp, Homo sapiens
tgggggcatgggggag

SEQ ID NO: 5325711 - DNA, 22 bp, Homo sapiens
tgggggcatgggggaggctctg

SEQ ID NO: 5325712 - DNA, 13 bp, Homo sapiens
tgggggcatgggt

SEQ ID NO: 5325713 - DNA, 17 bp, Homo sapiens
tgggggccacatttcac

SEQ ID NO: 5325714 - DNA, 14 bp, Homo sapiens
tgggggccacctgc

SEQ ID NO: 5325715 - DNA, 16 bp, Homo sapiens
tgggggccacctgcct

SEQ ID NO: 5325716 - DNA, 22 bp, Homo sapiens
tgggggccagcacagctgagga

SEQ ID NO: 5325717 - DNA, 18 bp, Homo sapiens
tgggggccaggacaccag

SEQ ID NO: 5325718 - DNA, 12 bp, Homo sapiens
tgggggccaggc

SEQ ID NO: 5325719 - DNA, 16 bp, Homo sapiens
tgggggccagggctgg

SEQ ID NO: 5325720 - DNA, 18 bp, Homo sapiens
tgggggccagggctggat

SEQ ID NO: 5325721 - DNA, 22 bp, Homo sapiens
tgggggccagggctggatggac

SEQ ID NO: 5325722 - DNA, 16 bp, Homo sapiens
tgggggccatgagctc

SEQ ID NO: 5325723 - DNA, 20 bp, Homo sapiens
tgggggcccattctgcatgc

SEQ ID NO: 5325724 - DNA, 16 bp, Homo sapiens
tgggggccgctggccc

SEQ ID NO: 5325725 - DNA, 12 bp, Homo sapiens
tgggggcctctc

SEQ ID NO: 5325726 - DNA, 17 bp, Homo sapiens
tgggggcctgctgtggg

SEQ ID NO: 5325727 - DNA, 18 bp, Homo sapiens
tgggggcctgctgtgggt

SEQ ID NO: 5325728 - DNA, 12 bp, Homo sapiens
tgggggcctggc

SEQ ID NO: 5325729 - DNA, 13 bp, Homo sapiens
tgggggcctggct

SEQ ID NO: 5325730 - DNA, 19 bp, Homo sapiens
tgggggcctggctggctga

SEQ ID NO: 5325731 - DNA, 17 bp, Homo sapiens
tgggggcgcagaggaca

SEQ ID NO: 5325732 - DNA, 20 bp, Homo sapiens
tgggggcgccctctctgctc

SEQ ID NO: 5325733 - DNA, 16 bp, Homo sapiens
tgggggcgggactcct

SEQ ID NO: 5325734 - DNA, 20 bp, Homo sapiens
tgggggcgggactcctccct

SEQ ID NO: 5325735 - DNA, 18 bp, Homo sapiens
tgggggcggggcctgggc

SEQ ID NO: 5325736 - DNA, 14 bp, Homo sapiens
tgggggctagggag

SEQ ID NO: 5325737 - DNA, 21 bp, Homo sapiens
tgggggctaggggagggggga

SEQ ID NO: 5325738 - DNA, 17 bp, Homo sapiens
tgggggctcagcaaggc

SEQ ID NO: 5325739 - DNA, 23 bp, Homo sapiens
tgggggctcagcaaggccacctc

SEQ ID NO: 5325740 - DNA, 14 bp, Homo sapiens
tgggggctcccctt

SEQ ID NO: 5325741 - DNA, 12 bp, Homo sapiens
tgggggctcctc

SEQ ID NO: 5325742 - DNA, 14 bp, Homo sapiens
tgggggctcctggt

SEQ ID NO: 5325743 - DNA, 15 bp, Homo sapiens
tgggggctcctggtg

SEQ ID NO: 5325744 - DNA, 22 bp, Homo sapiens
tgggggctctggccaagggcca

SEQ ID NO: 5325745 - DNA, 17 bp, Homo sapiens
tgggggctgaggagcag

SEQ ID NO: 5325746 - DNA, 22 bp, Homo sapiens
tgggggctgcgtccctgctcag

SEQ ID NO: 5325747 - DNA, 13 bp, Homo sapiens
tgggggctggacc

SEQ ID NO: 5325748 - DNA, 16 bp, Homo sapiens
tgggggctggaggtgc

SEQ ID NO: 5325749 - DNA, 14 bp, Homo sapiens
tgggggctggcctc

SEQ ID NO: 5325750 - DNA, 20 bp, Homo sapiens
tgggggctggctcccagggt

SEQ ID NO: 5325751 - DNA, 16 bp, Homo sapiens
tgggggctggtgccag

SEQ ID NO: 5325752 - DNA, 15 bp, Homo sapiens
tgggggctgtcctgc

SEQ ID NO: 5325753 - DNA, 20 bp, Homo sapiens
tgggggctgtctttgcaggg

SEQ ID NO: 5325754 - DNA, 16 bp, Homo sapiens
tgggggcttcttcctc

SEQ ID NO: 5325755 - DNA, 17 bp, Homo sapiens
tgggggcttcttcctca

SEQ ID NO: 5325756 - DNA, 21 bp, Homo sapiens
tgggggctttcggggagggcg

SEQ ID NO: 5325757 - DNA, 23 bp, Homo sapiens
tggggggaaataccttgagcaga

SEQ ID NO: 5325758 - DNA, 13 bp, Homo sapiens
tggggggaacgcc

SEQ ID NO: 5325759 - DNA, 21 bp, Homo sapiens
tggggggaacgcccacttccc

SEQ ID NO: 5325760 - DNA, 23 bp, Homo sapiens
tggggggagaaaaaaaaagcaaa

SEQ ID NO: 5325761 - DNA, 16 bp, Homo sapiens
tggggggagcaccctg

SEQ ID NO: 5325762 - DNA, 21 bp, Homo sapiens
tggggggagcaccctgagggc

SEQ ID NO: 5325763 - DNA, 13 bp, Homo sapiens
tggggggaggctg

SEQ ID NO: 5325764 - DNA, 20 bp, Homo sapiens
tggggggcaggatgggggag

SEQ ID NO: 5325765 - DNA, 20 bp, Homo sapiens
tggggggccaaagaaggcag

SEQ ID NO: 5325766 - DNA, 17 bp, Homo sapiens
tggggggccaacaccag

SEQ ID NO: 5325767 - DNA, 21 bp, Homo sapiens
tggggggccaacaccagggat

SEQ ID NO: 5325768 - DNA, 22 bp, Homo sapiens
tggggggccatgttcccagaac

SEQ ID NO: 5325769 - DNA, 14 bp, Homo sapiens
tggggggccgggca

SEQ ID NO: 5325770 - DNA, 17 bp, Homo sapiens
tgggggggaggtgaggt

SEQ ID NO: 5325771 - DNA, 20 bp, Homo sapiens
tgggggggccaaaaggaaaa

SEQ ID NO: 5325772 - DNA, 21 bp, Homo sapiens
tgggggggccaaaaggaaaaa

SEQ ID NO: 5325773 - DNA, 14 bp, Homo sapiens
tgggggggctgcct

SEQ ID NO: 5325774 - DNA, 17 bp, Homo sapiens
tgggggggctgcctttg

SEQ ID NO: 5325775 - DNA, 18 bp, Homo sapiens
tggggggggcaagaaaga

SEQ ID NO: 5325776 - DNA, 13 bp, Homo sapiens
tggggggggtgct

SEQ ID NO: 5325777 - DNA, 13 bp, Homo sapiens
tgggggggtggcc

SEQ ID NO: 5325778 - DNA, 23 bp, Homo sapiens
tgggggggtggccgctgagtggc

SEQ ID NO: 5325779 - DNA, 19 bp, Homo sapiens
tgggggggtgttaatttat

SEQ ID NO: 5325780 - DNA, 17 bp, Homo sapiens
tggggggtccagtctgt

SEQ ID NO: 5325781 - DNA, 20 bp, Homo sapiens
tggggggtgatgagggcagc

SEQ ID NO: 5325782 - DNA, 20 bp, Homo sapiens
tggggggtgcaggtgggcac

SEQ ID NO: 5325783 - DNA, 16 bp, Homo sapiens
tggggggtggccaggc

SEQ ID NO: 5325784 - DNA, 20 bp, Homo sapiens
tgggggtaaaaaatatagcc

SEQ ID NO: 5325785 - DNA, 18 bp, Homo sapiens
tgggggtagagctgatcc

SEQ ID NO: 5325786 - DNA, 22 bp, Homo sapiens
tgggggtagccccgccccagcc

SEQ ID NO: 5325787 - DNA, 22 bp, Homo sapiens
tgggggtcacccatggcctcag

SEQ ID NO: 5325788 - DNA, 11 bp, Homo sapiens
tgggggtcaga

SEQ ID NO: 5325789 - DNA, 13 bp, Homo sapiens
tgggggtcagaag

SEQ ID NO: 5325790 - DNA, 18 bp, Homo sapiens
tgggggtcaggcagccag

SEQ ID NO: 5325791 - DNA, 21 bp, Homo sapiens
tgggggtcctcctccagggac

SEQ ID NO: 5325792 - DNA, 21 bp, Homo sapiens
tgggggtcctctctgagtcaa

SEQ ID NO: 5325793 - DNA, 14 bp, Homo sapiens
tgggggtctgtgtg

SEQ ID NO: 5325794 - DNA, 14 bp, Homo sapiens
tgggggtgacccca

SEQ ID NO: 5325795 - DNA, 15 bp, Homo sapiens
tgggggtgagggtcc

SEQ ID NO: 5325796 - DNA, 15 bp, Homo sapiens
tgggggtgcagatgg

SEQ ID NO: 5325797 - DNA, 16 bp, Homo sapiens
tgggggtgcaggcagc

SEQ ID NO: 5325798 - DNA, 14 bp, Homo sapiens
tgggggtgccagga

SEQ ID NO: 5325799 - DNA, 16 bp, Homo sapiens
tgggggtggaaaagga

SEQ ID NO: 5325800 - DNA, 18 bp, Homo sapiens
tgggggtggaggcttcct

SEQ ID NO: 5325801 - DNA, 17 bp, Homo sapiens
tgggggtggccactcct

SEQ ID NO: 5325802 - DNA, 13 bp, Homo sapiens
tgggggtgggagg

SEQ ID NO: 5325803 - DNA, 21 bp, Homo sapiens
tgggggtgggctgctggccat

SEQ ID NO: 5325804 - DNA, 15 bp, Homo sapiens
tgggggtggggctcc

SEQ ID NO: 5325805 - DNA, 12 bp, Homo sapiens
tgggggtggggg

SEQ ID NO: 5325806 - DNA, 16 bp, Homo sapiens
tgggggtgggggtagg

SEQ ID NO: 5325807 - DNA, 13 bp, Homo sapiens
tgggggtgggtca

SEQ ID NO: 5325808 - DNA, 17 bp, Homo sapiens
tgggtgcctcctgcagt

SEQ ID NO: 5325809 - DNA, 13 bp, Homo sapiens
tgggtgcgacccc

SEQ ID NO: 5325810 - DNA, 19 bp, Homo sapiens
tgggtgcgaccccatctgc

SEQ ID NO: 5325811 - DNA, 23 bp, Homo sapiens
tgggtgcgaccccatctgcccag

SEQ ID NO: 5325812 - DNA, 19 bp, Homo sapiens
tgggtgcgtctccagtcat

SEQ ID NO: 5325813 - DNA, 10 bp, Homo sapiens
tgggtgctca

SEQ ID NO: 5325814 - DNA, 21 bp, Homo sapiens
tgggtgctcagggcatgctta

SEQ ID NO: 5325815 - DNA, 21 bp, Homo sapiens
tgggtgctgctaattctttgc

SEQ ID NO: 5325816 - DNA, 13 bp, Homo sapiens
tgggtgctggcag

SEQ ID NO: 5325817 - DNA, 14 bp, Homo sapiens
tgggtgctggctgc

SEQ ID NO: 5325818 - DNA, 19 bp, Homo sapiens
tgggtgctgtcatgcccag

SEQ ID NO: 5325819 - DNA, 19 bp, Homo sapiens
tgggtgcttggaggaagga

SEQ ID NO: 5325820 - DNA, 18 bp, Homo sapiens
tgggtggaaaacagggtg

SEQ ID NO: 5325821 - DNA, 19 bp, Homo sapiens
tgggtggaagtgcccagcc

SEQ ID NO: 5325822 - DNA, 15 bp, Homo sapiens
tgggtggagaagcca

SEQ ID NO: 5325823 - DNA, 14 bp, Homo sapiens
tgggtggagaaggg

SEQ ID NO: 5325824 - DNA, 18 bp, Homo sapiens
tgggtggagaagggaggg

SEQ ID NO: 5325825 - DNA, 22 bp, Homo sapiens
tgggtggaggaagatccaaaca

SEQ ID NO: 5325826 - DNA, 22 bp, Homo sapiens
tgggtggatcaccagaggtcag

SEQ ID NO: 5325827 - DNA, 23 bp, Homo sapiens
tgggtggatgcctggtggcagct

SEQ ID NO: 5325828 - DNA, 22 bp, Homo sapiens
tgggtggcaacatttggggaga

SEQ ID NO: 5325829 - DNA, 22 bp, Homo sapiens
tgggtggcaccagcagcctgga

SEQ ID NO: 5325830 - DNA, 20 bp, Homo sapiens
tgggtggccatcctacccag

SEQ ID NO: 5325831 - DNA, 21 bp, Homo sapiens
tgggtggccatcctacccagc

SEQ ID NO: 5325832 - DNA, 15 bp, Homo sapiens
tgggtggcccatccc

SEQ ID NO: 5325833 - DNA, 18 bp, Homo sapiens
tgggtggccggccctgcc

SEQ ID NO: 5325834 - DNA, 21 bp, Homo sapiens
tgggtggccggccctgccccc

SEQ ID NO: 5325835 - DNA, 14 bp, Homo sapiens
tgggtggctactct

SEQ ID NO: 5325836 - DNA, 20 bp, Homo sapiens
tgggtggctactctgtgcca

SEQ ID NO: 5325837 - DNA, 18 bp, Homo sapiens
tgggtggctcactactga

SEQ ID NO: 5325838 - DNA, 13 bp, Homo sapiens
tgggtggctcctg

SEQ ID NO: 5325839 - DNA, 21 bp, Homo sapiens
tgggtggctcctgccactgac

SEQ ID NO: 5325840 - DNA, 22 bp, Homo sapiens
tgggtggctttcaaggctgggg

SEQ ID NO: 5325841 - DNA, 17 bp, Homo sapiens
tgggtgggacagcctct

SEQ ID NO: 5325842 - DNA, 18 bp, Homo sapiens
tgggtgggacagggcttc

SEQ ID NO: 5325843 - DNA, 19 bp, Homo sapiens
tgggtgggagtgtgtctgc

SEQ ID NO: 5325844 - DNA, 16 bp, Homo sapiens
tgggtgggattttgca

SEQ ID NO: 5325845 - DNA, 14 bp, Homo sapiens
tgggtgggcaggga

SEQ ID NO: 5325846 - DNA, 19 bp, Homo sapiens
tgggtgggccctgccggga

SEQ ID NO: 5325847 - DNA, 14 bp, Homo sapiens
tgggtgggcctgac

SEQ ID NO: 5325848 - DNA, 18 bp, Homo sapiens
tgggtgggcctggccctg

SEQ ID NO: 5325849 - DNA, 15 bp, Homo sapiens
tgggtgggctctgtg

SEQ ID NO: 5325850 - DNA, 16 bp, Homo sapiens
tgggtggggctcctgg

SEQ ID NO: 5325851 - DNA, 21 bp, Homo sapiens
tgggtggggcttctctgggac

SEQ ID NO: 5325852 - DNA, 21 bp, Homo sapiens
tgggtgggggctgtggccctg

SEQ ID NO: 5325853 - DNA, 18 bp, Homo sapiens
tgggtggggggcttcata

SEQ ID NO: 5325854 - DNA, 20 bp, Homo sapiens
tgggtggggggcttcataca

SEQ ID NO: 5325855 - DNA, 16 bp, Homo sapiens
tgggtggggtattttt

SEQ ID NO: 5325856 - DNA, 16 bp, Homo sapiens
tgggtgggtagattta

SEQ ID NO: 5325857 - DNA, 16 bp, Homo sapiens
tgggtgggtgggcagg

SEQ ID NO: 5325858 - DNA, 14 bp, Homo sapiens
tgggtggttcctaa

SEQ ID NO: 5325859 - DNA, 15 bp, Homo sapiens
tgggtggttcctaag

SEQ ID NO: 5325860 - DNA, 22 bp, Homo sapiens
tgggtgtagatttctgacatca

SEQ ID NO: 5325861 - DNA, 20 bp, Homo sapiens
tgggtgtaggggcttacaaa

SEQ ID NO: 5325862 - DNA, 15 bp, Homo sapiens
tgggtgtatgtatgt

SEQ ID NO: 5325863 - DNA, 22 bp, Homo sapiens
tgggtgtatttattttcctccc

SEQ ID NO: 5325864 - DNA, 20 bp, Homo sapiens
tgggtgtcaagtgcctgcac

SEQ ID NO: 5325865 - DNA, 14 bp, Homo sapiens
tgggtgtcatttca

SEQ ID NO: 5325866 - DNA, 20 bp, Homo sapiens
tgggtgtcatttcattccat

SEQ ID NO: 5325867 - DNA, 21 bp, Homo sapiens
tgggtgtccgccatccagggt

SEQ ID NO: 5325868 - DNA, 22 bp, Homo sapiens
tgggtgtccgccatccagggtc

SEQ ID NO: 5325869 - DNA, 12 bp, Homo sapiens
tgggtgtcctgc

SEQ ID NO: 5325870 - DNA, 13 bp, Homo sapiens
tgggtgtcctgcc

SEQ ID NO: 5325871 - DNA, 15 bp, Homo sapiens
tgggtgtcctgcctg

SEQ ID NO: 5325872 - DNA, 23 bp, Homo sapiens
tgggtgtcctgcctgtctgcccc

SEQ ID NO: 5325873 - DNA, 14 bp, Homo sapiens
tgggtgtctccctc

SEQ ID NO: 5325874 - DNA, 23 bp, Homo sapiens
tgggtgtctccctcgggggctct

SEQ ID NO: 5325875 - DNA, 17 bp, Homo sapiens
tgggtgtctccttaagc

SEQ ID NO: 5325876 - DNA, 16 bp, Homo sapiens
tgggtgtgctccaggc

SEQ ID NO: 5325877 - DNA, 17 bp, Homo sapiens
tgggtgtgctccaggct

SEQ ID NO: 5325878 - DNA, 12 bp, Homo sapiens
tgggtgtgtcca

SEQ ID NO: 5325879 - DNA, 13 bp, Homo sapiens
tgggtgtgtccag

SEQ ID NO: 5325880 - DNA, 21 bp, Homo sapiens
tgggtgtgtgcgcctgagtga

SEQ ID NO: 5325881 - DNA, 18 bp, Homo sapiens
tgggtgtgtttcaggaca

SEQ ID NO: 5325882 - DNA, 19 bp, Homo sapiens
tgggtgttcctggcagttt

SEQ ID NO: 5325883 - DNA, 19 bp, Homo sapiens
tgggtgttctttcctgccc

SEQ ID NO: 5325884 - DNA, 15 bp, Homo sapiens
tgggtgttgatctta

SEQ ID NO: 5325885 - DNA, 15 bp, Homo sapiens
tgggtgttgctgttt

SEQ ID NO: 5325886 - DNA, 21 bp, Homo sapiens
tgggtgtttattacaagtggc

SEQ ID NO: 5325887 - DNA, 23 bp, Homo sapiens
tgggtgtttattacaagtggctc

SEQ ID NO: 5325888 - DNA, 15 bp, Homo sapiens
tgggtgtttccagaa

SEQ ID NO: 5325889 - DNA, 19 bp, Homo sapiens
tgggtgtttttcatgtttt

SEQ ID NO: 5325890 - DNA, 16 bp, Homo sapiens
tgggttaataaatgaa

SEQ ID NO: 5325891 - DNA, 23 bp, Homo sapiens
tgggttacagtatgcttgctcta

SEQ ID NO: 5325892 - DNA, 15 bp, Homo sapiens
tgggttagacctaca

SEQ ID NO: 5325893 - DNA, 19 bp, Homo sapiens
tgggttagactgccagctc

SEQ ID NO: 5325894 - DNA, 15 bp, Homo sapiens
tgggttagcaatatt

SEQ ID NO: 5325895 - DNA, 16 bp, Homo sapiens
tgggttagggaaaaca

SEQ ID NO: 5325896 - DNA, 22 bp, Homo sapiens
tgggttaggtggccgctcctcc

SEQ ID NO: 5325897 - DNA, 21 bp, Homo sapiens
tgggttatcatggaagaaaag

SEQ ID NO: 5325898 - DNA, 15 bp, Homo sapiens
tgggttatgaatatt

SEQ ID NO: 5325899 - DNA, 15 bp, Homo sapiens
tgggttatttattga

SEQ ID NO: 5325900 - DNA, 18 bp, Homo sapiens
tgggttatttttattaaa

SEQ ID NO: 5325901 - DNA, 21 bp, Homo sapiens
tgggttatttttattaaatgt

SEQ ID NO: 5325902 - DNA, 19 bp, Homo sapiens
tgggttatttttgtccctg

SEQ ID NO: 5325903 - DNA, 20 bp, Homo sapiens
tgggttatttttgtccctgc

SEQ ID NO: 5325904 - DNA, 15 bp, Homo sapiens
tgggttcaaaaagaa

SEQ ID NO: 5325905 - DNA, 18 bp, Homo sapiens
tgggttcactagagctgg

SEQ ID NO: 5325906 - DNA, 19 bp, Homo sapiens
tgggttcactagagctggg

SEQ ID NO: 5325907 - DNA, 20 bp, Homo sapiens
tgggttcacttgccatgcag

SEQ ID NO: 5325908 - DNA, 14 bp, Homo sapiens
tgggttcagaacca

SEQ ID NO: 5325909 - DNA, 21 bp, Homo sapiens
tgggttcatcctattctttcg

SEQ ID NO: 5325910 - DNA, 16 bp, Homo sapiens
tgggttcatgatgcag

SEQ ID NO: 5325911 - DNA, 17 bp, Homo sapiens
tgggttcatgatgcagt

SEQ ID NO: 5325912 - DNA, 16 bp, Homo sapiens
tgggttcattattgga

SEQ ID NO: 5325913 - DNA, 14 bp, Homo sapiens
tgggttccacagac

SEQ ID NO: 5325914 - DNA, 15 bp, Homo sapiens
tgggttccacagacg

SEQ ID NO: 5325915 - DNA, 12 bp, Homo sapiens
tgggttccagac

SEQ ID NO: 5325916 - DNA, 13 bp, Homo sapiens
tgggttccagaca

SEQ ID NO: 5325917 - DNA, 14 bp, Homo sapiens
tgggttccagacag

SEQ ID NO: 5325918 - DNA, 21 bp, Homo sapiens
tgggttccagacagagtggat

SEQ ID NO: 5325919 - DNA, 20 bp, Homo sapiens
tgggttccctttccttccat

SEQ ID NO: 5325920 - DNA, 15 bp, Homo sapiens
tgggttccgggaggc

SEQ ID NO: 5325921 - DNA, 22 bp, Homo sapiens
tgggttccttcctctgagcctt

SEQ ID NO: 5325922 - DNA, 18 bp, Homo sapiens
tgggttcgttggggacat

SEQ ID NO: 5325923 - DNA, 16 bp, Homo sapiens
tgggttctatgtttac

SEQ ID NO: 5325924 - DNA, 14 bp, Homo sapiens
tgggttctggggca

SEQ ID NO: 5325925 - DNA, 16 bp, Homo sapiens
tgggttcttcctctgt

SEQ ID NO: 5325926 - DNA, 16 bp, Homo sapiens
tgggttcttgttttat

SEQ ID NO: 5325927 - DNA, 12 bp, Homo sapiens
tgggttctttct

SEQ ID NO: 5325928 - DNA, 16 bp, Homo sapiens
tgggttctttggaagc

SEQ ID NO: 5325929 - DNA, 16 bp, Homo sapiens
tgggttgagggatgct

SEQ ID NO: 5325930 - DNA, 16 bp, Homo sapiens
tgggttgcagacagga

SEQ ID NO: 5325931 - DNA, 14 bp, Homo sapiens
tgggttggccagga

SEQ ID NO: 5325932 - DNA, 16 bp, Homo sapiens
tgggttggccaggagg

SEQ ID NO: 5325933 - DNA, 17 bp, Homo sapiens
tgggttggcgcaccctc

SEQ ID NO: 5325934 - DNA, 22 bp, Homo sapiens
tgggttggcgcaccctcccctc

SEQ ID NO: 5325935 - DNA, 20 bp, Homo sapiens
tgggttggcttgctgatggc

SEQ ID NO: 5325936 - DNA, 19 bp, Homo sapiens
tgggttggtgcacagtgat

SEQ ID NO: 5325937 - DNA, 16 bp, Homo sapiens
tgggttgtcactgaga

SEQ ID NO: 5325938 - DNA, 18 bp, Homo sapiens
tgggttgtgcacatttct

SEQ ID NO: 5325939 - DNA, 18 bp, Homo sapiens
tgggttgtttaaaaattt

SEQ ID NO: 5325940 - DNA, 14 bp, Homo sapiens
tgggttgtttccag

SEQ ID NO: 5325941 - DNA, 16 bp, Homo sapiens
tgggtttacaacaaac

SEQ ID NO: 5325942 - DNA, 22 bp, Homo sapiens
tgggtttattttcattctgcca

SEQ ID NO: 5325943 - DNA, 12 bp, Homo sapiens
tgggtttcatgt

SEQ ID NO: 5325944 - DNA, 14 bp, Homo sapiens
tgggtttccctgcg

SEQ ID NO: 5325945 - DNA, 16 bp, Homo sapiens
tgggtttcctgcaggc

SEQ ID NO: 5325946 - DNA, 17 bp, Homo sapiens
tgggtttctaaagctgc

SEQ ID NO: 5325947 - DNA, 14 bp, Homo sapiens
tgggtttctctgtg

SEQ ID NO: 5325948 - DNA, 18 bp, Homo sapiens
tgggtttgcccagtcctg

SEQ ID NO: 5325949 - DNA, 21 bp, Homo sapiens
tgggtttgcccagtcctgggt

SEQ ID NO: 5325950 - DNA, 17 bp, Homo sapiens
tgggtttggcaggcact

SEQ ID NO: 5325951 - DNA, 16 bp, Homo sapiens
tgggtttggcccctgg

SEQ ID NO: 5325952 - DNA, 18 bp, Homo sapiens
tgggtttgggagccagga

SEQ ID NO: 5325953 - DNA, 21 bp, Homo sapiens
tgggtttgggtgcctcctgca

SEQ ID NO: 5325954 - DNA, 16 bp, Homo sapiens
tgggttttagaaattc

SEQ ID NO: 5325955 - DNA, 16 bp, Homo sapiens
tgggttttatgagatg

SEQ ID NO: 5325956 - DNA, 18 bp, Homo sapiens
tgggttttccgcccacag

SEQ ID NO: 5325957 - DNA, 17 bp, Homo sapiens
tgggttttctaactgta

SEQ ID NO: 5325958 - DNA, 19 bp, Homo sapiens
tgggttttctaactgtaaa

SEQ ID NO: 5325959 - DNA, 20 bp, Homo sapiens
tgggttttctaactgtaaat

SEQ ID NO: 5325960 - DNA, 16 bp, Homo sapiens
tgggttttgcctctgc

SEQ ID NO: 5325961 - DNA, 19 bp, Homo sapiens
tgggttttgtattctctga

SEQ ID NO: 5325962 - DNA, 22 bp, Homo sapiens
tgggttttgttggctttttgaa

SEQ ID NO: 5325963 - DNA, 23 bp, Homo sapiens
tgggtttttaaaaaaaatattct

SEQ ID NO: 5325964 - DNA, 14 bp, Homo sapiens
tgggtttttatgaa

SEQ ID NO: 5325965 - DNA, 22 bp, Homo sapiens
tgggtttttatttcctatgatg

SEQ ID NO: 5325966 - DNA, 19 bp, Homo sapiens
tgggtttttgtatccagag

SEQ ID NO: 5325967 - DNA, 21 bp, Homo sapiens
tgggtttttgtatccagagct

SEQ ID NO: 5325968 - DNA, 22 bp, Homo sapiens
tgggtttttgttacctttatgg

SEQ ID NO: 5325969 - DNA, 17 bp, Homo sapiens
tgggttttttcacataa

SEQ ID NO: 5325970 - DNA, 17 bp, Homo sapiens
tggtaaaaaagaaatga

SEQ ID NO: 5325971 - DNA, 19 bp, Homo sapiens
tggtaaaaaagaaatgaaa

SEQ ID NO: 5325972 - DNA, 21 bp, Homo sapiens
tggtaaaaacagcagctcata

SEQ ID NO: 5325973 - DNA, 15 bp, Homo sapiens
tggtaaaaactagtt

SEQ ID NO: 5325974 - DNA, 18 bp, Homo sapiens
tggtaaaaagatccaggg

SEQ ID NO: 5325975 - DNA, 18 bp, Homo sapiens
tggtaaaacattacttat

SEQ ID NO: 5325976 - DNA, 18 bp, Homo sapiens
tggtaaaatgaagaattt

SEQ ID NO: 5325977 - DNA, 16 bp, Homo sapiens
tggtaaaattgcatgg

SEQ ID NO: 5325978 - DNA, 20 bp, Homo sapiens
tggtaaagaaaagcctcagc

SEQ ID NO: 5325979 - DNA, 23 bp, Homo sapiens
tggtaaagaaatacacagggagg

SEQ ID NO: 5325980 - DNA, 17 bp, Homo sapiens
tggtaaagactggcttt

SEQ ID NO: 5325981 - DNA, 17 bp, Homo sapiens
tggtaaagatattattc

SEQ ID NO: 5325982 - DNA, 18 bp, Homo sapiens
tggtaaagatattattca

SEQ ID NO: 5325983 - DNA, 23 bp, Homo sapiens
tggtaaagccatgttaaatgact

SEQ ID NO: 5325984 - DNA, 15 bp, Homo sapiens
tggtagttttacagt

SEQ ID NO: 5325985 - DNA, 12 bp, Homo sapiens
tggtataaaagg

SEQ ID NO: 5325986 - DNA, 14 bp, Homo sapiens
tggtataaattaat

SEQ ID NO: 5325987 - DNA, 16 bp, Homo sapiens
tggtataatgtttaaa

SEQ ID NO: 5325988 - DNA, 22 bp, Homo sapiens
tggtataatgtttaaatcatgt

SEQ ID NO: 5325989 - DNA, 21 bp, Homo sapiens
tggtatacattgaattcatta

SEQ ID NO: 5325990 - DNA, 16 bp, Homo sapiens
tggtatagaaatgctg

SEQ ID NO: 5325991 - DNA, 14 bp, Homo sapiens
tggtatagtattag

SEQ ID NO: 5325992 - DNA, 20 bp, Homo sapiens
tggtatatactttgccactg

SEQ ID NO: 5325993 - DNA, 23 bp, Homo sapiens
tggtatatatttaggatttgtgt

SEQ ID NO: 5325994 - DNA, 22 bp, Homo sapiens
tggtatatccaaaagcttttta

SEQ ID NO: 5325995 - DNA, 22 bp, Homo sapiens
tggtatatggcttcaagttgta

SEQ ID NO: 5325996 - DNA, 18 bp, Homo sapiens
tggtatatgtcattattt

SEQ ID NO: 5325997 - DNA, 18 bp, Homo sapiens
tggtatatttgtgtatgt

SEQ ID NO: 5325998 - DNA, 19 bp, Homo sapiens
tggtatatttgtgtatgtg

SEQ ID NO: 5325999 - DNA, 23 bp, Homo sapiens
tggtatcattacaattttctgta

SEQ ID NO: 5326000 - DNA, 19 bp, Homo sapiens
tggtatctgggtaagaaga

SEQ ID NO: 5326001 - DNA, 17 bp, Homo sapiens
tggtatctgttctttaa

SEQ ID NO: 5326002 - DNA, 19 bp, Homo sapiens
tggtatctgttctttaatt

SEQ ID NO: 5326003 - DNA, 16 bp, Homo sapiens
tggtatcttaaagtgt

SEQ ID NO: 5326004 - DNA, 17 bp, Homo sapiens
tggtatcttgagtcttg

SEQ ID NO: 5326005 - DNA, 18 bp, Homo sapiens
tggtatctttaattgtat

SEQ ID NO: 5326006 - DNA, 22 bp, Homo sapiens
tggtatgaaacaaatatactca

SEQ ID NO: 5326007 - DNA, 19 bp, Homo sapiens
tggtatgaacttgaggaca

SEQ ID NO: 5326008 - DNA, 17 bp, Homo sapiens
tggtatgaataattgca

SEQ ID NO: 5326009 - DNA, 15 bp, Homo sapiens
tggtatgatgctgcc

SEQ ID NO: 5326010 - DNA, 16 bp, Homo sapiens
tggtatgatgctgccg

SEQ ID NO: 5326011 - DNA, 14 bp, Homo sapiens
tggtatgctggcca

SEQ ID NO: 5326012 - DNA, 17 bp, Homo sapiens
tggtatgctggccagca

SEQ ID NO: 5326013 - DNA, 19 bp, Homo sapiens
tggtatgctggccagcacc

SEQ ID NO: 5326014 - DNA, 22 bp, Homo sapiens
tggtatgcttgcatatatttca

SEQ ID NO: 5326015 - DNA, 16 bp, Homo sapiens
tggtatggctgcagtc

SEQ ID NO: 5326016 - DNA, 18 bp, Homo sapiens
tggtatgggctgttctgt

SEQ ID NO: 5326017 - DNA, 18 bp, Homo sapiens
tggtatggggctgagccc

SEQ ID NO: 5326018 - DNA, 14 bp, Homo sapiens
tggtatgggtttct

SEQ ID NO: 5326019 - DNA, 15 bp, Homo sapiens
tggtatgtctcttta

SEQ ID NO: 5326020 - DNA, 13 bp, Homo sapiens
tggtatgtctgcc

SEQ ID NO: 5326021 - DNA, 12 bp, Homo sapiens
tggtatgtgaat

SEQ ID NO: 5326022 - DNA, 20 bp, Homo sapiens
tggtatgtgaattgaagtca

SEQ ID NO: 5326023 - DNA, 19 bp, Homo sapiens
tggtatgtgacaccaaagc

SEQ ID NO: 5326024 - DNA, 21 bp, Homo sapiens
tggtatgtgacatgcgggctg

SEQ ID NO: 5326025 - DNA, 18 bp, Homo sapiens
tggtatgtgagctaggag

SEQ ID NO: 5326026 - DNA, 13 bp, Homo sapiens
tggtatgtgccag

SEQ ID NO: 5326027 - DNA, 14 bp, Homo sapiens
tggtatgtgccagg

SEQ ID NO: 5326028 - DNA, 15 bp, Homo sapiens
tggtatgtgtgtgta

SEQ ID NO: 5326029 - DNA, 15 bp, Homo sapiens
tggtatgttgggata

SEQ ID NO: 5326030 - DNA, 21 bp, Homo sapiens
tggtatgttttcaggctagat

SEQ ID NO: 5326031 - DNA, 18 bp, Homo sapiens
tggtattagttaaaacac

SEQ ID NO: 5326032 - DNA, 21 bp, Homo sapiens
tggtattatcaaagcattgct

SEQ ID NO: 5326033 - DNA, 19 bp, Homo sapiens
tggtattattctgttttgc

SEQ ID NO: 5326034 - DNA, 13 bp, Homo sapiens
tggtattcaattt

SEQ ID NO: 5326035 - DNA, 19 bp, Homo sapiens
tggtattcaggattacatg

SEQ ID NO: 5326036 - DNA, 19 bp, Homo sapiens
tggtattcgcttgagaaaa

SEQ ID NO: 5326037 - DNA, 14 bp, Homo sapiens
tggtattctctcta

SEQ ID NO: 5326038 - DNA, 14 bp, Homo sapiens
tggtattgtaatat

SEQ ID NO: 5326039 - DNA, 12 bp, Homo sapiens
tggtattgtatt

SEQ ID NO: 5326040 - DNA, 18 bp, Homo sapiens
tggtattgtatttattca

SEQ ID NO: 5326041 - DNA, 21 bp, Homo sapiens
tggtattgtcttaaataaatc

SEQ ID NO: 5326042 - DNA, 12 bp, Homo sapiens
tggtatttactg

SEQ ID NO: 5326043 - DNA, 20 bp, Homo sapiens
tggtatttactgcaatgtct

SEQ ID NO: 5326044 - DNA, 19 bp, Homo sapiens
tggtatttatctattgtaa

SEQ ID NO: 5326045 - DNA, 12 bp, Homo sapiens
tggtatttctaa

SEQ ID NO: 5326046 - DNA, 21 bp, Homo sapiens
tggtatttgcaccaacatagt

SEQ ID NO: 5326047 - DNA, 18 bp, Homo sapiens
tggtatttgctgtcacat

SEQ ID NO: 5326048 - DNA, 20 bp, Homo sapiens
tggtattttaacatagcagc

SEQ ID NO: 5326049 - DNA, 21 bp, Homo sapiens
tggtattttaacatagcagct

SEQ ID NO: 5326050 - DNA, 22 bp, Homo sapiens
tggtattttataagcacagaca

SEQ ID NO: 5326051 - DNA, 17 bp, Homo sapiens
tggtattttcgtgcatt

SEQ ID NO: 5326052 - DNA, 16 bp, Homo sapiens
tggtattttttgtgaa

SEQ ID NO: 5326053 - DNA, 18 bp, Homo sapiens
tggtatttttttaaatca

SEQ ID NO: 5326054 - DNA, 22 bp, Homo sapiens
tggtcaaacaaactctctgaac

SEQ ID NO: 5326055 - DNA, 14 bp, Homo sapiens
tggtcaaaccgcac

SEQ ID NO: 5326056 - DNA, 23 bp, Homo sapiens
tggtcaacatttctcatgttgaa

SEQ ID NO: 5326057 - DNA, 22 bp, Homo sapiens
tggtcaagaaaggaggggagaa

SEQ ID NO: 5326058 - DNA, 22 bp, Homo sapiens
tggtcaagattttgaatgcttc

SEQ ID NO: 5326059 - DNA, 16 bp, Homo sapiens
tggtcaaggccacctc

SEQ ID NO: 5326060 - DNA, 21 bp, Homo sapiens
tggtcaaggccacctctgcct

SEQ ID NO: 5326061 - DNA, 22 bp, Homo sapiens
tggtcaaggccacctctgcctc

SEQ ID NO: 5326062 - DNA, 19 bp, Homo sapiens
tggtcaaggcccggcccca

SEQ ID NO: 5326063 - DNA, 21 bp, Homo sapiens
tggtcaaggcccggccccatc

SEQ ID NO: 5326064 - DNA, 15 bp, Homo sapiens
tggtcaagttgagat

SEQ ID NO: 5326065 - DNA, 15 bp, Homo sapiens
tggtcaatgcagttt

SEQ ID NO: 5326066 - DNA, 16 bp, Homo sapiens
tggtcacacaaggaac

SEQ ID NO: 5326067 - DNA, 16 bp, Homo sapiens
tggtcacacactgatg

SEQ ID NO: 5326068 - DNA, 20 bp, Homo sapiens
tggtcacagccatgaagtca

SEQ ID NO: 5326069 - DNA, 15 bp, Homo sapiens
tggtcacagcctcct

SEQ ID NO: 5326070 - DNA, 17 bp, Homo sapiens
tggtcacaggaagtaga

SEQ ID NO: 5326071 - DNA, 19 bp, Homo sapiens
tggtcacaggactctgcct

SEQ ID NO: 5326072 - DNA, 23 bp, Homo sapiens
tggtcacaggactctgcctcctc

SEQ ID NO: 5326073 - DNA, 15 bp, Homo sapiens
tggtcacaggctgtg

SEQ ID NO: 5326074 - DNA, 16 bp, Homo sapiens
tggtcacaggctgtgc

SEQ ID NO: 5326075 - DNA, 12 bp, Homo sapiens
tggtcacatgga

SEQ ID NO: 5326076 - DNA, 14 bp, Homo sapiens
tggtcacattccat

SEQ ID NO: 5326077 - DNA, 18 bp, Homo sapiens
tggtcaccaaatcagctg

SEQ ID NO: 5326078 - DNA, 23 bp, Homo sapiens
tggtcaccaaggcagtgcatgca

SEQ ID NO: 5326079 - DNA, 15 bp, Homo sapiens
tggtcacccagacta

SEQ ID NO: 5326080 - DNA, 21 bp, Homo sapiens
tggtcacccatgcatcttcca

SEQ ID NO: 5326081 - DNA, 20 bp, Homo sapiens
tggtcacccgactttggaat

SEQ ID NO: 5326082 - DNA, 19 bp, Homo sapiens
tggtcaccctggggctgct

SEQ ID NO: 5326083 - DNA, 16 bp, Homo sapiens
tggtcaccttcgagta

SEQ ID NO: 5326084 - DNA, 18 bp, Homo sapiens
tggtcaccttgcactcct

SEQ ID NO: 5326085 - DNA, 22 bp, Homo sapiens
tggtcactccagtagctcctgg

SEQ ID NO: 5326086 - DNA, 21 bp, Homo sapiens
tggtcactctgccctctgctg

SEQ ID NO: 5326087 - DNA, 14 bp, Homo sapiens
tggtcactgccatg

SEQ ID NO: 5326088 - DNA, 22 bp, Homo sapiens
tggtcactgccatggaggcaca

SEQ ID NO: 5326089 - DNA, 16 bp, Homo sapiens
tggtcactggtcaggg

SEQ ID NO: 5326090 - DNA, 18 bp, Homo sapiens
tggtcactggtcagggca

SEQ ID NO: 5326091 - DNA, 21 bp, Homo sapiens
tggtcactggtcagggcagtg

SEQ ID NO: 5326092 - DNA, 14 bp, Homo sapiens
tggtcactgtgcac

SEQ ID NO: 5326093 - DNA, 22 bp, Homo sapiens
tggtcacttcaaacatgccctc

SEQ ID NO: 5326094 - DNA, 22 bp, Homo sapiens
tggtcagaacctttggacaaga

SEQ ID NO: 5326095 - DNA, 16 bp, Homo sapiens
tggtcagagacggcag

SEQ ID NO: 5326096 - DNA, 22 bp, Homo sapiens
tggtcagagagggaagctgagg

SEQ ID NO: 5326097 - DNA, 21 bp, Homo sapiens
tggtcagagccacagggtctg

SEQ ID NO: 5326098 - DNA, 12 bp, Homo sapiens
tggtcagaggag

SEQ ID NO: 5326099 - DNA, 21 bp, Homo sapiens
tggtcagagtaagctgctttt

SEQ ID NO: 5326100 - DNA, 14 bp, Homo sapiens
tggtcagagtgcca

SEQ ID NO: 5326101 - DNA, 16 bp, Homo sapiens
tggtcagatttgaact

SEQ ID NO: 5326102 - DNA, 22 bp, Homo sapiens
tggtcagatttgaactcttcaa

SEQ ID NO: 5326103 - DNA, 15 bp, Homo sapiens
tggtcagcagaaacc

SEQ ID NO: 5326104 - DNA, 21 bp, Homo sapiens
tggtcagcagaaacccccagg

SEQ ID NO: 5326105 - DNA, 23 bp, Homo sapiens
tggtcagcagaaacccccaggag

SEQ ID NO: 5326106 - DNA, 15 bp, Homo sapiens
tggtcagcagagccg

SEQ ID NO: 5326107 - DNA, 18 bp, Homo sapiens
tggtcagcagagccgccc

SEQ ID NO: 5326108 - DNA, 22 bp, Homo sapiens
tggtcagccaaggctcccgttc

SEQ ID NO: 5326109 - DNA, 20 bp, Homo sapiens
tggtcagccctaggataaaa

SEQ ID NO: 5326110 - DNA, 15 bp, Homo sapiens
tggtcagccctaggg

SEQ ID NO: 5326111 - DNA, 22 bp, Homo sapiens
tggtcagccctagggtggagag

SEQ ID NO: 5326112 - DNA, 18 bp, Homo sapiens
tggtcagcggtatgtgcg

SEQ ID NO: 5326113 - DNA, 20 bp, Homo sapiens
tggtcaggcaatgccctgcg

SEQ ID NO: 5326114 - DNA, 10 bp, Homo sapiens
tggtcaggcc

SEQ ID NO: 5326115 - DNA, 11 bp, Homo sapiens
tggtcaggccc

SEQ ID NO: 5326116 - DNA, 12 bp, Homo sapiens
tggtcaggccca

SEQ ID NO: 5326117 - DNA, 12 bp, Homo sapiens
tggtcaggctgg

SEQ ID NO: 5326118 - DNA, 20 bp, Homo sapiens
tggtcaggctggtctcgaac

SEQ ID NO: 5326119 - DNA, 12 bp, Homo sapiens
tggtcagggcag

SEQ ID NO: 5326120 - DNA, 23 bp, Homo sapiens
tggtcaggggtgagacctgaagg

SEQ ID NO: 5326121 - DNA, 19 bp, Homo sapiens
tggtcagggtgtgggatct

SEQ ID NO: 5326122 - DNA, 12 bp, Homo sapiens
tggtcaggtccc

SEQ ID NO: 5326123 - DNA, 20 bp, Homo sapiens
tggtcagtagtttcatgttt

SEQ ID NO: 5326124 - DNA, 18 bp, Homo sapiens
tggtcagtctttgctcag

SEQ ID NO: 5326125 - DNA, 22 bp, Homo sapiens
tggtcagtgaagcccaggagga

SEQ ID NO: 5326126 - DNA, 21 bp, Homo sapiens
tggtcagttgtacgtaatgta

SEQ ID NO: 5326127 - DNA, 22 bp, Homo sapiens
tggtcagtttggttgtgtaaga

SEQ ID NO: 5326128 - DNA, 13 bp, Homo sapiens
tggtcataaaata

SEQ ID NO: 5326129 - DNA, 18 bp, Homo sapiens
tggtcatcaccacccttc

SEQ ID NO: 5326130 - DNA, 14 bp, Homo sapiens
tggtcatcctgggc

SEQ ID NO: 5326131 - DNA, 17 bp, Homo sapiens
tggtcatcctgggcatg

SEQ ID NO: 5326132 - DNA, 23 bp, Homo sapiens
tggtcatccttggtgctcttgct

SEQ ID NO: 5326133 - DNA, 22 bp, Homo sapiens
tggtcatgaattcatactctgt

SEQ ID NO: 5326134 - DNA, 22 bp, Homo sapiens
tggtcatgctcagccttgctgc

SEQ ID NO: 5326135 - DNA, 23 bp, Homo sapiens
tggtcatgctcagccttgctgct

SEQ ID NO: 5326136 - DNA, 22 bp, Homo sapiens
tggtcatggtagatttttttca

SEQ ID NO: 5326137 - DNA, 17 bp, Homo sapiens
tggtcatgtcctgaggc

SEQ ID NO: 5326138 - DNA, 19 bp, Homo sapiens
tggtcatgtgggtcttcca

SEQ ID NO: 5326139 - DNA, 18 bp, Homo sapiens
tggtcattatttcagtgt

SEQ ID NO: 5326140 - DNA, 14 bp, Homo sapiens
tggtcatttcaggc

SEQ ID NO: 5326141 - DNA, 21 bp, Homo sapiens
tggtcatttggtggctctaac

SEQ ID NO: 5326142 - DNA, 16 bp, Homo sapiens
tggtccaaaaaaagga

SEQ ID NO: 5326143 - DNA, 23 bp, Homo sapiens
tggtccaaaataaaacctcagct

SEQ ID NO: 5326144 - DNA, 15 bp, Homo sapiens
tggtccaaataggca

SEQ ID NO: 5326145 - DNA, 19 bp, Homo sapiens
tggtccaaccaggagctga

SEQ ID NO: 5326146 - DNA, 15 bp, Homo sapiens
tggtccaactgcaac

SEQ ID NO: 5326147 - DNA, 19 bp, Homo sapiens
tggtccaattagtttcctt

SEQ ID NO: 5326148 - DNA, 13 bp, Homo sapiens
tggtccacacacc

SEQ ID NO: 5326149 - DNA, 20 bp, Homo sapiens
tggtccacacaccacagaag

SEQ ID NO: 5326150 - DNA, 14 bp, Homo sapiens
tggtccacagggca

SEQ ID NO: 5326151 - DNA, 20 bp, Homo sapiens
tggtccacattctgctgccc

SEQ ID NO: 5326152 - DNA, 12 bp, Homo sapiens
tggtccaccctt

SEQ ID NO: 5326153 - DNA, 22 bp, Homo sapiens
tggtccagaaactcctgtttct

SEQ ID NO: 5326154 - DNA, 21 bp, Homo sapiens
tggtccagaccagccctgcag

SEQ ID NO: 5326155 - DNA, 23 bp, Homo sapiens
tggtccagattgaaaagtgtcct

SEQ ID NO: 5326156 - DNA, 19 bp, Homo sapiens
tggtccagcgtcactccag

SEQ ID NO: 5326157 - DNA, 12 bp, Homo sapiens
tggtccagctct

SEQ ID NO: 5326158 - DNA, 14 bp, Homo sapiens
tggtccagctctga

SEQ ID NO: 5326159 - DNA, 22 bp, Homo sapiens
tggtccagctctgacatccctt

SEQ ID NO: 5326160 - DNA, 13 bp, Homo sapiens
tggtctgaatgtt

SEQ ID NO: 5326161 - DNA, 15 bp, Homo sapiens
tggtctgaatgttct

SEQ ID NO: 5326162 - DNA, 16 bp, Homo sapiens
tggtctgaatgttctg

SEQ ID NO: 5326163 - DNA, 21 bp, Homo sapiens
tggtctgaatgttctgacatt

SEQ ID NO: 5326164 - DNA, 16 bp, Homo sapiens
tggtctgacccactgc

SEQ ID NO: 5326165 - DNA, 18 bp, Homo sapiens
tggtctgacccactgctt

SEQ ID NO: 5326166 - DNA, 16 bp, Homo sapiens
tggtctgagcaccccc

SEQ ID NO: 5326167 - DNA, 22 bp, Homo sapiens
tggtctgcaccccacaggatga

SEQ ID NO: 5326168 - DNA, 19 bp, Homo sapiens
tggtctgccaatctgtaca

SEQ ID NO: 5326169 - DNA, 18 bp, Homo sapiens
tggtctgccctctgcatc

SEQ ID NO: 5326170 - DNA, 17 bp, Homo sapiens
tggtctgctcgggccca

SEQ ID NO: 5326171 - DNA, 11 bp, Homo sapiens
tggtctgctgt

SEQ ID NO: 5326172 - DNA, 12 bp, Homo sapiens
tggtctggaaac

SEQ ID NO: 5326173 - DNA, 14 bp, Homo sapiens
tggtctggaaacag

SEQ ID NO: 5326174 - DNA, 16 bp, Homo sapiens
tggtctggactgacag

SEQ ID NO: 5326175 - DNA, 19 bp, Homo sapiens
tggtctggagtcccacccg

SEQ ID NO: 5326176 - DNA, 18 bp, Homo sapiens
tggtctggatggtagaat

SEQ ID NO: 5326177 - DNA, 17 bp, Homo sapiens
tggtctggctttaagaa

SEQ ID NO: 5326178 - DNA, 16 bp, Homo sapiens
tggtctgggacttcct

SEQ ID NO: 5326179 - DNA, 17 bp, Homo sapiens
tggtctgggacttcctt

SEQ ID NO: 5326180 - DNA, 22 bp, Homo sapiens
tggtctgggtgtagctcttaga

SEQ ID NO: 5326181 - DNA, 16 bp, Homo sapiens
tggtctggtcaggcaa

SEQ ID NO: 5326182 - DNA, 16 bp, Homo sapiens
tggtctggttgggcag

SEQ ID NO: 5326183 - DNA, 17 bp, Homo sapiens
tggtctggttgggcagc

SEQ ID NO: 5326184 - DNA, 12 bp, Homo sapiens
tggtctgtactc

SEQ ID NO: 5326185 - DNA, 14 bp, Homo sapiens
tggtctgtctggat

SEQ ID NO: 5326186 - DNA, 16 bp, Homo sapiens
tggtctgtgcattgtg

SEQ ID NO: 5326187 - DNA, 21 bp, Homo sapiens
tggtctgtgtaacatccaagc

SEQ ID NO: 5326188 - DNA, 11 bp, Homo sapiens
tggtctgtgtg

SEQ ID NO: 5326189 - DNA, 18 bp, Homo sapiens
tggtctgtgtgtgacacc

SEQ ID NO: 5326190 - DNA, 22 bp, Homo sapiens
tggtctgtgtgtgacaccacca

SEQ ID NO: 5326191 - DNA, 18 bp, Homo sapiens
tggtctgtgtgtgttctt

SEQ ID NO: 5326192 - DNA, 21 bp, Homo sapiens
tggtctgtgtgtgttcttcaa

SEQ ID NO: 5326193 - DNA, 22 bp, Homo sapiens
tggtctgtgttctcaacacaca

SEQ ID NO: 5326194 - DNA, 15 bp, Homo sapiens
tggtctgttaatctt

SEQ ID NO: 5326195 - DNA, 21 bp, Homo sapiens
tggtctgttttggtcccctcc

SEQ ID NO: 5326196 - DNA, 16 bp, Homo sapiens
tggtcttaagaaatgt

SEQ ID NO: 5326197 - DNA, 15 bp, Homo sapiens
tggtcttactttgtt

SEQ ID NO: 5326198 - DNA, 19 bp, Homo sapiens
tggtcttagctttacattt

SEQ ID NO: 5326199 - DNA, 15 bp, Homo sapiens
tggtcttaggtcttc

SEQ ID NO: 5326200 - DNA, 20 bp, Homo sapiens
tggtcttaggtcttcctgtg

SEQ ID NO: 5326201 - DNA, 18 bp, Homo sapiens
tggtcttcaagcctggcc

SEQ ID NO: 5326202 - DNA, 14 bp, Homo sapiens
tggtcttcactgcc

SEQ ID NO: 5326203 - DNA, 20 bp, Homo sapiens
tggtcttccttacctggaaa

SEQ ID NO: 5326204 - DNA, 19 bp, Homo sapiens
tggtcttctactgccttga

SEQ ID NO: 5326205 - DNA, 16 bp, Homo sapiens
tggtcttgaactcctg

SEQ ID NO: 5326206 - DNA, 18 bp, Homo sapiens
tggtcttgaactcctgac

SEQ ID NO: 5326207 - DNA, 15 bp, Homo sapiens
tggtcttgagccagt

SEQ ID NO: 5326208 - DNA, 17 bp, Homo sapiens
tggtcttgatcctccaa

SEQ ID NO: 5326209 - DNA, 21 bp, Homo sapiens
tggtcttgatctcctgagctc

SEQ ID NO: 5326210 - DNA, 11 bp, Homo sapiens
tggtcttggaa

SEQ ID NO: 5326211 - DNA, 14 bp, Homo sapiens
tggtcttggagagg

SEQ ID NO: 5326212 - DNA, 17 bp, Homo sapiens
tggtcttggagaggagg

SEQ ID NO: 5326213 - DNA, 18 bp, Homo sapiens
tggtcttggagaggaggt

SEQ ID NO: 5326214 - DNA, 18 bp, Homo sapiens
tggtcttggtcatttgcc

SEQ ID NO: 5326215 - DNA, 19 bp, Homo sapiens
tggtcttggtcatttgcca

SEQ ID NO: 5326216 - DNA, 14 bp, Homo sapiens
tggtcttgtaagag

SEQ ID NO: 5326217 - DNA, 21 bp, Homo sapiens
tggtcttgtaagagctataca

SEQ ID NO: 5326218 - DNA, 14 bp, Homo sapiens
tggtcttgtttcca

SEQ ID NO: 5326219 - DNA, 14 bp, Homo sapiens
tggtctttctggag

SEQ ID NO: 5326220 - DNA, 20 bp, Homo sapiens
tggtctttgaaagaaatgta

SEQ ID NO: 5326221 - DNA, 16 bp, Homo sapiens
tggtctttgaataaag

SEQ ID NO: 5326222 - DNA, 19 bp, Homo sapiens
tggtctttgaataaagtct

SEQ ID NO: 5326223 - DNA, 23 bp, Homo sapiens
tggtctttgaataaagtctgagt

SEQ ID NO: 5326224 - DNA, 13 bp, Homo sapiens
tggtctttgctcc

SEQ ID NO: 5326225 - DNA, 14 bp, Homo sapiens
tggtctttgtaaga

SEQ ID NO: 5326226 - DNA, 22 bp, Homo sapiens
tggtctttgtaagagtgtagaa

SEQ ID NO: 5326227 - DNA, 15 bp, Homo sapiens
tggtctttgtttgag

SEQ ID NO: 5326228 - DNA, 21 bp, Homo sapiens
tggtctttgtttgaggcctga

SEQ ID NO: 5326229 - DNA, 19 bp, Homo sapiens
tggtcttttcctcgcttct

SEQ ID NO: 5326230 - DNA, 13 bp, Homo sapiens
tggtcttttctcc

SEQ ID NO: 5326231 - DNA, 14 bp, Homo sapiens
tggtctttttcctg

SEQ ID NO: 5326232 - DNA, 16 bp, Homo sapiens
tggtctttttcctgaa

SEQ ID NO: 5326233 - DNA, 21 bp, Homo sapiens
tggtctttttctaccttgttg

SEQ ID NO: 5326234 - DNA, 23 bp, Homo sapiens
tggtgaaaacgtcttccttcttt

SEQ ID NO: 5326235 - DNA, 15 bp, Homo sapiens
tggtgaaaatgtact

SEQ ID NO: 5326236 - DNA, 12 bp, Homo sapiens
tggtgaaagagt

SEQ ID NO: 5326237 - DNA, 21 bp, Homo sapiens
tggtgaaagagtaaaaccaaa

SEQ ID NO: 5326238 - DNA, 18 bp, Homo sapiens
tggtgaaagggtttgata

SEQ ID NO: 5326239 - DNA, 17 bp, Homo sapiens
tggtgaaataataaaat

SEQ ID NO: 5326240 - DNA, 18 bp, Homo sapiens
tggtgaaataataaaatg

SEQ ID NO: 5326241 - DNA, 20 bp, Homo sapiens
tggtgaaataataaaatgca

SEQ ID NO: 5326242 - DNA, 17 bp, Homo sapiens
tggtgaaatctgctctg

SEQ ID NO: 5326243 - DNA, 19 bp, Homo sapiens
tggtgaaattataactatt

SEQ ID NO: 5326244 - DNA, 22 bp, Homo sapiens
tggtgaaattataactattaca

SEQ ID NO: 5326245 - DNA, 19 bp, Homo sapiens
tggtgaaattgactgatga

SEQ ID NO: 5326246 - DNA, 15 bp, Homo sapiens
tggtgaacacacacg

SEQ ID NO: 5326247 - DNA, 14 bp, Homo sapiens
tggtgaacactgtg

SEQ ID NO: 5326248 - DNA, 15 bp, Homo sapiens
tggtgaacactgtga

SEQ ID NO: 5326249 - DNA, 18 bp, Homo sapiens
tggtgaacagagagaacc

SEQ ID NO: 5326250 - DNA, 21 bp, Homo sapiens
tggtgaactgaagcagagtca

SEQ ID NO: 5326251 - DNA, 13 bp, Homo sapiens
tggtgaaggggct

SEQ ID NO: 5326252 - DNA, 15 bp, Homo sapiens
tggtgaaggggctgg

SEQ ID NO: 5326253 - DNA, 20 bp, Homo sapiens
tggtgaagtaaattaggcag

SEQ ID NO: 5326254 - DNA, 14 bp, Homo sapiens
tggtgaagtgaaaa

SEQ ID NO: 5326255 - DNA, 14 bp, Homo sapiens
tggtgaagtgtggc

SEQ ID NO: 5326256 - DNA, 17 bp, Homo sapiens
tggtgaatggccttcct

SEQ ID NO: 5326257 - DNA, 19 bp, Homo sapiens
tggtgaatgtgtgagaaaa

SEQ ID NO: 5326258 - DNA, 11 bp, Homo sapiens
tggtgaattat

SEQ ID NO: 5326259 - DNA, 20 bp, Homo sapiens
tggtgaattttcaaggcctt

SEQ ID NO: 5326260 - DNA, 13 bp, Homo sapiens
tggtgaattttcc

SEQ ID NO: 5326261 - DNA, 16 bp, Homo sapiens
tggtgacaaaattcat

SEQ ID NO: 5326262 - DNA, 17 bp, Homo sapiens
tggtgacaaaattcatt

SEQ ID NO: 5326263 - DNA, 20 bp, Homo sapiens
tggtgacaaaattcatttgc

SEQ ID NO: 5326264 - DNA, 13 bp, Homo sapiens
tggtgacacacag

SEQ ID NO: 5326265 - DNA, 17 bp, Homo sapiens
tggtgacacacagcagc

SEQ ID NO: 5326266 - DNA, 18 bp, Homo sapiens
tggtgacaccagcctttc

SEQ ID NO: 5326267 - DNA, 18 bp, Homo sapiens
tggtgacacctccccctt

SEQ ID NO: 5326268 - DNA, 16 bp, Homo sapiens
tggtgacagctgcaag

SEQ ID NO: 5326269 - DNA, 18 bp, Homo sapiens
tggtgacagctgcaagcc

SEQ ID NO: 5326270 - DNA, 19 bp, Homo sapiens
tggtgacaggccaaaggcc

SEQ ID NO: 5326271 - DNA, 22 bp, Homo sapiens
tggtgacatcaggtttttcccg

SEQ ID NO: 5326272 - DNA, 18 bp, Homo sapiens
tggtgacatgtgcctgta

SEQ ID NO: 5326273 - DNA, 16 bp, Homo sapiens
tggtgaccaccccctg

SEQ ID NO: 5326274 - DNA, 12 bp, Homo sapiens
tggtgaccagac

SEQ ID NO: 5326275 - DNA, 16 bp, Homo sapiens
tggtgaccagaccaag

SEQ ID NO: 5326276 - DNA, 19 bp, Homo sapiens
tggtgaccagtttcttaaa

SEQ ID NO: 5326277 - DNA, 22 bp, Homo sapiens
tggtgaccatctgtttgagaat

SEQ ID NO: 5326278 - DNA, 19 bp, Homo sapiens
tggtgaccccatacatttg

SEQ ID NO: 5326279 - DNA, 18 bp, Homo sapiens
tggtgacctcacacacct

SEQ ID NO: 5326280 - DNA, 23 bp, Homo sapiens
tggtgacctcacacacctctgcc

SEQ ID NO: 5326281 - DNA, 14 bp, Homo sapiens
tggtgacctcctgt

SEQ ID NO: 5326282 - DNA, 18 bp, Homo sapiens
tggtgacctcctgtcact

SEQ ID NO: 5326283 - DNA, 13 bp, Homo sapiens
tggtgacctctgc

SEQ ID NO: 5326284 - DNA, 15 bp, Homo sapiens
tggtgacctctgcct

SEQ ID NO: 5326285 - DNA, 22 bp, Homo sapiens
tggtgacgatgggtgttgctgt

SEQ ID NO: 5326286 - DNA, 21 bp, Homo sapiens
tggtgactcacttcaatgtgt

SEQ ID NO: 5326287 - DNA, 20 bp, Homo sapiens
tggtgactcgggggctgtct

SEQ ID NO: 5326288 - DNA, 19 bp, Homo sapiens
tggtgactgtcccaccggg

SEQ ID NO: 5326289 - DNA, 17 bp, Homo sapiens
tggtgacttgtctgcct

SEQ ID NO: 5326290 - DNA, 18 bp, Homo sapiens
tggtgacttgtctgcctc

SEQ ID NO: 5326291 - DNA, 16 bp, Homo sapiens
tggtgactttgcttca

SEQ ID NO: 5326292 - DNA, 16 bp, Homo sapiens
tggtgactttggataa

SEQ ID NO: 5326293 - DNA, 19 bp, Homo sapiens
tggtgactttggataataa

SEQ ID NO: 5326294 - DNA, 17 bp, Homo sapiens
tggtgactttggggaca

SEQ ID NO: 5326295 - DNA, 17 bp, Homo sapiens
tggtgacttttgaagaa

SEQ ID NO: 5326296 - DNA, 15 bp, Homo sapiens
tggtgagaaaatata

SEQ ID NO: 5326297 - DNA, 14 bp, Homo sapiens
tggtgagaaacctg

SEQ ID NO: 5326298 - DNA, 14 bp, Homo sapiens
tggtgagaattaaa

SEQ ID NO: 5326299 - DNA, 17 bp, Homo sapiens
tggtgagaattaaaata

SEQ ID NO: 5326300 - DNA, 22 bp, Homo sapiens
tggtgagaattaaaataaaacg

SEQ ID NO: 5326301 - DNA, 22 bp, Homo sapiens
tggtgagaccccgcactgcaga

SEQ ID NO: 5326302 - DNA, 23 bp, Homo sapiens
tggtgagaccccgcactgcagac

SEQ ID NO: 5326303 - DNA, 16 bp, Homo sapiens
tggtgagagaagaaaa

SEQ ID NO: 5326304 - DNA, 16 bp, Homo sapiens
tggtgagatgcagctg

SEQ ID NO: 5326305 - DNA, 20 bp, Homo sapiens
tggtgagatgcagctggaaa

SEQ ID NO: 5326306 - DNA, 19 bp, Homo sapiens
tggtgagcaagcaccaacc

SEQ ID NO: 5326307 - DNA, 17 bp, Homo sapiens
tggtgagcagagcggga

SEQ ID NO: 5326308 - DNA, 18 bp, Homo sapiens
tggtgagcatacagagtg

SEQ ID NO: 5326309 - DNA, 12 bp, Homo sapiens
tggtgagcatta

SEQ ID NO: 5326310 - DNA, 18 bp, Homo sapiens
tggtgagccggtcaggca

SEQ ID NO: 5326311 - DNA, 19 bp, Homo sapiens
tggtgagcctagccctggg

SEQ ID NO: 5326312 - DNA, 13 bp, Homo sapiens
tggtgagctggga

SEQ ID NO: 5326313 - DNA, 21 bp, Homo sapiens
tggtgagctgggaagctgtac

SEQ ID NO: 5326314 - DNA, 16 bp, Homo sapiens
tggtgaggaagctcca

SEQ ID NO: 5326315 - DNA, 22 bp, Homo sapiens
tggtgaggacctgcggccttgg

SEQ ID NO: 5326316 - DNA, 14 bp, Homo sapiens
tggtgaggaggagg

SEQ ID NO: 5326317 - DNA, 23 bp, Homo sapiens
tggtgaggcccagcctgtcctgg

SEQ ID NO: 5326318 - DNA, 16 bp, Homo sapiens
tggtgaggccggccct

SEQ ID NO: 5326319 - DNA, 19 bp, Homo sapiens
tggtgaggcttaacaatgt

SEQ ID NO: 5326320 - DNA, 15 bp, Homo sapiens
tggtgagggagcctc

SEQ ID NO: 5326321 - DNA, 19 bp, Homo sapiens
tggtgagggcagttctgca

SEQ ID NO: 5326322 - DNA, 20 bp, Homo sapiens
tggtgagggcagttctgcac

SEQ ID NO: 5326323 - DNA, 21 bp, Homo sapiens
tggtgagggctgagagggctg

SEQ ID NO: 5326324 - DNA, 19 bp, Homo sapiens
tggtgaggggccactgggc

SEQ ID NO: 5326325 - DNA, 20 bp, Homo sapiens
tggtgaggggctttctcttc

SEQ ID NO: 5326326 - DNA, 21 bp, Homo sapiens
tggtgagggtcctcttcctca

SEQ ID NO: 5326327 - DNA, 12 bp, Homo sapiens
tggtgaggtggc

SEQ ID NO: 5326328 - DNA, 17 bp, Homo sapiens
tggtgaggtggcccagg

SEQ ID NO: 5326329 - DNA, 14 bp, Homo sapiens
tggtgaggtgtgga

SEQ ID NO: 5326330 - DNA, 17 bp, Homo sapiens
tggtgaggttgggcagc

SEQ ID NO: 5326331 - DNA, 19 bp, Homo sapiens
tggtgaggttgtgctgcct

SEQ ID NO: 5326332 - DNA, 17 bp, Homo sapiens
tggtgagtctgtgtggc

SEQ ID NO: 5326333 - DNA, 17 bp, Homo sapiens
tggtgataagtggaaaa

SEQ ID NO: 5326334 - DNA, 18 bp, Homo sapiens
tggtgatactgtcaagcc

SEQ ID NO: 5326335 - DNA, 18 bp, Homo sapiens
tggtgatataaagaatga

SEQ ID NO: 5326336 - DNA, 15 bp, Homo sapiens
tggtgatatagaatt

SEQ ID NO: 5326337 - DNA, 17 bp, Homo sapiens
tggtgatcctctatttt

SEQ ID NO: 5326338 - DNA, 20 bp, Homo sapiens
tggtgttctggcctctggcc

SEQ ID NO: 5326339 - DNA, 14 bp, Homo sapiens
tggtgttgactgga

SEQ ID NO: 5326340 - DNA, 14 bp, Homo sapiens
tggtgttgcagccg

SEQ ID NO: 5326341 - DNA, 20 bp, Homo sapiens
tggtgttgccagttgtcctc

SEQ ID NO: 5326342 - DNA, 17 bp, Homo sapiens
tggtgttggaggggcag

SEQ ID NO: 5326343 - DNA, 18 bp, Homo sapiens
tggtgttggcagtgtttg

SEQ ID NO: 5326344 - DNA, 17 bp, Homo sapiens
tggtgttgtatacttca

SEQ ID NO: 5326345 - DNA, 16 bp, Homo sapiens
tggtgttgtatgcctt

SEQ ID NO: 5326346 - DNA, 21 bp, Homo sapiens
tggtgttgtcacaaactgtgg

SEQ ID NO: 5326347 - DNA, 19 bp, Homo sapiens
tggtgttgttatggcaagt

SEQ ID NO: 5326348 - DNA, 22 bp, Homo sapiens
tggtgtttatgtgaacattcct

SEQ ID NO: 5326349 - DNA, 21 bp, Homo sapiens
tggtgtttattataaagctta

SEQ ID NO: 5326350 - DNA, 18 bp, Homo sapiens
tggtgtttgactgtaatg

SEQ ID NO: 5326351 - DNA, 13 bp, Homo sapiens
tggtgtttgtcat

SEQ ID NO: 5326352 - DNA, 15 bp, Homo sapiens
tggtgtttgtctgtg

SEQ ID NO: 5326353 - DNA, 17 bp, Homo sapiens
tggtgttttataggtca

SEQ ID NO: 5326354 - DNA, 17 bp, Homo sapiens
tggtgttttatttccta

SEQ ID NO: 5326355 - DNA, 20 bp, Homo sapiens
tggtgttttcttatgcagga

SEQ ID NO: 5326356 - DNA, 18 bp, Homo sapiens
tggtgttttggatttgga

SEQ ID NO: 5326357 - DNA, 13 bp, Homo sapiens
tggtgttttgtca

SEQ ID NO: 5326358 - DNA, 17 bp, Homo sapiens
tggtgtttttcccccgc

SEQ ID NO: 5326359 - DNA, 17 bp, Homo sapiens
tggtgtttttctctctg

SEQ ID NO: 5326360 - DNA, 19 bp, Homo sapiens
tggtgtttttctctctgga

SEQ ID NO: 5326361 - DNA, 18 bp, Homo sapiens
tggtgttttttgttactg

SEQ ID NO: 5326362 - DNA, 22 bp, Homo sapiens
tggtgttttttgttactgtttt

SEQ ID NO: 5326363 - DNA, 16 bp, Homo sapiens
tggttaaaaaggccaa

SEQ ID NO: 5326364 - DNA, 18 bp, Homo sapiens
tggttaaaagggaacaca

SEQ ID NO: 5326365 - DNA, 19 bp, Homo sapiens
tggttaaaagggaacacaa

SEQ ID NO: 5326366 - DNA, 17 bp, Homo sapiens
tggttaaacattaatat

SEQ ID NO: 5326367 - DNA, 16 bp, Homo sapiens
tggttaaattaacatt

SEQ ID NO: 5326368 - DNA, 21 bp, Homo sapiens
tggttaacaataaagtgacaa

SEQ ID NO: 5326369 - DNA, 23 bp, Homo sapiens
tggttaacaataaagtgacaaaa

SEQ ID NO: 5326370 - DNA, 18 bp, Homo sapiens
tggttaaccctctcttga

SEQ ID NO: 5326371 - DNA, 23 bp, Homo sapiens
tggttaaccgggactacagaagt

SEQ ID NO: 5326372 - DNA, 12 bp, Homo sapiens
tggttaacttaa

SEQ ID NO: 5326373 - DNA, 18 bp, Homo sapiens
tggttaagagaatgaatt

SEQ ID NO: 5326374 - DNA, 14 bp, Homo sapiens
tggttaagagtcca

SEQ ID NO: 5326375 - DNA, 17 bp, Homo sapiens
tggttaagagtccaaga

SEQ ID NO: 5326376 - DNA, 21 bp, Homo sapiens
tggttaagcaggcattgcttt

SEQ ID NO: 5326377 - DNA, 21 bp, Homo sapiens
tggttaaggccagggcctctc

SEQ ID NO: 5326378 - DNA, 20 bp, Homo sapiens
tggttaagggacttgtccca

SEQ ID NO: 5326379 - DNA, 15 bp, Homo sapiens
tggttaagtctgttt

SEQ ID NO: 5326380 - DNA, 21 bp, Homo sapiens
tggttaagttttcttgtttct

SEQ ID NO: 5326381 - DNA, 23 bp, Homo sapiens
tggttaagttttcttgtttctgc

SEQ ID NO: 5326382 - DNA, 13 bp, Homo sapiens
tggttaataaaac

SEQ ID NO: 5326383 - DNA, 15 bp, Homo sapiens
tggttaatcagtgtt

SEQ ID NO: 5326384 - DNA, 19 bp, Homo sapiens
tggttaatgaaaaatctga

SEQ ID NO: 5326385 - DNA, 13 bp, Homo sapiens
tggttaatgccat

SEQ ID NO: 5326386 - DNA, 16 bp, Homo sapiens
tggttaatggcagcat

SEQ ID NO: 5326387 - DNA, 12 bp, Homo sapiens
tggttaattttt

SEQ ID NO: 5326388 - DNA, 20 bp, Homo sapiens
tggttaatttttcctgcatg

SEQ ID NO: 5326389 - DNA, 22 bp, Homo sapiens
tggttacactgttagaacacta

SEQ ID NO: 5326390 - DNA, 13 bp, Homo sapiens
tggttacatatca

SEQ ID NO: 5326391 - DNA, 21 bp, Homo sapiens
tggttacatggaaaagttctt

SEQ ID NO: 5326392 - DNA, 16 bp, Homo sapiens
tggttaccactctttt

SEQ ID NO: 5326393 - DNA, 23 bp, Homo sapiens
tggttaccactcttttgctgtgc

SEQ ID NO: 5326394 - DNA, 20 bp, Homo sapiens
tggttacctgacctaaatta

SEQ ID NO: 5326395 - DNA, 14 bp, Homo sapiens
tggttacctggaga

SEQ ID NO: 5326396 - DNA, 17 bp, Homo sapiens
tggttacctgttccatt

SEQ ID NO: 5326397 - DNA, 20 bp, Homo sapiens
tggttactaaaaagtaccag

SEQ ID NO: 5326398 - DNA, 20 bp, Homo sapiens
tggttactggtgatgttgaa

SEQ ID NO: 5326399 - DNA, 18 bp, Homo sapiens
tggttacttcttctctta

SEQ ID NO: 5326400 - DNA, 13 bp, Homo sapiens
tggttagaaaaca

SEQ ID NO: 5326401 - DNA, 13 bp, Homo sapiens
tggttagaaaagt

SEQ ID NO: 5326402 - DNA, 14 bp, Homo sapiens
tggttagaagaaaa

SEQ ID NO: 5326403 - DNA, 19 bp, Homo sapiens
tggttagagaagtaagcag

SEQ ID NO: 5326404 - DNA, 21 bp, Homo sapiens
tggttagagaagtaagcagag

SEQ ID NO: 5326405 - DNA, 17 bp, Homo sapiens
tggttagctcacaggac

SEQ ID NO: 5326406 - DNA, 16 bp, Homo sapiens
tggttagctcagcccc

SEQ ID NO: 5326407 - DNA, 19 bp, Homo sapiens
tggttagctcagccccagc

SEQ ID NO: 5326408 - DNA, 20 bp, Homo sapiens
tggttagctcagccccagcc

SEQ ID NO: 5326409 - DNA, 22 bp, Homo sapiens
tggttaggatggcaggacgtgg

SEQ ID NO: 5326410 - DNA, 17 bp, Homo sapiens
tggttagtatttaacta

SEQ ID NO: 5326411 - DNA, 16 bp, Homo sapiens
tggttagtgatgcagt

SEQ ID NO: 5326412 - DNA, 14 bp, Homo sapiens
tggttagtgcatgt

SEQ ID NO: 5326413 - DNA, 15 bp, Homo sapiens
tggttagtgcatgtc

SEQ ID NO: 5326414 - DNA, 22 bp, Homo sapiens
tggttagtggggtaattctgct

SEQ ID NO: 5326415 - DNA, 15 bp, Homo sapiens
tggttagtgtggagg

SEQ ID NO: 5326416 - DNA, 17 bp, Homo sapiens
tggttagttaactgaat

SEQ ID NO: 5326417 - DNA, 16 bp, Homo sapiens
tggttataacttaatg

SEQ ID NO: 5326418 - DNA, 18 bp, Homo sapiens
tggttatacaagttcttg

SEQ ID NO: 5326419 - DNA, 19 bp, Homo sapiens
tggttatacatgacactga

SEQ ID NO: 5326420 - DNA, 18 bp, Homo sapiens
tggttatagtgcaatata

SEQ ID NO: 5326421 - DNA, 22 bp, Homo sapiens
tggttatagtgcaatatatttt

SEQ ID NO: 5326422 - DNA, 13 bp, Homo sapiens
tggttatcacttt

SEQ ID NO: 5326423 - DNA, 17 bp, Homo sapiens
tggttatcactttaagt

SEQ ID NO: 5326424 - DNA, 18 bp, Homo sapiens
tggttatcctgtgctaca

SEQ ID NO: 5326425 - DNA, 14 bp, Homo sapiens
tggttatcttgtta

SEQ ID NO: 5326426 - DNA, 17 bp, Homo sapiens
tggttatgaatactttg

SEQ ID NO: 5326427 - DNA, 14 bp, Homo sapiens
tggttatgtcccat

SEQ ID NO: 5326428 - DNA, 19 bp, Homo sapiens
tggttatgtcccatgacct

SEQ ID NO: 5326429 - DNA, 17 bp, Homo sapiens
tggttatgttgataaac

SEQ ID NO: 5326430 - DNA, 21 bp, Homo sapiens
tggttattagacaattccatt

SEQ ID NO: 5326431 - DNA, 18 bp, Homo sapiens
tggttattggactccagg

SEQ ID NO: 5326432 - DNA, 18 bp, Homo sapiens
tggttatttaatcacagt

SEQ ID NO: 5326433 - DNA, 13 bp, Homo sapiens
tggttatttctaa

SEQ ID NO: 5326434 - DNA, 14 bp, Homo sapiens
tggttatttctaaa

SEQ ID NO: 5326435 - DNA, 16 bp, Homo sapiens
tggttatttctaaacc

SEQ ID NO: 5326436 - DNA, 15 bp, Homo sapiens
tggttatttctctga

SEQ ID NO: 5326437 - DNA, 20 bp, Homo sapiens
tggttatttggtattaaact

SEQ ID NO: 5326438 - DNA, 22 bp, Homo sapiens
tggttattttaaatataaatag

SEQ ID NO: 5326439 - DNA, 15 bp, Homo sapiens
tggttattttacttt

SEQ ID NO: 5326440 - DNA, 17 bp, Homo sapiens
tggttatttttatacag

SEQ ID NO: 5326441 - DNA, 18 bp, Homo sapiens
tggttatttttatacagt

SEQ ID NO: 5326442 - DNA, 19 bp, Homo sapiens
tggttcaatcaacagaatt

SEQ ID NO: 5326443 - DNA, 21 bp, Homo sapiens
tggttcactcttggagcctgc

SEQ ID NO: 5326444 - DNA, 16 bp, Homo sapiens
tggttcactgcactgt

SEQ ID NO: 5326445 - DNA, 17 bp, Homo sapiens
tggttcagaataaattg

SEQ ID NO: 5326446 - DNA, 18 bp, Homo sapiens
tggttcagacaagacaga

SEQ ID NO: 5326447 - DNA, 22 bp, Homo sapiens
tggttcagacacagctcttcca

SEQ ID NO: 5326448 - DNA, 16 bp, Homo sapiens
tggttcagctactttc

SEQ ID NO: 5326449 - DNA, 23 bp, Homo sapiens
tggttcagggttggcccctgccc

SEQ ID NO: 5326450 - DNA, 18 bp, Homo sapiens
tggttcatcagtgttaaa

SEQ ID NO: 5326451 - DNA, 23 bp, Homo sapiens
tggttcatcagtgttaaaaaatt

SEQ ID NO: 5326452 - DNA, 23 bp, Homo sapiens
tggttcatccatcatctgctgca

SEQ ID NO: 5326453 - DNA, 16 bp, Homo sapiens
tggttcatgcagacaa

SEQ ID NO: 5326454 - DNA, 14 bp, Homo sapiens
tggttccaagaaag

SEQ ID NO: 5326455 - DNA, 16 bp, Homo sapiens
tggttccaagccctgg

SEQ ID NO: 5326456 - DNA, 22 bp, Homo sapiens
tggttccacaatcatctattga

SEQ ID NO: 5326457 - DNA, 15 bp, Homo sapiens
tggttccagcctgcc

SEQ ID NO: 5326458 - DNA, 22 bp, Homo sapiens
tggttccagggtccctctgtgt

SEQ ID NO: 5326459 - DNA, 13 bp, Homo sapiens
tggttccatgcct

SEQ ID NO: 5326460 - DNA, 19 bp, Homo sapiens
tggttccatgcctgagggt

SEQ ID NO: 5326461 - DNA, 22 bp, Homo sapiens
tggttccatgcctgagggtgga

SEQ ID NO: 5326462 - DNA, 19 bp, Homo sapiens
tggttcccaataaaagtga

SEQ ID NO: 5326463 - DNA, 16 bp, Homo sapiens
tggttcccattgtgac

SEQ ID NO: 5326464 - DNA, 16 bp, Homo sapiens
tggttccccagtagag

SEQ ID NO: 5326465 - DNA, 21 bp, Homo sapiens
tggttcccccaggaccctgag

SEQ ID NO: 5326466 - DNA, 18 bp, Homo sapiens
tggttcccctgttcactc

SEQ ID NO: 5326467 - DNA, 18 bp, Homo sapiens
tggttcccgtttctccac

SEQ ID NO: 5326468 - DNA, 20 bp, Homo sapiens
tggttcccgtttctccacct

SEQ ID NO: 5326469 - DNA, 24 bp, Homo sapiens
tggttccctctttcctgtgccagg

SEQ ID NO: 5326470 - DNA, 16 bp, Homo sapiens
tggttcctaagggaaa

SEQ ID NO: 5326471 - DNA, 21 bp, Homo sapiens
tggttcctaggggaatgaggg

SEQ ID NO: 5326472 - DNA, 13 bp, Homo sapiens
tggttcctccagc

SEQ ID NO: 5326473 - DNA, 12 bp, Homo sapiens
tggttcctgccc

SEQ ID NO: 5326474 - DNA, 13 bp, Homo sapiens
tggttcctgcccc

SEQ ID NO: 5326475 - DNA, 15 bp, Homo sapiens
tggttcctgctgtcc

SEQ ID NO: 5326476 - DNA, 19 bp, Homo sapiens
tggttcctgctgtcctggt

SEQ ID NO: 5326477 - DNA, 12 bp, Homo sapiens
tggttcctgggg

SEQ ID NO: 5326478 - DNA, 22 bp, Homo sapiens
tggttcctgtgtgaccctgggc

SEQ ID NO: 5326479 - DNA, 14 bp, Homo sapiens
tggttcctgtttga

SEQ ID NO: 5326480 - DNA, 22 bp, Homo sapiens
tggttcctgtttgaaactaaaa

SEQ ID NO: 5326481 - DNA, 13 bp, Homo sapiens
tggttccttctct

SEQ ID NO: 5326482 - DNA, 16 bp, Homo sapiens
tggttcctttcatctc

SEQ ID NO: 5326483 - DNA, 21 bp, Homo sapiens
tggttcctttgcaccctgtag

SEQ ID NO: 5326484 - DNA, 18 bp, Homo sapiens
tggttcgatacctggagc

SEQ ID NO: 5326485 - DNA, 17 bp, Homo sapiens
tggttcgggggaaatag

SEQ ID NO: 5326486 - DNA, 11 bp, Homo sapiens
tggttctaact

SEQ ID NO: 5326487 - DNA, 14 bp, Homo sapiens
tggttctacaaatt

SEQ ID NO: 5326488 - DNA, 14 bp, Homo sapiens
tggttctaggctgc

SEQ ID NO: 5326489 - DNA, 16 bp, Homo sapiens
tggttctatttaatgg

SEQ ID NO: 5326490 - DNA, 15 bp, Homo sapiens
tggttctcaatgaaa

SEQ ID NO: 5326491 - DNA, 23 bp, Homo sapiens
tggttctcaattccaacagttta

SEQ ID NO: 5326492 - DNA, 11 bp, Homo sapiens
tggttctcatc

SEQ ID NO: 5326493 - DNA, 14 bp, Homo sapiens
tggttctcatcttt

SEQ ID NO: 5326494 - DNA, 19 bp, Homo sapiens
tggttctccttcctcagcc

SEQ ID NO: 5326495 - DNA, 16 bp, Homo sapiens
tggttctcttcatcca

SEQ ID NO: 5326496 - DNA, 14 bp, Homo sapiens
tggttctgaggcca

SEQ ID NO: 5326497 - DNA, 16 bp, Homo sapiens
tggttctgcctcctgg

SEQ ID NO: 5326498 - DNA, 20 bp, Homo sapiens
tggttctgctgcctctacac

SEQ ID NO: 5326499 - DNA, 13 bp, Homo sapiens
tggttctgtgacc

SEQ ID NO: 5326500 - DNA, 19 bp, Homo sapiens
tggttctgtgacccatctg

SEQ ID NO: 5326501 - DNA, 13 bp, Homo sapiens
tggttctgtgcca

SEQ ID NO: 5326502 - DNA, 19 bp, Homo sapiens
tggttcttcctttccctgg

SEQ ID NO: 5326503 - DNA, 21 bp, Homo sapiens
tggttcttcctttccctggag

SEQ ID NO: 5326504 - DNA, 13 bp, Homo sapiens
tggttcttgaaaa

SEQ ID NO: 5326505 - DNA, 21 bp, Homo sapiens
tggttcttgaggggaccagga

SEQ ID NO: 5326506 - DNA, 18 bp, Homo sapiens
tggttcttgggtggtttt

SEQ ID NO: 5326507 - DNA, 21 bp, Homo sapiens
tggttcttggtagagattcat

SEQ ID NO: 5326508 - DNA, 15 bp, Homo sapiens
tggttctttatcatt

SEQ ID NO: 5326509 - DNA, 17 bp, Homo sapiens
tggttctttcttttctt

SEQ ID NO: 5326510 - DNA, 14 bp, Homo sapiens
tggttcttttttca

SEQ ID NO: 5326511 - DNA, 16 bp, Homo sapiens
tggttgaaaataaaaa

SEQ ID NO: 5326512 - DNA, 18 bp, Homo sapiens
tggttgaataaactagat

SEQ ID NO: 5326513 - DNA, 12 bp, Homo sapiens
tggttgaggaaa

SEQ ID NO: 5326514 - DNA, 18 bp, Homo sapiens
tggttgaggggcctggag

SEQ ID NO: 5326515 - DNA, 19 bp, Homo sapiens
tggttgagtgcaaatccat

SEQ ID NO: 5326516 - DNA, 18 bp, Homo sapiens
tggttgatgccaaaaaaa

SEQ ID NO: 5326517 - DNA, 16 bp, Homo sapiens
tggttgatggaaaata

SEQ ID NO: 5326518 - DNA, 23 bp, Homo sapiens
tggttgattggggtttgatttgc

SEQ ID NO: 5326519 - DNA, 12 bp, Homo sapiens
tggttgatttgt

SEQ ID NO: 5326520 - DNA, 17 bp, Homo sapiens
tggttgcacgttaaaaa

SEQ ID NO: 5326521 - DNA, 16 bp, Homo sapiens
tggttgcagtctttcc

SEQ ID NO: 5326522 - DNA, 17 bp, Homo sapiens
tggttgcagtctttccc

SEQ ID NO: 5326523 - DNA, 22 bp, Homo sapiens
tggttgcagtctttcccccagg

SEQ ID NO: 5326524 - DNA, 15 bp, Homo sapiens
tggttgccaccccaa

SEQ ID NO: 5326525 - DNA, 19 bp, Homo sapiens
tggttgccaccccaaccca

SEQ ID NO: 5326526 - DNA, 14 bp, Homo sapiens
tggttgcctctctt

SEQ ID NO: 5326527 - DNA, 12 bp, Homo sapiens
tggttgcctggg

SEQ ID NO: 5326528 - DNA, 13 bp, Homo sapiens
tggttgcctgggg

SEQ ID NO: 5326529 - DNA, 15 bp, Homo sapiens
tggttgccttaaaag

SEQ ID NO: 5326530 - DNA, 17 bp, Homo sapiens
tggttggagagccctgg

SEQ ID NO: 5326531 - DNA, 16 bp, Homo sapiens
tggttggagagctaga

SEQ ID NO: 5326532 - DNA, 13 bp, Homo sapiens
tggttggaggccc

SEQ ID NO: 5326533 - DNA, 22 bp, Homo sapiens
tggttggaggcctggtctggag

SEQ ID NO: 5326534 - DNA, 23 bp, Homo sapiens
tggttggaggcctggtctggagc

SEQ ID NO: 5326535 - DNA, 12 bp, Homo sapiens
tggttggataag

SEQ ID NO: 5326536 - DNA, 21 bp, Homo sapiens
tggttggcatttgctggcctg

SEQ ID NO: 5326537 - DNA, 20 bp, Homo sapiens
tggttgggacaatggcaata

SEQ ID NO: 5326538 - DNA, 14 bp, Homo sapiens
tggttgggacccag

SEQ ID NO: 5326539 - DNA, 21 bp, Homo sapiens
tggttgggacccagtggcagg

SEQ ID NO: 5326540 - DNA, 15 bp, Homo sapiens
tggttgggggaatgc

SEQ ID NO: 5326541 - DNA, 13 bp, Homo sapiens
tggttggggtggg

SEQ ID NO: 5326542 - DNA, 17 bp, Homo sapiens
tggttggggtggggcag

SEQ ID NO: 5326543 - DNA, 18 bp, Homo sapiens
tggttggtgttcttccca

SEQ ID NO: 5326544 - DNA, 17 bp, Homo sapiens
tggttggttttcttctt

SEQ ID NO: 5326545 - DNA, 18 bp, Homo sapiens
tggttgtaaatgctcgtg

SEQ ID NO: 5326546 - DNA, 20 bp, Homo sapiens
tggttgtacatataagtgat

SEQ ID NO: 5326547 - DNA, 17 bp, Homo sapiens
tggttgtatataaagtt

SEQ ID NO: 5326548 - DNA, 12 bp, Homo sapiens
tggttgtattag

SEQ ID NO: 5326549 - DNA, 18 bp, Homo sapiens
tggttgtattagatgttc

SEQ ID NO: 5326550 - DNA, 11 bp, Homo sapiens
tggttgtattc

SEQ ID NO: 5326551 - DNA, 16 bp, Homo sapiens
tggttgtattctttga

SEQ ID NO: 5326552 - DNA, 17 bp, Homo sapiens
tggttgtcaatattaaa

SEQ ID NO: 5326553 - DNA, 23 bp, Homo sapiens
tggttgtcatttttgcagtagag

SEQ ID NO: 5326554 - DNA, 23 bp, Homo sapiens
tggttgtctgaacccaggcagct

SEQ ID NO: 5326555 - DNA, 14 bp, Homo sapiens
tggttgtgattttt

SEQ ID NO: 5326556 - DNA, 15 bp, Homo sapiens
tggttgtgatttttt

SEQ ID NO: 5326557 - DNA, 21 bp, Homo sapiens
tggttgtggatgggaggctcc

SEQ ID NO: 5326558 - DNA, 19 bp, Homo sapiens
tggttgtggtgtagactgt

SEQ ID NO: 5326559 - DNA, 12 bp, Homo sapiens
tggttgtgtagg

SEQ ID NO: 5326560 - DNA, 18 bp, Homo sapiens
tggttgtgtatgggtagc

SEQ ID NO: 5326561 - DNA, 14 bp, Homo sapiens
tggttgtgtctttt

SEQ ID NO: 5326562 - DNA, 21 bp, Homo sapiens
tggttgttagttatagatgtc

SEQ ID NO: 5326563 - DNA, 22 bp, Homo sapiens
tggttgttgcaccatctgcttg

SEQ ID NO: 5326564 - DNA, 15 bp, Homo sapiens
tggttgttgccaact

SEQ ID NO: 5326565 - DNA, 16 bp, Homo sapiens
tggttgttgccaggtt

SEQ ID NO: 5326566 - DNA, 17 bp, Homo sapiens
tggttgttgccaggttg

SEQ ID NO: 5326567 - DNA, 15 bp, Homo sapiens
tggttgtttctctga

SEQ ID NO: 5326568 - DNA, 15 bp, Homo sapiens
tggttgtttcttcca

SEQ ID NO: 5326569 - DNA, 20 bp, Homo sapiens
tggttgtttcttccaagact

SEQ ID NO: 5326570 - DNA, 16 bp, Homo sapiens
tggtttaaaaagtttc

SEQ ID NO: 5326571 - DNA, 15 bp, Homo sapiens
tggtttaaactttta

SEQ ID NO: 5326572 - DNA, 15 bp, Homo sapiens
tggtttaaagaaagt

SEQ ID NO: 5326573 - DNA, 17 bp, Homo sapiens
tggtttaaagaaagtgt

SEQ ID NO: 5326574 - DNA, 21 bp, Homo sapiens
tggtttaaagaaagtgtattt

SEQ ID NO: 5326575 - DNA, 22 bp, Homo sapiens
tggtttaaccattggaatggac

SEQ ID NO: 5326576 - DNA, 18 bp, Homo sapiens
tggtttaacttctgcctg

SEQ ID NO: 5326577 - DNA, 22 bp, Homo sapiens
tggtttaattaataatatgtac

SEQ ID NO: 5326578 - DNA, 15 bp, Homo sapiens
tggtttaatttaaag

SEQ ID NO: 5326579 - DNA, 15 bp, Homo sapiens
tggtttacaggccct

SEQ ID NO: 5326580 - DNA, 11 bp, Homo sapiens
tggtttacatg

SEQ ID NO: 5326581 - DNA, 13 bp, Homo sapiens
tggtttacattta

SEQ ID NO: 5326582 - DNA, 15 bp, Homo sapiens
tggtttacctgcacc

SEQ ID NO: 5326583 - DNA, 15 bp, Homo sapiens
tggtttactttcaaa

SEQ ID NO: 5326584 - DNA, 16 bp, Homo sapiens
tggtttagatccaatt

SEQ ID NO: 5326585 - DNA, 22 bp, Homo sapiens
tggtttagcgttgttttgtgga

SEQ ID NO: 5326586 - DNA, 14 bp, Homo sapiens
tggtttagtctttt

SEQ ID NO: 5326587 - DNA, 18 bp, Homo sapiens
tggtttagtgttctgtat

SEQ ID NO: 5326588 - DNA, 20 bp, Homo sapiens
tggtttagttataaaaggct

SEQ ID NO: 5326589 - DNA, 14 bp, Homo sapiens
tggtttatactgta

SEQ ID NO: 5326590 - DNA, 20 bp, Homo sapiens
tggtttatagccctgtgaag

SEQ ID NO: 5326591 - DNA, 22 bp, Homo sapiens
tggtttatatgccctcaagtaa

SEQ ID NO: 5326592 - DNA, 14 bp, Homo sapiens
tggtttatattctt

SEQ ID NO: 5326593 - DNA, 18 bp, Homo sapiens
tggtttatcagcaaaaaa

SEQ ID NO: 5326594 - DNA, 19 bp, Homo sapiens
tggtttatcagcaaaaaag

SEQ ID NO: 5326595 - DNA, 13 bp, Homo sapiens
tggtttatgtctt

SEQ ID NO: 5326596 - DNA, 18 bp, Homo sapiens
tggtttattctttgcaaa

SEQ ID NO: 5326597 - DNA, 16 bp, Homo sapiens
tggtttatttttgtaa

SEQ ID NO: 5326598 - DNA, 19 bp, Homo sapiens
tggtttatttttgtaatgt

SEQ ID NO: 5326599 - DNA, 16 bp, Homo sapiens
tggtttcaaagaaaga

SEQ ID NO: 5326600 - DNA, 16 bp, Homo sapiens
tggtttcaaagattca

SEQ ID NO: 5326601 - DNA, 11 bp, Homo sapiens
tggtttcaaat

SEQ ID NO: 5326602 - DNA, 16 bp, Homo sapiens
tggtttcactggccca

SEQ ID NO: 5326603 - DNA, 17 bp, Homo sapiens
tggtttcagatgtgcaa

SEQ ID NO: 5326604 - DNA, 13 bp, Homo sapiens
tggtttcagcaat

SEQ ID NO: 5326605 - DNA, 13 bp, Homo sapiens
tggtttcagcact

SEQ ID NO: 5326606 - DNA, 23 bp, Homo sapiens
tggtttcagcactagccaaacct

SEQ ID NO: 5326607 - DNA, 22 bp, Homo sapiens
tggtttcaggacccctgcattt

SEQ ID NO: 5326608 - DNA, 20 bp, Homo sapiens
tggtttcagttctgtgtaca

SEQ ID NO: 5326609 - DNA, 21 bp, Homo sapiens
tggtttcagttctgtgtacat

SEQ ID NO: 5326610 - DNA, 20 bp, Homo sapiens
tggtttccacgatgaaaaac

SEQ ID NO: 5326611 - DNA, 21 bp, Homo sapiens
tggtttccacgatgaaaaact

SEQ ID NO: 5326612 - DNA, 13 bp, Homo sapiens
tggtttcccaaga

SEQ ID NO: 5326613 - DNA, 14 bp, Homo sapiens
tggtttcctcattt

SEQ ID NO: 5326614 - DNA, 14 bp, Homo sapiens
tggtttcctctgga

SEQ ID NO: 5326615 - DNA, 20 bp, Homo sapiens
tggtttcctgcccagcctgg

SEQ ID NO: 5326616 - DNA, 13 bp, Homo sapiens
tggtttccttcct

SEQ ID NO: 5326617 - DNA, 21 bp, Homo sapiens
tggtttcggaaaaaaaaaaag

SEQ ID NO: 5326618 - DNA, 14 bp, Homo sapiens
tggtttctacttcc

SEQ ID NO: 5326619 - DNA, 21 bp, Homo sapiens
tggtttctcagaatccaaaga

SEQ ID NO: 5326620 - DNA, 13 bp, Homo sapiens
tggtttctcttct

SEQ ID NO: 5326621 - DNA, 14 bp, Homo sapiens
tggtttctcttctc

SEQ ID NO: 5326622 - DNA, 19 bp, Homo sapiens
tggtttctcttctcccctt

SEQ ID NO: 5326623 - DNA, 13 bp, Homo sapiens
tggtttctgaaaa

SEQ ID NO: 5326624 - DNA, 15 bp, Homo sapiens
tggtttctgtttgaa

SEQ ID NO: 5326625 - DNA, 16 bp, Homo sapiens
tggtttcttattcaaa

SEQ ID NO: 5326626 - DNA, 22 bp, Homo sapiens
tggtttgaaagattatgatgca

SEQ ID NO: 5326627 - DNA, 23 bp, Homo sapiens
tggtttgaagaatgttaagactt

SEQ ID NO: 5326628 - DNA, 15 bp, Homo sapiens
tggtttgaagtgtta

SEQ ID NO: 5326629 - DNA, 19 bp, Homo sapiens
tggtttgacaattttgtct

SEQ ID NO: 5326630 - DNA, 13 bp, Homo sapiens
tggtttgactcag

SEQ ID NO: 5326631 - DNA, 17 bp, Homo sapiens
tggtttgagcttagtga

SEQ ID NO: 5326632 - DNA, 22 bp, Homo sapiens
tggtttgcaacctctttgctca

SEQ ID NO: 5326633 - DNA, 16 bp, Homo sapiens
tggtttgcacataaaa

SEQ ID NO: 5326634 - DNA, 19 bp, Homo sapiens
tggtttgcacataaaacgt

SEQ ID NO: 5326635 - DNA, 14 bp, Homo sapiens
tggtttgcagatga

SEQ ID NO: 5326636 - DNA, 18 bp, Homo sapiens
tggtttgcagcgactggc

SEQ ID NO: 5326637 - DNA, 15 bp, Homo sapiens
tggtttgccaggcca

SEQ ID NO: 5326638 - DNA, 21 bp, Homo sapiens
tggtttgccggtggtgcaggt

SEQ ID NO: 5326639 - DNA, 13 bp, Homo sapiens
tggtttgcgcagt

SEQ ID NO: 5326640 - DNA, 20 bp, Homo sapiens
tggtttggaatattaaaaaa

SEQ ID NO: 5326641 - DNA, 19 bp, Homo sapiens
tggtttggccatctctgga

SEQ ID NO: 5326642 - DNA, 12 bp, Homo sapiens
tggtttggcctc

SEQ ID NO: 5326643 - DNA, 20 bp, Homo sapiens
tggtttgggaatatccatgt

SEQ ID NO: 5326644 - DNA, 14 bp, Homo sapiens
tggtttggggagaa

SEQ ID NO: 5326645 - DNA, 22 bp, Homo sapiens
tggtttggtgctttttataaaa

SEQ ID NO: 5326646 - DNA, 15 bp, Homo sapiens
tggtttgtaaaatcc

SEQ ID NO: 5326647 - DNA, 15 bp, Homo sapiens
tggtttgtaatgttt

SEQ ID NO: 5326648 - DNA, 16 bp, Homo sapiens
tggtttgtacatatca

SEQ ID NO: 5326649 - DNA, 20 bp, Homo sapiens
tggtttgtacatatcaaata

SEQ ID NO: 5326650 - DNA, 14 bp, Homo sapiens
tggtttgtggacga

SEQ ID NO: 5326651 - DNA, 22 bp, Homo sapiens
tggtttgttagagggtatttgt

SEQ ID NO: 5326652 - DNA, 17 bp, Homo sapiens
tggtttgttctgacttt

SEQ ID NO: 5326653 - DNA, 22 bp, Homo sapiens
tggtttgtttgcttaatttcct

SEQ ID NO: 5326654 - DNA, 15 bp, Homo sapiens
tggttttaaaagcac

SEQ ID NO: 5326655 - DNA, 16 bp, Homo sapiens
tggttttaaaatactg

SEQ ID NO: 5326656 - DNA, 23 bp, Homo sapiens
tggttttaaacctttaatgagaa

SEQ ID NO: 5326657 - DNA, 22 bp, Homo sapiens
tggttttaaagctaaacgtaat

SEQ ID NO: 5326658 - DNA, 17 bp, Homo sapiens
tggttttaatacttgat

SEQ ID NO: 5326659 - DNA, 13 bp, Homo sapiens
tggttttacacag

SEQ ID NO: 5326660 - DNA, 18 bp, Homo sapiens
tggttttaccccagctcc

SEQ ID NO: 5326661 - DNA, 21 bp, Homo sapiens
tggttttacttacaaaaatgg

SEQ ID NO: 5326662 - DNA, 20 bp, Homo sapiens
tggttttaggatacttaaca

SEQ ID NO: 5326663 - DNA, 18 bp, Homo sapiens
tggttttagttgcaactt

SEQ ID NO: 5326664 - DNA, 19 bp, Homo sapiens
tggttttatactatattaa

SEQ ID NO: 5326665 - DNA, 16 bp, Homo sapiens
tggttttatactgaag

SEQ ID NO: 5326666 - DNA, 20 bp, Homo sapiens
tggttttattctttgagaag

SEQ ID NO: 5326667 - DNA, 13 bp, Homo sapiens
tggttttatttgt

SEQ ID NO: 5326668 - DNA, 17 bp, Homo sapiens
tggttttcaaaataaaa

SEQ ID NO: 5326669 - DNA, 13 bp, Homo sapiens
tggttttcaaatc

SEQ ID NO: 5326670 - DNA, 19 bp, Homo sapiens
tggttttcaacctctagaa

SEQ ID NO: 5326671 - DNA, 21 bp, Homo sapiens
tggttttcaacctctagaatt

SEQ ID NO: 5326672 - DNA, 23 bp, Homo sapiens
tggttttcagattccacacaaaa

SEQ ID NO: 5326673 - DNA, 13 bp, Homo sapiens
tggttttccatga

SEQ ID NO: 5326674 - DNA, 18 bp, Homo sapiens
tggttttcccctccctgg

SEQ ID NO: 5326675 - DNA, 20 bp, Homo sapiens
tggttttcccctccctgggt

SEQ ID NO: 5326676 - DNA, 13 bp, Homo sapiens
tggttttctcctt

SEQ ID NO: 5326677 - DNA, 17 bp, Homo sapiens
tggttttctctctggat

SEQ ID NO: 5326678 - DNA, 19 bp, Homo sapiens
tggttttctctgatggcac

SEQ ID NO: 5326679 - DNA, 15 bp, Homo sapiens
tggttttctgttctt

SEQ ID NO: 5326680 - DNA, 14 bp, Homo sapiens
tggttttcttaagg

SEQ ID NO: 5326681 - DNA, 19 bp, Homo sapiens
tggttttcttgtgtgttta

SEQ ID NO: 5326682 - DNA, 18 bp, Homo sapiens
tggttttcttttgccatg

SEQ ID NO: 5326683 - DNA, 12 bp, Homo sapiens
tggttttgaaat

SEQ ID NO: 5326684 - DNA, 16 bp, Homo sapiens
tggttttgagaaagta

SEQ ID NO: 5326685 - DNA, 22 bp, Homo sapiens
tggttttgccctccctctctgc

SEQ ID NO: 5326686 - DNA, 13 bp, Homo sapiens
tggttttgctgag

SEQ ID NO: 5326687 - DNA, 13 bp, Homo sapiens
tggttttgggaaa

SEQ ID NO: 5326688 - DNA, 15 bp, Homo sapiens
tggttttggtttcca

SEQ ID NO: 5326689 - DNA, 16 bp, Homo sapiens
tggttttggtttccac

SEQ ID NO: 5326690 - DNA, 21 bp, Homo sapiens
tggttttgtaaaattccatgg

SEQ ID NO: 5326691 - DNA, 16 bp, Homo sapiens
tggttttgtacactgc

SEQ ID NO: 5326692 - DNA, 20 bp, Homo sapiens
tggttttgtacactgctgta

SEQ ID NO: 5326693 - DNA, 16 bp, Homo sapiens
tggttttgttcccctc

SEQ ID NO: 5326694 - DNA, 20 bp, Homo sapiens
tggttttgttcccctcctcc

SEQ ID NO: 5326695 - DNA, 12 bp, Homo sapiens
tgtaacccacac

SEQ ID NO: 5326696 - DNA, 22 bp, Homo sapiens
tgtaaccgattcatctctcaga

SEQ ID NO: 5326697 - DNA, 17 bp, Homo sapiens
tgtaaccgcttctgggg

SEQ ID NO: 5326698 - DNA, 16 bp, Homo sapiens
tgtaacctcagctctg

SEQ ID NO: 5326699 - DNA, 18 bp, Homo sapiens
tgtaacctcagctctggg

SEQ ID NO: 5326700 - DNA, 12 bp, Homo sapiens
tgtaacctcagt

SEQ ID NO: 5326701 - DNA, 19 bp, Homo sapiens
tgtaacctcttcagaggcc

SEQ ID NO: 5326702 - DNA, 22 bp, Homo sapiens
tgtaacctgagatggccctctg

SEQ ID NO: 5326703 - DNA, 13 bp, Homo sapiens
tgtaacctgattc

SEQ ID NO: 5326704 - DNA, 14 bp, Homo sapiens
tgtaaccttgggtg

SEQ ID NO: 5326705 - DNA, 15 bp, Homo sapiens
tgtaacgaaacactt

SEQ ID NO: 5326706 - DNA, 23 bp, Homo sapiens
tgtaacgcaagttcccagttgga

SEQ ID NO: 5326707 - DNA, 19 bp, Homo sapiens
tgtaacgtgtgctgtgttt

SEQ ID NO: 5326708 - DNA, 22 bp, Homo sapiens
tgtaacgttttctttcacacac

SEQ ID NO: 5326709 - DNA, 15 bp, Homo sapiens
tgtaactaaaataat

SEQ ID NO: 5326710 - DNA, 16 bp, Homo sapiens
tgtaactaatttgtgg

SEQ ID NO: 5326711 - DNA, 16 bp, Homo sapiens
tgtaactacaaagctt

SEQ ID NO: 5326712 - DNA, 19 bp, Homo sapiens
tgtaactacaaagctttgc

SEQ ID NO: 5326713 - DNA, 21 bp, Homo sapiens
tgtaactacaaagctttgcta

SEQ ID NO: 5326714 - DNA, 17 bp, Homo sapiens
tgtaactacaatgatgg

SEQ ID NO: 5326715 - DNA, 23 bp, Homo sapiens
tgtaactagaccatttttaaatg

SEQ ID NO: 5326716 - DNA, 20 bp, Homo sapiens
tgtaactatagactggaaaa

SEQ ID NO: 5326717 - DNA, 11 bp, Homo sapiens
tgtaactattg

SEQ ID NO: 5326718 - DNA, 15 bp, Homo sapiens
tgtaactatttcttc

SEQ ID NO: 5326719 - DNA, 19 bp, Homo sapiens
tgtaactccagatagagaa

SEQ ID NO: 5326720 - DNA, 19 bp, Homo sapiens
tgtaactctaaaagatcct

SEQ ID NO: 5326721 - DNA, 13 bp, Homo sapiens
tgtaactctccag

SEQ ID NO: 5326722 - DNA, 20 bp, Homo sapiens
tgtaactgaagcataaacat

SEQ ID NO: 5326723 - DNA, 13 bp, Homo sapiens
tgtaactgccagg

SEQ ID NO: 5326724 - DNA, 23 bp, Homo sapiens
tgtaactgcccttttaaatggca

SEQ ID NO: 5326725 - DNA, 13 bp, Homo sapiens
tgtaactgcctac

SEQ ID NO: 5326726 - DNA, 18 bp, Homo sapiens
tgtaactgctcagagctt

SEQ ID NO: 5326727 - DNA, 19 bp, Homo sapiens
tgtaactgctcagagcttt

SEQ ID NO: 5326728 - DNA, 19 bp, Homo sapiens
tgtaactgctgagccactc

SEQ ID NO: 5326729 - DNA, 17 bp, Homo sapiens
tgtaactggctgctccc

SEQ ID NO: 5326730 - DNA, 14 bp, Homo sapiens
tgtaactgttacca

SEQ ID NO: 5326731 - DNA, 21 bp, Homo sapiens
tgtaactgttaccattggaaa

SEQ ID NO: 5326732 - DNA, 16 bp, Homo sapiens
tgtaactgttctttgc

SEQ ID NO: 5326733 - DNA, 19 bp, Homo sapiens
tgtaactgttctttgcagt

SEQ ID NO: 5326734 - DNA, 18 bp, Homo sapiens
tgtaacttaaatatttga

SEQ ID NO: 5326735 - DNA, 16 bp, Homo sapiens
tgtaacttacacctgg

SEQ ID NO: 5326736 - DNA, 12 bp, Homo sapiens
tgtaacttcaaa

SEQ ID NO: 5326737 - DNA, 13 bp, Homo sapiens
tgtaacttcaaat

SEQ ID NO: 5326738 - DNA, 18 bp, Homo sapiens
tgtaacttcagatgtttc

SEQ ID NO: 5326739 - DNA, 20 bp, Homo sapiens
tgtaacttcagatgtttcca

SEQ ID NO: 5326740 - DNA, 20 bp, Homo sapiens
tgtaacttccaaataaataa

SEQ ID NO: 5326741 - DNA, 13 bp, Homo sapiens
tgtaacttcctct

SEQ ID NO: 5326742 - DNA, 12 bp, Homo sapiens
tgtaacttcctg

SEQ ID NO: 5326743 - DNA, 22 bp, Homo sapiens
tgtaacttgatccatttctaat

SEQ ID NO: 5326744 - DNA, 13 bp, Homo sapiens
tgtaacttgtgct

SEQ ID NO: 5326745 - DNA, 14 bp, Homo sapiens
tgtaactttaaaca

SEQ ID NO: 5326746 - DNA, 17 bp, Homo sapiens
tgtaactttaaacatct

SEQ ID NO: 5326747 - DNA, 19 bp, Homo sapiens
tgtaactttcataccactt

SEQ ID NO: 5326748 - DNA, 13 bp, Homo sapiens
tgtaactttgcat

SEQ ID NO: 5326749 - DNA, 16 bp, Homo sapiens
tgtaactttgcatgtt

SEQ ID NO: 5326750 - DNA, 19 bp, Homo sapiens
tgtaactttgcatgttctt

SEQ ID NO: 5326751 - DNA, 15 bp, Homo sapiens
tgtaactttttacat

SEQ ID NO: 5326752 - DNA, 22 bp, Homo sapiens
tgtaactttttacattacagaa

SEQ ID NO: 5326753 - DNA, 14 bp, Homo sapiens
tgtaagaaaaccaa

SEQ ID NO: 5326754 - DNA, 11 bp, Homo sapiens
tgtaagaaaat

SEQ ID NO: 5326755 - DNA, 17 bp, Homo sapiens
tgtaagaaaatatcact

SEQ ID NO: 5326756 - DNA, 15 bp, Homo sapiens
tgtaagaaaatttga

SEQ ID NO: 5326757 - DNA, 24 bp, Homo sapiens
tgtaagaaaccaatcaagataaag

SEQ ID NO: 5326758 - DNA, 12 bp, Homo sapiens
tgtaagaaacct

SEQ ID NO: 5326759 - DNA, 21 bp, Homo sapiens
tgtaagaacaactacctgagc

SEQ ID NO: 5326760 - DNA, 20 bp, Homo sapiens
tgtaagaacacattttaaat

SEQ ID NO: 5326761 - DNA, 18 bp, Homo sapiens
tgtaagaactacaaacaa

SEQ ID NO: 5326762 - DNA, 14 bp, Homo sapiens
tgtaagaactgtac

SEQ ID NO: 5326763 - DNA, 19 bp, Homo sapiens
tgtaagaagccccttattt

SEQ ID NO: 5326764 - DNA, 20 bp, Homo sapiens
tgtaagaagcggcatagcac

SEQ ID NO: 5326765 - DNA, 18 bp, Homo sapiens
tgtaagaagctgtgaata

SEQ ID NO: 5326766 - DNA, 14 bp, Homo sapiens
tgtaagaaggcaat

SEQ ID NO: 5326767 - DNA, 16 bp, Homo sapiens
tgtaagaataatttat

SEQ ID NO: 5326768 - DNA, 18 bp, Homo sapiens
tgtaagaatccaaagtgg

SEQ ID NO: 5326769 - DNA, 16 bp, Homo sapiens
tgtaagaatgactgat

SEQ ID NO: 5326770 - DNA, 16 bp, Homo sapiens
tgtaagaattcagaag

SEQ ID NO: 5326771 - DNA, 18 bp, Homo sapiens
tgtaagaattcagaagac

SEQ ID NO: 5326772 - DNA, 11 bp, Homo sapiens
tgtaagacaca

SEQ ID NO: 5326773 - DNA, 20 bp, Homo sapiens
tgtaagacacacagcctttc

SEQ ID NO: 5326774 - DNA, 15 bp, Homo sapiens
tgtaagacatttcct

SEQ ID NO: 5326775 - DNA, 21 bp, Homo sapiens
tgtaagacatttgtatattgt

SEQ ID NO: 5326776 - DNA, 19 bp, Homo sapiens
tgtaagacgtatgtaacat

SEQ ID NO: 5326777 - DNA, 19 bp, Homo sapiens
tgtaagagaaaatattact

SEQ ID NO: 5326778 - DNA, 18 bp, Homo sapiens
tgtaagagcaccttcctc

SEQ ID NO: 5326779 - DNA, 18 bp, Homo sapiens
tgtaagagcttgctccag

SEQ ID NO: 5326780 - DNA, 18 bp, Homo sapiens
tgtaagagtattaacaaa

SEQ ID NO: 5326781 - DNA, 22 bp, Homo sapiens
tgtaagagtgagctctggtgga

SEQ ID NO: 5326782 - DNA, 21 bp, Homo sapiens
tgtaagagtgtagaagcattc

SEQ ID NO: 5326783 - DNA, 23 bp, Homo sapiens
tgtaagatccaccccctgcccac

SEQ ID NO: 5326784 - DNA, 19 bp, Homo sapiens
tgtaagatcgttctctgcc

SEQ ID NO: 5326785 - DNA, 12 bp, Homo sapiens
tgtaagatgctg

SEQ ID NO: 5326786 - DNA, 15 bp, Homo sapiens
tgtaagatgctgggt

SEQ ID NO: 5326787 - DNA, 17 bp, Homo sapiens
tgtaagatgctgggttg

SEQ ID NO: 5326788 - DNA, 13 bp, Homo sapiens
tgtaagatgtctg

SEQ ID NO: 5326789 - DNA, 11 bp, Homo sapiens
tgtaagatgtt

SEQ ID NO: 5326790 - DNA, 18 bp, Homo sapiens
tgtaagattatagattct

SEQ ID NO: 5326791 - DNA, 20 bp, Homo sapiens
tgtaagattatagattctaa

SEQ ID NO: 5326792 - DNA, 22 bp, Homo sapiens
tgtaagattatagattctaaag

SEQ ID NO: 5326793 - DNA, 22 bp, Homo sapiens
tgtaagcaaaggctctgaaata

SEQ ID NO: 5326794 - DNA, 19 bp, Homo sapiens
tgtaagcaacttgcttcta

SEQ ID NO: 5326795 - DNA, 21 bp, Homo sapiens
tgtaagcaacttgcttctaaa

SEQ ID NO: 5326796 - DNA, 16 bp, Homo sapiens
tgtaagcaattctaag

SEQ ID NO: 5326797 - DNA, 21 bp, Homo sapiens
tgtaagcacctgggctgagga

SEQ ID NO: 5326798 - DNA, 19 bp, Homo sapiens
tgtaagcaggagagaaatt

SEQ ID NO: 5326799 - DNA, 20 bp, Homo sapiens
tgtaagcatactttgtaaat

SEQ ID NO: 5326800 - DNA, 20 bp, Homo sapiens
tgtaagcattctgagctggg

SEQ ID NO: 5326801 - DNA, 15 bp, Homo sapiens
tgtaagccaaagaaa

SEQ ID NO: 5326802 - DNA, 15 bp, Homo sapiens
tgtaagccagagtca

SEQ ID NO: 5326803 - DNA, 20 bp, Homo sapiens
tgtaagccagagtcaacaaa

SEQ ID NO: 5326804 - DNA, 16 bp, Homo sapiens
tgtaagccctctttaa

SEQ ID NO: 5326805 - DNA, 23 bp, Homo sapiens
tgtaagccctttggggacaaggg

SEQ ID NO: 5326806 - DNA, 23 bp, Homo sapiens
tgtaagcctcgtaggatgtatgt

SEQ ID NO: 5326807 - DNA, 15 bp, Homo sapiens
tgtaagcctgcaagc

SEQ ID NO: 5326808 - DNA, 19 bp, Homo sapiens
tgtaagcggtggtttgtaa

SEQ ID NO: 5326809 - DNA, 17 bp, Homo sapiens
tgtaagcgtatggcttt

SEQ ID NO: 5326810 - DNA, 21 bp, Homo sapiens
tgtaagcgtatggctttattt

SEQ ID NO: 5326811 - DNA, 18 bp, Homo sapiens
tgtaagctataacatatt

SEQ ID NO: 5326812 - DNA, 13 bp, Homo sapiens
tgtaagctgaagt

SEQ ID NO: 5326813 - DNA, 14 bp, Homo sapiens
tgtaaggaatgatt

SEQ ID NO: 5326814 - DNA, 18 bp, Homo sapiens
tgtaaggaatgattaatt

SEQ ID NO: 5326815 - DNA, 17 bp, Homo sapiens
tgtaaggaattgaagat

SEQ ID NO: 5326816 - DNA, 17 bp, Homo sapiens
tgtaaggactgtaaaca

SEQ ID NO: 5326817 - DNA, 20 bp, Homo sapiens
tgtaaggatgattttaatat

SEQ ID NO: 5326818 - DNA, 15 bp, Homo sapiens
tgtaaggctctagat

SEQ ID NO: 5326819 - DNA, 18 bp, Homo sapiens
tgtaaggctctagatcat

SEQ ID NO: 5326820 - DNA, 20 bp, Homo sapiens
tgtaaggctgtgtaagattt

SEQ ID NO: 5326821 - DNA, 21 bp, Homo sapiens
tgtaaggcttgttccaatgcc

SEQ ID NO: 5326822 - DNA, 13 bp, Homo sapiens
tgtaagggaaact

SEQ ID NO: 5326823 - DNA, 19 bp, Homo sapiens
tgtaagggaaactgccagc

SEQ ID NO: 5326824 - DNA, 14 bp, Homo sapiens
tgtaagggcagtgc

SEQ ID NO: 5326825 - DNA, 16 bp, Homo sapiens
tgtaagggcagtgccc

SEQ ID NO: 5326826 - DNA, 19 bp, Homo sapiens
tgtaagggctttaaataaa

SEQ ID NO: 5326827 - DNA, 23 bp, Homo sapiens
tgtaagggctttaaataaaagag

SEQ ID NO: 5326828 - DNA, 12 bp, Homo sapiens
tgtaaggggaag

SEQ ID NO: 5326829 - DNA, 21 bp, Homo sapiens
tgtaagggtctgttgtaaatg

SEQ ID NO: 5326830 - DNA, 23 bp, Homo sapiens
tgtaagggtctgttgtaaatgac

SEQ ID NO: 5326831 - DNA, 19 bp, Homo sapiens
tgtaaggtatatcattcta

SEQ ID NO: 5326832 - DNA, 15 bp, Homo sapiens
tgtaaggtattgcaa

SEQ ID NO: 5326833 - DNA, 16 bp, Homo sapiens
tgtaaggtattgcaag

SEQ ID NO: 5326834 - DNA, 16 bp, Homo sapiens
tgtaaggtcatgctgg

SEQ ID NO: 5326835 - DNA, 17 bp, Homo sapiens
tgtaaggtctttgtaaa

SEQ ID NO: 5326836 - DNA, 11 bp, Homo sapiens
tgtaaggttcc

SEQ ID NO: 5326837 - DNA, 19 bp, Homo sapiens
tgtaaggttgtgcagggtg

SEQ ID NO: 5326838 - DNA, 15 bp, Homo sapiens
tgtaaggtttcaatg

SEQ ID NO: 5326839 - DNA, 18 bp, Homo sapiens
tgtaagtaaatgctttga

SEQ ID NO: 5326840 - DNA, 16 bp, Homo sapiens
tgtaagtaaatgtctg

SEQ ID NO: 5326841 - DNA, 21 bp, Homo sapiens
tgtaagtaaatgtctgtggcc

SEQ ID NO: 5326842 - DNA, 21 bp, Homo sapiens
tgtaagtaaattgcctgattt

SEQ ID NO: 5326843 - DNA, 14 bp, Homo sapiens
tgtaagtaacacag

SEQ ID NO: 5326844 - DNA, 16 bp, Homo sapiens
tgtaagtaacacagta

SEQ ID NO: 5326845 - DNA, 17 bp, Homo sapiens
tgtaagtaacacagtat

SEQ ID NO: 5326846 - DNA, 21 bp, Homo sapiens
tgtaagtaacttcacattaaa

SEQ ID NO: 5326847 - DNA, 23 bp, Homo sapiens
tgtaagtaagtaagaaagaaggc

SEQ ID NO: 5326848 - DNA, 21 bp, Homo sapiens
tgtaagtaccctgatgccttt

SEQ ID NO: 5326849 - DNA, 23 bp, Homo sapiens
tgtaagtactctaatatacagtg

SEQ ID NO: 5326850 - DNA, 17 bp, Homo sapiens
tgtaagtcagtgttgag

SEQ ID NO: 5326851 - DNA, 19 bp, Homo sapiens
tgtaagtgaagtaaaactt

SEQ ID NO: 5326852 - DNA, 14 bp, Homo sapiens
tgtaagtgggccca

SEQ ID NO: 5326853 - DNA, 23 bp, Homo sapiens
tgtaagtggtttttatattttca

SEQ ID NO: 5326854 - DNA, 13 bp, Homo sapiens
tgtaagtgtagct

SEQ ID NO: 5326855 - DNA, 14 bp, Homo sapiens
tgtaagtgtgagta

SEQ ID NO: 5326856 - DNA, 17 bp, Homo sapiens
tgtaagtgtgagtaaga

SEQ ID NO: 5326857 - DNA, 19 bp, Homo sapiens
tgtaagttatgttttacat

SEQ ID NO: 5326858 - DNA, 21 bp, Homo sapiens
tgtaagttgggcttgctattc

SEQ ID NO: 5326859 - DNA, 15 bp, Homo sapiens
tgtaagttgtacaaa

SEQ ID NO: 5326860 - DNA, 17 bp, Homo sapiens
tgtaagttgtacaaatg

SEQ ID NO: 5326861 - DNA, 15 bp, Homo sapiens
tgtaagttgtgtgca

SEQ ID NO: 5326862 - DNA, 13 bp, Homo sapiens
tgtaagtttattt

SEQ ID NO: 5326863 - DNA, 22 bp, Homo sapiens
tgtaagtttattttttctacac

SEQ ID NO: 5326864 - DNA, 13 bp, Homo sapiens
tgtaagtttcagg

SEQ ID NO: 5326865 - DNA, 15 bp, Homo sapiens
tgtaagtttcaggtg

SEQ ID NO: 5326866 - DNA, 16 bp, Homo sapiens
tgtaagtttcaggtga

SEQ ID NO: 5326867 - DNA, 20 bp, Homo sapiens
tgtaagtttcaggtgacatg

SEQ ID NO: 5326868 - DNA, 12 bp, Homo sapiens
tgtaagtttcta

SEQ ID NO: 5326869 - DNA, 13 bp, Homo sapiens
tgtaagtttgcat

SEQ ID NO: 5326870 - DNA, 14 bp, Homo sapiens
tgtaagtttgcata

SEQ ID NO: 5326871 - DNA, 16 bp, Homo sapiens
tgtaagtttgtgtaaa

SEQ ID NO: 5326872 - DNA, 17 bp, Homo sapiens
tgtaagtttgtgtaaat

SEQ ID NO: 5326873 - DNA, 16 bp, Homo sapiens
tgtaattatttgaatg

SEQ ID NO: 5326874 - DNA, 14 bp, Homo sapiens
tgtaattattttcc

SEQ ID NO: 5326875 - DNA, 15 bp, Homo sapiens
tgtaattcaggactc

SEQ ID NO: 5326876 - DNA, 13 bp, Homo sapiens
tgtaattcagtgt

SEQ ID NO: 5326877 - DNA, 13 bp, Homo sapiens
tgtaattccccta

SEQ ID NO: 5326878 - DNA, 15 bp, Homo sapiens
tgtaattcctacctc

SEQ ID NO: 5326879 - DNA, 15 bp, Homo sapiens
tgtaattcctctagc

SEQ ID NO: 5326880 - DNA, 15 bp, Homo sapiens
tgtaattctaaatga

SEQ ID NO: 5326881 - DNA, 15 bp, Homo sapiens
tgtaattgaataaag

SEQ ID NO: 5326882 - DNA, 17 bp, Homo sapiens
tgtaattgaatattatt

SEQ ID NO: 5326883 - DNA, 22 bp, Homo sapiens
tgtaattgacactatatatttc

SEQ ID NO: 5326884 - DNA, 22 bp, Homo sapiens
tgtaattgacagagtaaaagta

SEQ ID NO: 5326885 - DNA, 19 bp, Homo sapiens
tgtaattgacggtttttta

SEQ ID NO: 5326886 - DNA, 13 bp, Homo sapiens
tgtaattgattgt

SEQ ID NO: 5326887 - DNA, 17 bp, Homo sapiens
tgtaattgatttataaa

SEQ ID NO: 5326888 - DNA, 17 bp, Homo sapiens
tgtaattggtgacaatg

SEQ ID NO: 5326889 - DNA, 16 bp, Homo sapiens
tgtaattgtaattcca

SEQ ID NO: 5326890 - DNA, 20 bp, Homo sapiens
tgtaattgtaattccaaaat

SEQ ID NO: 5326891 - DNA, 13 bp, Homo sapiens
tgtaattgtctca

SEQ ID NO: 5326892 - DNA, 10 bp, Homo sapiens
tgtaattgtg

SEQ ID NO: 5326893 - DNA, 13 bp, Homo sapiens
tgtaattgtgtaa

SEQ ID NO: 5326894 - DNA, 21 bp, Homo sapiens
tgtaattgtgtaaaaaatgga

SEQ ID NO: 5326895 - DNA, 22 bp, Homo sapiens
tgtaattgtgtaaaaaatggaa

SEQ ID NO: 5326896 - DNA, 20 bp, Homo sapiens
tgtaattgtgtggattcttt

SEQ ID NO: 5326897 - DNA, 15 bp, Homo sapiens
tgtaattgttccttt

SEQ ID NO: 5326898 - DNA, 16 bp, Homo sapiens
tgtaattgttcctttt

SEQ ID NO: 5326899 - DNA, 16 bp, Homo sapiens
tgtaattgttgtttgt

SEQ ID NO: 5326900 - DNA, 19 bp, Homo sapiens
tgtaatttaaacaggccca

SEQ ID NO: 5326901 - DNA, 20 bp, Homo sapiens
tgtaatttaagtgacacaga

SEQ ID NO: 5326902 - DNA, 19 bp, Homo sapiens
tgtaatttaatgcctgccc

SEQ ID NO: 5326903 - DNA, 14 bp, Homo sapiens
tgtaatttagaaac

SEQ ID NO: 5326904 - DNA, 14 bp, Homo sapiens
tgtaatttagtcta

SEQ ID NO: 5326905 - DNA, 15 bp, Homo sapiens
tgtaatttataaaat

SEQ ID NO: 5326906 - DNA, 18 bp, Homo sapiens
tgtaatttatattccatt

SEQ ID NO: 5326907 - DNA, 13 bp, Homo sapiens
tgtaatttcaaaa

SEQ ID NO: 5326908 - DNA, 14 bp, Homo sapiens
tgtaatttcaaaat

SEQ ID NO: 5326909 - DNA, 17 bp, Homo sapiens
tgtaatttcaaaataca

SEQ ID NO: 5326910 - DNA, 18 bp, Homo sapiens
tgtaatttcaaaatacat

SEQ ID NO: 5326911 - DNA, 15 bp, Homo sapiens
tgtaatttcgcctta

SEQ ID NO: 5326912 - DNA, 16 bp, Homo sapiens
tgtaatttcgccttaa

SEQ ID NO: 5326913 - DNA, 19 bp, Homo sapiens
tgtaatttcgccttaaact

SEQ ID NO: 5326914 - DNA, 21 bp, Homo sapiens
tgtaatttcgccttaaactct

SEQ ID NO: 5326915 - DNA, 21 bp, Homo sapiens
tgtaatttctttaaatgtgta

SEQ ID NO: 5326916 - DNA, 21 bp, Homo sapiens
tgtaatttctttgcctgttca

SEQ ID NO: 5326917 - DNA, 21 bp, Homo sapiens
tgtaatttgaatgagttttta

SEQ ID NO: 5326918 - DNA, 13 bp, Homo sapiens
tgtaatttgaatt

SEQ ID NO: 5326919 - DNA, 19 bp, Homo sapiens
tgtaatttgtacaggggcc

SEQ ID NO: 5326920 - DNA, 14 bp, Homo sapiens
tgtaatttgtgata

SEQ ID NO: 5326921 - DNA, 13 bp, Homo sapiens
tgtaatttgtgta

SEQ ID NO: 5326922 - DNA, 21 bp, Homo sapiens
tgtaattttaaaagtctattt

SEQ ID NO: 5326923 - DNA, 16 bp, Homo sapiens
tgtaattttaaagtca

SEQ ID NO: 5326924 - DNA, 17 bp, Homo sapiens
tgtaattttaatggctg

SEQ ID NO: 5326925 - DNA, 17 bp, Homo sapiens
tgtaattttacttttta

SEQ ID NO: 5326926 - DNA, 18 bp, Homo sapiens
tgtaattttactttttat

SEQ ID NO: 5326927 - DNA, 23 bp, Homo sapiens
tgtaattttatttgttctttttc

SEQ ID NO: 5326928 - DNA, 20 bp, Homo sapiens
tgtaattttattttaaaatt

SEQ ID NO: 5326929 - DNA, 17 bp, Homo sapiens
tgtaattttcttgatga

SEQ ID NO: 5326930 - DNA, 19 bp, Homo sapiens
tgtaattttgagtacagaa

SEQ ID NO: 5326931 - DNA, 15 bp, Homo sapiens
tgtaattttgtagta

SEQ ID NO: 5326932 - DNA, 17 bp, Homo sapiens
tgtaattttgtagtagt

SEQ ID NO: 5326933 - DNA, 16 bp, Homo sapiens
tgtaattttgtgtaag

SEQ ID NO: 5326934 - DNA, 15 bp, Homo sapiens
tgtaattttgttcct

SEQ ID NO: 5326935 - DNA, 18 bp, Homo sapiens
tgtaattttgtttgtaat

SEQ ID NO: 5326936 - DNA, 18 bp, Homo sapiens
tgtaatttttaaagcaaa

SEQ ID NO: 5326937 - DNA, 23 bp, Homo sapiens
tgtaatttttaaagcaaatatat

SEQ ID NO: 5326938 - DNA, 22 bp, Homo sapiens
tgtaatttttcagctctctgta

SEQ ID NO: 5326939 - DNA, 15 bp, Homo sapiens
tgtaatttttctgta

SEQ ID NO: 5326940 - DNA, 23 bp, Homo sapiens
tgtaatttttttgtaaaggaaat

SEQ ID NO: 5326941 - DNA, 21 bp, Homo sapiens
tgtacaaaaaaatcttccaat

SEQ ID NO: 5326942 - DNA, 21 bp, Homo sapiens
tgtacaaaaaagttataagaa

SEQ ID NO: 5326943 - DNA, 15 bp, Homo sapiens
tgtacaaaaacaaaa

SEQ ID NO: 5326944 - DNA, 14 bp, Homo sapiens
tgtacaaaaacaca

SEQ ID NO: 5326945 - DNA, 11 bp, Homo sapiens
tgtacaaaaga

SEQ ID NO: 5326946 - DNA, 12 bp, Homo sapiens
tgtacaaaagaa

SEQ ID NO: 5326947 - DNA, 11 bp, Homo sapiens
tgtacaaaagc

SEQ ID NO: 5326948 - DNA, 15 bp, Homo sapiens
tgtacaaaagcaatg

SEQ ID NO: 5326949 - DNA, 21 bp, Homo sapiens
tgtacaaaatcgattggcttt

SEQ ID NO: 5326950 - DNA, 21 bp, Homo sapiens
tgtacaaaatgaattgccttt

SEQ ID NO: 5326951 - DNA, 19 bp, Homo sapiens
tgtacaaaattaagcaaat

SEQ ID NO: 5326952 - DNA, 19 bp, Homo sapiens
tgtacaaacagtatttctg

SEQ ID NO: 5326953 - DNA, 15 bp, Homo sapiens
tgtacaaagatactt

SEQ ID NO: 5326954 - DNA, 22 bp, Homo sapiens
tgtacaaagatacttgatgcac

SEQ ID NO: 5326955 - DNA, 14 bp, Homo sapiens
tgtacaaaggggaa

SEQ ID NO: 5326956 - DNA, 22 bp, Homo sapiens
tgtacaaaggggaaagaacata

SEQ ID NO: 5326957 - DNA, 17 bp, Homo sapiens
tgtacaaagtattaagc

SEQ ID NO: 5326958 - DNA, 19 bp, Homo sapiens
tgtacaaagtattaagcat

SEQ ID NO: 5326959 - DNA, 16 bp, Homo sapiens
tgtacaaataaacctg

SEQ ID NO: 5326960 - DNA, 22 bp, Homo sapiens
tgtacaaataaacctgaggcag

SEQ ID NO: 5326961 - DNA, 21 bp, Homo sapiens
tgtacaaataatattgccttg

SEQ ID NO: 5326962 - DNA, 18 bp, Homo sapiens
tgtacaaatataagaata

SEQ ID NO: 5326963 - DNA, 16 bp, Homo sapiens
tgtacaaatcctctgt

SEQ ID NO: 5326964 - DNA, 20 bp, Homo sapiens
tgtacaaattgtcgttttta

SEQ ID NO: 5326965 - DNA, 18 bp, Homo sapiens
tgtacaacaatgctttga

SEQ ID NO: 5326966 - DNA, 14 bp, Homo sapiens
tgtacaaccctgac

SEQ ID NO: 5326967 - DNA, 15 bp, Homo sapiens
tgtacaacttaagtt

SEQ ID NO: 5326968 - DNA, 14 bp, Homo sapiens
tgtacaacttttta

SEQ ID NO: 5326969 - DNA, 16 bp, Homo sapiens
tgtacaagatgaagga

SEQ ID NO: 5326970 - DNA, 17 bp, Homo sapiens
tgtacaaggatgaaaga

SEQ ID NO: 5326971 - DNA, 18 bp, Homo sapiens
tgtacaaggtatgtacag

SEQ ID NO: 5326972 - DNA, 22 bp, Homo sapiens
tgtacaagtgctcagttccaat

SEQ ID NO: 5326973 - DNA, 13 bp, Homo sapiens
tgtacaagttgct

SEQ ID NO: 5326974 - DNA, 14 bp, Homo sapiens
tgtacaagttgctt

SEQ ID NO: 5326975 - DNA, 19 bp, Homo sapiens
tgtacaagttgctttgtta

SEQ ID NO: 5326976 - DNA, 15 bp, Homo sapiens
tgtacaagttgttat

SEQ ID NO: 5326977 - DNA, 19 bp, Homo sapiens
tgtacaagttttgtataaa

SEQ ID NO: 5326978 - DNA, 12 bp, Homo sapiens
tgtacaataaat

SEQ ID NO: 5326979 - DNA, 14 bp, Homo sapiens
tgtacaataaattt

SEQ ID NO: 5326980 - DNA, 11 bp, Homo sapiens
tgtacaataag

SEQ ID NO: 5326981 - DNA, 14 bp, Homo sapiens
tgtacaataagtta

SEQ ID NO: 5326982 - DNA, 17 bp, Homo sapiens
tgtacaataagttactt

SEQ ID NO: 5326983 - DNA, 20 bp, Homo sapiens
tgtacaataagttacttgaa

SEQ ID NO: 5326984 - DNA, 23 bp, Homo sapiens
tgtacaataagttacttgaaata

SEQ ID NO: 5326985 - DNA, 18 bp, Homo sapiens
tgtacaatatgaaaagga

SEQ ID NO: 5326986 - DNA, 15 bp, Homo sapiens
tgtacaatattttaa

SEQ ID NO: 5326987 - DNA, 19 bp, Homo sapiens
tgtacaatcaaaacacact

SEQ ID NO: 5326988 - DNA, 18 bp, Homo sapiens
tgtacaatgactttattg

SEQ ID NO: 5326989 - DNA, 22 bp, Homo sapiens
tgtacaatggtttattcccaag

SEQ ID NO: 5326990 - DNA, 13 bp, Homo sapiens
tgtacaatgtgag

SEQ ID NO: 5326991 - DNA, 17 bp, Homo sapiens
tgtacaattactgtgag

SEQ ID NO: 5326992 - DNA, 14 bp, Homo sapiens
tgtacaattgatct

SEQ ID NO: 5326993 - DNA, 18 bp, Homo sapiens
tgtacaattgatcttttt

SEQ ID NO: 5326994 - DNA, 16 bp, Homo sapiens
tgtacaattttaaagt

SEQ ID NO: 5326995 - DNA, 18 bp, Homo sapiens
tgtacaattttcatccca

SEQ ID NO: 5326996 - DNA, 22 bp, Homo sapiens
tgtacaattttcatcccacaat

SEQ ID NO: 5326997 - DNA, 11 bp, Homo sapiens
tgtacacacac

SEQ ID NO: 5326998 - DNA, 16 bp, Homo sapiens
tgtacacacacagaca

SEQ ID NO: 5326999 - DNA, 13 bp, Homo sapiens
tgtacacacttta

SEQ ID NO: 5327000 - DNA, 21 bp, Homo sapiens
tgtacacagtgggaagatttt

SEQ ID NO: 5327001 - DNA, 15 bp, Homo sapiens
tgtacacatatacat

SEQ ID NO: 5327002 - DNA, 13 bp, Homo sapiens
tgtacacatatga

SEQ ID NO: 5327003 - DNA, 20 bp, Homo sapiens
tgtacacatctattctcaaa

SEQ ID NO: 5327004 - DNA, 23 bp, Homo sapiens
tgtacacatgccaacacttaatc

SEQ ID NO: 5327005 - DNA, 12 bp, Homo sapiens
tgtacacatgtc

SEQ ID NO: 5327006 - DNA, 16 bp, Homo sapiens
tgtacacattcctgca

SEQ ID NO: 5327007 - DNA, 14 bp, Homo sapiens
tgtacacatttctt

SEQ ID NO: 5327008 - DNA, 17 bp, Homo sapiens
tgtacacatttcttaaa

SEQ ID NO: 5327009 - DNA, 19 bp, Homo sapiens
tgtacaccatagtttacaa

SEQ ID NO: 5327010 - DNA, 18 bp, Homo sapiens
tgtacacgggaccagctc

SEQ ID NO: 5327011 - DNA, 14 bp, Homo sapiens
tgtacacgggactg

SEQ ID NO: 5327012 - DNA, 20 bp, Homo sapiens
tgtacacgggactgacgcaa

SEQ ID NO: 5327013 - DNA, 16 bp, Homo sapiens
tgtacacgtgtcctgt

SEQ ID NO: 5327014 - DNA, 16 bp, Homo sapiens
tgtacactaacatttc

SEQ ID NO: 5327015 - DNA, 12 bp, Homo sapiens
tgtacactgaat

SEQ ID NO: 5327016 - DNA, 17 bp, Homo sapiens
tgtacactgaatattta

SEQ ID NO: 5327017 - DNA, 20 bp, Homo sapiens
tgtacactgaatatttatat

SEQ ID NO: 5327018 - DNA, 14 bp, Homo sapiens
tgtacactgctgta

SEQ ID NO: 5327019 - DNA, 18 bp, Homo sapiens
tgtacactgctgtaccca

SEQ ID NO: 5327020 - DNA, 20 bp, Homo sapiens
tgtacactgctgtacccaga

SEQ ID NO: 5327021 - DNA, 12 bp, Homo sapiens
tgtacacttttt

SEQ ID NO: 5327022 - DNA, 14 bp, Homo sapiens
tgtacagaaaatag

SEQ ID NO: 5327023 - DNA, 21 bp, Homo sapiens
tgtacagaaacaactgccaaa

SEQ ID NO: 5327024 - DNA, 18 bp, Homo sapiens
tgtacagaacacaaatgt

SEQ ID NO: 5327025 - DNA, 21 bp, Homo sapiens
tgtacagaacacaaatgtcta

SEQ ID NO: 5327026 - DNA, 17 bp, Homo sapiens
tgtacagaagaaactga

SEQ ID NO: 5327027 - DNA, 18 bp, Homo sapiens
tgtacagaattctgctac

SEQ ID NO: 5327028 - DNA, 17 bp, Homo sapiens
tgtacagaatttccact

SEQ ID NO: 5327029 - DNA, 18 bp, Homo sapiens
tgtacagaatttttaatg

SEQ ID NO: 5327030 - DNA, 22 bp, Homo sapiens
tgtacagaatttttaatgactt

SEQ ID NO: 5327031 - DNA, 14 bp, Homo sapiens
tgtacagacaacaa

SEQ ID NO: 5327032 - DNA, 12 bp, Homo sapiens
tgtacagacaag

SEQ ID NO: 5327033 - DNA, 14 bp, Homo sapiens
tgtacagacatatt

SEQ ID NO: 5327034 - DNA, 13 bp, Homo sapiens
tgtacagactctt

SEQ ID NO: 5327035 - DNA, 21 bp, Homo sapiens
tgtacagactgttttactgtt

SEQ ID NO: 5327036 - DNA, 12 bp, Homo sapiens
tgtacagagccc

SEQ ID NO: 5327037 - DNA, 13 bp, Homo sapiens
tgtacagagccca

SEQ ID NO: 5327038 - DNA, 16 bp, Homo sapiens
tgtacagagcccacgc

SEQ ID NO: 5327039 - DNA, 18 bp, Homo sapiens
tgtacagagcccacgccc

SEQ ID NO: 5327040 - DNA, 21 bp, Homo sapiens
tgtacagagcccacgccccca

SEQ ID NO: 5327041 - DNA, 15 bp, Homo sapiens
tgtacagagctttct

SEQ ID NO: 5327042 - DNA, 14 bp, Homo sapiens
tgtacagaggaagc

SEQ ID NO: 5327043 - DNA, 19 bp, Homo sapiens
tgtacagagtgcttttctg

SEQ ID NO: 5327044 - DNA, 19 bp, Homo sapiens
tgtacagatgaatgataaa

SEQ ID NO: 5327045 - DNA, 18 bp, Homo sapiens
tgtacagattctttcagt

SEQ ID NO: 5327046 - DNA, 13 bp, Homo sapiens
tgtacagcacaga

SEQ ID NO: 5327047 - DNA, 15 bp, Homo sapiens
tgtacagcacagaat

SEQ ID NO: 5327048 - DNA, 16 bp, Homo sapiens
tgtacagcacagaatg

SEQ ID NO: 5327049 - DNA, 11 bp, Homo sapiens
tgtacagctct

SEQ ID NO: 5327050 - DNA, 20 bp, Homo sapiens
tgtacagctctcccctccct

SEQ ID NO: 5327051 - DNA, 16 bp, Homo sapiens
tgtacaggaactgcat

SEQ ID NO: 5327052 - DNA, 21 bp, Homo sapiens
tgtacaggaaggtgcctggcc

SEQ ID NO: 5327053 - DNA, 20 bp, Homo sapiens
tgtaccgtcgacaagaatgt

SEQ ID NO: 5327054 - DNA, 23 bp, Homo sapiens
tgtaccgtcgacaagaatgtccc

SEQ ID NO: 5327055 - DNA, 14 bp, Homo sapiens
tgtacctaacttga

SEQ ID NO: 5327056 - DNA, 21 bp, Homo sapiens
tgtacctaatccaaatatcat

SEQ ID NO: 5327057 - DNA, 16 bp, Homo sapiens
tgtacctatttctgat

SEQ ID NO: 5327058 - DNA, 22 bp, Homo sapiens
tgtacctatttctgatgatgtc

SEQ ID NO: 5327059 - DNA, 15 bp, Homo sapiens
tgtacctcactgtcc

SEQ ID NO: 5327060 - DNA, 20 bp, Homo sapiens
tgtacctcctctcagtgttt

SEQ ID NO: 5327061 - DNA, 13 bp, Homo sapiens
tgtacctctagaa

SEQ ID NO: 5327062 - DNA, 22 bp, Homo sapiens
tgtacctctattagtttcaatt

SEQ ID NO: 5327063 - DNA, 22 bp, Homo sapiens
tgtacctcttgagccttgaact

SEQ ID NO: 5327064 - DNA, 21 bp, Homo sapiens
tgtacctgcccccactcagca

SEQ ID NO: 5327065 - DNA, 22 bp, Homo sapiens
tgtacctgtaggaaacagaaaa

SEQ ID NO: 5327066 - DNA, 16 bp, Homo sapiens
tgtacctgttcctccc

SEQ ID NO: 5327067 - DNA, 16 bp, Homo sapiens
tgtaccttaagatatt

SEQ ID NO: 5327068 - DNA, 18 bp, Homo sapiens
tgtaccttctttcactct

SEQ ID NO: 5327069 - DNA, 22 bp, Homo sapiens
tgtaccttttaacacctgatgt

SEQ ID NO: 5327070 - DNA, 23 bp, Homo sapiens
tgtaccttttaacacctgatgtg

SEQ ID NO: 5327071 - DNA, 21 bp, Homo sapiens
tgtaccttttgaggagcccca

SEQ ID NO: 5327072 - DNA, 21 bp, Homo sapiens
tgtaccttttgcgatttcaca

SEQ ID NO: 5327073 - DNA, 15 bp, Homo sapiens
tgtacgaacccctcc

SEQ ID NO: 5327074 - DNA, 19 bp, Homo sapiens
tgtacgaacccctcccctc

SEQ ID NO: 5327075 - DNA, 23 bp, Homo sapiens
tgtacgacacgggtggggaaagg

SEQ ID NO: 5327076 - DNA, 20 bp, Homo sapiens
tgtacgataggtagaattgt

SEQ ID NO: 5327077 - DNA, 14 bp, Homo sapiens
tgtacgctagagca

SEQ ID NO: 5327078 - DNA, 21 bp, Homo sapiens
tgtacgtagccacaggagccc

SEQ ID NO: 5327079 - DNA, 20 bp, Homo sapiens
tgtacgtatgaatgatatct

SEQ ID NO: 5327080 - DNA, 14 bp, Homo sapiens
tgtacgtccagcct

SEQ ID NO: 5327081 - DNA, 16 bp, Homo sapiens
tgtacgtctgacaggc

SEQ ID NO: 5327082 - DNA, 14 bp, Homo sapiens
tgtacgtggagagg

SEQ ID NO: 5327083 - DNA, 23 bp, Homo sapiens
tgtacgtggccatgtatgaagcc

SEQ ID NO: 5327084 - DNA, 17 bp, Homo sapiens
tgtacgttaattaaaca

SEQ ID NO: 5327085 - DNA, 16 bp, Homo sapiens
tgtacgtttgtatgtg

SEQ ID NO: 5327086 - DNA, 13 bp, Homo sapiens
tgtacgttttgca

SEQ ID NO: 5327087 - DNA, 20 bp, Homo sapiens
tgtactaaacctcgtgcttg

SEQ ID NO: 5327088 - DNA, 15 bp, Homo sapiens
tgtactaaagccaaa

SEQ ID NO: 5327089 - DNA, 20 bp, Homo sapiens
tgtactaagaatgtccttat

SEQ ID NO: 5327090 - DNA, 17 bp, Homo sapiens
tgtactaagccaggagg

SEQ ID NO: 5327091 - DNA, 18 bp, Homo sapiens
tgtactaatctgagattg

SEQ ID NO: 5327092 - DNA, 22 bp, Homo sapiens
tgtactaatctgagattgtgtt

SEQ ID NO: 5327093 - DNA, 16 bp, Homo sapiens
tgtactaattcttaca

SEQ ID NO: 5327094 - DNA, 16 bp, Homo sapiens
tgtactaccccaggac

SEQ ID NO: 5327095 - DNA, 16 bp, Homo sapiens
tgtactagtactgtgt

SEQ ID NO: 5327096 - DNA, 19 bp, Homo sapiens
tgtactagtcctctagaaa

SEQ ID NO: 5327097 - DNA, 18 bp, Homo sapiens
tgtactatatgtatatct

SEQ ID NO: 5327098 - DNA, 18 bp, Homo sapiens
tgtactatcttatctcag

SEQ ID NO: 5327099 - DNA, 22 bp, Homo sapiens
tgtactatgatgggcttctgtt

SEQ ID NO: 5327100 - DNA, 15 bp, Homo sapiens
tgtactattgcttaa

SEQ ID NO: 5327101 - DNA, 14 bp, Homo sapiens
tgtactatttaact

SEQ ID NO: 5327102 - DNA, 15 bp, Homo sapiens
tgtactatttaactg

SEQ ID NO: 5327103 - DNA, 17 bp, Homo sapiens
tgtactcaaagcccaga

SEQ ID NO: 5327104 - DNA, 13 bp, Homo sapiens
tgtactcaatttt

SEQ ID NO: 5327105 - DNA, 14 bp, Homo sapiens
tgtactcacatata

SEQ ID NO: 5327106 - DNA, 20 bp, Homo sapiens
tgtactcacatataacatgc

SEQ ID NO: 5327107 - DNA, 21 bp, Homo sapiens
tgtactccagagggacagggt

SEQ ID NO: 5327108 - DNA, 19 bp, Homo sapiens
tgtactccagcctgggcaa

SEQ ID NO: 5327109 - DNA, 18 bp, Homo sapiens
tgtactccagcctgggtg

SEQ ID NO: 5327110 - DNA, 12 bp, Homo sapiens
tgtactcctccc

SEQ ID NO: 5327111 - DNA, 13 bp, Homo sapiens
tgtactcctccca

SEQ ID NO: 5327112 - DNA, 19 bp, Homo sapiens
tgtactctacaaaatatag

SEQ ID NO: 5327113 - DNA, 19 bp, Homo sapiens
tgtactctacgccaaagtg

SEQ ID NO: 5327114 - DNA, 19 bp, Homo sapiens
tgtactctaggacttcaaa

SEQ ID NO: 5327115 - DNA, 12 bp, Homo sapiens
tgtactctggcc

SEQ ID NO: 5327116 - DNA, 14 bp, Homo sapiens
tgtactctgtgtgt

SEQ ID NO: 5327117 - DNA, 19 bp, Homo sapiens
tgtactcttaggatatttg

SEQ ID NO: 5327118 - DNA, 20 bp, Homo sapiens
tgtactcttaggatatttga

SEQ ID NO: 5327119 - DNA, 19 bp, Homo sapiens
tgtactcttatatttttct

SEQ ID NO: 5327120 - DNA, 14 bp, Homo sapiens
tgtactcttccgaa

SEQ ID NO: 5327121 - DNA, 20 bp, Homo sapiens
tgtactcttccgatgtttgt

SEQ ID NO: 5327122 - DNA, 20 bp, Homo sapiens
tgtactctttatttctagca

SEQ ID NO: 5327123 - DNA, 12 bp, Homo sapiens
tgtactgaaaaa

SEQ ID NO: 5327124 - DNA, 14 bp, Homo sapiens
tgtactgaagtaaa

SEQ ID NO: 5327125 - DNA, 15 bp, Homo sapiens
tgtactgaattcttt

SEQ ID NO: 5327126 - DNA, 14 bp, Homo sapiens
tgtactgaattttt

SEQ ID NO: 5327127 - DNA, 15 bp, Homo sapiens
tgtactgacttgagg

SEQ ID NO: 5327128 - DNA, 22 bp, Homo sapiens
tgtactgagaggaggggtaaat

SEQ ID NO: 5327129 - DNA, 17 bp, Homo sapiens
tgtactgagccttgtaa

SEQ ID NO: 5327130 - DNA, 20 bp, Homo sapiens
tgtactgagccttgtaattc

SEQ ID NO: 5327131 - DNA, 21 bp, Homo sapiens
tgtactgatactattcaatgc

SEQ ID NO: 5327132 - DNA, 15 bp, Homo sapiens
tgtactgattcaatt

SEQ ID NO: 5327133 - DNA, 16 bp, Homo sapiens
tgtactgattcaattt

SEQ ID NO: 5327134 - DNA, 22 bp, Homo sapiens
tgtactgatttttgtaagacaa

SEQ ID NO: 5327135 - DNA, 12 bp, Homo sapiens
tgtactgcaaag

SEQ ID NO: 5327136 - DNA, 19 bp, Homo sapiens
tgtactgcatatgaaagga

SEQ ID NO: 5327137 - DNA, 18 bp, Homo sapiens
tgtactgcatcttagttt

SEQ ID NO: 5327138 - DNA, 23 bp, Homo sapiens
tgtactgcatcttagtttactgg

SEQ ID NO: 5327139 - DNA, 16 bp, Homo sapiens
tgtactgcatgtgact

SEQ ID NO: 5327140 - DNA, 18 bp, Homo sapiens
tgtactgcatgtgacttc

SEQ ID NO: 5327141 - DNA, 13 bp, Homo sapiens
tgtactgcctgct

SEQ ID NO: 5327142 - DNA, 15 bp, Homo sapiens
tgtactgcctgcttg

SEQ ID NO: 5327143 - DNA, 17 bp, Homo sapiens
tgtactgctcaggctgc

SEQ ID NO: 5327144 - DNA, 20 bp, Homo sapiens
tgtactgctcaggctgcagc

SEQ ID NO: 5327145 - DNA, 19 bp, Homo sapiens
tgtactggagagtggcaaa

SEQ ID NO: 5327146 - DNA, 19 bp, Homo sapiens
tgtactggagcctgcatta

SEQ ID NO: 5327147 - DNA, 12 bp, Homo sapiens
tgtactgggggt

SEQ ID NO: 5327148 - DNA, 19 bp, Homo sapiens
tgtactggtaattgtacaa

SEQ ID NO: 5327149 - DNA, 12 bp, Homo sapiens
tgtactggttca

SEQ ID NO: 5327150 - DNA, 15 bp, Homo sapiens
tgtactggttcattg

SEQ ID NO: 5327151 - DNA, 16 bp, Homo sapiens
tgtactgtaaacagtt

SEQ ID NO: 5327152 - DNA, 22 bp, Homo sapiens
tgtactgtaaacagttctgcac

SEQ ID NO: 5327153 - DNA, 23 bp, Homo sapiens
tgtactgtaattttgtttgtaat

SEQ ID NO: 5327154 - DNA, 20 bp, Homo sapiens
tgtactgtacataaattcca

SEQ ID NO: 5327155 - DNA, 22 bp, Homo sapiens
tgtactgtacataaattccaga

SEQ ID NO: 5327156 - DNA, 17 bp, Homo sapiens
tgtactgtactgaagaa

SEQ ID NO: 5327157 - DNA, 14 bp, Homo sapiens
tgtactgtagttca

SEQ ID NO: 5327158 - DNA, 17 bp, Homo sapiens
tgtactgtatagacagt

SEQ ID NO: 5327159 - DNA, 23 bp, Homo sapiens
tgtactgtatagacagtttgtaa

SEQ ID NO: 5327160 - DNA, 18 bp, Homo sapiens
tgtactgtatctattctt

SEQ ID NO: 5327161 - DNA, 13 bp, Homo sapiens
tgtactgtgacct

SEQ ID NO: 5327162 - DNA, 15 bp, Homo sapiens
tgtactgtgcctggt

SEQ ID NO: 5327163 - DNA, 10 bp, Homo sapiens
tgtactgtgt

SEQ ID NO: 5327164 - DNA, 15 bp, Homo sapiens
tgtactgttactggg

SEQ ID NO: 5327165 - DNA, 18 bp, Homo sapiens
tgtactgttgaaaaagat

SEQ ID NO: 5327166 - DNA, 19 bp, Homo sapiens
tgtactgtttaatgttctg

SEQ ID NO: 5327167 - DNA, 19 bp, Homo sapiens
tgtacttaaatgagttact

SEQ ID NO: 5327168 - DNA, 12 bp, Homo sapiens
tgtacttagaaa

SEQ ID NO: 5327169 - DNA, 16 bp, Homo sapiens
tgtacttagctgtact

SEQ ID NO: 5327170 - DNA, 17 bp, Homo sapiens
tgtacttagctgtacta

SEQ ID NO: 5327171 - DNA, 18 bp, Homo sapiens
tgtacttagctgtactat

SEQ ID NO: 5327172 - DNA, 21 bp, Homo sapiens
tgtacttagggcagctggcct

SEQ ID NO: 5327173 - DNA, 13 bp, Homo sapiens
tgtacttattaca

SEQ ID NO: 5327174 - DNA, 14 bp, Homo sapiens
tgtacttcattcaa

SEQ ID NO: 5327175 - DNA, 16 bp, Homo sapiens
tgtacttcattcaaaa

SEQ ID NO: 5327176 - DNA, 22 bp, Homo sapiens
tgtacttcccgggccagggctg

SEQ ID NO: 5327177 - DNA, 15 bp, Homo sapiens
tgtacttcctgtgta

SEQ ID NO: 5327178 - DNA, 17 bp, Homo sapiens
tgtacttcctgtgtact

SEQ ID NO: 5327179 - DNA, 17 bp, Homo sapiens
tgtacttctctgtgtgc

SEQ ID NO: 5327180 - DNA, 13 bp, Homo sapiens
tgtacttctgctc

SEQ ID NO: 5327181 - DNA, 16 bp, Homo sapiens
tgtacttctgtgttca

SEQ ID NO: 5327182 - DNA, 19 bp, Homo sapiens
tgtacttctgtgttcattt

SEQ ID NO: 5327183 - DNA, 18 bp, Homo sapiens
tgtacttcttattgcaag

SEQ ID NO: 5327184 - DNA, 15 bp, Homo sapiens
tgtacttcttcatcc

SEQ ID NO: 5327185 - DNA, 23 bp, Homo sapiens
tgtacttgaagtctaaaagcaga

SEQ ID NO: 5327186 - DNA, 14 bp, Homo sapiens
tgtacttgaataat

SEQ ID NO: 5327187 - DNA, 16 bp, Homo sapiens
tgtacttgaataataa

SEQ ID NO: 5327188 - DNA, 16 bp, Homo sapiens
tgtacttgatgacaga

SEQ ID NO: 5327189 - DNA, 19 bp, Homo sapiens
tgtacttgctcttgatgcc

SEQ ID NO: 5327190 - DNA, 23 bp, Homo sapiens
tgtacttgctcttgatgcctggc

SEQ ID NO: 5327191 - DNA, 12 bp, Homo sapiens
tgtacttggagt

SEQ ID NO: 5327192 - DNA, 13 bp, Homo sapiens
tgtacttggagta

SEQ ID NO: 5327193 - DNA, 22 bp, Homo sapiens
tgtacttggagtattggggtct

SEQ ID NO: 5327194 - DNA, 20 bp, Homo sapiens
tgtacttggtccaactgcaa

SEQ ID NO: 5327195 - DNA, 16 bp, Homo sapiens
tgtacttgtcctcagc

SEQ ID NO: 5327196 - DNA, 14 bp, Homo sapiens
tgtacttgtttgaa

SEQ ID NO: 5327197 - DNA, 14 bp, Homo sapiens
tgtacttgtttgca

SEQ ID NO: 5327198 - DNA, 15 bp, Homo sapiens
tgtacttgtttgcta

SEQ ID NO: 5327199 - DNA, 16 bp, Homo sapiens
tgtacttgtttgctat

SEQ ID NO: 5327200 - DNA, 19 bp, Homo sapiens
tgtactttatcatgaatgc

SEQ ID NO: 5327201 - DNA, 21 bp, Homo sapiens
tgtactttatcatgaatgctt

SEQ ID NO: 5327202 - DNA, 23 bp, Homo sapiens
tgtactttcattccctttcatga

SEQ ID NO: 5327203 - DNA, 19 bp, Homo sapiens
tgtactttctaagagaaag

SEQ ID NO: 5327204 - DNA, 15 bp, Homo sapiens
tgtactttctgttaa

SEQ ID NO: 5327205 - DNA, 12 bp, Homo sapiens
tgtactttgaat

SEQ ID NO: 5327206 - DNA, 18 bp, Homo sapiens
tgtactttgattcacatg

SEQ ID NO: 5327207 - DNA, 14 bp, Homo sapiens
tgtactttgccatt

SEQ ID NO: 5327208 - DNA, 15 bp, Homo sapiens
tgtactttgcttctt

SEQ ID NO: 5327209 - DNA, 16 bp, Homo sapiens
tgtactttgtttttcc

SEQ ID NO: 5327210 - DNA, 15 bp, Homo sapiens
tgtacttttaagact

SEQ ID NO: 5327211 - DNA, 16 bp, Homo sapiens
tgtacttttaaggcag

SEQ ID NO: 5327212 - DNA, 17 bp, Homo sapiens
tgtacttttatcttaaa

SEQ ID NO: 5327213 - DNA, 23 bp, Homo sapiens
tgtacttttattttacacagaaa

SEQ ID NO: 5327214 - DNA, 18 bp, Homo sapiens
tgtacttttcattctctt

SEQ ID NO: 5327215 - DNA, 14 bp, Homo sapiens
tgtacttttccttt

SEQ ID NO: 5327216 - DNA, 19 bp, Homo sapiens
tgtacttttctggttccaa

SEQ ID NO: 5327217 - DNA, 16 bp, Homo sapiens
tgtactttttattcaa

SEQ ID NO: 5327218 - DNA, 12 bp, Homo sapiens
tgtactttttgg

SEQ ID NO: 5327219 - DNA, 16 bp, Homo sapiens
tgtactttttggcata

SEQ ID NO: 5327220 - DNA, 16 bp, Homo sapiens
tgtactttttgttcca

SEQ ID NO: 5327221 - DNA, 17 bp, Homo sapiens
tgtactttttgttttgt

SEQ ID NO: 5327222 - DNA, 16 bp, Homo sapiens
tgtacttttttcaaat

SEQ ID NO: 5327223 - DNA, 17 bp, Homo sapiens
tgtacttttttcaaata

SEQ ID NO: 5327224 - DNA, 22 bp, Homo sapiens
tgtagaaaaatactgattttaa

SEQ ID NO: 5327225 - DNA, 17 bp, Homo sapiens
tgtagaaaaatccctcc

SEQ ID NO: 5327226 - DNA, 11 bp, Homo sapiens
tgtagaaaaca

SEQ ID NO: 5327227 - DNA, 20 bp, Homo sapiens
tgtagaaaagaactggaaac

SEQ ID NO: 5327228 - DNA, 18 bp, Homo sapiens
tgtagaaaagggaactga

SEQ ID NO: 5327229 - DNA, 20 bp, Homo sapiens
tgtagaaaatgaggaaatgc

SEQ ID NO: 5327230 - DNA, 13 bp, Homo sapiens
tgtagaaacaaag

SEQ ID NO: 5327231 - DNA, 17 bp, Homo sapiens
tgtagtttgcccagagt

SEQ ID NO: 5327232 - DNA, 16 bp, Homo sapiens
tgtagttttaacagaa

SEQ ID NO: 5327233 - DNA, 22 bp, Homo sapiens
tgtagttttatcacatgtatgt

SEQ ID NO: 5327234 - DNA, 17 bp, Homo sapiens
tgtagttttatttgtat

SEQ ID NO: 5327235 - DNA, 22 bp, Homo sapiens
tgtagttttccctgcactgtgt

SEQ ID NO: 5327236 - DNA, 21 bp, Homo sapiens
tgtagttttcttttttaaatt

SEQ ID NO: 5327237 - DNA, 16 bp, Homo sapiens
tgtagtttttgaaaat

SEQ ID NO: 5327238 - DNA, 24 bp, Homo sapiens
tgtagtttttgaaaattatgcaaa

SEQ ID NO: 5327239 - DNA, 16 bp, Homo sapiens
tgtataaaaaggaaat

SEQ ID NO: 5327240 - DNA, 18 bp, Homo sapiens
tgtataaaaaggaaatta

SEQ ID NO: 5327241 - DNA, 16 bp, Homo sapiens
tgtataaaaatgtaaa

SEQ ID NO: 5327242 - DNA, 19 bp, Homo sapiens
tgtataaaaattatcaaaa

SEQ ID NO: 5327243 - DNA, 14 bp, Homo sapiens
tgtataaaacagtg

SEQ ID NO: 5327244 - DNA, 16 bp, Homo sapiens
tgtataaaacagtgtt

SEQ ID NO: 5327245 - DNA, 19 bp, Homo sapiens
tgtataaaacagtgtttcc

SEQ ID NO: 5327246 - DNA, 13 bp, Homo sapiens
tgtataaaagtgt

SEQ ID NO: 5327247 - DNA, 14 bp, Homo sapiens
tgtataaaataatt

SEQ ID NO: 5327248 - DNA, 16 bp, Homo sapiens
tgtataaaatcagcca

SEQ ID NO: 5327249 - DNA, 19 bp, Homo sapiens
tgtataaaatccaaaatga

SEQ ID NO: 5327250 - DNA, 20 bp, Homo sapiens
tgtataaaatccaaaatgaa

SEQ ID NO: 5327251 - DNA, 17 bp, Homo sapiens
tgtataaaatctgaatt

SEQ ID NO: 5327252 - DNA, 23 bp, Homo sapiens
tgtataaaatctgaattttgcaa

SEQ ID NO: 5327253 - DNA, 20 bp, Homo sapiens
tgtataaaatgcaaaataaa

SEQ ID NO: 5327254 - DNA, 16 bp, Homo sapiens
tgtataaaatgtaaca

SEQ ID NO: 5327255 - DNA, 23 bp, Homo sapiens
tgtataaacaagaaaaataaaga

SEQ ID NO: 5327256 - DNA, 16 bp, Homo sapiens
tgtataaacagaactc

SEQ ID NO: 5327257 - DNA, 19 bp, Homo sapiens
tgtataaacataagttgca

SEQ ID NO: 5327258 - DNA, 20 bp, Homo sapiens
tgtataaacattaaatgtct

SEQ ID NO: 5327259 - DNA, 18 bp, Homo sapiens
tgtataaagattgtactt

SEQ ID NO: 5327260 - DNA, 19 bp, Homo sapiens
tgtataaagcaactgttat

SEQ ID NO: 5327261 - DNA, 23 bp, Homo sapiens
tgtataaagcaactgttatgaaa

SEQ ID NO: 5327262 - DNA, 13 bp, Homo sapiens
tgtataaagcatg

SEQ ID NO: 5327263 - DNA, 19 bp, Homo sapiens
tgtataaaggtgtgctgtg

SEQ ID NO: 5327264 - DNA, 14 bp, Homo sapiens
tgtataaataagag

SEQ ID NO: 5327265 - DNA, 21 bp, Homo sapiens
tgtataaataataaagaactc

SEQ ID NO: 5327266 - DNA, 18 bp, Homo sapiens
tgtataaataggagagga

SEQ ID NO: 5327267 - DNA, 13 bp, Homo sapiens
tgtataaatatac

SEQ ID NO: 5327268 - DNA, 14 bp, Homo sapiens
tgtataaatataca

SEQ ID NO: 5327269 - DNA, 21 bp, Homo sapiens
tgtataaatctttcttttgat

SEQ ID NO: 5327270 - DNA, 19 bp, Homo sapiens
tgtataaatggacctttta

SEQ ID NO: 5327271 - DNA, 14 bp, Homo sapiens
tgtataaatgtata

SEQ ID NO: 5327272 - DNA, 15 bp, Homo sapiens
tgtataaatgtatat

SEQ ID NO: 5327273 - DNA, 18 bp, Homo sapiens
tgtataaatgtatataca

SEQ ID NO: 5327274 - DNA, 21 bp, Homo sapiens
tgtataaatgtatatacacat

SEQ ID NO: 5327275 - DNA, 16 bp, Homo sapiens
tgtataaatgtctatt

SEQ ID NO: 5327276 - DNA, 19 bp, Homo sapiens
tgtataaatgtctttaatg

SEQ ID NO: 5327277 - DNA, 14 bp, Homo sapiens
tgtataaatgtgat

SEQ ID NO: 5327278 - DNA, 13 bp, Homo sapiens
tgtataaattaaa

SEQ ID NO: 5327279 - DNA, 18 bp, Homo sapiens
tgtataaattaatacaga

SEQ ID NO: 5327280 - DNA, 15 bp, Homo sapiens
tgtataaattgtctt

SEQ ID NO: 5327281 - DNA, 14 bp, Homo sapiens
tgtataacaggtta

SEQ ID NO: 5327282 - DNA, 20 bp, Homo sapiens
tgtataacattaagaaaata

SEQ ID NO: 5327283 - DNA, 22 bp, Homo sapiens
tgtataacccatatctgtgcaa

SEQ ID NO: 5327284 - DNA, 16 bp, Homo sapiens
tgtataactaggagct

SEQ ID NO: 5327285 - DNA, 16 bp, Homo sapiens
tgtataactgtgcaga

SEQ ID NO: 5327286 - DNA, 18 bp, Homo sapiens
tgtataagcactgaaaaa

SEQ ID NO: 5327287 - DNA, 19 bp, Homo sapiens
tgtataagccacttgtctt

SEQ ID NO: 5327288 - DNA, 16 bp, Homo sapiens
tgtataagctaatgtt

SEQ ID NO: 5327289 - DNA, 15 bp, Homo sapiens
tgtataagtcaagca

SEQ ID NO: 5327290 - DNA, 19 bp, Homo sapiens
tgtataagtccatgaatgt

SEQ ID NO: 5327291 - DNA, 23 bp, Homo sapiens
tgtataagtccatgaatgttcat

SEQ ID NO: 5327292 - DNA, 24 bp, Homo sapiens
tgtataagtccatgaatgttcata

SEQ ID NO: 5327293 - DNA, 19 bp, Homo sapiens
tgtataagtccttgcaaga

SEQ ID NO: 5327294 - DNA, 19 bp, Homo sapiens
tgtataagtggaggcactt

SEQ ID NO: 5327295 - DNA, 14 bp, Homo sapiens
tgtataataagaaa

SEQ ID NO: 5327296 - DNA, 20 bp, Homo sapiens
tgtataatattgaaaattga

SEQ ID NO: 5327297 - DNA, 15 bp, Homo sapiens
tgtataatattttta

SEQ ID NO: 5327298 - DNA, 14 bp, Homo sapiens
tgtataatcacagt

SEQ ID NO: 5327299 - DNA, 15 bp, Homo sapiens
tgtataatgtgcttt

SEQ ID NO: 5327300 - DNA, 19 bp, Homo sapiens
tgtataattaacttaactg

SEQ ID NO: 5327301 - DNA, 14 bp, Homo sapiens
tgtataattggatt

SEQ ID NO: 5327302 - DNA, 15 bp, Homo sapiens
tgtataattgtatcg

SEQ ID NO: 5327303 - DNA, 13 bp, Homo sapiens
tgtataatttacc

SEQ ID NO: 5327304 - DNA, 19 bp, Homo sapiens
tgtataatttcacagataa

SEQ ID NO: 5327305 - DNA, 21 bp, Homo sapiens
tgtataatttttttcttgtag

SEQ ID NO: 5327306 - DNA, 13 bp, Homo sapiens
tgtatacaaatat

SEQ ID NO: 5327307 - DNA, 18 bp, Homo sapiens
tgtatacaaatatattgt

SEQ ID NO: 5327308 - DNA, 15 bp, Homo sapiens
tgtatacaaggatca

SEQ ID NO: 5327309 - DNA, 13 bp, Homo sapiens
tgtatacacacac

SEQ ID NO: 5327310 - DNA, 14 bp, Homo sapiens
tgtatacacacaca

SEQ ID NO: 5327311 - DNA, 13 bp, Homo sapiens
tgtatacacacat

SEQ ID NO: 5327312 - DNA, 14 bp, Homo sapiens
tgtatacacacata

SEQ ID NO: 5327313 - DNA, 18 bp, Homo sapiens
tgtatacacacatataca

SEQ ID NO: 5327314 - DNA, 16 bp, Homo sapiens
tgtatacagtgcagag

SEQ ID NO: 5327315 - DNA, 23 bp, Homo sapiens
tgtatacagtgcagagccttctc

SEQ ID NO: 5327316 - DNA, 14 bp, Homo sapiens
tgtatacatacatg

SEQ ID NO: 5327317 - DNA, 14 bp, Homo sapiens
tgtatacatatgta

SEQ ID NO: 5327318 - DNA, 16 bp, Homo sapiens
tgtatacatatgtatg

SEQ ID NO: 5327319 - DNA, 18 bp, Homo sapiens
tgtatacatatgtatgtg

SEQ ID NO: 5327320 - DNA, 20 bp, Homo sapiens
tgtatacatatgtatgtgtg

SEQ ID NO: 5327321 - DNA, 12 bp, Homo sapiens
tgtatacatctt

SEQ ID NO: 5327322 - DNA, 18 bp, Homo sapiens
tgtatacattttgttata

SEQ ID NO: 5327323 - DNA, 15 bp, Homo sapiens
tgtataccacctgta

SEQ ID NO: 5327324 - DNA, 17 bp, Homo sapiens
tgtataccatgatgcat

SEQ ID NO: 5327325 - DNA, 21 bp, Homo sapiens
tgtataccatgatgcatggag

SEQ ID NO: 5327326 - DNA, 22 bp, Homo sapiens
tgtataccatgatgcatggagt

SEQ ID NO: 5327327 - DNA, 20 bp, Homo sapiens
tgtatacgcacgcacccaca

SEQ ID NO: 5327328 - DNA, 21 bp, Homo sapiens
tgtatacgcacgcacccacac

SEQ ID NO: 5327329 - DNA, 17 bp, Homo sapiens
tgtatactccatagaaa

SEQ ID NO: 5327330 - DNA, 17 bp, Homo sapiens
tgtatactcctgtcacc

SEQ ID NO: 5327331 - DNA, 15 bp, Homo sapiens
tgtatactgccacta

SEQ ID NO: 5327332 - DNA, 17 bp, Homo sapiens
tgtatactgtaaaagtt

SEQ ID NO: 5327333 - DNA, 21 bp, Homo sapiens
tgtatactgtaaaagttataa

SEQ ID NO: 5327334 - DNA, 24 bp, Homo sapiens
tgtatacttaaaaataaagtaact

SEQ ID NO: 5327335 - DNA, 22 bp, Homo sapiens
tgtatacttgaaaaatgttata

SEQ ID NO: 5327336 - DNA, 20 bp, Homo sapiens
tgtatacttgtattccctta

SEQ ID NO: 5327337 - DNA, 15 bp, Homo sapiens
tgtatactttaaata

SEQ ID NO: 5327338 - DNA, 16 bp, Homo sapiens
tgtatactttaaataa

SEQ ID NO: 5327339 - DNA, 17 bp, Homo sapiens
tgtatactttaaataat

SEQ ID NO: 5327340 - DNA, 21 bp, Homo sapiens
tgtatactttaaataatttaa

SEQ ID NO: 5327341 - DNA, 14 bp, Homo sapiens
tgtatactttagta

SEQ ID NO: 5327342 - DNA, 15 bp, Homo sapiens
tgtatactttagtat

SEQ ID NO: 5327343 - DNA, 17 bp, Homo sapiens
tgtatactttagtatga

SEQ ID NO: 5327344 - DNA, 18 bp, Homo sapiens
tgtatagaaaataaaata

SEQ ID NO: 5327345 - DNA, 22 bp, Homo sapiens
tgtatagaaaataaaataaatt

SEQ ID NO: 5327346 - DNA, 20 bp, Homo sapiens
tgtatagaccaaagcaaaga

SEQ ID NO: 5327347 - DNA, 22 bp, Homo sapiens
tgtatagagaatttaagtagaa

SEQ ID NO: 5327348 - DNA, 18 bp, Homo sapiens
tgtatagatgcaagatat

SEQ ID NO: 5327349 - DNA, 21 bp, Homo sapiens
tgtatagcaccaaaaaatgga

SEQ ID NO: 5327350 - DNA, 23 bp, Homo sapiens
tgtatagcaccaaaaaatggagg

SEQ ID NO: 5327351 - DNA, 23 bp, Homo sapiens
tgtatagccaaatgactgaaagc

SEQ ID NO: 5327352 - DNA, 15 bp, Homo sapiens
tgtatagctgcttcc

SEQ ID NO: 5327353 - DNA, 16 bp, Homo sapiens
tgtataggaatttgta

SEQ ID NO: 5327354 - DNA, 19 bp, Homo sapiens
tgtataggagccccaggca

SEQ ID NO: 5327355 - DNA, 16 bp, Homo sapiens
tgtataggccatctgt

SEQ ID NO: 5327356 - DNA, 19 bp, Homo sapiens
tgtataggccatctgtaaa

SEQ ID NO: 5327357 - DNA, 18 bp, Homo sapiens
tgtatagggaattttcat

SEQ ID NO: 5327358 - DNA, 19 bp, Homo sapiens
tgtataggggaaaatatta

SEQ ID NO: 5327359 - DNA, 13 bp, Homo sapiens
tgtataggtagat

SEQ ID NO: 5327360 - DNA, 19 bp, Homo sapiens
tgtataggtagatccagat

SEQ ID NO: 5327361 - DNA, 15 bp, Homo sapiens
tgtatagtactggca

SEQ ID NO: 5327362 - DNA, 21 bp, Homo sapiens
tgtatagtactggcatggtac

SEQ ID NO: 5327363 - DNA, 19 bp, Homo sapiens
tgtatagtatttgaaaaca

SEQ ID NO: 5327364 - DNA, 23 bp, Homo sapiens
tgtatagtgagagaggaggcctg

SEQ ID NO: 5327365 - DNA, 16 bp, Homo sapiens
tgtatagtgtaaaata

SEQ ID NO: 5327366 - DNA, 21 bp, Homo sapiens
tgtatagtgtctattatcaca

SEQ ID NO: 5327367 - DNA, 14 bp, Homo sapiens
tgtatagtgttcac

SEQ ID NO: 5327368 - DNA, 15 bp, Homo sapiens
tgtatagtgttcaca

SEQ ID NO: 5327369 - DNA, 16 bp, Homo sapiens
tgtatagtgttcacaa

SEQ ID NO: 5327370 - DNA, 20 bp, Homo sapiens
tgtatagtgttcacaaactg

SEQ ID NO: 5327371 - DNA, 21 bp, Homo sapiens
tgtatagtgttcacaaactgt

SEQ ID NO: 5327372 - DNA, 22 bp, Homo sapiens
tgtatagtgttcacaaactgtg

SEQ ID NO: 5327373 - DNA, 23 bp, Homo sapiens
tgtatagtgttcacaaactgtga

SEQ ID NO: 5327374 - DNA, 15 bp, Homo sapiens
tgtatagttaacaca

SEQ ID NO: 5327375 - DNA, 16 bp, Homo sapiens
tgtatagttaacacac

SEQ ID NO: 5327376 - DNA, 17 bp, Homo sapiens
tgtatagttaacacact

SEQ ID NO: 5327377 - DNA, 20 bp, Homo sapiens
tgtatagttaggatagcatt

SEQ ID NO: 5327378 - DNA, 18 bp, Homo sapiens
tgtatagttatgtaaata

SEQ ID NO: 5327379 - DNA, 17 bp, Homo sapiens
tgtatagttgcttttga

SEQ ID NO: 5327380 - DNA, 21 bp, Homo sapiens
tgtatagttgtggacatttaa

SEQ ID NO: 5327381 - DNA, 17 bp, Homo sapiens
tgtatagttttccctat

SEQ ID NO: 5327382 - DNA, 15 bp, Homo sapiens
tgtatataaaatgtg

SEQ ID NO: 5327383 - DNA, 16 bp, Homo sapiens
tgtatataaagttttt

SEQ ID NO: 5327384 - DNA, 12 bp, Homo sapiens
tgtatataaata

SEQ ID NO: 5327385 - DNA, 14 bp, Homo sapiens
tgtatataaatggg

SEQ ID NO: 5327386 - DNA, 21 bp, Homo sapiens
tgtatataatactaaagtgtc

SEQ ID NO: 5327387 - DNA, 23 bp, Homo sapiens
tgtatataatcatgctcatgtat

SEQ ID NO: 5327388 - DNA, 18 bp, Homo sapiens
tgtatatacaataacata

SEQ ID NO: 5327389 - DNA, 20 bp, Homo sapiens
tgtatatacacacatgtata

SEQ ID NO: 5327390 - DNA, 13 bp, Homo sapiens
tgtatatacacat

SEQ ID NO: 5327391 - DNA, 14 bp, Homo sapiens
tgtatatacagtta

SEQ ID NO: 5327392 - DNA, 12 bp, Homo sapiens
tgtatatacata

SEQ ID NO: 5327393 - DNA, 15 bp, Homo sapiens
tgtatatacatatat

SEQ ID NO: 5327394 - DNA, 13 bp, Homo sapiens
tgtatatactttt

SEQ ID NO: 5327395 - DNA, 15 bp, Homo sapiens
tgtatatagatgtct

SEQ ID NO: 5327396 - DNA, 13 bp, Homo sapiens
tgtatatagtttg

SEQ ID NO: 5327397 - DNA, 20 bp, Homo sapiens
tgtatatatacctgcgcttg

SEQ ID NO: 5327398 - DNA, 15 bp, Homo sapiens
tgtatatatatatat

SEQ ID NO: 5327399 - DNA, 15 bp, Homo sapiens
tgtatatatatatgt

SEQ ID NO: 5327400 - DNA, 18 bp, Homo sapiens
tgtatatatattctcagc

SEQ ID NO: 5327401 - DNA, 23 bp, Homo sapiens
tgtatatatatttatatatatga

SEQ ID NO: 5327402 - DNA, 18 bp, Homo sapiens
tgtatatatcttataact

SEQ ID NO: 5327403 - DNA, 21 bp, Homo sapiens
tgtatatatcttataactgtt

SEQ ID NO: 5327404 - DNA, 17 bp, Homo sapiens
tgtatatatgtatttct

SEQ ID NO: 5327405 - DNA, 13 bp, Homo sapiens
tgtatatatgtgt

SEQ ID NO: 5327406 - DNA, 18 bp, Homo sapiens
tgtatatatgtgtatata

SEQ ID NO: 5327407 - DNA, 18 bp, Homo sapiens
tgtatatatgtgtgccct

SEQ ID NO: 5327408 - DNA, 16 bp, Homo sapiens
tgtatctttattaaaa

SEQ ID NO: 5327409 - DNA, 14 bp, Homo sapiens
tgtatctttctatg

SEQ ID NO: 5327410 - DNA, 21 bp, Homo sapiens
tgtatctttctatgctgcttt

SEQ ID NO: 5327411 - DNA, 22 bp, Homo sapiens
tgtatctttgacaattctgggt

SEQ ID NO: 5327412 - DNA, 20 bp, Homo sapiens
tgtatctttggggaaactaa

SEQ ID NO: 5327413 - DNA, 20 bp, Homo sapiens
tgtatcttttattttcctgt

SEQ ID NO: 5327414 - DNA, 15 bp, Homo sapiens
tgtatgaaaatcctt

SEQ ID NO: 5327415 - DNA, 14 bp, Homo sapiens
tgtatgaaatatat

SEQ ID NO: 5327416 - DNA, 16 bp, Homo sapiens
tgtatgaaatatatgt

SEQ ID NO: 5327417 - DNA, 18 bp, Homo sapiens
tgtatgaaattataatct

SEQ ID NO: 5327418 - DNA, 21 bp, Homo sapiens
tgtatgaactctttaagttga

SEQ ID NO: 5327419 - DNA, 21 bp, Homo sapiens
tgtatgaagtacttttaacgt

SEQ ID NO: 5327420 - DNA, 20 bp, Homo sapiens
tgtatgaataaaaggctgga

SEQ ID NO: 5327421 - DNA, 12 bp, Homo sapiens
tgtatgaatttt

SEQ ID NO: 5327422 - DNA, 24 bp, Homo sapiens
tgtatgaattttgtaagtataaga

SEQ ID NO: 5327423 - DNA, 15 bp, Homo sapiens
tgtatgactaaagag

SEQ ID NO: 5327424 - DNA, 21 bp, Homo sapiens
tgtatgactaaagagagaatg

SEQ ID NO: 5327425 - DNA, 19 bp, Homo sapiens
tgtatgactgaagtaataa

SEQ ID NO: 5327426 - DNA, 16 bp, Homo sapiens
tgtatgactgcacatg

SEQ ID NO: 5327427 - DNA, 11 bp, Homo sapiens
tgtatgagaca

SEQ ID NO: 5327428 - DNA, 15 bp, Homo sapiens
tgtatgagactgtgt

SEQ ID NO: 5327429 - DNA, 21 bp, Homo sapiens
tgtatgagcagagcagttcaa

SEQ ID NO: 5327430 - DNA, 17 bp, Homo sapiens
tgtatgagtagccaggg

SEQ ID NO: 5327431 - DNA, 15 bp, Homo sapiens
tgtatgagtgtatgt

SEQ ID NO: 5327432 - DNA, 15 bp, Homo sapiens
tgtatgagttgcatt

SEQ ID NO: 5327433 - DNA, 22 bp, Homo sapiens
tgtatgagttgcatttgtaaaa

SEQ ID NO: 5327434 - DNA, 16 bp, Homo sapiens
tgtatgatctctctag

SEQ ID NO: 5327435 - DNA, 22 bp, Homo sapiens
tgtatgattactggcctttttc

SEQ ID NO: 5327436 - DNA, 15 bp, Homo sapiens
tgtatgatttataaa

SEQ ID NO: 5327437 - DNA, 19 bp, Homo sapiens
tgtatgatttgttttgaat

SEQ ID NO: 5327438 - DNA, 19 bp, Homo sapiens
tgtatgcaagcagtttcaa

SEQ ID NO: 5327439 - DNA, 15 bp, Homo sapiens
tgtatgcacacacat

SEQ ID NO: 5327440 - DNA, 18 bp, Homo sapiens
tgtatgcacgtgtgcaca

SEQ ID NO: 5327441 - DNA, 22 bp, Homo sapiens
tgtatgcagttttgtaaataag

SEQ ID NO: 5327442 - DNA, 22 bp, Homo sapiens
tgtatgcataataatcctgcaa

SEQ ID NO: 5327443 - DNA, 16 bp, Homo sapiens
tgtatgccaagtgaga

SEQ ID NO: 5327444 - DNA, 20 bp, Homo sapiens
tgtatgccaagtgagaagat

SEQ ID NO: 5327445 - DNA, 17 bp, Homo sapiens
tgtatgccatgtatgtt

SEQ ID NO: 5327446 - DNA, 14 bp, Homo sapiens
tgtatgcccaaaga

SEQ ID NO: 5327447 - DNA, 14 bp, Homo sapiens
tgtatgccttctgt

SEQ ID NO: 5327448 - DNA, 15 bp, Homo sapiens
tgtatgctaaatgag

SEQ ID NO: 5327449 - DNA, 18 bp, Homo sapiens
tgtatgctgcatgaaagc

SEQ ID NO: 5327450 - DNA, 12 bp, Homo sapiens
tgtatgctgctt

SEQ ID NO: 5327451 - DNA, 13 bp, Homo sapiens
tgtatgctgcttt

SEQ ID NO: 5327452 - DNA, 16 bp, Homo sapiens
tgtatgctgcttttct

SEQ ID NO: 5327453 - DNA, 16 bp, Homo sapiens
tgtatgctggtagcta

SEQ ID NO: 5327454 - DNA, 16 bp, Homo sapiens
tgtatgcttcatacag

SEQ ID NO: 5327455 - DNA, 19 bp, Homo sapiens
tgtatgcttcatacaggga

SEQ ID NO: 5327456 - DNA, 14 bp, Homo sapiens
tgtatgctttgaat

SEQ ID NO: 5327457 - DNA, 14 bp, Homo sapiens
tgtatggaaacact

SEQ ID NO: 5327458 - DNA, 23 bp, Homo sapiens
tgtatggaaataaatgtatcata

SEQ ID NO: 5327459 - DNA, 16 bp, Homo sapiens
tgtatggaaatgcacc

SEQ ID NO: 5327460 - DNA, 17 bp, Homo sapiens
tgtatggaatacagtgt

SEQ ID NO: 5327461 - DNA, 19 bp, Homo sapiens
tgtatggaatcccactgta

SEQ ID NO: 5327462 - DNA, 14 bp, Homo sapiens
tgtatggatatatt

SEQ ID NO: 5327463 - DNA, 16 bp, Homo sapiens
tgtatggatatatttg

SEQ ID NO: 5327464 - DNA, 16 bp, Homo sapiens
tgtatggcatgacaac

SEQ ID NO: 5327465 - DNA, 15 bp, Homo sapiens
tgtatggccaggaag

SEQ ID NO: 5327466 - DNA, 13 bp, Homo sapiens
tgtatggcccagg

SEQ ID NO: 5327467 - DNA, 15 bp, Homo sapiens
tgtatggcccaggca

SEQ ID NO: 5327468 - DNA, 17 bp, Homo sapiens
tgtatggcccaggcagc

SEQ ID NO: 5327469 - DNA, 16 bp, Homo sapiens
tgtatggctctcaagt

SEQ ID NO: 5327470 - DNA, 19 bp, Homo sapiens
tgtatgggagatggcagca

SEQ ID NO: 5327471 - DNA, 19 bp, Homo sapiens
tgtatgggattggtgggct

SEQ ID NO: 5327472 - DNA, 21 bp, Homo sapiens
tgtatgggattggtgggctga

SEQ ID NO: 5327473 - DNA, 21 bp, Homo sapiens
tgtatgggggagattgaactt

SEQ ID NO: 5327474 - DNA, 22 bp, Homo sapiens
tgtatggtccatagcactgtat

SEQ ID NO: 5327475 - DNA, 22 bp, Homo sapiens
tgtatggttactaaaaagtacc

SEQ ID NO: 5327476 - DNA, 15 bp, Homo sapiens
tgtatggttctgtgc

SEQ ID NO: 5327477 - DNA, 21 bp, Homo sapiens
tgtatggtttttgagatatta

SEQ ID NO: 5327478 - DNA, 22 bp, Homo sapiens
tgtatggtttttgagatattaa

SEQ ID NO: 5327479 - DNA, 15 bp, Homo sapiens
tgtatgtaaagttaa

SEQ ID NO: 5327480 - DNA, 12 bp, Homo sapiens
tgtatgtaaata

SEQ ID NO: 5327481 - DNA, 14 bp, Homo sapiens
tgtatgtaaatgtg

SEQ ID NO: 5327482 - DNA, 19 bp, Homo sapiens
tgtatgtaacgatgttgta

SEQ ID NO: 5327483 - DNA, 19 bp, Homo sapiens
tgtatgtaagtaattgcat

SEQ ID NO: 5327484 - DNA, 13 bp, Homo sapiens
tgtatgtacaata

SEQ ID NO: 5327485 - DNA, 19 bp, Homo sapiens
tgtatgtacaatacaatgt

SEQ ID NO: 5327486 - DNA, 16 bp, Homo sapiens
tgtatgtatggaaaca

SEQ ID NO: 5327487 - DNA, 13 bp, Homo sapiens
tgtatgtatgtgt

SEQ ID NO: 5327488 - DNA, 14 bp, Homo sapiens
tgtatgtattatta

SEQ ID NO: 5327489 - DNA, 22 bp, Homo sapiens
tgtatgtcaaattgtgcaaaat

SEQ ID NO: 5327490 - DNA, 12 bp, Homo sapiens
tgtatgtcatgg

SEQ ID NO: 5327491 - DNA, 12 bp, Homo sapiens
tgtatgtccatt

SEQ ID NO: 5327492 - DNA, 20 bp, Homo sapiens
tgtatgtccattcactttca

SEQ ID NO: 5327493 - DNA, 22 bp, Homo sapiens
tgtatgtctgcaggtgtctgac

SEQ ID NO: 5327494 - DNA, 15 bp, Homo sapiens
tgtatgtcttaaaac

SEQ ID NO: 5327495 - DNA, 19 bp, Homo sapiens
tgtatgtgaaagtgtaaaa

SEQ ID NO: 5327496 - DNA, 23 bp, Homo sapiens
tgtatgtgagctgtaaaaatgtt

SEQ ID NO: 5327497 - DNA, 11 bp, Homo sapiens
tgtatgtgcac

SEQ ID NO: 5327498 - DNA, 19 bp, Homo sapiens
tgtatgtgcactgtcactt

SEQ ID NO: 5327499 - DNA, 17 bp, Homo sapiens
tgtatgtgcgtgtgtgc

SEQ ID NO: 5327500 - DNA, 13 bp, Homo sapiens
tgtatgtggaagt

SEQ ID NO: 5327501 - DNA, 14 bp, Homo sapiens
tgtatgtggaagta

SEQ ID NO: 5327502 - DNA, 20 bp, Homo sapiens
tgtatgtggatacagtcatt

SEQ ID NO: 5327503 - DNA, 21 bp, Homo sapiens
tgtatgtgggggtctgtgtgt

SEQ ID NO: 5327504 - DNA, 18 bp, Homo sapiens
tgtatgtggtatgtatat

SEQ ID NO: 5327505 - DNA, 11 bp, Homo sapiens
tgtatgtggtt

SEQ ID NO: 5327506 - DNA, 17 bp, Homo sapiens
tgtatgtgtaataaata

SEQ ID NO: 5327507 - DNA, 19 bp, Homo sapiens
tgtatgtgtcactgcatgg

SEQ ID NO: 5327508 - DNA, 19 bp, Homo sapiens
tgtatgtgtctcccaggtg

SEQ ID NO: 5327509 - DNA, 21 bp, Homo sapiens
tgtatgtgtctgctaatgtaa

SEQ ID NO: 5327510 - DNA, 11 bp, Homo sapiens
tgtatgtgtga

SEQ ID NO: 5327511 - DNA, 13 bp, Homo sapiens
tgtatgtgtgaaa

SEQ ID NO: 5327512 - DNA, 18 bp, Homo sapiens
tgtatgtgtgagtgtatg

SEQ ID NO: 5327513 - DNA, 17 bp, Homo sapiens
tgtatgtgtggctgtgg

SEQ ID NO: 5327514 - DNA, 17 bp, Homo sapiens
tgtatgtgtggtttcag

SEQ ID NO: 5327515 - DNA, 11 bp, Homo sapiens
tgtatgtgtgt

SEQ ID NO: 5327516 - DNA, 13 bp, Homo sapiens
tgtatgtgtgtga

SEQ ID NO: 5327517 - DNA, 21 bp, Homo sapiens
tgtatgtgtgtgtctgtgcgt

SEQ ID NO: 5327518 - DNA, 15 bp, Homo sapiens
tgtatgtgtttagaa

SEQ ID NO: 5327519 - DNA, 20 bp, Homo sapiens
tgtatgtgtttagaattgaa

SEQ ID NO: 5327520 - DNA, 19 bp, Homo sapiens
tgtatgtgtttataattgt

SEQ ID NO: 5327521 - DNA, 22 bp, Homo sapiens
tgtatgttaaagagaatgagtc

SEQ ID NO: 5327522 - DNA, 12 bp, Homo sapiens
tgtatgttaata

SEQ ID NO: 5327523 - DNA, 15 bp, Homo sapiens
tgtatgttatgatat

SEQ ID NO: 5327524 - DNA, 21 bp, Homo sapiens
tgtatgttattatattccgta

SEQ ID NO: 5327525 - DNA, 12 bp, Homo sapiens
tgtatgttgtac

SEQ ID NO: 5327526 - DNA, 14 bp, Homo sapiens
tgtatgttgtacaa

SEQ ID NO: 5327527 - DNA, 11 bp, Homo sapiens
tgtatgtttac

SEQ ID NO: 5327528 - DNA, 17 bp, Homo sapiens
tgtatgtttacactgtc

SEQ ID NO: 5327529 - DNA, 15 bp, Homo sapiens
tgtatgtttacatat

SEQ ID NO: 5327530 - DNA, 17 bp, Homo sapiens
tgtatgtttatgttaat

SEQ ID NO: 5327531 - DNA, 14 bp, Homo sapiens
tgtatgtttcttct

SEQ ID NO: 5327532 - DNA, 14 bp, Homo sapiens
tgtatgtttgcaca

SEQ ID NO: 5327533 - DNA, 22 bp, Homo sapiens
tgtatgtttgcacacttgtgtg

SEQ ID NO: 5327534 - DNA, 11 bp, Homo sapiens
tgtatgttttg

SEQ ID NO: 5327535 - DNA, 19 bp, Homo sapiens
tgtatgttttggtatctgt

SEQ ID NO: 5327536 - DNA, 17 bp, Homo sapiens
tgtatgtttttactgaa

SEQ ID NO: 5327537 - DNA, 13 bp, Homo sapiens
tgtatgtttttca

SEQ ID NO: 5327538 - DNA, 17 bp, Homo sapiens
tgtattaaaaaaaacaa

SEQ ID NO: 5327539 - DNA, 21 bp, Homo sapiens
tgtattaaaaaaaacaaaaag

SEQ ID NO: 5327540 - DNA, 14 bp, Homo sapiens
tgtattaaactttt

SEQ ID NO: 5327541 - DNA, 15 bp, Homo sapiens
tgtattaaagaaaaa

SEQ ID NO: 5327542 - DNA, 16 bp, Homo sapiens
tgtattaaagatgcag

SEQ ID NO: 5327543 - DNA, 24 bp, Homo sapiens
tgtattaaatcttaaacaatgtat

SEQ ID NO: 5327544 - DNA, 14 bp, Homo sapiens
tgtattaaattaca

SEQ ID NO: 5327545 - DNA, 17 bp, Homo sapiens
tgtattaaattacattt

SEQ ID NO: 5327546 - DNA, 15 bp, Homo sapiens
tgtattaacaaaagt

SEQ ID NO: 5327547 - DNA, 19 bp, Homo sapiens
tgtattaacaaaagttccc

SEQ ID NO: 5327548 - DNA, 14 bp, Homo sapiens
tgtattaacaaagt

SEQ ID NO: 5327549 - DNA, 16 bp, Homo sapiens
tgtattaacatgcaat

SEQ ID NO: 5327550 - DNA, 20 bp, Homo sapiens
tgtattaacatgcaataaca

SEQ ID NO: 5327551 - DNA, 17 bp, Homo sapiens
tgtattaactgaaacct

SEQ ID NO: 5327552 - DNA, 18 bp, Homo sapiens
tgtattaagccaaacatg

SEQ ID NO: 5327553 - DNA, 15 bp, Homo sapiens
tgtattaagctccag

SEQ ID NO: 5327554 - DNA, 16 bp, Homo sapiens
tgtattaagctccagt

SEQ ID NO: 5327555 - DNA, 17 bp, Homo sapiens
tgtattaagggcatttt

SEQ ID NO: 5327556 - DNA, 22 bp, Homo sapiens
tgtattaatccccatcattact

SEQ ID NO: 5327557 - DNA, 14 bp, Homo sapiens
tgtattaatctgtt

SEQ ID NO: 5327558 - DNA, 18 bp, Homo sapiens
tgtattaatctgtttgtg

SEQ ID NO: 5327559 - DNA, 14 bp, Homo sapiens
tgtattacagatgc

SEQ ID NO: 5327560 - DNA, 15 bp, Homo sapiens
tgtattacataaata

SEQ ID NO: 5327561 - DNA, 20 bp, Homo sapiens
tgtattacatgactgtttct

SEQ ID NO: 5327562 - DNA, 15 bp, Homo sapiens
tgtattaccagcccc

SEQ ID NO: 5327563 - DNA, 23 bp, Homo sapiens
tgtattactagaagatgaataca

SEQ ID NO: 5327564 - DNA, 23 bp, Homo sapiens
tgtattacttaggttattttgct

SEQ ID NO: 5327565 - DNA, 14 bp, Homo sapiens
tgtattactttaat

SEQ ID NO: 5327566 - DNA, 13 bp, Homo sapiens
tgtattagatgtt

SEQ ID NO: 5327567 - DNA, 19 bp, Homo sapiens
tgtattagtgatatttctc

SEQ ID NO: 5327568 - DNA, 20 bp, Homo sapiens
tgtattagtgatatttctct

SEQ ID NO: 5327569 - DNA, 22 bp, Homo sapiens
tgtattagtgatatttctctag

SEQ ID NO: 5327570 - DNA, 20 bp, Homo sapiens
tgtattataattgttgatat

SEQ ID NO: 5327571 - DNA, 21 bp, Homo sapiens
tgtattataattgttgatatt

SEQ ID NO: 5327572 - DNA, 22 bp, Homo sapiens
tgtattatagtactgctttact

SEQ ID NO: 5327573 - DNA, 17 bp, Homo sapiens
tgtattatcagtgaata

SEQ ID NO: 5327574 - DNA, 18 bp, Homo sapiens
tgtattatcatatatgct

SEQ ID NO: 5327575 - DNA, 20 bp, Homo sapiens
tgtattatgaaaaagattat

SEQ ID NO: 5327576 - DNA, 15 bp, Homo sapiens
tgtattatgtcctgt

SEQ ID NO: 5327577 - DNA, 13 bp, Homo sapiens
tgtattattgcaa

SEQ ID NO: 5327578 - DNA, 18 bp, Homo sapiens
tgtattatttcaccagca

SEQ ID NO: 5327579 - DNA, 21 bp, Homo sapiens
tgtattatttcattatgtaaa

SEQ ID NO: 5327580 - DNA, 14 bp, Homo sapiens
tgtattatttggag

SEQ ID NO: 5327581 - DNA, 16 bp, Homo sapiens
tgtattatttggagtt

SEQ ID NO: 5327582 - DNA, 17 bp, Homo sapiens
tgtattattttctatag

SEQ ID NO: 5327583 - DNA, 15 bp, Homo sapiens
tgtattcaaatttgt

SEQ ID NO: 5327584 - DNA, 14 bp, Homo sapiens
tgtattcagacaga

SEQ ID NO: 5327585 - DNA, 18 bp, Homo sapiens
tgtattcagacagatgag

SEQ ID NO: 5327586 - DNA, 13 bp, Homo sapiens
tgtattcagagcc

SEQ ID NO: 5327587 - DNA, 18 bp, Homo sapiens
tgtcaccaccttcccagc

SEQ ID NO: 5327588 - DNA, 19 bp, Homo sapiens
tgtcaccaccttcccagct

SEQ ID NO: 5327589 - DNA, 14 bp, Homo sapiens
tgtcaccactacag

SEQ ID NO: 5327590 - DNA, 14 bp, Homo sapiens
tgtcaccagagctt

SEQ ID NO: 5327591 - DNA, 22 bp, Homo sapiens
tgtcaccagcctgtttagccaa

SEQ ID NO: 5327592 - DNA, 14 bp, Homo sapiens
tgtcaccagctatc

SEQ ID NO: 5327593 - DNA, 19 bp, Homo sapiens
tgtcaccagctatctgtca

SEQ ID NO: 5327594 - DNA, 22 bp, Homo sapiens
tgtcaccagctgccaaaatcgt

SEQ ID NO: 5327595 - DNA, 21 bp, Homo sapiens
tgtcaccagctggtatattgt

SEQ ID NO: 5327596 - DNA, 18 bp, Homo sapiens
tgtcaccagttaaaagca

SEQ ID NO: 5327597 - DNA, 22 bp, Homo sapiens
tgtcacccaaagcctgtcccag

SEQ ID NO: 5327598 - DNA, 16 bp, Homo sapiens
tgtcacccaacctggc

SEQ ID NO: 5327599 - DNA, 22 bp, Homo sapiens
tgtcacccagactggagtgcag

SEQ ID NO: 5327600 - DNA, 16 bp, Homo sapiens
tgtcacccagcaaggc

SEQ ID NO: 5327601 - DNA, 14 bp, Homo sapiens
tgtcacccaggctg

SEQ ID NO: 5327602 - DNA, 16 bp, Homo sapiens
tgtcacccaggctgga

SEQ ID NO: 5327603 - DNA, 18 bp, Homo sapiens
tgtcacccaggctggagt

SEQ ID NO: 5327604 - DNA, 20 bp, Homo sapiens
tgtcaccccagagccacaca

SEQ ID NO: 5327605 - DNA, 14 bp, Homo sapiens
tgtcacccccactc

SEQ ID NO: 5327606 - DNA, 22 bp, Homo sapiens
tgtcaccctccacctcttcacc

SEQ ID NO: 5327607 - DNA, 18 bp, Homo sapiens
tgtcaccctgcagagcta

SEQ ID NO: 5327608 - DNA, 21 bp, Homo sapiens
tgtcaccctggccaccaccca

SEQ ID NO: 5327609 - DNA, 15 bp, Homo sapiens
tgtcaccctggcccc

SEQ ID NO: 5327610 - DNA, 21 bp, Homo sapiens
tgtcaccctgtgggtgtctcc

SEQ ID NO: 5327611 - DNA, 18 bp, Homo sapiens
tgtcaccggatcctgggt

SEQ ID NO: 5327612 - DNA, 17 bp, Homo sapiens
tgtcaccggccttgtga

SEQ ID NO: 5327613 - DNA, 16 bp, Homo sapiens
tgtcaccgtgagcagc

SEQ ID NO: 5327614 - DNA, 22 bp, Homo sapiens
tgtcaccgtgagcagctttgga

SEQ ID NO: 5327615 - DNA, 23 bp, Homo sapiens
tgtcaccgtgagcagctttggaa

SEQ ID NO: 5327616 - DNA, 22 bp, Homo sapiens
tgtcaccgtggaccttcctgcc

SEQ ID NO: 5327617 - DNA, 18 bp, Homo sapiens
tgtcacctagaacgtgca

SEQ ID NO: 5327618 - DNA, 13 bp, Homo sapiens
tgtcacctcaata

SEQ ID NO: 5327619 - DNA, 20 bp, Homo sapiens
tgtcacctcaatatttacta

SEQ ID NO: 5327620 - DNA, 14 bp, Homo sapiens
tgtcacctccttcc

SEQ ID NO: 5327621 - DNA, 20 bp, Homo sapiens
tgtcacctccttccccagct

SEQ ID NO: 5327622 - DNA, 17 bp, Homo sapiens
tgtcacctctctcagag

SEQ ID NO: 5327623 - DNA, 20 bp, Homo sapiens
tgtcacctctctcagagcat

SEQ ID NO: 5327624 - DNA, 14 bp, Homo sapiens
tgtcacctctctct

SEQ ID NO: 5327625 - DNA, 21 bp, Homo sapiens
tgtcacctctctctgaggaca

SEQ ID NO: 5327626 - DNA, 19 bp, Homo sapiens
tgtcacctgctcacaggga

SEQ ID NO: 5327627 - DNA, 22 bp, Homo sapiens
tgtcacctgctcacagggatgc

SEQ ID NO: 5327628 - DNA, 14 bp, Homo sapiens
tgtcacctggcctg

SEQ ID NO: 5327629 - DNA, 12 bp, Homo sapiens
tgtcacctggct

SEQ ID NO: 5327630 - DNA, 19 bp, Homo sapiens
tgtcacgaatatggacata

SEQ ID NO: 5327631 - DNA, 14 bp, Homo sapiens
tgtcacgagcccat

SEQ ID NO: 5327632 - DNA, 17 bp, Homo sapiens
tgtcacgagcccattct

SEQ ID NO: 5327633 - DNA, 23 bp, Homo sapiens
tgtcacgagcccattctcatgtt

SEQ ID NO: 5327634 - DNA, 15 bp, Homo sapiens
tgtcacgcaggctga

SEQ ID NO: 5327635 - DNA, 22 bp, Homo sapiens
tgtcacgctcatgtcctgtcct

SEQ ID NO: 5327636 - DNA, 13 bp, Homo sapiens
tgtcacgctctgg

SEQ ID NO: 5327637 - DNA, 15 bp, Homo sapiens
tgtcacgctctggtg

SEQ ID NO: 5327638 - DNA, 20 bp, Homo sapiens
tgtcacgctctggtgcagtc

SEQ ID NO: 5327639 - DNA, 18 bp, Homo sapiens
tgtcacggggttccctcc

SEQ ID NO: 5327640 - DNA, 19 bp, Homo sapiens
tgtcacgtcttgaaaagcc

SEQ ID NO: 5327641 - DNA, 17 bp, Homo sapiens
tgtcacgtgaaatattt

SEQ ID NO: 5327642 - DNA, 17 bp, Homo sapiens
tgtcacgtgaccctgtg

SEQ ID NO: 5327643 - DNA, 20 bp, Homo sapiens
tgtcacgttttgttttgtgc

SEQ ID NO: 5327644 - DNA, 15 bp, Homo sapiens
tgtcactaaagcagg

SEQ ID NO: 5327645 - DNA, 22 bp, Homo sapiens
tgtcactaagaatataaatatt

SEQ ID NO: 5327646 - DNA, 15 bp, Homo sapiens
tgtcactacaaaaat

SEQ ID NO: 5327647 - DNA, 19 bp, Homo sapiens
tgtcactacaaaaatacaa

SEQ ID NO: 5327648 - DNA, 20 bp, Homo sapiens
tgtcactacaaaaatacaat

SEQ ID NO: 5327649 - DNA, 22 bp, Homo sapiens
tgtcactactcacagtctcttt

SEQ ID NO: 5327650 - DNA, 12 bp, Homo sapiens
tgtcactactgg

SEQ ID NO: 5327651 - DNA, 17 bp, Homo sapiens
tgtcactactggtctgt

SEQ ID NO: 5327652 - DNA, 17 bp, Homo sapiens
tgtcactcaaggcggtg

SEQ ID NO: 5327653 - DNA, 13 bp, Homo sapiens
tgtcactcacaaa

SEQ ID NO: 5327654 - DNA, 15 bp, Homo sapiens
tgtcactcactgagg

SEQ ID NO: 5327655 - DNA, 17 bp, Homo sapiens
tgtcactcactgaggcc

SEQ ID NO: 5327656 - DNA, 19 bp, Homo sapiens
tgtcactcactgaggccat

SEQ ID NO: 5327657 - DNA, 13 bp, Homo sapiens
tgtcactcagctg

SEQ ID NO: 5327658 - DNA, 19 bp, Homo sapiens
tgtcactcagctgagaagg

SEQ ID NO: 5327659 - DNA, 16 bp, Homo sapiens
tgtcactcattgctga

SEQ ID NO: 5327660 - DNA, 21 bp, Homo sapiens
tgtcactcattgctgagcctc

SEQ ID NO: 5327661 - DNA, 22 bp, Homo sapiens
tgtcactcattgctgagcctct

SEQ ID NO: 5327662 - DNA, 23 bp, Homo sapiens
tgtcactccaaaccttactctga

SEQ ID NO: 5327663 - DNA, 15 bp, Homo sapiens
tgtcactctgcctct

SEQ ID NO: 5327664 - DNA, 23 bp, Homo sapiens
tgtcactctgcctctaaggccaa

SEQ ID NO: 5327665 - DNA, 12 bp, Homo sapiens
tgtcactgaagt

SEQ ID NO: 5327666 - DNA, 16 bp, Homo sapiens
tgtcactgaagtgatt

SEQ ID NO: 5327667 - DNA, 13 bp, Homo sapiens
tgtcactgatgga

SEQ ID NO: 5327668 - DNA, 10 bp, Homo sapiens
tgtcactgcc

SEQ ID NO: 5327669 - DNA, 18 bp, Homo sapiens
tgtcactgctgtaaagca

SEQ ID NO: 5327670 - DNA, 16 bp, Homo sapiens
tgtcactgcttttggc

SEQ ID NO: 5327671 - DNA, 19 bp, Homo sapiens
tgtcactgcttttggcctg

SEQ ID NO: 5327672 - DNA, 18 bp, Homo sapiens
tgtcactggaacctccct

SEQ ID NO: 5327673 - DNA, 14 bp, Homo sapiens
tgtcactggctgcc

SEQ ID NO: 5327674 - DNA, 19 bp, Homo sapiens
tgtcactggctgcctccac

SEQ ID NO: 5327675 - DNA, 14 bp, Homo sapiens
tgtcactggctggc

SEQ ID NO: 5327676 - DNA, 16 bp, Homo sapiens
tgtcactggctggctc

SEQ ID NO: 5327677 - DNA, 17 bp, Homo sapiens
tgtcactggctggctcc

SEQ ID NO: 5327678 - DNA, 21 bp, Homo sapiens
tgtcactggtagaccaaaata

SEQ ID NO: 5327679 - DNA, 18 bp, Homo sapiens
tgtcactgtccctcctgg

SEQ ID NO: 5327680 - DNA, 12 bp, Homo sapiens
tgtcactgtggt

SEQ ID NO: 5327681 - DNA, 16 bp, Homo sapiens
tgtcactgttataaat

SEQ ID NO: 5327682 - DNA, 18 bp, Homo sapiens
tgtcactgttataaattt

SEQ ID NO: 5327683 - DNA, 18 bp, Homo sapiens
tgtcactgtttctctgct

SEQ ID NO: 5327684 - DNA, 14 bp, Homo sapiens
tgtcacttactgtt

SEQ ID NO: 5327685 - DNA, 12 bp, Homo sapiens
tgtcacttattt

SEQ ID NO: 5327686 - DNA, 14 bp, Homo sapiens
tgtcacttcatatt

SEQ ID NO: 5327687 - DNA, 18 bp, Homo sapiens
tgtcacttcatattttat

SEQ ID NO: 5327688 - DNA, 18 bp, Homo sapiens
tgtcacttgcattccact

SEQ ID NO: 5327689 - DNA, 18 bp, Homo sapiens
tgtcacttgctgcttttt

SEQ ID NO: 5327690 - DNA, 21 bp, Homo sapiens
tgtcacttgctggctgtgaaa

SEQ ID NO: 5327691 - DNA, 15 bp, Homo sapiens
tgtcacttggtggcg

SEQ ID NO: 5327692 - DNA, 18 bp, Homo sapiens
tgtcacttgtcgggggcc

SEQ ID NO: 5327693 - DNA, 16 bp, Homo sapiens
tgtcactttctctctt

SEQ ID NO: 5327694 - DNA, 14 bp, Homo sapiens
tgtcactttgctct

SEQ ID NO: 5327695 - DNA, 18 bp, Homo sapiens
tgtcacttttccttttct

SEQ ID NO: 5327696 - DNA, 22 bp, Homo sapiens
tgtcacttttccttttcttaaa

SEQ ID NO: 5327697 - DNA, 15 bp, Homo sapiens
tgtcactttttgagg

SEQ ID NO: 5327698 - DNA, 17 bp, Homo sapiens
tgtcactttttgaggca

SEQ ID NO: 5327699 - DNA, 13 bp, Homo sapiens
tgtcacttttttc

SEQ ID NO: 5327700 - DNA, 19 bp, Homo sapiens
tgtcacttttttcctgtca

SEQ ID NO: 5327701 - DNA, 20 bp, Homo sapiens
tgtcagaaacaatgacatcc

SEQ ID NO: 5327702 - DNA, 23 bp, Homo sapiens
tgtcagaaacaatgacatccaga

SEQ ID NO: 5327703 - DNA, 16 bp, Homo sapiens
tgtcagaaaccagtta

SEQ ID NO: 5327704 - DNA, 17 bp, Homo sapiens
tgtcagaaaccctggtc

SEQ ID NO: 5327705 - DNA, 13 bp, Homo sapiens
tgtcagaagacac

SEQ ID NO: 5327706 - DNA, 21 bp, Homo sapiens
tgtcagaagacactaattcct

SEQ ID NO: 5327707 - DNA, 15 bp, Homo sapiens
tgtcagaagcctcca

SEQ ID NO: 5327708 - DNA, 18 bp, Homo sapiens
tgtcagaagcctccaagc

SEQ ID NO: 5327709 - DNA, 17 bp, Homo sapiens
tgtcagaagtgcagaat

SEQ ID NO: 5327710 - DNA, 20 bp, Homo sapiens
tgtcagaataaaaatgtggt

SEQ ID NO: 5327711 - DNA, 17 bp, Homo sapiens
tgtcagaatatgtatgt

SEQ ID NO: 5327712 - DNA, 15 bp, Homo sapiens
tgtcagaatattctt

SEQ ID NO: 5327713 - DNA, 18 bp, Homo sapiens
tgtcagaatcctttacat

SEQ ID NO: 5327714 - DNA, 15 bp, Homo sapiens
tgtcagaatggaatc

SEQ ID NO: 5327715 - DNA, 17 bp, Homo sapiens
tgtcagaatggaatcca

SEQ ID NO: 5327716 - DNA, 22 bp, Homo sapiens
tgtcagaatggaatccatctgt

SEQ ID NO: 5327717 - DNA, 11 bp, Homo sapiens
tgtcagaatgt

SEQ ID NO: 5327718 - DNA, 22 bp, Homo sapiens
tgtcagaattggcctcagtgta

SEQ ID NO: 5327719 - DNA, 13 bp, Homo sapiens
tgtcagacacaga

SEQ ID NO: 5327720 - DNA, 16 bp, Homo sapiens
tgtcagaccctggagg

SEQ ID NO: 5327721 - DNA, 20 bp, Homo sapiens
tgtcagacctatttgacata

SEQ ID NO: 5327722 - DNA, 12 bp, Homo sapiens
tgtcagacttta

SEQ ID NO: 5327723 - DNA, 18 bp, Homo sapiens
tgtcagagccaggctctg

SEQ ID NO: 5327724 - DNA, 20 bp, Homo sapiens
tgtcagagcccagcccagga

SEQ ID NO: 5327725 - DNA, 14 bp, Homo sapiens
tgtcagagcccagg

SEQ ID NO: 5327726 - DNA, 15 bp, Homo sapiens
tgtcagagcccaggg

SEQ ID NO: 5327727 - DNA, 21 bp, Homo sapiens
tgtcagagcctaccttcacca

SEQ ID NO: 5327728 - DNA, 22 bp, Homo sapiens
tgtcagagctatgttccctcca

SEQ ID NO: 5327729 - DNA, 12 bp, Homo sapiens
tgtcagagctgg

SEQ ID NO: 5327730 - DNA, 16 bp, Homo sapiens
tgtcagagctgggagt

SEQ ID NO: 5327731 - DNA, 20 bp, Homo sapiens
tgtcagagctgttataaatt

SEQ ID NO: 5327732 - DNA, 19 bp, Homo sapiens
tgtcagagctgttggcctc

SEQ ID NO: 5327733 - DNA, 15 bp, Homo sapiens
tgtcagaggacccca

SEQ ID NO: 5327734 - DNA, 20 bp, Homo sapiens
tgtcagagtaacatgccagc

SEQ ID NO: 5327735 - DNA, 15 bp, Homo sapiens
tgtcagagtgttgtt

SEQ ID NO: 5327736 - DNA, 19 bp, Homo sapiens
tgtcagataagtgtaaata

SEQ ID NO: 5327737 - DNA, 21 bp, Homo sapiens
tgtcagataatcggtgcagcg

SEQ ID NO: 5327738 - DNA, 21 bp, Homo sapiens
tgtcagatattttttcagaaa

SEQ ID NO: 5327739 - DNA, 20 bp, Homo sapiens
tgtcagatccaggagctcca

SEQ ID NO: 5327740 - DNA, 21 bp, Homo sapiens
tgtcagatccaggagctccag

SEQ ID NO: 5327741 - DNA, 21 bp, Homo sapiens
tgtcagatgagaacaaagctg

SEQ ID NO: 5327742 - DNA, 21 bp, Homo sapiens
tgtcagatgcccgagggaggg

SEQ ID NO: 5327743 - DNA, 16 bp, Homo sapiens
tgtcagattaaattac

SEQ ID NO: 5327744 - DNA, 19 bp, Homo sapiens
tgtcagattaaattacagc

SEQ ID NO: 5327745 - DNA, 17 bp, Homo sapiens
tgtcagattcctttccc

SEQ ID NO: 5327746 - DNA, 13 bp, Homo sapiens
tgtcagatttctg

SEQ ID NO: 5327747 - DNA, 16 bp, Homo sapiens
tgtcagatttctggtt

SEQ ID NO: 5327748 - DNA, 14 bp, Homo sapiens
tgtcagcaaaaagc

SEQ ID NO: 5327749 - DNA, 18 bp, Homo sapiens
tgtcagcaaaaagcaaaa

SEQ ID NO: 5327750 - DNA, 22 bp, Homo sapiens
tgtcagcaaaaagcaaaatcat

SEQ ID NO: 5327751 - DNA, 16 bp, Homo sapiens
tgtcagcagacacaca

SEQ ID NO: 5327752 - DNA, 12 bp, Homo sapiens
tgtcagcaggca

SEQ ID NO: 5327753 - DNA, 16 bp, Homo sapiens
tgtcagcagggactgt

SEQ ID NO: 5327754 - DNA, 20 bp, Homo sapiens
tgtcagcagttgctggtaaa

SEQ ID NO: 5327755 - DNA, 13 bp, Homo sapiens
tgtcagcatctga

SEQ ID NO: 5327756 - DNA, 15 bp, Homo sapiens
tgtcagcatctgacc

SEQ ID NO: 5327757 - DNA, 23 bp, Homo sapiens
tgtcagcatctgaccatctgtga

SEQ ID NO: 5327758 - DNA, 17 bp, Homo sapiens
tgtcagcatctggctgt

SEQ ID NO: 5327759 - DNA, 17 bp, Homo sapiens
tgtcagcatctttgccc

SEQ ID NO: 5327760 - DNA, 21 bp, Homo sapiens
tgtcagcatctttgcccttct

SEQ ID NO: 5327761 - DNA, 12 bp, Homo sapiens
tgtcagcatgaa

SEQ ID NO: 5327762 - DNA, 18 bp, Homo sapiens
tgtcagccaacattgcct

SEQ ID NO: 5327763 - DNA, 15 bp, Homo sapiens
tgtcagccactgtga

SEQ ID NO: 5327764 - DNA, 22 bp, Homo sapiens
tgtcagccatcgtcctgggact

SEQ ID NO: 5327765 - DNA, 21 bp, Homo sapiens
tgtcatggtgatgcaagtcac

SEQ ID NO: 5327766 - DNA, 15 bp, Homo sapiens
tgtcatggtgcaatt

SEQ ID NO: 5327767 - DNA, 16 bp, Homo sapiens
tgtcatggtgcaattt

SEQ ID NO: 5327768 - DNA, 18 bp, Homo sapiens
tgtcatgtacttcctgtg

SEQ ID NO: 5327769 - DNA, 22 bp, Homo sapiens
tgtcatgtacttcctgtgtact

SEQ ID NO: 5327770 - DNA, 16 bp, Homo sapiens
tgtcatgtctgcttgt

SEQ ID NO: 5327771 - DNA, 17 bp, Homo sapiens
tgtcatgtggaaactat

SEQ ID NO: 5327772 - DNA, 17 bp, Homo sapiens
tgtcatgtgtatgagaa

SEQ ID NO: 5327773 - DNA, 20 bp, Homo sapiens
tgtcatgtgtatgagaagta

SEQ ID NO: 5327774 - DNA, 16 bp, Homo sapiens
tgtcatgtgttccctt

SEQ ID NO: 5327775 - DNA, 20 bp, Homo sapiens
tgtcatgttatgcagtgaac

SEQ ID NO: 5327776 - DNA, 22 bp, Homo sapiens
tgtcatgttatgcagtgaacta

SEQ ID NO: 5327777 - DNA, 22 bp, Homo sapiens
tgtcattaaccatctttaatca

SEQ ID NO: 5327778 - DNA, 14 bp, Homo sapiens
tgtcattaatgtgt

SEQ ID NO: 5327779 - DNA, 19 bp, Homo sapiens
tgtcattagaattgaatta

SEQ ID NO: 5327780 - DNA, 13 bp, Homo sapiens
tgtcattagcctg

SEQ ID NO: 5327781 - DNA, 21 bp, Homo sapiens
tgtcattagcctgagtagaaa

SEQ ID NO: 5327782 - DNA, 16 bp, Homo sapiens
tgtcattagtcctttg

SEQ ID NO: 5327783 - DNA, 16 bp, Homo sapiens
tgtcattatattctaa

SEQ ID NO: 5327784 - DNA, 22 bp, Homo sapiens
tgtcattatattctaattaaaa

SEQ ID NO: 5327785 - DNA, 22 bp, Homo sapiens
tgtcattatgacatttcttaaa

SEQ ID NO: 5327786 - DNA, 12 bp, Homo sapiens
tgtcattatgta

SEQ ID NO: 5327787 - DNA, 20 bp, Homo sapiens
tgtcattatttattgttaaa

SEQ ID NO: 5327788 - DNA, 13 bp, Homo sapiens
tgtcattatttga

SEQ ID NO: 5327789 - DNA, 18 bp, Homo sapiens
tgtcattatttgataaca

SEQ ID NO: 5327790 - DNA, 15 bp, Homo sapiens
tgtcattcagaaaaa

SEQ ID NO: 5327791 - DNA, 19 bp, Homo sapiens
tgtcattcagagtcagcca

SEQ ID NO: 5327792 - DNA, 14 bp, Homo sapiens
tgtcattcagttct

SEQ ID NO: 5327793 - DNA, 22 bp, Homo sapiens
tgtcattcagttctaggccttt

SEQ ID NO: 5327794 - DNA, 23 bp, Homo sapiens
tgtcattcagttctaggcctttc

SEQ ID NO: 5327795 - DNA, 13 bp, Homo sapiens
tgtcattcatatg

SEQ ID NO: 5327796 - DNA, 23 bp, Homo sapiens
tgtcattcccctcttttgtcttc

SEQ ID NO: 5327797 - DNA, 21 bp, Homo sapiens
tgtcattcgtggttgatttca

SEQ ID NO: 5327798 - DNA, 17 bp, Homo sapiens
tgtcattctgcctgctc

SEQ ID NO: 5327799 - DNA, 16 bp, Homo sapiens
tgtcattctgctaatt

SEQ ID NO: 5327800 - DNA, 17 bp, Homo sapiens
tgtcattgcacataagc

SEQ ID NO: 5327801 - DNA, 21 bp, Homo sapiens
tgtcattgcacataagcttcc

SEQ ID NO: 5327802 - DNA, 16 bp, Homo sapiens
tgtcattgcccacttc

SEQ ID NO: 5327803 - DNA, 18 bp, Homo sapiens
tgtcattgcccacttctg

SEQ ID NO: 5327804 - DNA, 14 bp, Homo sapiens
tgtcattgctaaaa

SEQ ID NO: 5327805 - DNA, 16 bp, Homo sapiens
tgtcattgctggtcaa

SEQ ID NO: 5327806 - DNA, 17 bp, Homo sapiens
tgtcattggaagccatc

SEQ ID NO: 5327807 - DNA, 16 bp, Homo sapiens
tgtcattggttacaaa

SEQ ID NO: 5327808 - DNA, 22 bp, Homo sapiens
tgtcattggttacaaattttta

SEQ ID NO: 5327809 - DNA, 14 bp, Homo sapiens
tgtcattgtccagc

SEQ ID NO: 5327810 - DNA, 14 bp, Homo sapiens
tgtcattgtccatg

SEQ ID NO: 5327811 - DNA, 18 bp, Homo sapiens
tgtcattgtccatgccta

SEQ ID NO: 5327812 - DNA, 20 bp, Homo sapiens
tgtcattgtccatgcctaca

SEQ ID NO: 5327813 - DNA, 20 bp, Homo sapiens
tgtcattgtgtttgtgtgct

SEQ ID NO: 5327814 - DNA, 21 bp, Homo sapiens
tgtcatttactcaaaatctgt

SEQ ID NO: 5327815 - DNA, 20 bp, Homo sapiens
tgtcatttagttcagcatcc

SEQ ID NO: 5327816 - DNA, 15 bp, Homo sapiens
tgtcatttcattcca

SEQ ID NO: 5327817 - DNA, 20 bp, Homo sapiens
tgtcatttcattccattgcc

SEQ ID NO: 5327818 - DNA, 16 bp, Homo sapiens
tgtcatttcatttcct

SEQ ID NO: 5327819 - DNA, 13 bp, Homo sapiens
tgtcatttctcat

SEQ ID NO: 5327820 - DNA, 16 bp, Homo sapiens
tgtcatttctcatgga

SEQ ID NO: 5327821 - DNA, 17 bp, Homo sapiens
tgtcatttctctttcaa

SEQ ID NO: 5327822 - DNA, 18 bp, Homo sapiens
tgtcatttgactgtctca

SEQ ID NO: 5327823 - DNA, 21 bp, Homo sapiens
tgtcatttgagcagggctcag

SEQ ID NO: 5327824 - DNA, 13 bp, Homo sapiens
tgtcatttgttaa

SEQ ID NO: 5327825 - DNA, 15 bp, Homo sapiens
tgtcattttaaaatc

SEQ ID NO: 5327826 - DNA, 18 bp, Homo sapiens
tgtcattttaaaatctga

SEQ ID NO: 5327827 - DNA, 22 bp, Homo sapiens
tgtcattttaaaatctgattta

SEQ ID NO: 5327828 - DNA, 15 bp, Homo sapiens
tgtcattttatgaat

SEQ ID NO: 5327829 - DNA, 12 bp, Homo sapiens
tgtcattttcat

SEQ ID NO: 5327830 - DNA, 17 bp, Homo sapiens
tgtcattttgcactgta

SEQ ID NO: 5327831 - DNA, 21 bp, Homo sapiens
tgtcattttggcatctgcaaa

SEQ ID NO: 5327832 - DNA, 23 bp, Homo sapiens
tgtcatttttaatattactgtct

SEQ ID NO: 5327833 - DNA, 15 bp, Homo sapiens
tgtcatttttaatgt

SEQ ID NO: 5327834 - DNA, 14 bp, Homo sapiens
tgtcatttttcctt

SEQ ID NO: 5327835 - DNA, 21 bp, Homo sapiens
tgtcatttttgaatgcctcat

SEQ ID NO: 5327836 - DNA, 23 bp, Homo sapiens
tgtccaaaaccgccagctctgtt

SEQ ID NO: 5327837 - DNA, 16 bp, Homo sapiens
tgtccaaaatatttgt

SEQ ID NO: 5327838 - DNA, 24 bp, Homo sapiens
tgtccaaacaggtgctggcccagc

SEQ ID NO: 5327839 - DNA, 17 bp, Homo sapiens
tgtccaaaccagcaaac

SEQ ID NO: 5327840 - DNA, 14 bp, Homo sapiens
tgtccaaacccact

SEQ ID NO: 5327841 - DNA, 17 bp, Homo sapiens
tgtccaaactgcctaag

SEQ ID NO: 5327842 - DNA, 11 bp, Homo sapiens
tgtccaaagag

SEQ ID NO: 5327843 - DNA, 21 bp, Homo sapiens
tgtccaaagaggctgcccctc

SEQ ID NO: 5327844 - DNA, 20 bp, Homo sapiens
tgtccaaataaattcaataa

SEQ ID NO: 5327845 - DNA, 17 bp, Homo sapiens
tgtccaaatttaatgta

SEQ ID NO: 5327846 - DNA, 20 bp, Homo sapiens
tgtccaacaactccaggaaa

SEQ ID NO: 5327847 - DNA, 13 bp, Homo sapiens
tgtccaacaataa

SEQ ID NO: 5327848 - DNA, 18 bp, Homo sapiens
tgtccaacaataaacagg

SEQ ID NO: 5327849 - DNA, 18 bp, Homo sapiens
tgtccaacccctccccca

SEQ ID NO: 5327850 - DNA, 19 bp, Homo sapiens
tgtccaacccctcccccac

SEQ ID NO: 5327851 - DNA, 13 bp, Homo sapiens
tgtccaactctgt

SEQ ID NO: 5327852 - DNA, 23 bp, Homo sapiens
tgtccaactgagaagtaccttat

SEQ ID NO: 5327853 - DNA, 23 bp, Homo sapiens
tgtccaagaactctaaccagtgt

SEQ ID NO: 5327854 - DNA, 15 bp, Homo sapiens
tgtccaagaagccca

SEQ ID NO: 5327855 - DNA, 17 bp, Homo sapiens
tgtccaagaagcccagg

SEQ ID NO: 5327856 - DNA, 18 bp, Homo sapiens
tgtccaagaagcccagga

SEQ ID NO: 5327857 - DNA, 23 bp, Homo sapiens
tgtccaagacacatgctgaggtt

SEQ ID NO: 5327858 - DNA, 13 bp, Homo sapiens
tgtccaagacagg

SEQ ID NO: 5327859 - DNA, 22 bp, Homo sapiens
tgtccaagacagggctcatttt

SEQ ID NO: 5327860 - DNA, 14 bp, Homo sapiens
tgtccaaggaaact

SEQ ID NO: 5327861 - DNA, 20 bp, Homo sapiens
tgtccaagggccgtgccctt

SEQ ID NO: 5327862 - DNA, 23 bp, Homo sapiens
tgtccaagtacttaactatctgt

SEQ ID NO: 5327863 - DNA, 20 bp, Homo sapiens
tgtccaagttcttcacctct

SEQ ID NO: 5327864 - DNA, 22 bp, Homo sapiens
tgtccaagttcttcacctctat

SEQ ID NO: 5327865 - DNA, 21 bp, Homo sapiens
tgtccaatggctgtaaactat

SEQ ID NO: 5327866 - DNA, 12 bp, Homo sapiens
tgtccacaaatg

SEQ ID NO: 5327867 - DNA, 14 bp, Homo sapiens
tgtccacaaatgtc

SEQ ID NO: 5327868 - DNA, 17 bp, Homo sapiens
tgtccacaaatgtcctc

SEQ ID NO: 5327869 - DNA, 21 bp, Homo sapiens
tgtccacacaagacagcagag

SEQ ID NO: 5327870 - DNA, 15 bp, Homo sapiens
tgtccacacccagct

SEQ ID NO: 5327871 - DNA, 18 bp, Homo sapiens
tgtccacacccagctcag

SEQ ID NO: 5327872 - DNA, 14 bp, Homo sapiens
tgtccacagatgcc

SEQ ID NO: 5327873 - DNA, 18 bp, Homo sapiens
tgtccacagatgcctcca

SEQ ID NO: 5327874 - DNA, 20 bp, Homo sapiens
tgtccacagatgcctccacc

SEQ ID NO: 5327875 - DNA, 22 bp, Homo sapiens
tgtccacagtgattagcctcgt

SEQ ID NO: 5327876 - DNA, 20 bp, Homo sapiens
tgtccacatccccagagccc

SEQ ID NO: 5327877 - DNA, 22 bp, Homo sapiens
tgtccacatccccagagcccag

SEQ ID NO: 5327878 - DNA, 21 bp, Homo sapiens
tgtccacatctaacaaagtca

SEQ ID NO: 5327879 - DNA, 18 bp, Homo sapiens
tgtccacatctgcctcct

SEQ ID NO: 5327880 - DNA, 14 bp, Homo sapiens
tgtccacattctac

SEQ ID NO: 5327881 - DNA, 14 bp, Homo sapiens
tgtccaccagaccc

SEQ ID NO: 5327882 - DNA, 16 bp, Homo sapiens
tgtccaccatgctctc

SEQ ID NO: 5327883 - DNA, 23 bp, Homo sapiens
tgtccaccatgctctctcacctg

SEQ ID NO: 5327884 - DNA, 21 bp, Homo sapiens
tgtccacccacttagtccact

SEQ ID NO: 5327885 - DNA, 19 bp, Homo sapiens
tgtccacctgtgctgctgc

SEQ ID NO: 5327886 - DNA, 14 bp, Homo sapiens
tgtccacctgtggg

SEQ ID NO: 5327887 - DNA, 17 bp, Homo sapiens
tgtccaccttctgccaa

SEQ ID NO: 5327888 - DNA, 16 bp, Homo sapiens
tgtccacgactgtctc

SEQ ID NO: 5327889 - DNA, 19 bp, Homo sapiens
tgtccacgactgtctccat

SEQ ID NO: 5327890 - DNA, 20 bp, Homo sapiens
tgtccacggggctcactctg

SEQ ID NO: 5327891 - DNA, 23 bp, Homo sapiens
tgtccacggggctcactctggcc

SEQ ID NO: 5327892 - DNA, 15 bp, Homo sapiens
tgtccacgtacttaa

SEQ ID NO: 5327893 - DNA, 20 bp, Homo sapiens
tgtccacgtgtgtgtgtgat

SEQ ID NO: 5327894 - DNA, 18 bp, Homo sapiens
tgtccacgtttttggaaa

SEQ ID NO: 5327895 - DNA, 19 bp, Homo sapiens
tgtccactctgctcagggc

SEQ ID NO: 5327896 - DNA, 21 bp, Homo sapiens
tgtccactctgctcagggccg

SEQ ID NO: 5327897 - DNA, 13 bp, Homo sapiens
tgtccactgagac

SEQ ID NO: 5327898 - DNA, 22 bp, Homo sapiens
tgtccactgagactttcccctc

SEQ ID NO: 5327899 - DNA, 14 bp, Homo sapiens
tgtccactgttctg

SEQ ID NO: 5327900 - DNA, 18 bp, Homo sapiens
tgtccactgttctgttct

SEQ ID NO: 5327901 - DNA, 15 bp, Homo sapiens
tgtccacttaaaata

SEQ ID NO: 5327902 - DNA, 13 bp, Homo sapiens
tgtccacttgtgg

SEQ ID NO: 5327903 - DNA, 21 bp, Homo sapiens
tgtccacttgtgggtcctggg

SEQ ID NO: 5327904 - DNA, 18 bp, Homo sapiens
tgtccagaacaaaagata

SEQ ID NO: 5327905 - DNA, 23 bp, Homo sapiens
tgtccagaagagtcaaagtagtt

SEQ ID NO: 5327906 - DNA, 12 bp, Homo sapiens
tgtccagacagc

SEQ ID NO: 5327907 - DNA, 21 bp, Homo sapiens
tgtccagaccattgtcttcca

SEQ ID NO: 5327908 - DNA, 17 bp, Homo sapiens
tgtccagactgtgggtg

SEQ ID NO: 5327909 - DNA, 23 bp, Homo sapiens
tgtccagagagagaagtgcccct

SEQ ID NO: 5327910 - DNA, 23 bp, Homo sapiens
tgtccagagggactggacagcca

SEQ ID NO: 5327911 - DNA, 14 bp, Homo sapiens
tgtccagagtctct

SEQ ID NO: 5327912 - DNA, 15 bp, Homo sapiens
tgtccagataagtta

SEQ ID NO: 5327913 - DNA, 15 bp, Homo sapiens
tgtccagataattgg

SEQ ID NO: 5327914 - DNA, 16 bp, Homo sapiens
tgtccagcacagaagg

SEQ ID NO: 5327915 - DNA, 15 bp, Homo sapiens
tgtccagcaccttgt

SEQ ID NO: 5327916 - DNA, 11 bp, Homo sapiens
tgtccagcccc

SEQ ID NO: 5327917 - DNA, 24 bp, Homo sapiens
tgtccagccgtgtgtgcatgtgcc

SEQ ID NO: 5327918 - DNA, 19 bp, Homo sapiens
tgtccagcctgggcagcca

SEQ ID NO: 5327919 - DNA, 14 bp, Homo sapiens
tgtccagcgcctag

SEQ ID NO: 5327920 - DNA, 16 bp, Homo sapiens
tgtccagctccaacct

SEQ ID NO: 5327921 - DNA, 21 bp, Homo sapiens
tgtccagctgagcgccaggat

SEQ ID NO: 5327922 - DNA, 17 bp, Homo sapiens
tgtccagctgctgtcag

SEQ ID NO: 5327923 - DNA, 14 bp, Homo sapiens
tgtccagctgggac

SEQ ID NO: 5327924 - DNA, 14 bp, Homo sapiens
tgtccagctggggc

SEQ ID NO: 5327925 - DNA, 17 bp, Homo sapiens
tgtccagcttccaaagc

SEQ ID NO: 5327926 - DNA, 18 bp, Homo sapiens
tgtccagcttccaaagcc

SEQ ID NO: 5327927 - DNA, 21 bp, Homo sapiens
tgtccagcttccaaagcctag

SEQ ID NO: 5327928 - DNA, 19 bp, Homo sapiens
tgtccagcttctcttgaaa

SEQ ID NO: 5327929 - DNA, 18 bp, Homo sapiens
tgtccaggagaccttcca

SEQ ID NO: 5327930 - DNA, 20 bp, Homo sapiens
tgtccaggagccccgccagg

SEQ ID NO: 5327931 - DNA, 13 bp, Homo sapiens
tgtccaggcagct

SEQ ID NO: 5327932 - DNA, 21 bp, Homo sapiens
tgtccaggcagtagatcattt

SEQ ID NO: 5327933 - DNA, 14 bp, Homo sapiens
tgtccaggccactg

SEQ ID NO: 5327934 - DNA, 21 bp, Homo sapiens
tgtccaggccactgtggccag

SEQ ID NO: 5327935 - DNA, 21 bp, Homo sapiens
tgtccaggctctgggcacagt

SEQ ID NO: 5327936 - DNA, 20 bp, Homo sapiens
tgtccagggaaacagcctct

SEQ ID NO: 5327937 - DNA, 21 bp, Homo sapiens
tgtccagggaaacagcctctc

SEQ ID NO: 5327938 - DNA, 15 bp, Homo sapiens
tgtccagggcccatg

SEQ ID NO: 5327939 - DNA, 14 bp, Homo sapiens
tgtccagggcccca

SEQ ID NO: 5327940 - DNA, 17 bp, Homo sapiens
tgtccagggccctgagc

SEQ ID NO: 5327941 - DNA, 19 bp, Homo sapiens
tgtcccccctgtggtctgt

SEQ ID NO: 5327942 - DNA, 21 bp, Homo sapiens
tgtccccccttgaagcaataa

SEQ ID NO: 5327943 - DNA, 23 bp, Homo sapiens
tgtccccccttgaagcaataact

SEQ ID NO: 5327944 - DNA, 20 bp, Homo sapiens
tgtccccctcacccccacct

SEQ ID NO: 5327945 - DNA, 20 bp, Homo sapiens
tgtccccctgagatcagagt

SEQ ID NO: 5327946 - DNA, 23 bp, Homo sapiens
tgtccccggcggggtgcctgctg

SEQ ID NO: 5327947 - DNA, 13 bp, Homo sapiens
tgtcccctaggga

SEQ ID NO: 5327948 - DNA, 13 bp, Homo sapiens
tgtcccctatcct

SEQ ID NO: 5327949 - DNA, 14 bp, Homo sapiens
tgtcccctatcctc

SEQ ID NO: 5327950 - DNA, 22 bp, Homo sapiens
tgtcccctcaaactcattgcag

SEQ ID NO: 5327951 - DNA, 15 bp, Homo sapiens
tgtcccctcactctg

SEQ ID NO: 5327952 - DNA, 18 bp, Homo sapiens
tgtcccctcactctgtca

SEQ ID NO: 5327953 - DNA, 19 bp, Homo sapiens
tgtcccctccatctgggga

SEQ ID NO: 5327954 - DNA, 15 bp, Homo sapiens
tgtcccctcctcgcc

SEQ ID NO: 5327955 - DNA, 19 bp, Homo sapiens
tgtcccctccttccagcct

SEQ ID NO: 5327956 - DNA, 17 bp, Homo sapiens
tgtcccctctcccctca

SEQ ID NO: 5327957 - DNA, 14 bp, Homo sapiens
tgtcccctctgtca

SEQ ID NO: 5327958 - DNA, 14 bp, Homo sapiens
tgtcccctcttgac

SEQ ID NO: 5327959 - DNA, 21 bp, Homo sapiens
tgtcccctcttgccccaaccc

SEQ ID NO: 5327960 - DNA, 18 bp, Homo sapiens
tgtcccctgacagggcca

SEQ ID NO: 5327961 - DNA, 14 bp, Homo sapiens
tgtcccctgacctg

SEQ ID NO: 5327962 - DNA, 17 bp, Homo sapiens
tgtcccctgacctgtcc

SEQ ID NO: 5327963 - DNA, 14 bp, Homo sapiens
tgtcccctgcccca

SEQ ID NO: 5327964 - DNA, 18 bp, Homo sapiens
tgtcccctgccccagagg

SEQ ID NO: 5327965 - DNA, 13 bp, Homo sapiens
tgtcccctgcctg

SEQ ID NO: 5327966 - DNA, 14 bp, Homo sapiens
tgtcccctggggct

SEQ ID NO: 5327967 - DNA, 17 bp, Homo sapiens
tgtcccctggtgcccct

SEQ ID NO: 5327968 - DNA, 18 bp, Homo sapiens
tgtcccctggtgcccctc

SEQ ID NO: 5327969 - DNA, 19 bp, Homo sapiens
tgtcccctgtcccaccaac

SEQ ID NO: 5327970 - DNA, 11 bp, Homo sapiens
tgtccccttcc

SEQ ID NO: 5327971 - DNA, 12 bp, Homo sapiens
tgtccccttccc

SEQ ID NO: 5327972 - DNA, 14 bp, Homo sapiens
tgtccccttcccct

SEQ ID NO: 5327973 - DNA, 12 bp, Homo sapiens
tgtccccttcct

SEQ ID NO: 5327974 - DNA, 13 bp, Homo sapiens
tgtccccttcctg

SEQ ID NO: 5327975 - DNA, 11 bp, Homo sapiens
tgtccccttct

SEQ ID NO: 5327976 - DNA, 14 bp, Homo sapiens
tgtccccttctctc

SEQ ID NO: 5327977 - DNA, 16 bp, Homo sapiens
tgtcccgattgtaact

SEQ ID NO: 5327978 - DNA, 17 bp, Homo sapiens
tgtcccgattgtaactc

SEQ ID NO: 5327979 - DNA, 15 bp, Homo sapiens
tgtcccgccttcctc

SEQ ID NO: 5327980 - DNA, 22 bp, Homo sapiens
tgtcccgccttcctcctccaca

SEQ ID NO: 5327981 - DNA, 17 bp, Homo sapiens
tgtcccgcggtgctgac

SEQ ID NO: 5327982 - DNA, 19 bp, Homo sapiens
tgtcccggggtcctgtggc

SEQ ID NO: 5327983 - DNA, 19 bp, Homo sapiens
tgtcccgggtactcagtca

SEQ ID NO: 5327984 - DNA, 16 bp, Homo sapiens
tgtcccggtaccttcc

SEQ ID NO: 5327985 - DNA, 17 bp, Homo sapiens
tgtcccggtaccttcca

SEQ ID NO: 5327986 - DNA, 19 bp, Homo sapiens
tgtcccgtaaatcatattt

SEQ ID NO: 5327987 - DNA, 15 bp, Homo sapiens
tgtccctaaacatag

SEQ ID NO: 5327988 - DNA, 23 bp, Homo sapiens
tgtccctaagtaagtttcttcct

SEQ ID NO: 5327989 - DNA, 23 bp, Homo sapiens
tgtccctacaggaggaacagtgg

SEQ ID NO: 5327990 - DNA, 23 bp, Homo sapiens
tgtccctaccactgagcccttgc

SEQ ID NO: 5327991 - DNA, 15 bp, Homo sapiens
tgtccctacccactc

SEQ ID NO: 5327992 - DNA, 18 bp, Homo sapiens
tgtccctacccactcttt

SEQ ID NO: 5327993 - DNA, 21 bp, Homo sapiens
tgtccctaccgagtctcttct

SEQ ID NO: 5327994 - DNA, 15 bp, Homo sapiens
tgtccctactttctc

SEQ ID NO: 5327995 - DNA, 15 bp, Homo sapiens
tgtccctagctcaca

SEQ ID NO: 5327996 - DNA, 17 bp, Homo sapiens
tgtccctagctcacact

SEQ ID NO: 5327997 - DNA, 15 bp, Homo sapiens
tgtccctagggctct

SEQ ID NO: 5327998 - DNA, 14 bp, Homo sapiens
tgtccctaggtcag

SEQ ID NO: 5327999 - DNA, 22 bp, Homo sapiens
tgtccctatctattaaagtgac

SEQ ID NO: 5328000 - DNA, 17 bp, Homo sapiens
tgtccctatgcatatca

SEQ ID NO: 5328001 - DNA, 17 bp, Homo sapiens
tgtccctattctgccat

SEQ ID NO: 5328002 - DNA, 20 bp, Homo sapiens
tgtccctcactgccttccag

SEQ ID NO: 5328003 - DNA, 14 bp, Homo sapiens
tgtccctccaaggc

SEQ ID NO: 5328004 - DNA, 15 bp, Homo sapiens
tgtccctccaaggct

SEQ ID NO: 5328005 - DNA, 15 bp, Homo sapiens
tgtccctccaggccc

SEQ ID NO: 5328006 - DNA, 14 bp, Homo sapiens
tgtccctccaggga

SEQ ID NO: 5328007 - DNA, 12 bp, Homo sapiens
tgtccctcccac

SEQ ID NO: 5328008 - DNA, 17 bp, Homo sapiens
tgtccctcccactccct

SEQ ID NO: 5328009 - DNA, 15 bp, Homo sapiens
tgtccctcccttgct

SEQ ID NO: 5328010 - DNA, 14 bp, Homo sapiens
tgtccctcctgagg

SEQ ID NO: 5328011 - DNA, 16 bp, Homo sapiens
tgtccctcctggtgtc

SEQ ID NO: 5328012 - DNA, 22 bp, Homo sapiens
tgtccctcctggtgtcacccca

SEQ ID NO: 5328013 - DNA, 11 bp, Homo sapiens
tgtccctctca

SEQ ID NO: 5328014 - DNA, 17 bp, Homo sapiens
tgtccctctcactcccc

SEQ ID NO: 5328015 - DNA, 15 bp, Homo sapiens
tgtccctctccttgc

SEQ ID NO: 5328016 - DNA, 19 bp, Homo sapiens
tgtccctctccttgccccc

SEQ ID NO: 5328017 - DNA, 16 bp, Homo sapiens
tgtccctctctctgga

SEQ ID NO: 5328018 - DNA, 19 bp, Homo sapiens
tgtccctctgggccaatgc

SEQ ID NO: 5328019 - DNA, 16 bp, Homo sapiens
tgtccctcttcactcc

SEQ ID NO: 5328020 - DNA, 20 bp, Homo sapiens
tgtccctctttgcctgtgtg

SEQ ID NO: 5328021 - DNA, 23 bp, Homo sapiens
tgtccctgcacttgcagactcta

SEQ ID NO: 5328022 - DNA, 12 bp, Homo sapiens
tgtccctgcagg

SEQ ID NO: 5328023 - DNA, 13 bp, Homo sapiens
tgtccctgcaggg

SEQ ID NO: 5328024 - DNA, 22 bp, Homo sapiens
tgtccctgccaatgctccagct

SEQ ID NO: 5328025 - DNA, 11 bp, Homo sapiens
tgtccctgccc

SEQ ID NO: 5328026 - DNA, 17 bp, Homo sapiens
tgtccctgccccgcccc

SEQ ID NO: 5328027 - DNA, 23 bp, Homo sapiens
tgtccctgccccgccccccagag

SEQ ID NO: 5328028 - DNA, 15 bp, Homo sapiens
tgtccctgcctggcc

SEQ ID NO: 5328029 - DNA, 17 bp, Homo sapiens
tgtccctgcctggccct

SEQ ID NO: 5328030 - DNA, 18 bp, Homo sapiens
tgtccctgcgcctttcct

SEQ ID NO: 5328031 - DNA, 14 bp, Homo sapiens
tgtccctgctgggg

SEQ ID NO: 5328032 - DNA, 21 bp, Homo sapiens
tgtccctgctggggtctcagg

SEQ ID NO: 5328033 - DNA, 18 bp, Homo sapiens
tgtccctgctttctggta

SEQ ID NO: 5328034 - DNA, 22 bp, Homo sapiens
tgtccctggacacagctcttca

SEQ ID NO: 5328035 - DNA, 11 bp, Homo sapiens
tgtccctggat

SEQ ID NO: 5328036 - DNA, 12 bp, Homo sapiens
tgtccctggatg

SEQ ID NO: 5328037 - DNA, 22 bp, Homo sapiens
tgtccctggccatctctgaact

SEQ ID NO: 5328038 - DNA, 15 bp, Homo sapiens
tgtccctggcttcct

SEQ ID NO: 5328039 - DNA, 20 bp, Homo sapiens
tgtccctgggccagggtctg

SEQ ID NO: 5328040 - DNA, 18 bp, Homo sapiens
tgtccctggggcactccc

SEQ ID NO: 5328041 - DNA, 20 bp, Homo sapiens
tgtccctggggcactccccc

SEQ ID NO: 5328042 - DNA, 16 bp, Homo sapiens
tgtccctgtagctcag

SEQ ID NO: 5328043 - DNA, 18 bp, Homo sapiens
tgtccctgtagctcagtc

SEQ ID NO: 5328044 - DNA, 21 bp, Homo sapiens
tgtccctgtcaccaagctcac

SEQ ID NO: 5328045 - DNA, 13 bp, Homo sapiens
tgtccctgtcccc

SEQ ID NO: 5328046 - DNA, 18 bp, Homo sapiens
tgtccctgtccccaggcc

SEQ ID NO: 5328047 - DNA, 19 bp, Homo sapiens
tgtccctgtccccctcccc

SEQ ID NO: 5328048 - DNA, 15 bp, Homo sapiens
tgtccctgtccctgc

SEQ ID NO: 5328049 - DNA, 19 bp, Homo sapiens
tgtccctgtgggctcacac

SEQ ID NO: 5328050 - DNA, 18 bp, Homo sapiens
tgtccctgtttcaaactg

SEQ ID NO: 5328051 - DNA, 16 bp, Homo sapiens
tgtcccttaaacaaaa

SEQ ID NO: 5328052 - DNA, 15 bp, Homo sapiens
tgtcccttacctggc

SEQ ID NO: 5328053 - DNA, 17 bp, Homo sapiens
tgtcccttcacatagtt

SEQ ID NO: 5328054 - DNA, 17 bp, Homo sapiens
tgtcccttccacttcta

SEQ ID NO: 5328055 - DNA, 14 bp, Homo sapiens
tgtcccttccagga

SEQ ID NO: 5328056 - DNA, 12 bp, Homo sapiens
tgtcccttcccc

SEQ ID NO: 5328057 - DNA, 17 bp, Homo sapiens
tgtcccttcctttctcc

SEQ ID NO: 5328058 - DNA, 20 bp, Homo sapiens
tgtcccttctgtccctcaca

SEQ ID NO: 5328059 - DNA, 22 bp, Homo sapiens
tgtcccttgcctcaatgccagt

SEQ ID NO: 5328060 - DNA, 15 bp, Homo sapiens
tgtccctttcagaga

SEQ ID NO: 5328061 - DNA, 15 bp, Homo sapiens
tgtccctttccccta

SEQ ID NO: 5328062 - DNA, 22 bp, Homo sapiens
tgtccctttcccctagatccag

SEQ ID NO: 5328063 - DNA, 17 bp, Homo sapiens
tgtccctttcttggcca

SEQ ID NO: 5328064 - DNA, 19 bp, Homo sapiens
tgtcccttttaatataaaa

SEQ ID NO: 5328065 - DNA, 21 bp, Homo sapiens
tgtcccttttgcataagatta

SEQ ID NO: 5328066 - DNA, 14 bp, Homo sapiens
tgtcccttttgcta

SEQ ID NO: 5328067 - DNA, 22 bp, Homo sapiens
tgtccgaagaccgaattttatt

SEQ ID NO: 5328068 - DNA, 14 bp, Homo sapiens
tgtccgagctttga

SEQ ID NO: 5328069 - DNA, 19 bp, Homo sapiens
tgtccgatggtatctgggt

SEQ ID NO: 5328070 - DNA, 14 bp, Homo sapiens
tgtccgcaaggggt

SEQ ID NO: 5328071 - DNA, 17 bp, Homo sapiens
tgtccgcataagaaaaa

SEQ ID NO: 5328072 - DNA, 16 bp, Homo sapiens
tgtccgccatccaggg

SEQ ID NO: 5328073 - DNA, 20 bp, Homo sapiens
tgtccgccatccagggtctg

SEQ ID NO: 5328074 - DNA, 15 bp, Homo sapiens
tgtccgcctctgccc

SEQ ID NO: 5328075 - DNA, 18 bp, Homo sapiens
tgtccgctgtctccctcc

SEQ ID NO: 5328076 - DNA, 22 bp, Homo sapiens
tgtccggagcgaccctggctct

SEQ ID NO: 5328077 - DNA, 18 bp, Homo sapiens
tgtccggaggatattaaa

SEQ ID NO: 5328078 - DNA, 24 bp, Homo sapiens
tgtccggaggatattaaaatgcta

SEQ ID NO: 5328079 - DNA, 17 bp, Homo sapiens
tgtccggcccagtgcca

SEQ ID NO: 5328080 - DNA, 22 bp, Homo sapiens
tgtccggcccagtgccagctcc

SEQ ID NO: 5328081 - DNA, 22 bp, Homo sapiens
tgtccggtttccgtagcagttt

SEQ ID NO: 5328082 - DNA, 15 bp, Homo sapiens
tgtccgtccaccctt

SEQ ID NO: 5328083 - DNA, 18 bp, Homo sapiens
tgtccgtccacccttcca

SEQ ID NO: 5328084 - DNA, 19 bp, Homo sapiens
tgtccgtccacccttccat

SEQ ID NO: 5328085 - DNA, 22 bp, Homo sapiens
tgtccgtccacccttccatcag

SEQ ID NO: 5328086 - DNA, 15 bp, Homo sapiens
tgtccgtctgtcctg

SEQ ID NO: 5328087 - DNA, 18 bp, Homo sapiens
tgtccgtctgtcctgcgc

SEQ ID NO: 5328088 - DNA, 19 bp, Homo sapiens
tgtccgtgcttgctggtgc

SEQ ID NO: 5328089 - DNA, 17 bp, Homo sapiens
tgtccgtgtgcctcctg

SEQ ID NO: 5328090 - DNA, 16 bp, Homo sapiens
tgtccgttccaggagc

SEQ ID NO: 5328091 - DNA, 19 bp, Homo sapiens
tgtcctaaaaataggggcc

SEQ ID NO: 5328092 - DNA, 22 bp, Homo sapiens
tgtcctaaagaagacattttct

SEQ ID NO: 5328093 - DNA, 17 bp, Homo sapiens
tgtcctaagaacaatgc

SEQ ID NO: 5328094 - DNA, 16 bp, Homo sapiens
tgtcctaaggaacctt

SEQ ID NO: 5328095 - DNA, 19 bp, Homo sapiens
tgtcctaaggaaccttcct

SEQ ID NO: 5328096 - DNA, 16 bp, Homo sapiens
tgtcctaaggacacac

SEQ ID NO: 5328097 - DNA, 20 bp, Homo sapiens
tgtcctaaggacacactaat

SEQ ID NO: 5328098 - DNA, 22 bp, Homo sapiens
tgtcctaataatatcccactgg

SEQ ID NO: 5328099 - DNA, 20 bp, Homo sapiens
tgtcctaatctgctgccaga

SEQ ID NO: 5328100 - DNA, 16 bp, Homo sapiens
tgtcctaattcttctg

SEQ ID NO: 5328101 - DNA, 16 bp, Homo sapiens
tgtcctacagaaaaac

SEQ ID NO: 5328102 - DNA, 16 bp, Homo sapiens
tgtcctaccatcagct

SEQ ID NO: 5328103 - DNA, 20 bp, Homo sapiens
tgtcctacccaccctccttt

SEQ ID NO: 5328104 - DNA, 19 bp, Homo sapiens
tgtcctacctccactctct

SEQ ID NO: 5328105 - DNA, 15 bp, Homo sapiens
tgtcctacttctgac

SEQ ID NO: 5328106 - DNA, 16 bp, Homo sapiens
tgtcctagactccggg

SEQ ID NO: 5328107 - DNA, 15 bp, Homo sapiens
tgtcctagccaggtc

SEQ ID NO: 5328108 - DNA, 21 bp, Homo sapiens
tgtcctaggggccgagggaaa

SEQ ID NO: 5328109 - DNA, 15 bp, Homo sapiens
tgtcctatccctgga

SEQ ID NO: 5328110 - DNA, 13 bp, Homo sapiens
tgtcctatgaatg

SEQ ID NO: 5328111 - DNA, 14 bp, Homo sapiens
tgtcctatgcaata

SEQ ID NO: 5328112 - DNA, 15 bp, Homo sapiens
tgtcctatgcaataa

SEQ ID NO: 5328113 - DNA, 16 bp, Homo sapiens
tgtcctatgcaataaa

SEQ ID NO: 5328114 - DNA, 22 bp, Homo sapiens
tgtcctattactgatgtgtgca

SEQ ID NO: 5328115 - DNA, 15 bp, Homo sapiens
tgtcctcaaataagt

SEQ ID NO: 5328116 - DNA, 19 bp, Homo sapiens
tgtcctcaaccccaaatcc

SEQ ID NO: 5328117 - DNA, 22 bp, Homo sapiens
tgtcctcaagaagaaagtgttc

SEQ ID NO: 5328118 - DNA, 16 bp, Homo sapiens
tgtcctcacatgcaga

SEQ ID NO: 5328119 - DNA, 20 bp, Homo sapiens
tgtctaggcactgagcaggg

SEQ ID NO: 5328120 - DNA, 19 bp, Homo sapiens
tgtctaggcaggacctgtg

SEQ ID NO: 5328121 - DNA, 20 bp, Homo sapiens
tgtctagggcagagtatgtt

SEQ ID NO: 5328122 - DNA, 18 bp, Homo sapiens
tgtctagggtgtgattta

SEQ ID NO: 5328123 - DNA, 21 bp, Homo sapiens
tgtctagggtgttctgtactt

SEQ ID NO: 5328124 - DNA, 22 bp, Homo sapiens
tgtctagggtgttctgtactta

SEQ ID NO: 5328125 - DNA, 23 bp, Homo sapiens
tgtctaggtagagatattggaag

SEQ ID NO: 5328126 - DNA, 20 bp, Homo sapiens
tgtctaggtctcctcagggt

SEQ ID NO: 5328127 - DNA, 22 bp, Homo sapiens
tgtctagtaattgggaaaaaag

SEQ ID NO: 5328128 - DNA, 19 bp, Homo sapiens
tgtctagtagaacaatgta

SEQ ID NO: 5328129 - DNA, 21 bp, Homo sapiens
tgtctagtagaacaatgtaca

SEQ ID NO: 5328130 - DNA, 19 bp, Homo sapiens
tgtctagtgaggaagacaa

SEQ ID NO: 5328131 - DNA, 19 bp, Homo sapiens
tgtctagtttcccacattc

SEQ ID NO: 5328132 - DNA, 14 bp, Homo sapiens
tgtctagtttctca

SEQ ID NO: 5328133 - DNA, 15 bp, Homo sapiens
tgtctataaaagaaa

SEQ ID NO: 5328134 - DNA, 13 bp, Homo sapiens
tgtctataaatgg

SEQ ID NO: 5328135 - DNA, 18 bp, Homo sapiens
tgtctataatggaaacat

SEQ ID NO: 5328136 - DNA, 21 bp, Homo sapiens
tgtctataatggaaacattta

SEQ ID NO: 5328137 - DNA, 18 bp, Homo sapiens
tgtctatactacagtagt

SEQ ID NO: 5328138 - DNA, 21 bp, Homo sapiens
tgtctatatacacagacatgc

SEQ ID NO: 5328139 - DNA, 12 bp, Homo sapiens
tgtctatgaagt

SEQ ID NO: 5328140 - DNA, 16 bp, Homo sapiens
tgtctatgaagttgct

SEQ ID NO: 5328141 - DNA, 22 bp, Homo sapiens
tgtctatgaagttgctgtttat

SEQ ID NO: 5328142 - DNA, 23 bp, Homo sapiens
tgtctatgatgttgctgttcaca

SEQ ID NO: 5328143 - DNA, 17 bp, Homo sapiens
tgtctatgcagcctgct

SEQ ID NO: 5328144 - DNA, 14 bp, Homo sapiens
tgtctatgctccct

SEQ ID NO: 5328145 - DNA, 14 bp, Homo sapiens
tgtctatgggactc

SEQ ID NO: 5328146 - DNA, 15 bp, Homo sapiens
tgtctatgggactca

SEQ ID NO: 5328147 - DNA, 13 bp, Homo sapiens
tgtctatgtgtat

SEQ ID NO: 5328148 - DNA, 15 bp, Homo sapiens
tgtctatgtgtatat

SEQ ID NO: 5328149 - DNA, 21 bp, Homo sapiens
tgtctatgtgtatatattata

SEQ ID NO: 5328150 - DNA, 22 bp, Homo sapiens
tgtctattagttttctttgtaa

SEQ ID NO: 5328151 - DNA, 18 bp, Homo sapiens
tgtctattatcacattaa

SEQ ID NO: 5328152 - DNA, 21 bp, Homo sapiens
tgtctattatgtacaggacat

SEQ ID NO: 5328153 - DNA, 16 bp, Homo sapiens
tgtctattattatgaa

SEQ ID NO: 5328154 - DNA, 20 bp, Homo sapiens
tgtctattatttagaaatga

SEQ ID NO: 5328155 - DNA, 14 bp, Homo sapiens
tgtctattcagctt

SEQ ID NO: 5328156 - DNA, 17 bp, Homo sapiens
tgtctattccattccct

SEQ ID NO: 5328157 - DNA, 22 bp, Homo sapiens
tgtctattccattcccttcggc

SEQ ID NO: 5328158 - DNA, 21 bp, Homo sapiens
tgtctattccctggaattcac

SEQ ID NO: 5328159 - DNA, 18 bp, Homo sapiens
tgtctattctgagccttg

SEQ ID NO: 5328160 - DNA, 15 bp, Homo sapiens
tgtctattgtcacat

SEQ ID NO: 5328161 - DNA, 15 bp, Homo sapiens
tgtctatttctgctg

SEQ ID NO: 5328162 - DNA, 14 bp, Homo sapiens
tgtctatttgtctc

SEQ ID NO: 5328163 - DNA, 12 bp, Homo sapiens
tgtctattttaa

SEQ ID NO: 5328164 - DNA, 15 bp, Homo sapiens
tgtctattttaaaat

SEQ ID NO: 5328165 - DNA, 22 bp, Homo sapiens
tgtctattttaaaataaattag

SEQ ID NO: 5328166 - DNA, 13 bp, Homo sapiens
tgtctattttctt

SEQ ID NO: 5328167 - DNA, 17 bp, Homo sapiens
tgtctattttgtaactg

SEQ ID NO: 5328168 - DNA, 13 bp, Homo sapiens
tgtctatttttaa

SEQ ID NO: 5328169 - DNA, 20 bp, Homo sapiens
tgtctatttttaatgtttgt

SEQ ID NO: 5328170 - DNA, 19 bp, Homo sapiens
tgtctcaaaaaaaaaaaga

SEQ ID NO: 5328171 - DNA, 22 bp, Homo sapiens
tgtctcaaaaaccattacaaaa

SEQ ID NO: 5328172 - DNA, 13 bp, Homo sapiens
tgtctcaaaataa

SEQ ID NO: 5328173 - DNA, 21 bp, Homo sapiens
tgtctcaaaataaaaccagaa

SEQ ID NO: 5328174 - DNA, 21 bp, Homo sapiens
tgtctcaaacttcagatggga

SEQ ID NO: 5328175 - DNA, 16 bp, Homo sapiens
tgtctcaacgcctccc

SEQ ID NO: 5328176 - DNA, 19 bp, Homo sapiens
tgtctcaacgcctccccct

SEQ ID NO: 5328177 - DNA, 18 bp, Homo sapiens
tgtctcaagagggcactg

SEQ ID NO: 5328178 - DNA, 23 bp, Homo sapiens
tgtctcaagagggcactggtggc

SEQ ID NO: 5328179 - DNA, 21 bp, Homo sapiens
tgtctcaatagctccaagctg

SEQ ID NO: 5328180 - DNA, 14 bp, Homo sapiens
tgtctcaatgctca

SEQ ID NO: 5328181 - DNA, 15 bp, Homo sapiens
tgtctcaatgctcat

SEQ ID NO: 5328182 - DNA, 14 bp, Homo sapiens
tgtctcacactggc

SEQ ID NO: 5328183 - DNA, 17 bp, Homo sapiens
tgtctcacgattccagt

SEQ ID NO: 5328184 - DNA, 17 bp, Homo sapiens
tgtctcactaaagcatg

SEQ ID NO: 5328185 - DNA, 18 bp, Homo sapiens
tgtctcactcttctgtct

SEQ ID NO: 5328186 - DNA, 18 bp, Homo sapiens
tgtctcactgttctgcaa

SEQ ID NO: 5328187 - DNA, 20 bp, Homo sapiens
tgtctcactttactttcaag

SEQ ID NO: 5328188 - DNA, 16 bp, Homo sapiens
tgtctcacttttcatc

SEQ ID NO: 5328189 - DNA, 15 bp, Homo sapiens
tgtctcagagccttc

SEQ ID NO: 5328190 - DNA, 17 bp, Homo sapiens
tgtctcagcctcctcag

SEQ ID NO: 5328191 - DNA, 16 bp, Homo sapiens
tgtctcagcctcctga

SEQ ID NO: 5328192 - DNA, 17 bp, Homo sapiens
tgtctcagcctctgcca

SEQ ID NO: 5328193 - DNA, 19 bp, Homo sapiens
tgtctcaggaaaacagcta

SEQ ID NO: 5328194 - DNA, 19 bp, Homo sapiens
tgtctcaggctcaagtttt

SEQ ID NO: 5328195 - DNA, 17 bp, Homo sapiens
tgtctcaggtccctgca

SEQ ID NO: 5328196 - DNA, 17 bp, Homo sapiens
tgtctcagtccacctga

SEQ ID NO: 5328197 - DNA, 21 bp, Homo sapiens
tgtctcagtccatgaagatgt

SEQ ID NO: 5328198 - DNA, 22 bp, Homo sapiens
tgtctcagtccatgaagatgta

SEQ ID NO: 5328199 - DNA, 23 bp, Homo sapiens
tgtctcagtgattcgcttttggt

SEQ ID NO: 5328200 - DNA, 15 bp, Homo sapiens
tgtctcagtgctggt

SEQ ID NO: 5328201 - DNA, 13 bp, Homo sapiens
tgtctcatcccca

SEQ ID NO: 5328202 - DNA, 15 bp, Homo sapiens
tgtctcatcctcctg

SEQ ID NO: 5328203 - DNA, 15 bp, Homo sapiens
tgtctcatgttttat

SEQ ID NO: 5328204 - DNA, 20 bp, Homo sapiens
tgtctcatgttttatatgat

SEQ ID NO: 5328205 - DNA, 13 bp, Homo sapiens
tgtctcattctca

SEQ ID NO: 5328206 - DNA, 14 bp, Homo sapiens
tgtctcattgccag

SEQ ID NO: 5328207 - DNA, 23 bp, Homo sapiens
tgtctcattgccagtggtgtcca

SEQ ID NO: 5328208 - DNA, 23 bp, Homo sapiens
tgtctcattttaatgtaaagatt

SEQ ID NO: 5328209 - DNA, 17 bp, Homo sapiens
tgtctcattttgtatgt

SEQ ID NO: 5328210 - DNA, 21 bp, Homo sapiens
tgtctcattttgtatgtatgt

SEQ ID NO: 5328211 - DNA, 17 bp, Homo sapiens
tgtctccactaaatgag

SEQ ID NO: 5328212 - DNA, 13 bp, Homo sapiens
tgtctccactgtg

SEQ ID NO: 5328213 - DNA, 14 bp, Homo sapiens
tgtctccactgtgc

SEQ ID NO: 5328214 - DNA, 16 bp, Homo sapiens
tgtctccagaccccca

SEQ ID NO: 5328215 - DNA, 14 bp, Homo sapiens
tgtctccagctgat

SEQ ID NO: 5328216 - DNA, 16 bp, Homo sapiens
tgtctccagctgcctg

SEQ ID NO: 5328217 - DNA, 20 bp, Homo sapiens
tgtctccagctgcctgggcc

SEQ ID NO: 5328218 - DNA, 12 bp, Homo sapiens
tgtctccagctt

SEQ ID NO: 5328219 - DNA, 14 bp, Homo sapiens
tgtctccaggcagt

SEQ ID NO: 5328220 - DNA, 19 bp, Homo sapiens
tgtctccaggccatgatgg

SEQ ID NO: 5328221 - DNA, 15 bp, Homo sapiens
tgtctccaggtaact

SEQ ID NO: 5328222 - DNA, 22 bp, Homo sapiens
tgtctccaggtaactttgcttg

SEQ ID NO: 5328223 - DNA, 15 bp, Homo sapiens
tgtctccataatgcc

SEQ ID NO: 5328224 - DNA, 15 bp, Homo sapiens
tgtctccatgctgga

SEQ ID NO: 5328225 - DNA, 15 bp, Homo sapiens
tgtctccatggccct

SEQ ID NO: 5328226 - DNA, 11 bp, Homo sapiens
tgtctccattg

SEQ ID NO: 5328227 - DNA, 16 bp, Homo sapiens
tgtctccattgtgtga

SEQ ID NO: 5328228 - DNA, 12 bp, Homo sapiens
tgtctcccacac

SEQ ID NO: 5328229 - DNA, 22 bp, Homo sapiens
tgtctcccaccctttctgccag

SEQ ID NO: 5328230 - DNA, 10 bp, Homo sapiens
tgtctcccag

SEQ ID NO: 5328231 - DNA, 14 bp, Homo sapiens
tgtctcccagaact

SEQ ID NO: 5328232 - DNA, 14 bp, Homo sapiens
tgtctcccaggctg

SEQ ID NO: 5328233 - DNA, 17 bp, Homo sapiens
tgtctcccaggctgctg

SEQ ID NO: 5328234 - DNA, 21 bp, Homo sapiens
tgtctccccgaaagggacaca

SEQ ID NO: 5328235 - DNA, 21 bp, Homo sapiens
tgtctcccctaccaggctgta

SEQ ID NO: 5328236 - DNA, 20 bp, Homo sapiens
tgtctcccctttccccgcgt

SEQ ID NO: 5328237 - DNA, 13 bp, Homo sapiens
tgtctcccgcccc

SEQ ID NO: 5328238 - DNA, 23 bp, Homo sapiens
tgtctcccgtgcatgctctgcag

SEQ ID NO: 5328239 - DNA, 18 bp, Homo sapiens
tgtctccctcccctctca

SEQ ID NO: 5328240 - DNA, 20 bp, Homo sapiens
tgtctccctcccctctcaga

SEQ ID NO: 5328241 - DNA, 23 bp, Homo sapiens
tgtctccctcgggggctcttccc

SEQ ID NO: 5328242 - DNA, 17 bp, Homo sapiens
tgtctccctctttctca

SEQ ID NO: 5328243 - DNA, 15 bp, Homo sapiens
tgtctccctggccct

SEQ ID NO: 5328244 - DNA, 17 bp, Homo sapiens
tgtctccctggttgcct

SEQ ID NO: 5328245 - DNA, 22 bp, Homo sapiens
tgtctcctacctgctgctgcta

SEQ ID NO: 5328246 - DNA, 16 bp, Homo sapiens
tgtctcctactcctga

SEQ ID NO: 5328247 - DNA, 18 bp, Homo sapiens
tgtctcctactctgtgta

SEQ ID NO: 5328248 - DNA, 15 bp, Homo sapiens
tgtctcctactgagg

SEQ ID NO: 5328249 - DNA, 21 bp, Homo sapiens
tgtctcctcaagcctgtgggc

SEQ ID NO: 5328250 - DNA, 21 bp, Homo sapiens
tgtctcctctatcctgggctt

SEQ ID NO: 5328251 - DNA, 19 bp, Homo sapiens
tgtctcctctatggaagga

SEQ ID NO: 5328252 - DNA, 15 bp, Homo sapiens
tgtctcctctctctg

SEQ ID NO: 5328253 - DNA, 16 bp, Homo sapiens
tgtctcctctgtcagt

SEQ ID NO: 5328254 - DNA, 11 bp, Homo sapiens
tgtctcctgca

SEQ ID NO: 5328255 - DNA, 13 bp, Homo sapiens
tgtctcctgtctt

SEQ ID NO: 5328256 - DNA, 19 bp, Homo sapiens
tgtctcctgtttcagacca

SEQ ID NO: 5328257 - DNA, 17 bp, Homo sapiens
tgtctccttaagctgca

SEQ ID NO: 5328258 - DNA, 16 bp, Homo sapiens
tgtctccttcccactg

SEQ ID NO: 5328259 - DNA, 21 bp, Homo sapiens
tgtctccttcccactgtcctt

SEQ ID NO: 5328260 - DNA, 17 bp, Homo sapiens
tgtctcctttaagagct

SEQ ID NO: 5328261 - DNA, 20 bp, Homo sapiens
tgtctcgaaataatttttta

SEQ ID NO: 5328262 - DNA, 23 bp, Homo sapiens
tgtctcgccagaagactcctagg

SEQ ID NO: 5328263 - DNA, 20 bp, Homo sapiens
tgtctcgcgcgactgagaac

SEQ ID NO: 5328264 - DNA, 13 bp, Homo sapiens
tgtctcggcagag

SEQ ID NO: 5328265 - DNA, 18 bp, Homo sapiens
tgtctcgtggtaggactg

SEQ ID NO: 5328266 - DNA, 19 bp, Homo sapiens
tgtctcgtggtaggactgt

SEQ ID NO: 5328267 - DNA, 20 bp, Homo sapiens
tgtctcgtggtaggactgta

SEQ ID NO: 5328268 - DNA, 16 bp, Homo sapiens
tgtctcgtgtcagtaa

SEQ ID NO: 5328269 - DNA, 21 bp, Homo sapiens
tgtctcgtgtcagtaatttat

SEQ ID NO: 5328270 - DNA, 15 bp, Homo sapiens
tgtctcgttcctgtt

SEQ ID NO: 5328271 - DNA, 18 bp, Homo sapiens
tgtctcgtttgtgattct

SEQ ID NO: 5328272 - DNA, 14 bp, Homo sapiens
tgtctctaaaaaga

SEQ ID NO: 5328273 - DNA, 21 bp, Homo sapiens
tgtctctaaccattcaaatga

SEQ ID NO: 5328274 - DNA, 15 bp, Homo sapiens
tgtctctaacttatt

SEQ ID NO: 5328275 - DNA, 14 bp, Homo sapiens
tgtctctaattgat

SEQ ID NO: 5328276 - DNA, 20 bp, Homo sapiens
tgtctctacaaaaaaaatca

SEQ ID NO: 5328277 - DNA, 23 bp, Homo sapiens
tgtctctaccaaaaaaaggaagg

SEQ ID NO: 5328278 - DNA, 23 bp, Homo sapiens
tgtctctagaagtgccatctcaa

SEQ ID NO: 5328279 - DNA, 20 bp, Homo sapiens
tgtctctagcagtgagtact

SEQ ID NO: 5328280 - DNA, 22 bp, Homo sapiens
tgtctctagccgggccatgctt

SEQ ID NO: 5328281 - DNA, 22 bp, Homo sapiens
tgtctctagctgttctggacta

SEQ ID NO: 5328282 - DNA, 18 bp, Homo sapiens
tgtctctatcttgcatct

SEQ ID NO: 5328283 - DNA, 12 bp, Homo sapiens
tgtctctcatga

SEQ ID NO: 5328284 - DNA, 18 bp, Homo sapiens
tgtctctccagtgaaatg

SEQ ID NO: 5328285 - DNA, 17 bp, Homo sapiens
tgtctctccccctctgt

SEQ ID NO: 5328286 - DNA, 23 bp, Homo sapiens
tgtctctccctaccctcttctca

SEQ ID NO: 5328287 - DNA, 18 bp, Homo sapiens
tgtctctcctagcccctc

SEQ ID NO: 5328288 - DNA, 20 bp, Homo sapiens
tgtctctcctagcccctctc

SEQ ID NO: 5328289 - DNA, 16 bp, Homo sapiens
tgtctctcctgcccct

SEQ ID NO: 5328290 - DNA, 12 bp, Homo sapiens
tgtctctcctgg

SEQ ID NO: 5328291 - DNA, 20 bp, Homo sapiens
tgtctctcctggctgggcca

SEQ ID NO: 5328292 - DNA, 21 bp, Homo sapiens
tgtctctcctggctgggccat

SEQ ID NO: 5328293 - DNA, 22 bp, Homo sapiens
tgtctctccttgttgcccccaa

SEQ ID NO: 5328294 - DNA, 13 bp, Homo sapiens
tgtctctcctttt

SEQ ID NO: 5328295 - DNA, 15 bp, Homo sapiens
tgtctctccttttct

SEQ ID NO: 5328296 - DNA, 21 bp, Homo sapiens
tgtctctccttttcttttgtt

SEQ ID NO: 5328297 - DNA, 14 bp, Homo sapiens
tgtctctctcttct

SEQ ID NO: 5328298 - DNA, 13 bp, Homo sapiens
tgtctctctgggc

SEQ ID NO: 5328299 - DNA, 20 bp, Homo sapiens
tgtctctcttctcagagtgg

SEQ ID NO: 5328300 - DNA, 18 bp, Homo sapiens
tgtctctcttgtcacatg

SEQ ID NO: 5328301 - DNA, 17 bp, Homo sapiens
tgtctctgacaaagtgt

SEQ ID NO: 5328302 - DNA, 13 bp, Homo sapiens
tgtctctgagagt

SEQ ID NO: 5328303 - DNA, 17 bp, Homo sapiens
tgtctctgagccccctg

SEQ ID NO: 5328304 - DNA, 24 bp, Homo sapiens
tgtctctgagccccctgtgcccac

SEQ ID NO: 5328305 - DNA, 13 bp, Homo sapiens
tgtctctgaggac

SEQ ID NO: 5328306 - DNA, 12 bp, Homo sapiens
tgtctctgaggc

SEQ ID NO: 5328307 - DNA, 15 bp, Homo sapiens
tgtctctgataaaag

SEQ ID NO: 5328308 - DNA, 14 bp, Homo sapiens
tgtctctgatgcag

SEQ ID NO: 5328309 - DNA, 16 bp, Homo sapiens
tgtctctgcatctcat

SEQ ID NO: 5328310 - DNA, 20 bp, Homo sapiens
tgtctctgcatctcattgta

SEQ ID NO: 5328311 - DNA, 17 bp, Homo sapiens
tgtctctgccatgtggc

SEQ ID NO: 5328312 - DNA, 13 bp, Homo sapiens
tgtctctgcctcc

SEQ ID NO: 5328313 - DNA, 17 bp, Homo sapiens
tgtctctgcctccctca

SEQ ID NO: 5328314 - DNA, 14 bp, Homo sapiens
tgtctctgcctgga

SEQ ID NO: 5328315 - DNA, 16 bp, Homo sapiens
tgtctctgcctggagc

SEQ ID NO: 5328316 - DNA, 11 bp, Homo sapiens
tgtctctgctc

SEQ ID NO: 5328317 - DNA, 14 bp, Homo sapiens
tgtctctgctccta

SEQ ID NO: 5328318 - DNA, 14 bp, Homo sapiens
tgtctctgctcttg

SEQ ID NO: 5328319 - DNA, 11 bp, Homo sapiens
tgtctctgctt

SEQ ID NO: 5328320 - DNA, 22 bp, Homo sapiens
tgtctctggattatattatgaa

SEQ ID NO: 5328321 - DNA, 19 bp, Homo sapiens
tgtctctggctactccctg

SEQ ID NO: 5328322 - DNA, 16 bp, Homo sapiens
tgtctctgggccactt

SEQ ID NO: 5328323 - DNA, 13 bp, Homo sapiens
tgtctctgggcct

SEQ ID NO: 5328324 - DNA, 14 bp, Homo sapiens
tgtctctgggcctg

SEQ ID NO: 5328325 - DNA, 15 bp, Homo sapiens
tgtctctgggcctgt

SEQ ID NO: 5328326 - DNA, 16 bp, Homo sapiens
tgtctctgggctgagg

SEQ ID NO: 5328327 - DNA, 18 bp, Homo sapiens
tgtctctgggctgaggaa

SEQ ID NO: 5328328 - DNA, 23 bp, Homo sapiens
tgtctctgggcttggggcttcct

SEQ ID NO: 5328329 - DNA, 13 bp, Homo sapiens
tgtctctggggca

SEQ ID NO: 5328330 - DNA, 23 bp, Homo sapiens
tgtctctggggcagatccccact

SEQ ID NO: 5328331 - DNA, 14 bp, Homo sapiens
tgtctctgtactgt

SEQ ID NO: 5328332 - DNA, 15 bp, Homo sapiens
tgtctctgtagaagc

SEQ ID NO: 5328333 - DNA, 19 bp, Homo sapiens
tgtctctgtatatagctct

SEQ ID NO: 5328334 - DNA, 16 bp, Homo sapiens
tgtctctgtccctcac

SEQ ID NO: 5328335 - DNA, 19 bp, Homo sapiens
tgtctctgtccctcactgc

SEQ ID NO: 5328336 - DNA, 19 bp, Homo sapiens
tgtctctgtgtttgaagtt

SEQ ID NO: 5328337 - DNA, 12 bp, Homo sapiens
tgtctctgttca

SEQ ID NO: 5328338 - DNA, 14 bp, Homo sapiens
tgtctctgtttcct

SEQ ID NO: 5328339 - DNA, 15 bp, Homo sapiens
tgtctctgtttcctg

SEQ ID NO: 5328340 - DNA, 16 bp, Homo sapiens
tgtctctgtttcctga

SEQ ID NO: 5328341 - DNA, 18 bp, Homo sapiens
tgtctctgtttcctgaaa

SEQ ID NO: 5328342 - DNA, 12 bp, Homo sapiens
tgtctctgtttt

SEQ ID NO: 5328343 - DNA, 14 bp, Homo sapiens
tgtctcttacatct

SEQ ID NO: 5328344 - DNA, 21 bp, Homo sapiens
tgtctcttccatatgacctca

SEQ ID NO: 5328345 - DNA, 23 bp, Homo sapiens
tgtctcttcctctgcaggacaca

SEQ ID NO: 5328346 - DNA, 16 bp, Homo sapiens
tgtctcttcctctgtt

SEQ ID NO: 5328347 - DNA, 13 bp, Homo sapiens
tgtctcttctgag

SEQ ID NO: 5328348 - DNA, 15 bp, Homo sapiens
tgtctcttctgagga

SEQ ID NO: 5328349 - DNA, 12 bp, Homo sapiens
tgtctcttctgg

SEQ ID NO: 5328350 - DNA, 21 bp, Homo sapiens
tgtctcttgagcatcaatctt

SEQ ID NO: 5328351 - DNA, 23 bp, Homo sapiens
tgtctcttgcataagcctcaggc

SEQ ID NO: 5328352 - DNA, 23 bp, Homo sapiens
tgtctcttggaaatgttaagaaa

SEQ ID NO: 5328353 - DNA, 17 bp, Homo sapiens
tgtctcttgggaagcag

SEQ ID NO: 5328354 - DNA, 22 bp, Homo sapiens
tgtctcttgggaagcagtttca

SEQ ID NO: 5328355 - DNA, 21 bp, Homo sapiens
tgtctcttggtcctgctgcag

SEQ ID NO: 5328356 - DNA, 15 bp, Homo sapiens
tgtctcttgtagaag

SEQ ID NO: 5328357 - DNA, 17 bp, Homo sapiens
tgtctcttgttaaatga

SEQ ID NO: 5328358 - DNA, 22 bp, Homo sapiens
tgtctctttattataagtgaga

SEQ ID NO: 5328359 - DNA, 13 bp, Homo sapiens
tgtctctttcatg

SEQ ID NO: 5328360 - DNA, 12 bp, Homo sapiens
tgtctgaaaaat

SEQ ID NO: 5328361 - DNA, 19 bp, Homo sapiens
tgtctgaaaaatgcctgct

SEQ ID NO: 5328362 - DNA, 23 bp, Homo sapiens
tgtctgaaaaggaggggtacatt

SEQ ID NO: 5328363 - DNA, 17 bp, Homo sapiens
tgtctgaaaagggactg

SEQ ID NO: 5328364 - DNA, 15 bp, Homo sapiens
tgtctgaaacagaga

SEQ ID NO: 5328365 - DNA, 17 bp, Homo sapiens
tgtctgaaacagagaac

SEQ ID NO: 5328366 - DNA, 19 bp, Homo sapiens
tgtctgaaacatttcataa

SEQ ID NO: 5328367 - DNA, 15 bp, Homo sapiens
tgtctgaaattttct

SEQ ID NO: 5328368 - DNA, 14 bp, Homo sapiens
tgtctgaacaaaaa

SEQ ID NO: 5328369 - DNA, 19 bp, Homo sapiens
tgtctgaacaatctccaaa

SEQ ID NO: 5328370 - DNA, 13 bp, Homo sapiens
tgtctgaacccag

SEQ ID NO: 5328371 - DNA, 18 bp, Homo sapiens
tgtctgaacccaggcagc

SEQ ID NO: 5328372 - DNA, 22 bp, Homo sapiens
tgtctgaacccaggcagctggc

SEQ ID NO: 5328373 - DNA, 16 bp, Homo sapiens
tgtctgaacttgcatt

SEQ ID NO: 5328374 - DNA, 24 bp, Homo sapiens
tgtctgaagcccaaagcctgagga

SEQ ID NO: 5328375 - DNA, 18 bp, Homo sapiens
tgtctgaaggacacttcc

SEQ ID NO: 5328376 - DNA, 18 bp, Homo sapiens
tgtctgaagtacaaacat

SEQ ID NO: 5328377 - DNA, 16 bp, Homo sapiens
tgtctgaagtcactgc

SEQ ID NO: 5328378 - DNA, 19 bp, Homo sapiens
tgtctgaatattctagaac

SEQ ID NO: 5328379 - DNA, 16 bp, Homo sapiens
tgtctgaatcatgtct

SEQ ID NO: 5328380 - DNA, 18 bp, Homo sapiens
tgtctgaatcatgtctgt

SEQ ID NO: 5328381 - DNA, 23 bp, Homo sapiens
tgtctgaatcgagtgagacaaaa

SEQ ID NO: 5328382 - DNA, 16 bp, Homo sapiens
tgtctgaatgtattta

SEQ ID NO: 5328383 - DNA, 16 bp, Homo sapiens
tgtctgaattgagaaa

SEQ ID NO: 5328384 - DNA, 21 bp, Homo sapiens
tgtctgacacgcaagtgtgtg

SEQ ID NO: 5328385 - DNA, 22 bp, Homo sapiens
tgtctgacacgcaagtgtgtga

SEQ ID NO: 5328386 - DNA, 14 bp, Homo sapiens
tgtctgaccagaga

SEQ ID NO: 5328387 - DNA, 13 bp, Homo sapiens
tgtctgacctagc

SEQ ID NO: 5328388 - DNA, 13 bp, Homo sapiens
tgtctgactcagg

SEQ ID NO: 5328389 - DNA, 17 bp, Homo sapiens
tgtctgagacaggtgcc

SEQ ID NO: 5328390 - DNA, 18 bp, Homo sapiens
tgtctgagacaggtgcct

SEQ ID NO: 5328391 - DNA, 21 bp, Homo sapiens
tgtctgagatacgtctgtgac

SEQ ID NO: 5328392 - DNA, 16 bp, Homo sapiens
tgtctgagatgctggt

SEQ ID NO: 5328393 - DNA, 14 bp, Homo sapiens
tgtctgagcccaac

SEQ ID NO: 5328394 - DNA, 17 bp, Homo sapiens
tgtctgagcccaaccct

SEQ ID NO: 5328395 - DNA, 20 bp, Homo sapiens
tgtctgagccctcaaagtga

SEQ ID NO: 5328396 - DNA, 19 bp, Homo sapiens
tgtctgagccctgccctca

SEQ ID NO: 5328397 - DNA, 21 bp, Homo sapiens
tgtctgagccctgccctcact

SEQ ID NO: 5328398 - DNA, 21 bp, Homo sapiens
tgtctgaggagtaagtgtaca

SEQ ID NO: 5328399 - DNA, 16 bp, Homo sapiens
tgtctgaggcctcatc

SEQ ID NO: 5328400 - DNA, 14 bp, Homo sapiens
tgtctgagggacat

SEQ ID NO: 5328401 - DNA, 17 bp, Homo sapiens
tgtctgaggttctttcc

SEQ ID NO: 5328402 - DNA, 15 bp, Homo sapiens
tgtctgagtgaacct

SEQ ID NO: 5328403 - DNA, 21 bp, Homo sapiens
tgtctgagtgaacctgtataa

SEQ ID NO: 5328404 - DNA, 17 bp, Homo sapiens
tgtctgatgtgtgccca

SEQ ID NO: 5328405 - DNA, 18 bp, Homo sapiens
tgtctgatgtgtgcccag

SEQ ID NO: 5328406 - DNA, 15 bp, Homo sapiens
tgtctgatgtttgtt

SEQ ID NO: 5328407 - DNA, 12 bp, Homo sapiens
tgtctgattcta

SEQ ID NO: 5328408 - DNA, 19 bp, Homo sapiens
tgtctgattggctcaccca

SEQ ID NO: 5328409 - DNA, 16 bp, Homo sapiens
tgtctgatttaacact

SEQ ID NO: 5328410 - DNA, 14 bp, Homo sapiens
tgtctgcaacatgg

SEQ ID NO: 5328411 - DNA, 16 bp, Homo sapiens
tgtctgcaacatggat

SEQ ID NO: 5328412 - DNA, 15 bp, Homo sapiens
tgtctgcacagggtc

SEQ ID NO: 5328413 - DNA, 23 bp, Homo sapiens
tgtctgcagacaagtcttgctgt

SEQ ID NO: 5328414 - DNA, 16 bp, Homo sapiens
tgtctgcagccctgag

SEQ ID NO: 5328415 - DNA, 17 bp, Homo sapiens
tgtctgcagccctgaga

SEQ ID NO: 5328416 - DNA, 13 bp, Homo sapiens
tgtctgcagcctt

SEQ ID NO: 5328417 - DNA, 11 bp, Homo sapiens
tgtctgcagct

SEQ ID NO: 5328418 - DNA, 23 bp, Homo sapiens
tgtctgcagctcaagggctggca

SEQ ID NO: 5328419 - DNA, 16 bp, Homo sapiens
tgtctgcagctcctgg

SEQ ID NO: 5328420 - DNA, 13 bp, Homo sapiens
tgtctgcagctgt

SEQ ID NO: 5328421 - DNA, 18 bp, Homo sapiens
tgtctgcaggattgatta

SEQ ID NO: 5328422 - DNA, 13 bp, Homo sapiens
tgtctgcaggcca

SEQ ID NO: 5328423 - DNA, 23 bp, Homo sapiens
tgtctgcaggtgggctgctgagg

SEQ ID NO: 5328424 - DNA, 15 bp, Homo sapiens
tgtctgcaggtttct

SEQ ID NO: 5328425 - DNA, 16 bp, Homo sapiens
tgtctgccaatttttg

SEQ ID NO: 5328426 - DNA, 14 bp, Homo sapiens
tgtctgccacagag

SEQ ID NO: 5328427 - DNA, 15 bp, Homo sapiens
tgtctgccagccagc

SEQ ID NO: 5328428 - DNA, 18 bp, Homo sapiens
tgtctgccagccagcagc

SEQ ID NO: 5328429 - DNA, 14 bp, Homo sapiens
tgtctgccaggcac

SEQ ID NO: 5328430 - DNA, 19 bp, Homo sapiens
tgtctgcccaatgaataat

SEQ ID NO: 5328431 - DNA, 15 bp, Homo sapiens
tgtctgcctatgcac

SEQ ID NO: 5328432 - DNA, 19 bp, Homo sapiens
tgtctgcctcctgctttgg

SEQ ID NO: 5328433 - DNA, 16 bp, Homo sapiens
tgtctgccttactggt

SEQ ID NO: 5328434 - DNA, 17 bp, Homo sapiens
tgtctgccttcacaaat

SEQ ID NO: 5328435 - DNA, 18 bp, Homo sapiens
tgtctgccttcacaaatg

SEQ ID NO: 5328436 - DNA, 13 bp, Homo sapiens
tgtctgccttccc

SEQ ID NO: 5328437 - DNA, 23 bp, Homo sapiens
tgtctgcgaagtcctatggaaac

SEQ ID NO: 5328438 - DNA, 17 bp, Homo sapiens
tgtctgcgccgctgtgc

SEQ ID NO: 5328439 - DNA, 18 bp, Homo sapiens
tgtctgcgccgctgtgct

SEQ ID NO: 5328440 - DNA, 15 bp, Homo sapiens
tgtctgcgcctgaaa

SEQ ID NO: 5328441 - DNA, 17 bp, Homo sapiens
tgtctgcgcctgaaaag

SEQ ID NO: 5328442 - DNA, 17 bp, Homo sapiens
tgtctgctaaataaaca

SEQ ID NO: 5328443 - DNA, 18 bp, Homo sapiens
tgtctgctaaataaacat

SEQ ID NO: 5328444 - DNA, 16 bp, Homo sapiens
tgtctgctccagctct

SEQ ID NO: 5328445 - DNA, 17 bp, Homo sapiens
tgtctgctccagctctg

SEQ ID NO: 5328446 - DNA, 13 bp, Homo sapiens
tgtctgctcccaa

SEQ ID NO: 5328447 - DNA, 14 bp, Homo sapiens
tgtctgctctcatc

SEQ ID NO: 5328448 - DNA, 23 bp, Homo sapiens
tgtctgctctcatccattcctct

SEQ ID NO: 5328449 - DNA, 23 bp, Homo sapiens
tgtctgctgagttggcctggcca

SEQ ID NO: 5328450 - DNA, 15 bp, Homo sapiens
tgtctgctgcctcca

SEQ ID NO: 5328451 - DNA, 15 bp, Homo sapiens
tgtctgctgctccca

SEQ ID NO: 5328452 - DNA, 18 bp, Homo sapiens
tgtctgctgctgcctccc

SEQ ID NO: 5328453 - DNA, 11 bp, Homo sapiens
tgtctgctggt

SEQ ID NO: 5328454 - DNA, 22 bp, Homo sapiens
tgtctgctggtcacttcttctg

SEQ ID NO: 5328455 - DNA, 12 bp, Homo sapiens
tgtctgctgttg

SEQ ID NO: 5328456 - DNA, 13 bp, Homo sapiens
tgtctgcttctct

SEQ ID NO: 5328457 - DNA, 16 bp, Homo sapiens
tgtctgcttctctctc

SEQ ID NO: 5328458 - DNA, 21 bp, Homo sapiens
tgtctgcttgcatctgcacat

SEQ ID NO: 5328459 - DNA, 17 bp, Homo sapiens
tgtctggaagacgtggc

SEQ ID NO: 5328460 - DNA, 20 bp, Homo sapiens
tgtctggaagacgtggctct

SEQ ID NO: 5328461 - DNA, 14 bp, Homo sapiens
tgtctggaagctga

SEQ ID NO: 5328462 - DNA, 19 bp, Homo sapiens
tgtctggaatcccagctcc

SEQ ID NO: 5328463 - DNA, 11 bp, Homo sapiens
tgtctggagac

SEQ ID NO: 5328464 - DNA, 17 bp, Homo sapiens
tgtctggagcctgcagg

SEQ ID NO: 5328465 - DNA, 20 bp, Homo sapiens
tgtctggagtcccctcctcc

SEQ ID NO: 5328466 - DNA, 20 bp, Homo sapiens
tgtctggatcagtaaaatta

SEQ ID NO: 5328467 - DNA, 21 bp, Homo sapiens
tgtctggatcagtaaaattat

SEQ ID NO: 5328468 - DNA, 20 bp, Homo sapiens
tgtctggatccttcccaagg

SEQ ID NO: 5328469 - DNA, 19 bp, Homo sapiens
tgtctggattcccaggatg

SEQ ID NO: 5328470 - DNA, 18 bp, Homo sapiens
tgtctggcacagcctgca

SEQ ID NO: 5328471 - DNA, 20 bp, Homo sapiens
tgtctggcacagcctgcact

SEQ ID NO: 5328472 - DNA, 11 bp, Homo sapiens
tgtctggcaga

SEQ ID NO: 5328473 - DNA, 22 bp, Homo sapiens
tgtctggcaggctactctgccc

SEQ ID NO: 5328474 - DNA, 18 bp, Homo sapiens
tgtctggccagaaaaggc

SEQ ID NO: 5328475 - DNA, 14 bp, Homo sapiens
tgtctggccaggga

SEQ ID NO: 5328476 - DNA, 23 bp, Homo sapiens
tgtgaaaagcttaataaattcca

SEQ ID NO: 5328477 - DNA, 17 bp, Homo sapiens
tgtgaaaagtaaaacag

SEQ ID NO: 5328478 - DNA, 13 bp, Homo sapiens
tgtgaaaagtatc

SEQ ID NO: 5328479 - DNA, 17 bp, Homo sapiens
tgtgaaaatcaaataca

SEQ ID NO: 5328480 - DNA, 14 bp, Homo sapiens
tgtgaaaatgaata

SEQ ID NO: 5328481 - DNA, 17 bp, Homo sapiens
tgtgaaaatgaggagga

SEQ ID NO: 5328482 - DNA, 20 bp, Homo sapiens
tgtgaaaatgctttgaaaat

SEQ ID NO: 5328483 - DNA, 14 bp, Homo sapiens
tgtgaaaatgtgtt

SEQ ID NO: 5328484 - DNA, 13 bp, Homo sapiens
tgtgaaaattaca

SEQ ID NO: 5328485 - DNA, 20 bp, Homo sapiens
tgtgaaacaatgttgtccaa

SEQ ID NO: 5328486 - DNA, 19 bp, Homo sapiens
tgtgaaacactttgcctcc

SEQ ID NO: 5328487 - DNA, 13 bp, Homo sapiens
tgtgaaacagtgt

SEQ ID NO: 5328488 - DNA, 19 bp, Homo sapiens
tgtgaaacagttgctgtga

SEQ ID NO: 5328489 - DNA, 13 bp, Homo sapiens
tgtgaaacatgtt

SEQ ID NO: 5328490 - DNA, 13 bp, Homo sapiens
tgtgaaactaaaa

SEQ ID NO: 5328491 - DNA, 13 bp, Homo sapiens
tgtgaaactgaga

SEQ ID NO: 5328492 - DNA, 15 bp, Homo sapiens
tgtgaaactttcatt

SEQ ID NO: 5328493 - DNA, 12 bp, Homo sapiens
tgtgaaagaagt

SEQ ID NO: 5328494 - DNA, 17 bp, Homo sapiens
tgtgaaagataaatgat

SEQ ID NO: 5328495 - DNA, 12 bp, Homo sapiens
tgtgaaagatgc

SEQ ID NO: 5328496 - DNA, 16 bp, Homo sapiens
tgtgaaagatgcatgt

SEQ ID NO: 5328497 - DNA, 18 bp, Homo sapiens
tgtgaaaggaaagaggct

SEQ ID NO: 5328498 - DNA, 20 bp, Homo sapiens
tgtgaaaggaagctccactg

SEQ ID NO: 5328499 - DNA, 20 bp, Homo sapiens
tgtgaaagggagaagtgaca

SEQ ID NO: 5328500 - DNA, 18 bp, Homo sapiens
tgtgaaagtatgtgatat

SEQ ID NO: 5328501 - DNA, 21 bp, Homo sapiens
tgtgaaagtcagatgcccaga

SEQ ID NO: 5328502 - DNA, 22 bp, Homo sapiens
tgtgaaagtcagatgcccagag

SEQ ID NO: 5328503 - DNA, 17 bp, Homo sapiens
tgtgaaagttttgagta

SEQ ID NO: 5328504 - DNA, 18 bp, Homo sapiens
tgtgaaataaaacaggac

SEQ ID NO: 5328505 - DNA, 14 bp, Homo sapiens
tgtgaaatatcatc

SEQ ID NO: 5328506 - DNA, 22 bp, Homo sapiens
tgtgaaatcaccacattctgtc

SEQ ID NO: 5328507 - DNA, 15 bp, Homo sapiens
tgtgaaatctgtctt

SEQ ID NO: 5328508 - DNA, 14 bp, Homo sapiens
tgtgaaatctttca

SEQ ID NO: 5328509 - DNA, 15 bp, Homo sapiens
tgtgaaatctttcaa

SEQ ID NO: 5328510 - DNA, 12 bp, Homo sapiens
tgtgaaatgctt

SEQ ID NO: 5328511 - DNA, 15 bp, Homo sapiens
tgtgaaatgtaacat

SEQ ID NO: 5328512 - DNA, 18 bp, Homo sapiens
tgtgaaatgtaacatgaa

SEQ ID NO: 5328513 - DNA, 12 bp, Homo sapiens
tgtgaaattatt

SEQ ID NO: 5328514 - DNA, 16 bp, Homo sapiens
tgtgaaattcatttgt

SEQ ID NO: 5328515 - DNA, 13 bp, Homo sapiens
tgtgaaattccca

SEQ ID NO: 5328516 - DNA, 10 bp, Homo sapiens
tgtgaaattg

SEQ ID NO: 5328517 - DNA, 13 bp, Homo sapiens
tgtgaaattgcat

SEQ ID NO: 5328518 - DNA, 13 bp, Homo sapiens
tgtgaaattgtgt

SEQ ID NO: 5328519 - DNA, 18 bp, Homo sapiens
tgtgaaatttacagttac

SEQ ID NO: 5328520 - DNA, 14 bp, Homo sapiens
tgtgaaatttcatg

SEQ ID NO: 5328521 - DNA, 16 bp, Homo sapiens
tgtgaaatttcatgaa

SEQ ID NO: 5328522 - DNA, 18 bp, Homo sapiens
tgtgaacaatcagattag

SEQ ID NO: 5328523 - DNA, 13 bp, Homo sapiens
tgtgaacagcata

SEQ ID NO: 5328524 - DNA, 17 bp, Homo sapiens
tgtgaacagctttgtat

SEQ ID NO: 5328525 - DNA, 19 bp, Homo sapiens
tgtgaacagtacagtattt

SEQ ID NO: 5328526 - DNA, 20 bp, Homo sapiens
tgtgaacatgcctcctcctg

SEQ ID NO: 5328527 - DNA, 22 bp, Homo sapiens
tgtgaacatgccttatatttgt

SEQ ID NO: 5328528 - DNA, 14 bp, Homo sapiens
tgtgaacatggact

SEQ ID NO: 5328529 - DNA, 12 bp, Homo sapiens
tgtgaacattta

SEQ ID NO: 5328530 - DNA, 16 bp, Homo sapiens
tgtgaaccaaccccca

SEQ ID NO: 5328531 - DNA, 19 bp, Homo sapiens
tgtgaaccaccacacccag

SEQ ID NO: 5328532 - DNA, 14 bp, Homo sapiens
tgtgaacccaggac

SEQ ID NO: 5328533 - DNA, 16 bp, Homo sapiens
tgtgaacccaggacaa

SEQ ID NO: 5328534 - DNA, 21 bp, Homo sapiens
tgtgaacccaggacaagcatg

SEQ ID NO: 5328535 - DNA, 18 bp, Homo sapiens
tgtgaaccctggggcctg

SEQ ID NO: 5328536 - DNA, 22 bp, Homo sapiens
tgtgaaccctggggcctgactg

SEQ ID NO: 5328537 - DNA, 18 bp, Homo sapiens
tgtgaaccggctcccacc

SEQ ID NO: 5328538 - DNA, 16 bp, Homo sapiens
tgtgaacctacctgcc

SEQ ID NO: 5328539 - DNA, 22 bp, Homo sapiens
tgtgaacctacctgccttggag

SEQ ID NO: 5328540 - DNA, 19 bp, Homo sapiens
tgtgaacctgggcactccg

SEQ ID NO: 5328541 - DNA, 24 bp, Homo sapiens
tgtgaacctttgagctttcataga

SEQ ID NO: 5328542 - DNA, 12 bp, Homo sapiens
tgtgaacgctgt

SEQ ID NO: 5328543 - DNA, 17 bp, Homo sapiens
tgtgaacgctgtgatgc

SEQ ID NO: 5328544 - DNA, 20 bp, Homo sapiens
tgtgaactaaactttcacac

SEQ ID NO: 5328545 - DNA, 23 bp, Homo sapiens
tgtgaactaagttattgctgcat

SEQ ID NO: 5328546 - DNA, 22 bp, Homo sapiens
tgtgaactatatcagtagtgta

SEQ ID NO: 5328547 - DNA, 14 bp, Homo sapiens
tgtgaactatgttt

SEQ ID NO: 5328548 - DNA, 17 bp, Homo sapiens
tgtgaactattttgaag

SEQ ID NO: 5328549 - DNA, 20 bp, Homo sapiens
tgtgaactcaatctccaggg

SEQ ID NO: 5328550 - DNA, 20 bp, Homo sapiens
tgtgaactcagccaagcaca

SEQ ID NO: 5328551 - DNA, 18 bp, Homo sapiens
tgtgaactccatcattca

SEQ ID NO: 5328552 - DNA, 20 bp, Homo sapiens
tgtgaactctcccctcccca

SEQ ID NO: 5328553 - DNA, 18 bp, Homo sapiens
tgtgaactgaaattaaaa

SEQ ID NO: 5328554 - DNA, 23 bp, Homo sapiens
tgtgaactgaactctgacaacag

SEQ ID NO: 5328555 - DNA, 19 bp, Homo sapiens
tgtgaactgactttaagta

SEQ ID NO: 5328556 - DNA, 15 bp, Homo sapiens
tgtgaactgctttca

SEQ ID NO: 5328557 - DNA, 17 bp, Homo sapiens
tgtgaactgctttcaag

SEQ ID NO: 5328558 - DNA, 17 bp, Homo sapiens
tgtgaactgggcacaga

SEQ ID NO: 5328559 - DNA, 16 bp, Homo sapiens
tgtgaacttgaaattt

SEQ ID NO: 5328560 - DNA, 20 bp, Homo sapiens
tgtgaacttggggaacaagg

SEQ ID NO: 5328561 - DNA, 20 bp, Homo sapiens
tgtgaacttgtagctgtaaa

SEQ ID NO: 5328562 - DNA, 13 bp, Homo sapiens
tgtgaactttcat

SEQ ID NO: 5328563 - DNA, 19 bp, Homo sapiens
tgtgaagaaacatttatct

SEQ ID NO: 5328564 - DNA, 20 bp, Homo sapiens
tgtgaagaaacatttatctt

SEQ ID NO: 5328565 - DNA, 20 bp, Homo sapiens
tgtgaagaaagcctcagtga

SEQ ID NO: 5328566 - DNA, 14 bp, Homo sapiens
tgtgaagaaataag

SEQ ID NO: 5328567 - DNA, 16 bp, Homo sapiens
tgtgaagaagccctgt

SEQ ID NO: 5328568 - DNA, 17 bp, Homo sapiens
tgtgaagaagccctgtt

SEQ ID NO: 5328569 - DNA, 20 bp, Homo sapiens
tgtgaagaagccctgttctc

SEQ ID NO: 5328570 - DNA, 15 bp, Homo sapiens
tgtgaagaatttaga

SEQ ID NO: 5328571 - DNA, 14 bp, Homo sapiens
tgtgaagacactgt

SEQ ID NO: 5328572 - DNA, 23 bp, Homo sapiens
tgtgaagacactgtgcaggccca

SEQ ID NO: 5328573 - DNA, 17 bp, Homo sapiens
tgtgaagacccagcagg

SEQ ID NO: 5328574 - DNA, 14 bp, Homo sapiens
tgtgaagagaatgt

SEQ ID NO: 5328575 - DNA, 23 bp, Homo sapiens
tgtgaagagaatgtattctgtat

SEQ ID NO: 5328576 - DNA, 18 bp, Homo sapiens
tgtgaagagggagaagca

SEQ ID NO: 5328577 - DNA, 16 bp, Homo sapiens
tgtgaagatgtttgca

SEQ ID NO: 5328578 - DNA, 17 bp, Homo sapiens
tgtgaagcaaaaagatg

SEQ ID NO: 5328579 - DNA, 20 bp, Homo sapiens
tgtgaagcaaactctaaaat

SEQ ID NO: 5328580 - DNA, 22 bp, Homo sapiens
tgtgaagcacagaccccttcca

SEQ ID NO: 5328581 - DNA, 15 bp, Homo sapiens
tgtgaagcatttaca

SEQ ID NO: 5328582 - DNA, 21 bp, Homo sapiens
tgtgaagccaattcagacagg

SEQ ID NO: 5328583 - DNA, 12 bp, Homo sapiens
tgtgaagccacc

SEQ ID NO: 5328584 - DNA, 14 bp, Homo sapiens
tgtgaagccctgtt

SEQ ID NO: 5328585 - DNA, 20 bp, Homo sapiens
tgtgaagccgccagttcatc

SEQ ID NO: 5328586 - DNA, 22 bp, Homo sapiens
tgtgaagccgccagttcatctt

SEQ ID NO: 5328587 - DNA, 21 bp, Homo sapiens
tgtgaagcctgtcgtgttctc

SEQ ID NO: 5328588 - DNA, 12 bp, Homo sapiens
tgtgaagccttc

SEQ ID NO: 5328589 - DNA, 13 bp, Homo sapiens
tgtgaagccttcc

SEQ ID NO: 5328590 - DNA, 17 bp, Homo sapiens
tgtgaagctcacactga

SEQ ID NO: 5328591 - DNA, 16 bp, Homo sapiens
tgtgaaggacatgaga

SEQ ID NO: 5328592 - DNA, 13 bp, Homo sapiens
tgtgaaggacctt

SEQ ID NO: 5328593 - DNA, 18 bp, Homo sapiens
tgtgaaggaccttcactc

SEQ ID NO: 5328594 - DNA, 14 bp, Homo sapiens
tgtgaaggccatga

SEQ ID NO: 5328595 - DNA, 23 bp, Homo sapiens
tgtgaaggtgatttaagggccca

SEQ ID NO: 5328596 - DNA, 23 bp, Homo sapiens
tgtgaagtccttcacctcactga

SEQ ID NO: 5328597 - DNA, 16 bp, Homo sapiens
tgtgaagtgattgaca

SEQ ID NO: 5328598 - DNA, 18 bp, Homo sapiens
tgtgaagtgttgtggaga

SEQ ID NO: 5328599 - DNA, 22 bp, Homo sapiens
tgtgaagttacacaattaattg

SEQ ID NO: 5328600 - DNA, 13 bp, Homo sapiens
tgtgaagttagaa

SEQ ID NO: 5328601 - DNA, 14 bp, Homo sapiens
tgtgaagtttacat

SEQ ID NO: 5328602 - DNA, 15 bp, Homo sapiens
tgtgaagtttggaga

SEQ ID NO: 5328603 - DNA, 20 bp, Homo sapiens
tgtgaataaaaagaaagatt

SEQ ID NO: 5328604 - DNA, 21 bp, Homo sapiens
tgtgaataaagagggtgggtg

SEQ ID NO: 5328605 - DNA, 15 bp, Homo sapiens
tgtgaataaagccac

SEQ ID NO: 5328606 - DNA, 17 bp, Homo sapiens
tgtgaataatggcactg

SEQ ID NO: 5328607 - DNA, 17 bp, Homo sapiens
tgtgaatacaattaaag

SEQ ID NO: 5328608 - DNA, 16 bp, Homo sapiens
tgtgaatacattcttt

SEQ ID NO: 5328609 - DNA, 19 bp, Homo sapiens
tgtgaatacattctttgct

SEQ ID NO: 5328610 - DNA, 16 bp, Homo sapiens
tgtgaataccccaaga

SEQ ID NO: 5328611 - DNA, 18 bp, Homo sapiens
tgtgaatactgcttgaat

SEQ ID NO: 5328612 - DNA, 21 bp, Homo sapiens
tgtgaatactgcttgaataaa

SEQ ID NO: 5328613 - DNA, 16 bp, Homo sapiens
tgtgaatagcctggcc

SEQ ID NO: 5328614 - DNA, 17 bp, Homo sapiens
tgtgaatataaatgtgt

SEQ ID NO: 5328615 - DNA, 13 bp, Homo sapiens
tgtgaatatgaga

SEQ ID NO: 5328616 - DNA, 20 bp, Homo sapiens
tgtgaatatggacagttagc

SEQ ID NO: 5328617 - DNA, 22 bp, Homo sapiens
tgtgaatatggacagttagcat

SEQ ID NO: 5328618 - DNA, 20 bp, Homo sapiens
tgtgaatatggactcagttt

SEQ ID NO: 5328619 - DNA, 15 bp, Homo sapiens
tgtgaatatgtgtaa

SEQ ID NO: 5328620 - DNA, 19 bp, Homo sapiens
tgtgaatattgtggctccc

SEQ ID NO: 5328621 - DNA, 21 bp, Homo sapiens
tgtgaatattgtggctccctg

SEQ ID NO: 5328622 - DNA, 23 bp, Homo sapiens
tgtgaatatttccatatggattt

SEQ ID NO: 5328623 - DNA, 14 bp, Homo sapiens
tgtgaatattttca

SEQ ID NO: 5328624 - DNA, 17 bp, Homo sapiens
tgtgaatcaagggtcag

SEQ ID NO: 5328625 - DNA, 14 bp, Homo sapiens
tgtgaatcagaccc

SEQ ID NO: 5328626 - DNA, 15 bp, Homo sapiens
tgtgaatcagaccct

SEQ ID NO: 5328627 - DNA, 21 bp, Homo sapiens
tgtgaatccaggaggcagtgg

SEQ ID NO: 5328628 - DNA, 22 bp, Homo sapiens
tgtgaatccatgggtctggcta

SEQ ID NO: 5328629 - DNA, 22 bp, Homo sapiens
tgtgaatcgcaaggcctgtgct

SEQ ID NO: 5328630 - DNA, 20 bp, Homo sapiens
tgtgaatcggcgacggagca

SEQ ID NO: 5328631 - DNA, 14 bp, Homo sapiens
tgtgaatctatgct

SEQ ID NO: 5328632 - DNA, 15 bp, Homo sapiens
tgtgaatctgagagt

SEQ ID NO: 5328633 - DNA, 21 bp, Homo sapiens
tgtgaatctgcttttcctctg

SEQ ID NO: 5328634 - DNA, 17 bp, Homo sapiens
tgtgaatgaacactctt

SEQ ID NO: 5328635 - DNA, 20 bp, Homo sapiens
tgtgaatgcaggttttatca

SEQ ID NO: 5328636 - DNA, 12 bp, Homo sapiens
tgtgaatgcttc

SEQ ID NO: 5328637 - DNA, 15 bp, Homo sapiens
tgtgaatggaagcaa

SEQ ID NO: 5328638 - DNA, 14 bp, Homo sapiens
tgtgaatggaggca

SEQ ID NO: 5328639 - DNA, 16 bp, Homo sapiens
tgtgaatggattggat

SEQ ID NO: 5328640 - DNA, 13 bp, Homo sapiens
tgtgaatgtgagt

SEQ ID NO: 5328641 - DNA, 15 bp, Homo sapiens
tgtgaatgtgggcac

SEQ ID NO: 5328642 - DNA, 18 bp, Homo sapiens
tgtgaatgtgggcactgg

SEQ ID NO: 5328643 - DNA, 22 bp, Homo sapiens
tgtgaattaacacagtgtttca

SEQ ID NO: 5328644 - DNA, 13 bp, Homo sapiens
tgtgaattactaa

SEQ ID NO: 5328645 - DNA, 20 bp, Homo sapiens
tgtgaattattgacactgaa

SEQ ID NO: 5328646 - DNA, 21 bp, Homo sapiens
tgtgaattattgacactgaac

SEQ ID NO: 5328647 - DNA, 14 bp, Homo sapiens
tgtgaattcagatt

SEQ ID NO: 5328648 - DNA, 22 bp, Homo sapiens
tgtgaattcccaggttggcctg

SEQ ID NO: 5328649 - DNA, 14 bp, Homo sapiens
tgtgaattccttaa

SEQ ID NO: 5328650 - DNA, 19 bp, Homo sapiens
tgtgaattgaagtcatcat

SEQ ID NO: 5328651 - DNA, 12 bp, Homo sapiens
tgtgaatttcaa

SEQ ID NO: 5328652 - DNA, 14 bp, Homo sapiens
tgtgaatttcaaaa

SEQ ID NO: 5328653 - DNA, 17 bp, Homo sapiens
tgtgaatttcaaaaaaa

SEQ ID NO: 5328654 - DNA, 18 bp, Homo sapiens
tgtgaatttgccagagga

SEQ ID NO: 5328655 - DNA, 21 bp, Homo sapiens
tgtgatcccagctcactgcag

SEQ ID NO: 5328656 - DNA, 22 bp, Homo sapiens
tgtgatccggtttctttttgct

SEQ ID NO: 5328657 - DNA, 19 bp, Homo sapiens
tgtgatccttggtgctgtg

SEQ ID NO: 5328658 - DNA, 17 bp, Homo sapiens
tgtgatccttttatgtt

SEQ ID NO: 5328659 - DNA, 18 bp, Homo sapiens
tgtgatctattactctga

SEQ ID NO: 5328660 - DNA, 13 bp, Homo sapiens
tgtgatctgggaa

SEQ ID NO: 5328661 - DNA, 16 bp, Homo sapiens
tgtgatctgtccttcc

SEQ ID NO: 5328662 - DNA, 14 bp, Homo sapiens
tgtgatctgtcttg

SEQ ID NO: 5328663 - DNA, 19 bp, Homo sapiens
tgtgatctgtcttgtaata

SEQ ID NO: 5328664 - DNA, 20 bp, Homo sapiens
tgtgatctgtcttgtaatat

SEQ ID NO: 5328665 - DNA, 16 bp, Homo sapiens
tgtgatgaaatatgaa

SEQ ID NO: 5328666 - DNA, 17 bp, Homo sapiens
tgtgatgaataaaataa

SEQ ID NO: 5328667 - DNA, 16 bp, Homo sapiens
tgtgatgaatctacat

SEQ ID NO: 5328668 - DNA, 17 bp, Homo sapiens
tgtgatgaatctacatt

SEQ ID NO: 5328669 - DNA, 18 bp, Homo sapiens
tgtgatgacaactggaat

SEQ ID NO: 5328670 - DNA, 14 bp, Homo sapiens
tgtgatgagctgat

SEQ ID NO: 5328671 - DNA, 14 bp, Homo sapiens
tgtgatgaggggag

SEQ ID NO: 5328672 - DNA, 22 bp, Homo sapiens
tgtgatgatgaaatgaggtcag

SEQ ID NO: 5328673 - DNA, 16 bp, Homo sapiens
tgtgatgatgtaattg

SEQ ID NO: 5328674 - DNA, 16 bp, Homo sapiens
tgtgatgattaataca

SEQ ID NO: 5328675 - DNA, 12 bp, Homo sapiens
tgtgatgcagga

SEQ ID NO: 5328676 - DNA, 14 bp, Homo sapiens
tgtgatgcaggaag

SEQ ID NO: 5328677 - DNA, 16 bp, Homo sapiens
tgtgatgcatgagctc

SEQ ID NO: 5328678 - DNA, 17 bp, Homo sapiens
tgtgatgcattttatag

SEQ ID NO: 5328679 - DNA, 17 bp, Homo sapiens
tgtgatgccaaagatgt

SEQ ID NO: 5328680 - DNA, 15 bp, Homo sapiens
tgtgatgccacacag

SEQ ID NO: 5328681 - DNA, 23 bp, Homo sapiens
tgtgatgctcccaagcaaaggaa

SEQ ID NO: 5328682 - DNA, 19 bp, Homo sapiens
tgtgatgctgtgtgcccaa

SEQ ID NO: 5328683 - DNA, 15 bp, Homo sapiens
tgtgatgcttgatat

SEQ ID NO: 5328684 - DNA, 17 bp, Homo sapiens
tgtgatgctttgaagta

SEQ ID NO: 5328685 - DNA, 13 bp, Homo sapiens
tgtgatggaggga

SEQ ID NO: 5328686 - DNA, 15 bp, Homo sapiens
tgtgatggagtgctg

SEQ ID NO: 5328687 - DNA, 19 bp, Homo sapiens
tgtgatggatggcacaatg

SEQ ID NO: 5328688 - DNA, 20 bp, Homo sapiens
tgtgatggatggcacaatga

SEQ ID NO: 5328689 - DNA, 15 bp, Homo sapiens
tgtgatggggccctg

SEQ ID NO: 5328690 - DNA, 17 bp, Homo sapiens
tgtgatggggccctgcc

SEQ ID NO: 5328691 - DNA, 20 bp, Homo sapiens
tgtgatggggccctgcctcc

SEQ ID NO: 5328692 - DNA, 19 bp, Homo sapiens
tgtgatggttcgttctgtt

SEQ ID NO: 5328693 - DNA, 16 bp, Homo sapiens
tgtgatgtacacattt

SEQ ID NO: 5328694 - DNA, 22 bp, Homo sapiens
tgtgatgtaccagtttgtccat

SEQ ID NO: 5328695 - DNA, 14 bp, Homo sapiens
tgtgatgtattcta

SEQ ID NO: 5328696 - DNA, 16 bp, Homo sapiens
tgtgatgtattctagc

SEQ ID NO: 5328697 - DNA, 22 bp, Homo sapiens
tgtgatgtcacagtttgttcag

SEQ ID NO: 5328698 - DNA, 22 bp, Homo sapiens
tgtgatgtcatacagagaagtc

SEQ ID NO: 5328699 - DNA, 13 bp, Homo sapiens
tgtgatgtcatga

SEQ ID NO: 5328700 - DNA, 13 bp, Homo sapiens
tgtgatgtcccag

SEQ ID NO: 5328701 - DNA, 15 bp, Homo sapiens
tgtgatgtgacattt

SEQ ID NO: 5328702 - DNA, 16 bp, Homo sapiens
tgtgatgtgacatttg

SEQ ID NO: 5328703 - DNA, 19 bp, Homo sapiens
tgtgatgtgacatttgtca

SEQ ID NO: 5328704 - DNA, 14 bp, Homo sapiens
tgtgatgtggcagg

SEQ ID NO: 5328705 - DNA, 15 bp, Homo sapiens
tgtgatgtgttgctc

SEQ ID NO: 5328706 - DNA, 16 bp, Homo sapiens
tgtgatgttaactatt

SEQ ID NO: 5328707 - DNA, 23 bp, Homo sapiens
tgtgatgtttaggggcaaacatc

SEQ ID NO: 5328708 - DNA, 21 bp, Homo sapiens
tgtgattacgtgtatgtttct

SEQ ID NO: 5328709 - DNA, 19 bp, Homo sapiens
tgtgattagatcacatctt

SEQ ID NO: 5328710 - DNA, 15 bp, Homo sapiens
tgtgattatcattta

SEQ ID NO: 5328711 - DNA, 17 bp, Homo sapiens
tgtgattatcatttatt

SEQ ID NO: 5328712 - DNA, 17 bp, Homo sapiens
tgtgattatttcacttt

SEQ ID NO: 5328713 - DNA, 21 bp, Homo sapiens
tgtgattcactgccttcctct

SEQ ID NO: 5328714 - DNA, 22 bp, Homo sapiens
tgtgattccactacacctggct

SEQ ID NO: 5328715 - DNA, 13 bp, Homo sapiens
tgtgattccatgg

SEQ ID NO: 5328716 - DNA, 23 bp, Homo sapiens
tgtgattccatggattgattcag

SEQ ID NO: 5328717 - DNA, 17 bp, Homo sapiens
tgtgattccccggagct

SEQ ID NO: 5328718 - DNA, 19 bp, Homo sapiens
tgtgattccccggagctgg

SEQ ID NO: 5328719 - DNA, 15 bp, Homo sapiens
tgtgattccttttga

SEQ ID NO: 5328720 - DNA, 12 bp, Homo sapiens
tgtgattctgtt

SEQ ID NO: 5328721 - DNA, 15 bp, Homo sapiens
tgtgattcttctaaa

SEQ ID NO: 5328722 - DNA, 13 bp, Homo sapiens
tgtgattgaatct

SEQ ID NO: 5328723 - DNA, 14 bp, Homo sapiens
tgtgattgcacaga

SEQ ID NO: 5328724 - DNA, 21 bp, Homo sapiens
tgtgattgcacgtgcctgtgg

SEQ ID NO: 5328725 - DNA, 19 bp, Homo sapiens
tgtgattgccatttcttcc

SEQ ID NO: 5328726 - DNA, 22 bp, Homo sapiens
tgtgattgcctcaataaagctc

SEQ ID NO: 5328727 - DNA, 19 bp, Homo sapiens
tgtgattggcagcttcaaa

SEQ ID NO: 5328728 - DNA, 14 bp, Homo sapiens
tgtgattggcctgt

SEQ ID NO: 5328729 - DNA, 16 bp, Homo sapiens
tgtgattggctgcagg

SEQ ID NO: 5328730 - DNA, 15 bp, Homo sapiens
tgtgattgggaataa

SEQ ID NO: 5328731 - DNA, 14 bp, Homo sapiens
tgtgattgtgccta

SEQ ID NO: 5328732 - DNA, 17 bp, Homo sapiens
tgtgattgtggaatgga

SEQ ID NO: 5328733 - DNA, 15 bp, Homo sapiens
tgtgatttaatagtg

SEQ ID NO: 5328734 - DNA, 19 bp, Homo sapiens
tgtgatttaatagtgttaa

SEQ ID NO: 5328735 - DNA, 20 bp, Homo sapiens
tgtgatttaatagtgttaat

SEQ ID NO: 5328736 - DNA, 19 bp, Homo sapiens
tgtgatttcccgtggcccc

SEQ ID NO: 5328737 - DNA, 22 bp, Homo sapiens
tgtgatttcccgtggccccagc

SEQ ID NO: 5328738 - DNA, 17 bp, Homo sapiens
tgtgatttcctaaacat

SEQ ID NO: 5328739 - DNA, 21 bp, Homo sapiens
tgtgatttcctaaacataatt

SEQ ID NO: 5328740 - DNA, 14 bp, Homo sapiens
tgtgatttcctaca

SEQ ID NO: 5328741 - DNA, 12 bp, Homo sapiens
tgtgatttcttc

SEQ ID NO: 5328742 - DNA, 22 bp, Homo sapiens
tgtgatttctttaaaagaatga

SEQ ID NO: 5328743 - DNA, 15 bp, Homo sapiens
tgtgatttctttctt

SEQ ID NO: 5328744 - DNA, 17 bp, Homo sapiens
tgtgatttgaattctgt

SEQ ID NO: 5328745 - DNA, 22 bp, Homo sapiens
tgtgatttgactgtttttaccc

SEQ ID NO: 5328746 - DNA, 23 bp, Homo sapiens
tgtgatttggttgcactttagac

SEQ ID NO: 5328747 - DNA, 17 bp, Homo sapiens
tgtgatttgtgaaataa

SEQ ID NO: 5328748 - DNA, 17 bp, Homo sapiens
tgtgattttaagacaag

SEQ ID NO: 5328749 - DNA, 13 bp, Homo sapiens
tgtgattttcaaa

SEQ ID NO: 5328750 - DNA, 14 bp, Homo sapiens
tgtgattttcaaat

SEQ ID NO: 5328751 - DNA, 23 bp, Homo sapiens
tgtgattttcaaatatgtaaact

SEQ ID NO: 5328752 - DNA, 17 bp, Homo sapiens
tgtgattttgccctcct

SEQ ID NO: 5328753 - DNA, 19 bp, Homo sapiens
tgtgattttgccctcctgc

SEQ ID NO: 5328754 - DNA, 22 bp, Homo sapiens
tgtgattttgccctcctgccca

SEQ ID NO: 5328755 - DNA, 13 bp, Homo sapiens
tgtgattttgtac

SEQ ID NO: 5328756 - DNA, 14 bp, Homo sapiens
tgtgattttgtaca

SEQ ID NO: 5328757 - DNA, 15 bp, Homo sapiens
tgtgattttgtacag

SEQ ID NO: 5328758 - DNA, 17 bp, Homo sapiens
tgtgattttgtacagaa

SEQ ID NO: 5328759 - DNA, 15 bp, Homo sapiens
tgtgattttgtaggt

SEQ ID NO: 5328760 - DNA, 18 bp, Homo sapiens
tgtgatttttataataca

SEQ ID NO: 5328761 - DNA, 16 bp, Homo sapiens
tgtgatttttatcaca

SEQ ID NO: 5328762 - DNA, 20 bp, Homo sapiens
tgtgatttttggtatttgaa

SEQ ID NO: 5328763 - DNA, 21 bp, Homo sapiens
tgtgatttttggtatttgaaa

SEQ ID NO: 5328764 - DNA, 17 bp, Homo sapiens
tgtgattttttgttctt

SEQ ID NO: 5328765 - DNA, 18 bp, Homo sapiens
tgtgcaaaaatttttgga

SEQ ID NO: 5328766 - DNA, 20 bp, Homo sapiens
tgtgcaaaaccttttactgg

SEQ ID NO: 5328767 - DNA, 14 bp, Homo sapiens
tgtgcaaaataaaa

SEQ ID NO: 5328768 - DNA, 17 bp, Homo sapiens
tgtgcaaaataaaatga

SEQ ID NO: 5328769 - DNA, 21 bp, Homo sapiens
tgtgcaaacatggagaaatct

SEQ ID NO: 5328770 - DNA, 12 bp, Homo sapiens
tgtgcaaagtga

SEQ ID NO: 5328771 - DNA, 12 bp, Homo sapiens
tgtgcaaatcct

SEQ ID NO: 5328772 - DNA, 15 bp, Homo sapiens
tgtgcaaattaacag

SEQ ID NO: 5328773 - DNA, 17 bp, Homo sapiens
tgtgcaaattttgcatt

SEQ ID NO: 5328774 - DNA, 20 bp, Homo sapiens
tgtgcaacagggtatggact

SEQ ID NO: 5328775 - DNA, 16 bp, Homo sapiens
tgtgcaaccatgtttg

SEQ ID NO: 5328776 - DNA, 21 bp, Homo sapiens
tgtgcaacctgtggctcaggg

SEQ ID NO: 5328777 - DNA, 19 bp, Homo sapiens
tgtgcaacgccgtgggctg

SEQ ID NO: 5328778 - DNA, 12 bp, Homo sapiens
tgtgcaacggcc

SEQ ID NO: 5328779 - DNA, 21 bp, Homo sapiens
tgtgcaacggtctcctgactg

SEQ ID NO: 5328780 - DNA, 23 bp, Homo sapiens
tgtgcaactcttgtattgctcca

SEQ ID NO: 5328781 - DNA, 18 bp, Homo sapiens
tgtgcaactttttaaagt

SEQ ID NO: 5328782 - DNA, 21 bp, Homo sapiens
tgtgcaagagtatactttgta

SEQ ID NO: 5328783 - DNA, 23 bp, Homo sapiens
tgtgcaagcgacgacagatgcta

SEQ ID NO: 5328784 - DNA, 19 bp, Homo sapiens
tgtgcaagcttttcctaat

SEQ ID NO: 5328785 - DNA, 18 bp, Homo sapiens
tgtgcaagtatgtgagtg

SEQ ID NO: 5328786 - DNA, 20 bp, Homo sapiens
tgtgcaagtgtctgtgtgca

SEQ ID NO: 5328787 - DNA, 12 bp, Homo sapiens
tgtgcaagtgtg

SEQ ID NO: 5328788 - DNA, 19 bp, Homo sapiens
tgtgcaataatttgtacaa

SEQ ID NO: 5328789 - DNA, 15 bp, Homo sapiens
tgtgcaatagaaata

SEQ ID NO: 5328790 - DNA, 16 bp, Homo sapiens
tgtgcaatagaaggtg

SEQ ID NO: 5328791 - DNA, 21 bp, Homo sapiens
tgtgcaatggaatataaatat

SEQ ID NO: 5328792 - DNA, 17 bp, Homo sapiens
tgtgcaatgtaaatatt

SEQ ID NO: 5328793 - DNA, 16 bp, Homo sapiens
tgtgcaatgtgtataa

SEQ ID NO: 5328794 - DNA, 22 bp, Homo sapiens
tgtgcaatgtgtataaacaaga

SEQ ID NO: 5328795 - DNA, 19 bp, Homo sapiens
tgtgcaattactgcctgca

SEQ ID NO: 5328796 - DNA, 18 bp, Homo sapiens
tgtgcaattcagtctgct

SEQ ID NO: 5328797 - DNA, 16 bp, Homo sapiens
tgtgcacaagtgtgca

SEQ ID NO: 5328798 - DNA, 15 bp, Homo sapiens
tgtgcacaatgggca

SEQ ID NO: 5328799 - DNA, 16 bp, Homo sapiens
tgtgcacaccaccctc

SEQ ID NO: 5328800 - DNA, 21 bp, Homo sapiens
tgtgcacactaagaaatggga

SEQ ID NO: 5328801 - DNA, 13 bp, Homo sapiens
tgtgcacagaaaa

SEQ ID NO: 5328802 - DNA, 14 bp, Homo sapiens
tgtgcacagaaaac

SEQ ID NO: 5328803 - DNA, 13 bp, Homo sapiens
tgtgcacaggcag

SEQ ID NO: 5328804 - DNA, 21 bp, Homo sapiens
tgtgcacatacgggctttaat

SEQ ID NO: 5328805 - DNA, 22 bp, Homo sapiens
tgtgcacatccgcgtgtgcctg

SEQ ID NO: 5328806 - DNA, 23 bp, Homo sapiens
tgtgcacatccgcgtgtgcctgt

SEQ ID NO: 5328807 - DNA, 22 bp, Homo sapiens
tgtgcacatctacatgccatgc

SEQ ID NO: 5328808 - DNA, 15 bp, Homo sapiens
tgtgcacatctctgc

SEQ ID NO: 5328809 - DNA, 19 bp, Homo sapiens
tgtgcacatctctgcttga

SEQ ID NO: 5328810 - DNA, 20 bp, Homo sapiens
tgtgcacatctctgcttgag

SEQ ID NO: 5328811 - DNA, 17 bp, Homo sapiens
tgtgcacatctgtgtct

SEQ ID NO: 5328812 - DNA, 16 bp, Homo sapiens
tgtgcacatgcacgtg

SEQ ID NO: 5328813 - DNA, 18 bp, Homo sapiens
tgtgcacatgcctctgta

SEQ ID NO: 5328814 - DNA, 13 bp, Homo sapiens
tgtgcacatgtgt

SEQ ID NO: 5328815 - DNA, 19 bp, Homo sapiens
tgtgcacattctcccttga

SEQ ID NO: 5328816 - DNA, 18 bp, Homo sapiens
tgtgcacatttaataatc

SEQ ID NO: 5328817 - DNA, 19 bp, Homo sapiens
tgtgcacatttaataatca

SEQ ID NO: 5328818 - DNA, 14 bp, Homo sapiens
tgtgcacatttctt

SEQ ID NO: 5328819 - DNA, 23 bp, Homo sapiens
tgtgcaccagtgtgacaggaaag

SEQ ID NO: 5328820 - DNA, 17 bp, Homo sapiens
tgtgcacccctccccat

SEQ ID NO: 5328821 - DNA, 22 bp, Homo sapiens
tgtgcacctaccccttggaaat

SEQ ID NO: 5328822 - DNA, 23 bp, Homo sapiens
tgtgcacctaccccttggaaatg

SEQ ID NO: 5328823 - DNA, 21 bp, Homo sapiens
tgtgcacctatggcccagcca

SEQ ID NO: 5328824 - DNA, 13 bp, Homo sapiens
tgtgcacctgact

SEQ ID NO: 5328825 - DNA, 21 bp, Homo sapiens
tgtgcacgagtgggaaggact

SEQ ID NO: 5328826 - DNA, 22 bp, Homo sapiens
tgtgcacgtaaagtacttgtag

SEQ ID NO: 5328827 - DNA, 19 bp, Homo sapiens
tgtgcacgtggcatgtggc

SEQ ID NO: 5328828 - DNA, 12 bp, Homo sapiens
tgtgcactaagg

SEQ ID NO: 5328829 - DNA, 23 bp, Homo sapiens
tgtgcactaaggggcccggccag

SEQ ID NO: 5328830 - DNA, 17 bp, Homo sapiens
tgtgcactgacatgttt

SEQ ID NO: 5328831 - DNA, 21 bp, Homo sapiens
tgtgcactgacatgtttcaca

SEQ ID NO: 5328832 - DNA, 12 bp, Homo sapiens
tgtgcccagctc

SEQ ID NO: 5328833 - DNA, 14 bp, Homo sapiens
tgtgcccagctcag

SEQ ID NO: 5328834 - DNA, 16 bp, Homo sapiens
tgtgcccagctcagtc

SEQ ID NO: 5328835 - DNA, 19 bp, Homo sapiens
tgtgcccagggttttgccc

SEQ ID NO: 5328836 - DNA, 13 bp, Homo sapiens
tgtgcccagtcat

SEQ ID NO: 5328837 - DNA, 12 bp, Homo sapiens
tgtgcccagtta

SEQ ID NO: 5328838 - DNA, 17 bp, Homo sapiens
tgtgcccatggcttctg

SEQ ID NO: 5328839 - DNA, 20 bp, Homo sapiens
tgtgcccatgggcactgctg

SEQ ID NO: 5328840 - DNA, 21 bp, Homo sapiens
tgtgcccatgggcactgctgg

SEQ ID NO: 5328841 - DNA, 19 bp, Homo sapiens
tgtgccccactccagcctg

SEQ ID NO: 5328842 - DNA, 20 bp, Homo sapiens
tgtgccccactccagcctgg

SEQ ID NO: 5328843 - DNA, 19 bp, Homo sapiens
tgtgccccatcagcagctt

SEQ ID NO: 5328844 - DNA, 19 bp, Homo sapiens
tgtgccccatgcctgtcca

SEQ ID NO: 5328845 - DNA, 14 bp, Homo sapiens
tgtgcccccacccc

SEQ ID NO: 5328846 - DNA, 15 bp, Homo sapiens
tgtgcccccagcctc

SEQ ID NO: 5328847 - DNA, 16 bp, Homo sapiens
tgtgcccccagcctca

SEQ ID NO: 5328848 - DNA, 19 bp, Homo sapiens
tgtgcccccagcctcagcc

SEQ ID NO: 5328849 - DNA, 22 bp, Homo sapiens
tgtgcccccagcctcagcccaa

SEQ ID NO: 5328850 - DNA, 13 bp, Homo sapiens
tgtgccccccatc

SEQ ID NO: 5328851 - DNA, 20 bp, Homo sapiens
tgtgccccccatcctggccc

SEQ ID NO: 5328852 - DNA, 21 bp, Homo sapiens
tgtgccccccatcctggccca

SEQ ID NO: 5328853 - DNA, 13 bp, Homo sapiens
tgtgcccccctcc

SEQ ID NO: 5328854 - DNA, 14 bp, Homo sapiens
tgtgcccccctcct

SEQ ID NO: 5328855 - DNA, 19 bp, Homo sapiens
tgtgcccccctcctccccg

SEQ ID NO: 5328856 - DNA, 19 bp, Homo sapiens
tgtgccccgaccccacctg

SEQ ID NO: 5328857 - DNA, 18 bp, Homo sapiens
tgtgcccctaaagagcat

SEQ ID NO: 5328858 - DNA, 18 bp, Homo sapiens
tgtgcccctcagagaggc

SEQ ID NO: 5328859 - DNA, 22 bp, Homo sapiens
tgtgcccctcagagaggcatgt

SEQ ID NO: 5328860 - DNA, 17 bp, Homo sapiens
tgtgcccctggcccatc

SEQ ID NO: 5328861 - DNA, 20 bp, Homo sapiens
tgtgccccttcactcatttt

SEQ ID NO: 5328862 - DNA, 21 bp, Homo sapiens
tgtgccccttccccatgctca

SEQ ID NO: 5328863 - DNA, 21 bp, Homo sapiens
tgtgccccttccgccactggg

SEQ ID NO: 5328864 - DNA, 20 bp, Homo sapiens
tgtgcccgccctgggctggg

SEQ ID NO: 5328865 - DNA, 20 bp, Homo sapiens
tgtgcccgctgcgctgccct

SEQ ID NO: 5328866 - DNA, 16 bp, Homo sapiens
tgtgcccggtgccatc

SEQ ID NO: 5328867 - DNA, 22 bp, Homo sapiens
tgtgcccggtgccatcttccat

SEQ ID NO: 5328868 - DNA, 16 bp, Homo sapiens
tgtgcccgtggtgagg

SEQ ID NO: 5328869 - DNA, 20 bp, Homo sapiens
tgtgccctaaagtgtatttt

SEQ ID NO: 5328870 - DNA, 17 bp, Homo sapiens
tgtgccctagggctcag

SEQ ID NO: 5328871 - DNA, 16 bp, Homo sapiens
tgtgccctccaaagag

SEQ ID NO: 5328872 - DNA, 11 bp, Homo sapiens
tgtgccctctg

SEQ ID NO: 5328873 - DNA, 12 bp, Homo sapiens
tgtgccctctgg

SEQ ID NO: 5328874 - DNA, 12 bp, Homo sapiens
tgtgccctgcct

SEQ ID NO: 5328875 - DNA, 15 bp, Homo sapiens
tgtgccctgcctcca

SEQ ID NO: 5328876 - DNA, 12 bp, Homo sapiens
tgtgccctggac

SEQ ID NO: 5328877 - DNA, 14 bp, Homo sapiens
tgtgccctggactg

SEQ ID NO: 5328878 - DNA, 15 bp, Homo sapiens
tgtgccctggactgt

SEQ ID NO: 5328879 - DNA, 11 bp, Homo sapiens
tgtgccctggc

SEQ ID NO: 5328880 - DNA, 15 bp, Homo sapiens
tgtgccctggctccc

SEQ ID NO: 5328881 - DNA, 15 bp, Homo sapiens
tgtgccctgggccag

SEQ ID NO: 5328882 - DNA, 18 bp, Homo sapiens
tgtgccctgggccaggca

SEQ ID NO: 5328883 - DNA, 11 bp, Homo sapiens
tgtgccctggt

SEQ ID NO: 5328884 - DNA, 14 bp, Homo sapiens
tgtgccctggtgga

SEQ ID NO: 5328885 - DNA, 18 bp, Homo sapiens
tgtgccctgtagctcctt

SEQ ID NO: 5328886 - DNA, 22 bp, Homo sapiens
tgtgccctgtagctccttagct

SEQ ID NO: 5328887 - DNA, 23 bp, Homo sapiens
tgtgcccttaaaaccaaacccta

SEQ ID NO: 5328888 - DNA, 14 bp, Homo sapiens
tgtgcccttgattt

SEQ ID NO: 5328889 - DNA, 15 bp, Homo sapiens
tgtgcccttgctggg

SEQ ID NO: 5328890 - DNA, 17 bp, Homo sapiens
tgtgccgacactgttct

SEQ ID NO: 5328891 - DNA, 20 bp, Homo sapiens
tgtgccgctgccacccgccc

SEQ ID NO: 5328892 - DNA, 20 bp, Homo sapiens
tgtgccgtctttggttcctc

SEQ ID NO: 5328893 - DNA, 23 bp, Homo sapiens
tgtgcctaaataagttataaaga

SEQ ID NO: 5328894 - DNA, 14 bp, Homo sapiens
tgtgcctaatgtgt

SEQ ID NO: 5328895 - DNA, 15 bp, Homo sapiens
tgtgcctaatgtgtt

SEQ ID NO: 5328896 - DNA, 18 bp, Homo sapiens
tgtgcctatagtcccact

SEQ ID NO: 5328897 - DNA, 19 bp, Homo sapiens
tgtgcctattgctagagct

SEQ ID NO: 5328898 - DNA, 15 bp, Homo sapiens
tgtgcctcaggccag

SEQ ID NO: 5328899 - DNA, 16 bp, Homo sapiens
tgtgcctcaggccagg

SEQ ID NO: 5328900 - DNA, 22 bp, Homo sapiens
tgtgcctcattaagaggcaggt

SEQ ID NO: 5328901 - DNA, 16 bp, Homo sapiens
tgtgcctccccccaga

SEQ ID NO: 5328902 - DNA, 14 bp, Homo sapiens
tgtgcctccctggt

SEQ ID NO: 5328903 - DNA, 22 bp, Homo sapiens
tgtgcctcccttcccagtgggc

SEQ ID NO: 5328904 - DNA, 15 bp, Homo sapiens
tgtgcctcccttccg

SEQ ID NO: 5328905 - DNA, 16 bp, Homo sapiens
tgtgcctcctcacccc

SEQ ID NO: 5328906 - DNA, 15 bp, Homo sapiens
tgtgcctcctgtgtg

SEQ ID NO: 5328907 - DNA, 16 bp, Homo sapiens
tgtgcctcctgtgtgt

SEQ ID NO: 5328908 - DNA, 20 bp, Homo sapiens
tgtgcctcgctccccactct

SEQ ID NO: 5328909 - DNA, 12 bp, Homo sapiens
tgtgcctcggct

SEQ ID NO: 5328910 - DNA, 21 bp, Homo sapiens
tgtgcctcggcttttctcagc

SEQ ID NO: 5328911 - DNA, 14 bp, Homo sapiens
tgtgcctctagctg

SEQ ID NO: 5328912 - DNA, 20 bp, Homo sapiens
tgtgcctctagctgaattga

SEQ ID NO: 5328913 - DNA, 18 bp, Homo sapiens
tgtgcctctctctcccaa

SEQ ID NO: 5328914 - DNA, 15 bp, Homo sapiens
tgtgcctctgggact

SEQ ID NO: 5328915 - DNA, 16 bp, Homo sapiens
tgtgcctctgggactg

SEQ ID NO: 5328916 - DNA, 17 bp, Homo sapiens
tgtgcctcttgggagac

SEQ ID NO: 5328917 - DNA, 17 bp, Homo sapiens
tgtgcctgactctgtgc

SEQ ID NO: 5328918 - DNA, 12 bp, Homo sapiens
tgtgcctgagcg

SEQ ID NO: 5328919 - DNA, 22 bp, Homo sapiens
tgtgcctgagcggaccttccca

SEQ ID NO: 5328920 - DNA, 15 bp, Homo sapiens
tgtgcctgattattt

SEQ ID NO: 5328921 - DNA, 12 bp, Homo sapiens
tgtgcctgcagc

SEQ ID NO: 5328922 - DNA, 15 bp, Homo sapiens
tgtgcctgccatggg

SEQ ID NO: 5328923 - DNA, 18 bp, Homo sapiens
tgtgcctgccatgggcca

SEQ ID NO: 5328924 - DNA, 15 bp, Homo sapiens
tgtgcctgccctgga

SEQ ID NO: 5328925 - DNA, 20 bp, Homo sapiens
tgtgcctgctagagcaaccc

SEQ ID NO: 5328926 - DNA, 15 bp, Homo sapiens
tgtgcctgctatcca

SEQ ID NO: 5328927 - DNA, 18 bp, Homo sapiens
tgtgcctgctatccagcc

SEQ ID NO: 5328928 - DNA, 19 bp, Homo sapiens
tgtgcctgctatccagccg

SEQ ID NO: 5328929 - DNA, 20 bp, Homo sapiens
tgtgcctgctatccagccgc

SEQ ID NO: 5328930 - DNA, 15 bp, Homo sapiens
tgtgcctgctcagca

SEQ ID NO: 5328931 - DNA, 21 bp, Homo sapiens
tgtgcctgctcagcagccagt

SEQ ID NO: 5328932 - DNA, 12 bp, Homo sapiens
tgtgcctgctgg

SEQ ID NO: 5328933 - DNA, 18 bp, Homo sapiens
tgtgcctgctgggcactg

SEQ ID NO: 5328934 - DNA, 12 bp, Homo sapiens
tgtgcctggaaa

SEQ ID NO: 5328935 - DNA, 13 bp, Homo sapiens
tgtgcctggagct

SEQ ID NO: 5328936 - DNA, 17 bp, Homo sapiens
tgtgcctggagctcctg

SEQ ID NO: 5328937 - DNA, 17 bp, Homo sapiens
tgtgcctggccccagcc

SEQ ID NO: 5328938 - DNA, 22 bp, Homo sapiens
tgtgcctggccccagcctgggc

SEQ ID NO: 5328939 - DNA, 16 bp, Homo sapiens
tgtgcctggcctctgc

SEQ ID NO: 5328940 - DNA, 12 bp, Homo sapiens
tgtgcctggctc

SEQ ID NO: 5328941 - DNA, 20 bp, Homo sapiens
tgtgcctggctctgattctt

SEQ ID NO: 5328942 - DNA, 23 bp, Homo sapiens
tgtgcctggcttctttctctcag

SEQ ID NO: 5328943 - DNA, 12 bp, Homo sapiens
tgtgcctgggat

SEQ ID NO: 5328944 - DNA, 19 bp, Homo sapiens
tgtgcctgggccctgggct

SEQ ID NO: 5328945 - DNA, 21 bp, Homo sapiens
tgtgcctgggggagttttcct

SEQ ID NO: 5328946 - DNA, 16 bp, Homo sapiens
tgtgcctgtaatccca

SEQ ID NO: 5328947 - DNA, 20 bp, Homo sapiens
tgtgcctgtattcccagcta

SEQ ID NO: 5328948 - DNA, 23 bp, Homo sapiens
tgtgcctgtcaggctctggccct

SEQ ID NO: 5328949 - DNA, 12 bp, Homo sapiens
tgtgcctgtgct

SEQ ID NO: 5328950 - DNA, 15 bp, Homo sapiens
tgtgcctgtgctcct

SEQ ID NO: 5328951 - DNA, 19 bp, Homo sapiens
tgtgcctgtgctcctgccc

SEQ ID NO: 5328952 - DNA, 13 bp, Homo sapiens
tgtgcctgtgtgc

SEQ ID NO: 5328953 - DNA, 22 bp, Homo sapiens
tgtgcctgtgtgcgagtctgag

SEQ ID NO: 5328954 - DNA, 15 bp, Homo sapiens
tgtgcctgtgtttca

SEQ ID NO: 5328955 - DNA, 21 bp, Homo sapiens
tgtgccttaaaaggagagaag

SEQ ID NO: 5328956 - DNA, 12 bp, Homo sapiens
tgtgccttccct

SEQ ID NO: 5328957 - DNA, 13 bp, Homo sapiens
tgtgccttccctt

SEQ ID NO: 5328958 - DNA, 15 bp, Homo sapiens
tgtgccttccctttc

SEQ ID NO: 5328959 - DNA, 14 bp, Homo sapiens
tgtgccttcgtctt

SEQ ID NO: 5328960 - DNA, 21 bp, Homo sapiens
tgtgccttctctctccctttt

SEQ ID NO: 5328961 - DNA, 16 bp, Homo sapiens
tgtgccttcttttgat

SEQ ID NO: 5328962 - DNA, 12 bp, Homo sapiens
tgtgccttgggc

SEQ ID NO: 5328963 - DNA, 17 bp, Homo sapiens
tgtgccttggtgtgctg

SEQ ID NO: 5328964 - DNA, 19 bp, Homo sapiens
tgtgccttgtcacgccaga

SEQ ID NO: 5328965 - DNA, 16 bp, Homo sapiens
tgtgccttgtccagga

SEQ ID NO: 5328966 - DNA, 17 bp, Homo sapiens
tgtgccttgtccaggaa

SEQ ID NO: 5328967 - DNA, 12 bp, Homo sapiens
tgtgccttgttc

SEQ ID NO: 5328968 - DNA, 13 bp, Homo sapiens
tgtgccttgtttt

SEQ ID NO: 5328969 - DNA, 14 bp, Homo sapiens
tgtgcctttcctat

SEQ ID NO: 5328970 - DNA, 10 bp, Homo sapiens
tgtgcctttg

SEQ ID NO: 5328971 - DNA, 20 bp, Homo sapiens
tgtgcctttgcaaatcagtg

SEQ ID NO: 5328972 - DNA, 15 bp, Homo sapiens
tgtgcctttggcctg

SEQ ID NO: 5328973 - DNA, 17 bp, Homo sapiens
tgtgcctttgggaggca

SEQ ID NO: 5328974 - DNA, 23 bp, Homo sapiens
tgtgcctttgggaggcagcatca

SEQ ID NO: 5328975 - DNA, 15 bp, Homo sapiens
tgtgccttttatagc

SEQ ID NO: 5328976 - DNA, 13 bp, Homo sapiens
tgtgccttttctg

SEQ ID NO: 5328977 - DNA, 20 bp, Homo sapiens
tgtgccttttttagcttcat

SEQ ID NO: 5328978 - DNA, 13 bp, Homo sapiens
tgtgcgaacacag

SEQ ID NO: 5328979 - DNA, 21 bp, Homo sapiens
tgtgcgaagcaagaagaattg

SEQ ID NO: 5328980 - DNA, 14 bp, Homo sapiens
tgtgcgcctacagg

SEQ ID NO: 5328981 - DNA, 19 bp, Homo sapiens
tgtgcgcctacaggagtga

SEQ ID NO: 5328982 - DNA, 19 bp, Homo sapiens
tgtgcgctaaacttttctg

SEQ ID NO: 5328983 - DNA, 15 bp, Homo sapiens
tgtgcgctctgtgga

SEQ ID NO: 5328984 - DNA, 13 bp, Homo sapiens
tgtgcgctgcctg

SEQ ID NO: 5328985 - DNA, 13 bp, Homo sapiens
tgtgcggagctga

SEQ ID NO: 5328986 - DNA, 18 bp, Homo sapiens
tgtgcgtctctctttctc

SEQ ID NO: 5328987 - DNA, 13 bp, Homo sapiens
tgtgcgtgaaaca

SEQ ID NO: 5328988 - DNA, 14 bp, Homo sapiens
tgtgcgtgaaacac

SEQ ID NO: 5328989 - DNA, 16 bp, Homo sapiens
tgtgcgtgaaacacac

SEQ ID NO: 5328990 - DNA, 20 bp, Homo sapiens
tgtgcgtgcatgtgtgttca

SEQ ID NO: 5328991 - DNA, 15 bp, Homo sapiens
tgtgcgtggaaaaag

SEQ ID NO: 5328992 - DNA, 16 bp, Homo sapiens
tgtgcgtggaaaaaga

SEQ ID NO: 5328993 - DNA, 17 bp, Homo sapiens
tgtgcgtggtccgtgtg

SEQ ID NO: 5328994 - DNA, 20 bp, Homo sapiens
tgtgcgtgtgtccatgtgtg

SEQ ID NO: 5328995 - DNA, 13 bp, Homo sapiens
tgtgcgtgttcct

SEQ ID NO: 5328996 - DNA, 14 bp, Homo sapiens
tgtgcgttaaataa

SEQ ID NO: 5328997 - DNA, 18 bp, Homo sapiens
tgtgcgttaaataagcaa

SEQ ID NO: 5328998 - DNA, 16 bp, Homo sapiens
tgtgcgttcccttcag

SEQ ID NO: 5328999 - DNA, 21 bp, Homo sapiens
tgtgctaaacgtgtatgtttt

SEQ ID NO: 5329000 - DNA, 23 bp, Homo sapiens
tgtgctaaccacgtctgtcttca

SEQ ID NO: 5329001 - DNA, 20 bp, Homo sapiens
tgtgctaacctcactgcctc

SEQ ID NO: 5329002 - DNA, 18 bp, Homo sapiens
tgtgctaagtctttccca

SEQ ID NO: 5329003 - DNA, 22 bp, Homo sapiens
tgtgctaatttctgtccagaaa

SEQ ID NO: 5329004 - DNA, 19 bp, Homo sapiens
tgtgctacagagaaaatca

SEQ ID NO: 5329005 - DNA, 21 bp, Homo sapiens
tgtgctacagagaaaatcaaa

SEQ ID NO: 5329006 - DNA, 16 bp, Homo sapiens
tgtgctaccagagtta

SEQ ID NO: 5329007 - DNA, 21 bp, Homo sapiens
tgtgctaccagagttaaagca

SEQ ID NO: 5329008 - DNA, 14 bp, Homo sapiens
tgtgctacctctaa

SEQ ID NO: 5329009 - DNA, 16 bp, Homo sapiens
tgtgctacgtgtgaaa

SEQ ID NO: 5329010 - DNA, 17 bp, Homo sapiens
tgtgctacgtgtgaaat

SEQ ID NO: 5329011 - DNA, 19 bp, Homo sapiens
tgtgctacgtgtgaaatct

SEQ ID NO: 5329012 - DNA, 22 bp, Homo sapiens
tgtgcttttgcaaaagaagttg

SEQ ID NO: 5329013 - DNA, 20 bp, Homo sapiens
tgtgctttttgcaaaagggc

SEQ ID NO: 5329014 - DNA, 18 bp, Homo sapiens
tgtgctttttgtcatgtt

SEQ ID NO: 5329015 - DNA, 22 bp, Homo sapiens
tgtgctttttgtcatgttatgc

SEQ ID NO: 5329016 - DNA, 22 bp, Homo sapiens
tgtgcttttttaaccaaggagg

SEQ ID NO: 5329017 - DNA, 16 bp, Homo sapiens
tgtgctttttttgtgt

SEQ ID NO: 5329018 - DNA, 22 bp, Homo sapiens
tgtggaaaaaaaaaaaaactac

SEQ ID NO: 5329019 - DNA, 15 bp, Homo sapiens
tgtggaaaaaatatt

SEQ ID NO: 5329020 - DNA, 21 bp, Homo sapiens
tgtggaaaaataaaggaaatt

SEQ ID NO: 5329021 - DNA, 14 bp, Homo sapiens
tgtggaaaaatatt

SEQ ID NO: 5329022 - DNA, 20 bp, Homo sapiens
tgtggaaaaatgagagaagg

SEQ ID NO: 5329023 - DNA, 13 bp, Homo sapiens
tgtggaaaacaga

SEQ ID NO: 5329024 - DNA, 14 bp, Homo sapiens
tgtggaaaaccagg

SEQ ID NO: 5329025 - DNA, 18 bp, Homo sapiens
tgtggaaaaccaggaaaa

SEQ ID NO: 5329026 - DNA, 16 bp, Homo sapiens
tgtggaaaagatggca

SEQ ID NO: 5329027 - DNA, 20 bp, Homo sapiens
tgtggaaaagccatctcagg

SEQ ID NO: 5329028 - DNA, 15 bp, Homo sapiens
tgtggaaagcctctg

SEQ ID NO: 5329029 - DNA, 19 bp, Homo sapiens
tgtggaaagcctctgctgc

SEQ ID NO: 5329030 - DNA, 20 bp, Homo sapiens
tgtggaaagcctctgctgcc

SEQ ID NO: 5329031 - DNA, 21 bp, Homo sapiens
tgtggaaaggattctaaacag

SEQ ID NO: 5329032 - DNA, 15 bp, Homo sapiens
tgtggaaagtagctg

SEQ ID NO: 5329033 - DNA, 18 bp, Homo sapiens
tgtggaaagtagctgcta

SEQ ID NO: 5329034 - DNA, 16 bp, Homo sapiens
tgtggaaagtgaattt

SEQ ID NO: 5329035 - DNA, 22 bp, Homo sapiens
tgtggaaagtgaatttgaatga

SEQ ID NO: 5329036 - DNA, 15 bp, Homo sapiens
tgtggaaagtgtaaa

SEQ ID NO: 5329037 - DNA, 16 bp, Homo sapiens
tgtggaaagtgtaaag

SEQ ID NO: 5329038 - DNA, 19 bp, Homo sapiens
tgtggaaagtgtaaagcat

SEQ ID NO: 5329039 - DNA, 14 bp, Homo sapiens
tgtggaaatatgca

SEQ ID NO: 5329040 - DNA, 19 bp, Homo sapiens
tgtggaaatcataccagtt

SEQ ID NO: 5329041 - DNA, 21 bp, Homo sapiens
tgtggaaatcataccagttgt

SEQ ID NO: 5329042 - DNA, 15 bp, Homo sapiens
tgtggaacactaaag

SEQ ID NO: 5329043 - DNA, 20 bp, Homo sapiens
tgtggaacactaaagagcta

SEQ ID NO: 5329044 - DNA, 20 bp, Homo sapiens
tgtggaactaataaatacat

SEQ ID NO: 5329045 - DNA, 23 bp, Homo sapiens
tgtggaactaataaatacatacg

SEQ ID NO: 5329046 - DNA, 14 bp, Homo sapiens
tgtggaactgccac

SEQ ID NO: 5329047 - DNA, 21 bp, Homo sapiens
tgtggaagacaagtctgtggc

SEQ ID NO: 5329048 - DNA, 20 bp, Homo sapiens
tgtggaagacacttgctgag

SEQ ID NO: 5329049 - DNA, 23 bp, Homo sapiens
tgtggaagcaggttgcttcaaga

SEQ ID NO: 5329050 - DNA, 21 bp, Homo sapiens
tgtggaagcatggctgtctgc

SEQ ID NO: 5329051 - DNA, 22 bp, Homo sapiens
tgtggaaggcacactgagcaag

SEQ ID NO: 5329052 - DNA, 19 bp, Homo sapiens
tgtggaaggcagggacaga

SEQ ID NO: 5329053 - DNA, 16 bp, Homo sapiens
tgtggaaggcctccct

SEQ ID NO: 5329054 - DNA, 15 bp, Homo sapiens
tgtggaagggactag

SEQ ID NO: 5329055 - DNA, 13 bp, Homo sapiens
tgtggaataatac

SEQ ID NO: 5329056 - DNA, 14 bp, Homo sapiens
tgtggaatataaat

SEQ ID NO: 5329057 - DNA, 17 bp, Homo sapiens
tgtggaatctggagtga

SEQ ID NO: 5329058 - DNA, 18 bp, Homo sapiens
tgtggaatctggagtgag

SEQ ID NO: 5329059 - DNA, 18 bp, Homo sapiens
tgtggaatgagtgtgcat

SEQ ID NO: 5329060 - DNA, 15 bp, Homo sapiens
tgtggaatggatttt

SEQ ID NO: 5329061 - DNA, 16 bp, Homo sapiens
tgtggaatttaaatca

SEQ ID NO: 5329062 - DNA, 15 bp, Homo sapiens
tgtggacacagctct

SEQ ID NO: 5329063 - DNA, 22 bp, Homo sapiens
tgtggacaccactgagctctgc

SEQ ID NO: 5329064 - DNA, 18 bp, Homo sapiens
tgtggacacctccctgtg

SEQ ID NO: 5329065 - DNA, 16 bp, Homo sapiens
tgtggacactgtggaa

SEQ ID NO: 5329066 - DNA, 12 bp, Homo sapiens
tgtggacatgca

SEQ ID NO: 5329067 - DNA, 21 bp, Homo sapiens
tgtggaccaatgcatctcttt

SEQ ID NO: 5329068 - DNA, 17 bp, Homo sapiens
tgtggaccaattattga

SEQ ID NO: 5329069 - DNA, 19 bp, Homo sapiens
tgtggaccactgcatgagc

SEQ ID NO: 5329070 - DNA, 17 bp, Homo sapiens
tgtggaccatattttgt

SEQ ID NO: 5329071 - DNA, 22 bp, Homo sapiens
tgtggaccatggagtggcagcc

SEQ ID NO: 5329072 - DNA, 19 bp, Homo sapiens
tgtggaccctcgctctctg

SEQ ID NO: 5329073 - DNA, 18 bp, Homo sapiens
tgtggacctcaccagaga

SEQ ID NO: 5329074 - DNA, 15 bp, Homo sapiens
tgtggacctggacaa

SEQ ID NO: 5329075 - DNA, 14 bp, Homo sapiens
tgtggacggcgctg

SEQ ID NO: 5329076 - DNA, 18 bp, Homo sapiens
tgtggacgtgcactgaca

SEQ ID NO: 5329077 - DNA, 14 bp, Homo sapiens
tgtggactaaatat

SEQ ID NO: 5329078 - DNA, 16 bp, Homo sapiens
tgtggactaaatatct

SEQ ID NO: 5329079 - DNA, 16 bp, Homo sapiens
tgtggactctctgcct

SEQ ID NO: 5329080 - DNA, 12 bp, Homo sapiens
tgtggactctgg

SEQ ID NO: 5329081 - DNA, 22 bp, Homo sapiens
tgtggactctggtgcctccaga

SEQ ID NO: 5329082 - DNA, 23 bp, Homo sapiens
tgtggactctggtgcctccagag

SEQ ID NO: 5329083 - DNA, 14 bp, Homo sapiens
tgtggactggctgt

SEQ ID NO: 5329084 - DNA, 24 bp, Homo sapiens
tgtggactgtcctgaggagccctg

SEQ ID NO: 5329085 - DNA, 11 bp, Homo sapiens
tgtggactgtg

SEQ ID NO: 5329086 - DNA, 22 bp, Homo sapiens
tgtggactgtgcctcaggccag

SEQ ID NO: 5329087 - DNA, 15 bp, Homo sapiens
tgtggacttaggaag

SEQ ID NO: 5329088 - DNA, 16 bp, Homo sapiens
tgtggacttggcaggt

SEQ ID NO: 5329089 - DNA, 22 bp, Homo sapiens
tgtggactttatttaatttcat

SEQ ID NO: 5329090 - DNA, 17 bp, Homo sapiens
tgtggagaaaaagatat

SEQ ID NO: 5329091 - DNA, 23 bp, Homo sapiens
tgtggagaaataaaaatacctct

SEQ ID NO: 5329092 - DNA, 19 bp, Homo sapiens
tgtggagaactcagtgcca

SEQ ID NO: 5329093 - DNA, 14 bp, Homo sapiens
tgtggagaagtgtg

SEQ ID NO: 5329094 - DNA, 19 bp, Homo sapiens
tgtggagaagtgtgttctg

SEQ ID NO: 5329095 - DNA, 18 bp, Homo sapiens
tgtggagacagccctgcc

SEQ ID NO: 5329096 - DNA, 13 bp, Homo sapiens
tgtggagactgct

SEQ ID NO: 5329097 - DNA, 13 bp, Homo sapiens
tgtggagactggg

SEQ ID NO: 5329098 - DNA, 14 bp, Homo sapiens
tgtggagaggagag

SEQ ID NO: 5329099 - DNA, 16 bp, Homo sapiens
tgtggagaggagagaa

SEQ ID NO: 5329100 - DNA, 17 bp, Homo sapiens
tgtggagaggagagaat

SEQ ID NO: 5329101 - DNA, 21 bp, Homo sapiens
tgtggagaggggtgcacccac

SEQ ID NO: 5329102 - DNA, 17 bp, Homo sapiens
tgtggagatcacagccc

SEQ ID NO: 5329103 - DNA, 19 bp, Homo sapiens
tgtggagcccgcaccccca

SEQ ID NO: 5329104 - DNA, 15 bp, Homo sapiens
tgtggagctcagccc

SEQ ID NO: 5329105 - DNA, 21 bp, Homo sapiens
tgtggagctccactgccatgt

SEQ ID NO: 5329106 - DNA, 11 bp, Homo sapiens
tgtggagctgc

SEQ ID NO: 5329107 - DNA, 15 bp, Homo sapiens
tgtggagctgccaca

SEQ ID NO: 5329108 - DNA, 21 bp, Homo sapiens
tgtggaggaagagccacctgc

SEQ ID NO: 5329109 - DNA, 22 bp, Homo sapiens
tgtggaggaagagccacctgca

SEQ ID NO: 5329110 - DNA, 14 bp, Homo sapiens
tgtggaggaaggat

SEQ ID NO: 5329111 - DNA, 16 bp, Homo sapiens
tgtggaggaaggattg

SEQ ID NO: 5329112 - DNA, 17 bp, Homo sapiens
tgtggaggcctcaggga

SEQ ID NO: 5329113 - DNA, 13 bp, Homo sapiens
tgtggaggcctga

SEQ ID NO: 5329114 - DNA, 14 bp, Homo sapiens
tgtggaggctcctg

SEQ ID NO: 5329115 - DNA, 16 bp, Homo sapiens
tgtggaggctcctgtg

SEQ ID NO: 5329116 - DNA, 18 bp, Homo sapiens
tgtggaggctcctgtggt

SEQ ID NO: 5329117 - DNA, 22 bp, Homo sapiens
tgtggagggagtgagccagcag

SEQ ID NO: 5329118 - DNA, 21 bp, Homo sapiens
tgtggagggattgaacacagg

SEQ ID NO: 5329119 - DNA, 23 bp, Homo sapiens
tgtggagggattgaacacaggca

SEQ ID NO: 5329120 - DNA, 19 bp, Homo sapiens
tgtggagggcacattcctt

SEQ ID NO: 5329121 - DNA, 22 bp, Homo sapiens
tgtggaggggcagcctgtgcct

SEQ ID NO: 5329122 - DNA, 12 bp, Homo sapiens
tgtggaggggcc

SEQ ID NO: 5329123 - DNA, 22 bp, Homo sapiens
tgtggaggggcttgggcctgca

SEQ ID NO: 5329124 - DNA, 22 bp, Homo sapiens
tgtggagggtcaccaggttggg

SEQ ID NO: 5329125 - DNA, 13 bp, Homo sapiens
tgtggaggtggct

SEQ ID NO: 5329126 - DNA, 14 bp, Homo sapiens
tgtggaggtggctg

SEQ ID NO: 5329127 - DNA, 15 bp, Homo sapiens
tgtggagtactggac

SEQ ID NO: 5329128 - DNA, 14 bp, Homo sapiens
tgtggagtagagtt

SEQ ID NO: 5329129 - DNA, 20 bp, Homo sapiens
tgtggagtatttttataatt

SEQ ID NO: 5329130 - DNA, 22 bp, Homo sapiens
tgtggagtcagcctcgcaggcc

SEQ ID NO: 5329131 - DNA, 12 bp, Homo sapiens
tgtggagtggag

SEQ ID NO: 5329132 - DNA, 13 bp, Homo sapiens
tgtggagtggagg

SEQ ID NO: 5329133 - DNA, 18 bp, Homo sapiens
tgtggagtggggcagtag

SEQ ID NO: 5329134 - DNA, 21 bp, Homo sapiens
tgtggagttcatcttgaattg

SEQ ID NO: 5329135 - DNA, 14 bp, Homo sapiens
tgtggagttcctgc

SEQ ID NO: 5329136 - DNA, 13 bp, Homo sapiens
tgtggagttttca

SEQ ID NO: 5329137 - DNA, 15 bp, Homo sapiens
tgtggagttttcatg

SEQ ID NO: 5329138 - DNA, 19 bp, Homo sapiens
tgtggataaaactgtgtaa

SEQ ID NO: 5329139 - DNA, 13 bp, Homo sapiens
tgtggataaattt

SEQ ID NO: 5329140 - DNA, 14 bp, Homo sapiens
tgtggataacaaag

SEQ ID NO: 5329141 - DNA, 17 bp, Homo sapiens
tgtggataacaaagata

SEQ ID NO: 5329142 - DNA, 19 bp, Homo sapiens
tgtggataacaaagatatc

SEQ ID NO: 5329143 - DNA, 15 bp, Homo sapiens
tgtggataagtggct

SEQ ID NO: 5329144 - DNA, 16 bp, Homo sapiens
tgtggatacagtgccc

SEQ ID NO: 5329145 - DNA, 21 bp, Homo sapiens
tgtggatcaaatccagcctgc

SEQ ID NO: 5329146 - DNA, 14 bp, Homo sapiens
tgtggatcagagat

SEQ ID NO: 5329147 - DNA, 19 bp, Homo sapiens
tgtggatcttgccacattt

SEQ ID NO: 5329148 - DNA, 21 bp, Homo sapiens
tgtggatgaaaaaaagggaaa

SEQ ID NO: 5329149 - DNA, 19 bp, Homo sapiens
tgtggatgaccacataaga

SEQ ID NO: 5329150 - DNA, 19 bp, Homo sapiens
tgtggatgagccctcagaa

SEQ ID NO: 5329151 - DNA, 23 bp, Homo sapiens
tgtggatgagccctcagaaccct

SEQ ID NO: 5329152 - DNA, 14 bp, Homo sapiens
tgtggatgataaaa

SEQ ID NO: 5329153 - DNA, 21 bp, Homo sapiens
tgtggatgcctgtggaagagt

SEQ ID NO: 5329154 - DNA, 22 bp, Homo sapiens
tgtggatgcctgtggaagagtg

SEQ ID NO: 5329155 - DNA, 19 bp, Homo sapiens
tgtggatgctgagctgtga

SEQ ID NO: 5329156 - DNA, 15 bp, Homo sapiens
tgtggatggaaatgt

SEQ ID NO: 5329157 - DNA, 13 bp, Homo sapiens
tgtggatggcagt

SEQ ID NO: 5329158 - DNA, 17 bp, Homo sapiens
tgtggatgggaggctcc

SEQ ID NO: 5329159 - DNA, 18 bp, Homo sapiens
tgtggatgggaggctcct

SEQ ID NO: 5329160 - DNA, 22 bp, Homo sapiens
tgtggatgggaggggtccccaa

SEQ ID NO: 5329161 - DNA, 21 bp, Homo sapiens
tgtggatgtaattagctctgg

SEQ ID NO: 5329162 - DNA, 19 bp, Homo sapiens
tgtggatgtgtaaatggag

SEQ ID NO: 5329163 - DNA, 20 bp, Homo sapiens
tgtggatgttcagaattttg

SEQ ID NO: 5329164 - DNA, 22 bp, Homo sapiens
tgtggatgttttaattccatga

SEQ ID NO: 5329165 - DNA, 15 bp, Homo sapiens
tgtggattaatgtca

SEQ ID NO: 5329166 - DNA, 19 bp, Homo sapiens
tgtggattataaaaaatgt

SEQ ID NO: 5329167 - DNA, 16 bp, Homo sapiens
tgtggattccagcatt

SEQ ID NO: 5329168 - DNA, 22 bp, Homo sapiens
tgtggattctgaggccctgccc

SEQ ID NO: 5329169 - DNA, 14 bp, Homo sapiens
tgtggattctttaa

SEQ ID NO: 5329170 - DNA, 19 bp, Homo sapiens
tgtggatttaacagaaatg

SEQ ID NO: 5329171 - DNA, 20 bp, Homo sapiens
tgtggatttaacagaaatgt

SEQ ID NO: 5329172 - DNA, 22 bp, Homo sapiens
tgtggatttgattcattttcct

SEQ ID NO: 5329173 - DNA, 23 bp, Homo sapiens
tgtggatttgattcattttcctg

SEQ ID NO: 5329174 - DNA, 13 bp, Homo sapiens
tgtggcaaacatt

SEQ ID NO: 5329175 - DNA, 15 bp, Homo sapiens
tgtggcaaacattta

SEQ ID NO: 5329176 - DNA, 22 bp, Homo sapiens
tgtggcaaagccttcattgcct

SEQ ID NO: 5329177 - DNA, 15 bp, Homo sapiens
tgtggcaaagtgctg

SEQ ID NO: 5329178 - DNA, 19 bp, Homo sapiens
tgtggcaatagtgggccct

SEQ ID NO: 5329179 - DNA, 17 bp, Homo sapiens
tgtggcaatctgtgggc

SEQ ID NO: 5329180 - DNA, 18 bp, Homo sapiens
tgtggcaatctgtgggct

SEQ ID NO: 5329181 - DNA, 21 bp, Homo sapiens
tgtggcacaaagttggtgcca

SEQ ID NO: 5329182 - DNA, 20 bp, Homo sapiens
tgtggcacagccctgagtgt

SEQ ID NO: 5329183 - DNA, 23 bp, Homo sapiens
tgtggcacagccctgagtgtccc

SEQ ID NO: 5329184 - DNA, 14 bp, Homo sapiens
tgtggcacattctt

SEQ ID NO: 5329185 - DNA, 14 bp, Homo sapiens
tgtggcacattttt

SEQ ID NO: 5329186 - DNA, 15 bp, Homo sapiens
tgtggcacgcacctg

SEQ ID NO: 5329187 - DNA, 13 bp, Homo sapiens
tgtggcacgtaag

SEQ ID NO: 5329188 - DNA, 14 bp, Homo sapiens
tgtggcactgccac

SEQ ID NO: 5329189 - DNA, 21 bp, Homo sapiens
tgtgtaaatatgtacatttgt

SEQ ID NO: 5329190 - DNA, 19 bp, Homo sapiens
tgtgtaaatctgaaaaact

SEQ ID NO: 5329191 - DNA, 14 bp, Homo sapiens
tgtgtaaatgttat

SEQ ID NO: 5329192 - DNA, 15 bp, Homo sapiens
tgtgtaaattattga

SEQ ID NO: 5329193 - DNA, 17 bp, Homo sapiens
tgtgtaaatttgtatcc

SEQ ID NO: 5329194 - DNA, 20 bp, Homo sapiens
tgtgtaacactgtgtacacc

SEQ ID NO: 5329195 - DNA, 18 bp, Homo sapiens
tgtgtaacacttggctct

SEQ ID NO: 5329196 - DNA, 14 bp, Homo sapiens
tgtgtaacaggata

SEQ ID NO: 5329197 - DNA, 13 bp, Homo sapiens
tgtgtaacatatt

SEQ ID NO: 5329198 - DNA, 12 bp, Homo sapiens
tgtgtaacatcc

SEQ ID NO: 5329199 - DNA, 13 bp, Homo sapiens
tgtgtaacatctg

SEQ ID NO: 5329200 - DNA, 19 bp, Homo sapiens
tgtgtaacatctgccattt

SEQ ID NO: 5329201 - DNA, 23 bp, Homo sapiens
tgtgtaaccattttataaagtgc

SEQ ID NO: 5329202 - DNA, 19 bp, Homo sapiens
tgtgtaacctcttcacctt

SEQ ID NO: 5329203 - DNA, 18 bp, Homo sapiens
tgtgtaactaatttgtgg

SEQ ID NO: 5329204 - DNA, 15 bp, Homo sapiens
tgtgtaactgttctt

SEQ ID NO: 5329205 - DNA, 19 bp, Homo sapiens
tgtgtaactgttctttgca

SEQ ID NO: 5329206 - DNA, 12 bp, Homo sapiens
tgtgtaagaaaa

SEQ ID NO: 5329207 - DNA, 22 bp, Homo sapiens
tgtgtaagaaaacaaactaaat

SEQ ID NO: 5329208 - DNA, 18 bp, Homo sapiens
tgtgtaagacaaaaagct

SEQ ID NO: 5329209 - DNA, 18 bp, Homo sapiens
tgtgtaagagaatgttga

SEQ ID NO: 5329210 - DNA, 13 bp, Homo sapiens
tgtgtaagatttg

SEQ ID NO: 5329211 - DNA, 22 bp, Homo sapiens
tgtgtaaggtatatgttttata

SEQ ID NO: 5329212 - DNA, 17 bp, Homo sapiens
tgtgtaataaagtgttt

SEQ ID NO: 5329213 - DNA, 18 bp, Homo sapiens
tgtgtaataaagtgtttt

SEQ ID NO: 5329214 - DNA, 19 bp, Homo sapiens
tgtgtaataaagtgttttc

SEQ ID NO: 5329215 - DNA, 20 bp, Homo sapiens
tgtgtaataaagtgttttca

SEQ ID NO: 5329216 - DNA, 23 bp, Homo sapiens
tgtgtaataaagtgttttcagag

SEQ ID NO: 5329217 - DNA, 14 bp, Homo sapiens
tgtgtaataagaaa

SEQ ID NO: 5329218 - DNA, 14 bp, Homo sapiens
tgtgtaataatgta

SEQ ID NO: 5329219 - DNA, 19 bp, Homo sapiens
tgtgtaataatgtaacatg

SEQ ID NO: 5329220 - DNA, 20 bp, Homo sapiens
tgtgtaataatgtaacatga

SEQ ID NO: 5329221 - DNA, 18 bp, Homo sapiens
tgtgtaatagaaaactga

SEQ ID NO: 5329222 - DNA, 15 bp, Homo sapiens
tgtgtaatcaataaa

SEQ ID NO: 5329223 - DNA, 19 bp, Homo sapiens
tgtgtaatcaataaacgat

SEQ ID NO: 5329224 - DNA, 23 bp, Homo sapiens
tgtgtaatcatttcttgggccct

SEQ ID NO: 5329225 - DNA, 14 bp, Homo sapiens
tgtgtaattcaaaa

SEQ ID NO: 5329226 - DNA, 15 bp, Homo sapiens
tgtgtaattcaaaag

SEQ ID NO: 5329227 - DNA, 19 bp, Homo sapiens
tgtgtaattgatttataaa

SEQ ID NO: 5329228 - DNA, 11 bp, Homo sapiens
tgtgtaattta

SEQ ID NO: 5329229 - DNA, 18 bp, Homo sapiens
tgtgtaatttaaaattgt

SEQ ID NO: 5329230 - DNA, 22 bp, Homo sapiens
tgtgtaatttaaaattgtgatg

SEQ ID NO: 5329231 - DNA, 20 bp, Homo sapiens
tgtgtaatttaagtgacaca

SEQ ID NO: 5329232 - DNA, 22 bp, Homo sapiens
tgtgtaatttaagtgacacaga

SEQ ID NO: 5329233 - DNA, 16 bp, Homo sapiens
tgtgtaattttaaagt

SEQ ID NO: 5329234 - DNA, 17 bp, Homo sapiens
tgtgtaattttaaagtc

SEQ ID NO: 5329235 - DNA, 22 bp, Homo sapiens
tgtgtaattttaaagtcagtgt

SEQ ID NO: 5329236 - DNA, 14 bp, Homo sapiens
tgtgtaatttttct

SEQ ID NO: 5329237 - DNA, 15 bp, Homo sapiens
tgtgtaatttttctg

SEQ ID NO: 5329238 - DNA, 20 bp, Homo sapiens
tgtgtacaaatacatgtgta

SEQ ID NO: 5329239 - DNA, 21 bp, Homo sapiens
tgtgtacaaatacatgtgtat

SEQ ID NO: 5329240 - DNA, 17 bp, Homo sapiens
tgtgtacaagttgttat

SEQ ID NO: 5329241 - DNA, 13 bp, Homo sapiens
tgtgtacacaaag

SEQ ID NO: 5329242 - DNA, 15 bp, Homo sapiens
tgtgtacacatatga

SEQ ID NO: 5329243 - DNA, 13 bp, Homo sapiens
tgtgtacacatgg

SEQ ID NO: 5329244 - DNA, 15 bp, Homo sapiens
tgtgtacagaaacaa

SEQ ID NO: 5329245 - DNA, 21 bp, Homo sapiens
tgtgtacagaaacaactgcca

SEQ ID NO: 5329246 - DNA, 18 bp, Homo sapiens
tgtgtacagtgaacaaat

SEQ ID NO: 5329247 - DNA, 15 bp, Homo sapiens
tgtgtacagtgaatt

SEQ ID NO: 5329248 - DNA, 19 bp, Homo sapiens
tgtgtacagtgaattgtct

SEQ ID NO: 5329249 - DNA, 22 bp, Homo sapiens
tgtgtacagtgaattgtctttt

SEQ ID NO: 5329250 - DNA, 18 bp, Homo sapiens
tgtgtacataactctgta

SEQ ID NO: 5329251 - DNA, 20 bp, Homo sapiens
tgtgtacatagagcaatgtt

SEQ ID NO: 5329252 - DNA, 23 bp, Homo sapiens
tgtgtacatcccatgtaacagaa

SEQ ID NO: 5329253 - DNA, 22 bp, Homo sapiens
tgtgtacatgtgtgcagagcag

SEQ ID NO: 5329254 - DNA, 19 bp, Homo sapiens
tgtgtaccacaccctgcct

SEQ ID NO: 5329255 - DNA, 23 bp, Homo sapiens
tgtgtaccacaccctgcctgctg

SEQ ID NO: 5329256 - DNA, 21 bp, Homo sapiens
tgtgtaccacttcctgaggcc

SEQ ID NO: 5329257 - DNA, 13 bp, Homo sapiens
tgtgtacccactc

SEQ ID NO: 5329258 - DNA, 16 bp, Homo sapiens
tgtgtacctcactgtc

SEQ ID NO: 5329259 - DNA, 14 bp, Homo sapiens
tgtgtacctgtggc

SEQ ID NO: 5329260 - DNA, 15 bp, Homo sapiens
tgtgtacgtggagag

SEQ ID NO: 5329261 - DNA, 22 bp, Homo sapiens
tgtgtactcactgaagcctgcg

SEQ ID NO: 5329262 - DNA, 15 bp, Homo sapiens
tgtgtactctggcct

SEQ ID NO: 5329263 - DNA, 16 bp, Homo sapiens
tgtgtactctggcctc

SEQ ID NO: 5329264 - DNA, 17 bp, Homo sapiens
tgtgtactctggcctct

SEQ ID NO: 5329265 - DNA, 18 bp, Homo sapiens
tgtgtactctggcctctg

SEQ ID NO: 5329266 - DNA, 20 bp, Homo sapiens
tgtgtactctggcctctgtc

SEQ ID NO: 5329267 - DNA, 16 bp, Homo sapiens
tgtgtactcttaggct

SEQ ID NO: 5329268 - DNA, 17 bp, Homo sapiens
tgtgtactgattcaaga

SEQ ID NO: 5329269 - DNA, 18 bp, Homo sapiens
tgtgtacttattacagtc

SEQ ID NO: 5329270 - DNA, 13 bp, Homo sapiens
tgtgtacttcttc

SEQ ID NO: 5329271 - DNA, 17 bp, Homo sapiens
tgtgtactttcttccct

SEQ ID NO: 5329272 - DNA, 19 bp, Homo sapiens
tgtgtagactcctgcttct

SEQ ID NO: 5329273 - DNA, 20 bp, Homo sapiens
tgtgtagagtgtttgtgagc

SEQ ID NO: 5329274 - DNA, 18 bp, Homo sapiens
tgtgtagagttaagaagc

SEQ ID NO: 5329275 - DNA, 17 bp, Homo sapiens
tgtgtagatattatgta

SEQ ID NO: 5329276 - DNA, 17 bp, Homo sapiens
tgtgtagcatgatacca

SEQ ID NO: 5329277 - DNA, 19 bp, Homo sapiens
tgtgtagcatgataccagg

SEQ ID NO: 5329278 - DNA, 15 bp, Homo sapiens
tgtgtagcctgtgca

SEQ ID NO: 5329279 - DNA, 16 bp, Homo sapiens
tgtgtagcctgtgcat

SEQ ID NO: 5329280 - DNA, 13 bp, Homo sapiens
tgtgtagcctttt

SEQ ID NO: 5329281 - DNA, 20 bp, Homo sapiens
tgtgtagctgtccaaaataa

SEQ ID NO: 5329282 - DNA, 22 bp, Homo sapiens
tgtgtaggcaccacctctgtca

SEQ ID NO: 5329283 - DNA, 14 bp, Homo sapiens
tgtgtaggctgggg

SEQ ID NO: 5329284 - DNA, 15 bp, Homo sapiens
tgtgtaggtgaacag

SEQ ID NO: 5329285 - DNA, 18 bp, Homo sapiens
tgtgtaggtgaacagtca

SEQ ID NO: 5329286 - DNA, 15 bp, Homo sapiens
tgtgtaggttatctt

SEQ ID NO: 5329287 - DNA, 21 bp, Homo sapiens
tgtgtagtctctctagtagtt

SEQ ID NO: 5329288 - DNA, 14 bp, Homo sapiens
tgtgtagttccagc

SEQ ID NO: 5329289 - DNA, 22 bp, Homo sapiens
tgtgtagttccctctgcctggg

SEQ ID NO: 5329290 - DNA, 21 bp, Homo sapiens
tgtgtataaaaataaaaaaga

SEQ ID NO: 5329291 - DNA, 16 bp, Homo sapiens
tgtgtataactggatt

SEQ ID NO: 5329292 - DNA, 10 bp, Homo sapiens
tgtgtataat

SEQ ID NO: 5329293 - DNA, 21 bp, Homo sapiens
tgtgtatacacttaaacttgc

SEQ ID NO: 5329294 - DNA, 14 bp, Homo sapiens
tgtgtatacagaaa

SEQ ID NO: 5329295 - DNA, 22 bp, Homo sapiens
tgtgtatacagccctgacgcaa

SEQ ID NO: 5329296 - DNA, 15 bp, Homo sapiens
tgtgtatacatatgt

SEQ ID NO: 5329297 - DNA, 14 bp, Homo sapiens
tgtgtatactgtaa

SEQ ID NO: 5329298 - DNA, 14 bp, Homo sapiens
tgtgtatagctgtg

SEQ ID NO: 5329299 - DNA, 13 bp, Homo sapiens
tgtgtataggaat

SEQ ID NO: 5329300 - DNA, 16 bp, Homo sapiens
tgtgtatatatacata

SEQ ID NO: 5329301 - DNA, 21 bp, Homo sapiens
tgtgtatatatatatatatgt

SEQ ID NO: 5329302 - DNA, 14 bp, Homo sapiens
tgtgtatatggaca

SEQ ID NO: 5329303 - DNA, 13 bp, Homo sapiens
tgtgtatatgtat

SEQ ID NO: 5329304 - DNA, 21 bp, Homo sapiens
tgtgtatatgtttatacacac

SEQ ID NO: 5329305 - DNA, 23 bp, Homo sapiens
tgtgtatatgtttatacacacag

SEQ ID NO: 5329306 - DNA, 14 bp, Homo sapiens
tgtgtatattacac

SEQ ID NO: 5329307 - DNA, 16 bp, Homo sapiens
tgtgtatattacacca

SEQ ID NO: 5329308 - DNA, 18 bp, Homo sapiens
tgtgtatattatttggca

SEQ ID NO: 5329309 - DNA, 14 bp, Homo sapiens
tgtgtatattggtg

SEQ ID NO: 5329310 - DNA, 21 bp, Homo sapiens
tgtgtatatttgatttattaa

SEQ ID NO: 5329311 - DNA, 14 bp, Homo sapiens
tgtgtatatttgta

SEQ ID NO: 5329312 - DNA, 21 bp, Homo sapiens
tgtgtatcagtttccatgaaa

SEQ ID NO: 5329313 - DNA, 13 bp, Homo sapiens
tgtgtatcattaa

SEQ ID NO: 5329314 - DNA, 19 bp, Homo sapiens
tgtgtatccattatcatgt

SEQ ID NO: 5329315 - DNA, 24 bp, Homo sapiens
tgtgtatccattatcatgtgtaat

SEQ ID NO: 5329316 - DNA, 17 bp, Homo sapiens
tgtgtatccgactctaa

SEQ ID NO: 5329317 - DNA, 19 bp, Homo sapiens
tgtgtatccgactctaagc

SEQ ID NO: 5329318 - DNA, 22 bp, Homo sapiens
tgtgtatccgactctaagctgt

SEQ ID NO: 5329319 - DNA, 17 bp, Homo sapiens
tgtgtatctctttcaca

SEQ ID NO: 5329320 - DNA, 22 bp, Homo sapiens
tgtgtatgagactgtgtttcta

SEQ ID NO: 5329321 - DNA, 13 bp, Homo sapiens
tgtgtatgagaga

SEQ ID NO: 5329322 - DNA, 23 bp, Homo sapiens
tgtgtatgcacatgaacttagat

SEQ ID NO: 5329323 - DNA, 14 bp, Homo sapiens
tgtgtatgccaaga

SEQ ID NO: 5329324 - DNA, 23 bp, Homo sapiens
tgtgtatgggggaaggcgctggg

SEQ ID NO: 5329325 - DNA, 18 bp, Homo sapiens
tgtgtatgggtagcacta

SEQ ID NO: 5329326 - DNA, 11 bp, Homo sapiens
tgtgtatgtac

SEQ ID NO: 5329327 - DNA, 22 bp, Homo sapiens
tgtgtatgtacttagctgtact

SEQ ID NO: 5329328 - DNA, 12 bp, Homo sapiens
tgtgtatgtata

SEQ ID NO: 5329329 - DNA, 19 bp, Homo sapiens
tgtgtatgtatacacacat

SEQ ID NO: 5329330 - DNA, 15 bp, Homo sapiens
tgtgtatgtcagtgg

SEQ ID NO: 5329331 - DNA, 12 bp, Homo sapiens
tgtgtatgtcta

SEQ ID NO: 5329332 - DNA, 16 bp, Homo sapiens
tgtgtatgtctatgtg

SEQ ID NO: 5329333 - DNA, 11 bp, Homo sapiens
tgtgtatgtgg

SEQ ID NO: 5329334 - DNA, 12 bp, Homo sapiens
tgtgtatgtggg

SEQ ID NO: 5329335 - DNA, 16 bp, Homo sapiens
tgtgtatgtgtattta

SEQ ID NO: 5329336 - DNA, 16 bp, Homo sapiens
tgtgtatgtgtgtgtg

SEQ ID NO: 5329337 - DNA, 13 bp, Homo sapiens
tgtgtatgtgttt

SEQ ID NO: 5329338 - DNA, 19 bp, Homo sapiens
tgtgtatgtgtttataatt

SEQ ID NO: 5329339 - DNA, 14 bp, Homo sapiens
tgtgtattaaaaaa

SEQ ID NO: 5329340 - DNA, 15 bp, Homo sapiens
tgtgtattaaatggt

SEQ ID NO: 5329341 - DNA, 15 bp, Homo sapiens
tgtgtattaacatgc

SEQ ID NO: 5329342 - DNA, 19 bp, Homo sapiens
tgtgtattcattgaagtca

SEQ ID NO: 5329343 - DNA, 14 bp, Homo sapiens
tgtgtattccaaga

SEQ ID NO: 5329344 - DNA, 13 bp, Homo sapiens
tgtgtattctgtg

SEQ ID NO: 5329345 - DNA, 23 bp, Homo sapiens
tgtgtattctgtggattctatat

SEQ ID NO: 5329346 - DNA, 12 bp, Homo sapiens
tgtgtattctta

SEQ ID NO: 5329347 - DNA, 20 bp, Homo sapiens
tgtgtattgagtcttaactg

SEQ ID NO: 5329348 - DNA, 18 bp, Homo sapiens
tgtgtattgatgcaatat

SEQ ID NO: 5329349 - DNA, 18 bp, Homo sapiens
tgtgtatttaacagggag

SEQ ID NO: 5329350 - DNA, 22 bp, Homo sapiens
tgtgtatttaacagggagggga

SEQ ID NO: 5329351 - DNA, 19 bp, Homo sapiens
tgtgtatttaattgtaaac

SEQ ID NO: 5329352 - DNA, 23 bp, Homo sapiens
tgtgtatttatttaaaactctgg

SEQ ID NO: 5329353 - DNA, 13 bp, Homo sapiens
tgtgtatttctaa

SEQ ID NO: 5329354 - DNA, 13 bp, Homo sapiens
tgtgtatttctct

SEQ ID NO: 5329355 - DNA, 13 bp, Homo sapiens
tgtgtatttctgt

SEQ ID NO: 5329356 - DNA, 15 bp, Homo sapiens
tgtgtatttgtatta

SEQ ID NO: 5329357 - DNA, 19 bp, Homo sapiens
tgtgtatttgtattaataa

SEQ ID NO: 5329358 - DNA, 16 bp, Homo sapiens
tgtgtattttcctgga

SEQ ID NO: 5329359 - DNA, 16 bp, Homo sapiens
tgtgtattttctttgg

SEQ ID NO: 5329360 - DNA, 17 bp, Homo sapiens
tgtgtatttttcaaggc

SEQ ID NO: 5329361 - DNA, 21 bp, Homo sapiens
tgtgtatttttgttgcagtgt

SEQ ID NO: 5329362 - DNA, 17 bp, Homo sapiens
tgtgtcaaccactaaag

SEQ ID NO: 5329363 - DNA, 17 bp, Homo sapiens
tgtgtcaagacatttct

SEQ ID NO: 5329364 - DNA, 14 bp, Homo sapiens
tgtgtcaatgtaaa

SEQ ID NO: 5329365 - DNA, 17 bp, Homo sapiens
tgtgtcacaaagctaaa

SEQ ID NO: 5329366 - DNA, 23 bp, Homo sapiens
tgtgtcacaatgagattgaattt

SEQ ID NO: 5329367 - DNA, 18 bp, Homo sapiens
tgtgtgttgcttatgttg

SEQ ID NO: 5329368 - DNA, 19 bp, Homo sapiens
tgtgtgttgcttctctatt

SEQ ID NO: 5329369 - DNA, 18 bp, Homo sapiens
tgtgtgttgtcagcctgt

SEQ ID NO: 5329370 - DNA, 18 bp, Homo sapiens
tgtgtgttgtctcttgag

SEQ ID NO: 5329371 - DNA, 14 bp, Homo sapiens
tgtgtgttgtctga

SEQ ID NO: 5329372 - DNA, 18 bp, Homo sapiens
tgtgtgttgtcttgaaag

SEQ ID NO: 5329373 - DNA, 16 bp, Homo sapiens
tgtgtgttgtgtccat

SEQ ID NO: 5329374 - DNA, 17 bp, Homo sapiens
tgtgtgttgtttccata

SEQ ID NO: 5329375 - DNA, 18 bp, Homo sapiens
tgtgtgtttaaataaagt

SEQ ID NO: 5329376 - DNA, 21 bp, Homo sapiens
tgtgtgtttaacattcacagc

SEQ ID NO: 5329377 - DNA, 23 bp, Homo sapiens
tgtgtgtttaacattcacagccc

SEQ ID NO: 5329378 - DNA, 11 bp, Homo sapiens
tgtgtgtttat

SEQ ID NO: 5329379 - DNA, 19 bp, Homo sapiens
tgtgtgtttattgtcaaag

SEQ ID NO: 5329380 - DNA, 19 bp, Homo sapiens
tgtgtgtttcaaggtcaga

SEQ ID NO: 5329381 - DNA, 13 bp, Homo sapiens
tgtgtgtttcact

SEQ ID NO: 5329382 - DNA, 13 bp, Homo sapiens
tgtgtgtttcttg

SEQ ID NO: 5329383 - DNA, 14 bp, Homo sapiens
tgtgtgtttcttgc

SEQ ID NO: 5329384 - DNA, 18 bp, Homo sapiens
tgtgtgtttcttgctttg

SEQ ID NO: 5329385 - DNA, 15 bp, Homo sapiens
tgtgtgtttgtgctg

SEQ ID NO: 5329386 - DNA, 20 bp, Homo sapiens
tgtgtgttttcccaaagcac

SEQ ID NO: 5329387 - DNA, 16 bp, Homo sapiens
tgtgtgtttttataga

SEQ ID NO: 5329388 - DNA, 20 bp, Homo sapiens
tgtgttaaacatgctaaata

SEQ ID NO: 5329389 - DNA, 16 bp, Homo sapiens
tgtgttaaatttagtg

SEQ ID NO: 5329390 - DNA, 19 bp, Homo sapiens
tgtgttaacttatgtctct

SEQ ID NO: 5329391 - DNA, 22 bp, Homo sapiens
tgtgttaacttgcctccatctt

SEQ ID NO: 5329392 - DNA, 19 bp, Homo sapiens
tgtgttaagctctgctatt

SEQ ID NO: 5329393 - DNA, 21 bp, Homo sapiens
tgtgttacccaggctggtctc

SEQ ID NO: 5329394 - DNA, 19 bp, Homo sapiens
tgtgttaccctcctgtaaa

SEQ ID NO: 5329395 - DNA, 12 bp, Homo sapiens
tgtgttactgat

SEQ ID NO: 5329396 - DNA, 17 bp, Homo sapiens
tgtgttactgctttgca

SEQ ID NO: 5329397 - DNA, 18 bp, Homo sapiens
tgtgttactgctttgcaa

SEQ ID NO: 5329398 - DNA, 15 bp, Homo sapiens
tgtgttacttcaagt

SEQ ID NO: 5329399 - DNA, 18 bp, Homo sapiens
tgtgttacttgaagtaac

SEQ ID NO: 5329400 - DNA, 19 bp, Homo sapiens
tgtgttagtgtctgtccat

SEQ ID NO: 5329401 - DNA, 22 bp, Homo sapiens
tgtgttagttaagaattgaaga

SEQ ID NO: 5329402 - DNA, 23 bp, Homo sapiens
tgtgttatcacccagaagaaaat

SEQ ID NO: 5329403 - DNA, 23 bp, Homo sapiens
tgtgttattattttttaataaga

SEQ ID NO: 5329404 - DNA, 20 bp, Homo sapiens
tgtgttatttccccagccac

SEQ ID NO: 5329405 - DNA, 20 bp, Homo sapiens
tgtgttcaatgaaataaaag

SEQ ID NO: 5329406 - DNA, 14 bp, Homo sapiens
tgtgttcaccatcg

SEQ ID NO: 5329407 - DNA, 22 bp, Homo sapiens
tgtgttcaccttcaaaatgttc

SEQ ID NO: 5329408 - DNA, 15 bp, Homo sapiens
tgtgttcagtgcctt

SEQ ID NO: 5329409 - DNA, 22 bp, Homo sapiens
tgtgttcagtgccttggagcag

SEQ ID NO: 5329410 - DNA, 14 bp, Homo sapiens
tgtgttcagttttg

SEQ ID NO: 5329411 - DNA, 22 bp, Homo sapiens
tgtgttcatccagctacttagc

SEQ ID NO: 5329412 - DNA, 19 bp, Homo sapiens
tgtgttcattaatgtttat

SEQ ID NO: 5329413 - DNA, 13 bp, Homo sapiens
tgtgttcattctt

SEQ ID NO: 5329414 - DNA, 12 bp, Homo sapiens
tgtgttcatttc

SEQ ID NO: 5329415 - DNA, 15 bp, Homo sapiens
tgtgttcatttcatt

SEQ ID NO: 5329416 - DNA, 16 bp, Homo sapiens
tgtgttccaaccactg

SEQ ID NO: 5329417 - DNA, 17 bp, Homo sapiens
tgtgttccaagtttcca

SEQ ID NO: 5329418 - DNA, 16 bp, Homo sapiens
tgtgttcccatttcag

SEQ ID NO: 5329419 - DNA, 17 bp, Homo sapiens
tgtgttccccagctgat

SEQ ID NO: 5329420 - DNA, 19 bp, Homo sapiens
tgtgttccgggaataacat

SEQ ID NO: 5329421 - DNA, 12 bp, Homo sapiens
tgtgttcctcct

SEQ ID NO: 5329422 - DNA, 19 bp, Homo sapiens
tgtgttcctctttgcatga

SEQ ID NO: 5329423 - DNA, 13 bp, Homo sapiens
tgtgttcctggct

SEQ ID NO: 5329424 - DNA, 12 bp, Homo sapiens
tgtgttccttct

SEQ ID NO: 5329425 - DNA, 14 bp, Homo sapiens
tgtgttccttctgt

SEQ ID NO: 5329426 - DNA, 15 bp, Homo sapiens
tgtgttccttctgtg

SEQ ID NO: 5329427 - DNA, 17 bp, Homo sapiens
tgtgttccttctgtgaa

SEQ ID NO: 5329428 - DNA, 18 bp, Homo sapiens
tgtgttccttctgtgaag

SEQ ID NO: 5329429 - DNA, 19 bp, Homo sapiens
tgtgttccttctgtgaaga

SEQ ID NO: 5329430 - DNA, 19 bp, Homo sapiens
tgtgttcctttttgcagca

SEQ ID NO: 5329431 - DNA, 23 bp, Homo sapiens
tgtgttcgggggagcagagagag

SEQ ID NO: 5329432 - DNA, 15 bp, Homo sapiens
tgtgttcgttcttgt

SEQ ID NO: 5329433 - DNA, 22 bp, Homo sapiens
tgtgttcgttgcacagctgttt

SEQ ID NO: 5329434 - DNA, 10 bp, Homo sapiens
tgtgttctaa

SEQ ID NO: 5329435 - DNA, 13 bp, Homo sapiens
tgtgttctatcca

SEQ ID NO: 5329436 - DNA, 16 bp, Homo sapiens
tgtgttctcaacacac

SEQ ID NO: 5329437 - DNA, 14 bp, Homo sapiens
tgtgttctgctcca

SEQ ID NO: 5329438 - DNA, 12 bp, Homo sapiens
tgtgttctgggc

SEQ ID NO: 5329439 - DNA, 23 bp, Homo sapiens
tgtgttctgttgaaggtgccatt

SEQ ID NO: 5329440 - DNA, 15 bp, Homo sapiens
tgtgttcttaaaata

SEQ ID NO: 5329441 - DNA, 14 bp, Homo sapiens
tgtgttctttataa

SEQ ID NO: 5329442 - DNA, 20 bp, Homo sapiens
tgtgttcttttgatacattt

SEQ ID NO: 5329443 - DNA, 22 bp, Homo sapiens
tgtgttcttttgatacatttat

SEQ ID NO: 5329444 - DNA, 13 bp, Homo sapiens
tgtgttgaaatat

SEQ ID NO: 5329445 - DNA, 14 bp, Homo sapiens
tgtgttgacactgt

SEQ ID NO: 5329446 - DNA, 15 bp, Homo sapiens
tgtgttgactttata

SEQ ID NO: 5329447 - DNA, 21 bp, Homo sapiens
tgtgttgagtgaagtttggag

SEQ ID NO: 5329448 - DNA, 15 bp, Homo sapiens
tgtgttgatacattc

SEQ ID NO: 5329449 - DNA, 15 bp, Homo sapiens
tgtgttgatactgtt

SEQ ID NO: 5329450 - DNA, 20 bp, Homo sapiens
tgtgttgatactgttgcacg

SEQ ID NO: 5329451 - DNA, 16 bp, Homo sapiens
tgtgttgcactgaaca

SEQ ID NO: 5329452 - DNA, 14 bp, Homo sapiens
tgtgttgcattatt

SEQ ID NO: 5329453 - DNA, 13 bp, Homo sapiens
tgtgttgccaaag

SEQ ID NO: 5329454 - DNA, 23 bp, Homo sapiens
tgtgttgccacaggacacagtca

SEQ ID NO: 5329455 - DNA, 22 bp, Homo sapiens
tgtgttgccacagtagaactgt

SEQ ID NO: 5329456 - DNA, 22 bp, Homo sapiens
tgtgttgccattttgtctggct

SEQ ID NO: 5329457 - DNA, 16 bp, Homo sapiens
tgtgttgccctggcat

SEQ ID NO: 5329458 - DNA, 20 bp, Homo sapiens
tgtgttgctctccattcttt

SEQ ID NO: 5329459 - DNA, 17 bp, Homo sapiens
tgtgttgcttatgttgt

SEQ ID NO: 5329460 - DNA, 19 bp, Homo sapiens
tgtgttgctttctgactga

SEQ ID NO: 5329461 - DNA, 20 bp, Homo sapiens
tgtgttgctttggatacaca

SEQ ID NO: 5329462 - DNA, 13 bp, Homo sapiens
tgtgttggaaact

SEQ ID NO: 5329463 - DNA, 18 bp, Homo sapiens
tgtgttggaaactgtaaa

SEQ ID NO: 5329464 - DNA, 12 bp, Homo sapiens
tgtgttggctgt

SEQ ID NO: 5329465 - DNA, 13 bp, Homo sapiens
tgtgttggcttta

SEQ ID NO: 5329466 - DNA, 13 bp, Homo sapiens
tgtgttgggcccc

SEQ ID NO: 5329467 - DNA, 14 bp, Homo sapiens
tgtgttgggcccca

SEQ ID NO: 5329468 - DNA, 19 bp, Homo sapiens
tgtgttggggccttggcct

SEQ ID NO: 5329469 - DNA, 21 bp, Homo sapiens
tgtgttgggggaaatgttgtg

SEQ ID NO: 5329470 - DNA, 18 bp, Homo sapiens
tgtgttggggggcaaggt

SEQ ID NO: 5329471 - DNA, 18 bp, Homo sapiens
tgtgttggtatttactgc

SEQ ID NO: 5329472 - DNA, 17 bp, Homo sapiens
tgtgttggtgtggccca

SEQ ID NO: 5329473 - DNA, 20 bp, Homo sapiens
tgtgttgtacaataccagat

SEQ ID NO: 5329474 - DNA, 15 bp, Homo sapiens
tgtgttgtcagcctg

SEQ ID NO: 5329475 - DNA, 16 bp, Homo sapiens
tgtgttgtcagcctgt

SEQ ID NO: 5329476 - DNA, 19 bp, Homo sapiens
tgtgttgtctcttgagttt

SEQ ID NO: 5329477 - DNA, 14 bp, Homo sapiens
tgtgttgtcttgaa

SEQ ID NO: 5329478 - DNA, 19 bp, Homo sapiens
tgtgttgtcttttttatgt

SEQ ID NO: 5329479 - DNA, 13 bp, Homo sapiens
tgtgttgtgcttt

SEQ ID NO: 5329480 - DNA, 23 bp, Homo sapiens
tgtgttgtgtgtgggagtgtgta

SEQ ID NO: 5329481 - DNA, 23 bp, Homo sapiens
tgtgttgttgcttcttgtgaagg

SEQ ID NO: 5329482 - DNA, 16 bp, Homo sapiens
tgtgttgttttctctg

SEQ ID NO: 5329483 - DNA, 23 bp, Homo sapiens
tgtgtttaaaaattgaaaaaagt

SEQ ID NO: 5329484 - DNA, 16 bp, Homo sapiens
tgtgtttaaactgagt

SEQ ID NO: 5329485 - DNA, 12 bp, Homo sapiens
tgtgtttaaata

SEQ ID NO: 5329486 - DNA, 21 bp, Homo sapiens
tgtgtttaaattattttatca

SEQ ID NO: 5329487 - DNA, 21 bp, Homo sapiens
tgtgtttaacattcacagccc

SEQ ID NO: 5329488 - DNA, 17 bp, Homo sapiens
tgtgtttagaagcctaa

SEQ ID NO: 5329489 - DNA, 15 bp, Homo sapiens
tgtgtttaggcctca

SEQ ID NO: 5329490 - DNA, 14 bp, Homo sapiens
tgtgtttataaaat

SEQ ID NO: 5329491 - DNA, 23 bp, Homo sapiens
tgtgtttatatgtcttgcaaagc

SEQ ID NO: 5329492 - DNA, 16 bp, Homo sapiens
tgtgtttatgtaactt

SEQ ID NO: 5329493 - DNA, 17 bp, Homo sapiens
tgtgtttatgtgagctg

SEQ ID NO: 5329494 - DNA, 15 bp, Homo sapiens
tgtgtttatgtgtgt

SEQ ID NO: 5329495 - DNA, 14 bp, Homo sapiens
tgtgtttattcaaa

SEQ ID NO: 5329496 - DNA, 22 bp, Homo sapiens
tgtgtttattcaaactgaaaag

SEQ ID NO: 5329497 - DNA, 20 bp, Homo sapiens
tgtgtttattcttgatgaaa

SEQ ID NO: 5329498 - DNA, 13 bp, Homo sapiens
tgtgtttattgtc

SEQ ID NO: 5329499 - DNA, 21 bp, Homo sapiens
tgtgtttcaaaaccatgcctg

SEQ ID NO: 5329500 - DNA, 17 bp, Homo sapiens
tgtgtttcaaggtcaga

SEQ ID NO: 5329501 - DNA, 18 bp, Homo sapiens
tgtgtttcacagtttgaa

SEQ ID NO: 5329502 - DNA, 21 bp, Homo sapiens
tgtgtttcacagtttgaaata

SEQ ID NO: 5329503 - DNA, 14 bp, Homo sapiens
tgtgtttcagccac

SEQ ID NO: 5329504 - DNA, 19 bp, Homo sapiens
tgtgtttcaggacagctgc

SEQ ID NO: 5329505 - DNA, 19 bp, Homo sapiens
tgtgtttcatgttctgtgt

SEQ ID NO: 5329506 - DNA, 17 bp, Homo sapiens
tgtgtttcattacttga

SEQ ID NO: 5329507 - DNA, 18 bp, Homo sapiens
tgtgtttccaaaggttcc

SEQ ID NO: 5329508 - DNA, 21 bp, Homo sapiens
tgtgtttccctagactctgta

SEQ ID NO: 5329509 - DNA, 11 bp, Homo sapiens
tgtgtttcctt

SEQ ID NO: 5329510 - DNA, 15 bp, Homo sapiens
tgtgtttccttttca

SEQ ID NO: 5329511 - DNA, 18 bp, Homo sapiens
tgtgtttctaaaactatg

SEQ ID NO: 5329512 - DNA, 20 bp, Homo sapiens
tgtgtttctatgtgacaatt

SEQ ID NO: 5329513 - DNA, 14 bp, Homo sapiens
tgtgtttctgacac

SEQ ID NO: 5329514 - DNA, 13 bp, Homo sapiens
tgtgtttctgtaa

SEQ ID NO: 5329515 - DNA, 14 bp, Homo sapiens
tgtgtttgaagttt

SEQ ID NO: 5329516 - DNA, 20 bp, Homo sapiens
tgtgtttgacactaagaaaa

SEQ ID NO: 5329517 - DNA, 14 bp, Homo sapiens
tgtgtttgagcaag

SEQ ID NO: 5329518 - DNA, 13 bp, Homo sapiens
tgtgtttgatttt

SEQ ID NO: 5329519 - DNA, 16 bp, Homo sapiens
tgtgtttgcagcctgc

SEQ ID NO: 5329520 - DNA, 16 bp, Homo sapiens
tgtgtttgcattgtct

SEQ ID NO: 5329521 - DNA, 15 bp, Homo sapiens
tgtgtttgctgcctt

SEQ ID NO: 5329522 - DNA, 12 bp, Homo sapiens
tgtgtttgcttg

SEQ ID NO: 5329523 - DNA, 14 bp, Homo sapiens
tgtgtttgctttct

SEQ ID NO: 5329524 - DNA, 15 bp, Homo sapiens
tgtgtttgctttctg

SEQ ID NO: 5329525 - DNA, 17 bp, Homo sapiens
tgtgtttggaagactat

SEQ ID NO: 5329526 - DNA, 18 bp, Homo sapiens
tgtgtttggcttggcctt

SEQ ID NO: 5329527 - DNA, 15 bp, Homo sapiens
tgtgtttggctttca

SEQ ID NO: 5329528 - DNA, 16 bp, Homo sapiens
tgtgtttggctttcag

SEQ ID NO: 5329529 - DNA, 18 bp, Homo sapiens
tgtgtttggttctggggc

SEQ ID NO: 5329530 - DNA, 17 bp, Homo sapiens
tgtgtttggtttacatt

SEQ ID NO: 5329531 - DNA, 19 bp, Homo sapiens
tgtgtttgtcattagcctg

SEQ ID NO: 5329532 - DNA, 9 bp, Homo sapiens
tgtgtttta

SEQ ID NO: 5329533 - DNA, 19 bp, Homo sapiens
tgtgttttaaaaaaactga

SEQ ID NO: 5329534 - DNA, 21 bp, Homo sapiens
tgtgttttaaaaaaactgaag

SEQ ID NO: 5329535 - DNA, 20 bp, Homo sapiens
tgtgttttaattttctttat

SEQ ID NO: 5329536 - DNA, 12 bp, Homo sapiens
tgtgttttataa

SEQ ID NO: 5329537 - DNA, 19 bp, Homo sapiens
tgtgttttcagactgcctg

SEQ ID NO: 5329538 - DNA, 13 bp, Homo sapiens
tgtgttttcataa

SEQ ID NO: 5329539 - DNA, 20 bp, Homo sapiens
tgtgttttcatcatttcagc

SEQ ID NO: 5329540 - DNA, 20 bp, Homo sapiens
tgtgttttcccaaagcactt

SEQ ID NO: 5329541 - DNA, 13 bp, Homo sapiens
tgtgttttcctaa

SEQ ID NO: 5329542 - DNA, 14 bp, Homo sapiens
tgtgttttcctaaa

SEQ ID NO: 5329543 - DNA, 16 bp, Homo sapiens
tgtgttttcttcgtgg

SEQ ID NO: 5329544 - DNA, 19 bp, Homo sapiens
tgtgttttcttcgtggatt

SEQ ID NO: 5329545 - DNA, 23 bp, Homo sapiens
tgtgttttcttcgtggattgttt

SEQ ID NO: 5329546 - DNA, 12 bp, Homo sapiens
tgttagtgtctg

SEQ ID NO: 5329547 - DNA, 15 bp, Homo sapiens
tgttagtgtctgtcc

SEQ ID NO: 5329548 - DNA, 16 bp, Homo sapiens
tgttagtgtctgtcca

SEQ ID NO: 5329549 - DNA, 17 bp, Homo sapiens
tgttagttaaaggctta

SEQ ID NO: 5329550 - DNA, 20 bp, Homo sapiens
tgttagttaccttatagtta

SEQ ID NO: 5329551 - DNA, 23 bp, Homo sapiens
tgttagttaccttatagttactg

SEQ ID NO: 5329552 - DNA, 17 bp, Homo sapiens
tgttagttatagatgtc

SEQ ID NO: 5329553 - DNA, 15 bp, Homo sapiens
tgttagttcccaaca

SEQ ID NO: 5329554 - DNA, 22 bp, Homo sapiens
tgttagttcctgtatgaaagat

SEQ ID NO: 5329555 - DNA, 14 bp, Homo sapiens
tgttagtttacaat

SEQ ID NO: 5329556 - DNA, 17 bp, Homo sapiens
tgttagtttacaatatt

SEQ ID NO: 5329557 - DNA, 22 bp, Homo sapiens
tgttagtttacaatattatgaa

SEQ ID NO: 5329558 - DNA, 23 bp, Homo sapiens
tgttagtttacaatattatgaaa

SEQ ID NO: 5329559 - DNA, 23 bp, Homo sapiens
tgttagtttagtgtgtgtgcaga

SEQ ID NO: 5329560 - DNA, 14 bp, Homo sapiens
tgttagttttcctt

SEQ ID NO: 5329561 - DNA, 21 bp, Homo sapiens
tgttagttttgtaaaaactga

SEQ ID NO: 5329562 - DNA, 16 bp, Homo sapiens
tgttataaaataacat

SEQ ID NO: 5329563 - DNA, 12 bp, Homo sapiens
tgttataaattt

SEQ ID NO: 5329564 - DNA, 18 bp, Homo sapiens
tgttataaattttgtaca

SEQ ID NO: 5329565 - DNA, 20 bp, Homo sapiens
tgttataaattttgtacatt

SEQ ID NO: 5329566 - DNA, 17 bp, Homo sapiens
tgttatacaaccttcat

SEQ ID NO: 5329567 - DNA, 22 bp, Homo sapiens
tgttatacaaccttcatttaaa

SEQ ID NO: 5329568 - DNA, 15 bp, Homo sapiens
tgttatacaaggcaa

SEQ ID NO: 5329569 - DNA, 17 bp, Homo sapiens
tgttatacacagttcca

SEQ ID NO: 5329570 - DNA, 15 bp, Homo sapiens
tgttatacattttta

SEQ ID NO: 5329571 - DNA, 21 bp, Homo sapiens
tgttatactgaaccaggccag

SEQ ID NO: 5329572 - DNA, 19 bp, Homo sapiens
tgttatagaacttcatgga

SEQ ID NO: 5329573 - DNA, 20 bp, Homo sapiens
tgttatagaacttcatggat

SEQ ID NO: 5329574 - DNA, 19 bp, Homo sapiens
tgttatagaatagcctgag

SEQ ID NO: 5329575 - DNA, 18 bp, Homo sapiens
tgttatagattgtcttaa

SEQ ID NO: 5329576 - DNA, 15 bp, Homo sapiens
tgttatagatttagc

SEQ ID NO: 5329577 - DNA, 19 bp, Homo sapiens
tgttataggtcctttagaa

SEQ ID NO: 5329578 - DNA, 15 bp, Homo sapiens
tgttatataatcatt

SEQ ID NO: 5329579 - DNA, 12 bp, Homo sapiens
tgttatataatt

SEQ ID NO: 5329580 - DNA, 16 bp, Homo sapiens
tgttatatataaatat

SEQ ID NO: 5329581 - DNA, 17 bp, Homo sapiens
tgttatatataaatata

SEQ ID NO: 5329582 - DNA, 22 bp, Homo sapiens
tgttatatatttactcagtctt

SEQ ID NO: 5329583 - DNA, 19 bp, Homo sapiens
tgttatatcccctgctacc

SEQ ID NO: 5329584 - DNA, 13 bp, Homo sapiens
tgttatatgaaca

SEQ ID NO: 5329585 - DNA, 14 bp, Homo sapiens
tgttatatgaacat

SEQ ID NO: 5329586 - DNA, 14 bp, Homo sapiens
tgttatattaaaga

SEQ ID NO: 5329587 - DNA, 12 bp, Homo sapiens
tgttatattata

SEQ ID NO: 5329588 - DNA, 16 bp, Homo sapiens
tgttatattccaagga

SEQ ID NO: 5329589 - DNA, 13 bp, Homo sapiens
tgttatattgctt

SEQ ID NO: 5329590 - DNA, 14 bp, Homo sapiens
tgttatattgcttc

SEQ ID NO: 5329591 - DNA, 20 bp, Homo sapiens
tgttatatttaatgcattaa

SEQ ID NO: 5329592 - DNA, 18 bp, Homo sapiens
tgttatatttccttttgt

SEQ ID NO: 5329593 - DNA, 16 bp, Homo sapiens
tgttatatttttctta

SEQ ID NO: 5329594 - DNA, 20 bp, Homo sapiens
tgttatcaaaactttctttt

SEQ ID NO: 5329595 - DNA, 19 bp, Homo sapiens
tgttatcaccgtgggctcc

SEQ ID NO: 5329596 - DNA, 21 bp, Homo sapiens
tgttatcagtcaatattttta

SEQ ID NO: 5329597 - DNA, 17 bp, Homo sapiens
tgttatccactacaggt

SEQ ID NO: 5329598 - DNA, 19 bp, Homo sapiens
tgttatcctcttgtatact

SEQ ID NO: 5329599 - DNA, 22 bp, Homo sapiens
tgttatcctgctagctgtagaa

SEQ ID NO: 5329600 - DNA, 19 bp, Homo sapiens
tgttatccttttttaaaag

SEQ ID NO: 5329601 - DNA, 22 bp, Homo sapiens
tgttatcggctctattctctaa

SEQ ID NO: 5329602 - DNA, 16 bp, Homo sapiens
tgttatctcaggtgag

SEQ ID NO: 5329603 - DNA, 17 bp, Homo sapiens
tgttatctcaggtgagc

SEQ ID NO: 5329604 - DNA, 20 bp, Homo sapiens
tgttatctgtctttatgatt

SEQ ID NO: 5329605 - DNA, 15 bp, Homo sapiens
tgttatcttaacact

SEQ ID NO: 5329606 - DNA, 17 bp, Homo sapiens
tgttatcttaacactga

SEQ ID NO: 5329607 - DNA, 18 bp, Homo sapiens
tgttatcttaacactgaa

SEQ ID NO: 5329608 - DNA, 22 bp, Homo sapiens
tgttatcttatactgtacaata

SEQ ID NO: 5329609 - DNA, 15 bp, Homo sapiens
tgttatcttctcaag

SEQ ID NO: 5329610 - DNA, 14 bp, Homo sapiens
tgttatcttggtgt

SEQ ID NO: 5329611 - DNA, 21 bp, Homo sapiens
tgttatgaaaatcctatatct

SEQ ID NO: 5329612 - DNA, 16 bp, Homo sapiens
tgttatgaaataaaga

SEQ ID NO: 5329613 - DNA, 17 bp, Homo sapiens
tgttatgaacagctgtg

SEQ ID NO: 5329614 - DNA, 22 bp, Homo sapiens
tgttatgacagccctaggaaac

SEQ ID NO: 5329615 - DNA, 13 bp, Homo sapiens
tgttatgactcca

SEQ ID NO: 5329616 - DNA, 14 bp, Homo sapiens
tgttatgagaaatt

SEQ ID NO: 5329617 - DNA, 14 bp, Homo sapiens
tgttatgataaaag

SEQ ID NO: 5329618 - DNA, 18 bp, Homo sapiens
tgttatgatcgcctgtgg

SEQ ID NO: 5329619 - DNA, 12 bp, Homo sapiens
tgttatgatgtg

SEQ ID NO: 5329620 - DNA, 18 bp, Homo sapiens
tgttatgatttccttcaa

SEQ ID NO: 5329621 - DNA, 21 bp, Homo sapiens
tgttatgatttccttcaatgt

SEQ ID NO: 5329622 - DNA, 18 bp, Homo sapiens
tgttatgcaaatgagatt

SEQ ID NO: 5329623 - DNA, 23 bp, Homo sapiens
tgttatgcactgtggtttcagat

SEQ ID NO: 5329624 - DNA, 15 bp, Homo sapiens
tgttatgcagtgaac

SEQ ID NO: 5329625 - DNA, 17 bp, Homo sapiens
tgttatgcagtgaacta

SEQ ID NO: 5329626 - DNA, 20 bp, Homo sapiens
tgttatgcctgttgcaggca

SEQ ID NO: 5329627 - DNA, 13 bp, Homo sapiens
tgttatgctgttt

SEQ ID NO: 5329628 - DNA, 19 bp, Homo sapiens
tgttatgctgtttcctagc

SEQ ID NO: 5329629 - DNA, 14 bp, Homo sapiens
tgttatggaaactg

SEQ ID NO: 5329630 - DNA, 18 bp, Homo sapiens
tgttatggcttaatgaca

SEQ ID NO: 5329631 - DNA, 12 bp, Homo sapiens
tgttatgtaaaa

SEQ ID NO: 5329632 - DNA, 19 bp, Homo sapiens
tgttatgtaaacatcataa

SEQ ID NO: 5329633 - DNA, 13 bp, Homo sapiens
tgttatgtacaaa

SEQ ID NO: 5329634 - DNA, 18 bp, Homo sapiens
tgttatgtacaaactagt

SEQ ID NO: 5329635 - DNA, 20 bp, Homo sapiens
tgttatgtactagtgttctg

SEQ ID NO: 5329636 - DNA, 15 bp, Homo sapiens
tgttatgtatatggt

SEQ ID NO: 5329637 - DNA, 13 bp, Homo sapiens
tgttatgtatgaa

SEQ ID NO: 5329638 - DNA, 16 bp, Homo sapiens
tgttatgtcattgtgt

SEQ ID NO: 5329639 - DNA, 17 bp, Homo sapiens
tgttatgtgtctggaag

SEQ ID NO: 5329640 - DNA, 18 bp, Homo sapiens
tgttatgtgtctggaaga

SEQ ID NO: 5329641 - DNA, 13 bp, Homo sapiens
tgttatgttgtaa

SEQ ID NO: 5329642 - DNA, 18 bp, Homo sapiens
tgttattaaaaaaacaca

SEQ ID NO: 5329643 - DNA, 14 bp, Homo sapiens
tgttattaaacaaa

SEQ ID NO: 5329644 - DNA, 21 bp, Homo sapiens
tgttattaaacgtatgcatgt

SEQ ID NO: 5329645 - DNA, 23 bp, Homo sapiens
tgttattaaacgtatgcatgtga

SEQ ID NO: 5329646 - DNA, 13 bp, Homo sapiens
tgttattaaatgt

SEQ ID NO: 5329647 - DNA, 17 bp, Homo sapiens
tgttattaatccacaaa

SEQ ID NO: 5329648 - DNA, 15 bp, Homo sapiens
tgttattaatgtttc

SEQ ID NO: 5329649 - DNA, 21 bp, Homo sapiens
tgttattaatgtttcttctcc

SEQ ID NO: 5329650 - DNA, 17 bp, Homo sapiens
tgttattacatccttgt

SEQ ID NO: 5329651 - DNA, 16 bp, Homo sapiens
tgttattaccaaaaca

SEQ ID NO: 5329652 - DNA, 20 bp, Homo sapiens
tgttattactgttttgggcc

SEQ ID NO: 5329653 - DNA, 23 bp, Homo sapiens
tgttattatctgggcttatatct

SEQ ID NO: 5329654 - DNA, 19 bp, Homo sapiens
tgttattatgaaggaattt

SEQ ID NO: 5329655 - DNA, 22 bp, Homo sapiens
tgttattattaccagcatttgt

SEQ ID NO: 5329656 - DNA, 22 bp, Homo sapiens
tgttattattacttatttttga

SEQ ID NO: 5329657 - DNA, 20 bp, Homo sapiens
tgttattattattatattgt

SEQ ID NO: 5329658 - DNA, 15 bp, Homo sapiens
tgttattattcatta

SEQ ID NO: 5329659 - DNA, 20 bp, Homo sapiens
tgttattcaataactattgc

SEQ ID NO: 5329660 - DNA, 18 bp, Homo sapiens
tgttattccatcaataaa

SEQ ID NO: 5329661 - DNA, 24 bp, Homo sapiens
tgttattcctagtggatgactgtt

SEQ ID NO: 5329662 - DNA, 21 bp, Homo sapiens
tgttattcgaaccactgagag

SEQ ID NO: 5329663 - DNA, 14 bp, Homo sapiens
tgttattgaaaaaa

SEQ ID NO: 5329664 - DNA, 16 bp, Homo sapiens
tgttattgaaaaaaat

SEQ ID NO: 5329665 - DNA, 20 bp, Homo sapiens
tgttattgcatgctgataat

SEQ ID NO: 5329666 - DNA, 15 bp, Homo sapiens
tgttattgtgaatga

SEQ ID NO: 5329667 - DNA, 18 bp, Homo sapiens
tgttatttaacagctgaa

SEQ ID NO: 5329668 - DNA, 18 bp, Homo sapiens
tgttatttaatagctgtg

SEQ ID NO: 5329669 - DNA, 16 bp, Homo sapiens
tgttatttacactggt

SEQ ID NO: 5329670 - DNA, 21 bp, Homo sapiens
tgttatttataatcacttttt

SEQ ID NO: 5329671 - DNA, 16 bp, Homo sapiens
tgttatttattattaa

SEQ ID NO: 5329672 - DNA, 14 bp, Homo sapiens
tgttatttattgaa

SEQ ID NO: 5329673 - DNA, 17 bp, Homo sapiens
tgttatttattgaaatg

SEQ ID NO: 5329674 - DNA, 16 bp, Homo sapiens
tgttatttcagatgat

SEQ ID NO: 5329675 - DNA, 20 bp, Homo sapiens
tgttatttccctacattaaa

SEQ ID NO: 5329676 - DNA, 21 bp, Homo sapiens
tgttatttccctacattaaac

SEQ ID NO: 5329677 - DNA, 21 bp, Homo sapiens
tgttatttctatttttgtaga

SEQ ID NO: 5329678 - DNA, 16 bp, Homo sapiens
tgttattttcaatgaa

SEQ ID NO: 5329679 - DNA, 19 bp, Homo sapiens
tgttattttcaatgaaaca

SEQ ID NO: 5329680 - DNA, 15 bp, Homo sapiens
tgttattttcagcat

SEQ ID NO: 5329681 - DNA, 14 bp, Homo sapiens
tgttattttcagta

SEQ ID NO: 5329682 - DNA, 18 bp, Homo sapiens
tgttattttcagtatttt

SEQ ID NO: 5329683 - DNA, 20 bp, Homo sapiens
tgttattttccttctgaagt

SEQ ID NO: 5329684 - DNA, 18 bp, Homo sapiens
tgttattttctgttgaag

SEQ ID NO: 5329685 - DNA, 15 bp, Homo sapiens
tgttattttctttga

SEQ ID NO: 5329686 - DNA, 19 bp, Homo sapiens
tgttattttctttgaaatt

SEQ ID NO: 5329687 - DNA, 17 bp, Homo sapiens
tgttattttgtgtacaa

SEQ ID NO: 5329688 - DNA, 18 bp, Homo sapiens
tgttatttttaagctttt

SEQ ID NO: 5329689 - DNA, 14 bp, Homo sapiens
tgttatttttacag

SEQ ID NO: 5329690 - DNA, 20 bp, Homo sapiens
tgttatttttataagaaaac

SEQ ID NO: 5329691 - DNA, 18 bp, Homo sapiens
tgttatttttcaaggaag

SEQ ID NO: 5329692 - DNA, 19 bp, Homo sapiens
tgttatttttgtattttta

SEQ ID NO: 5329693 - DNA, 19 bp, Homo sapiens
tgttcaaaaaaacactagt

SEQ ID NO: 5329694 - DNA, 16 bp, Homo sapiens
tgttcaaaaagatatt

SEQ ID NO: 5329695 - DNA, 15 bp, Homo sapiens
tgttcaaaaatttct

SEQ ID NO: 5329696 - DNA, 13 bp, Homo sapiens
tgttcaaaagaag

SEQ ID NO: 5329697 - DNA, 14 bp, Homo sapiens
tgttcaaaagaagt

SEQ ID NO: 5329698 - DNA, 16 bp, Homo sapiens
tgttcaaactactgta

SEQ ID NO: 5329699 - DNA, 23 bp, Homo sapiens
tgttcaaagaacccccctcccca

SEQ ID NO: 5329700 - DNA, 16 bp, Homo sapiens
tgttcaaagatgcatt

SEQ ID NO: 5329701 - DNA, 18 bp, Homo sapiens
tgttcaaagccacattat

SEQ ID NO: 5329702 - DNA, 20 bp, Homo sapiens
tgttcaaagccacattattt

SEQ ID NO: 5329703 - DNA, 21 bp, Homo sapiens
tgttcaaagccagcgtcctcc

SEQ ID NO: 5329704 - DNA, 21 bp, Homo sapiens
tgttcaaaggagcaagaactt

SEQ ID NO: 5329705 - DNA, 15 bp, Homo sapiens
tgttcaaagtttaag

SEQ ID NO: 5329706 - DNA, 18 bp, Homo sapiens
tgttcaaattaaaaaagc

SEQ ID NO: 5329707 - DNA, 16 bp, Homo sapiens
tgttcaacagtttctc

SEQ ID NO: 5329708 - DNA, 17 bp, Homo sapiens
tgttcaacatcactgaa

SEQ ID NO: 5329709 - DNA, 18 bp, Homo sapiens
tgttcaagaaataaaaat

SEQ ID NO: 5329710 - DNA, 13 bp, Homo sapiens
tgttcaagcaaaa

SEQ ID NO: 5329711 - DNA, 21 bp, Homo sapiens
tgttcaagcgattctcctgcc

SEQ ID NO: 5329712 - DNA, 13 bp, Homo sapiens
tgttcaagctttt

SEQ ID NO: 5329713 - DNA, 22 bp, Homo sapiens
tgttcaagtttgctgcaaccca

SEQ ID NO: 5329714 - DNA, 20 bp, Homo sapiens
tgttcaataaaggaaatatg

SEQ ID NO: 5329715 - DNA, 22 bp, Homo sapiens
tgttcaatatcagctttgataa

SEQ ID NO: 5329716 - DNA, 18 bp, Homo sapiens
tgttcaatctgtgtaaga

SEQ ID NO: 5329717 - DNA, 20 bp, Homo sapiens
tgttcaatgaaataaaagca

SEQ ID NO: 5329718 - DNA, 16 bp, Homo sapiens
tgttcaatgttccatt

SEQ ID NO: 5329719 - DNA, 16 bp, Homo sapiens
tgttcaatgtttaatg

SEQ ID NO: 5329720 - DNA, 20 bp, Homo sapiens
tgttcacaaactacctctgg

SEQ ID NO: 5329721 - DNA, 15 bp, Homo sapiens
tgttcacaaactgtg

SEQ ID NO: 5329722 - DNA, 13 bp, Homo sapiens
tgttcacacacac

SEQ ID NO: 5329723 - DNA, 17 bp, Homo sapiens
tgttctctgggagaaaa

SEQ ID NO: 5329724 - DNA, 14 bp, Homo sapiens
tgttctcttcccag

SEQ ID NO: 5329725 - DNA, 18 bp, Homo sapiens
tgttctcttcccaggcct

SEQ ID NO: 5329726 - DNA, 16 bp, Homo sapiens
tgttctcttctgcgta

SEQ ID NO: 5329727 - DNA, 13 bp, Homo sapiens
tgttctcttggct

SEQ ID NO: 5329728 - DNA, 13 bp, Homo sapiens
tgttctcttgtat

SEQ ID NO: 5329729 - DNA, 16 bp, Homo sapiens
tgttctctttaaaata

SEQ ID NO: 5329730 - DNA, 18 bp, Homo sapiens
tgttctctttgctgacac

SEQ ID NO: 5329731 - DNA, 15 bp, Homo sapiens
tgttctgaaacctta

SEQ ID NO: 5329732 - DNA, 16 bp, Homo sapiens
tgttctgaatgctgct

SEQ ID NO: 5329733 - DNA, 19 bp, Homo sapiens
tgttctgacattaacagtt

SEQ ID NO: 5329734 - DNA, 22 bp, Homo sapiens
tgttctgacattaacagttttc

SEQ ID NO: 5329735 - DNA, 19 bp, Homo sapiens
tgttctgactttttgtttc

SEQ ID NO: 5329736 - DNA, 10 bp, Homo sapiens
tgttctgagc

SEQ ID NO: 5329737 - DNA, 12 bp, Homo sapiens
tgttctgagcac

SEQ ID NO: 5329738 - DNA, 21 bp, Homo sapiens
tgttctgagtaagtgtgttca

SEQ ID NO: 5329739 - DNA, 14 bp, Homo sapiens
tgttctgcaagaat

SEQ ID NO: 5329740 - DNA, 20 bp, Homo sapiens
tgttctgcaagaattaaaac

SEQ ID NO: 5329741 - DNA, 21 bp, Homo sapiens
tgttctgcaagaattaaaact

SEQ ID NO: 5329742 - DNA, 17 bp, Homo sapiens
tgttctgcactgaaaag

SEQ ID NO: 5329743 - DNA, 23 bp, Homo sapiens
tgttctgcagagacttctaggag

SEQ ID NO: 5329744 - DNA, 23 bp, Homo sapiens
tgttctgcccaatgcctttttga

SEQ ID NO: 5329745 - DNA, 23 bp, Homo sapiens
tgttctgcccacgatcccctccc

SEQ ID NO: 5329746 - DNA, 14 bp, Homo sapiens
tgttctgcccccag

SEQ ID NO: 5329747 - DNA, 22 bp, Homo sapiens
tgttctgcccccagcccaaagg

SEQ ID NO: 5329748 - DNA, 18 bp, Homo sapiens
tgttctgccccctcaggg

SEQ ID NO: 5329749 - DNA, 19 bp, Homo sapiens
tgttctgcctctccctggg

SEQ ID NO: 5329750 - DNA, 20 bp, Homo sapiens
tgttctgcgctgtgtacaat

SEQ ID NO: 5329751 - DNA, 14 bp, Homo sapiens
tgttctgctcctgc

SEQ ID NO: 5329752 - DNA, 16 bp, Homo sapiens
tgttctgctcctgctt

SEQ ID NO: 5329753 - DNA, 18 bp, Homo sapiens
tgttctgctgttctctag

SEQ ID NO: 5329754 - DNA, 18 bp, Homo sapiens
tgttctggcctcagacca

SEQ ID NO: 5329755 - DNA, 16 bp, Homo sapiens
tgttctggcctctggc

SEQ ID NO: 5329756 - DNA, 21 bp, Homo sapiens
tgttctggcctctggcctggg

SEQ ID NO: 5329757 - DNA, 22 bp, Homo sapiens
tgttctggcctctggcctggga

SEQ ID NO: 5329758 - DNA, 12 bp, Homo sapiens
tgttctggctct

SEQ ID NO: 5329759 - DNA, 13 bp, Homo sapiens
tgttctggctctt

SEQ ID NO: 5329760 - DNA, 17 bp, Homo sapiens
tgttctggctcttccag

SEQ ID NO: 5329761 - DNA, 21 bp, Homo sapiens
tgttctggctcttccaggctg

SEQ ID NO: 5329762 - DNA, 12 bp, Homo sapiens
tgttctgggaca

SEQ ID NO: 5329763 - DNA, 12 bp, Homo sapiens
tgttctggggga

SEQ ID NO: 5329764 - DNA, 16 bp, Homo sapiens
tgttctgggtgatgga

SEQ ID NO: 5329765 - DNA, 23 bp, Homo sapiens
tgttctgggtgttgaccactcca

SEQ ID NO: 5329766 - DNA, 23 bp, Homo sapiens
tgttctggtatgcattctttata

SEQ ID NO: 5329767 - DNA, 19 bp, Homo sapiens
tgttctggtatttcccctg

SEQ ID NO: 5329768 - DNA, 23 bp, Homo sapiens
tgttctggtttagtgttctgtat

SEQ ID NO: 5329769 - DNA, 18 bp, Homo sapiens
tgttctgtaatggaactg

SEQ ID NO: 5329770 - DNA, 22 bp, Homo sapiens
tgttctgtaatggaactgaccc

SEQ ID NO: 5329771 - DNA, 17 bp, Homo sapiens
tgttctgtcttcccaaa

SEQ ID NO: 5329772 - DNA, 15 bp, Homo sapiens
tgttctgtgatataa

SEQ ID NO: 5329773 - DNA, 23 bp, Homo sapiens
tgttctgtgatgaggggaggggg

SEQ ID NO: 5329774 - DNA, 12 bp, Homo sapiens
tgttctgtgcaa

SEQ ID NO: 5329775 - DNA, 13 bp, Homo sapiens
tgttctgtgcaac

SEQ ID NO: 5329776 - DNA, 18 bp, Homo sapiens
tgttctgtggaaagtgta

SEQ ID NO: 5329777 - DNA, 20 bp, Homo sapiens
tgttctgtggaaagtgtaaa

SEQ ID NO: 5329778 - DNA, 21 bp, Homo sapiens
tgttctgtgggcttggccttg

SEQ ID NO: 5329779 - DNA, 23 bp, Homo sapiens
tgttctgtggttcctctgctcac

SEQ ID NO: 5329780 - DNA, 15 bp, Homo sapiens
tgttctgtgtacata

SEQ ID NO: 5329781 - DNA, 21 bp, Homo sapiens
tgttctgtgtcacgtgaccct

SEQ ID NO: 5329782 - DNA, 23 bp, Homo sapiens
tgttctgtgtcacgtgaccctgt

SEQ ID NO: 5329783 - DNA, 14 bp, Homo sapiens
tgttctgtgtcttt

SEQ ID NO: 5329784 - DNA, 14 bp, Homo sapiens
tgttctgtgtgggt

SEQ ID NO: 5329785 - DNA, 20 bp, Homo sapiens
tgttctgtgttgcaagatat

SEQ ID NO: 5329786 - DNA, 18 bp, Homo sapiens
tgttctgttaactgaata

SEQ ID NO: 5329787 - DNA, 22 bp, Homo sapiens
tgttctgttaactgaataccac

SEQ ID NO: 5329788 - DNA, 13 bp, Homo sapiens
tgttctgttacaa

SEQ ID NO: 5329789 - DNA, 16 bp, Homo sapiens
tgttctgttacaaaat

SEQ ID NO: 5329790 - DNA, 18 bp, Homo sapiens
tgttctgttacaaaatgt

SEQ ID NO: 5329791 - DNA, 22 bp, Homo sapiens
tgttctgttctcatagaggaaa

SEQ ID NO: 5329792 - DNA, 15 bp, Homo sapiens
tgttctgttgtctgc

SEQ ID NO: 5329793 - DNA, 16 bp, Homo sapiens
tgttctgtttcctgtg

SEQ ID NO: 5329794 - DNA, 17 bp, Homo sapiens
tgttctgtttcctgtgt

SEQ ID NO: 5329795 - DNA, 23 bp, Homo sapiens
tgttctgtttcctgtgtctccaa

SEQ ID NO: 5329796 - DNA, 17 bp, Homo sapiens
tgttctgtttggcactt

SEQ ID NO: 5329797 - DNA, 21 bp, Homo sapiens
tgttctgtttggcacttgtat

SEQ ID NO: 5329798 - DNA, 16 bp, Homo sapiens
tgttctgtttgttaaa

SEQ ID NO: 5329799 - DNA, 20 bp, Homo sapiens
tgttctgtttgttaaaactg

SEQ ID NO: 5329800 - DNA, 16 bp, Homo sapiens
tgttctgttttgtttc

SEQ ID NO: 5329801 - DNA, 18 bp, Homo sapiens
tgttctgttttgttttgt

SEQ ID NO: 5329802 - DNA, 21 bp, Homo sapiens
tgttcttaaaaaaataaaata

SEQ ID NO: 5329803 - DNA, 19 bp, Homo sapiens
tgttcttaaaaatgcattt

SEQ ID NO: 5329804 - DNA, 14 bp, Homo sapiens
tgttcttaaaatat

SEQ ID NO: 5329805 - DNA, 18 bp, Homo sapiens
tgttcttaattgcactct

SEQ ID NO: 5329806 - DNA, 15 bp, Homo sapiens
tgttcttaattgtga

SEQ ID NO: 5329807 - DNA, 12 bp, Homo sapiens
tgttcttaattt

SEQ ID NO: 5329808 - DNA, 15 bp, Homo sapiens
tgttcttacaaatgt

SEQ ID NO: 5329809 - DNA, 16 bp, Homo sapiens
tgttcttagagcagat

SEQ ID NO: 5329810 - DNA, 15 bp, Homo sapiens
tgttcttagagtgta

SEQ ID NO: 5329811 - DNA, 17 bp, Homo sapiens
tgttcttaggtttactg

SEQ ID NO: 5329812 - DNA, 18 bp, Homo sapiens
tgttcttaggtttactgt

SEQ ID NO: 5329813 - DNA, 21 bp, Homo sapiens
tgttcttaggtttactgtgaa

SEQ ID NO: 5329814 - DNA, 22 bp, Homo sapiens
tgttcttaggtttactgtgaag

SEQ ID NO: 5329815 - DNA, 17 bp, Homo sapiens
tgttcttataagaagaa

SEQ ID NO: 5329816 - DNA, 20 bp, Homo sapiens
tgttcttatgcaaaatggaa

SEQ ID NO: 5329817 - DNA, 22 bp, Homo sapiens
tgttcttcaagccagctctagg

SEQ ID NO: 5329818 - DNA, 17 bp, Homo sapiens
tgttcttcaatgtgaaa

SEQ ID NO: 5329819 - DNA, 14 bp, Homo sapiens
tgttcttcacttct

SEQ ID NO: 5329820 - DNA, 15 bp, Homo sapiens
tgttcttcacttctg

SEQ ID NO: 5329821 - DNA, 13 bp, Homo sapiens
tgttcttcagaga

SEQ ID NO: 5329822 - DNA, 14 bp, Homo sapiens
tgttcttcagtcct

SEQ ID NO: 5329823 - DNA, 10 bp, Homo sapiens
tgttcttcca

SEQ ID NO: 5329824 - DNA, 16 bp, Homo sapiens
tgttcttccaaagcag

SEQ ID NO: 5329825 - DNA, 17 bp, Homo sapiens
tgttcttccaaagcaga

SEQ ID NO: 5329826 - DNA, 13 bp, Homo sapiens
tgttcttccagtt

SEQ ID NO: 5329827 - DNA, 22 bp, Homo sapiens
tgttcttccagttactttccaa

SEQ ID NO: 5329828 - DNA, 13 bp, Homo sapiens
tgttcttcccaaa

SEQ ID NO: 5329829 - DNA, 14 bp, Homo sapiens
tgttcttccccaca

SEQ ID NO: 5329830 - DNA, 10 bp, Homo sapiens
tgttcttcct

SEQ ID NO: 5329831 - DNA, 13 bp, Homo sapiens
tgttcttccttcc

SEQ ID NO: 5329832 - DNA, 14 bp, Homo sapiens
tgttcttcgtatat

SEQ ID NO: 5329833 - DNA, 13 bp, Homo sapiens
tgttcttcttggg

SEQ ID NO: 5329834 - DNA, 14 bp, Homo sapiens
tgttcttcttggga

SEQ ID NO: 5329835 - DNA, 13 bp, Homo sapiens
tgttcttgaagca

SEQ ID NO: 5329836 - DNA, 16 bp, Homo sapiens
tgttcttgaatcctct

SEQ ID NO: 5329837 - DNA, 23 bp, Homo sapiens
tgttcttgaatttaataatctgt

SEQ ID NO: 5329838 - DNA, 16 bp, Homo sapiens
tgttcttgacaatcat

SEQ ID NO: 5329839 - DNA, 23 bp, Homo sapiens
tgttcttgacaatcatctccaat

SEQ ID NO: 5329840 - DNA, 16 bp, Homo sapiens
tgttcttgcagcagag

SEQ ID NO: 5329841 - DNA, 12 bp, Homo sapiens
tgttcttgctgc

SEQ ID NO: 5329842 - DNA, 14 bp, Homo sapiens
tgttcttgctgcta

SEQ ID NO: 5329843 - DNA, 16 bp, Homo sapiens
tgttcttgctgctaga

SEQ ID NO: 5329844 - DNA, 19 bp, Homo sapiens
tgttcttgctgctagaact

SEQ ID NO: 5329845 - DNA, 23 bp, Homo sapiens
tgttcttgctgctagaacttttt

SEQ ID NO: 5329846 - DNA, 20 bp, Homo sapiens
tgttcttggcaataaatttt

SEQ ID NO: 5329847 - DNA, 22 bp, Homo sapiens
tgttcttggcaataaattttga

SEQ ID NO: 5329848 - DNA, 23 bp, Homo sapiens
tgttcttggcaataaattttgaa

SEQ ID NO: 5329849 - DNA, 21 bp, Homo sapiens
tgttcttggtgtttgactgta

SEQ ID NO: 5329850 - DNA, 22 bp, Homo sapiens
tgttcttggttcccattgtgac

SEQ ID NO: 5329851 - DNA, 20 bp, Homo sapiens
tgttcttggtttgtaaatta

SEQ ID NO: 5329852 - DNA, 12 bp, Homo sapiens
tgttcttgtaaa

SEQ ID NO: 5329853 - DNA, 14 bp, Homo sapiens
tgttcttgtcataa

SEQ ID NO: 5329854 - DNA, 12 bp, Homo sapiens
tgttcttgttgt

SEQ ID NO: 5329855 - DNA, 14 bp, Homo sapiens
tgttcttgttttgt

SEQ ID NO: 5329856 - DNA, 16 bp, Homo sapiens
tgttctttagtttgct

SEQ ID NO: 5329857 - DNA, 11 bp, Homo sapiens
tgttctttata

SEQ ID NO: 5329858 - DNA, 16 bp, Homo sapiens
tgttctttccccaggg

SEQ ID NO: 5329859 - DNA, 19 bp, Homo sapiens
tgttctttccccaggggca

SEQ ID NO: 5329860 - DNA, 14 bp, Homo sapiens
tgttctttcctgcc

SEQ ID NO: 5329861 - DNA, 16 bp, Homo sapiens
tgttctttcctgccct

SEQ ID NO: 5329862 - DNA, 17 bp, Homo sapiens
tgttctttcctgccctg

SEQ ID NO: 5329863 - DNA, 23 bp, Homo sapiens
tgttctttcctttcatcctcagc

SEQ ID NO: 5329864 - DNA, 16 bp, Homo sapiens
tgttctttctggagtc

SEQ ID NO: 5329865 - DNA, 20 bp, Homo sapiens
tgttctttctggctatgcat

SEQ ID NO: 5329866 - DNA, 22 bp, Homo sapiens
tgttctttgccagtctcatttt

SEQ ID NO: 5329867 - DNA, 18 bp, Homo sapiens
tgttctttggaaagtaca

SEQ ID NO: 5329868 - DNA, 22 bp, Homo sapiens
tgttctttggaaagtacactct

SEQ ID NO: 5329869 - DNA, 18 bp, Homo sapiens
tgttctttgtgttttagg

SEQ ID NO: 5329870 - DNA, 13 bp, Homo sapiens
tgttctttgttta

SEQ ID NO: 5329871 - DNA, 22 bp, Homo sapiens
tgttcttttaaagactacctgg

SEQ ID NO: 5329872 - DNA, 20 bp, Homo sapiens
tgttcttttaaatgattgaa

SEQ ID NO: 5329873 - DNA, 16 bp, Homo sapiens
tgttcttttaccactg

SEQ ID NO: 5329874 - DNA, 21 bp, Homo sapiens
tgttcttttctcctttaccag

SEQ ID NO: 5329875 - DNA, 15 bp, Homo sapiens
tgttcttttctggta

SEQ ID NO: 5329876 - DNA, 13 bp, Homo sapiens
tgttcttttgata

SEQ ID NO: 5329877 - DNA, 18 bp, Homo sapiens
tgttcttttgatacattt

SEQ ID NO: 5329878 - DNA, 12 bp, Homo sapiens
tgttcttttgca

SEQ ID NO: 5329879 - DNA, 12 bp, Homo sapiens
tgttgaaaaaat

SEQ ID NO: 5329880 - DNA, 18 bp, Homo sapiens
tgttgaaaaagtttgttt

SEQ ID NO: 5329881 - DNA, 22 bp, Homo sapiens
tgttgaaaagccatgtttaaga

SEQ ID NO: 5329882 - DNA, 19 bp, Homo sapiens
tgttgaaaataatccattt

SEQ ID NO: 5329883 - DNA, 13 bp, Homo sapiens
tgttgaaaatgag

SEQ ID NO: 5329884 - DNA, 20 bp, Homo sapiens
tgttgaaaatggtttcaagt

SEQ ID NO: 5329885 - DNA, 22 bp, Homo sapiens
tgttgaaaattattttaaacaa

SEQ ID NO: 5329886 - DNA, 20 bp, Homo sapiens
tgttgaaacggatgatttct

SEQ ID NO: 5329887 - DNA, 22 bp, Homo sapiens
tgttgaaacggatgatttctat

SEQ ID NO: 5329888 - DNA, 16 bp, Homo sapiens
tgttgaaactttaaga

SEQ ID NO: 5329889 - DNA, 12 bp, Homo sapiens
tgttgaaagcaa

SEQ ID NO: 5329890 - DNA, 13 bp, Homo sapiens
tgttgaaatatag

SEQ ID NO: 5329891 - DNA, 19 bp, Homo sapiens
tgttgaaatatagttgaaa

SEQ ID NO: 5329892 - DNA, 21 bp, Homo sapiens
tgttgaaatatagttgaaagt

SEQ ID NO: 5329893 - DNA, 16 bp, Homo sapiens
tgttgaaatatgcata

SEQ ID NO: 5329894 - DNA, 15 bp, Homo sapiens
tgttgaaattatgta

SEQ ID NO: 5329895 - DNA, 16 bp, Homo sapiens
tgttgaaattttgcaa

SEQ ID NO: 5329896 - DNA, 16 bp, Homo sapiens
tgttgaacaaaactga

SEQ ID NO: 5329897 - DNA, 14 bp, Homo sapiens
tgttgaacaaaata

SEQ ID NO: 5329898 - DNA, 19 bp, Homo sapiens
tgttgaaccacctgtgtag

SEQ ID NO: 5329899 - DNA, 19 bp, Homo sapiens
tgttgaaccctccccacca

SEQ ID NO: 5329900 - DNA, 17 bp, Homo sapiens
tgttgaactaatatatg

SEQ ID NO: 5329901 - DNA, 21 bp, Homo sapiens
tgttgctgttgttgttaattt

SEQ ID NO: 5329902 - DNA, 11 bp, Homo sapiens
tgttgctgttt

SEQ ID NO: 5329903 - DNA, 15 bp, Homo sapiens
tgttgctgtttagag

SEQ ID NO: 5329904 - DNA, 14 bp, Homo sapiens
tgttgcttaatcta

SEQ ID NO: 5329905 - DNA, 21 bp, Homo sapiens
tgttgcttaatctagagctat

SEQ ID NO: 5329906 - DNA, 13 bp, Homo sapiens
tgttgcttacaat

SEQ ID NO: 5329907 - DNA, 14 bp, Homo sapiens
tgttgcttacaatt

SEQ ID NO: 5329908 - DNA, 16 bp, Homo sapiens
tgttgcttagtcactt

SEQ ID NO: 5329909 - DNA, 18 bp, Homo sapiens
tgttgcttcagtaaaagg

SEQ ID NO: 5329910 - DNA, 17 bp, Homo sapiens
tgttgcttctgaatcac

SEQ ID NO: 5329911 - DNA, 17 bp, Homo sapiens
tgttgcttcttgtgaag

SEQ ID NO: 5329912 - DNA, 14 bp, Homo sapiens
tgttgcttggagtg

SEQ ID NO: 5329913 - DNA, 14 bp, Homo sapiens
tgttgcttgtacag

SEQ ID NO: 5329914 - DNA, 20 bp, Homo sapiens
tgttgcttgtcgctttctca

SEQ ID NO: 5329915 - DNA, 16 bp, Homo sapiens
tgttgctttcttacct

SEQ ID NO: 5329916 - DNA, 18 bp, Homo sapiens
tgttgctttcttacctac

SEQ ID NO: 5329917 - DNA, 20 bp, Homo sapiens
tgttgctttcttcctgcata

SEQ ID NO: 5329918 - DNA, 13 bp, Homo sapiens
tgttgcttttacg

SEQ ID NO: 5329919 - DNA, 17 bp, Homo sapiens
tgttgcttttgaaaagt

SEQ ID NO: 5329920 - DNA, 13 bp, Homo sapiens
tgttggaaaaaat

SEQ ID NO: 5329921 - DNA, 19 bp, Homo sapiens
tgttggaaagagtctccag

SEQ ID NO: 5329922 - DNA, 13 bp, Homo sapiens
tgttggaaatgtg

SEQ ID NO: 5329923 - DNA, 16 bp, Homo sapiens
tgttggaattttaagt

SEQ ID NO: 5329924 - DNA, 16 bp, Homo sapiens
tgttggacaaatgtga

SEQ ID NO: 5329925 - DNA, 20 bp, Homo sapiens
tgttggacaaatgtgaagat

SEQ ID NO: 5329926 - DNA, 21 bp, Homo sapiens
tgttggacacctttaggttct

SEQ ID NO: 5329927 - DNA, 18 bp, Homo sapiens
tgttggacagacactgtt

SEQ ID NO: 5329928 - DNA, 18 bp, Homo sapiens
tgttggacagctgcttgt

SEQ ID NO: 5329929 - DNA, 19 bp, Homo sapiens
tgttggacccgctctggac

SEQ ID NO: 5329930 - DNA, 18 bp, Homo sapiens
tgttggactctgagctca

SEQ ID NO: 5329931 - DNA, 14 bp, Homo sapiens
tgttggagaaagaa

SEQ ID NO: 5329932 - DNA, 16 bp, Homo sapiens
tgttggagaagaactg

SEQ ID NO: 5329933 - DNA, 21 bp, Homo sapiens
tgttggagaagaactgaaatc

SEQ ID NO: 5329934 - DNA, 17 bp, Homo sapiens
tgttggagcagcaggcc

SEQ ID NO: 5329935 - DNA, 12 bp, Homo sapiens
tgttggaggggc

SEQ ID NO: 5329936 - DNA, 20 bp, Homo sapiens
tgttggaggggcaggccttt

SEQ ID NO: 5329937 - DNA, 16 bp, Homo sapiens
tgttggagtgtttcta

SEQ ID NO: 5329938 - DNA, 19 bp, Homo sapiens
tgttggataaatcagtggt

SEQ ID NO: 5329939 - DNA, 21 bp, Homo sapiens
tgttggataaggaattataga

SEQ ID NO: 5329940 - DNA, 17 bp, Homo sapiens
tgttggatttataaatg

SEQ ID NO: 5329941 - DNA, 21 bp, Homo sapiens
tgttggcaaacgagactttct

SEQ ID NO: 5329942 - DNA, 20 bp, Homo sapiens
tgttggcaaatttgtgaact

SEQ ID NO: 5329943 - DNA, 16 bp, Homo sapiens
tgttggcaagctgcag

SEQ ID NO: 5329944 - DNA, 14 bp, Homo sapiens
tgttggcaattgag

SEQ ID NO: 5329945 - DNA, 19 bp, Homo sapiens
tgttggcacatcctatgca

SEQ ID NO: 5329946 - DNA, 21 bp, Homo sapiens
tgttggcactcacagacctgg

SEQ ID NO: 5329947 - DNA, 13 bp, Homo sapiens
tgttggcagagct

SEQ ID NO: 5329948 - DNA, 22 bp, Homo sapiens
tgttggcagagcttttgcattt

SEQ ID NO: 5329949 - DNA, 15 bp, Homo sapiens
tgttggcagatgcag

SEQ ID NO: 5329950 - DNA, 23 bp, Homo sapiens
tgttggcagatgcagctcttcct

SEQ ID NO: 5329951 - DNA, 13 bp, Homo sapiens
tgttggcagctct

SEQ ID NO: 5329952 - DNA, 12 bp, Homo sapiens
tgttggcaggct

SEQ ID NO: 5329953 - DNA, 21 bp, Homo sapiens
tgttggcaggctggccagtcc

SEQ ID NO: 5329954 - DNA, 21 bp, Homo sapiens
tgttggcagtgagtgagcctg

SEQ ID NO: 5329955 - DNA, 15 bp, Homo sapiens
tgttggccaaagcca

SEQ ID NO: 5329956 - DNA, 11 bp, Homo sapiens
tgttggccagg

SEQ ID NO: 5329957 - DNA, 18 bp, Homo sapiens
tgttggccaggctgctct

SEQ ID NO: 5329958 - DNA, 15 bp, Homo sapiens
tgttggccaggctgg

SEQ ID NO: 5329959 - DNA, 23 bp, Homo sapiens
tgttggccaggctggtctaaaac

SEQ ID NO: 5329960 - DNA, 21 bp, Homo sapiens
tgttggcccctctgctgtcct

SEQ ID NO: 5329961 - DNA, 23 bp, Homo sapiens
tgttggcctcgcctgggcccagg

SEQ ID NO: 5329962 - DNA, 17 bp, Homo sapiens
tgttggcctgtcaccag

SEQ ID NO: 5329963 - DNA, 13 bp, Homo sapiens
tgttggcctgtgg

SEQ ID NO: 5329964 - DNA, 15 bp, Homo sapiens
tgttggcgagaggag

SEQ ID NO: 5329965 - DNA, 13 bp, Homo sapiens
tgttggcgctgag

SEQ ID NO: 5329966 - DNA, 15 bp, Homo sapiens
tgttggcgctgaggt

SEQ ID NO: 5329967 - DNA, 18 bp, Homo sapiens
tgttggcgtaggctacag

SEQ ID NO: 5329968 - DNA, 21 bp, Homo sapiens
tgttggcgtaggctacagaga

SEQ ID NO: 5329969 - DNA, 15 bp, Homo sapiens
tgttggctaatgaag

SEQ ID NO: 5329970 - DNA, 11 bp, Homo sapiens
tgttggctgcg

SEQ ID NO: 5329971 - DNA, 13 bp, Homo sapiens
tgttggctgctgc

SEQ ID NO: 5329972 - DNA, 14 bp, Homo sapiens
tgttggctgctgcc

SEQ ID NO: 5329973 - DNA, 14 bp, Homo sapiens
tgttggctgtgtga

SEQ ID NO: 5329974 - DNA, 22 bp, Homo sapiens
tgttggcttctttgctttctcg

SEQ ID NO: 5329975 - DNA, 20 bp, Homo sapiens
tgttgggaaaaactggcttt

SEQ ID NO: 5329976 - DNA, 23 bp, Homo sapiens
tgttgggaaaaaggcctctgtcc

SEQ ID NO: 5329977 - DNA, 15 bp, Homo sapiens
tgttgggacctgctg

SEQ ID NO: 5329978 - DNA, 19 bp, Homo sapiens
tgttgggacctgctgctcc

SEQ ID NO: 5329979 - DNA, 14 bp, Homo sapiens
tgttgggagagggc

SEQ ID NO: 5329980 - DNA, 19 bp, Homo sapiens
tgttgggagagggcgcagg

SEQ ID NO: 5329981 - DNA, 20 bp, Homo sapiens
tgttgggattacaggtgtga

SEQ ID NO: 5329982 - DNA, 18 bp, Homo sapiens
tgttgggattcctgaccc

SEQ ID NO: 5329983 - DNA, 13 bp, Homo sapiens
tgttgggccagga

SEQ ID NO: 5329984 - DNA, 20 bp, Homo sapiens
tgttgggccccagggaacta

SEQ ID NO: 5329985 - DNA, 16 bp, Homo sapiens
tgttgggcctttttcc

SEQ ID NO: 5329986 - DNA, 20 bp, Homo sapiens
tgttggggagtgggtggcag

SEQ ID NO: 5329987 - DNA, 15 bp, Homo sapiens
tgttggggcagtggt

SEQ ID NO: 5329988 - DNA, 16 bp, Homo sapiens
tgttggggctcttcct

SEQ ID NO: 5329989 - DNA, 12 bp, Homo sapiens
tgttggggctgg

SEQ ID NO: 5329990 - DNA, 15 bp, Homo sapiens
tgttggggctggggg

SEQ ID NO: 5329991 - DNA, 20 bp, Homo sapiens
tgttgggggggaccctgcct

SEQ ID NO: 5329992 - DNA, 21 bp, Homo sapiens
tgttgggggggaccctgcctc

SEQ ID NO: 5329993 - DNA, 24 bp, Homo sapiens
tgttgggggggaccctgcctcagc

SEQ ID NO: 5329994 - DNA, 16 bp, Homo sapiens
tgttggggggtgggag

SEQ ID NO: 5329995 - DNA, 17 bp, Homo sapiens
tgttggggtgggtataa

SEQ ID NO: 5329996 - DNA, 20 bp, Homo sapiens
tgttggggtgggtataaaag

SEQ ID NO: 5329997 - DNA, 22 bp, Homo sapiens
tgttggggtgggtataaaagat

SEQ ID NO: 5329998 - DNA, 23 bp, Homo sapiens
tgttggggtgggtataaaagatg

SEQ ID NO: 5329999 - DNA, 20 bp, Homo sapiens
tgttgggtcagtggccaggt

SEQ ID NO: 5330000 - DNA, 20 bp, Homo sapiens
tgttgggtggaccccgagca

SEQ ID NO: 5330001 - DNA, 18 bp, Homo sapiens
tgttgggtggaggatgga

SEQ ID NO: 5330002 - DNA, 14 bp, Homo sapiens
tgttggtacctttc

SEQ ID NO: 5330003 - DNA, 13 bp, Homo sapiens
tgttggtagccat

SEQ ID NO: 5330004 - DNA, 14 bp, Homo sapiens
tgttggtatttact

SEQ ID NO: 5330005 - DNA, 21 bp, Homo sapiens
tgttggtatttactgcaatgt

SEQ ID NO: 5330006 - DNA, 15 bp, Homo sapiens
tgttggtatttatct

SEQ ID NO: 5330007 - DNA, 13 bp, Homo sapiens
tgttggtcacatg

SEQ ID NO: 5330008 - DNA, 20 bp, Homo sapiens
tgttggtcatctctcctgtg

SEQ ID NO: 5330009 - DNA, 14 bp, Homo sapiens
tgttggtcatttta

SEQ ID NO: 5330010 - DNA, 15 bp, Homo sapiens
tgttggtccactgtg

SEQ ID NO: 5330011 - DNA, 21 bp, Homo sapiens
tgttggtccactgtgtttagt

SEQ ID NO: 5330012 - DNA, 21 bp, Homo sapiens
tgttggtctgaatacaaacat

SEQ ID NO: 5330013 - DNA, 14 bp, Homo sapiens
tgttggtctgtgta

SEQ ID NO: 5330014 - DNA, 23 bp, Homo sapiens
tgttggtctttctaatgtagcta

SEQ ID NO: 5330015 - DNA, 18 bp, Homo sapiens
tgttggtgcacagcacaa

SEQ ID NO: 5330016 - DNA, 17 bp, Homo sapiens
tgttggttacatgaatg

SEQ ID NO: 5330017 - DNA, 16 bp, Homo sapiens
tgttggttccaagccc

SEQ ID NO: 5330018 - DNA, 19 bp, Homo sapiens
tgttggttccaagccctgg

SEQ ID NO: 5330019 - DNA, 19 bp, Homo sapiens
tgttggttgttttttcctt

SEQ ID NO: 5330020 - DNA, 14 bp, Homo sapiens
tgttggtttaatat

SEQ ID NO: 5330021 - DNA, 14 bp, Homo sapiens
tgttggtttacttt

SEQ ID NO: 5330022 - DNA, 17 bp, Homo sapiens
tgttggtttactttcaa

SEQ ID NO: 5330023 - DNA, 19 bp, Homo sapiens
tgttggtttactttcaaat

SEQ ID NO: 5330024 - DNA, 19 bp, Homo sapiens
tgttggtttagcgttgttt

SEQ ID NO: 5330025 - DNA, 14 bp, Homo sapiens
tgttggtttcattt

SEQ ID NO: 5330026 - DNA, 17 bp, Homo sapiens
tgttggttttgactgga

SEQ ID NO: 5330027 - DNA, 15 bp, Homo sapiens
tgttggtttttaaag

SEQ ID NO: 5330028 - DNA, 13 bp, Homo sapiens
tgttgtaaaaaga

SEQ ID NO: 5330029 - DNA, 17 bp, Homo sapiens
tgttgtaaaaagaaaaa

SEQ ID NO: 5330030 - DNA, 19 bp, Homo sapiens
tgttgtaaaagatgcagag

SEQ ID NO: 5330031 - DNA, 13 bp, Homo sapiens
tgttgtaaactgt

SEQ ID NO: 5330032 - DNA, 21 bp, Homo sapiens
tgttgtaaactgttgttttgt

SEQ ID NO: 5330033 - DNA, 13 bp, Homo sapiens
tgttgtaaataaa

SEQ ID NO: 5330034 - DNA, 16 bp, Homo sapiens
tgttgtaaataaaagt

SEQ ID NO: 5330035 - DNA, 14 bp, Homo sapiens
tgttgtaaatattt

SEQ ID NO: 5330036 - DNA, 21 bp, Homo sapiens
tgttgtaaatatttatgtaaa

SEQ ID NO: 5330037 - DNA, 13 bp, Homo sapiens
tgttgtaaattag

SEQ ID NO: 5330038 - DNA, 16 bp, Homo sapiens
tgttgtaagaattctg

SEQ ID NO: 5330039 - DNA, 15 bp, Homo sapiens
tgttgtaatagtcca

SEQ ID NO: 5330040 - DNA, 15 bp, Homo sapiens
tgttgtaatgctgca

SEQ ID NO: 5330041 - DNA, 16 bp, Homo sapiens
tgttgtaatgctgcac

SEQ ID NO: 5330042 - DNA, 13 bp, Homo sapiens
tgttgtacaagct

SEQ ID NO: 5330043 - DNA, 20 bp, Homo sapiens
tgttgtacaatcatgttctg

SEQ ID NO: 5330044 - DNA, 20 bp, Homo sapiens
tgttgtacaattactgtgag

SEQ ID NO: 5330045 - DNA, 22 bp, Homo sapiens
tgttgtacatacagaggtaact

SEQ ID NO: 5330046 - DNA, 23 bp, Homo sapiens
tgttgtacatacagaggtaacta

SEQ ID NO: 5330047 - DNA, 15 bp, Homo sapiens
tgttgtacatttatg

SEQ ID NO: 5330048 - DNA, 22 bp, Homo sapiens
tgttgtacatttatgatttaat

SEQ ID NO: 5330049 - DNA, 23 bp, Homo sapiens
tgttgtacatttatgatttaata

SEQ ID NO: 5330050 - DNA, 15 bp, Homo sapiens
tgttgtacttaaatg

SEQ ID NO: 5330051 - DNA, 14 bp, Homo sapiens
tgttgtacttgaaa

SEQ ID NO: 5330052 - DNA, 17 bp, Homo sapiens
tgttgtacttgaaaatg

SEQ ID NO: 5330053 - DNA, 17 bp, Homo sapiens
tgttgtagagaaaacat

SEQ ID NO: 5330054 - DNA, 22 bp, Homo sapiens
tgttgtagatgctaacgtgtca

SEQ ID NO: 5330055 - DNA, 17 bp, Homo sapiens
tgttgtagcattttcct

SEQ ID NO: 5330056 - DNA, 11 bp, Homo sapiens
tgttgtagtgt

SEQ ID NO: 5330057 - DNA, 13 bp, Homo sapiens
tgttgtataaatt

SEQ ID NO: 5330058 - DNA, 16 bp, Homo sapiens
tgttgtatacttcatt

SEQ ID NO: 5330059 - DNA, 18 bp, Homo sapiens
tgttgtatatcactaaaa

SEQ ID NO: 5330060 - DNA, 22 bp, Homo sapiens
tgttgtatatcactaaaagcat

SEQ ID NO: 5330061 - DNA, 14 bp, Homo sapiens
tgttgtatgggatt

SEQ ID NO: 5330062 - DNA, 13 bp, Homo sapiens
tgttgtattaaca

SEQ ID NO: 5330063 - DNA, 15 bp, Homo sapiens
tgttgtattaacaaa

SEQ ID NO: 5330064 - DNA, 12 bp, Homo sapiens
tgttgtatttct

SEQ ID NO: 5330065 - DNA, 13 bp, Homo sapiens
tgttgtatttcta

SEQ ID NO: 5330066 - DNA, 20 bp, Homo sapiens
tgttgtcaagaatagcattg

SEQ ID NO: 5330067 - DNA, 19 bp, Homo sapiens
tgttgtcaaggatggtttt

SEQ ID NO: 5330068 - DNA, 13 bp, Homo sapiens
tgttgtcaagtat

SEQ ID NO: 5330069 - DNA, 14 bp, Homo sapiens
tgttgtcagcaggc

SEQ ID NO: 5330070 - DNA, 17 bp, Homo sapiens
tgttgtcagcctgtgct

SEQ ID NO: 5330071 - DNA, 15 bp, Homo sapiens
tgttgtcattgcttt

SEQ ID NO: 5330072 - DNA, 15 bp, Homo sapiens
tgttgtcattgtcca

SEQ ID NO: 5330073 - DNA, 23 bp, Homo sapiens
tgttgtccaacaataaacaggaa

SEQ ID NO: 5330074 - DNA, 15 bp, Homo sapiens
tgttgtcccatctgc

SEQ ID NO: 5330075 - DNA, 16 bp, Homo sapiens
tgttgtcccatctgcc

SEQ ID NO: 5330076 - DNA, 20 bp, Homo sapiens
tgttgtccctactttctctc

SEQ ID NO: 5330077 - DNA, 12 bp, Homo sapiens
tgttgtccctgc

SEQ ID NO: 5330078 - DNA, 13 bp, Homo sapiens
tgttgtcccttct

SEQ ID NO: 5330079 - DNA, 17 bp, Homo sapiens
tgttgtccggtttactt

SEQ ID NO: 5330080 - DNA, 20 bp, Homo sapiens
tgtttcatattgatgtgtgt

SEQ ID NO: 5330081 - DNA, 16 bp, Homo sapiens
tgtttcatctgttcat

SEQ ID NO: 5330082 - DNA, 14 bp, Homo sapiens
tgtttcatgaagaa

SEQ ID NO: 5330083 - DNA, 15 bp, Homo sapiens
tgtttcatgagccca

SEQ ID NO: 5330084 - DNA, 15 bp, Homo sapiens
tgtttcatgttctgt

SEQ ID NO: 5330085 - DNA, 17 bp, Homo sapiens
tgtttcatgttctgtgt

SEQ ID NO: 5330086 - DNA, 14 bp, Homo sapiens
tgtttcatgttttg

SEQ ID NO: 5330087 - DNA, 19 bp, Homo sapiens
tgtttcatgttttgtgact

SEQ ID NO: 5330088 - DNA, 18 bp, Homo sapiens
tgtttcattacttgaatg

SEQ ID NO: 5330089 - DNA, 17 bp, Homo sapiens
tgtttcattcatcctga

SEQ ID NO: 5330090 - DNA, 15 bp, Homo sapiens
tgtttcatttctgca

SEQ ID NO: 5330091 - DNA, 16 bp, Homo sapiens
tgtttcatttgcttgc

SEQ ID NO: 5330092 - DNA, 19 bp, Homo sapiens
tgtttcattttcattaaaa

SEQ ID NO: 5330093 - DNA, 21 bp, Homo sapiens
tgtttccaaagtgcatgtcac

SEQ ID NO: 5330094 - DNA, 23 bp, Homo sapiens
tgtttccaaagtgcatgtcacat

SEQ ID NO: 5330095 - DNA, 14 bp, Homo sapiens
tgtttccaagatgt

SEQ ID NO: 5330096 - DNA, 15 bp, Homo sapiens
tgtttccaatgttta

SEQ ID NO: 5330097 - DNA, 23 bp, Homo sapiens
tgtttccaatgtttagcaaatac

SEQ ID NO: 5330098 - DNA, 22 bp, Homo sapiens
tgtttccaccccctggtgcctg

SEQ ID NO: 5330099 - DNA, 23 bp, Homo sapiens
tgtttccacggctggatacctgt

SEQ ID NO: 5330100 - DNA, 21 bp, Homo sapiens
tgtttccagaaaatataaatg

SEQ ID NO: 5330101 - DNA, 22 bp, Homo sapiens
tgtttccagaattggtaaaaac

SEQ ID NO: 5330102 - DNA, 18 bp, Homo sapiens
tgtttccagcagaagaca

SEQ ID NO: 5330103 - DNA, 17 bp, Homo sapiens
tgtttccagcttgcatt

SEQ ID NO: 5330104 - DNA, 19 bp, Homo sapiens
tgtttccaggcatgaccct

SEQ ID NO: 5330105 - DNA, 18 bp, Homo sapiens
tgtttccagttgttactg

SEQ ID NO: 5330106 - DNA, 18 bp, Homo sapiens
tgtttccatagctcttca

SEQ ID NO: 5330107 - DNA, 16 bp, Homo sapiens
tgtttccatcatttct

SEQ ID NO: 5330108 - DNA, 14 bp, Homo sapiens
tgtttccatcttca

SEQ ID NO: 5330109 - DNA, 15 bp, Homo sapiens
tgtttccatttctca

SEQ ID NO: 5330110 - DNA, 20 bp, Homo sapiens
tgtttccattttaaggatat

SEQ ID NO: 5330111 - DNA, 14 bp, Homo sapiens
tgtttcccaagcta

SEQ ID NO: 5330112 - DNA, 22 bp, Homo sapiens
tgtttcccaggcccactgtgcc

SEQ ID NO: 5330113 - DNA, 14 bp, Homo sapiens
tgtttcccataatt

SEQ ID NO: 5330114 - DNA, 15 bp, Homo sapiens
tgtttccccatctct

SEQ ID NO: 5330115 - DNA, 19 bp, Homo sapiens
tgtttccccatctctgtct

SEQ ID NO: 5330116 - DNA, 14 bp, Homo sapiens
tgtttcccccactc

SEQ ID NO: 5330117 - DNA, 20 bp, Homo sapiens
tgtttcccgctccaagagaa

SEQ ID NO: 5330118 - DNA, 18 bp, Homo sapiens
tgtttccctagactctgt

SEQ ID NO: 5330119 - DNA, 19 bp, Homo sapiens
tgtttccctagactctgta

SEQ ID NO: 5330120 - DNA, 15 bp, Homo sapiens
tgtttccctctgtgt

SEQ ID NO: 5330121 - DNA, 11 bp, Homo sapiens
tgtttccctgc

SEQ ID NO: 5330122 - DNA, 15 bp, Homo sapiens
tgtttcccttcctcg

SEQ ID NO: 5330123 - DNA, 15 bp, Homo sapiens
tgtttcccttgcttt

SEQ ID NO: 5330124 - DNA, 23 bp, Homo sapiens
tgtttcccttgctttgttttaat

SEQ ID NO: 5330125 - DNA, 17 bp, Homo sapiens
tgtttcctaatatcaaa

SEQ ID NO: 5330126 - DNA, 21 bp, Homo sapiens
tgtttcctaatatcaaatgca

SEQ ID NO: 5330127 - DNA, 23 bp, Homo sapiens
tgtttcctagcacacacttttgg

SEQ ID NO: 5330128 - DNA, 20 bp, Homo sapiens
tgtttcctagctaggagcag

SEQ ID NO: 5330129 - DNA, 20 bp, Homo sapiens
tgtttcctaggaggaaaatt

SEQ ID NO: 5330130 - DNA, 14 bp, Homo sapiens
tgtttcctcatctt

SEQ ID NO: 5330131 - DNA, 13 bp, Homo sapiens
tgtttcctccaaa

SEQ ID NO: 5330132 - DNA, 16 bp, Homo sapiens
tgtttcctcttccaaa

SEQ ID NO: 5330133 - DNA, 11 bp, Homo sapiens
tgtttcctgag

SEQ ID NO: 5330134 - DNA, 14 bp, Homo sapiens
tgtttcctgctgct

SEQ ID NO: 5330135 - DNA, 14 bp, Homo sapiens
tgtttcctggaagc

SEQ ID NO: 5330136 - DNA, 22 bp, Homo sapiens
tgtttcctggcactgcttccag

SEQ ID NO: 5330137 - DNA, 14 bp, Homo sapiens
tgtttcctggcctc

SEQ ID NO: 5330138 - DNA, 19 bp, Homo sapiens
tgtttcctggcctcagagc

SEQ ID NO: 5330139 - DNA, 14 bp, Homo sapiens
tgtttcctgtgccc

SEQ ID NO: 5330140 - DNA, 12 bp, Homo sapiens
tgtttcctgtgg

SEQ ID NO: 5330141 - DNA, 22 bp, Homo sapiens
tgtttcctgtgtctccaagcct

SEQ ID NO: 5330142 - DNA, 15 bp, Homo sapiens
tgtttccttaaacat

SEQ ID NO: 5330143 - DNA, 22 bp, Homo sapiens
tgtttccttgtgcctgctcctg

SEQ ID NO: 5330144 - DNA, 13 bp, Homo sapiens
tgtttcctttttt

SEQ ID NO: 5330145 - DNA, 22 bp, Homo sapiens
tgtttcgagtaaacttgaaaag

SEQ ID NO: 5330146 - DNA, 23 bp, Homo sapiens
tgtttcgtcatgttggccaggct

SEQ ID NO: 5330147 - DNA, 23 bp, Homo sapiens
tgtttctaaacagttgagtttct

SEQ ID NO: 5330148 - DNA, 20 bp, Homo sapiens
tgtttctaaaggtagatcat

SEQ ID NO: 5330149 - DNA, 13 bp, Homo sapiens
tgtttctacaata

SEQ ID NO: 5330150 - DNA, 15 bp, Homo sapiens
tgtttctacctatat

SEQ ID NO: 5330151 - DNA, 23 bp, Homo sapiens
tgtttctagatagcacaggagag

SEQ ID NO: 5330152 - DNA, 17 bp, Homo sapiens
tgtttctagctaaataa

SEQ ID NO: 5330153 - DNA, 15 bp, Homo sapiens
tgtttctaggctgtt

SEQ ID NO: 5330154 - DNA, 15 bp, Homo sapiens
tgtttctagggaaat

SEQ ID NO: 5330155 - DNA, 23 bp, Homo sapiens
tgtttctagttgaggagtttcct

SEQ ID NO: 5330156 - DNA, 14 bp, Homo sapiens
tgtttctatactgt

SEQ ID NO: 5330157 - DNA, 16 bp, Homo sapiens
tgtttctatactgttt

SEQ ID NO: 5330158 - DNA, 23 bp, Homo sapiens
tgtttctatactgtttgtaatat

SEQ ID NO: 5330159 - DNA, 14 bp, Homo sapiens
tgtttctatatgta

SEQ ID NO: 5330160 - DNA, 16 bp, Homo sapiens
tgtttctatctgattt

SEQ ID NO: 5330161 - DNA, 15 bp, Homo sapiens
tgtttctcaaaagag

SEQ ID NO: 5330162 - DNA, 19 bp, Homo sapiens
tgtttctcaaaagaggtta

SEQ ID NO: 5330163 - DNA, 20 bp, Homo sapiens
tgtttctcaaaagaggttac

SEQ ID NO: 5330164 - DNA, 23 bp, Homo sapiens
tgtttctcaaaagaggttacttt

SEQ ID NO: 5330165 - DNA, 19 bp, Homo sapiens
tgtttctcacattgctgta

SEQ ID NO: 5330166 - DNA, 23 bp, Homo sapiens
tgtttctctaaggaattatttca

SEQ ID NO: 5330167 - DNA, 19 bp, Homo sapiens
tgtttctctataaagtatg

SEQ ID NO: 5330168 - DNA, 24 bp, Homo sapiens
tgtttctctataaagtatggtaat

SEQ ID NO: 5330169 - DNA, 13 bp, Homo sapiens
tgtttctctgaaa

SEQ ID NO: 5330170 - DNA, 15 bp, Homo sapiens
tgtttctctgctgtt

SEQ ID NO: 5330171 - DNA, 11 bp, Homo sapiens
tgtttctctgt

SEQ ID NO: 5330172 - DNA, 14 bp, Homo sapiens
tgtttctctgtaaa

SEQ ID NO: 5330173 - DNA, 22 bp, Homo sapiens
tgtttctctttgattatttgca

SEQ ID NO: 5330174 - DNA, 12 bp, Homo sapiens
tgtttctgaaaa

SEQ ID NO: 5330175 - DNA, 14 bp, Homo sapiens
tgtttctgaaaaga

SEQ ID NO: 5330176 - DNA, 13 bp, Homo sapiens
tgtttctgaaaat

SEQ ID NO: 5330177 - DNA, 15 bp, Homo sapiens
tgtttctgaatgttt

SEQ ID NO: 5330178 - DNA, 17 bp, Homo sapiens
tgtttctgaatgtttgt

SEQ ID NO: 5330179 - DNA, 22 bp, Homo sapiens
tgtttctgaatgtttgtgtctg

SEQ ID NO: 5330180 - DNA, 16 bp, Homo sapiens
tgtttctgacacaaga

SEQ ID NO: 5330181 - DNA, 22 bp, Homo sapiens
tgtttctgcagcccttgggcag

SEQ ID NO: 5330182 - DNA, 12 bp, Homo sapiens
tgtttctgcagt

SEQ ID NO: 5330183 - DNA, 18 bp, Homo sapiens
tgtttctggaaatggctg

SEQ ID NO: 5330184 - DNA, 24 bp, Homo sapiens
tgtttctggacattctctttgata

SEQ ID NO: 5330185 - DNA, 22 bp, Homo sapiens
tgtttctggagtgattctagag

SEQ ID NO: 5330186 - DNA, 18 bp, Homo sapiens
tgtttctggcttagaaca

SEQ ID NO: 5330187 - DNA, 11 bp, Homo sapiens
tgtttctgtaa

SEQ ID NO: 5330188 - DNA, 14 bp, Homo sapiens
tgtttctgtaacaa

SEQ ID NO: 5330189 - DNA, 22 bp, Homo sapiens
tgtttctgtcaagctggtgcta

SEQ ID NO: 5330190 - DNA, 14 bp, Homo sapiens
tgtttctgtgctcc

SEQ ID NO: 5330191 - DNA, 13 bp, Homo sapiens
tgtttctgtgggc

SEQ ID NO: 5330192 - DNA, 19 bp, Homo sapiens
tgtttctgttattaacaaa

SEQ ID NO: 5330193 - DNA, 11 bp, Homo sapiens
tgtttctgttc

SEQ ID NO: 5330194 - DNA, 17 bp, Homo sapiens
tgtttctgttcaccttc

SEQ ID NO: 5330195 - DNA, 13 bp, Homo sapiens
tgtttctgttcca

SEQ ID NO: 5330196 - DNA, 15 bp, Homo sapiens
tgtttctgttccaaa

SEQ ID NO: 5330197 - DNA, 16 bp, Homo sapiens
tgtttctgttccaaat

SEQ ID NO: 5330198 - DNA, 14 bp, Homo sapiens
tgtttctgtttagt

SEQ ID NO: 5330199 - DNA, 21 bp, Homo sapiens
tgtttctgtttataatgaaga

SEQ ID NO: 5330200 - DNA, 16 bp, Homo sapiens
tgtttcttaaatggaa

SEQ ID NO: 5330201 - DNA, 22 bp, Homo sapiens
tgtttcttacgcttgctatcat

SEQ ID NO: 5330202 - DNA, 19 bp, Homo sapiens
tgtttcttatattattcca

SEQ ID NO: 5330203 - DNA, 13 bp, Homo sapiens
tgtttcttcctgc

SEQ ID NO: 5330204 - DNA, 12 bp, Homo sapiens
tgtttcttctcc

SEQ ID NO: 5330205 - DNA, 15 bp, Homo sapiens
tgtttcttctgtctt

SEQ ID NO: 5330206 - DNA, 18 bp, Homo sapiens
tgtttcttgacaagctga

SEQ ID NO: 5330207 - DNA, 11 bp, Homo sapiens
tgtttcttgat

SEQ ID NO: 5330208 - DNA, 14 bp, Homo sapiens
tgtttcttgccttt

SEQ ID NO: 5330209 - DNA, 19 bp, Homo sapiens
tgtttcttgctctctctcc

SEQ ID NO: 5330210 - DNA, 13 bp, Homo sapiens
tgtttcttgcttg

SEQ ID NO: 5330211 - DNA, 16 bp, Homo sapiens
tgtttcttgcttgtac

SEQ ID NO: 5330212 - DNA, 19 bp, Homo sapiens
tgtttcttgcttgtacctc

SEQ ID NO: 5330213 - DNA, 14 bp, Homo sapiens
tgtttcttgctttg

SEQ ID NO: 5330214 - DNA, 13 bp, Homo sapiens
tgtttcttgttca

SEQ ID NO: 5330215 - DNA, 16 bp, Homo sapiens
tgtttctttatatttt

SEQ ID NO: 5330216 - DNA, 12 bp, Homo sapiens
tgtttctttctg

SEQ ID NO: 5330217 - DNA, 17 bp, Homo sapiens
tgtttctttctgtctct

SEQ ID NO: 5330218 - DNA, 18 bp, Homo sapiens
tgtttctttgtaatgaaa

SEQ ID NO: 5330219 - DNA, 14 bp, Homo sapiens
tgtttctttgtgtt

SEQ ID NO: 5330220 - DNA, 18 bp, Homo sapiens
tgtttctttgtgtttgct

SEQ ID NO: 5330221 - DNA, 21 bp, Homo sapiens
tgtttcttttgtttggtaaat

SEQ ID NO: 5330222 - DNA, 19 bp, Homo sapiens
tgtttctttttacagcatt

SEQ ID NO: 5330223 - DNA, 20 bp, Homo sapiens
tgtttgaaaaagctggtctt

SEQ ID NO: 5330224 - DNA, 22 bp, Homo sapiens
tgtttgaaaatattatctttgt

SEQ ID NO: 5330225 - DNA, 17 bp, Homo sapiens
tgtttgaaaatgctctt

SEQ ID NO: 5330226 - DNA, 17 bp, Homo sapiens
tgtttgaaaattagaga

SEQ ID NO: 5330227 - DNA, 16 bp, Homo sapiens
tgtttgaaatatcatg

SEQ ID NO: 5330228 - DNA, 17 bp, Homo sapiens
tgtttgaaatatcatgt

SEQ ID NO: 5330229 - DNA, 18 bp, Homo sapiens
tgtttgaaatgcttagtt

SEQ ID NO: 5330230 - DNA, 22 bp, Homo sapiens
tgtttgaaatgtttaataaagc

SEQ ID NO: 5330231 - DNA, 17 bp, Homo sapiens
tgtttgaacccaggaga

SEQ ID NO: 5330232 - DNA, 19 bp, Homo sapiens
tgtttgaactgccaagaaa

SEQ ID NO: 5330233 - DNA, 22 bp, Homo sapiens
tgtttgaagaaccgcattttga

SEQ ID NO: 5330234 - DNA, 17 bp, Homo sapiens
tgtttgaagcctgccct

SEQ ID NO: 5330235 - DNA, 15 bp, Homo sapiens
tgtttgaagtctgct

SEQ ID NO: 5330236 - DNA, 16 bp, Homo sapiens
tgtttgaagtctgctc

SEQ ID NO: 5330237 - DNA, 13 bp, Homo sapiens
tgtttgacactaa

SEQ ID NO: 5330238 - DNA, 17 bp, Homo sapiens
tgtttgagaacccccta

SEQ ID NO: 5330239 - DNA, 22 bp, Homo sapiens
tgtttgagacagggtctcactc

SEQ ID NO: 5330240 - DNA, 18 bp, Homo sapiens
tgtttgagatgtgatgct

SEQ ID NO: 5330241 - DNA, 11 bp, Homo sapiens
tgtttgagcac

SEQ ID NO: 5330242 - DNA, 22 bp, Homo sapiens
tgtttgagcatcgcttaggaga

SEQ ID NO: 5330243 - DNA, 14 bp, Homo sapiens
tgtttgagctcaga

SEQ ID NO: 5330244 - DNA, 18 bp, Homo sapiens
tgtttgaggagcatgttt

SEQ ID NO: 5330245 - DNA, 20 bp, Homo sapiens
tgtttgaggagcatgttttg

SEQ ID NO: 5330246 - DNA, 20 bp, Homo sapiens
tgtttgaggcaaattaactg

SEQ ID NO: 5330247 - DNA, 14 bp, Homo sapiens
tgtttgaggttaaa

SEQ ID NO: 5330248 - DNA, 19 bp, Homo sapiens
tgtttgagttatcagggaa

SEQ ID NO: 5330249 - DNA, 19 bp, Homo sapiens
tgtttgagtttttcctccc

SEQ ID NO: 5330250 - DNA, 23 bp, Homo sapiens
tgtttgagtttttcctcccagtg

SEQ ID NO: 5330251 - DNA, 13 bp, Homo sapiens
tgtttgatagatt

SEQ ID NO: 5330252 - DNA, 21 bp, Homo sapiens
tgtttgatataccaaattaaa

SEQ ID NO: 5330253 - DNA, 19 bp, Homo sapiens
tgtttgatatttgtgtaaa

SEQ ID NO: 5330254 - DNA, 21 bp, Homo sapiens
tgtttgatgcattaaaagaaa

SEQ ID NO: 5330255 - DNA, 14 bp, Homo sapiens
tgtttgatgtcccc

SEQ ID NO: 5330256 - DNA, 14 bp, Homo sapiens
tgtttgatgtgtat

SEQ ID NO: 5330257 - DNA, 20 bp, Homo sapiens
tgtttgatgtgtatgtgttt

SEQ ID NO: 5330258 - DNA, 13 bp, Homo sapiens
tgtttgatgtttt

SEQ ID NO: 5330259 - DNA, 14 bp, Homo sapiens
tgtttgattataga

SEQ ID NO: 5330260 - DNA, 22 bp, Homo sapiens
tgtttgattcagacagctgcct

SEQ ID NO: 5330261 - DNA, 15 bp, Homo sapiens
tgtttgattccattc

SEQ ID NO: 5330262 - DNA, 12 bp, Homo sapiens
tgtttgattggc

SEQ ID NO: 5330263 - DNA, 16 bp, Homo sapiens
tgtttgatttagtaat

SEQ ID NO: 5330264 - DNA, 13 bp, Homo sapiens
tgtttgatttcaa

SEQ ID NO: 5330265 - DNA, 18 bp, Homo sapiens
tgtttgatttgtctcata

SEQ ID NO: 5330266 - DNA, 12 bp, Homo sapiens
tgtttgattttc

SEQ ID NO: 5330267 - DNA, 14 bp, Homo sapiens
tgtttgattttcat

SEQ ID NO: 5330268 - DNA, 12 bp, Homo sapiens
tgtttgattttt

SEQ ID NO: 5330269 - DNA, 12 bp, Homo sapiens
tgtttgcaatgc

SEQ ID NO: 5330270 - DNA, 14 bp, Homo sapiens
tgtttgcacagagg

SEQ ID NO: 5330271 - DNA, 23 bp, Homo sapiens
tgtttgcacctttctagttgaaa

SEQ ID NO: 5330272 - DNA, 22 bp, Homo sapiens
tgtttgcacgttatggtgtttc

SEQ ID NO: 5330273 - DNA, 23 bp, Homo sapiens
tgtttgcactgtgtgctgactga

SEQ ID NO: 5330274 - DNA, 19 bp, Homo sapiens
tgtttgcagtgttaagata

SEQ ID NO: 5330275 - DNA, 13 bp, Homo sapiens
tgtttgcatataa

SEQ ID NO: 5330276 - DNA, 22 bp, Homo sapiens
tgtttgcatgtgaaaatcaaat

SEQ ID NO: 5330277 - DNA, 15 bp, Homo sapiens
tgtttgccaaataaa

SEQ ID NO: 5330278 - DNA, 16 bp, Homo sapiens
tgtttgccaagctgaa

SEQ ID NO: 5330279 - DNA, 17 bp, Homo sapiens
tgtttgccaagctgaag

SEQ ID NO: 5330280 - DNA, 20 bp, Homo sapiens
tgtttgccttctacttttaa

SEQ ID NO: 5330281 - DNA, 12 bp, Homo sapiens
tgtttgccttgg

SEQ ID NO: 5330282 - DNA, 21 bp, Homo sapiens
tgtttgcctttaggcaggaag

SEQ ID NO: 5330283 - DNA, 17 bp, Homo sapiens
tgtttgctatcttaatt

SEQ ID NO: 5330284 - DNA, 16 bp, Homo sapiens
tgtttgctcaaaattg

SEQ ID NO: 5330285 - DNA, 17 bp, Homo sapiens
tgtttgctcacccagga

SEQ ID NO: 5330286 - DNA, 18 bp, Homo sapiens
tgtttgctcacccaggac

SEQ ID NO: 5330287 - DNA, 23 bp, Homo sapiens
tgtttgctcacccaggacctctg

SEQ ID NO: 5330288 - DNA, 15 bp, Homo sapiens
tgtttgctcagaaca

SEQ ID NO: 5330289 - DNA, 16 bp, Homo sapiens
tgtttgctcagaggaa

SEQ ID NO: 5330290 - DNA, 18 bp, Homo sapiens
tgtttgctccaccttcat

SEQ ID NO: 5330291 - DNA, 12 bp, Homo sapiens
tgtttgctcccc

SEQ ID NO: 5330292 - DNA, 17 bp, Homo sapiens
tgtttgctcctgttgtt

SEQ ID NO: 5330293 - DNA, 14 bp, Homo sapiens
tgtttgctctcccg

SEQ ID NO: 5330294 - DNA, 13 bp, Homo sapiens
tgtttgctgctat

SEQ ID NO: 5330295 - DNA, 15 bp, Homo sapiens
tgtttgctgtttttt

SEQ ID NO: 5330296 - DNA, 12 bp, Homo sapiens
tgtttgcttaaa

SEQ ID NO: 5330297 - DNA, 16 bp, Homo sapiens
tgtttgcttattgttc

SEQ ID NO: 5330298 - DNA, 21 bp, Homo sapiens
tgtttgcttcatgtgtcccag

SEQ ID NO: 5330299 - DNA, 15 bp, Homo sapiens
tgtttgcttccatta

SEQ ID NO: 5330300 - DNA, 17 bp, Homo sapiens
tgtttgcttcttgccat

SEQ ID NO: 5330301 - DNA, 20 bp, Homo sapiens
tgtttgcttgaatgctggta

SEQ ID NO: 5330302 - DNA, 20 bp, Homo sapiens
tgtttgcttggaaattcctt

SEQ ID NO: 5330303 - DNA, 22 bp, Homo sapiens
tgtttgcttggaaattccttgc

SEQ ID NO: 5330304 - DNA, 19 bp, Homo sapiens
tgtttgcttttcactggca

SEQ ID NO: 5330305 - DNA, 20 bp, Homo sapiens
tgtttggaaaaaactctgaa

SEQ ID NO: 5330306 - DNA, 17 bp, Homo sapiens
tgtttggaaaagacagt

SEQ ID NO: 5330307 - DNA, 17 bp, Homo sapiens
tgtttggaaaagctaag

SEQ ID NO: 5330308 - DNA, 23 bp, Homo sapiens
tgtttggaaaagctaagtagaaa

SEQ ID NO: 5330309 - DNA, 18 bp, Homo sapiens
tgtttggaatattgtcca

SEQ ID NO: 5330310 - DNA, 16 bp, Homo sapiens
tgtttggaatttaaga

SEQ ID NO: 5330311 - DNA, 13 bp, Homo sapiens
tgtttggagacag

SEQ ID NO: 5330312 - DNA, 22 bp, Homo sapiens
tgtttggaggagcaaagttaaa

SEQ ID NO: 5330313 - DNA, 17 bp, Homo sapiens
tgtttggatgtaattta

SEQ ID NO: 5330314 - DNA, 18 bp, Homo sapiens
tgtttggatttcctttat

SEQ ID NO: 5330315 - DNA, 17 bp, Homo sapiens
tgtttggcaaggaaagg

SEQ ID NO: 5330316 - DNA, 11 bp, Homo sapiens
tgtttggcacc

SEQ ID NO: 5330317 - DNA, 15 bp, Homo sapiens
tgtttggcacccaaa

SEQ ID NO: 5330318 - DNA, 15 bp, Homo sapiens
tgtttggcatgtaaa

SEQ ID NO: 5330319 - DNA, 16 bp, Homo sapiens
tgtttggcatgtaaat

SEQ ID NO: 5330320 - DNA, 17 bp, Homo sapiens
tgtttggcttataaaca

SEQ ID NO: 5330321 - DNA, 17 bp, Homo sapiens
tgtttggcttggccttg

SEQ ID NO: 5330322 - DNA, 21 bp, Homo sapiens
tgtttgggaaaggcagggccc

SEQ ID NO: 5330323 - DNA, 23 bp, Homo sapiens
tgtttgggaatggtgcccttgga

SEQ ID NO: 5330324 - DNA, 19 bp, Homo sapiens
tgtttgggatgtctgagat

SEQ ID NO: 5330325 - DNA, 17 bp, Homo sapiens
tgtttggggaagttcaa

SEQ ID NO: 5330326 - DNA, 23 bp, Homo sapiens
tgtttggggatcgatgtgctcag

SEQ ID NO: 5330327 - DNA, 15 bp, Homo sapiens
tgtttggggcaggag

SEQ ID NO: 5330328 - DNA, 23 bp, Homo sapiens
tgtttggggcaggagtagctgag

SEQ ID NO: 5330329 - DNA, 21 bp, Homo sapiens
tgtttgggggttctgtttcag

SEQ ID NO: 5330330 - DNA, 23 bp, Homo sapiens
tgtttgggtatcctgcccagtgt

SEQ ID NO: 5330331 - DNA, 15 bp, Homo sapiens
tgtttggtaaatgtt

SEQ ID NO: 5330332 - DNA, 16 bp, Homo sapiens
tgtttggtattgtatt

SEQ ID NO: 5330333 - DNA, 22 bp, Homo sapiens
tgtttggtattgtatttattca

SEQ ID NO: 5330334 - DNA, 15 bp, Homo sapiens
tgtttggtgaggacc

SEQ ID NO: 5330335 - DNA, 22 bp, Homo sapiens
tgtttggtgcatagaactgggt

SEQ ID NO: 5330336 - DNA, 22 bp, Homo sapiens
tgtttggtgggccatatgccta

SEQ ID NO: 5330337 - DNA, 21 bp, Homo sapiens
tgtttggtggggtggcacctg

SEQ ID NO: 5330338 - DNA, 16 bp, Homo sapiens
tgtttggttctggggc

SEQ ID NO: 5330339 - DNA, 20 bp, Homo sapiens
tgtttggttctggggcccct

SEQ ID NO: 5330340 - DNA, 16 bp, Homo sapiens
tgtttggttgtaaatg

SEQ ID NO: 5330341 - DNA, 22 bp, Homo sapiens
tgtttggttgtaaatgctcgtg

SEQ ID NO: 5330342 - DNA, 19 bp, Homo sapiens
tgtttggtttactttcaaa

SEQ ID NO: 5330343 - DNA, 16 bp, Homo sapiens
tgtttggtttcttcat

SEQ ID NO: 5330344 - DNA, 19 bp, Homo sapiens
tgtttggtttcttcattct

SEQ ID NO: 5330345 - DNA, 21 bp, Homo sapiens
tgtttggtttcttcattcttt

SEQ ID NO: 5330346 - DNA, 16 bp, Homo sapiens
tgtttggttttaaaat

SEQ ID NO: 5330347 - DNA, 16 bp, Homo sapiens
tgtttggttttacatt

SEQ ID NO: 5330348 - DNA, 24 bp, Homo sapiens
tgtttggttttttgttcttgcgat

SEQ ID NO: 5330349 - DNA, 16 bp, Homo sapiens
tgtttgtaaaaatgta

SEQ ID NO: 5330350 - DNA, 17 bp, Homo sapiens
tgtttgtaaaagagctg

SEQ ID NO: 5330351 - DNA, 11 bp, Homo sapiens
tgtttgtaaat

SEQ ID NO: 5330352 - DNA, 13 bp, Homo sapiens
tgtttgtaaataa

SEQ ID NO: 5330353 - DNA, 15 bp, Homo sapiens
tgtttgtaaatgcct

SEQ ID NO: 5330354 - DNA, 17 bp, Homo sapiens
tgtttgtaaatgcctct

SEQ ID NO: 5330355 - DNA, 16 bp, Homo sapiens
tgtttgtaaattaata

SEQ ID NO: 5330356 - DNA, 19 bp, Homo sapiens
tgtttgtaaattaatactt

SEQ ID NO: 5330357 - DNA, 20 bp, Homo sapiens
tgtttgtaactttttacatt

SEQ ID NO: 5330358 - DNA, 23 bp, Homo sapiens
tgtttgtaactttttacattaca

SEQ ID NO: 5330359 - DNA, 13 bp, Homo sapiens
tgtttgtaagcaa

SEQ ID NO: 5330360 - DNA, 17 bp, Homo sapiens
tgtttgtacaagattgt

SEQ ID NO: 5330361 - DNA, 18 bp, Homo sapiens
tgtttgtacaagattgtc

SEQ ID NO: 5330362 - DNA, 20 bp, Homo sapiens
tgtttgtacacaacaatcct

SEQ ID NO: 5330363 - DNA, 11 bp, Homo sapiens
tgtttgtacag

SEQ ID NO: 5330364 - DNA, 13 bp, Homo sapiens
tgtttgtacagta

SEQ ID NO: 5330365 - DNA, 19 bp, Homo sapiens
tgtttgtactggttcattg

SEQ ID NO: 5330366 - DNA, 12 bp, Homo sapiens
tgtttgtactgt

SEQ ID NO: 5330367 - DNA, 19 bp, Homo sapiens
tgtttgtagtcttgtctta

SEQ ID NO: 5330368 - DNA, 19 bp, Homo sapiens
tgtttgtataatgaatgag

SEQ ID NO: 5330369 - DNA, 20 bp, Homo sapiens
tgtttgtataccatgatgca

SEQ ID NO: 5330370 - DNA, 15 bp, Homo sapiens
tgtttgtatataaat

SEQ ID NO: 5330371 - DNA, 15 bp, Homo sapiens
tgtttgtatatttgc

SEQ ID NO: 5330372 - DNA, 13 bp, Homo sapiens
tgtttgtatgtct

SEQ ID NO: 5330373 - DNA, 16 bp, Homo sapiens
tgtttgtatgtctgtg

SEQ ID NO: 5330374 - DNA, 20 bp, Homo sapiens
tgtttgtattgtaaaaaatt

SEQ ID NO: 5330375 - DNA, 15 bp, Homo sapiens
tgtttgtcagcatct

SEQ ID NO: 5330376 - DNA, 17 bp, Homo sapiens
tgtttgtcagcatctga

SEQ ID NO: 5330377 - DNA, 19 bp, Homo sapiens
tgtttgtcatggtgaaatt

SEQ ID NO: 5330378 - DNA, 15 bp, Homo sapiens
tgtttgtcattagcc

SEQ ID NO: 5330379 - DNA, 16 bp, Homo sapiens
tgtttgtctcatccca

SEQ ID NO: 5330380 - DNA, 20 bp, Homo sapiens
tgtttgtctgtttgtttcaa

SEQ ID NO: 5330381 - DNA, 17 bp, Homo sapiens
tgtttgtcttctcccca

SEQ ID NO: 5330382 - DNA, 17 bp, Homo sapiens
tgtttgtgagtatgtgt

SEQ ID NO: 5330383 - DNA, 13 bp, Homo sapiens
tgtttgtgattga

SEQ ID NO: 5330384 - DNA, 17 bp, Homo sapiens
tgtttgtgcagtaactt

SEQ ID NO: 5330385 - DNA, 15 bp, Homo sapiens
tgtttgtgcatcctg

SEQ ID NO: 5330386 - DNA, 15 bp, Homo sapiens
tgtttgtgctgtggt

SEQ ID NO: 5330387 - DNA, 16 bp, Homo sapiens
tgtttgtgcttcaaat

SEQ ID NO: 5330388 - DNA, 15 bp, Homo sapiens
tgtttgtgcttctaa

SEQ ID NO: 5330389 - DNA, 19 bp, Homo sapiens
tgtttgtgcttctaatatt

SEQ ID NO: 5330390 - DNA, 19 bp, Homo sapiens
tgtttgtgtccataagaga

SEQ ID NO: 5330391 - DNA, 12 bp, Homo sapiens
tgtttgtgtctg

SEQ ID NO: 5330392 - DNA, 14 bp, Homo sapiens
tgtttgtgtgcatg

SEQ ID NO: 5330393 - DNA, 16 bp, Homo sapiens
tgtttgtgtgtatctg

SEQ ID NO: 5330394 - DNA, 13 bp, Homo sapiens
tgtttgtgtgtgt

SEQ ID NO: 5330395 - DNA, 19 bp, Homo sapiens
tgtttgtgttcaatatcag

SEQ ID NO: 5330396 - DNA, 17 bp, Homo sapiens
tgtttgttaaaactggc

SEQ ID NO: 5330397 - DNA, 21 bp, Homo sapiens
tgtttgttaaaactggcatct

SEQ ID NO: 5330398 - DNA, 20 bp, Homo sapiens
tgtttgttatttacactggt

SEQ ID NO: 5330399 - DNA, 16 bp, Homo sapiens
tgtttgttcttgtttt

SEQ ID NO: 5330400 - DNA, 14 bp, Homo sapiens
tgtttgtttaattt

SEQ ID NO: 5330401 - DNA, 12 bp, Homo sapiens
tgtttgtttatt

SEQ ID NO: 5330402 - DNA, 18 bp, Homo sapiens
tgtttgtttattagatga

SEQ ID NO: 5330403 - DNA, 19 bp, Homo sapiens
tgtttgtttcaagaacctg

SEQ ID NO: 5330404 - DNA, 22 bp, Homo sapiens
tgtttgtttctccccctgggct

SEQ ID NO: 5330405 - DNA, 13 bp, Homo sapiens
tgtttgtttcttc

SEQ ID NO: 5330406 - DNA, 14 bp, Homo sapiens
tgtttgtttcttct

SEQ ID NO: 5330407 - DNA, 20 bp, Homo sapiens
tgtttgtttcttcttttcct

SEQ ID NO: 5330408 - DNA, 13 bp, Homo sapiens
tgtttgtttcttt

SEQ ID NO: 5330409 - DNA, 20 bp, Homo sapiens
tgtttgttttggattcttta

SEQ ID NO: 5330410 - DNA, 12 bp, Homo sapiens
tgttttaaaaaa

SEQ ID NO: 5330411 - DNA, 17 bp, Homo sapiens
tgttttaaaaaaactga

SEQ ID NO: 5330412 - DNA, 18 bp, Homo sapiens
tgttttaaaaaaactgaa

SEQ ID NO: 5330413 - DNA, 21 bp, Homo sapiens
tgttttaaaaaggaactgcag

SEQ ID NO: 5330414 - DNA, 18 bp, Homo sapiens
tgttttaaaactggacct

SEQ ID NO: 5330415 - DNA, 14 bp, Homo sapiens
tgttttaaaacttt

SEQ ID NO: 5330416 - DNA, 23 bp, Homo sapiens
tgttttaaaataaaaattctgaa

SEQ ID NO: 5330417 - DNA, 15 bp, Homo sapiens
tgttttaaaatgcag

SEQ ID NO: 5330418 - DNA, 22 bp, Homo sapiens
tgttttaaaatgtgaggcaata

SEQ ID NO: 5330419 - DNA, 22 bp, Homo sapiens
tgttttaaactacatcttgaaa

SEQ ID NO: 5330420 - DNA, 15 bp, Homo sapiens
tgttttaaactgtga

SEQ ID NO: 5330421 - DNA, 22 bp, Homo sapiens
tgttttaaatacgcactacatg

SEQ ID NO: 5330422 - DNA, 15 bp, Homo sapiens
tgttttaaatgtaca

SEQ ID NO: 5330423 - DNA, 14 bp, Homo sapiens
tgttttaaattctg

SEQ ID NO: 5330424 - DNA, 15 bp, Homo sapiens
tgttttaaattctga

SEQ ID NO: 5330425 - DNA, 20 bp, Homo sapiens
tgttttaaatttaaaacaat

SEQ ID NO: 5330426 - DNA, 22 bp, Homo sapiens
tgttttaaatttatttcaaaaa

SEQ ID NO: 5330427 - DNA, 13 bp, Homo sapiens
tgttttaacaaaa

SEQ ID NO: 5330428 - DNA, 19 bp, Homo sapiens
tgttttaacaagaagcaat

SEQ ID NO: 5330429 - DNA, 20 bp, Homo sapiens
tgttttaacacagtacctaa

SEQ ID NO: 5330430 - DNA, 21 bp, Homo sapiens
tgttttaaccagtacttctaa

SEQ ID NO: 5330431 - DNA, 12 bp, Homo sapiens
tgttttaactta

SEQ ID NO: 5330432 - DNA, 20 bp, Homo sapiens
tgttttaagaggcagggtct

SEQ ID NO: 5330433 - DNA, 20 bp, Homo sapiens
tgttttaagccaatatttta

SEQ ID NO: 5330434 - DNA, 17 bp, Homo sapiens
tgttttaagccacaaag

SEQ ID NO: 5330435 - DNA, 17 bp, Homo sapiens
tgttttaaggaagaaaa

SEQ ID NO: 5330436 - DNA, 18 bp, Homo sapiens
tgttttaaggatgcttgt

SEQ ID NO: 5330437 - DNA, 13 bp, Homo sapiens
ttaaaaaattctt

SEQ ID NO: 5330438 - DNA, 12 bp, Homo sapiens
ttaaaaaattta

SEQ ID NO: 5330439 - DNA, 13 bp, Homo sapiens
ttaaaaaatttgt

SEQ ID NO: 5330440 - DNA, 14 bp, Homo sapiens
ttaaaaaatttgta

SEQ ID NO: 5330441 - DNA, 13 bp, Homo sapiens
ttaaaaacaaagg

SEQ ID NO: 5330442 - DNA, 18 bp, Homo sapiens
ttaaaaacagctgtaact

SEQ ID NO: 5330443 - DNA, 13 bp, Homo sapiens
ttaaaaacataga

SEQ ID NO: 5330444 - DNA, 21 bp, Homo sapiens
ttaaaaacatgagaaatgtga

SEQ ID NO: 5330445 - DNA, 22 bp, Homo sapiens
ttaaaaacattttttatacatt

SEQ ID NO: 5330446 - DNA, 21 bp, Homo sapiens
ttaaaaacctattttgaaagg

SEQ ID NO: 5330447 - DNA, 19 bp, Homo sapiens
ttaaaaacctgcctaaatt

SEQ ID NO: 5330448 - DNA, 18 bp, Homo sapiens
ttaaaaacctgttcaagt

SEQ ID NO: 5330449 - DNA, 16 bp, Homo sapiens
ttaaaaactcacttac

SEQ ID NO: 5330450 - DNA, 14 bp, Homo sapiens
ttaaaaactgtgta

SEQ ID NO: 5330451 - DNA, 22 bp, Homo sapiens
ttaaaaactgtgtatcattaaa

SEQ ID NO: 5330452 - DNA, 16 bp, Homo sapiens
ttaaaaactttaaaga

SEQ ID NO: 5330453 - DNA, 15 bp, Homo sapiens
ttaaaaagaaaatca

SEQ ID NO: 5330454 - DNA, 17 bp, Homo sapiens
ttaaaaagaaacaagat

SEQ ID NO: 5330455 - DNA, 20 bp, Homo sapiens
ttaaaaagaagtttctatat

SEQ ID NO: 5330456 - DNA, 19 bp, Homo sapiens
ttaaaaagatgaaaaagaa

SEQ ID NO: 5330457 - DNA, 20 bp, Homo sapiens
ttaaaaagatgaaaaagaat

SEQ ID NO: 5330458 - DNA, 17 bp, Homo sapiens
ttaaaaagcagctgcat

SEQ ID NO: 5330459 - DNA, 14 bp, Homo sapiens
ttaaaaagcccaac

SEQ ID NO: 5330460 - DNA, 17 bp, Homo sapiens
ttaaaaagcccaacctc

SEQ ID NO: 5330461 - DNA, 23 bp, Homo sapiens
ttaaaaaggaaagaaaactaaca

SEQ ID NO: 5330462 - DNA, 22 bp, Homo sapiens
ttaaaaaggaaatttgtttgta

SEQ ID NO: 5330463 - DNA, 22 bp, Homo sapiens
ttaaaaaggcagtttgcaaaaa

SEQ ID NO: 5330464 - DNA, 21 bp, Homo sapiens
ttaaaaagggaagaaactgct

SEQ ID NO: 5330465 - DNA, 20 bp, Homo sapiens
ttaaaaagggtaacttgttt

SEQ ID NO: 5330466 - DNA, 15 bp, Homo sapiens
ttaaaaaggtaaatg

SEQ ID NO: 5330467 - DNA, 12 bp, Homo sapiens
ttaaaaagtatt

SEQ ID NO: 5330468 - DNA, 20 bp, Homo sapiens
ttaaaaagtattgccaaaca

SEQ ID NO: 5330469 - DNA, 22 bp, Homo sapiens
ttaaaaagtattgccaaacatt

SEQ ID NO: 5330470 - DNA, 17 bp, Homo sapiens
ttaaaaagtcttttaaa

SEQ ID NO: 5330471 - DNA, 12 bp, Homo sapiens
ttaaaaagtgtt

SEQ ID NO: 5330472 - DNA, 19 bp, Homo sapiens
ttaaaaagttgcacattag

SEQ ID NO: 5330473 - DNA, 16 bp, Homo sapiens
ttaaaaagttgttctt

SEQ ID NO: 5330474 - DNA, 20 bp, Homo sapiens
ttaaaaagtttctaatatta

SEQ ID NO: 5330475 - DNA, 18 bp, Homo sapiens
ttaaaaataaaagctatt

SEQ ID NO: 5330476 - DNA, 20 bp, Homo sapiens
ttaaaaataaacaagcattt

SEQ ID NO: 5330477 - DNA, 12 bp, Homo sapiens
ttaaaaataaag

SEQ ID NO: 5330478 - DNA, 21 bp, Homo sapiens
ttaaaaataagtcaacagtaa

SEQ ID NO: 5330479 - DNA, 22 bp, Homo sapiens
ttaaaaataagtcaacagtaaa

SEQ ID NO: 5330480 - DNA, 19 bp, Homo sapiens
ttaaaaataattattttat

SEQ ID NO: 5330481 - DNA, 13 bp, Homo sapiens
ttaaaaatacaca

SEQ ID NO: 5330482 - DNA, 18 bp, Homo sapiens
ttaaaaatacatagcatt

SEQ ID NO: 5330483 - DNA, 14 bp, Homo sapiens
ttaaaaatacatat

SEQ ID NO: 5330484 - DNA, 18 bp, Homo sapiens
ttaaaaataccttctatg

SEQ ID NO: 5330485 - DNA, 22 bp, Homo sapiens
ttaaaaataccttctatgtatt

SEQ ID NO: 5330486 - DNA, 20 bp, Homo sapiens
ttaaaaatagaatacatttt

SEQ ID NO: 5330487 - DNA, 23 bp, Homo sapiens
ttaaaaatataaacaatgttcag

SEQ ID NO: 5330488 - DNA, 19 bp, Homo sapiens
ttaaaaatatcaaattaat

SEQ ID NO: 5330489 - DNA, 19 bp, Homo sapiens
ttaaaaatatctgaatata

SEQ ID NO: 5330490 - DNA, 14 bp, Homo sapiens
ttaaaaatatttca

SEQ ID NO: 5330491 - DNA, 12 bp, Homo sapiens
ttaaaaatcaac

SEQ ID NO: 5330492 - DNA, 21 bp, Homo sapiens
ttaaaaatctaccttctgtag

SEQ ID NO: 5330493 - DNA, 16 bp, Homo sapiens
ttaaaaatctcaaatt

SEQ ID NO: 5330494 - DNA, 14 bp, Homo sapiens
ttaaaaatcttggt

SEQ ID NO: 5330495 - DNA, 19 bp, Homo sapiens
ttaaaaatgagatttctta

SEQ ID NO: 5330496 - DNA, 19 bp, Homo sapiens
ttaaaaatgcaatatctga

SEQ ID NO: 5330497 - DNA, 23 bp, Homo sapiens
ttaaaaatgcacacctcatgagt

SEQ ID NO: 5330498 - DNA, 18 bp, Homo sapiens
ttaaaaatgcatgataat

SEQ ID NO: 5330499 - DNA, 21 bp, Homo sapiens
ttaaaaatgccaaaaacaaaa

SEQ ID NO: 5330500 - DNA, 10 bp, Homo sapiens
ttaaaaatgg

SEQ ID NO: 5330501 - DNA, 20 bp, Homo sapiens
ttaaaaatggctcaagtaga

SEQ ID NO: 5330502 - DNA, 21 bp, Homo sapiens
ttaaaaatggctcaagtagaa

SEQ ID NO: 5330503 - DNA, 13 bp, Homo sapiens
ttaaaaatggtaa

SEQ ID NO: 5330504 - DNA, 22 bp, Homo sapiens
ttaaaaatggtaaaattgcatg

SEQ ID NO: 5330505 - DNA, 23 bp, Homo sapiens
ttaaaaatggtatcaaaattaca

SEQ ID NO: 5330506 - DNA, 24 bp, Homo sapiens
ttaaaaatggtatcaaaattacat

SEQ ID NO: 5330507 - DNA, 19 bp, Homo sapiens
ttaaaaatgtaaatattct

SEQ ID NO: 5330508 - DNA, 19 bp, Homo sapiens
ttaaaaatgtagaaattct

SEQ ID NO: 5330509 - DNA, 15 bp, Homo sapiens
ttaaaaatgtatgtt

SEQ ID NO: 5330510 - DNA, 18 bp, Homo sapiens
ttaaaaatgtcttattgt

SEQ ID NO: 5330511 - DNA, 12 bp, Homo sapiens
ttaaaaatgtgg

SEQ ID NO: 5330512 - DNA, 16 bp, Homo sapiens
ttaaaaatgttctcaa

SEQ ID NO: 5330513 - DNA, 23 bp, Homo sapiens
ttaaaaattaatatggtgtattt

SEQ ID NO: 5330514 - DNA, 13 bp, Homo sapiens
ttaaaaattactg

SEQ ID NO: 5330515 - DNA, 18 bp, Homo sapiens
ttaaaaattacttttaaa

SEQ ID NO: 5330516 - DNA, 13 bp, Homo sapiens
ttaaaaattgcat

SEQ ID NO: 5330517 - DNA, 15 bp, Homo sapiens
ttaaaaattgtctct

SEQ ID NO: 5330518 - DNA, 17 bp, Homo sapiens
ttaaaaattgtctcttt

SEQ ID NO: 5330519 - DNA, 23 bp, Homo sapiens
ttaaaaatttactacaatatgta

SEQ ID NO: 5330520 - DNA, 22 bp, Homo sapiens
ttaaaaattttgtcctttcatg

SEQ ID NO: 5330521 - DNA, 13 bp, Homo sapiens
ttaaaacaaaaga

SEQ ID NO: 5330522 - DNA, 20 bp, Homo sapiens
ttaaaacaaaaggaaagaaa

SEQ ID NO: 5330523 - DNA, 13 bp, Homo sapiens
ttaaaacaaaatc

SEQ ID NO: 5330524 - DNA, 17 bp, Homo sapiens
ttaaaacaaatatacat

SEQ ID NO: 5330525 - DNA, 19 bp, Homo sapiens
ttaaaacaaatatacattt

SEQ ID NO: 5330526 - DNA, 20 bp, Homo sapiens
ttaaaacaagaaagtttccc

SEQ ID NO: 5330527 - DNA, 15 bp, Homo sapiens
ttaaaacaagagacc

SEQ ID NO: 5330528 - DNA, 20 bp, Homo sapiens
ttaaaacaagagaccacttc

SEQ ID NO: 5330529 - DNA, 22 bp, Homo sapiens
ttaaaacaataatgcaattaga

SEQ ID NO: 5330530 - DNA, 20 bp, Homo sapiens
ttaaaacaatattgtttcta

SEQ ID NO: 5330531 - DNA, 12 bp, Homo sapiens
ttaaaacaatgt

SEQ ID NO: 5330532 - DNA, 15 bp, Homo sapiens
ttaaaacaatttatt

SEQ ID NO: 5330533 - DNA, 14 bp, Homo sapiens
ttaaaacacatgat

SEQ ID NO: 5330534 - DNA, 20 bp, Homo sapiens
ttaaaacacatgtttttata

SEQ ID NO: 5330535 - DNA, 16 bp, Homo sapiens
ttaaaacacattatgt

SEQ ID NO: 5330536 - DNA, 15 bp, Homo sapiens
ttaaaacactaaaag

SEQ ID NO: 5330537 - DNA, 20 bp, Homo sapiens
ttaaaacacttctgtcctgt

SEQ ID NO: 5330538 - DNA, 14 bp, Homo sapiens
ttaaaacagcctgg

SEQ ID NO: 5330539 - DNA, 16 bp, Homo sapiens
ttaaaacagcctgggt

SEQ ID NO: 5330540 - DNA, 17 bp, Homo sapiens
ttaaaacaggcaaagtt

SEQ ID NO: 5330541 - DNA, 13 bp, Homo sapiens
ttaaaacagtatt

SEQ ID NO: 5330542 - DNA, 20 bp, Homo sapiens
ttaaaacagtatttattttg

SEQ ID NO: 5330543 - DNA, 16 bp, Homo sapiens
ttaaaacatcattcct

SEQ ID NO: 5330544 - DNA, 18 bp, Homo sapiens
ttaaaacatcattccttt

SEQ ID NO: 5330545 - DNA, 21 bp, Homo sapiens
ttaaaacatgctgtttatgac

SEQ ID NO: 5330546 - DNA, 14 bp, Homo sapiens
ttaaaacatgtaat

SEQ ID NO: 5330547 - DNA, 13 bp, Homo sapiens
ttaaaacatttca

SEQ ID NO: 5330548 - DNA, 20 bp, Homo sapiens
ttaaaaccagagaatcttaa

SEQ ID NO: 5330549 - DNA, 20 bp, Homo sapiens
ttaaaaccatgcagcttcat

SEQ ID NO: 5330550 - DNA, 22 bp, Homo sapiens
ttaaaaccattatttaataaga

SEQ ID NO: 5330551 - DNA, 13 bp, Homo sapiens
ttaaaacccaaac

SEQ ID NO: 5330552 - DNA, 14 bp, Homo sapiens
ttaaaacccaagtg

SEQ ID NO: 5330553 - DNA, 18 bp, Homo sapiens
ttaaaacctagaacttca

SEQ ID NO: 5330554 - DNA, 21 bp, Homo sapiens
ttaaaacgcgtctgcctgggc

SEQ ID NO: 5330555 - DNA, 20 bp, Homo sapiens
ttaaaactaggcatttgtaa

SEQ ID NO: 5330556 - DNA, 13 bp, Homo sapiens
ttaaaactaggta

SEQ ID NO: 5330557 - DNA, 19 bp, Homo sapiens
ttaaaactaggtaatgttt

SEQ ID NO: 5330558 - DNA, 22 bp, Homo sapiens
ttaaaactatccaattaaaatt

SEQ ID NO: 5330559 - DNA, 22 bp, Homo sapiens
ttaaaactcaacattactgtta

SEQ ID NO: 5330560 - DNA, 21 bp, Homo sapiens
ttaaaactcagaatataacat

SEQ ID NO: 5330561 - DNA, 18 bp, Homo sapiens
ttaaaactcagatttaaa

SEQ ID NO: 5330562 - DNA, 22 bp, Homo sapiens
ttaaaactcagatttaaaacaa

SEQ ID NO: 5330563 - DNA, 11 bp, Homo sapiens
ttaaaactcat

SEQ ID NO: 5330564 - DNA, 17 bp, Homo sapiens
ttaaaactgaagtctga

SEQ ID NO: 5330565 - DNA, 19 bp, Homo sapiens
ttaaaactgaagtctgaaa

SEQ ID NO: 5330566 - DNA, 21 bp, Homo sapiens
ttaaaactgaagtctgaaatt

SEQ ID NO: 5330567 - DNA, 11 bp, Homo sapiens
ttaaaactgag

SEQ ID NO: 5330568 - DNA, 12 bp, Homo sapiens
ttaaaactgctt

SEQ ID NO: 5330569 - DNA, 13 bp, Homo sapiens
ttaaaactgcttt

SEQ ID NO: 5330570 - DNA, 14 bp, Homo sapiens
ttaaaactgtattt

SEQ ID NO: 5330571 - DNA, 14 bp, Homo sapiens
ttaaaacttcttaa

SEQ ID NO: 5330572 - DNA, 15 bp, Homo sapiens
ttaaaactttaagaa

SEQ ID NO: 5330573 - DNA, 15 bp, Homo sapiens
ttaaaactttgaagt

SEQ ID NO: 5330574 - DNA, 15 bp, Homo sapiens
ttaaaactttgtaga

SEQ ID NO: 5330575 - DNA, 20 bp, Homo sapiens
ttaaaacttttctgcatttg

SEQ ID NO: 5330576 - DNA, 9 bp, Homo sapiens
ttaaaagaa

SEQ ID NO: 5330577 - DNA, 14 bp, Homo sapiens
ttaaaagaaaaaaa

SEQ ID NO: 5330578 - DNA, 18 bp, Homo sapiens
ttaaaagaaaaaatgaca

SEQ ID NO: 5330579 - DNA, 16 bp, Homo sapiens
ttaaaagaaaaacaaa

SEQ ID NO: 5330580 - DNA, 15 bp, Homo sapiens
ttaaaagaaaacaaa

SEQ ID NO: 5330581 - DNA, 22 bp, Homo sapiens
ttaaaagaaaataaaaaaaaga

SEQ ID NO: 5330582 - DNA, 20 bp, Homo sapiens
ttaaaagaaagggttctgta

SEQ ID NO: 5330583 - DNA, 12 bp, Homo sapiens
ttaaaagaaata

SEQ ID NO: 5330584 - DNA, 12 bp, Homo sapiens
ttaaaagaaatt

SEQ ID NO: 5330585 - DNA, 14 bp, Homo sapiens
ttaaaagaacatag

SEQ ID NO: 5330586 - DNA, 14 bp, Homo sapiens
ttaaaagaagactg

SEQ ID NO: 5330587 - DNA, 16 bp, Homo sapiens
ttaaaagaagactgga

SEQ ID NO: 5330588 - DNA, 14 bp, Homo sapiens
ttaaaagaagcttt

SEQ ID NO: 5330589 - DNA, 19 bp, Homo sapiens
ttaaaagaaggaccctttt

SEQ ID NO: 5330590 - DNA, 15 bp, Homo sapiens
ttaaaagaatgacta

SEQ ID NO: 5330591 - DNA, 13 bp, Homo sapiens
ttaaaagaatgat

SEQ ID NO: 5330592 - DNA, 16 bp, Homo sapiens
ttaaaagacaaatatg

SEQ ID NO: 5330593 - DNA, 17 bp, Homo sapiens
ttaaaagacaagacttc

SEQ ID NO: 5330594 - DNA, 13 bp, Homo sapiens
ttaaaagacagtg

SEQ ID NO: 5330595 - DNA, 13 bp, Homo sapiens
ttaaaagactcat

SEQ ID NO: 5330596 - DNA, 15 bp, Homo sapiens
ttaaaagagaaaaac

SEQ ID NO: 5330597 - DNA, 12 bp, Homo sapiens
ttaaaagagacc

SEQ ID NO: 5330598 - DNA, 13 bp, Homo sapiens
ttaaaagaggaaa

SEQ ID NO: 5330599 - DNA, 18 bp, Homo sapiens
ttaaaagaggaaattaaa

SEQ ID NO: 5330600 - DNA, 21 bp, Homo sapiens
ttaaaagaggagaaaatttat

SEQ ID NO: 5330601 - DNA, 11 bp, Homo sapiens
ttaaaagagta

SEQ ID NO: 5330602 - DNA, 18 bp, Homo sapiens
ttaaaagataaatattat

SEQ ID NO: 5330603 - DNA, 15 bp, Homo sapiens
ttaaaagatgaaaat

SEQ ID NO: 5330604 - DNA, 21 bp, Homo sapiens
ttaaaagatgcaatgtagagg

SEQ ID NO: 5330605 - DNA, 17 bp, Homo sapiens
ttaaaagattcattttt

SEQ ID NO: 5330606 - DNA, 13 bp, Homo sapiens
ttaaaagattttt

SEQ ID NO: 5330607 - DNA, 20 bp, Homo sapiens
ttaaaagatttttttaactt

SEQ ID NO: 5330608 - DNA, 15 bp, Homo sapiens
ttaaaagcacaatca

SEQ ID NO: 5330609 - DNA, 17 bp, Homo sapiens
ttaaaagcacaatcact

SEQ ID NO: 5330610 - DNA, 15 bp, Homo sapiens
ttaaaagcagagcat

SEQ ID NO: 5330611 - DNA, 13 bp, Homo sapiens
ttaaaagcatgaa

SEQ ID NO: 5330612 - DNA, 12 bp, Homo sapiens
ttaaaagcattt

SEQ ID NO: 5330613 - DNA, 21 bp, Homo sapiens
ttaaaagccatcatgtaaatt

SEQ ID NO: 5330614 - DNA, 21 bp, Homo sapiens
ttaaaagccttccagttttgt

SEQ ID NO: 5330615 - DNA, 23 bp, Homo sapiens
ttaaaagctatcttcatgtaaat

SEQ ID NO: 5330616 - DNA, 12 bp, Homo sapiens
ttaaaaggaaaa

SEQ ID NO: 5330617 - DNA, 17 bp, Homo sapiens
ttaaaaggaaaaaagaa

SEQ ID NO: 5330618 - DNA, 16 bp, Homo sapiens
ttaaaaggaaaaataa

SEQ ID NO: 5330619 - DNA, 19 bp, Homo sapiens
ttaaaaggatgtataaatt

SEQ ID NO: 5330620 - DNA, 15 bp, Homo sapiens
ttaaaagggaacaca

SEQ ID NO: 5330621 - DNA, 21 bp, Homo sapiens
ttaaaagggattacccaagca

SEQ ID NO: 5330622 - DNA, 23 bp, Homo sapiens
ttaaaaggtataattaaacttct

SEQ ID NO: 5330623 - DNA, 15 bp, Homo sapiens
ttaaaagtaaaagag

SEQ ID NO: 5330624 - DNA, 14 bp, Homo sapiens
ttaaaagtaaatgt

SEQ ID NO: 5330625 - DNA, 20 bp, Homo sapiens
ttaaaagtatctttaacaat

SEQ ID NO: 5330626 - DNA, 15 bp, Homo sapiens
ttaaaagtctatttt

SEQ ID NO: 5330627 - DNA, 17 bp, Homo sapiens
ttaaaagtctattttat

SEQ ID NO: 5330628 - DNA, 20 bp, Homo sapiens
ttaaaagtctattttattat

SEQ ID NO: 5330629 - DNA, 18 bp, Homo sapiens
ttaaaagtgtatttgtta

SEQ ID NO: 5330630 - DNA, 15 bp, Homo sapiens
ttaaaagttgcattt

SEQ ID NO: 5330631 - DNA, 16 bp, Homo sapiens
ttaaaagtttcaatgt

SEQ ID NO: 5330632 - DNA, 18 bp, Homo sapiens
ttaaaagttttgttcttt

SEQ ID NO: 5330633 - DNA, 12 bp, Homo sapiens
ttaaaataaaaa

SEQ ID NO: 5330634 - DNA, 17 bp, Homo sapiens
ttaaaataaaacaagcc

SEQ ID NO: 5330635 - DNA, 21 bp, Homo sapiens
ttaaaataaaacgttatctca

SEQ ID NO: 5330636 - DNA, 13 bp, Homo sapiens
ttaaaataaaagt

SEQ ID NO: 5330637 - DNA, 19 bp, Homo sapiens
ttaaaataaacagttgtga

SEQ ID NO: 5330638 - DNA, 20 bp, Homo sapiens
ttaaaataaacagttgtgaa

SEQ ID NO: 5330639 - DNA, 14 bp, Homo sapiens
ttaaaataaactgt

SEQ ID NO: 5330640 - DNA, 17 bp, Homo sapiens
ttaaaataaactgtaaa

SEQ ID NO: 5330641 - DNA, 13 bp, Homo sapiens
ttaaaataaactt

SEQ ID NO: 5330642 - DNA, 14 bp, Homo sapiens
ttaaaataaatatt

SEQ ID NO: 5330643 - DNA, 14 bp, Homo sapiens
ttaaaataaatggt

SEQ ID NO: 5330644 - DNA, 22 bp, Homo sapiens
ttaaaataattatatgaagcag

SEQ ID NO: 5330645 - DNA, 15 bp, Homo sapiens
ttaaaataattcata

SEQ ID NO: 5330646 - DNA, 16 bp, Homo sapiens
ttaaaataattcatat

SEQ ID NO: 5330647 - DNA, 20 bp, Homo sapiens
ttaaaataattcatatctaa

SEQ ID NO: 5330648 - DNA, 20 bp, Homo sapiens
ttaaaatacataacttcagt

SEQ ID NO: 5330649 - DNA, 14 bp, Homo sapiens
ttaaaatacatttt

SEQ ID NO: 5330650 - DNA, 17 bp, Homo sapiens
ttaaaataccactgtaa

SEQ ID NO: 5330651 - DNA, 18 bp, Homo sapiens
ttaaaataccactgtaat

SEQ ID NO: 5330652 - DNA, 21 bp, Homo sapiens
ttaaaataccagccagtaaat

SEQ ID NO: 5330653 - DNA, 17 bp, Homo sapiens
ttaaaatactgtagata

SEQ ID NO: 5330654 - DNA, 21 bp, Homo sapiens
ttaaaatagaaattttgtaag

SEQ ID NO: 5330655 - DNA, 22 bp, Homo sapiens
ttaaaatagcaacactctatat

SEQ ID NO: 5330656 - DNA, 14 bp, Homo sapiens
ttaaaatagcatac

SEQ ID NO: 5330657 - DNA, 18 bp, Homo sapiens
ttaaaatagcatactgtg

SEQ ID NO: 5330658 - DNA, 21 bp, Homo sapiens
ttaaaatagcgttcttgtaat

SEQ ID NO: 5330659 - DNA, 22 bp, Homo sapiens
ttaaaatagcgttcttgtaatt

SEQ ID NO: 5330660 - DNA, 23 bp, Homo sapiens
ttaaaatagcgttcttgtaattt

SEQ ID NO: 5330661 - DNA, 16 bp, Homo sapiens
ttaaaatagttttcta

SEQ ID NO: 5330662 - DNA, 13 bp, Homo sapiens
ttaaaatataaat

SEQ ID NO: 5330663 - DNA, 16 bp, Homo sapiens
ttaaaatataaattaa

SEQ ID NO: 5330664 - DNA, 23 bp, Homo sapiens
ttaaaatatacttaaaaattaat

SEQ ID NO: 5330665 - DNA, 16 bp, Homo sapiens
ttaaaatatagagaca

SEQ ID NO: 5330666 - DNA, 15 bp, Homo sapiens
ttaaaatatagtgtt

SEQ ID NO: 5330667 - DNA, 11 bp, Homo sapiens
ttaaaatatat

SEQ ID NO: 5330668 - DNA, 13 bp, Homo sapiens
ttaaaatatatgt

SEQ ID NO: 5330669 - DNA, 14 bp, Homo sapiens
ttaaaatatatgta

SEQ ID NO: 5330670 - DNA, 16 bp, Homo sapiens
ttaaaatatatgttct

SEQ ID NO: 5330671 - DNA, 18 bp, Homo sapiens
ttaaaatatatgttctgc

SEQ ID NO: 5330672 - DNA, 13 bp, Homo sapiens
ttaaaatatcttt

SEQ ID NO: 5330673 - DNA, 15 bp, Homo sapiens
ttaaaatatgaaggt

SEQ ID NO: 5330674 - DNA, 19 bp, Homo sapiens
ttaaaatatgcactaagtc

SEQ ID NO: 5330675 - DNA, 14 bp, Homo sapiens
ttaaaatatgtgaa

SEQ ID NO: 5330676 - DNA, 19 bp, Homo sapiens
ttaaaatatttaacttttt

SEQ ID NO: 5330677 - DNA, 17 bp, Homo sapiens
ttaaaatatttatttat

SEQ ID NO: 5330678 - DNA, 18 bp, Homo sapiens
ttaaaatatttgaatgaa

SEQ ID NO: 5330679 - DNA, 14 bp, Homo sapiens
ttaaaatatttgcc

SEQ ID NO: 5330680 - DNA, 15 bp, Homo sapiens
ttaaaatatttgcct

SEQ ID NO: 5330681 - DNA, 16 bp, Homo sapiens
ttaaaatcaaatgtaa

SEQ ID NO: 5330682 - DNA, 15 bp, Homo sapiens
ttaaaatcacatttt

SEQ ID NO: 5330683 - DNA, 20 bp, Homo sapiens
ttaaaatcacattttaagtg

SEQ ID NO: 5330684 - DNA, 18 bp, Homo sapiens
ttaaaatcagactcttta

SEQ ID NO: 5330685 - DNA, 20 bp, Homo sapiens
ttaaaatcataacattgatt

SEQ ID NO: 5330686 - DNA, 23 bp, Homo sapiens
ttaaaatcatatttacctgtgaa

SEQ ID NO: 5330687 - DNA, 14 bp, Homo sapiens
ttaaaatcatttct

SEQ ID NO: 5330688 - DNA, 22 bp, Homo sapiens
ttaaaatcatttctgcatcagc

SEQ ID NO: 5330689 - DNA, 13 bp, Homo sapiens
ttaaaatcctcaa

SEQ ID NO: 5330690 - DNA, 23 bp, Homo sapiens
ttaaaatctattctgtgttgcat

SEQ ID NO: 5330691 - DNA, 18 bp, Homo sapiens
ttaaaatctgatttaatg

SEQ ID NO: 5330692 - DNA, 21 bp, Homo sapiens
ttaaaatctggaaatctgttt

SEQ ID NO: 5330693 - DNA, 16 bp, Homo sapiens
ttaaaatcttattaaa

SEQ ID NO: 5330694 - DNA, 19 bp, Homo sapiens
ttaaaatcttattaaagtt

SEQ ID NO: 5330695 - DNA, 20 bp, Homo sapiens
ttaaaatcttattaaagttt

SEQ ID NO: 5330696 - DNA, 13 bp, Homo sapiens
ttaaaatcttgaa

SEQ ID NO: 5330697 - DNA, 17 bp, Homo sapiens
ttaaaatctttctttgg

SEQ ID NO: 5330698 - DNA, 14 bp, Homo sapiens
ttaaaatgaagcaa

SEQ ID NO: 5330699 - DNA, 17 bp, Homo sapiens
ttaaaatgaataattta

SEQ ID NO: 5330700 - DNA, 12 bp, Homo sapiens
ttaaaatgacaa

SEQ ID NO: 5330701 - DNA, 19 bp, Homo sapiens
ttaaaatgagaaatctaaa

SEQ ID NO: 5330702 - DNA, 23 bp, Homo sapiens
ttaaaatgattcacttttattgt

SEQ ID NO: 5330703 - DNA, 18 bp, Homo sapiens
ttaaaatgattctctacc

SEQ ID NO: 5330704 - DNA, 16 bp, Homo sapiens
ttaaaatgattgtaaa

SEQ ID NO: 5330705 - DNA, 18 bp, Homo sapiens
ttaaaatgattgtaaaat

SEQ ID NO: 5330706 - DNA, 16 bp, Homo sapiens
ttaaaatgcaacatgt

SEQ ID NO: 5330707 - DNA, 19 bp, Homo sapiens
ttaaaatgcaggtgaactt

SEQ ID NO: 5330708 - DNA, 21 bp, Homo sapiens
ttaaaatgcatgattgcagaa

SEQ ID NO: 5330709 - DNA, 13 bp, Homo sapiens
ttaaaatgcgaaa

SEQ ID NO: 5330710 - DNA, 21 bp, Homo sapiens
ttaaaatggtttgtcctgatg

SEQ ID NO: 5330711 - DNA, 17 bp, Homo sapiens
ttaaaatgtaagattat

SEQ ID NO: 5330712 - DNA, 14 bp, Homo sapiens
ttaaaatgtacatg

SEQ ID NO: 5330713 - DNA, 17 bp, Homo sapiens
ttaaaatgtacatgtat

SEQ ID NO: 5330714 - DNA, 17 bp, Homo sapiens
ttaaaatgtagaagaaa

SEQ ID NO: 5330715 - DNA, 21 bp, Homo sapiens
ttaaaatgtagaagaaagcaa

SEQ ID NO: 5330716 - DNA, 17 bp, Homo sapiens
ttaaaatgtatgcatgt

SEQ ID NO: 5330717 - DNA, 22 bp, Homo sapiens
ttaaaatgtgatttttcttcag

SEQ ID NO: 5330718 - DNA, 17 bp, Homo sapiens
ttaaaatgtgcagtaat

SEQ ID NO: 5330719 - DNA, 14 bp, Homo sapiens
ttaaaatgtgtaca

SEQ ID NO: 5330720 - DNA, 22 bp, Homo sapiens
ttaaaatgttacttattttaaa

SEQ ID NO: 5330721 - DNA, 20 bp, Homo sapiens
ttaaaatgtttactgtaaat

SEQ ID NO: 5330722 - DNA, 17 bp, Homo sapiens
ttaaaatgtttaggaaa

SEQ ID NO: 5330723 - DNA, 21 bp, Homo sapiens
ttaaaatgtttaggaaattta

SEQ ID NO: 5330724 - DNA, 17 bp, Homo sapiens
ttaaaatgtttgagcac

SEQ ID NO: 5330725 - DNA, 22 bp, Homo sapiens
ttaaaattaaagtatacatttt

SEQ ID NO: 5330726 - DNA, 18 bp, Homo sapiens
ttaaaattaaataaattt

SEQ ID NO: 5330727 - DNA, 16 bp, Homo sapiens
ttaaaattaagtagaa

SEQ ID NO: 5330728 - DNA, 19 bp, Homo sapiens
ttaaaattaagtagaacaa

SEQ ID NO: 5330729 - DNA, 14 bp, Homo sapiens
ttaaaattacagat

SEQ ID NO: 5330730 - DNA, 20 bp, Homo sapiens
ttaaaattacagatgtgaaa

SEQ ID NO: 5330731 - DNA, 17 bp, Homo sapiens
ttaaaattagtgagatt

SEQ ID NO: 5330732 - DNA, 19 bp, Homo sapiens
ttaaaattatatagctgct

SEQ ID NO: 5330733 - DNA, 20 bp, Homo sapiens
ttaaaattatgaatctgatt

SEQ ID NO: 5330734 - DNA, 22 bp, Homo sapiens
ttaaaattatgaatctgatttt

SEQ ID NO: 5330735 - DNA, 20 bp, Homo sapiens
ttaaaattcaagaaaataaa

SEQ ID NO: 5330736 - DNA, 21 bp, Homo sapiens
ttaaaattcagtttttgtatc

SEQ ID NO: 5330737 - DNA, 15 bp, Homo sapiens
ttaaaattctgaatt

SEQ ID NO: 5330738 - DNA, 15 bp, Homo sapiens
ttaaaattgctatgt

SEQ ID NO: 5330739 - DNA, 20 bp, Homo sapiens
ttaaaattggtatatttgaa

SEQ ID NO: 5330740 - DNA, 21 bp, Homo sapiens
ttaaaattggtatatttgaaa

SEQ ID NO: 5330741 - DNA, 15 bp, Homo sapiens
ttaaaattggttaat

SEQ ID NO: 5330742 - DNA, 13 bp, Homo sapiens
ttaaaattgtgat

SEQ ID NO: 5330743 - DNA, 16 bp, Homo sapiens
ttaaaattgtgttctt

SEQ ID NO: 5330744 - DNA, 17 bp, Homo sapiens
ttaaaattgttaatatg

SEQ ID NO: 5330745 - DNA, 17 bp, Homo sapiens
ttaaaatttaacatctg

SEQ ID NO: 5330746 - DNA, 19 bp, Homo sapiens
ttaaaatttatcttaagtt

SEQ ID NO: 5330747 - DNA, 13 bp, Homo sapiens
ttaaaatttcata

SEQ ID NO: 5330748 - DNA, 18 bp, Homo sapiens
ttaaaatttcgttgtcca

SEQ ID NO: 5330749 - DNA, 22 bp, Homo sapiens
ttaaaatttcttagaaaacaat

SEQ ID NO: 5330750 - DNA, 18 bp, Homo sapiens
ttaaaatttgtcttaaaa

SEQ ID NO: 5330751 - DNA, 12 bp, Homo sapiens
ttaaaatttgtt

SEQ ID NO: 5330752 - DNA, 12 bp, Homo sapiens
ttaaaattttaa

SEQ ID NO: 5330753 - DNA, 19 bp, Homo sapiens
ttaaaattttaatttctac

SEQ ID NO: 5330754 - DNA, 19 bp, Homo sapiens
ttaaaattttacttttgtt

SEQ ID NO: 5330755 - DNA, 23 bp, Homo sapiens
ttaaaattttggaatatttgctt

SEQ ID NO: 5330756 - DNA, 23 bp, Homo sapiens
ttaaaattttttgagtgaagttt

SEQ ID NO: 5330757 - DNA, 15 bp, Homo sapiens
ttaaacaaaaaacta

SEQ ID NO: 5330758 - DNA, 17 bp, Homo sapiens
ttaaacaaaaaactatc

SEQ ID NO: 5330759 - DNA, 13 bp, Homo sapiens
ttaaacaaaatgt

SEQ ID NO: 5330760 - DNA, 14 bp, Homo sapiens
ttaaacaaaattta

SEQ ID NO: 5330761 - DNA, 19 bp, Homo sapiens
ttaaacaaaatttcacagt

SEQ ID NO: 5330762 - DNA, 12 bp, Homo sapiens
ttaaacaaacca

SEQ ID NO: 5330763 - DNA, 15 bp, Homo sapiens
ttaaacaaagcagta

SEQ ID NO: 5330764 - DNA, 22 bp, Homo sapiens
ttaaacaaagcagtatataata

SEQ ID NO: 5330765 - DNA, 15 bp, Homo sapiens
ttaaacaaatatgaa

SEQ ID NO: 5330766 - DNA, 18 bp, Homo sapiens
ttaaacaaatatgaaaaa

SEQ ID NO: 5330767 - DNA, 15 bp, Homo sapiens
ttaaacaaatgagta

SEQ ID NO: 5330768 - DNA, 15 bp, Homo sapiens
ttaaacaaatgattt

SEQ ID NO: 5330769 - DNA, 22 bp, Homo sapiens
ttaaacaaatgtatgattacat

SEQ ID NO: 5330770 - DNA, 21 bp, Homo sapiens
ttaaacaacacctcctcctgc

SEQ ID NO: 5330771 - DNA, 23 bp, Homo sapiens
ttaaacaacgatttctccattaa

SEQ ID NO: 5330772 - DNA, 13 bp, Homo sapiens
ttaaacaagtatt

SEQ ID NO: 5330773 - DNA, 21 bp, Homo sapiens
ttaaacaagtcaattctgtgt

SEQ ID NO: 5330774 - DNA, 16 bp, Homo sapiens
ttaaacaataaagcaa

SEQ ID NO: 5330775 - DNA, 14 bp, Homo sapiens
ttaaacaattttgt

SEQ ID NO: 5330776 - DNA, 11 bp, Homo sapiens
ttaaacacctg

SEQ ID NO: 5330777 - DNA, 17 bp, Homo sapiens
ttaaacacctgacacat

SEQ ID NO: 5330778 - DNA, 18 bp, Homo sapiens
ttaaacacctgacacatc

SEQ ID NO: 5330779 - DNA, 14 bp, Homo sapiens
ttaaacactacaca

SEQ ID NO: 5330780 - DNA, 14 bp, Homo sapiens
ttaaacactgtaat

SEQ ID NO: 5330781 - DNA, 16 bp, Homo sapiens
ttaaacactgtaatct

SEQ ID NO: 5330782 - DNA, 21 bp, Homo sapiens
ttaaacacttatcttctggat

SEQ ID NO: 5330783 - DNA, 17 bp, Homo sapiens
ttaaacagactttagct

SEQ ID NO: 5330784 - DNA, 16 bp, Homo sapiens
ttaaacagatgtccat

SEQ ID NO: 5330785 - DNA, 22 bp, Homo sapiens
ttaaacagcaaagccatattct

SEQ ID NO: 5330786 - DNA, 12 bp, Homo sapiens
ttaaacagcagt

SEQ ID NO: 5330787 - DNA, 19 bp, Homo sapiens
ttaaacagcctattcctga

SEQ ID NO: 5330788 - DNA, 23 bp, Homo sapiens
ttaaacagtagttgtattcttct

SEQ ID NO: 5330789 - DNA, 19 bp, Homo sapiens
ttaaacagtatttcattgc

SEQ ID NO: 5330790 - DNA, 18 bp, Homo sapiens
ttaaacagttgcacagca

SEQ ID NO: 5330791 - DNA, 13 bp, Homo sapiens
ttaaacataataa

SEQ ID NO: 5330792 - DNA, 21 bp, Homo sapiens
ttaaacatctagcagtaaata

SEQ ID NO: 5330793 - DNA, 19 bp, Homo sapiens
ttaaacatgaatttaatgt

SEQ ID NO: 5330794 - DNA, 12 bp, Homo sapiens
ttaaatcaaaag

SEQ ID NO: 5330795 - DNA, 17 bp, Homo sapiens
ttaaatcaaaagctgct

SEQ ID NO: 5330796 - DNA, 19 bp, Homo sapiens
ttaaatcaaaagctgcttg

SEQ ID NO: 5330797 - DNA, 14 bp, Homo sapiens
ttaaatcaaggaaa

SEQ ID NO: 5330798 - DNA, 20 bp, Homo sapiens
ttaaatcaaggaaaggctca

SEQ ID NO: 5330799 - DNA, 22 bp, Homo sapiens
ttaaatcacagcccaaaatttg

SEQ ID NO: 5330800 - DNA, 14 bp, Homo sapiens
ttaaatcagaataa

SEQ ID NO: 5330801 - DNA, 19 bp, Homo sapiens
ttaaatcagatttgtaatg

SEQ ID NO: 5330802 - DNA, 22 bp, Homo sapiens
ttaaatcagttttgtgtacagt

SEQ ID NO: 5330803 - DNA, 22 bp, Homo sapiens
ttaaatcatactcctatgcttt

SEQ ID NO: 5330804 - DNA, 12 bp, Homo sapiens
ttaaatcatgta

SEQ ID NO: 5330805 - DNA, 20 bp, Homo sapiens
ttaaatcatgtatgttatga

SEQ ID NO: 5330806 - DNA, 13 bp, Homo sapiens
ttaaatcatttca

SEQ ID NO: 5330807 - DNA, 12 bp, Homo sapiens
ttaaatcatttg

SEQ ID NO: 5330808 - DNA, 22 bp, Homo sapiens
ttaaatcatttggttaaatcat

SEQ ID NO: 5330809 - DNA, 20 bp, Homo sapiens
ttaaatcattttaggaaagg

SEQ ID NO: 5330810 - DNA, 15 bp, Homo sapiens
ttaaatcattttcat

SEQ ID NO: 5330811 - DNA, 21 bp, Homo sapiens
ttaaatccagtggggaaaaaa

SEQ ID NO: 5330812 - DNA, 20 bp, Homo sapiens
ttaaatcccattcataactt

SEQ ID NO: 5330813 - DNA, 18 bp, Homo sapiens
ttaaatcctgttgaaaag

SEQ ID NO: 5330814 - DNA, 18 bp, Homo sapiens
ttaaatcctttgcttcat

SEQ ID NO: 5330815 - DNA, 13 bp, Homo sapiens
ttaaatcctttta

SEQ ID NO: 5330816 - DNA, 19 bp, Homo sapiens
ttaaatcgccttgaacaaa

SEQ ID NO: 5330817 - DNA, 21 bp, Homo sapiens
ttaaatcgtttaatgtttata

SEQ ID NO: 5330818 - DNA, 12 bp, Homo sapiens
ttaaatctcaaa

SEQ ID NO: 5330819 - DNA, 12 bp, Homo sapiens
ttaaatctctta

SEQ ID NO: 5330820 - DNA, 15 bp, Homo sapiens
ttaaatctgctttag

SEQ ID NO: 5330821 - DNA, 20 bp, Homo sapiens
ttaaatctgctttagtttca

SEQ ID NO: 5330822 - DNA, 14 bp, Homo sapiens
ttaaatctgtgatg

SEQ ID NO: 5330823 - DNA, 16 bp, Homo sapiens
ttaaatctgtgatgat

SEQ ID NO: 5330824 - DNA, 16 bp, Homo sapiens
ttaaatcttaaacaat

SEQ ID NO: 5330825 - DNA, 22 bp, Homo sapiens
ttaaatcttaaacaatgtataa

SEQ ID NO: 5330826 - DNA, 22 bp, Homo sapiens
ttaaatcttcaatatgaaggac

SEQ ID NO: 5330827 - DNA, 16 bp, Homo sapiens
ttaaatctttgttaaa

SEQ ID NO: 5330828 - DNA, 17 bp, Homo sapiens
ttaaatcttttcttcaa

SEQ ID NO: 5330829 - DNA, 19 bp, Homo sapiens
ttaaatgaaaatgtaactt

SEQ ID NO: 5330830 - DNA, 11 bp, Homo sapiens
ttaaatgaaag

SEQ ID NO: 5330831 - DNA, 15 bp, Homo sapiens
ttaaatgaaagcatg

SEQ ID NO: 5330832 - DNA, 15 bp, Homo sapiens
ttaaatgaaatactt

SEQ ID NO: 5330833 - DNA, 15 bp, Homo sapiens
ttaaatgaactactg

SEQ ID NO: 5330834 - DNA, 21 bp, Homo sapiens
ttaaatgaatattttgataat

SEQ ID NO: 5330835 - DNA, 22 bp, Homo sapiens
ttaaatgacactcatataatta

SEQ ID NO: 5330836 - DNA, 16 bp, Homo sapiens
ttaaatgacagtaata

SEQ ID NO: 5330837 - DNA, 14 bp, Homo sapiens
ttaaatgacagtga

SEQ ID NO: 5330838 - DNA, 11 bp, Homo sapiens
ttaaatgactc

SEQ ID NO: 5330839 - DNA, 20 bp, Homo sapiens
ttaaatgacttgattgtact

SEQ ID NO: 5330840 - DNA, 17 bp, Homo sapiens
ttaaatgatctgtacta

SEQ ID NO: 5330841 - DNA, 14 bp, Homo sapiens
ttaaatgatgtaca

SEQ ID NO: 5330842 - DNA, 21 bp, Homo sapiens
ttaaatgatgtacaggcagat

SEQ ID NO: 5330843 - DNA, 15 bp, Homo sapiens
ttaaatgattccaaa

SEQ ID NO: 5330844 - DNA, 17 bp, Homo sapiens
ttaaatgattccaaata

SEQ ID NO: 5330845 - DNA, 16 bp, Homo sapiens
ttaaatgattgagagt

SEQ ID NO: 5330846 - DNA, 16 bp, Homo sapiens
ttaaatgatttaaatt

SEQ ID NO: 5330847 - DNA, 13 bp, Homo sapiens
ttaaatgcaaaaa

SEQ ID NO: 5330848 - DNA, 17 bp, Homo sapiens
ttaaatgcaaattaaag

SEQ ID NO: 5330849 - DNA, 16 bp, Homo sapiens
ttaaatgcaataattt

SEQ ID NO: 5330850 - DNA, 17 bp, Homo sapiens
ttaaatgcaataatttt

SEQ ID NO: 5330851 - DNA, 19 bp, Homo sapiens
ttaaatgcaataattttac

SEQ ID NO: 5330852 - DNA, 11 bp, Homo sapiens
ttaaatgcacc

SEQ ID NO: 5330853 - DNA, 17 bp, Homo sapiens
ttaaatgcacctggaat

SEQ ID NO: 5330854 - DNA, 16 bp, Homo sapiens
ttaaatgcatcaatat

SEQ ID NO: 5330855 - DNA, 16 bp, Homo sapiens
ttaaatgcatgtctta

SEQ ID NO: 5330856 - DNA, 21 bp, Homo sapiens
ttaaatgccaaaatgtactta

SEQ ID NO: 5330857 - DNA, 22 bp, Homo sapiens
ttaaatgccaaaatgtacttaa

SEQ ID NO: 5330858 - DNA, 14 bp, Homo sapiens
ttaaatgcccagcc

SEQ ID NO: 5330859 - DNA, 15 bp, Homo sapiens
ttaaatgcccagccc

SEQ ID NO: 5330860 - DNA, 20 bp, Homo sapiens
ttaaatgccctttgatgttt

SEQ ID NO: 5330861 - DNA, 16 bp, Homo sapiens
ttaaatgccttggttt

SEQ ID NO: 5330862 - DNA, 18 bp, Homo sapiens
ttaaatgccttgtataaa

SEQ ID NO: 5330863 - DNA, 20 bp, Homo sapiens
ttaaatgccttgtataaaat

SEQ ID NO: 5330864 - DNA, 16 bp, Homo sapiens
ttaaatgctactgaaa

SEQ ID NO: 5330865 - DNA, 20 bp, Homo sapiens
ttaaatgctcattttctggt

SEQ ID NO: 5330866 - DNA, 12 bp, Homo sapiens
ttaaatgctgtg

SEQ ID NO: 5330867 - DNA, 16 bp, Homo sapiens
ttaaatgcttcatttg

SEQ ID NO: 5330868 - DNA, 13 bp, Homo sapiens
ttaaatggacaga

SEQ ID NO: 5330869 - DNA, 11 bp, Homo sapiens
ttaaatggcac

SEQ ID NO: 5330870 - DNA, 18 bp, Homo sapiens
ttaaatggcacctgtata

SEQ ID NO: 5330871 - DNA, 21 bp, Homo sapiens
ttaaatggcagtatttcattt

SEQ ID NO: 5330872 - DNA, 22 bp, Homo sapiens
ttaaatggcatgacaaggtgtg

SEQ ID NO: 5330873 - DNA, 17 bp, Homo sapiens
ttaaatgtaaagatatt

SEQ ID NO: 5330874 - DNA, 14 bp, Homo sapiens
ttaaatgtaactta

SEQ ID NO: 5330875 - DNA, 15 bp, Homo sapiens
ttaaatgtagaaagt

SEQ ID NO: 5330876 - DNA, 20 bp, Homo sapiens
ttaaatgtagacagatattt

SEQ ID NO: 5330877 - DNA, 19 bp, Homo sapiens
ttaaatgtagcttcagtca

SEQ ID NO: 5330878 - DNA, 22 bp, Homo sapiens
ttaaatgtagcttcagtcatta

SEQ ID NO: 5330879 - DNA, 12 bp, Homo sapiens
ttaaatgtatac

SEQ ID NO: 5330880 - DNA, 17 bp, Homo sapiens
ttaaatgtctaatgtat

SEQ ID NO: 5330881 - DNA, 16 bp, Homo sapiens
ttaaatgtgaattact

SEQ ID NO: 5330882 - DNA, 10 bp, Homo sapiens
ttaaatgtgt

SEQ ID NO: 5330883 - DNA, 20 bp, Homo sapiens
ttaaatgtgtacatgtagtt

SEQ ID NO: 5330884 - DNA, 19 bp, Homo sapiens
ttaaatgtgtatttcttaa

SEQ ID NO: 5330885 - DNA, 20 bp, Homo sapiens
ttaaatgtgtatttcttaag

SEQ ID NO: 5330886 - DNA, 11 bp, Homo sapiens
ttaaatgtgtg

SEQ ID NO: 5330887 - DNA, 12 bp, Homo sapiens
ttaaatgttaat

SEQ ID NO: 5330888 - DNA, 14 bp, Homo sapiens
ttaaatgttatgta

SEQ ID NO: 5330889 - DNA, 23 bp, Homo sapiens
ttaaatgttctaacagatcagaa

SEQ ID NO: 5330890 - DNA, 14 bp, Homo sapiens
ttaaatgttgaaat

SEQ ID NO: 5330891 - DNA, 23 bp, Homo sapiens
ttaaatgtttactatagaccaaa

SEQ ID NO: 5330892 - DNA, 17 bp, Homo sapiens
ttaaatgtttatactgt

SEQ ID NO: 5330893 - DNA, 22 bp, Homo sapiens
ttaaatgtttatattagataac

SEQ ID NO: 5330894 - DNA, 21 bp, Homo sapiens
ttaaatgtttcaaaatagaca

SEQ ID NO: 5330895 - DNA, 12 bp, Homo sapiens
ttaaatgtttga

SEQ ID NO: 5330896 - DNA, 16 bp, Homo sapiens
ttaaatgtttgttgaa

SEQ ID NO: 5330897 - DNA, 13 bp, Homo sapiens
ttaaatgttttca

SEQ ID NO: 5330898 - DNA, 15 bp, Homo sapiens
ttaaatgttttcatt

SEQ ID NO: 5330899 - DNA, 23 bp, Homo sapiens
ttaaatgttttgtaaactttgaa

SEQ ID NO: 5330900 - DNA, 15 bp, Homo sapiens
ttaaattaaagcaaa

SEQ ID NO: 5330901 - DNA, 11 bp, Homo sapiens
ttaaattaata

SEQ ID NO: 5330902 - DNA, 22 bp, Homo sapiens
ttaaattaatatctttctgcac

SEQ ID NO: 5330903 - DNA, 13 bp, Homo sapiens
ttaaattacagaa

SEQ ID NO: 5330904 - DNA, 17 bp, Homo sapiens
ttaaattacatttgtaa

SEQ ID NO: 5330905 - DNA, 14 bp, Homo sapiens
ttaaattagaaaat

SEQ ID NO: 5330906 - DNA, 17 bp, Homo sapiens
ttaaattagaaaatatt

SEQ ID NO: 5330907 - DNA, 14 bp, Homo sapiens
ttaaattagaatga

SEQ ID NO: 5330908 - DNA, 18 bp, Homo sapiens
ttaaattagacttcctgt

SEQ ID NO: 5330909 - DNA, 17 bp, Homo sapiens
ttaaattagtttgtgaa

SEQ ID NO: 5330910 - DNA, 13 bp, Homo sapiens
ttaaattataagg

SEQ ID NO: 5330911 - DNA, 18 bp, Homo sapiens
ttaaattataaggactgc

SEQ ID NO: 5330912 - DNA, 12 bp, Homo sapiens
ttaaattatata

SEQ ID NO: 5330913 - DNA, 22 bp, Homo sapiens
ttaaattatatgatatgcatgt

SEQ ID NO: 5330914 - DNA, 22 bp, Homo sapiens
ttaaattatatttacctttttg

SEQ ID NO: 5330915 - DNA, 20 bp, Homo sapiens
ttaaattatcattgtttgtc

SEQ ID NO: 5330916 - DNA, 15 bp, Homo sapiens
ttaaattatgtttta

SEQ ID NO: 5330917 - DNA, 21 bp, Homo sapiens
ttaaattatgtttttattaag

SEQ ID NO: 5330918 - DNA, 12 bp, Homo sapiens
ttaaattattat

SEQ ID NO: 5330919 - DNA, 20 bp, Homo sapiens
ttaaattattatcttcttaa

SEQ ID NO: 5330920 - DNA, 11 bp, Homo sapiens
ttaaattattg

SEQ ID NO: 5330921 - DNA, 14 bp, Homo sapiens
ttaaattattgctt

SEQ ID NO: 5330922 - DNA, 14 bp, Homo sapiens
ttaaattcagtaat

SEQ ID NO: 5330923 - DNA, 21 bp, Homo sapiens
ttaaattcagtcctaagaaag

SEQ ID NO: 5330924 - DNA, 13 bp, Homo sapiens
ttaaattcatttt

SEQ ID NO: 5330925 - DNA, 18 bp, Homo sapiens
ttaaattctctctaacat

SEQ ID NO: 5330926 - DNA, 16 bp, Homo sapiens
ttaaattcttactctg

SEQ ID NO: 5330927 - DNA, 15 bp, Homo sapiens
ttaaattctttttca

SEQ ID NO: 5330928 - DNA, 16 bp, Homo sapiens
ttaaattgcacgtgca

SEQ ID NO: 5330929 - DNA, 14 bp, Homo sapiens
ttaaattgctcaca

SEQ ID NO: 5330930 - DNA, 17 bp, Homo sapiens
ttaaattggaaagcagg

SEQ ID NO: 5330931 - DNA, 21 bp, Homo sapiens
ttaaattgggcttcaatcact

SEQ ID NO: 5330932 - DNA, 14 bp, Homo sapiens
ttaaattgggttca

SEQ ID NO: 5330933 - DNA, 22 bp, Homo sapiens
ttaaattgggttcatgatgcag

SEQ ID NO: 5330934 - DNA, 16 bp, Homo sapiens
ttaaattgtaaatttt

SEQ ID NO: 5330935 - DNA, 11 bp, Homo sapiens
ttaaattgtca

SEQ ID NO: 5330936 - DNA, 22 bp, Homo sapiens
ttaaattgtcagatcgttcatt

SEQ ID NO: 5330937 - DNA, 15 bp, Homo sapiens
ttaaattgtgtttta

SEQ ID NO: 5330938 - DNA, 19 bp, Homo sapiens
ttaaattgttcctctttgt

SEQ ID NO: 5330939 - DNA, 13 bp, Homo sapiens
ttaaattgtttca

SEQ ID NO: 5330940 - DNA, 17 bp, Homo sapiens
ttaaattgtttcatatc

SEQ ID NO: 5330941 - DNA, 19 bp, Homo sapiens
ttaaattgtttcatatctg

SEQ ID NO: 5330942 - DNA, 23 bp, Homo sapiens
ttaaattgtttcatatctggtca

SEQ ID NO: 5330943 - DNA, 15 bp, Homo sapiens
ttaaatttaatacca

SEQ ID NO: 5330944 - DNA, 14 bp, Homo sapiens
ttaaatttacagaa

SEQ ID NO: 5330945 - DNA, 19 bp, Homo sapiens
ttaaatttaggtaaataaa

SEQ ID NO: 5330946 - DNA, 22 bp, Homo sapiens
ttaaatttaggtaaataaagct

SEQ ID NO: 5330947 - DNA, 23 bp, Homo sapiens
ttaaatttaggtaaataaagctc

SEQ ID NO: 5330948 - DNA, 22 bp, Homo sapiens
ttaaatttcttggtgctttgtc

SEQ ID NO: 5330949 - DNA, 16 bp, Homo sapiens
ttaaatttcttttatt

SEQ ID NO: 5330950 - DNA, 18 bp, Homo sapiens
ttaaatttgggttgcaaa

SEQ ID NO: 5330951 - DNA, 23 bp, Homo sapiens
ttaaatttggtttgttaattctt

SEQ ID NO: 5330952 - DNA, 22 bp, Homo sapiens
ttaaattttaaagcctgaaaat

SEQ ID NO: 5330953 - DNA, 18 bp, Homo sapiens
ttaaattttaagcttgaa

SEQ ID NO: 5330954 - DNA, 15 bp, Homo sapiens
ttaaattttaattta

SEQ ID NO: 5330955 - DNA, 16 bp, Homo sapiens
ttaaattttacatgac

SEQ ID NO: 5330956 - DNA, 16 bp, Homo sapiens
ttaaattttagtacat

SEQ ID NO: 5330957 - DNA, 18 bp, Homo sapiens
ttaaattttagtacattt

SEQ ID NO: 5330958 - DNA, 11 bp, Homo sapiens
ttaaattttat

SEQ ID NO: 5330959 - DNA, 13 bp, Homo sapiens
ttaaattttcacc

SEQ ID NO: 5330960 - DNA, 14 bp, Homo sapiens
ttaaattttcagaa

SEQ ID NO: 5330961 - DNA, 14 bp, Homo sapiens
ttaaattttccatt

SEQ ID NO: 5330962 - DNA, 14 bp, Homo sapiens
ttaaattttctcta

SEQ ID NO: 5330963 - DNA, 20 bp, Homo sapiens
ttaaattttctctaaactgt

SEQ ID NO: 5330964 - DNA, 22 bp, Homo sapiens
ttaaattttctctaaactgttt

SEQ ID NO: 5330965 - DNA, 12 bp, Homo sapiens
ttaaatttttcc

SEQ ID NO: 5330966 - DNA, 19 bp, Homo sapiens
ttaaatttttgtcatttta

SEQ ID NO: 5330967 - DNA, 18 bp, Homo sapiens
ttaaattttttttacatt

SEQ ID NO: 5330968 - DNA, 19 bp, Homo sapiens
ttaaattttttttacattt

SEQ ID NO: 5330969 - DNA, 16 bp, Homo sapiens
ttaacaaaaaatgtaa

SEQ ID NO: 5330970 - DNA, 16 bp, Homo sapiens
ttaacaaaagttccct

SEQ ID NO: 5330971 - DNA, 23 bp, Homo sapiens
ttaacaaacatcactctgctgct

SEQ ID NO: 5330972 - DNA, 19 bp, Homo sapiens
ttaacaaaccctcgtttct

SEQ ID NO: 5330973 - DNA, 19 bp, Homo sapiens
ttaacaaactaaaaatatt

SEQ ID NO: 5330974 - DNA, 16 bp, Homo sapiens
ttaaccttttttgtct

SEQ ID NO: 5330975 - DNA, 14 bp, Homo sapiens
ttaacgatgtccaa

SEQ ID NO: 5330976 - DNA, 17 bp, Homo sapiens
ttaacggctccaggatt

SEQ ID NO: 5330977 - DNA, 16 bp, Homo sapiens
ttaacgtatgtatttc

SEQ ID NO: 5330978 - DNA, 22 bp, Homo sapiens
ttaacgtattagttgccaatat

SEQ ID NO: 5330979 - DNA, 19 bp, Homo sapiens
ttaacgtcacccaaaagca

SEQ ID NO: 5330980 - DNA, 17 bp, Homo sapiens
ttaacgtcatctcaggg

SEQ ID NO: 5330981 - DNA, 20 bp, Homo sapiens
ttaacgtttctcattaaaat

SEQ ID NO: 5330982 - DNA, 20 bp, Homo sapiens
ttaactaaaattgttctctt

SEQ ID NO: 5330983 - DNA, 15 bp, Homo sapiens
ttaactaaagaagag

SEQ ID NO: 5330984 - DNA, 21 bp, Homo sapiens
ttaactaaataaacagatgta

SEQ ID NO: 5330985 - DNA, 13 bp, Homo sapiens
ttaactaaatgat

SEQ ID NO: 5330986 - DNA, 14 bp, Homo sapiens
ttaactaaatgctc

SEQ ID NO: 5330987 - DNA, 23 bp, Homo sapiens
ttaactaatatttgtctgtgtgc

SEQ ID NO: 5330988 - DNA, 17 bp, Homo sapiens
ttaactaatgtaaatat

SEQ ID NO: 5330989 - DNA, 12 bp, Homo sapiens
ttaactaattta

SEQ ID NO: 5330990 - DNA, 17 bp, Homo sapiens
ttaactaatttaaacca

SEQ ID NO: 5330991 - DNA, 15 bp, Homo sapiens
ttaactaatttgaat

SEQ ID NO: 5330992 - DNA, 18 bp, Homo sapiens
ttaactacataaaaatag

SEQ ID NO: 5330993 - DNA, 13 bp, Homo sapiens
ttaactacattta

SEQ ID NO: 5330994 - DNA, 17 bp, Homo sapiens
ttaactactaagaataa

SEQ ID NO: 5330995 - DNA, 18 bp, Homo sapiens
ttaactactgtagaactg

SEQ ID NO: 5330996 - DNA, 14 bp, Homo sapiens
ttaactagaattta

SEQ ID NO: 5330997 - DNA, 15 bp, Homo sapiens
ttaactagaatttat

SEQ ID NO: 5330998 - DNA, 17 bp, Homo sapiens
ttaactataaggtgcct

SEQ ID NO: 5330999 - DNA, 21 bp, Homo sapiens
ttaactatatgtgaaacattt

SEQ ID NO: 5331000 - DNA, 14 bp, Homo sapiens
ttaactatgtacaa

SEQ ID NO: 5331001 - DNA, 15 bp, Homo sapiens
ttaactatgtacaat

SEQ ID NO: 5331002 - DNA, 21 bp, Homo sapiens
ttaactattgcatttatatgt

SEQ ID NO: 5331003 - DNA, 14 bp, Homo sapiens
ttaactatttcaca

SEQ ID NO: 5331004 - DNA, 16 bp, Homo sapiens
ttaactatttcacatg

SEQ ID NO: 5331005 - DNA, 19 bp, Homo sapiens
ttaactattttattttcta

SEQ ID NO: 5331006 - DNA, 18 bp, Homo sapiens
ttaactcaggactccagc

SEQ ID NO: 5331007 - DNA, 23 bp, Homo sapiens
ttaactcccattaccatgtaatg

SEQ ID NO: 5331008 - DNA, 13 bp, Homo sapiens
ttaactccctcca

SEQ ID NO: 5331009 - DNA, 12 bp, Homo sapiens
ttaactctaact

SEQ ID NO: 5331010 - DNA, 13 bp, Homo sapiens
ttaactctactgt

SEQ ID NO: 5331011 - DNA, 19 bp, Homo sapiens
ttaactctctttatgtctg

SEQ ID NO: 5331012 - DNA, 12 bp, Homo sapiens
ttaactctttgc

SEQ ID NO: 5331013 - DNA, 16 bp, Homo sapiens
ttaactgaacaatggc

SEQ ID NO: 5331014 - DNA, 15 bp, Homo sapiens
ttaactgaactgtga

SEQ ID NO: 5331015 - DNA, 11 bp, Homo sapiens
ttaactgaaga

SEQ ID NO: 5331016 - DNA, 21 bp, Homo sapiens
ttaactgaagaaagagaagtc

SEQ ID NO: 5331017 - DNA, 18 bp, Homo sapiens
ttaactgaagatattcca

SEQ ID NO: 5331018 - DNA, 15 bp, Homo sapiens
ttaactgaagcaaat

SEQ ID NO: 5331019 - DNA, 21 bp, Homo sapiens
ttaactgacaagccatcttga

SEQ ID NO: 5331020 - DNA, 15 bp, Homo sapiens
ttaactgacttcact

SEQ ID NO: 5331021 - DNA, 18 bp, Homo sapiens
ttaactgaggagaagctg

SEQ ID NO: 5331022 - DNA, 21 bp, Homo sapiens
ttaactgatttaacacttttt

SEQ ID NO: 5331023 - DNA, 17 bp, Homo sapiens
ttaactgccaatcctta

SEQ ID NO: 5331024 - DNA, 24 bp, Homo sapiens
ttaactgcttcctataattttgat

SEQ ID NO: 5331025 - DNA, 22 bp, Homo sapiens
ttaactggaaggctgctttctc

SEQ ID NO: 5331026 - DNA, 19 bp, Homo sapiens
ttaactggagaccagaaac

SEQ ID NO: 5331027 - DNA, 17 bp, Homo sapiens
ttaactggcatggatta

SEQ ID NO: 5331028 - DNA, 16 bp, Homo sapiens
ttaactggcccagaag

SEQ ID NO: 5331029 - DNA, 23 bp, Homo sapiens
ttaactggtgcactttgtaaatt

SEQ ID NO: 5331030 - DNA, 16 bp, Homo sapiens
ttaactgtaaacttgg

SEQ ID NO: 5331031 - DNA, 21 bp, Homo sapiens
ttaactgtagtgcctcctaat

SEQ ID NO: 5331032 - DNA, 12 bp, Homo sapiens
ttaactgtattt

SEQ ID NO: 5331033 - DNA, 19 bp, Homo sapiens
ttaactgtatttcagtatt

SEQ ID NO: 5331034 - DNA, 17 bp, Homo sapiens
ttaactgtccagtccag

SEQ ID NO: 5331035 - DNA, 15 bp, Homo sapiens
ttaactgtggatatt

SEQ ID NO: 5331036 - DNA, 19 bp, Homo sapiens
ttaactgtgtatgtacata

SEQ ID NO: 5331037 - DNA, 17 bp, Homo sapiens
ttaactgtgtgaagaaa

SEQ ID NO: 5331038 - DNA, 14 bp, Homo sapiens
ttaactgttcagta

SEQ ID NO: 5331039 - DNA, 13 bp, Homo sapiens
ttaacttaaaaag

SEQ ID NO: 5331040 - DNA, 23 bp, Homo sapiens
ttaacttaaattttaagcttgaa

SEQ ID NO: 5331041 - DNA, 18 bp, Homo sapiens
ttaacttaacattctgta

SEQ ID NO: 5331042 - DNA, 13 bp, Homo sapiens
ttaacttaactga

SEQ ID NO: 5331043 - DNA, 16 bp, Homo sapiens
ttaacttaactgaaga

SEQ ID NO: 5331044 - DNA, 23 bp, Homo sapiens
ttaacttaagggttttttagaaa

SEQ ID NO: 5331045 - DNA, 14 bp, Homo sapiens
ttaacttaataatc

SEQ ID NO: 5331046 - DNA, 17 bp, Homo sapiens
ttaacttaataatcaag

SEQ ID NO: 5331047 - DNA, 16 bp, Homo sapiens
ttaacttagctacttt

SEQ ID NO: 5331048 - DNA, 18 bp, Homo sapiens
ttaacttagcttgaagga

SEQ ID NO: 5331049 - DNA, 14 bp, Homo sapiens
ttaacttagttttg

SEQ ID NO: 5331050 - DNA, 20 bp, Homo sapiens
ttaacttagtttttaaaatt

SEQ ID NO: 5331051 - DNA, 16 bp, Homo sapiens
ttaacttattacctca

SEQ ID NO: 5331052 - DNA, 19 bp, Homo sapiens
ttaacttatttatatgaag

SEQ ID NO: 5331053 - DNA, 23 bp, Homo sapiens
ttaacttatttatatgaagcaag

SEQ ID NO: 5331054 - DNA, 22 bp, Homo sapiens
ttaacttcaggtaaaaacttca

SEQ ID NO: 5331055 - DNA, 17 bp, Homo sapiens
ttaacttccactgttaa

SEQ ID NO: 5331056 - DNA, 17 bp, Homo sapiens
ttaacttccactttgta

SEQ ID NO: 5331057 - DNA, 23 bp, Homo sapiens
ttaacttccactttgtataaatt

SEQ ID NO: 5331058 - DNA, 14 bp, Homo sapiens
ttaacttctctgga

SEQ ID NO: 5331059 - DNA, 17 bp, Homo sapiens
ttaacttctgttttacc

SEQ ID NO: 5331060 - DNA, 16 bp, Homo sapiens
ttaacttcttcataat

SEQ ID NO: 5331061 - DNA, 14 bp, Homo sapiens
ttaacttcttgctt

SEQ ID NO: 5331062 - DNA, 21 bp, Homo sapiens
ttaacttgaaaattttttaac

SEQ ID NO: 5331063 - DNA, 17 bp, Homo sapiens
ttaacttgcctccatct

SEQ ID NO: 5331064 - DNA, 19 bp, Homo sapiens
ttaacttgcctccatcttt

SEQ ID NO: 5331065 - DNA, 19 bp, Homo sapiens
ttaacttggtcagagccac

SEQ ID NO: 5331066 - DNA, 19 bp, Homo sapiens
ttaacttggttctcagact

SEQ ID NO: 5331067 - DNA, 16 bp, Homo sapiens
ttaactttaacttttg

SEQ ID NO: 5331068 - DNA, 16 bp, Homo sapiens
ttaactttaagactga

SEQ ID NO: 5331069 - DNA, 16 bp, Homo sapiens
ttaactttaatacagc

SEQ ID NO: 5331070 - DNA, 19 bp, Homo sapiens
ttaactttcaaaagcaaac

SEQ ID NO: 5331071 - DNA, 17 bp, Homo sapiens
ttaactttgcaaaaaga

SEQ ID NO: 5331072 - DNA, 11 bp, Homo sapiens
ttaactttgtt

SEQ ID NO: 5331073 - DNA, 12 bp, Homo sapiens
ttaacttttaat

SEQ ID NO: 5331074 - DNA, 17 bp, Homo sapiens
ttaacttttaatttaaa

SEQ ID NO: 5331075 - DNA, 12 bp, Homo sapiens
ttaacttttata

SEQ ID NO: 5331076 - DNA, 22 bp, Homo sapiens
ttaacttttataaactttacct

SEQ ID NO: 5331077 - DNA, 14 bp, Homo sapiens
ttaacttttctacc

SEQ ID NO: 5331078 - DNA, 20 bp, Homo sapiens
ttaactttttctaagctgtt

SEQ ID NO: 5331079 - DNA, 23 bp, Homo sapiens
ttaactttttgtaggatacttgc

SEQ ID NO: 5331080 - DNA, 21 bp, Homo sapiens
ttaactttttgtttttatttc

SEQ ID NO: 5331081 - DNA, 22 bp, Homo sapiens
ttaactttttttcttctacttt

SEQ ID NO: 5331082 - DNA, 20 bp, Homo sapiens
ttaacttttttttctctctt

SEQ ID NO: 5331083 - DNA, 11 bp, Homo sapiens
ttaagaaaaaa

SEQ ID NO: 5331084 - DNA, 18 bp, Homo sapiens
ttaagaaaaaaagcaaaa

SEQ ID NO: 5331085 - DNA, 17 bp, Homo sapiens
ttaagaaaaaaataatt

SEQ ID NO: 5331086 - DNA, 23 bp, Homo sapiens
ttaagaaaaaaataattttatga

SEQ ID NO: 5331087 - DNA, 17 bp, Homo sapiens
ttaagaaaaacatctgg

SEQ ID NO: 5331088 - DNA, 15 bp, Homo sapiens
ttaagaaaaacatgt

SEQ ID NO: 5331089 - DNA, 17 bp, Homo sapiens
ttaagaaaaacatgtca

SEQ ID NO: 5331090 - DNA, 21 bp, Homo sapiens
ttaagaaaaaggatgcacaga

SEQ ID NO: 5331091 - DNA, 11 bp, Homo sapiens
ttaagaaaaat

SEQ ID NO: 5331092 - DNA, 13 bp, Homo sapiens
ttaagaaaaataa

SEQ ID NO: 5331093 - DNA, 13 bp, Homo sapiens
ttaagaaaacaag

SEQ ID NO: 5331094 - DNA, 13 bp, Homo sapiens
ttaagaaaagcac

SEQ ID NO: 5331095 - DNA, 17 bp, Homo sapiens
ttaagaaaagcactttt

SEQ ID NO: 5331096 - DNA, 15 bp, Homo sapiens
ttaagaaaagtattt

SEQ ID NO: 5331097 - DNA, 21 bp, Homo sapiens
ttaagaaaagtattttgaagt

SEQ ID NO: 5331098 - DNA, 18 bp, Homo sapiens
ttaagaaaatacaataaa

SEQ ID NO: 5331099 - DNA, 19 bp, Homo sapiens
ttaagaaaatacaataaac

SEQ ID NO: 5331100 - DNA, 16 bp, Homo sapiens
ttaagaaaatattcta

SEQ ID NO: 5331101 - DNA, 17 bp, Homo sapiens
ttaagaaaatattctaa

SEQ ID NO: 5331102 - DNA, 11 bp, Homo sapiens
ttaagaaaatc

SEQ ID NO: 5331103 - DNA, 14 bp, Homo sapiens
ttaagaaaatcata

SEQ ID NO: 5331104 - DNA, 13 bp, Homo sapiens
ttaagaaaccttg

SEQ ID NO: 5331105 - DNA, 21 bp, Homo sapiens
ttaagaaaccttgctctcctc

SEQ ID NO: 5331106 - DNA, 9 bp, Homo sapiens
ttaagaaag

SEQ ID NO: 5331107 - DNA, 12 bp, Homo sapiens
ttaagaaagaga

SEQ ID NO: 5331108 - DNA, 22 bp, Homo sapiens
ttaagaaagagaatgaactgtg

SEQ ID NO: 5331109 - DNA, 13 bp, Homo sapiens
ttaagaaagctat

SEQ ID NO: 5331110 - DNA, 16 bp, Homo sapiens
ttaagaaagggaaagc

SEQ ID NO: 5331111 - DNA, 16 bp, Homo sapiens
ttaagaaagtaattta

SEQ ID NO: 5331112 - DNA, 15 bp, Homo sapiens
ttaagaaatgtagtt

SEQ ID NO: 5331113 - DNA, 21 bp, Homo sapiens
ttaagaaatgtagttgatgta

SEQ ID NO: 5331114 - DNA, 16 bp, Homo sapiens
ttaagaacacaaagcg

SEQ ID NO: 5331115 - DNA, 15 bp, Homo sapiens
ttaagaacagaacag

SEQ ID NO: 5331116 - DNA, 13 bp, Homo sapiens
ttaagaacatttt

SEQ ID NO: 5331117 - DNA, 23 bp, Homo sapiens
ttaagaacattttataaaacata

SEQ ID NO: 5331118 - DNA, 16 bp, Homo sapiens
ttaagaactaaaatgt

SEQ ID NO: 5331119 - DNA, 18 bp, Homo sapiens
ttaagaactatatttaat

SEQ ID NO: 5331120 - DNA, 13 bp, Homo sapiens
ttaagaactgctt

SEQ ID NO: 5331121 - DNA, 12 bp, Homo sapiens
ttaagaactgtg

SEQ ID NO: 5331122 - DNA, 13 bp, Homo sapiens
ttaagaactgtgt

SEQ ID NO: 5331123 - DNA, 20 bp, Homo sapiens
ttaagaagactgcattatat

SEQ ID NO: 5331124 - DNA, 18 bp, Homo sapiens
ttaagaagcgaacaaaaa

SEQ ID NO: 5331125 - DNA, 18 bp, Homo sapiens
ttaagaagctgttgtaca

SEQ ID NO: 5331126 - DNA, 21 bp, Homo sapiens
ttaagaagctgttgtacattt

SEQ ID NO: 5331127 - DNA, 12 bp, Homo sapiens
ttaagaaggcaa

SEQ ID NO: 5331128 - DNA, 14 bp, Homo sapiens
ttaagaaggcaaaa

SEQ ID NO: 5331129 - DNA, 18 bp, Homo sapiens
ttaagaaggcaaaaatgt

SEQ ID NO: 5331130 - DNA, 16 bp, Homo sapiens
ttaagaatcttagata

SEQ ID NO: 5331131 - DNA, 14 bp, Homo sapiens
ttaagaatgaacac

SEQ ID NO: 5331132 - DNA, 20 bp, Homo sapiens
ttaagaatgagtttcttaga

SEQ ID NO: 5331133 - DNA, 17 bp, Homo sapiens
ttaagaatggtctcagt

SEQ ID NO: 5331134 - DNA, 14 bp, Homo sapiens
ttaagaattctgta

SEQ ID NO: 5331135 - DNA, 21 bp, Homo sapiens
ttaagaattgaccatctgctt

SEQ ID NO: 5331136 - DNA, 19 bp, Homo sapiens
ttaagaattgagtaatggt

SEQ ID NO: 5331137 - DNA, 14 bp, Homo sapiens
ttaagaatttacca

SEQ ID NO: 5331138 - DNA, 21 bp, Homo sapiens
ttaagaatttaccagaaatat

SEQ ID NO: 5331139 - DNA, 14 bp, Homo sapiens
ttaagaatttcaat

SEQ ID NO: 5331140 - DNA, 13 bp, Homo sapiens
ttaagacaaatgg

SEQ ID NO: 5331141 - DNA, 14 bp, Homo sapiens
ttaagacaaatggg

SEQ ID NO: 5331142 - DNA, 22 bp, Homo sapiens
ttaagacaaatgggactgatgt

SEQ ID NO: 5331143 - DNA, 15 bp, Homo sapiens
ttaagacaccaaata

SEQ ID NO: 5331144 - DNA, 11 bp, Homo sapiens
ttaagacagaa

SEQ ID NO: 5331145 - DNA, 14 bp, Homo sapiens
ttaagacagtgtac

SEQ ID NO: 5331146 - DNA, 20 bp, Homo sapiens
ttaagacagtgtacaaaact

SEQ ID NO: 5331147 - DNA, 15 bp, Homo sapiens
ttaagacataaacaa

SEQ ID NO: 5331148 - DNA, 18 bp, Homo sapiens
ttaagacataaacaaaga

SEQ ID NO: 5331149 - DNA, 15 bp, Homo sapiens
ttaagacattttcat

SEQ ID NO: 5331150 - DNA, 18 bp, Homo sapiens
ttaagacatttttggaag

SEQ ID NO: 5331151 - DNA, 16 bp, Homo sapiens
ttaagaccaaagactt

SEQ ID NO: 5331152 - DNA, 14 bp, Homo sapiens
ttaagaccagcctg

SEQ ID NO: 5331153 - DNA, 15 bp, Homo sapiens
ttaagaccagcctgg

SEQ ID NO: 5331154 - DNA, 21 bp, Homo sapiens
ttaagggcatttaatcaggag

SEQ ID NO: 5331155 - DNA, 15 bp, Homo sapiens
ttaagggcattttaa

SEQ ID NO: 5331156 - DNA, 15 bp, Homo sapiens
ttaagggcctgctgg

SEQ ID NO: 5331157 - DNA, 20 bp, Homo sapiens
ttaaggggaagaatgaaagc

SEQ ID NO: 5331158 - DNA, 18 bp, Homo sapiens
ttaaggggggatgtcttg

SEQ ID NO: 5331159 - DNA, 19 bp, Homo sapiens
ttaagggtggaaaaatgcc

SEQ ID NO: 5331160 - DNA, 16 bp, Homo sapiens
ttaagggttttttaga

SEQ ID NO: 5331161 - DNA, 23 bp, Homo sapiens
ttaagggttttttttttttcctt

SEQ ID NO: 5331162 - DNA, 22 bp, Homo sapiens
ttaaggtacactgtttccatgt

SEQ ID NO: 5331163 - DNA, 23 bp, Homo sapiens
ttaaggtcaaactaattctcaca

SEQ ID NO: 5331164 - DNA, 14 bp, Homo sapiens
ttaaggtcccccga

SEQ ID NO: 5331165 - DNA, 21 bp, Homo sapiens
ttaaggtgaggcctgtctgtg

SEQ ID NO: 5331166 - DNA, 18 bp, Homo sapiens
ttaaggtgatatatttaa

SEQ ID NO: 5331167 - DNA, 9 bp, Homo sapiens
ttaaggtgg

SEQ ID NO: 5331168 - DNA, 14 bp, Homo sapiens
ttaaggtgtagcca

SEQ ID NO: 5331169 - DNA, 16 bp, Homo sapiens
ttaaggtgtttgaaaa

SEQ ID NO: 5331170 - DNA, 22 bp, Homo sapiens
ttaaggttatttatttaaatgt

SEQ ID NO: 5331171 - DNA, 21 bp, Homo sapiens
ttaaggttgaactttgccaaa

SEQ ID NO: 5331172 - DNA, 17 bp, Homo sapiens
ttaaggttgcacacagt

SEQ ID NO: 5331173 - DNA, 15 bp, Homo sapiens
ttaaggtttcaacaa

SEQ ID NO: 5331174 - DNA, 23 bp, Homo sapiens
ttaaggtttcaacaaatttcatt

SEQ ID NO: 5331175 - DNA, 20 bp, Homo sapiens
ttaaggtttgcaaattaaaa

SEQ ID NO: 5331176 - DNA, 14 bp, Homo sapiens
ttaagtaaaaaaga

SEQ ID NO: 5331177 - DNA, 14 bp, Homo sapiens
ttaagtaaaagtct

SEQ ID NO: 5331178 - DNA, 13 bp, Homo sapiens
ttaagtaaactaa

SEQ ID NO: 5331179 - DNA, 13 bp, Homo sapiens
ttaagtaaatgct

SEQ ID NO: 5331180 - DNA, 14 bp, Homo sapiens
ttaagtaacgtgct

SEQ ID NO: 5331181 - DNA, 22 bp, Homo sapiens
ttaagtaacgtgctcactgtgt

SEQ ID NO: 5331182 - DNA, 24 bp, Homo sapiens
ttaagtaacgtgctcactgtgtat

SEQ ID NO: 5331183 - DNA, 17 bp, Homo sapiens
ttaagtaagacttttat

SEQ ID NO: 5331184 - DNA, 15 bp, Homo sapiens
ttaagtaatcttttt

SEQ ID NO: 5331185 - DNA, 12 bp, Homo sapiens
ttaagtaattgc

SEQ ID NO: 5331186 - DNA, 15 bp, Homo sapiens
ttaagtaatttcatg

SEQ ID NO: 5331187 - DNA, 22 bp, Homo sapiens
ttaagtaccaatgggaagcagg

SEQ ID NO: 5331188 - DNA, 20 bp, Homo sapiens
ttaagtagaaaagttgcaga

SEQ ID NO: 5331189 - DNA, 22 bp, Homo sapiens
ttaagtagaaaagttgcagatg

SEQ ID NO: 5331190 - DNA, 19 bp, Homo sapiens
ttaagtagaacaaaaaacc

SEQ ID NO: 5331191 - DNA, 13 bp, Homo sapiens
ttaagtagatttc

SEQ ID NO: 5331192 - DNA, 17 bp, Homo sapiens
ttaagtagtttctccaa

SEQ ID NO: 5331193 - DNA, 14 bp, Homo sapiens
ttaagtatatagta

SEQ ID NO: 5331194 - DNA, 14 bp, Homo sapiens
ttaagtatatcatg

SEQ ID NO: 5331195 - DNA, 17 bp, Homo sapiens
ttaagtatatcatgtaa

SEQ ID NO: 5331196 - DNA, 14 bp, Homo sapiens
ttaagtatatttgt

SEQ ID NO: 5331197 - DNA, 22 bp, Homo sapiens
ttaagtatctgggattattctt

SEQ ID NO: 5331198 - DNA, 23 bp, Homo sapiens
ttaagtatctgggattattcttt

SEQ ID NO: 5331199 - DNA, 18 bp, Homo sapiens
ttaagtatggaatattca

SEQ ID NO: 5331200 - DNA, 15 bp, Homo sapiens
ttaagtattcaagaa

SEQ ID NO: 5331201 - DNA, 21 bp, Homo sapiens
ttaagtattccttggcccagc

SEQ ID NO: 5331202 - DNA, 22 bp, Homo sapiens
ttaagtattccttggcccagca

SEQ ID NO: 5331203 - DNA, 21 bp, Homo sapiens
ttaagtattgcatctgtataa

SEQ ID NO: 5331204 - DNA, 13 bp, Homo sapiens
ttaagtcagaaca

SEQ ID NO: 5331205 - DNA, 17 bp, Homo sapiens
ttaagtcagatttttat

SEQ ID NO: 5331206 - DNA, 21 bp, Homo sapiens
ttaagtcagatttttatttat

SEQ ID NO: 5331207 - DNA, 12 bp, Homo sapiens
ttaagtcataat

SEQ ID NO: 5331208 - DNA, 23 bp, Homo sapiens
ttaagtcatcattacttgggaaa

SEQ ID NO: 5331209 - DNA, 12 bp, Homo sapiens
ttaagtcatcca

SEQ ID NO: 5331210 - DNA, 21 bp, Homo sapiens
ttaagtccaaggagaagaaga

SEQ ID NO: 5331211 - DNA, 14 bp, Homo sapiens
ttaagtccagcttg

SEQ ID NO: 5331212 - DNA, 18 bp, Homo sapiens
ttaagtcccagtatacct

SEQ ID NO: 5331213 - DNA, 23 bp, Homo sapiens
ttaagtcctaaaagttctcaatg

SEQ ID NO: 5331214 - DNA, 21 bp, Homo sapiens
ttaagtcgggaaattctgctg

SEQ ID NO: 5331215 - DNA, 22 bp, Homo sapiens
ttaagtcgggaaattctgctgc

SEQ ID NO: 5331216 - DNA, 15 bp, Homo sapiens
ttaagtctcgaatgt

SEQ ID NO: 5331217 - DNA, 12 bp, Homo sapiens
ttaagtctctga

SEQ ID NO: 5331218 - DNA, 22 bp, Homo sapiens
ttaagtctctgactcttgcctt

SEQ ID NO: 5331219 - DNA, 21 bp, Homo sapiens
ttaagtcttccttaaatgact

SEQ ID NO: 5331220 - DNA, 17 bp, Homo sapiens
ttaagtcttttgtctga

SEQ ID NO: 5331221 - DNA, 20 bp, Homo sapiens
ttaagtgaaagagattactt

SEQ ID NO: 5331222 - DNA, 13 bp, Homo sapiens
ttaagtgaaattt

SEQ ID NO: 5331223 - DNA, 19 bp, Homo sapiens
ttaagtgaaggagaagtct

SEQ ID NO: 5331224 - DNA, 13 bp, Homo sapiens
ttaagtgaatgtc

SEQ ID NO: 5331225 - DNA, 15 bp, Homo sapiens
ttaagtgacacagac

SEQ ID NO: 5331226 - DNA, 19 bp, Homo sapiens
ttaagtgacacagacattt

SEQ ID NO: 5331227 - DNA, 22 bp, Homo sapiens
ttaagtgacacagacattttgt

SEQ ID NO: 5331228 - DNA, 14 bp, Homo sapiens
ttaagtgacataga

SEQ ID NO: 5331229 - DNA, 14 bp, Homo sapiens
ttaagtgagcagaa

SEQ ID NO: 5331230 - DNA, 18 bp, Homo sapiens
ttaagtgagcagaacagg

SEQ ID NO: 5331231 - DNA, 19 bp, Homo sapiens
ttaagtgaggaaatcaaag

SEQ ID NO: 5331232 - DNA, 23 bp, Homo sapiens
ttaagtgaggaaatcaaagtgct

SEQ ID NO: 5331233 - DNA, 19 bp, Homo sapiens
ttaagtgcaacatttctgt

SEQ ID NO: 5331234 - DNA, 16 bp, Homo sapiens
ttaagtgcaattaaca

SEQ ID NO: 5331235 - DNA, 21 bp, Homo sapiens
ttaagtgcacttttttatgaa

SEQ ID NO: 5331236 - DNA, 23 bp, Homo sapiens
ttaagtgcacttttttatgaaga

SEQ ID NO: 5331237 - DNA, 23 bp, Homo sapiens
ttaagtgcatgcattgagctgcc

SEQ ID NO: 5331238 - DNA, 22 bp, Homo sapiens
ttaagtgccacaggttttaagg

SEQ ID NO: 5331239 - DNA, 21 bp, Homo sapiens
ttaagtgccattactactgta

SEQ ID NO: 5331240 - DNA, 15 bp, Homo sapiens
ttaagtgcctgagac

SEQ ID NO: 5331241 - DNA, 15 bp, Homo sapiens
ttaagtgctgcattt

SEQ ID NO: 5331242 - DNA, 15 bp, Homo sapiens
ttaagtgcttacatt

SEQ ID NO: 5331243 - DNA, 20 bp, Homo sapiens
ttaagtgcttggttgaaaag

SEQ ID NO: 5331244 - DNA, 20 bp, Homo sapiens
ttaagtggctgtgattaatt

SEQ ID NO: 5331245 - DNA, 16 bp, Homo sapiens
ttaagtgggcattttg

SEQ ID NO: 5331246 - DNA, 22 bp, Homo sapiens
ttaagtggggtagactgaggga

SEQ ID NO: 5331247 - DNA, 20 bp, Homo sapiens
ttaagtggggttgataacac

SEQ ID NO: 5331248 - DNA, 16 bp, Homo sapiens
ttaagtggttactttg

SEQ ID NO: 5331249 - DNA, 17 bp, Homo sapiens
ttaagtgtaaataatat

SEQ ID NO: 5331250 - DNA, 19 bp, Homo sapiens
ttaagtgtactaattaaca

SEQ ID NO: 5331251 - DNA, 17 bp, Homo sapiens
ttaagtgtgcagccata

SEQ ID NO: 5331252 - DNA, 18 bp, Homo sapiens
ttaagtgtgtgtatactg

SEQ ID NO: 5331253 - DNA, 12 bp, Homo sapiens
ttaagtgttgaa

SEQ ID NO: 5331254 - DNA, 13 bp, Homo sapiens
ttaagtgttgaaa

SEQ ID NO: 5331255 - DNA, 14 bp, Homo sapiens
ttaagttaatgaaa

SEQ ID NO: 5331256 - DNA, 12 bp, Homo sapiens
ttaagttacttc

SEQ ID NO: 5331257 - DNA, 23 bp, Homo sapiens
ttaagttagagaatatatttttg

SEQ ID NO: 5331258 - DNA, 21 bp, Homo sapiens
ttaagttctatgaagagtatt

SEQ ID NO: 5331259 - DNA, 20 bp, Homo sapiens
ttaagttctttgatttgtac

SEQ ID NO: 5331260 - DNA, 18 bp, Homo sapiens
ttaagttggcttctgttt

SEQ ID NO: 5331261 - DNA, 21 bp, Homo sapiens
ttaagttggcttctgtttcta

SEQ ID NO: 5331262 - DNA, 22 bp, Homo sapiens
ttaagttggcttctgtttctag

SEQ ID NO: 5331263 - DNA, 16 bp, Homo sapiens
ttaagttgtaaaatgt

SEQ ID NO: 5331264 - DNA, 12 bp, Homo sapiens
ttaagtttagaa

SEQ ID NO: 5331265 - DNA, 11 bp, Homo sapiens
ttaagtttctc

SEQ ID NO: 5331266 - DNA, 13 bp, Homo sapiens
ttaagtttgcact

SEQ ID NO: 5331267 - DNA, 12 bp, Homo sapiens
ttaagtttgttg

SEQ ID NO: 5331268 - DNA, 18 bp, Homo sapiens
ttaagtttttcactttgg

SEQ ID NO: 5331269 - DNA, 13 bp, Homo sapiens
ttaagtttttcca

SEQ ID NO: 5331270 - DNA, 20 bp, Homo sapiens
ttaataaaaacttcagaaaa

SEQ ID NO: 5331271 - DNA, 16 bp, Homo sapiens
ttaataaaaatacaca

SEQ ID NO: 5331272 - DNA, 12 bp, Homo sapiens
ttaataaaacaa

SEQ ID NO: 5331273 - DNA, 13 bp, Homo sapiens
ttaataaaacaac

SEQ ID NO: 5331274 - DNA, 13 bp, Homo sapiens
ttaataaaacatt

SEQ ID NO: 5331275 - DNA, 23 bp, Homo sapiens
ttaataaaactcactcactgttt

SEQ ID NO: 5331276 - DNA, 20 bp, Homo sapiens
ttaataaaactgcacagtgc

SEQ ID NO: 5331277 - DNA, 23 bp, Homo sapiens
ttaataaaactgcacagtgctgt

SEQ ID NO: 5331278 - DNA, 18 bp, Homo sapiens
ttaataaaactgtgcatc

SEQ ID NO: 5331279 - DNA, 14 bp, Homo sapiens
ttaataaaagaaaa

SEQ ID NO: 5331280 - DNA, 14 bp, Homo sapiens
ttaataaaagaaca

SEQ ID NO: 5331281 - DNA, 17 bp, Homo sapiens
ttaataaacatgtcaca

SEQ ID NO: 5331282 - DNA, 13 bp, Homo sapiens
ttaataaactgca

SEQ ID NO: 5331283 - DNA, 16 bp, Homo sapiens
ttaataaactgcaagt

SEQ ID NO: 5331284 - DNA, 21 bp, Homo sapiens
ttaataaactttgaataaaag

SEQ ID NO: 5331285 - DNA, 23 bp, Homo sapiens
ttaataaagaaatatttacctaa

SEQ ID NO: 5331286 - DNA, 13 bp, Homo sapiens
ttaataaagacag

SEQ ID NO: 5331287 - DNA, 22 bp, Homo sapiens
ttaataaagacgatttgtcagt

SEQ ID NO: 5331288 - DNA, 16 bp, Homo sapiens
ttaataaagatgagtt

SEQ ID NO: 5331289 - DNA, 14 bp, Homo sapiens
ttaataaagatgat

SEQ ID NO: 5331290 - DNA, 13 bp, Homo sapiens
ttaataaagcatt

SEQ ID NO: 5331291 - DNA, 11 bp, Homo sapiens
ttaataaagct

SEQ ID NO: 5331292 - DNA, 16 bp, Homo sapiens
ttaataaagctttata

SEQ ID NO: 5331293 - DNA, 20 bp, Homo sapiens
ttaataaaggccacaggaga

SEQ ID NO: 5331294 - DNA, 13 bp, Homo sapiens
ttaataaaggttt

SEQ ID NO: 5331295 - DNA, 17 bp, Homo sapiens
ttaataaagtagttatt

SEQ ID NO: 5331296 - DNA, 23 bp, Homo sapiens
ttaataaagtatattgaaagttt

SEQ ID NO: 5331297 - DNA, 15 bp, Homo sapiens
ttaataaatatgtaa

SEQ ID NO: 5331298 - DNA, 22 bp, Homo sapiens
ttaataaatatgtaatataaat

SEQ ID NO: 5331299 - DNA, 18 bp, Homo sapiens
ttaataaattatttatta

SEQ ID NO: 5331300 - DNA, 14 bp, Homo sapiens
ttaataaattccat

SEQ ID NO: 5331301 - DNA, 22 bp, Homo sapiens
ttaataaatttaataaatattg

SEQ ID NO: 5331302 - DNA, 20 bp, Homo sapiens
ttaataaattttaacatttt

SEQ ID NO: 5331303 - DNA, 13 bp, Homo sapiens
ttaataacattac

SEQ ID NO: 5331304 - DNA, 16 bp, Homo sapiens
ttaataacattacctt

SEQ ID NO: 5331305 - DNA, 12 bp, Homo sapiens
ttaataactgaa

SEQ ID NO: 5331306 - DNA, 17 bp, Homo sapiens
ttaataactttctctgt

SEQ ID NO: 5331307 - DNA, 21 bp, Homo sapiens
ttaataactttctctgtgaaa

SEQ ID NO: 5331308 - DNA, 21 bp, Homo sapiens
ttaataagagtaaaaatatgt

SEQ ID NO: 5331309 - DNA, 18 bp, Homo sapiens
ttaataagatatttagta

SEQ ID NO: 5331310 - DNA, 20 bp, Homo sapiens
ttaataagatttttcaaaat

SEQ ID NO: 5331311 - DNA, 15 bp, Homo sapiens
ttaataaggaaaaaa

SEQ ID NO: 5331312 - DNA, 19 bp, Homo sapiens
ttaataaggaaaaaataat

SEQ ID NO: 5331313 - DNA, 17 bp, Homo sapiens
ttaataagtatatctta

SEQ ID NO: 5331314 - DNA, 23 bp, Homo sapiens
ttaataataaattccctggcctt

SEQ ID NO: 5331315 - DNA, 12 bp, Homo sapiens
ttaataataatg

SEQ ID NO: 5331316 - DNA, 14 bp, Homo sapiens
ttaataataatgcc

SEQ ID NO: 5331317 - DNA, 18 bp, Homo sapiens
ttaataataattgaagaa

SEQ ID NO: 5331318 - DNA, 19 bp, Homo sapiens
ttaataataattgaagaat

SEQ ID NO: 5331319 - DNA, 21 bp, Homo sapiens
ttaataatatacttgtggact

SEQ ID NO: 5331320 - DNA, 14 bp, Homo sapiens
ttaataatatcaaa

SEQ ID NO: 5331321 - DNA, 12 bp, Homo sapiens
ttaataatatgt

SEQ ID NO: 5331322 - DNA, 19 bp, Homo sapiens
ttaataatatgtacaaata

SEQ ID NO: 5331323 - DNA, 21 bp, Homo sapiens
ttaataatatgtacaaataat

SEQ ID NO: 5331324 - DNA, 13 bp, Homo sapiens
ttaataatattta

SEQ ID NO: 5331325 - DNA, 17 bp, Homo sapiens
ttaataatgtatgtaca

SEQ ID NO: 5331326 - DNA, 21 bp, Homo sapiens
ttaataatgtattgtaatctt

SEQ ID NO: 5331327 - DNA, 15 bp, Homo sapiens
ttaataatgttgcct

SEQ ID NO: 5331328 - DNA, 20 bp, Homo sapiens
ttaataattatatgctattt

SEQ ID NO: 5331329 - DNA, 21 bp, Homo sapiens
ttaataattatgtgccatttt

SEQ ID NO: 5331330 - DNA, 14 bp, Homo sapiens
ttaataatttcatc

SEQ ID NO: 5331331 - DNA, 15 bp, Homo sapiens
ttaatgttgatttct

SEQ ID NO: 5331332 - DNA, 17 bp, Homo sapiens
ttaatgttgatttctag

SEQ ID NO: 5331333 - DNA, 21 bp, Homo sapiens
ttaatgttgatttctagttat

SEQ ID NO: 5331334 - DNA, 22 bp, Homo sapiens
ttaatgttgattttaatcctgt

SEQ ID NO: 5331335 - DNA, 16 bp, Homo sapiens
ttaatgtttatacaga

SEQ ID NO: 5331336 - DNA, 20 bp, Homo sapiens
ttaatgtttattatttacat

SEQ ID NO: 5331337 - DNA, 14 bp, Homo sapiens
ttaatgtttcttaa

SEQ ID NO: 5331338 - DNA, 16 bp, Homo sapiens
ttaatgtttcttaaat

SEQ ID NO: 5331339 - DNA, 16 bp, Homo sapiens
ttaatgtttgtaagca

SEQ ID NO: 5331340 - DNA, 10 bp, Homo sapiens
ttaatgtttt

SEQ ID NO: 5331341 - DNA, 18 bp, Homo sapiens
ttaatgttttaaatgtac

SEQ ID NO: 5331342 - DNA, 15 bp, Homo sapiens
ttaatgttttcatta

SEQ ID NO: 5331343 - DNA, 17 bp, Homo sapiens
ttaatgttttgtacaat

SEQ ID NO: 5331344 - DNA, 13 bp, Homo sapiens
ttaattaaaaact

SEQ ID NO: 5331345 - DNA, 19 bp, Homo sapiens
ttaattaaaaactagtagt

SEQ ID NO: 5331346 - DNA, 15 bp, Homo sapiens
ttaattaaacattgt

SEQ ID NO: 5331347 - DNA, 16 bp, Homo sapiens
ttaattaaacattgtg

SEQ ID NO: 5331348 - DNA, 18 bp, Homo sapiens
ttaattaaagaaaattaa

SEQ ID NO: 5331349 - DNA, 16 bp, Homo sapiens
ttaattaaagccttaa

SEQ ID NO: 5331350 - DNA, 20 bp, Homo sapiens
ttaattaaatagcttttgtg

SEQ ID NO: 5331351 - DNA, 12 bp, Homo sapiens
ttaattaaatat

SEQ ID NO: 5331352 - DNA, 21 bp, Homo sapiens
ttaattaaatttcacaatata

SEQ ID NO: 5331353 - DNA, 13 bp, Homo sapiens
ttaattaacatca

SEQ ID NO: 5331354 - DNA, 17 bp, Homo sapiens
ttaattaacatcaaaca

SEQ ID NO: 5331355 - DNA, 16 bp, Homo sapiens
ttaattaagtaaacta

SEQ ID NO: 5331356 - DNA, 22 bp, Homo sapiens
ttaattaatatgttcattaaat

SEQ ID NO: 5331357 - DNA, 12 bp, Homo sapiens
ttaattacagaa

SEQ ID NO: 5331358 - DNA, 16 bp, Homo sapiens
ttaattacatacagat

SEQ ID NO: 5331359 - DNA, 17 bp, Homo sapiens
ttaattacatacagatt

SEQ ID NO: 5331360 - DNA, 21 bp, Homo sapiens
ttaattactcagcagaatggt

SEQ ID NO: 5331361 - DNA, 16 bp, Homo sapiens
ttaattactgctataa

SEQ ID NO: 5331362 - DNA, 19 bp, Homo sapiens
ttaattactgtgtgtgagc

SEQ ID NO: 5331363 - DNA, 21 bp, Homo sapiens
ttaattacttttgaaaaagga

SEQ ID NO: 5331364 - DNA, 17 bp, Homo sapiens
ttaattagaaacgtgat

SEQ ID NO: 5331365 - DNA, 13 bp, Homo sapiens
ttaattaggttaa

SEQ ID NO: 5331366 - DNA, 18 bp, Homo sapiens
ttaattaggttaactatg

SEQ ID NO: 5331367 - DNA, 21 bp, Homo sapiens
ttaattagtgctaagtgtgaa

SEQ ID NO: 5331368 - DNA, 17 bp, Homo sapiens
ttaattataataaaggt

SEQ ID NO: 5331369 - DNA, 20 bp, Homo sapiens
ttaattatgtgtagttataa

SEQ ID NO: 5331370 - DNA, 14 bp, Homo sapiens
ttaattattatttg

SEQ ID NO: 5331371 - DNA, 13 bp, Homo sapiens
ttaattattgttt

SEQ ID NO: 5331372 - DNA, 13 bp, Homo sapiens
ttaattcaattaa

SEQ ID NO: 5331373 - DNA, 16 bp, Homo sapiens
ttaattcacctcagcc

SEQ ID NO: 5331374 - DNA, 15 bp, Homo sapiens
ttaattcactcccac

SEQ ID NO: 5331375 - DNA, 22 bp, Homo sapiens
ttaattcagcactgatttcaca

SEQ ID NO: 5331376 - DNA, 16 bp, Homo sapiens
ttaattcagctttaga

SEQ ID NO: 5331377 - DNA, 12 bp, Homo sapiens
ttaattcaggtg

SEQ ID NO: 5331378 - DNA, 14 bp, Homo sapiens
ttaattcaggtgat

SEQ ID NO: 5331379 - DNA, 20 bp, Homo sapiens
ttaattcaggttttttagtt

SEQ ID NO: 5331380 - DNA, 15 bp, Homo sapiens
ttaattcagtacaac

SEQ ID NO: 5331381 - DNA, 19 bp, Homo sapiens
ttaattcagtctcagctgc

SEQ ID NO: 5331382 - DNA, 13 bp, Homo sapiens
ttaattcataatt

SEQ ID NO: 5331383 - DNA, 12 bp, Homo sapiens
ttaattcattaa

SEQ ID NO: 5331384 - DNA, 17 bp, Homo sapiens
ttaattcattaatctgt

SEQ ID NO: 5331385 - DNA, 19 bp, Homo sapiens
ttaattcattaatctgttt

SEQ ID NO: 5331386 - DNA, 20 bp, Homo sapiens
ttaattcattaatctgtttg

SEQ ID NO: 5331387 - DNA, 22 bp, Homo sapiens
ttaattccatgaatcgcttctc

SEQ ID NO: 5331388 - DNA, 19 bp, Homo sapiens
ttaattccttcagcacttt

SEQ ID NO: 5331389 - DNA, 13 bp, Homo sapiens
ttaattctaaact

SEQ ID NO: 5331390 - DNA, 22 bp, Homo sapiens
ttaattctaaacttagaaatat

SEQ ID NO: 5331391 - DNA, 14 bp, Homo sapiens
ttaattctactaaa

SEQ ID NO: 5331392 - DNA, 11 bp, Homo sapiens
ttaattctcat

SEQ ID NO: 5331393 - DNA, 17 bp, Homo sapiens
ttaattctcattatgaa

SEQ ID NO: 5331394 - DNA, 21 bp, Homo sapiens
ttaattctcattatgaagatg

SEQ ID NO: 5331395 - DNA, 17 bp, Homo sapiens
ttaattctctttcaaag

SEQ ID NO: 5331396 - DNA, 13 bp, Homo sapiens
ttaattctgtctt

SEQ ID NO: 5331397 - DNA, 16 bp, Homo sapiens
ttaattcttaaaacta

SEQ ID NO: 5331398 - DNA, 21 bp, Homo sapiens
ttaattcttaccgaaatgaaa

SEQ ID NO: 5331399 - DNA, 18 bp, Homo sapiens
ttaattcttacctcattt

SEQ ID NO: 5331400 - DNA, 22 bp, Homo sapiens
ttaattcttcacctttgtaaga

SEQ ID NO: 5331401 - DNA, 13 bp, Homo sapiens
ttaattcttctct

SEQ ID NO: 5331402 - DNA, 13 bp, Homo sapiens
ttaattgaaaaga

SEQ ID NO: 5331403 - DNA, 20 bp, Homo sapiens
ttaattgaaagaatgtaaag

SEQ ID NO: 5331404 - DNA, 18 bp, Homo sapiens
ttaattgaaatacctatt

SEQ ID NO: 5331405 - DNA, 14 bp, Homo sapiens
ttaattgaagaact

SEQ ID NO: 5331406 - DNA, 19 bp, Homo sapiens
ttaattgaagaactgcact

SEQ ID NO: 5331407 - DNA, 15 bp, Homo sapiens
ttaattgaagctttt

SEQ ID NO: 5331408 - DNA, 14 bp, Homo sapiens
ttaattgactgaaa

SEQ ID NO: 5331409 - DNA, 21 bp, Homo sapiens
ttaattgacttatttatataa

SEQ ID NO: 5331410 - DNA, 20 bp, Homo sapiens
ttaattgagaatagaaattt

SEQ ID NO: 5331411 - DNA, 21 bp, Homo sapiens
ttaattgagaatagaaatttg

SEQ ID NO: 5331412 - DNA, 14 bp, Homo sapiens
ttaattgattaaac

SEQ ID NO: 5331413 - DNA, 17 bp, Homo sapiens
ttaattgattaaactgt

SEQ ID NO: 5331414 - DNA, 21 bp, Homo sapiens
ttaattgattaaactgtatgt

SEQ ID NO: 5331415 - DNA, 22 bp, Homo sapiens
ttaattgattaaactgtatgtc

SEQ ID NO: 5331416 - DNA, 10 bp, Homo sapiens
ttaattgcaa

SEQ ID NO: 5331417 - DNA, 19 bp, Homo sapiens
ttaattgcaagtctgccga

SEQ ID NO: 5331418 - DNA, 19 bp, Homo sapiens
ttaattgccacctctaaca

SEQ ID NO: 5331419 - DNA, 15 bp, Homo sapiens
ttaattgcctgttaa

SEQ ID NO: 5331420 - DNA, 19 bp, Homo sapiens
ttaattgcctgttaaatat

SEQ ID NO: 5331421 - DNA, 13 bp, Homo sapiens
ttaattgctgcaa

SEQ ID NO: 5331422 - DNA, 23 bp, Homo sapiens
ttaattgcttataacaagcatat

SEQ ID NO: 5331423 - DNA, 13 bp, Homo sapiens
ttaattgctttaa

SEQ ID NO: 5331424 - DNA, 18 bp, Homo sapiens
ttaattgctttaaatctt

SEQ ID NO: 5331425 - DNA, 13 bp, Homo sapiens
ttaattggaggaa

SEQ ID NO: 5331426 - DNA, 18 bp, Homo sapiens
ttaattgggcactattta

SEQ ID NO: 5331427 - DNA, 18 bp, Homo sapiens
ttaattggttaatcactt

SEQ ID NO: 5331428 - DNA, 12 bp, Homo sapiens
ttaattgtaaac

SEQ ID NO: 5331429 - DNA, 22 bp, Homo sapiens
ttaattgtagttctgtgtactt

SEQ ID NO: 5331430 - DNA, 15 bp, Homo sapiens
ttaattgtcctgtgt

SEQ ID NO: 5331431 - DNA, 16 bp, Homo sapiens
ttaattgtcctgtgtc

SEQ ID NO: 5331432 - DNA, 17 bp, Homo sapiens
ttaattgtcctgtgtct

SEQ ID NO: 5331433 - DNA, 15 bp, Homo sapiens
ttaattgtcttgcac

SEQ ID NO: 5331434 - DNA, 20 bp, Homo sapiens
ttaattgtgaattgataata

SEQ ID NO: 5331435 - DNA, 13 bp, Homo sapiens
ttaattgtgcctg

SEQ ID NO: 5331436 - DNA, 15 bp, Homo sapiens
ttaattgtgtaactg

SEQ ID NO: 5331437 - DNA, 16 bp, Homo sapiens
ttaattgtgtaactgt

SEQ ID NO: 5331438 - DNA, 18 bp, Homo sapiens
ttaattgtgtaactgttc

SEQ ID NO: 5331439 - DNA, 15 bp, Homo sapiens
ttaattgtgtgtctt

SEQ ID NO: 5331440 - DNA, 20 bp, Homo sapiens
ttaattgttccttgctttta

SEQ ID NO: 5331441 - DNA, 18 bp, Homo sapiens
ttaattgttttgcacttt

SEQ ID NO: 5331442 - DNA, 12 bp, Homo sapiens
ttaatttaaact

SEQ ID NO: 5331443 - DNA, 14 bp, Homo sapiens
ttaatttaaagcca

SEQ ID NO: 5331444 - DNA, 16 bp, Homo sapiens
ttaatttaaagcttac

SEQ ID NO: 5331445 - DNA, 12 bp, Homo sapiens
ttaatttaaagt

SEQ ID NO: 5331446 - DNA, 16 bp, Homo sapiens
ttaatttaaatagcat

SEQ ID NO: 5331447 - DNA, 14 bp, Homo sapiens
ttaatttaaatgat

SEQ ID NO: 5331448 - DNA, 16 bp, Homo sapiens
ttaatttaaatgattt

SEQ ID NO: 5331449 - DNA, 18 bp, Homo sapiens
ttaatttaacaaactaaa

SEQ ID NO: 5331450 - DNA, 21 bp, Homo sapiens
ttaatttaactttccagtctt

SEQ ID NO: 5331451 - DNA, 13 bp, Homo sapiens
ttaatttaagttt

SEQ ID NO: 5331452 - DNA, 15 bp, Homo sapiens
ttaatttaattgctt

SEQ ID NO: 5331453 - DNA, 17 bp, Homo sapiens
ttaatttaatttttcct

SEQ ID NO: 5331454 - DNA, 14 bp, Homo sapiens
ttaatttacctgtt

SEQ ID NO: 5331455 - DNA, 12 bp, Homo sapiens
ttaatttagaaa

SEQ ID NO: 5331456 - DNA, 19 bp, Homo sapiens
ttaatttagatattttcca

SEQ ID NO: 5331457 - DNA, 13 bp, Homo sapiens
ttaatttagtaaa

SEQ ID NO: 5331458 - DNA, 19 bp, Homo sapiens
ttaatttagtaaatgttat

SEQ ID NO: 5331459 - DNA, 16 bp, Homo sapiens
ttaatttataatgtat

SEQ ID NO: 5331460 - DNA, 17 bp, Homo sapiens
ttaatttataatgtatt

SEQ ID NO: 5331461 - DNA, 14 bp, Homo sapiens
ttaatttatatgta

SEQ ID NO: 5331462 - DNA, 14 bp, Homo sapiens
ttaatttatatttg

SEQ ID NO: 5331463 - DNA, 16 bp, Homo sapiens
ttaatttatcctctgt

SEQ ID NO: 5331464 - DNA, 15 bp, Homo sapiens
ttaatttatctaaat

SEQ ID NO: 5331465 - DNA, 15 bp, Homo sapiens
ttaatttatctgttg

SEQ ID NO: 5331466 - DNA, 20 bp, Homo sapiens
ttaatttatgagtttttgat

SEQ ID NO: 5331467 - DNA, 14 bp, Homo sapiens
ttaatttatggttt

SEQ ID NO: 5331468 - DNA, 19 bp, Homo sapiens
ttaatttattattgaaatt

SEQ ID NO: 5331469 - DNA, 22 bp, Homo sapiens
ttaatttattttaatgtaaata

SEQ ID NO: 5331470 - DNA, 14 bp, Homo sapiens
ttaatttattttgc

SEQ ID NO: 5331471 - DNA, 14 bp, Homo sapiens
ttaatttcaaatag

SEQ ID NO: 5331472 - DNA, 15 bp, Homo sapiens
ttaatttcaaataga

SEQ ID NO: 5331473 - DNA, 21 bp, Homo sapiens
ttaatttcaaatctgtaatta

SEQ ID NO: 5331474 - DNA, 14 bp, Homo sapiens
ttaatttcaggaaa

SEQ ID NO: 5331475 - DNA, 14 bp, Homo sapiens
ttaatttcagtcct

SEQ ID NO: 5331476 - DNA, 13 bp, Homo sapiens
ttaatttcataaa

SEQ ID NO: 5331477 - DNA, 18 bp, Homo sapiens
ttaatttcataaattggc

SEQ ID NO: 5331478 - DNA, 21 bp, Homo sapiens
ttaatttccaggaaaaaataa

SEQ ID NO: 5331479 - DNA, 14 bp, Homo sapiens
ttaatttcctgtga

SEQ ID NO: 5331480 - DNA, 15 bp, Homo sapiens
ttaatttcctgtgag

SEQ ID NO: 5331481 - DNA, 16 bp, Homo sapiens
ttaatttcctgtgagg

SEQ ID NO: 5331482 - DNA, 22 bp, Homo sapiens
ttaatttccttctgttaagaaa

SEQ ID NO: 5331483 - DNA, 21 bp, Homo sapiens
ttaatttctgcaaatgtaatt

SEQ ID NO: 5331484 - DNA, 21 bp, Homo sapiens
ttaatttctgccatttcatgt

SEQ ID NO: 5331485 - DNA, 14 bp, Homo sapiens
ttaatttcttcaaa

SEQ ID NO: 5331486 - DNA, 23 bp, Homo sapiens
ttaatttcttcaaaatgtatata

SEQ ID NO: 5331487 - DNA, 22 bp, Homo sapiens
ttaatttcttgggaaacttcta

SEQ ID NO: 5331488 - DNA, 13 bp, Homo sapiens
ttaatttgaatca

SEQ ID NO: 5331489 - DNA, 12 bp, Homo sapiens
ttaatttgataa

SEQ ID NO: 5331490 - DNA, 20 bp, Homo sapiens
ttaatttgatatcacagtct

SEQ ID NO: 5331491 - DNA, 18 bp, Homo sapiens
ttaatttgatgaaagctg

SEQ ID NO: 5331492 - DNA, 21 bp, Homo sapiens
ttaatttgattaacaaatatg

SEQ ID NO: 5331493 - DNA, 18 bp, Homo sapiens
ttaatttgcatctgaaat

SEQ ID NO: 5331494 - DNA, 18 bp, Homo sapiens
ttaatttgccaaaataat

SEQ ID NO: 5331495 - DNA, 20 bp, Homo sapiens
ttaatttgccaaaataatgt

SEQ ID NO: 5331496 - DNA, 22 bp, Homo sapiens
ttaatttggagcacaaaattca

SEQ ID NO: 5331497 - DNA, 23 bp, Homo sapiens
ttaatttggtagatgacaaatat

SEQ ID NO: 5331498 - DNA, 12 bp, Homo sapiens
ttaatttgtaaa

SEQ ID NO: 5331499 - DNA, 16 bp, Homo sapiens
ttaatttgtaaaactt

SEQ ID NO: 5331500 - DNA, 18 bp, Homo sapiens
ttaatttgtaaaacttct

SEQ ID NO: 5331501 - DNA, 20 bp, Homo sapiens
ttaatttgtaaaacttctgc

SEQ ID NO: 5331502 - DNA, 22 bp, Homo sapiens
ttaatttgtaaaacttctgctc

SEQ ID NO: 5331503 - DNA, 12 bp, Homo sapiens
ttaatttgtatg

SEQ ID NO: 5331504 - DNA, 17 bp, Homo sapiens
ttaatttgtatgctaaa

SEQ ID NO: 5331505 - DNA, 20 bp, Homo sapiens
ttaattttaaagagtgtgtt

SEQ ID NO: 5331506 - DNA, 13 bp, Homo sapiens
ttaattttaaagt

SEQ ID NO: 5331507 - DNA, 19 bp, Homo sapiens
ttaattttaaagtgcaaaa

SEQ ID NO: 5331508 - DNA, 13 bp, Homo sapiens
ttaattttaatgc

SEQ ID NO: 5331509 - DNA, 20 bp, Homo sapiens
ttaattttaccaagagtaac

SEQ ID NO: 5331510 - DNA, 17 bp, Homo sapiens
ttaattttactccataa

SEQ ID NO: 5331511 - DNA, 16 bp, Homo sapiens
ttaattttagaaagaa

SEQ ID NO: 5331512 - DNA, 21 bp, Homo sapiens
ttaattttagaaagaaaatta

SEQ ID NO: 5331513 - DNA, 23 bp, Homo sapiens
ttaattttagaaagaaaattata

SEQ ID NO: 5331514 - DNA, 21 bp, Homo sapiens
ttaattttagtttttcattaa

SEQ ID NO: 5331515 - DNA, 15 bp, Homo sapiens
ttaattttatatgta

SEQ ID NO: 5331516 - DNA, 18 bp, Homo sapiens
ttaattttcacaaaatgt

SEQ ID NO: 5331517 - DNA, 21 bp, Homo sapiens
ttaattttcacaaaatgtctc

SEQ ID NO: 5331518 - DNA, 15 bp, Homo sapiens
ttaattttcagttct

SEQ ID NO: 5331519 - DNA, 17 bp, Homo sapiens
ttaattttcagttctat

SEQ ID NO: 5331520 - DNA, 15 bp, Homo sapiens
ttaattttcctcatt

SEQ ID NO: 5331521 - DNA, 13 bp, Homo sapiens
ttaattttcctgg

SEQ ID NO: 5331522 - DNA, 20 bp, Homo sapiens
ttaattttgaagtgctgttt

SEQ ID NO: 5331523 - DNA, 22 bp, Homo sapiens
ttaattttgacactatatctgt

SEQ ID NO: 5331524 - DNA, 15 bp, Homo sapiens
ttaattttgaccaaa

SEQ ID NO: 5331525 - DNA, 19 bp, Homo sapiens
ttaattttgatatacattg

SEQ ID NO: 5331526 - DNA, 14 bp, Homo sapiens
ttaattttgctaac

SEQ ID NO: 5331527 - DNA, 17 bp, Homo sapiens
ttaattttgctaactgg

SEQ ID NO: 5331528 - DNA, 18 bp, Homo sapiens
ttaattttggttgtattc

SEQ ID NO: 5331529 - DNA, 16 bp, Homo sapiens
ttaattttgtgttgct

SEQ ID NO: 5331530 - DNA, 15 bp, Homo sapiens
ttaatttttaagaga

SEQ ID NO: 5331531 - DNA, 17 bp, Homo sapiens
ttaatttttaatgatga

SEQ ID NO: 5331532 - DNA, 13 bp, Homo sapiens
ttaatttttgcaa

SEQ ID NO: 5331533 - DNA, 22 bp, Homo sapiens
ttaatttttttaaccaaaggtg

SEQ ID NO: 5331534 - DNA, 23 bp, Homo sapiens
ttaatttttttaaccaaaggtga

SEQ ID NO: 5331535 - DNA, 19 bp, Homo sapiens
ttacaaaaacacttcgttc

SEQ ID NO: 5331536 - DNA, 15 bp, Homo sapiens
ttacaaaaatagtag

SEQ ID NO: 5331537 - DNA, 17 bp, Homo sapiens
ttacaaaacaaactcat

SEQ ID NO: 5331538 - DNA, 17 bp, Homo sapiens
ttacaaaacctattttt

SEQ ID NO: 5331539 - DNA, 22 bp, Homo sapiens
ttacaaaacctatttttccttt

SEQ ID NO: 5331540 - DNA, 23 bp, Homo sapiens
ttacaaaacctatttttccttta

SEQ ID NO: 5331541 - DNA, 13 bp, Homo sapiens
ttacaaaactgcc

SEQ ID NO: 5331542 - DNA, 18 bp, Homo sapiens
ttacaaaagatgtatcct

SEQ ID NO: 5331543 - DNA, 21 bp, Homo sapiens
ttacaaaaggctcgtttggat

SEQ ID NO: 5331544 - DNA, 12 bp, Homo sapiens
ttacaaaatact

SEQ ID NO: 5331545 - DNA, 17 bp, Homo sapiens
ttacaaaatccaactct

SEQ ID NO: 5331546 - DNA, 21 bp, Homo sapiens
ttacaaaatcctggaagattt

SEQ ID NO: 5331547 - DNA, 14 bp, Homo sapiens
ttacaaaatcttaa

SEQ ID NO: 5331548 - DNA, 18 bp, Homo sapiens
ttacaaaatgaagtttta

SEQ ID NO: 5331549 - DNA, 17 bp, Homo sapiens
ttacaaaatgccaaggg

SEQ ID NO: 5331550 - DNA, 18 bp, Homo sapiens
ttacaaaatgtaactgtt

SEQ ID NO: 5331551 - DNA, 17 bp, Homo sapiens
ttacaaaatttattctc

SEQ ID NO: 5331552 - DNA, 16 bp, Homo sapiens
ttacaaaattttaaca

SEQ ID NO: 5331553 - DNA, 14 bp, Homo sapiens
ttacaaacaaagga

SEQ ID NO: 5331554 - DNA, 20 bp, Homo sapiens
ttacaaaccattacctgtac

SEQ ID NO: 5331555 - DNA, 14 bp, Homo sapiens
ttacaaactacaga

SEQ ID NO: 5331556 - DNA, 13 bp, Homo sapiens
ttacaaactgaag

SEQ ID NO: 5331557 - DNA, 21 bp, Homo sapiens
ttacaaactgcaatagagact

SEQ ID NO: 5331558 - DNA, 22 bp, Homo sapiens
ttacaaactgcaatagagactg

SEQ ID NO: 5331559 - DNA, 14 bp, Homo sapiens
ttacaaagaaacaa

SEQ ID NO: 5331560 - DNA, 16 bp, Homo sapiens
ttacaaagaaacaaaa

SEQ ID NO: 5331561 - DNA, 21 bp, Homo sapiens
ttacaaagaaccatgcaggaa

SEQ ID NO: 5331562 - DNA, 16 bp, Homo sapiens
ttacaaagcagttact

SEQ ID NO: 5331563 - DNA, 13 bp, Homo sapiens
ttacaaagcatct

SEQ ID NO: 5331564 - DNA, 12 bp, Homo sapiens
ttacaaagccag

SEQ ID NO: 5331565 - DNA, 19 bp, Homo sapiens
ttacaaagggaaagcctct

SEQ ID NO: 5331566 - DNA, 22 bp, Homo sapiens
ttacaaagggtctatcttgtaa

SEQ ID NO: 5331567 - DNA, 15 bp, Homo sapiens
ttacaaagtgtgtat

SEQ ID NO: 5331568 - DNA, 21 bp, Homo sapiens
ttacaaagttaaaattgttat

SEQ ID NO: 5331569 - DNA, 20 bp, Homo sapiens
ttacaaataaatccaagact

SEQ ID NO: 5331570 - DNA, 15 bp, Homo sapiens
ttacaaatattaaga

SEQ ID NO: 5331571 - DNA, 21 bp, Homo sapiens
ttacaaatgaaaaattccact

SEQ ID NO: 5331572 - DNA, 22 bp, Homo sapiens
ttacaaatgaagtatttcatgt

SEQ ID NO: 5331573 - DNA, 19 bp, Homo sapiens
ttacaaatgattgctttta

SEQ ID NO: 5331574 - DNA, 23 bp, Homo sapiens
ttacaaatgattgcttttaaaat

SEQ ID NO: 5331575 - DNA, 21 bp, Homo sapiens
ttacaaatgttaaaatgtgtt

SEQ ID NO: 5331576 - DNA, 14 bp, Homo sapiens
ttacaaattaatat

SEQ ID NO: 5331577 - DNA, 18 bp, Homo sapiens
ttacaaattaatatttgt

SEQ ID NO: 5331578 - DNA, 21 bp, Homo sapiens
ttacaaattataatgtattca

SEQ ID NO: 5331579 - DNA, 24 bp, Homo sapiens
ttacaaattataatgtattcatat

SEQ ID NO: 5331580 - DNA, 13 bp, Homo sapiens
ttacaaatttaat

SEQ ID NO: 5331581 - DNA, 14 bp, Homo sapiens
ttacaaatttaatt

SEQ ID NO: 5331582 - DNA, 16 bp, Homo sapiens
ttacaaattttcactg

SEQ ID NO: 5331583 - DNA, 19 bp, Homo sapiens
ttacaaatttttactcagg

SEQ ID NO: 5331584 - DNA, 13 bp, Homo sapiens
ttacaacaaacac

SEQ ID NO: 5331585 - DNA, 15 bp, Homo sapiens
ttacaacaaacactg

SEQ ID NO: 5331586 - DNA, 13 bp, Homo sapiens
ttacaacaagcaa

SEQ ID NO: 5331587 - DNA, 19 bp, Homo sapiens
ttacaacacagtagtgttc

SEQ ID NO: 5331588 - DNA, 18 bp, Homo sapiens
ttacaacagatttgtgaa

SEQ ID NO: 5331589 - DNA, 16 bp, Homo sapiens
ttacaaccatacttta

SEQ ID NO: 5331590 - DNA, 22 bp, Homo sapiens
ttacaaccggttatcagttgga

SEQ ID NO: 5331591 - DNA, 20 bp, Homo sapiens
ttacaacgccgagtgcactg

SEQ ID NO: 5331592 - DNA, 16 bp, Homo sapiens
ttacaacggagtcaaa

SEQ ID NO: 5331593 - DNA, 23 bp, Homo sapiens
ttacaacggagtcaaaaattaaa

SEQ ID NO: 5331594 - DNA, 15 bp, Homo sapiens
ttacaactaaataac

SEQ ID NO: 5331595 - DNA, 13 bp, Homo sapiens
ttacaactccccc

SEQ ID NO: 5331596 - DNA, 22 bp, Homo sapiens
ttacaactgaaacctaggaagc

SEQ ID NO: 5331597 - DNA, 14 bp, Homo sapiens
ttacaactgagttg

SEQ ID NO: 5331598 - DNA, 20 bp, Homo sapiens
ttacaagaagtttattctca

SEQ ID NO: 5331599 - DNA, 21 bp, Homo sapiens
ttacaagaagtttattctcat

SEQ ID NO: 5331600 - DNA, 15 bp, Homo sapiens
ttacaagactgtaaa

SEQ ID NO: 5331601 - DNA, 16 bp, Homo sapiens
ttacaagactgtaaat

SEQ ID NO: 5331602 - DNA, 16 bp, Homo sapiens
ttacaagagaaacaaa

SEQ ID NO: 5331603 - DNA, 19 bp, Homo sapiens
ttacaagagaagaaagtga

SEQ ID NO: 5331604 - DNA, 13 bp, Homo sapiens
ttacaagcaggca

SEQ ID NO: 5331605 - DNA, 14 bp, Homo sapiens
ttacaagcaggcac

SEQ ID NO: 5331606 - DNA, 16 bp, Homo sapiens
ttacaagctatttttg

SEQ ID NO: 5331607 - DNA, 17 bp, Homo sapiens
ttacaagcttaaagctt

SEQ ID NO: 5331608 - DNA, 17 bp, Homo sapiens
ttacaaggcaatggaaa

SEQ ID NO: 5331609 - DNA, 22 bp, Homo sapiens
ttacaaggcaatggaaactatt

SEQ ID NO: 5331610 - DNA, 20 bp, Homo sapiens
ttacaagggcataaagtaaa

SEQ ID NO: 5331611 - DNA, 15 bp, Homo sapiens
ttacaaggttatgta

SEQ ID NO: 5331612 - DNA, 18 bp, Homo sapiens
ttacaaggttatgtagag

SEQ ID NO: 5331613 - DNA, 20 bp, Homo sapiens
ttacaagtaatgaattttat

SEQ ID NO: 5331614 - DNA, 17 bp, Homo sapiens
ttacaagtaatgtaaag

SEQ ID NO: 5331615 - DNA, 17 bp, Homo sapiens
ttacaagtatacttata

SEQ ID NO: 5331616 - DNA, 17 bp, Homo sapiens
ttacaagtggtgaccaa

SEQ ID NO: 5331617 - DNA, 14 bp, Homo sapiens
ttacaagtgtatat

SEQ ID NO: 5331618 - DNA, 20 bp, Homo sapiens
ttacaagtgttcttaggttt

SEQ ID NO: 5331619 - DNA, 19 bp, Homo sapiens
ttacaagttatagtactag

SEQ ID NO: 5331620 - DNA, 22 bp, Homo sapiens
ttacaagttgtgcatgcaacca

SEQ ID NO: 5331621 - DNA, 13 bp, Homo sapiens
ttacaagtttcag

SEQ ID NO: 5331622 - DNA, 17 bp, Homo sapiens
ttacaataaaactaaat

SEQ ID NO: 5331623 - DNA, 22 bp, Homo sapiens
ttacaataaaactaaatgtgta

SEQ ID NO: 5331624 - DNA, 14 bp, Homo sapiens
ttacaataaagttt

SEQ ID NO: 5331625 - DNA, 14 bp, Homo sapiens
ttacaataaatatt

SEQ ID NO: 5331626 - DNA, 19 bp, Homo sapiens
ttacaataaatattctgca

SEQ ID NO: 5331627 - DNA, 20 bp, Homo sapiens
ttacaataggtgcttattct

SEQ ID NO: 5331628 - DNA, 13 bp, Homo sapiens
ttacaatatagat

SEQ ID NO: 5331629 - DNA, 16 bp, Homo sapiens
ttacaatattatgaaa

SEQ ID NO: 5331630 - DNA, 23 bp, Homo sapiens
ttacaatattatgaaatttcact

SEQ ID NO: 5331631 - DNA, 21 bp, Homo sapiens
ttacaatattgattgggaaaa

SEQ ID NO: 5331632 - DNA, 18 bp, Homo sapiens
ttacaatatttgtgtgct

SEQ ID NO: 5331633 - DNA, 22 bp, Homo sapiens
ttacaatatttgtgtgctaaac

SEQ ID NO: 5331634 - DNA, 23 bp, Homo sapiens
ttacaatcattgctgaaaatggt

SEQ ID NO: 5331635 - DNA, 22 bp, Homo sapiens
ttacaatgatgccgaacattag

SEQ ID NO: 5331636 - DNA, 23 bp, Homo sapiens
ttacaatgtaaaccacatgaact

SEQ ID NO: 5331637 - DNA, 18 bp, Homo sapiens
ttacaatgtaatagaagc

SEQ ID NO: 5331638 - DNA, 13 bp, Homo sapiens
ttacaatgtaatt

SEQ ID NO: 5331639 - DNA, 19 bp, Homo sapiens
ttacaatgtaattatttat

SEQ ID NO: 5331640 - DNA, 13 bp, Homo sapiens
ttacaatgtatta

SEQ ID NO: 5331641 - DNA, 15 bp, Homo sapiens
ttacaatgtgaataa

SEQ ID NO: 5331642 - DNA, 16 bp, Homo sapiens
ttacaatgtgaataat

SEQ ID NO: 5331643 - DNA, 14 bp, Homo sapiens
ttacaatgtgcact

SEQ ID NO: 5331644 - DNA, 15 bp, Homo sapiens
ttacaattaataaat

SEQ ID NO: 5331645 - DNA, 12 bp, Homo sapiens
ttacaattacat

SEQ ID NO: 5331646 - DNA, 14 bp, Homo sapiens
ttacaattgaaatg

SEQ ID NO: 5331647 - DNA, 13 bp, Homo sapiens
ttacaattgtcat

SEQ ID NO: 5331648 - DNA, 12 bp, Homo sapiens
ttacaatttaca

SEQ ID NO: 5331649 - DNA, 13 bp, Homo sapiens
ttacaatttacaa

SEQ ID NO: 5331650 - DNA, 19 bp, Homo sapiens
ttacaatttatatgcttca

SEQ ID NO: 5331651 - DNA, 21 bp, Homo sapiens
ttacaatttctttaaatcatt

SEQ ID NO: 5331652 - DNA, 11 bp, Homo sapiens
ttacaatttgc

SEQ ID NO: 5331653 - DNA, 23 bp, Homo sapiens
ttacaatttgcacaatatttctt

SEQ ID NO: 5331654 - DNA, 19 bp, Homo sapiens
ttacaatttgttcatccta

SEQ ID NO: 5331655 - DNA, 16 bp, Homo sapiens
ttacaattttctgtaa

SEQ ID NO: 5331656 - DNA, 21 bp, Homo sapiens
ttacacaaagaacttgctgct

SEQ ID NO: 5331657 - DNA, 23 bp, Homo sapiens
ttacacaaagaacttgctgctgc

SEQ ID NO: 5331658 - DNA, 19 bp, Homo sapiens
ttacacaaatacttattca

SEQ ID NO: 5331659 - DNA, 17 bp, Homo sapiens
ttacacaaatgtgattt

SEQ ID NO: 5331660 - DNA, 15 bp, Homo sapiens
ttacacaagaatcta

SEQ ID NO: 5331661 - DNA, 15 bp, Homo sapiens
ttacacaataaagca

SEQ ID NO: 5331662 - DNA, 22 bp, Homo sapiens
ttacacaatggtttttaaattt

SEQ ID NO: 5331663 - DNA, 13 bp, Homo sapiens
ttacacaattaat

SEQ ID NO: 5331664 - DNA, 16 bp, Homo sapiens
ttacacaattaattgt

SEQ ID NO: 5331665 - DNA, 16 bp, Homo sapiens
ttacacaattcttacc

SEQ ID NO: 5331666 - DNA, 16 bp, Homo sapiens
ttacacacacagatgt

SEQ ID NO: 5331667 - DNA, 18 bp, Homo sapiens
ttacacacctgagaatgt

SEQ ID NO: 5331668 - DNA, 19 bp, Homo sapiens
ttacacacgtgcaatttgt

SEQ ID NO: 5331669 - DNA, 23 bp, Homo sapiens
ttacacacgtgcaatttgtttgt

SEQ ID NO: 5331670 - DNA, 21 bp, Homo sapiens
ttacacacgtgtgatgtatgt

SEQ ID NO: 5331671 - DNA, 17 bp, Homo sapiens
ttacacactaacatcaa

SEQ ID NO: 5331672 - DNA, 16 bp, Homo sapiens
ttacacactcaggcct

SEQ ID NO: 5331673 - DNA, 18 bp, Homo sapiens
ttacacactgtacacata

SEQ ID NO: 5331674 - DNA, 14 bp, Homo sapiens
ttacacagaaacac

SEQ ID NO: 5331675 - DNA, 18 bp, Homo sapiens
ttacacagaaacactgcc

SEQ ID NO: 5331676 - DNA, 19 bp, Homo sapiens
ttacacagaaatgctgctg

SEQ ID NO: 5331677 - DNA, 20 bp, Homo sapiens
ttacacagaaatgctgctgg

SEQ ID NO: 5331678 - DNA, 23 bp, Homo sapiens
ttacacagtcaaatttacattta

SEQ ID NO: 5331679 - DNA, 20 bp, Homo sapiens
ttacacagtgagactgtaca

SEQ ID NO: 5331680 - DNA, 16 bp, Homo sapiens
ttacacattagatttt

SEQ ID NO: 5331681 - DNA, 15 bp, Homo sapiens
ttacacattctcaca

SEQ ID NO: 5331682 - DNA, 23 bp, Homo sapiens
ttacacattctcacaattgtaaa

SEQ ID NO: 5331683 - DNA, 18 bp, Homo sapiens
ttacacatttcactgtga

SEQ ID NO: 5331684 - DNA, 15 bp, Homo sapiens
ttacaccacaagtat

SEQ ID NO: 5331685 - DNA, 14 bp, Homo sapiens
ttacacccaaatat

SEQ ID NO: 5331686 - DNA, 15 bp, Homo sapiens
ttacacccatgcaca

SEQ ID NO: 5331687 - DNA, 22 bp, Homo sapiens
ttacacctcagaaattgaaagc

SEQ ID NO: 5331688 - DNA, 15 bp, Homo sapiens
ttacctagcatttca

SEQ ID NO: 5331689 - DNA, 13 bp, Homo sapiens
ttacctagtgaaa

SEQ ID NO: 5331690 - DNA, 21 bp, Homo sapiens
ttacctagtgcaaaaactgta

SEQ ID NO: 5331691 - DNA, 23 bp, Homo sapiens
ttacctagtgcaaaaactgtaaa

SEQ ID NO: 5331692 - DNA, 16 bp, Homo sapiens
ttacctcatccatgca

SEQ ID NO: 5331693 - DNA, 20 bp, Homo sapiens
ttacctcatccatgcacttt

SEQ ID NO: 5331694 - DNA, 17 bp, Homo sapiens
ttacctcatgccgctgt

SEQ ID NO: 5331695 - DNA, 19 bp, Homo sapiens
ttacctcatgccgctgtgt

SEQ ID NO: 5331696 - DNA, 23 bp, Homo sapiens
ttacctccaacagaactaaatgt

SEQ ID NO: 5331697 - DNA, 21 bp, Homo sapiens
ttacctccatccatccttcca

SEQ ID NO: 5331698 - DNA, 16 bp, Homo sapiens
ttacctcccctgccag

SEQ ID NO: 5331699 - DNA, 12 bp, Homo sapiens
ttacctccctcg

SEQ ID NO: 5331700 - DNA, 19 bp, Homo sapiens
ttacctcctgcccaggaga

SEQ ID NO: 5331701 - DNA, 21 bp, Homo sapiens
ttacctcgggatggttggtta

SEQ ID NO: 5331702 - DNA, 23 bp, Homo sapiens
ttacctcgggatggttggttagt

SEQ ID NO: 5331703 - DNA, 16 bp, Homo sapiens
ttacctctctgggacc

SEQ ID NO: 5331704 - DNA, 15 bp, Homo sapiens
ttacctctctgtcat

SEQ ID NO: 5331705 - DNA, 11 bp, Homo sapiens
ttacctctgat

SEQ ID NO: 5331706 - DNA, 17 bp, Homo sapiens
ttacctctggaaccccc

SEQ ID NO: 5331707 - DNA, 21 bp, Homo sapiens
ttacctctggaaccccccagg

SEQ ID NO: 5331708 - DNA, 18 bp, Homo sapiens
ttacctgaaaacactgtg

SEQ ID NO: 5331709 - DNA, 22 bp, Homo sapiens
ttacctgaaaacactgtgcaca

SEQ ID NO: 5331710 - DNA, 18 bp, Homo sapiens
ttacctgacctcttgctg

SEQ ID NO: 5331711 - DNA, 23 bp, Homo sapiens
ttacctgacctcttgctgtctct

SEQ ID NO: 5331712 - DNA, 20 bp, Homo sapiens
ttacctgacggacgtcctgc

SEQ ID NO: 5331713 - DNA, 13 bp, Homo sapiens
ttacctgagaacc

SEQ ID NO: 5331714 - DNA, 20 bp, Homo sapiens
ttacctgatcaatgacagag

SEQ ID NO: 5331715 - DNA, 18 bp, Homo sapiens
ttacctgatcatggtcag

SEQ ID NO: 5331716 - DNA, 21 bp, Homo sapiens
ttacctgatcatggtcagctc

SEQ ID NO: 5331717 - DNA, 13 bp, Homo sapiens
ttacctgcttctg

SEQ ID NO: 5331718 - DNA, 23 bp, Homo sapiens
ttacctgcttgagctttctgtgc

SEQ ID NO: 5331719 - DNA, 13 bp, Homo sapiens
ttacctggaaaaa

SEQ ID NO: 5331720 - DNA, 16 bp, Homo sapiens
ttacctggaatcaaat

SEQ ID NO: 5331721 - DNA, 23 bp, Homo sapiens
ttacctggatataaattaattgt

SEQ ID NO: 5331722 - DNA, 15 bp, Homo sapiens
ttacctggatgttct

SEQ ID NO: 5331723 - DNA, 12 bp, Homo sapiens
ttacctggatta

SEQ ID NO: 5331724 - DNA, 23 bp, Homo sapiens
ttacctggcagcaaactgctgcc

SEQ ID NO: 5331725 - DNA, 21 bp, Homo sapiens
ttacctggcagtggctctcag

SEQ ID NO: 5331726 - DNA, 19 bp, Homo sapiens
ttacctggtgagtaactta

SEQ ID NO: 5331727 - DNA, 23 bp, Homo sapiens
ttacctggtgagtaacttagaaa

SEQ ID NO: 5331728 - DNA, 22 bp, Homo sapiens
ttacctgtaatagcctcacctt

SEQ ID NO: 5331729 - DNA, 14 bp, Homo sapiens
ttacctgtctctct

SEQ ID NO: 5331730 - DNA, 13 bp, Homo sapiens
ttacctgtgaaat

SEQ ID NO: 5331731 - DNA, 20 bp, Homo sapiens
ttacctgttatttatcaatt

SEQ ID NO: 5331732 - DNA, 15 bp, Homo sapiens
ttacctgttccattg

SEQ ID NO: 5331733 - DNA, 13 bp, Homo sapiens
ttacctgttctct

SEQ ID NO: 5331734 - DNA, 17 bp, Homo sapiens
ttacctgttctctagtt

SEQ ID NO: 5331735 - DNA, 18 bp, Homo sapiens
ttaccttatagttactgt

SEQ ID NO: 5331736 - DNA, 18 bp, Homo sapiens
ttaccttcaataaagtat

SEQ ID NO: 5331737 - DNA, 15 bp, Homo sapiens
ttaccttctgctgtt

SEQ ID NO: 5331738 - DNA, 19 bp, Homo sapiens
ttaccttctttctaataca

SEQ ID NO: 5331739 - DNA, 14 bp, Homo sapiens
ttaccttgtctttc

SEQ ID NO: 5331740 - DNA, 14 bp, Homo sapiens
ttacctttaatgca

SEQ ID NO: 5331741 - DNA, 20 bp, Homo sapiens
ttacctttaatgcaatgcat

SEQ ID NO: 5331742 - DNA, 17 bp, Homo sapiens
ttacctttatctttcac

SEQ ID NO: 5331743 - DNA, 22 bp, Homo sapiens
ttacctttattaatgaactgtg

SEQ ID NO: 5331744 - DNA, 14 bp, Homo sapiens
ttacctttgctgtc

SEQ ID NO: 5331745 - DNA, 17 bp, Homo sapiens
ttaccttttataagaca

SEQ ID NO: 5331746 - DNA, 15 bp, Homo sapiens
ttaccttttctataa

SEQ ID NO: 5331747 - DNA, 16 bp, Homo sapiens
ttaccttttctataag

SEQ ID NO: 5331748 - DNA, 18 bp, Homo sapiens
ttaccttttctgttgtac

SEQ ID NO: 5331749 - DNA, 19 bp, Homo sapiens
ttaccttttttatacataa

SEQ ID NO: 5331750 - DNA, 23 bp, Homo sapiens
ttaccttttttgataaagtttct

SEQ ID NO: 5331751 - DNA, 14 bp, Homo sapiens
ttacgaaacctctt

SEQ ID NO: 5331752 - DNA, 20 bp, Homo sapiens
ttacgaagttcaagatcaaa

SEQ ID NO: 5331753 - DNA, 17 bp, Homo sapiens
ttacgaatattttcagt

SEQ ID NO: 5331754 - DNA, 21 bp, Homo sapiens
ttacgaatgcccctgttcatg

SEQ ID NO: 5331755 - DNA, 13 bp, Homo sapiens
ttacgatatttcg

SEQ ID NO: 5331756 - DNA, 18 bp, Homo sapiens
ttacgatttcactaggac

SEQ ID NO: 5331757 - DNA, 22 bp, Homo sapiens
ttacgcctgtaaatgtattcat

SEQ ID NO: 5331758 - DNA, 12 bp, Homo sapiens
ttacggaattcc

SEQ ID NO: 5331759 - DNA, 15 bp, Homo sapiens
ttacggaattccaat

SEQ ID NO: 5331760 - DNA, 17 bp, Homo sapiens
ttacggaattccaatat

SEQ ID NO: 5331761 - DNA, 16 bp, Homo sapiens
ttacggacaccccctc

SEQ ID NO: 5331762 - DNA, 23 bp, Homo sapiens
ttacggactctggatatttgcac

SEQ ID NO: 5331763 - DNA, 17 bp, Homo sapiens
ttacggatttattatat

SEQ ID NO: 5331764 - DNA, 14 bp, Homo sapiens
ttacgggtacctga

SEQ ID NO: 5331765 - DNA, 13 bp, Homo sapiens
ttacggtacttgg

SEQ ID NO: 5331766 - DNA, 20 bp, Homo sapiens
ttacggttttccaggtttaa

SEQ ID NO: 5331767 - DNA, 23 bp, Homo sapiens
ttacgtactgtaactgctcagag

SEQ ID NO: 5331768 - DNA, 22 bp, Homo sapiens
ttacgtagctatttttatacac

SEQ ID NO: 5331769 - DNA, 13 bp, Homo sapiens
ttacgtataatgc

SEQ ID NO: 5331770 - DNA, 16 bp, Homo sapiens
ttacgtataatgcttt

SEQ ID NO: 5331771 - DNA, 13 bp, Homo sapiens
ttacgtatatttc

SEQ ID NO: 5331772 - DNA, 19 bp, Homo sapiens
ttacgtatgtctggttctc

SEQ ID NO: 5331773 - DNA, 22 bp, Homo sapiens
ttacgtatgtctggttctcaat

SEQ ID NO: 5331774 - DNA, 14 bp, Homo sapiens
ttacgtctttggag

SEQ ID NO: 5331775 - DNA, 21 bp, Homo sapiens
ttacgtgaagaaataaatgaa

SEQ ID NO: 5331776 - DNA, 22 bp, Homo sapiens
ttacgtgaagaaataaatgaaa

SEQ ID NO: 5331777 - DNA, 15 bp, Homo sapiens
ttacgtgcaaacaac

SEQ ID NO: 5331778 - DNA, 13 bp, Homo sapiens
ttacgtgcattta

SEQ ID NO: 5331779 - DNA, 21 bp, Homo sapiens
ttacgtgtaaaggaaaataat

SEQ ID NO: 5331780 - DNA, 14 bp, Homo sapiens
ttacgtgtatgttt

SEQ ID NO: 5331781 - DNA, 17 bp, Homo sapiens
ttacgtgtatgtttctt

SEQ ID NO: 5331782 - DNA, 15 bp, Homo sapiens
ttacgttctttcact

SEQ ID NO: 5331783 - DNA, 15 bp, Homo sapiens
ttacgtttaaagtgc

SEQ ID NO: 5331784 - DNA, 17 bp, Homo sapiens
ttacgtttgttattcct

SEQ ID NO: 5331785 - DNA, 23 bp, Homo sapiens
ttactaaaaagtaccagcatgtt

SEQ ID NO: 5331786 - DNA, 17 bp, Homo sapiens
ttactaaaaagtataaa

SEQ ID NO: 5331787 - DNA, 12 bp, Homo sapiens
ttactaaaagaa

SEQ ID NO: 5331788 - DNA, 19 bp, Homo sapiens
ttactaaaagttttgagaa

SEQ ID NO: 5331789 - DNA, 17 bp, Homo sapiens
ttactaaaatggactgt

SEQ ID NO: 5331790 - DNA, 17 bp, Homo sapiens
ttactaaaatttacaca

SEQ ID NO: 5331791 - DNA, 16 bp, Homo sapiens
ttactaaacattttgt

SEQ ID NO: 5331792 - DNA, 18 bp, Homo sapiens
ttactaaagaaagattac

SEQ ID NO: 5331793 - DNA, 14 bp, Homo sapiens
ttactaaagcagtg

SEQ ID NO: 5331794 - DNA, 16 bp, Homo sapiens
ttactaaagcagtgtt

SEQ ID NO: 5331795 - DNA, 22 bp, Homo sapiens
ttactaaagcagtgttttcacc

SEQ ID NO: 5331796 - DNA, 13 bp, Homo sapiens
ttactaagaagaa

SEQ ID NO: 5331797 - DNA, 15 bp, Homo sapiens
ttactaagaagaaaa

SEQ ID NO: 5331798 - DNA, 19 bp, Homo sapiens
ttactaagacatagtctct

SEQ ID NO: 5331799 - DNA, 23 bp, Homo sapiens
ttactaagatcacacaaataaca

SEQ ID NO: 5331800 - DNA, 16 bp, Homo sapiens
ttactaagatgaaatt

SEQ ID NO: 5331801 - DNA, 20 bp, Homo sapiens
ttactaagatgaaattgcca

SEQ ID NO: 5331802 - DNA, 21 bp, Homo sapiens
ttactaagatgaaattgccaa

SEQ ID NO: 5331803 - DNA, 23 bp, Homo sapiens
ttactaagatgacattgctaaga

SEQ ID NO: 5331804 - DNA, 22 bp, Homo sapiens
ttactaagccacaagaaatttg

SEQ ID NO: 5331805 - DNA, 14 bp, Homo sapiens
ttactaagctttgc

SEQ ID NO: 5331806 - DNA, 13 bp, Homo sapiens
ttactaaggaagg

SEQ ID NO: 5331807 - DNA, 23 bp, Homo sapiens
ttactaagttttcaaatttgtaa

SEQ ID NO: 5331808 - DNA, 14 bp, Homo sapiens
ttactaagttttta

SEQ ID NO: 5331809 - DNA, 14 bp, Homo sapiens
ttactaataaattg

SEQ ID NO: 5331810 - DNA, 13 bp, Homo sapiens
ttactaatatata

SEQ ID NO: 5331811 - DNA, 14 bp, Homo sapiens
ttactaatatatat

SEQ ID NO: 5331812 - DNA, 14 bp, Homo sapiens
ttactaatatatct

SEQ ID NO: 5331813 - DNA, 18 bp, Homo sapiens
ttactaatatatctgtaa

SEQ ID NO: 5331814 - DNA, 14 bp, Homo sapiens
ttactacaaaattt

SEQ ID NO: 5331815 - DNA, 18 bp, Homo sapiens
ttactacaaatggatgac

SEQ ID NO: 5331816 - DNA, 18 bp, Homo sapiens
ttactacagccttaatat

SEQ ID NO: 5331817 - DNA, 14 bp, Homo sapiens
ttactacagttttt

SEQ ID NO: 5331818 - DNA, 14 bp, Homo sapiens
ttactaccctcacc

SEQ ID NO: 5331819 - DNA, 17 bp, Homo sapiens
ttactacctcctctcct

SEQ ID NO: 5331820 - DNA, 15 bp, Homo sapiens
ttactactgcaagtt

SEQ ID NO: 5331821 - DNA, 17 bp, Homo sapiens
ttactactgcaagttca

SEQ ID NO: 5331822 - DNA, 14 bp, Homo sapiens
ttactactgtggaa

SEQ ID NO: 5331823 - DNA, 21 bp, Homo sapiens
ttactacttctctctgtattt

SEQ ID NO: 5331824 - DNA, 15 bp, Homo sapiens
ttactactttaaatc

SEQ ID NO: 5331825 - DNA, 17 bp, Homo sapiens
ttactactttgcctctt

SEQ ID NO: 5331826 - DNA, 13 bp, Homo sapiens
ttactagaaatat

SEQ ID NO: 5331827 - DNA, 13 bp, Homo sapiens
ttactagaaatgg

SEQ ID NO: 5331828 - DNA, 19 bp, Homo sapiens
ttactagaaatgggaatca

SEQ ID NO: 5331829 - DNA, 23 bp, Homo sapiens
ttactagaaatgggaatcatggc

SEQ ID NO: 5331830 - DNA, 14 bp, Homo sapiens
ttactagactttga

SEQ ID NO: 5331831 - DNA, 15 bp, Homo sapiens
ttactagagaaagac

SEQ ID NO: 5331832 - DNA, 14 bp, Homo sapiens
ttactagctgtgca

SEQ ID NO: 5331833 - DNA, 16 bp, Homo sapiens
ttactaggtaacttca

SEQ ID NO: 5331834 - DNA, 19 bp, Homo sapiens
ttactagtactatttctta

SEQ ID NO: 5331835 - DNA, 12 bp, Homo sapiens
ttactagtgttt

SEQ ID NO: 5331836 - DNA, 17 bp, Homo sapiens
ttactagtgtttaagtc

SEQ ID NO: 5331837 - DNA, 19 bp, Homo sapiens
ttactagttagcatacaca

SEQ ID NO: 5331838 - DNA, 20 bp, Homo sapiens
ttactataatttgacttgaa

SEQ ID NO: 5331839 - DNA, 16 bp, Homo sapiens
ttactatagtctcttg

SEQ ID NO: 5331840 - DNA, 22 bp, Homo sapiens
ttactatatagaatttcctgta

SEQ ID NO: 5331841 - DNA, 17 bp, Homo sapiens
ttactatcacacatgaa

SEQ ID NO: 5331842 - DNA, 21 bp, Homo sapiens
ttactatccatttcttcatgt

SEQ ID NO: 5331843 - DNA, 22 bp, Homo sapiens
ttactatcctggctttgcccaa

SEQ ID NO: 5331844 - DNA, 22 bp, Homo sapiens
ttactatcttttcatttatcaa

SEQ ID NO: 5331845 - DNA, 16 bp, Homo sapiens
ttactatgcacaattt

SEQ ID NO: 5331846 - DNA, 16 bp, Homo sapiens
ttactatgccacagat

SEQ ID NO: 5331847 - DNA, 14 bp, Homo sapiens
ttactatgcctgtg

SEQ ID NO: 5331848 - DNA, 18 bp, Homo sapiens
ttactatggtaacacttt

SEQ ID NO: 5331849 - DNA, 13 bp, Homo sapiens
ttactattaaaat

SEQ ID NO: 5331850 - DNA, 21 bp, Homo sapiens
ttactattaactctgcataga

SEQ ID NO: 5331851 - DNA, 19 bp, Homo sapiens
ttactattcattaaatgtt

SEQ ID NO: 5331852 - DNA, 21 bp, Homo sapiens
ttactattcattaaatgtttg

SEQ ID NO: 5331853 - DNA, 13 bp, Homo sapiens
ttactattcccac

SEQ ID NO: 5331854 - DNA, 20 bp, Homo sapiens
ttactattcccactttcatt

SEQ ID NO: 5331855 - DNA, 21 bp, Homo sapiens
ttactattccctttgacttca

SEQ ID NO: 5331856 - DNA, 15 bp, Homo sapiens
ttactcaaaatctgt

SEQ ID NO: 5331857 - DNA, 20 bp, Homo sapiens
ttactcaaaatgcaggacag

SEQ ID NO: 5331858 - DNA, 20 bp, Homo sapiens
ttactcaaagtctaacatat

SEQ ID NO: 5331859 - DNA, 21 bp, Homo sapiens
ttactcaaagttaacctacct

SEQ ID NO: 5331860 - DNA, 15 bp, Homo sapiens
ttactcaatgtgtgc

SEQ ID NO: 5331861 - DNA, 15 bp, Homo sapiens
ttactcacagccagc

SEQ ID NO: 5331862 - DNA, 12 bp, Homo sapiens
ttactcactgct

SEQ ID NO: 5331863 - DNA, 18 bp, Homo sapiens
ttactcagaattctctag

SEQ ID NO: 5331864 - DNA, 19 bp, Homo sapiens
ttactcagagctgcgggct

SEQ ID NO: 5331865 - DNA, 21 bp, Homo sapiens
ttactcagatgacctgaggaa

SEQ ID NO: 5331866 - DNA, 12 bp, Homo sapiens
ttagaaattggt

SEQ ID NO: 5331867 - DNA, 15 bp, Homo sapiens
ttagaaatttatatg

SEQ ID NO: 5331868 - DNA, 14 bp, Homo sapiens
ttagaacaacataa

SEQ ID NO: 5331869 - DNA, 22 bp, Homo sapiens
ttagaacaatagctattgcatg

SEQ ID NO: 5331870 - DNA, 18 bp, Homo sapiens
ttagaacaattttcttgt

SEQ ID NO: 5331871 - DNA, 13 bp, Homo sapiens
ttagaacactatt

SEQ ID NO: 5331872 - DNA, 16 bp, Homo sapiens
ttagaacagaaaacaa

SEQ ID NO: 5331873 - DNA, 18 bp, Homo sapiens
ttagaacaggcaagtgaa

SEQ ID NO: 5331874 - DNA, 16 bp, Homo sapiens
ttagaacattcacttt

SEQ ID NO: 5331875 - DNA, 20 bp, Homo sapiens
ttagaacattcacttttgtt

SEQ ID NO: 5331876 - DNA, 12 bp, Homo sapiens
ttagaacatttt

SEQ ID NO: 5331877 - DNA, 19 bp, Homo sapiens
ttagaaccacagcagacac

SEQ ID NO: 5331878 - DNA, 20 bp, Homo sapiens
ttagaaccaccaaaattata

SEQ ID NO: 5331879 - DNA, 17 bp, Homo sapiens
ttagaacctgcatttaa

SEQ ID NO: 5331880 - DNA, 13 bp, Homo sapiens
ttagaacctttct

SEQ ID NO: 5331881 - DNA, 19 bp, Homo sapiens
ttagaacgagcctggaagc

SEQ ID NO: 5331882 - DNA, 23 bp, Homo sapiens
ttagaactctagagagccttaac

SEQ ID NO: 5331883 - DNA, 19 bp, Homo sapiens
ttagaacttagttttgttc

SEQ ID NO: 5331884 - DNA, 16 bp, Homo sapiens
ttagaagaaaacatat

SEQ ID NO: 5331885 - DNA, 12 bp, Homo sapiens
ttagaagaaaga

SEQ ID NO: 5331886 - DNA, 17 bp, Homo sapiens
ttagaagaaatatgagc

SEQ ID NO: 5331887 - DNA, 13 bp, Homo sapiens
ttagaagagagcc

SEQ ID NO: 5331888 - DNA, 20 bp, Homo sapiens
ttagaagaggtagtgtgaat

SEQ ID NO: 5331889 - DNA, 10 bp, Homo sapiens
ttagaagcaa

SEQ ID NO: 5331890 - DNA, 20 bp, Homo sapiens
ttagaagcaaagatttcagt

SEQ ID NO: 5331891 - DNA, 23 bp, Homo sapiens
ttagaagcactacaccttgcctt

SEQ ID NO: 5331892 - DNA, 11 bp, Homo sapiens
ttagaagccac

SEQ ID NO: 5331893 - DNA, 17 bp, Homo sapiens
ttagaagcgacttttgt

SEQ ID NO: 5331894 - DNA, 22 bp, Homo sapiens
ttagaagctgaagatccccaac

SEQ ID NO: 5331895 - DNA, 20 bp, Homo sapiens
ttagaaggcttaagaactgc

SEQ ID NO: 5331896 - DNA, 18 bp, Homo sapiens
ttagaaggtattaagatt

SEQ ID NO: 5331897 - DNA, 17 bp, Homo sapiens
ttagaagtagtatgtta

SEQ ID NO: 5331898 - DNA, 16 bp, Homo sapiens
ttagaagtcacacagt

SEQ ID NO: 5331899 - DNA, 14 bp, Homo sapiens
ttagaagtgtcatg

SEQ ID NO: 5331900 - DNA, 14 bp, Homo sapiens
ttagaagtgtttta

SEQ ID NO: 5331901 - DNA, 14 bp, Homo sapiens
ttagaataaaattg

SEQ ID NO: 5331902 - DNA, 15 bp, Homo sapiens
ttagaataatattgt

SEQ ID NO: 5331903 - DNA, 14 bp, Homo sapiens
ttagaatagaactt

SEQ ID NO: 5331904 - DNA, 18 bp, Homo sapiens
ttagaatagtttgaaata

SEQ ID NO: 5331905 - DNA, 22 bp, Homo sapiens
ttagaatataaaaaatgttatt

SEQ ID NO: 5331906 - DNA, 13 bp, Homo sapiens
ttagaatattaaa

SEQ ID NO: 5331907 - DNA, 18 bp, Homo sapiens
ttagaatcaagtctgtga

SEQ ID NO: 5331908 - DNA, 20 bp, Homo sapiens
ttagaatcaagtctgtgaaa

SEQ ID NO: 5331909 - DNA, 13 bp, Homo sapiens
ttagaatcagaat

SEQ ID NO: 5331910 - DNA, 16 bp, Homo sapiens
ttagaatcagaataaa

SEQ ID NO: 5331911 - DNA, 18 bp, Homo sapiens
ttagaatccaaacttgga

SEQ ID NO: 5331912 - DNA, 12 bp, Homo sapiens
ttagaatctaga

SEQ ID NO: 5331913 - DNA, 16 bp, Homo sapiens
ttagaatctagaaatg

SEQ ID NO: 5331914 - DNA, 17 bp, Homo sapiens
ttagaatctagaaatgt

SEQ ID NO: 5331915 - DNA, 21 bp, Homo sapiens
ttagaatctattttctatgta

SEQ ID NO: 5331916 - DNA, 17 bp, Homo sapiens
ttagaatcttgttttgt

SEQ ID NO: 5331917 - DNA, 17 bp, Homo sapiens
ttagaatcttttaaata

SEQ ID NO: 5331918 - DNA, 12 bp, Homo sapiens
ttagaatgaaaa

SEQ ID NO: 5331919 - DNA, 17 bp, Homo sapiens
ttagaatgaatattaaa

SEQ ID NO: 5331920 - DNA, 14 bp, Homo sapiens
ttagaatgaattta

SEQ ID NO: 5331921 - DNA, 16 bp, Homo sapiens
ttagaatgaatttatc

SEQ ID NO: 5331922 - DNA, 20 bp, Homo sapiens
ttagaatgaatttatcttta

SEQ ID NO: 5331923 - DNA, 13 bp, Homo sapiens
ttagaatgcaagc

SEQ ID NO: 5331924 - DNA, 18 bp, Homo sapiens
ttagaatggtgattttaa

SEQ ID NO: 5331925 - DNA, 15 bp, Homo sapiens
ttagaatgtgaaaaa

SEQ ID NO: 5331926 - DNA, 13 bp, Homo sapiens
ttagaatgtttct

SEQ ID NO: 5331927 - DNA, 15 bp, Homo sapiens
ttagaattatttaaa

SEQ ID NO: 5331928 - DNA, 14 bp, Homo sapiens
ttagaattctgtat

SEQ ID NO: 5331929 - DNA, 15 bp, Homo sapiens
ttagaattctgtata

SEQ ID NO: 5331930 - DNA, 14 bp, Homo sapiens
ttagaattgaaggt

SEQ ID NO: 5331931 - DNA, 17 bp, Homo sapiens
ttagaattgaaggtttt

SEQ ID NO: 5331932 - DNA, 18 bp, Homo sapiens
ttagaattgaaggttttt

SEQ ID NO: 5331933 - DNA, 14 bp, Homo sapiens
ttagaattgatttc

SEQ ID NO: 5331934 - DNA, 15 bp, Homo sapiens
ttagaattgctggat

SEQ ID NO: 5331935 - DNA, 21 bp, Homo sapiens
ttagaattgtgtgttaatgtc

SEQ ID NO: 5331936 - DNA, 22 bp, Homo sapiens
ttagaatttgaaaggaaaaaca

SEQ ID NO: 5331937 - DNA, 16 bp, Homo sapiens
ttagaatttgtttcat

SEQ ID NO: 5331938 - DNA, 10 bp, Homo sapiens
ttagaatttt

SEQ ID NO: 5331939 - DNA, 19 bp, Homo sapiens
ttagaattttagaagagat

SEQ ID NO: 5331940 - DNA, 19 bp, Homo sapiens
ttagacaaagccttaagca

SEQ ID NO: 5331941 - DNA, 22 bp, Homo sapiens
ttagacaaagccttaagcaaat

SEQ ID NO: 5331942 - DNA, 18 bp, Homo sapiens
ttagacaaatactcatgt

SEQ ID NO: 5331943 - DNA, 18 bp, Homo sapiens
ttagacaaccatagaact

SEQ ID NO: 5331944 - DNA, 20 bp, Homo sapiens
ttagacaaccatagaactgt

SEQ ID NO: 5331945 - DNA, 16 bp, Homo sapiens
ttagacaagagatggg

SEQ ID NO: 5331946 - DNA, 16 bp, Homo sapiens
ttagacaaggaccagg

SEQ ID NO: 5331947 - DNA, 21 bp, Homo sapiens
ttagacaatggctatattaat

SEQ ID NO: 5331948 - DNA, 18 bp, Homo sapiens
ttagacactttacctctt

SEQ ID NO: 5331949 - DNA, 14 bp, Homo sapiens
ttagacagaacacc

SEQ ID NO: 5331950 - DNA, 13 bp, Homo sapiens
ttagacagagtct

SEQ ID NO: 5331951 - DNA, 18 bp, Homo sapiens
ttagacaggttaaatata

SEQ ID NO: 5331952 - DNA, 23 bp, Homo sapiens
ttagacagtcaaggagtggctta

SEQ ID NO: 5331953 - DNA, 14 bp, Homo sapiens
ttagacagtccctg

SEQ ID NO: 5331954 - DNA, 19 bp, Homo sapiens
ttagaccagaggtctagat

SEQ ID NO: 5331955 - DNA, 17 bp, Homo sapiens
ttagacccctgggtggg

SEQ ID NO: 5331956 - DNA, 16 bp, Homo sapiens
ttagacccgccaggtc

SEQ ID NO: 5331957 - DNA, 11 bp, Homo sapiens
ttagaccctgt

SEQ ID NO: 5331958 - DNA, 13 bp, Homo sapiens
ttagacctacagg

SEQ ID NO: 5331959 - DNA, 16 bp, Homo sapiens
ttagacctatactgaa

SEQ ID NO: 5331960 - DNA, 12 bp, Homo sapiens
ttagacctcagc

SEQ ID NO: 5331961 - DNA, 16 bp, Homo sapiens
ttagacctcagcctgt

SEQ ID NO: 5331962 - DNA, 14 bp, Homo sapiens
ttagacctgccagc

SEQ ID NO: 5331963 - DNA, 15 bp, Homo sapiens
ttagacctgtagata

SEQ ID NO: 5331964 - DNA, 21 bp, Homo sapiens
ttagacctgtagatagtgata

SEQ ID NO: 5331965 - DNA, 15 bp, Homo sapiens
ttagaccttatgtta

SEQ ID NO: 5331966 - DNA, 15 bp, Homo sapiens
ttagacgatcacaga

SEQ ID NO: 5331967 - DNA, 14 bp, Homo sapiens
ttagactacattta

SEQ ID NO: 5331968 - DNA, 21 bp, Homo sapiens
ttagactagttgaacatctca

SEQ ID NO: 5331969 - DNA, 14 bp, Homo sapiens
ttagactatttctt

SEQ ID NO: 5331970 - DNA, 13 bp, Homo sapiens
ttagactcaaaga

SEQ ID NO: 5331971 - DNA, 19 bp, Homo sapiens
ttagactcatcttactgta

SEQ ID NO: 5331972 - DNA, 22 bp, Homo sapiens
ttagactcatggtgtgttacac

SEQ ID NO: 5331973 - DNA, 16 bp, Homo sapiens
ttagactgccagctct

SEQ ID NO: 5331974 - DNA, 17 bp, Homo sapiens
ttagactgccagctctt

SEQ ID NO: 5331975 - DNA, 16 bp, Homo sapiens
ttagactggaacttga

SEQ ID NO: 5331976 - DNA, 17 bp, Homo sapiens
ttagactggaacttgaa

SEQ ID NO: 5331977 - DNA, 16 bp, Homo sapiens
ttagactggacagctt

SEQ ID NO: 5331978 - DNA, 19 bp, Homo sapiens
ttagactggacagcttgtg

SEQ ID NO: 5331979 - DNA, 22 bp, Homo sapiens
ttagactgttgggacagccatt

SEQ ID NO: 5331980 - DNA, 23 bp, Homo sapiens
ttagactgttgggacagccattt

SEQ ID NO: 5331981 - DNA, 20 bp, Homo sapiens
ttagactgttggggtgggta

SEQ ID NO: 5331982 - DNA, 15 bp, Homo sapiens
ttagacttactatta

SEQ ID NO: 5331983 - DNA, 15 bp, Homo sapiens
ttagacttctgtttt

SEQ ID NO: 5331984 - DNA, 18 bp, Homo sapiens
ttagacttctgttttcaa

SEQ ID NO: 5331985 - DNA, 12 bp, Homo sapiens
ttagacttgaaa

SEQ ID NO: 5331986 - DNA, 17 bp, Homo sapiens
ttagacttgaaatacta

SEQ ID NO: 5331987 - DNA, 17 bp, Homo sapiens
ttagacttgtgtgcatg

SEQ ID NO: 5331988 - DNA, 21 bp, Homo sapiens
ttagactttaacataagctat

SEQ ID NO: 5331989 - DNA, 21 bp, Homo sapiens
ttagacttttccaatatgtga

SEQ ID NO: 5331990 - DNA, 12 bp, Homo sapiens
ttagagaaaacc

SEQ ID NO: 5331991 - DNA, 15 bp, Homo sapiens
ttagagaaaacctta

SEQ ID NO: 5331992 - DNA, 18 bp, Homo sapiens
ttagagaaaaccttaaaa

SEQ ID NO: 5331993 - DNA, 12 bp, Homo sapiens
ttagagaaaata

SEQ ID NO: 5331994 - DNA, 24 bp, Homo sapiens
ttagagaaatacatgttgtaaatg

SEQ ID NO: 5331995 - DNA, 14 bp, Homo sapiens
ttagagaactgaaa

SEQ ID NO: 5331996 - DNA, 21 bp, Homo sapiens
ttagagaactgaaaagagagc

SEQ ID NO: 5331997 - DNA, 13 bp, Homo sapiens
ttagagaactgga

SEQ ID NO: 5331998 - DNA, 13 bp, Homo sapiens
ttagagaagccat

SEQ ID NO: 5331999 - DNA, 12 bp, Homo sapiens
ttagagaataaa

SEQ ID NO: 5332000 - DNA, 18 bp, Homo sapiens
ttagagaatgtgtttcaa

SEQ ID NO: 5332001 - DNA, 12 bp, Homo sapiens
ttagagacaggg

SEQ ID NO: 5332002 - DNA, 20 bp, Homo sapiens
ttagagacagggtcctgcta

SEQ ID NO: 5332003 - DNA, 23 bp, Homo sapiens
ttagagacagttgggtgagaaca

SEQ ID NO: 5332004 - DNA, 15 bp, Homo sapiens
ttagagagaaagaga

SEQ ID NO: 5332005 - DNA, 12 bp, Homo sapiens
ttagagagagga

SEQ ID NO: 5332006 - DNA, 21 bp, Homo sapiens
ttagagagcatctgcaacaaa

SEQ ID NO: 5332007 - DNA, 20 bp, Homo sapiens
ttagagagcctgtcaccaga

SEQ ID NO: 5332008 - DNA, 23 bp, Homo sapiens
ttagagagcctgtcaccagagct

SEQ ID NO: 5332009 - DNA, 20 bp, Homo sapiens
ttagagaggtagcgagctgc

SEQ ID NO: 5332010 - DNA, 21 bp, Homo sapiens
ttagagaggtagcgagctgct

SEQ ID NO: 5332011 - DNA, 16 bp, Homo sapiens
ttagagagtgttgaaa

SEQ ID NO: 5332012 - DNA, 19 bp, Homo sapiens
ttagagataaatatttatg

SEQ ID NO: 5332013 - DNA, 15 bp, Homo sapiens
ttagagataagagtt

SEQ ID NO: 5332014 - DNA, 15 bp, Homo sapiens
ttagagataattgct

SEQ ID NO: 5332015 - DNA, 18 bp, Homo sapiens
ttagagataggaaactga

SEQ ID NO: 5332016 - DNA, 20 bp, Homo sapiens
ttagagataggaaactgaag

SEQ ID NO: 5332017 - DNA, 15 bp, Homo sapiens
ttagagatgttgagt

SEQ ID NO: 5332018 - DNA, 13 bp, Homo sapiens
ttagagattataa

SEQ ID NO: 5332019 - DNA, 20 bp, Homo sapiens
ttagagattgacttcagaaa

SEQ ID NO: 5332020 - DNA, 15 bp, Homo sapiens
ttagagattttacaa

SEQ ID NO: 5332021 - DNA, 20 bp, Homo sapiens
ttagagcaactttctggggc

SEQ ID NO: 5332022 - DNA, 13 bp, Homo sapiens
ttagagcagcctc

SEQ ID NO: 5332023 - DNA, 20 bp, Homo sapiens
ttagagcagcctcgtggagc

SEQ ID NO: 5332024 - DNA, 19 bp, Homo sapiens
ttagagcattaaaataact

SEQ ID NO: 5332025 - DNA, 15 bp, Homo sapiens
ttagagcattgccat

SEQ ID NO: 5332026 - DNA, 16 bp, Homo sapiens
ttagagccaagctgca

SEQ ID NO: 5332027 - DNA, 18 bp, Homo sapiens
ttagagccaagctgcaca

SEQ ID NO: 5332028 - DNA, 21 bp, Homo sapiens
ttagagccaggcacacactgt

SEQ ID NO: 5332029 - DNA, 13 bp, Homo sapiens
ttagagctgcata

SEQ ID NO: 5332030 - DNA, 14 bp, Homo sapiens
ttagagcttccaaa

SEQ ID NO: 5332031 - DNA, 17 bp, Homo sapiens
ttagaggaaaaaaatga

SEQ ID NO: 5332032 - DNA, 20 bp, Homo sapiens
ttagaggaaataagaaaaat

SEQ ID NO: 5332033 - DNA, 23 bp, Homo sapiens
ttagaggataaataataaaggtt

SEQ ID NO: 5332034 - DNA, 17 bp, Homo sapiens
ttagaggcaacaggatt

SEQ ID NO: 5332035 - DNA, 20 bp, Homo sapiens
ttagaggcattgttagttta

SEQ ID NO: 5332036 - DNA, 12 bp, Homo sapiens
ttagaggccagc

SEQ ID NO: 5332037 - DNA, 19 bp, Homo sapiens
ttagaggcttgatgatgat

SEQ ID NO: 5332038 - DNA, 18 bp, Homo sapiens
ttagaggctttcaaatgt

SEQ ID NO: 5332039 - DNA, 19 bp, Homo sapiens
ttagaggctttcaaatgta

SEQ ID NO: 5332040 - DNA, 23 bp, Homo sapiens
ttagagggacagccaaaagtaag

SEQ ID NO: 5332041 - DNA, 18 bp, Homo sapiens
ttagagggaggtgtttaa

SEQ ID NO: 5332042 - DNA, 21 bp, Homo sapiens
ttagagggccttgcttctctt

SEQ ID NO: 5332043 - DNA, 11 bp, Homo sapiens
ttagaggggcc

SEQ ID NO: 5332044 - DNA, 19 bp, Homo sapiens
ttagagggtatttgtggaa

SEQ ID NO: 5332045 - DNA, 17 bp, Homo sapiens
ttagagggtgaaggaga

SEQ ID NO: 5332046 - DNA, 23 bp, Homo sapiens
ttagcccggccaaggacactgat

SEQ ID NO: 5332047 - DNA, 21 bp, Homo sapiens
ttagccctcacattagatcta

SEQ ID NO: 5332048 - DNA, 15 bp, Homo sapiens
ttagcccttccctgc

SEQ ID NO: 5332049 - DNA, 18 bp, Homo sapiens
ttagcccttccctgcctt

SEQ ID NO: 5332050 - DNA, 18 bp, Homo sapiens
ttagccgggcatggtggc

SEQ ID NO: 5332051 - DNA, 21 bp, Homo sapiens
ttagccgtggtgatttagcag

SEQ ID NO: 5332052 - DNA, 12 bp, Homo sapiens
ttagcctcgtct

SEQ ID NO: 5332053 - DNA, 12 bp, Homo sapiens
ttagcctggagc

SEQ ID NO: 5332054 - DNA, 12 bp, Homo sapiens
ttagcctggctg

SEQ ID NO: 5332055 - DNA, 17 bp, Homo sapiens
ttagcctgggcctcctc

SEQ ID NO: 5332056 - DNA, 12 bp, Homo sapiens
ttagcctgtcct

SEQ ID NO: 5332057 - DNA, 18 bp, Homo sapiens
ttagccttgctgtagaga

SEQ ID NO: 5332058 - DNA, 23 bp, Homo sapiens
ttagcctttgacattgatgtgtt

SEQ ID NO: 5332059 - DNA, 17 bp, Homo sapiens
ttagccttttttcccca

SEQ ID NO: 5332060 - DNA, 18 bp, Homo sapiens
ttagccttttttccccag

SEQ ID NO: 5332061 - DNA, 16 bp, Homo sapiens
ttagcgtcaagacatt

SEQ ID NO: 5332062 - DNA, 17 bp, Homo sapiens
ttagcgtcaagacattt

SEQ ID NO: 5332063 - DNA, 18 bp, Homo sapiens
ttagcgtcaagacatttg

SEQ ID NO: 5332064 - DNA, 23 bp, Homo sapiens
ttagcgtccatttcttatttaat

SEQ ID NO: 5332065 - DNA, 14 bp, Homo sapiens
ttagcgttctggac

SEQ ID NO: 5332066 - DNA, 16 bp, Homo sapiens
ttagcgttctggactc

SEQ ID NO: 5332067 - DNA, 14 bp, Homo sapiens
ttagctaaaaatat

SEQ ID NO: 5332068 - DNA, 22 bp, Homo sapiens
ttagctaataaaaagcttttgt

SEQ ID NO: 5332069 - DNA, 21 bp, Homo sapiens
ttagctacaatcctacctttt

SEQ ID NO: 5332070 - DNA, 23 bp, Homo sapiens
ttagctacaatcctaccttttga

SEQ ID NO: 5332071 - DNA, 20 bp, Homo sapiens
ttagctacctttttatattt

SEQ ID NO: 5332072 - DNA, 14 bp, Homo sapiens
ttagctaggatttg

SEQ ID NO: 5332073 - DNA, 21 bp, Homo sapiens
ttagctagttagagactcgcc

SEQ ID NO: 5332074 - DNA, 14 bp, Homo sapiens
ttagctatgtttcc

SEQ ID NO: 5332075 - DNA, 15 bp, Homo sapiens
ttagctattgggagc

SEQ ID NO: 5332076 - DNA, 19 bp, Homo sapiens
ttagctatttatccctttc

SEQ ID NO: 5332077 - DNA, 13 bp, Homo sapiens
ttagctatttctg

SEQ ID NO: 5332078 - DNA, 13 bp, Homo sapiens
ttagctcaatgag

SEQ ID NO: 5332079 - DNA, 17 bp, Homo sapiens
ttagctcactgaatctt

SEQ ID NO: 5332080 - DNA, 23 bp, Homo sapiens
ttagctcagctgagcatggagac

SEQ ID NO: 5332081 - DNA, 18 bp, Homo sapiens
ttagctccataaagtaca

SEQ ID NO: 5332082 - DNA, 14 bp, Homo sapiens
ttagctcccctcca

SEQ ID NO: 5332083 - DNA, 13 bp, Homo sapiens
ttagctcctgtgg

SEQ ID NO: 5332084 - DNA, 13 bp, Homo sapiens
ttagctccttgaa

SEQ ID NO: 5332085 - DNA, 22 bp, Homo sapiens
ttagctctcgcctcaggctttt

SEQ ID NO: 5332086 - DNA, 11 bp, Homo sapiens
ttagctctgag

SEQ ID NO: 5332087 - DNA, 12 bp, Homo sapiens
ttagctctgaga

SEQ ID NO: 5332088 - DNA, 12 bp, Homo sapiens
ttagctctgccc

SEQ ID NO: 5332089 - DNA, 23 bp, Homo sapiens
ttagctctggacgtgaaatactt

SEQ ID NO: 5332090 - DNA, 11 bp, Homo sapiens
ttagctctggg

SEQ ID NO: 5332091 - DNA, 13 bp, Homo sapiens
ttagctctggggg

SEQ ID NO: 5332092 - DNA, 14 bp, Homo sapiens
ttagctctgggggg

SEQ ID NO: 5332093 - DNA, 15 bp, Homo sapiens
ttagctctggggggc

SEQ ID NO: 5332094 - DNA, 14 bp, Homo sapiens
ttagctcttcccac

SEQ ID NO: 5332095 - DNA, 15 bp, Homo sapiens
ttagctgacaaaata

SEQ ID NO: 5332096 - DNA, 10 bp, Homo sapiens
ttagctgagc

SEQ ID NO: 5332097 - DNA, 21 bp, Homo sapiens
ttagctgaggtttagtaatct

SEQ ID NO: 5332098 - DNA, 23 bp, Homo sapiens
ttagctgatgaacttattctgta

SEQ ID NO: 5332099 - DNA, 18 bp, Homo sapiens
ttagctgctcacttaaac

SEQ ID NO: 5332100 - DNA, 16 bp, Homo sapiens
ttagctggcattacag

SEQ ID NO: 5332101 - DNA, 23 bp, Homo sapiens
ttagctggccacagtgagctgat

SEQ ID NO: 5332102 - DNA, 15 bp, Homo sapiens
ttagctggcgcatat

SEQ ID NO: 5332103 - DNA, 20 bp, Homo sapiens
ttagctggtgtcagcccctc

SEQ ID NO: 5332104 - DNA, 13 bp, Homo sapiens
ttagctgtaaata

SEQ ID NO: 5332105 - DNA, 20 bp, Homo sapiens
ttagctgtaaatacatgtgt

SEQ ID NO: 5332106 - DNA, 13 bp, Homo sapiens
ttagctgtaacag

SEQ ID NO: 5332107 - DNA, 16 bp, Homo sapiens
ttagctgtgtgaaata

SEQ ID NO: 5332108 - DNA, 17 bp, Homo sapiens
ttagctgtttactgaca

SEQ ID NO: 5332109 - DNA, 16 bp, Homo sapiens
ttagcttacctgggca

SEQ ID NO: 5332110 - DNA, 17 bp, Homo sapiens
ttagcttagacctcagc

SEQ ID NO: 5332111 - DNA, 16 bp, Homo sapiens
ttagcttcaggaacct

SEQ ID NO: 5332112 - DNA, 14 bp, Homo sapiens
ttagcttcagttgt

SEQ ID NO: 5332113 - DNA, 19 bp, Homo sapiens
ttagcttcagttgttcttt

SEQ ID NO: 5332114 - DNA, 18 bp, Homo sapiens
ttagcttcctccagagga

SEQ ID NO: 5332115 - DNA, 13 bp, Homo sapiens
ttagcttccttaa

SEQ ID NO: 5332116 - DNA, 15 bp, Homo sapiens
ttagcttctctgcca

SEQ ID NO: 5332117 - DNA, 21 bp, Homo sapiens
ttagcttgaaggatctgtttt

SEQ ID NO: 5332118 - DNA, 17 bp, Homo sapiens
ttagcttgcaccttgtc

SEQ ID NO: 5332119 - DNA, 12 bp, Homo sapiens
ttagcttgctta

SEQ ID NO: 5332120 - DNA, 20 bp, Homo sapiens
ttagcttggggacctgaact

SEQ ID NO: 5332121 - DNA, 15 bp, Homo sapiens
ttagctttactgttt

SEQ ID NO: 5332122 - DNA, 19 bp, Homo sapiens
ttagctttgctctgccaac

SEQ ID NO: 5332123 - DNA, 17 bp, Homo sapiens
ttagcttttaccttaaa

SEQ ID NO: 5332124 - DNA, 16 bp, Homo sapiens
ttagctttttaattgt

SEQ ID NO: 5332125 - DNA, 17 bp, Homo sapiens
ttagctttttaattgtt

SEQ ID NO: 5332126 - DNA, 18 bp, Homo sapiens
ttagctttttaattgttg

SEQ ID NO: 5332127 - DNA, 15 bp, Homo sapiens
ttagctttttcctta

SEQ ID NO: 5332128 - DNA, 20 bp, Homo sapiens
ttaggaaaaccagagcctat

SEQ ID NO: 5332129 - DNA, 13 bp, Homo sapiens
ttaggaaaagcat

SEQ ID NO: 5332130 - DNA, 20 bp, Homo sapiens
ttaggaaaataaacagacaa

SEQ ID NO: 5332131 - DNA, 16 bp, Homo sapiens
ttaggaaaggagatca

SEQ ID NO: 5332132 - DNA, 15 bp, Homo sapiens
ttaggaaataaaacc

SEQ ID NO: 5332133 - DNA, 15 bp, Homo sapiens
ttaggaaatgaatgt

SEQ ID NO: 5332134 - DNA, 17 bp, Homo sapiens
ttaggaaatgaatgtgt

SEQ ID NO: 5332135 - DNA, 12 bp, Homo sapiens
ttaggaaattgc

SEQ ID NO: 5332136 - DNA, 17 bp, Homo sapiens
ttaggaacagagtatat

SEQ ID NO: 5332137 - DNA, 17 bp, Homo sapiens
ttaggaacagcagtgtt

SEQ ID NO: 5332138 - DNA, 18 bp, Homo sapiens
ttaggaacagcagtgttc

SEQ ID NO: 5332139 - DNA, 17 bp, Homo sapiens
ttaggaacagtaaaatc

SEQ ID NO: 5332140 - DNA, 15 bp, Homo sapiens
ttaggaagatatcat

SEQ ID NO: 5332141 - DNA, 22 bp, Homo sapiens
ttaggaagatatcatgaaagaa

SEQ ID NO: 5332142 - DNA, 20 bp, Homo sapiens
ttaggaaggcagcattccat

SEQ ID NO: 5332143 - DNA, 19 bp, Homo sapiens
ttaggaagtcacagattct

SEQ ID NO: 5332144 - DNA, 14 bp, Homo sapiens
ttaggaagtgactt

SEQ ID NO: 5332145 - DNA, 13 bp, Homo sapiens
ttaggaagtgtaa

SEQ ID NO: 5332146 - DNA, 20 bp, Homo sapiens
ttaggaagtgtttatgttgt

SEQ ID NO: 5332147 - DNA, 16 bp, Homo sapiens
ttaggaataataaatt

SEQ ID NO: 5332148 - DNA, 15 bp, Homo sapiens
ttaggaatactgttt

SEQ ID NO: 5332149 - DNA, 15 bp, Homo sapiens
ttaggaatatgttca

SEQ ID NO: 5332150 - DNA, 12 bp, Homo sapiens
ttaggaatctct

SEQ ID NO: 5332151 - DNA, 18 bp, Homo sapiens
ttaggaatctcttcacta

SEQ ID NO: 5332152 - DNA, 14 bp, Homo sapiens
ttaggaatgagaag

SEQ ID NO: 5332153 - DNA, 15 bp, Homo sapiens
ttaggaatgagaagt

SEQ ID NO: 5332154 - DNA, 15 bp, Homo sapiens
ttaggaatgctcaat

SEQ ID NO: 5332155 - DNA, 17 bp, Homo sapiens
ttaggaatgctcaatgt

SEQ ID NO: 5332156 - DNA, 18 bp, Homo sapiens
ttaggaatgctcaatgtg

SEQ ID NO: 5332157 - DNA, 19 bp, Homo sapiens
ttaggaattgtttatacac

SEQ ID NO: 5332158 - DNA, 14 bp, Homo sapiens
ttaggacaaggctg

SEQ ID NO: 5332159 - DNA, 21 bp, Homo sapiens
ttaggacaatcagtcccctcc

SEQ ID NO: 5332160 - DNA, 19 bp, Homo sapiens
ttaggactacattttgctc

SEQ ID NO: 5332161 - DNA, 13 bp, Homo sapiens
ttaggactagaag

SEQ ID NO: 5332162 - DNA, 12 bp, Homo sapiens
ttaggagaagcc

SEQ ID NO: 5332163 - DNA, 23 bp, Homo sapiens
ttaggagattttaggtgttgatt

SEQ ID NO: 5332164 - DNA, 12 bp, Homo sapiens
ttaggaggctga

SEQ ID NO: 5332165 - DNA, 19 bp, Homo sapiens
ttaggagggagttatctaa

SEQ ID NO: 5332166 - DNA, 20 bp, Homo sapiens
ttaggagtggttctcatttg

SEQ ID NO: 5332167 - DNA, 19 bp, Homo sapiens
ttaggataactaaaattct

SEQ ID NO: 5332168 - DNA, 20 bp, Homo sapiens
ttaggatagaatatttacaa

SEQ ID NO: 5332169 - DNA, 14 bp, Homo sapiens
ttaggatatttgag

SEQ ID NO: 5332170 - DNA, 14 bp, Homo sapiens
ttaggatccatgca

SEQ ID NO: 5332171 - DNA, 19 bp, Homo sapiens
ttaggatctatgcaatttt

SEQ ID NO: 5332172 - DNA, 20 bp, Homo sapiens
ttaggatctatgcaattttt

SEQ ID NO: 5332173 - DNA, 14 bp, Homo sapiens
ttaggatctgcaaa

SEQ ID NO: 5332174 - DNA, 18 bp, Homo sapiens
ttaggatggggctcccag

SEQ ID NO: 5332175 - DNA, 15 bp, Homo sapiens
ttaggatgggggaga

SEQ ID NO: 5332176 - DNA, 11 bp, Homo sapiens
ttaggattcag

SEQ ID NO: 5332177 - DNA, 20 bp, Homo sapiens
ttaggattcaggcagcagtg

SEQ ID NO: 5332178 - DNA, 12 bp, Homo sapiens
ttaggattcccc

SEQ ID NO: 5332179 - DNA, 13 bp, Homo sapiens
ttaggattgaagt

SEQ ID NO: 5332180 - DNA, 23 bp, Homo sapiens
ttaggattgggggatgtgaagaa

SEQ ID NO: 5332181 - DNA, 14 bp, Homo sapiens
ttaggcaaaaataa

SEQ ID NO: 5332182 - DNA, 14 bp, Homo sapiens
ttaggcaaaacctt

SEQ ID NO: 5332183 - DNA, 19 bp, Homo sapiens
ttaggcaaagataatttat

SEQ ID NO: 5332184 - DNA, 19 bp, Homo sapiens
ttaggcaaagtacaaaatt

SEQ ID NO: 5332185 - DNA, 15 bp, Homo sapiens
ttaggcactgcttta

SEQ ID NO: 5332186 - DNA, 17 bp, Homo sapiens
ttaggcactttttaaca

SEQ ID NO: 5332187 - DNA, 15 bp, Homo sapiens
ttaggcagactcttt

SEQ ID NO: 5332188 - DNA, 13 bp, Homo sapiens
ttaggcagcagct

SEQ ID NO: 5332189 - DNA, 21 bp, Homo sapiens
ttaggcaggaagtcaggagcc

SEQ ID NO: 5332190 - DNA, 23 bp, Homo sapiens
ttaggcaggaagtcaggagccag

SEQ ID NO: 5332191 - DNA, 16 bp, Homo sapiens
ttaggcattatttaat

SEQ ID NO: 5332192 - DNA, 18 bp, Homo sapiens
ttaggcattatttaatgt

SEQ ID NO: 5332193 - DNA, 16 bp, Homo sapiens
ttaggcatttcctgct

SEQ ID NO: 5332194 - DNA, 18 bp, Homo sapiens
ttaggcatttcctgctga

SEQ ID NO: 5332195 - DNA, 19 bp, Homo sapiens
ttaggcatttcctgctgaa

SEQ ID NO: 5332196 - DNA, 22 bp, Homo sapiens
ttaggccaaaaaaatgtaagat

SEQ ID NO: 5332197 - DNA, 19 bp, Homo sapiens
ttaggccaaagacaaatag

SEQ ID NO: 5332198 - DNA, 15 bp, Homo sapiens
ttaggccccgtggtg

SEQ ID NO: 5332199 - DNA, 11 bp, Homo sapiens
ttaggcctcct

SEQ ID NO: 5332200 - DNA, 15 bp, Homo sapiens
ttaggcctggcacag

SEQ ID NO: 5332201 - DNA, 21 bp, Homo sapiens
ttaggcctggtgtgttcaaga

SEQ ID NO: 5332202 - DNA, 13 bp, Homo sapiens
ttaggccttggct

SEQ ID NO: 5332203 - DNA, 22 bp, Homo sapiens
ttaggcgcccatggtacaagga

SEQ ID NO: 5332204 - DNA, 14 bp, Homo sapiens
ttaggcgggagctc

SEQ ID NO: 5332205 - DNA, 15 bp, Homo sapiens
ttaggctattcacaa

SEQ ID NO: 5332206 - DNA, 16 bp, Homo sapiens
ttaggctatttgtaaa

SEQ ID NO: 5332207 - DNA, 22 bp, Homo sapiens
ttaggctatttgtaaatctgcc

SEQ ID NO: 5332208 - DNA, 23 bp, Homo sapiens
ttaggctatttgtaaatctgcca

SEQ ID NO: 5332209 - DNA, 17 bp, Homo sapiens
ttaggctgctgggatgg

SEQ ID NO: 5332210 - DNA, 14 bp, Homo sapiens
ttaggctgggccca

SEQ ID NO: 5332211 - DNA, 16 bp, Homo sapiens
ttaggctgggcccaga

SEQ ID NO: 5332212 - DNA, 17 bp, Homo sapiens
ttaggctgggcccagag

SEQ ID NO: 5332213 - DNA, 13 bp, Homo sapiens
ttaggctgtaaag

SEQ ID NO: 5332214 - DNA, 21 bp, Homo sapiens
ttaggctgtgtcaccattgtg

SEQ ID NO: 5332215 - DNA, 14 bp, Homo sapiens
ttagggaaaacatt

SEQ ID NO: 5332216 - DNA, 17 bp, Homo sapiens
ttagggaaaacattcca

SEQ ID NO: 5332217 - DNA, 16 bp, Homo sapiens
ttagggaacaatttgg

SEQ ID NO: 5332218 - DNA, 13 bp, Homo sapiens
ttagggaagagaa

SEQ ID NO: 5332219 - DNA, 17 bp, Homo sapiens
ttagggaagagaaacag

SEQ ID NO: 5332220 - DNA, 18 bp, Homo sapiens
ttagggaagagaaacagg

SEQ ID NO: 5332221 - DNA, 23 bp, Homo sapiens
ttagggactacccatagacatga

SEQ ID NO: 5332222 - DNA, 13 bp, Homo sapiens
ttagggagaaaat

SEQ ID NO: 5332223 - DNA, 22 bp, Homo sapiens
ttagggagacccaataaagaat

SEQ ID NO: 5332224 - DNA, 14 bp, Homo sapiens
ttagggagagaaga

SEQ ID NO: 5332225 - DNA, 23 bp, Homo sapiens
ttagggagagtcatattttgatt

SEQ ID NO: 5332226 - DNA, 16 bp, Homo sapiens
ttataactaatatggt

SEQ ID NO: 5332227 - DNA, 18 bp, Homo sapiens
ttataactaatatggttt

SEQ ID NO: 5332228 - DNA, 19 bp, Homo sapiens
ttataactagacatctgct

SEQ ID NO: 5332229 - DNA, 12 bp, Homo sapiens
ttataactatta

SEQ ID NO: 5332230 - DNA, 17 bp, Homo sapiens
ttataactattacagtg

SEQ ID NO: 5332231 - DNA, 19 bp, Homo sapiens
ttataactcatcataaaat

SEQ ID NO: 5332232 - DNA, 22 bp, Homo sapiens
ttataactcatcataaaataaa

SEQ ID NO: 5332233 - DNA, 17 bp, Homo sapiens
ttataactctgtataat

SEQ ID NO: 5332234 - DNA, 22 bp, Homo sapiens
ttataactgaaatactttactt

SEQ ID NO: 5332235 - DNA, 18 bp, Homo sapiens
ttataactgaaggagaag

SEQ ID NO: 5332236 - DNA, 18 bp, Homo sapiens
ttataactgtaaagatgt

SEQ ID NO: 5332237 - DNA, 19 bp, Homo sapiens
ttataactgttttagaaat

SEQ ID NO: 5332238 - DNA, 13 bp, Homo sapiens
ttataacttaaaa

SEQ ID NO: 5332239 - DNA, 21 bp, Homo sapiens
ttataacttaatgaaaacaat

SEQ ID NO: 5332240 - DNA, 14 bp, Homo sapiens
ttataagaaaaact

SEQ ID NO: 5332241 - DNA, 16 bp, Homo sapiens
ttataagaaaacatgt

SEQ ID NO: 5332242 - DNA, 22 bp, Homo sapiens
ttataagaaaacatgtaaaggg

SEQ ID NO: 5332243 - DNA, 14 bp, Homo sapiens
ttataagaagagga

SEQ ID NO: 5332244 - DNA, 17 bp, Homo sapiens
ttataagacaaaattta

SEQ ID NO: 5332245 - DNA, 13 bp, Homo sapiens
ttataagactctc

SEQ ID NO: 5332246 - DNA, 14 bp, Homo sapiens
ttataagactctca

SEQ ID NO: 5332247 - DNA, 18 bp, Homo sapiens
ttataagagggaacaaat

SEQ ID NO: 5332248 - DNA, 23 bp, Homo sapiens
ttataagatttttaggtgtcttt

SEQ ID NO: 5332249 - DNA, 15 bp, Homo sapiens
ttataagcaacatga

SEQ ID NO: 5332250 - DNA, 16 bp, Homo sapiens
ttataagcacagacaa

SEQ ID NO: 5332251 - DNA, 22 bp, Homo sapiens
ttataagcacagacaattctaa

SEQ ID NO: 5332252 - DNA, 13 bp, Homo sapiens
ttataagcatcat

SEQ ID NO: 5332253 - DNA, 17 bp, Homo sapiens
ttataagcattgaaatt

SEQ ID NO: 5332254 - DNA, 20 bp, Homo sapiens
ttataagccaaaggttcaga

SEQ ID NO: 5332255 - DNA, 21 bp, Homo sapiens
ttataagcccaaatggctctg

SEQ ID NO: 5332256 - DNA, 15 bp, Homo sapiens
ttataagccttatga

SEQ ID NO: 5332257 - DNA, 14 bp, Homo sapiens
ttataagcgtattt

SEQ ID NO: 5332258 - DNA, 23 bp, Homo sapiens
ttataagctatgtcactaccctc

SEQ ID NO: 5332259 - DNA, 17 bp, Homo sapiens
ttataaggaaattttac

SEQ ID NO: 5332260 - DNA, 11 bp, Homo sapiens
ttataaggact

SEQ ID NO: 5332261 - DNA, 18 bp, Homo sapiens
ttataaggccatttcctt

SEQ ID NO: 5332262 - DNA, 15 bp, Homo sapiens
ttataagggccctgc

SEQ ID NO: 5332263 - DNA, 14 bp, Homo sapiens
ttataaggtgtttt

SEQ ID NO: 5332264 - DNA, 18 bp, Homo sapiens
ttataagtagcaggccaa

SEQ ID NO: 5332265 - DNA, 17 bp, Homo sapiens
ttataagtgaagtgata

SEQ ID NO: 5332266 - DNA, 20 bp, Homo sapiens
ttataagtgactttaaactt

SEQ ID NO: 5332267 - DNA, 21 bp, Homo sapiens
ttataagtgactttaaacttt

SEQ ID NO: 5332268 - DNA, 17 bp, Homo sapiens
ttataagttcacaaaat

SEQ ID NO: 5332269 - DNA, 15 bp, Homo sapiens
ttataataatgttaa

SEQ ID NO: 5332270 - DNA, 14 bp, Homo sapiens
ttataataatgttc

SEQ ID NO: 5332271 - DNA, 19 bp, Homo sapiens
ttataataatgttctctgg

SEQ ID NO: 5332272 - DNA, 15 bp, Homo sapiens
ttataatacaaataa

SEQ ID NO: 5332273 - DNA, 21 bp, Homo sapiens
ttataatactactactgttat

SEQ ID NO: 5332274 - DNA, 20 bp, Homo sapiens
ttataataggtatatagaac

SEQ ID NO: 5332275 - DNA, 13 bp, Homo sapiens
ttataatatagaa

SEQ ID NO: 5332276 - DNA, 14 bp, Homo sapiens
ttataatatgtgcc

SEQ ID NO: 5332277 - DNA, 19 bp, Homo sapiens
ttataatattcatacaaca

SEQ ID NO: 5332278 - DNA, 23 bp, Homo sapiens
ttataatattcatacaacaaaga

SEQ ID NO: 5332279 - DNA, 21 bp, Homo sapiens
ttataatcaagacaagtgttt

SEQ ID NO: 5332280 - DNA, 16 bp, Homo sapiens
ttataatctcaaagga

SEQ ID NO: 5332281 - DNA, 13 bp, Homo sapiens
ttataatctccaa

SEQ ID NO: 5332282 - DNA, 16 bp, Homo sapiens
ttataatctccaactt

SEQ ID NO: 5332283 - DNA, 22 bp, Homo sapiens
ttataatctgatgggcctggct

SEQ ID NO: 5332284 - DNA, 18 bp, Homo sapiens
ttataatcttataattgt

SEQ ID NO: 5332285 - DNA, 15 bp, Homo sapiens
ttataatgaatactt

SEQ ID NO: 5332286 - DNA, 12 bp, Homo sapiens
ttataatgattc

SEQ ID NO: 5332287 - DNA, 22 bp, Homo sapiens
ttataatgcaatgataaataaa

SEQ ID NO: 5332288 - DNA, 18 bp, Homo sapiens
ttataatgccagaatata

SEQ ID NO: 5332289 - DNA, 13 bp, Homo sapiens
ttataatggctct

SEQ ID NO: 5332290 - DNA, 21 bp, Homo sapiens
ttataatgggcattactgaat

SEQ ID NO: 5332291 - DNA, 13 bp, Homo sapiens
ttataatgggtaa

SEQ ID NO: 5332292 - DNA, 22 bp, Homo sapiens
ttataatgtattcatatttgta

SEQ ID NO: 5332293 - DNA, 17 bp, Homo sapiens
ttataatgtatttgaaa

SEQ ID NO: 5332294 - DNA, 18 bp, Homo sapiens
ttataatgtatttgaaaa

SEQ ID NO: 5332295 - DNA, 13 bp, Homo sapiens
ttataattaaaga

SEQ ID NO: 5332296 - DNA, 21 bp, Homo sapiens
ttataattaaagaaaattgcc

SEQ ID NO: 5332297 - DNA, 22 bp, Homo sapiens
ttataattaaagaaaattgcca

SEQ ID NO: 5332298 - DNA, 23 bp, Homo sapiens
ttataattaaagaaaattgccaa

SEQ ID NO: 5332299 - DNA, 14 bp, Homo sapiens
ttataattaaagat

SEQ ID NO: 5332300 - DNA, 20 bp, Homo sapiens
ttataattagagttgtgata

SEQ ID NO: 5332301 - DNA, 22 bp, Homo sapiens
ttataattagtcgggcatgagt

SEQ ID NO: 5332302 - DNA, 11 bp, Homo sapiens
ttataattcag

SEQ ID NO: 5332303 - DNA, 14 bp, Homo sapiens
ttataattcagtat

SEQ ID NO: 5332304 - DNA, 13 bp, Homo sapiens
ttataattctttc

SEQ ID NO: 5332305 - DNA, 21 bp, Homo sapiens
ttataattggtgctatttgaa

SEQ ID NO: 5332306 - DNA, 14 bp, Homo sapiens
ttataattgtatca

SEQ ID NO: 5332307 - DNA, 15 bp, Homo sapiens
ttataattgtcatga

SEQ ID NO: 5332308 - DNA, 21 bp, Homo sapiens
ttataattgtcatgactttca

SEQ ID NO: 5332309 - DNA, 15 bp, Homo sapiens
ttataattgttgcat

SEQ ID NO: 5332310 - DNA, 14 bp, Homo sapiens
ttataattgtttat

SEQ ID NO: 5332311 - DNA, 16 bp, Homo sapiens
ttataatttaaatgat

SEQ ID NO: 5332312 - DNA, 13 bp, Homo sapiens
ttataatttcaat

SEQ ID NO: 5332313 - DNA, 13 bp, Homo sapiens
ttataatttccaa

SEQ ID NO: 5332314 - DNA, 24 bp, Homo sapiens
ttataatttgatagatgtttgact

SEQ ID NO: 5332315 - DNA, 12 bp, Homo sapiens
ttataattttaa

SEQ ID NO: 5332316 - DNA, 12 bp, Homo sapiens
ttataattttat

SEQ ID NO: 5332317 - DNA, 18 bp, Homo sapiens
ttataattttatctgtat

SEQ ID NO: 5332318 - DNA, 19 bp, Homo sapiens
ttataattttatctgtata

SEQ ID NO: 5332319 - DNA, 14 bp, Homo sapiens
ttataattttccta

SEQ ID NO: 5332320 - DNA, 14 bp, Homo sapiens
ttataattttctaa

SEQ ID NO: 5332321 - DNA, 15 bp, Homo sapiens
ttataattttgtgaa

SEQ ID NO: 5332322 - DNA, 16 bp, Homo sapiens
ttataattttgtgaag

SEQ ID NO: 5332323 - DNA, 17 bp, Homo sapiens
ttataattttgtgaagc

SEQ ID NO: 5332324 - DNA, 12 bp, Homo sapiens
ttatacaaagaa

SEQ ID NO: 5332325 - DNA, 13 bp, Homo sapiens
ttatacaaagaaa

SEQ ID NO: 5332326 - DNA, 15 bp, Homo sapiens
ttatacaaagaaact

SEQ ID NO: 5332327 - DNA, 12 bp, Homo sapiens
ttatacaaagac

SEQ ID NO: 5332328 - DNA, 18 bp, Homo sapiens
ttatacaaattaaaaaga

SEQ ID NO: 5332329 - DNA, 16 bp, Homo sapiens
ttatacaacagtgcta

SEQ ID NO: 5332330 - DNA, 17 bp, Homo sapiens
ttatacaacagtgctaa

SEQ ID NO: 5332331 - DNA, 16 bp, Homo sapiens
ttatacaaccttcatt

SEQ ID NO: 5332332 - DNA, 21 bp, Homo sapiens
ttatacaagaagggagattca

SEQ ID NO: 5332333 - DNA, 22 bp, Homo sapiens
ttatacaatttccatatagtct

SEQ ID NO: 5332334 - DNA, 16 bp, Homo sapiens
ttatacacaacattta

SEQ ID NO: 5332335 - DNA, 17 bp, Homo sapiens
ttatacacaacatttat

SEQ ID NO: 5332336 - DNA, 12 bp, Homo sapiens
ttatacacataa

SEQ ID NO: 5332337 - DNA, 13 bp, Homo sapiens
ttatacactgtaa

SEQ ID NO: 5332338 - DNA, 14 bp, Homo sapiens
ttatacactgtaag

SEQ ID NO: 5332339 - DNA, 18 bp, Homo sapiens
ttatacactgtaagcttt

SEQ ID NO: 5332340 - DNA, 15 bp, Homo sapiens
ttatacactgtaatg

SEQ ID NO: 5332341 - DNA, 23 bp, Homo sapiens
ttatacacttctggctcacagga

SEQ ID NO: 5332342 - DNA, 16 bp, Homo sapiens
ttatacagacctaata

SEQ ID NO: 5332343 - DNA, 21 bp, Homo sapiens
ttatacagagtaattatagga

SEQ ID NO: 5332344 - DNA, 22 bp, Homo sapiens
ttatacagatagagttccatat

SEQ ID NO: 5332345 - DNA, 16 bp, Homo sapiens
ttatacagattttcta

SEQ ID NO: 5332346 - DNA, 18 bp, Homo sapiens
ttatacagctcagctttt

SEQ ID NO: 5332347 - DNA, 21 bp, Homo sapiens
ttatacagctgtattgtctga

SEQ ID NO: 5332348 - DNA, 15 bp, Homo sapiens
ttatacagttttaaa

SEQ ID NO: 5332349 - DNA, 16 bp, Homo sapiens
ttatacagttttaaag

SEQ ID NO: 5332350 - DNA, 18 bp, Homo sapiens
ttatacagttttaaagaa

SEQ ID NO: 5332351 - DNA, 19 bp, Homo sapiens
ttatacagttttaaagaat

SEQ ID NO: 5332352 - DNA, 11 bp, Homo sapiens
ttatacataaa

SEQ ID NO: 5332353 - DNA, 19 bp, Homo sapiens
ttatacatagtcacaaaaa

SEQ ID NO: 5332354 - DNA, 15 bp, Homo sapiens
ttatacatatcagaa

SEQ ID NO: 5332355 - DNA, 16 bp, Homo sapiens
ttatacatatcagaaa

SEQ ID NO: 5332356 - DNA, 17 bp, Homo sapiens
ttatacatatcagaaaa

SEQ ID NO: 5332357 - DNA, 18 bp, Homo sapiens
ttatacatatcagaaaag

SEQ ID NO: 5332358 - DNA, 20 bp, Homo sapiens
ttatacatatcagaaaagta

SEQ ID NO: 5332359 - DNA, 14 bp, Homo sapiens
ttatacatcaatat

SEQ ID NO: 5332360 - DNA, 18 bp, Homo sapiens
ttatacatcaatatgtat

SEQ ID NO: 5332361 - DNA, 19 bp, Homo sapiens
ttatacatcaatatgtata

SEQ ID NO: 5332362 - DNA, 16 bp, Homo sapiens
ttatacatctgtattt

SEQ ID NO: 5332363 - DNA, 16 bp, Homo sapiens
ttatacatgacactga

SEQ ID NO: 5332364 - DNA, 14 bp, Homo sapiens
ttatacattagtaa

SEQ ID NO: 5332365 - DNA, 18 bp, Homo sapiens
ttatacatttaaagattt

SEQ ID NO: 5332366 - DNA, 22 bp, Homo sapiens
ttataccaaaatgttgctgaaa

SEQ ID NO: 5332367 - DNA, 19 bp, Homo sapiens
ttataccagatgaacattt

SEQ ID NO: 5332368 - DNA, 13 bp, Homo sapiens
ttataccagctta

SEQ ID NO: 5332369 - DNA, 19 bp, Homo sapiens
ttataccatgtgtgctaat

SEQ ID NO: 5332370 - DNA, 16 bp, Homo sapiens
ttataccattcagatc

SEQ ID NO: 5332371 - DNA, 18 bp, Homo sapiens
ttatacccagaaagttat

SEQ ID NO: 5332372 - DNA, 22 bp, Homo sapiens
ttatacccccaggaaactagct

SEQ ID NO: 5332373 - DNA, 18 bp, Homo sapiens
ttataccctttttcattt

SEQ ID NO: 5332374 - DNA, 13 bp, Homo sapiens
ttataccgcagag

SEQ ID NO: 5332375 - DNA, 18 bp, Homo sapiens
ttataccgcagagtattt

SEQ ID NO: 5332376 - DNA, 14 bp, Homo sapiens
ttatacctcaattt

SEQ ID NO: 5332377 - DNA, 21 bp, Homo sapiens
ttatacctcaattttcactgt

SEQ ID NO: 5332378 - DNA, 18 bp, Homo sapiens
ttatacctgtacacacac

SEQ ID NO: 5332379 - DNA, 14 bp, Homo sapiens
ttatacctgttgct

SEQ ID NO: 5332380 - DNA, 12 bp, Homo sapiens
ttatacctgttt

SEQ ID NO: 5332381 - DNA, 14 bp, Homo sapiens
ttatacctttgaaa

SEQ ID NO: 5332382 - DNA, 14 bp, Homo sapiens
ttatacgaaataat

SEQ ID NO: 5332383 - DNA, 15 bp, Homo sapiens
ttatacggaaaaaat

SEQ ID NO: 5332384 - DNA, 18 bp, Homo sapiens
ttatactaacttatttat

SEQ ID NO: 5332385 - DNA, 12 bp, Homo sapiens
ttatactaagaa

SEQ ID NO: 5332386 - DNA, 19 bp, Homo sapiens
ttatactatttattaaaac

SEQ ID NO: 5332387 - DNA, 14 bp, Homo sapiens
ttatactcagaact

SEQ ID NO: 5332388 - DNA, 16 bp, Homo sapiens
ttatactcagaactgt

SEQ ID NO: 5332389 - DNA, 19 bp, Homo sapiens
ttatactcttcctattttt

SEQ ID NO: 5332390 - DNA, 14 bp, Homo sapiens
ttatactgagcttt

SEQ ID NO: 5332391 - DNA, 22 bp, Homo sapiens
ttatactgagcttttgagtgtt

SEQ ID NO: 5332392 - DNA, 14 bp, Homo sapiens
ttatactgcacttt

SEQ ID NO: 5332393 - DNA, 24 bp, Homo sapiens
ttatactgggacaccattaccaaa

SEQ ID NO: 5332394 - DNA, 17 bp, Homo sapiens
ttatactgtacaataaa

SEQ ID NO: 5332395 - DNA, 18 bp, Homo sapiens
ttatactgtacaataaaa

SEQ ID NO: 5332396 - DNA, 22 bp, Homo sapiens
ttatactgtacttaataaattc

SEQ ID NO: 5332397 - DNA, 17 bp, Homo sapiens
ttatactgtagatttca

SEQ ID NO: 5332398 - DNA, 19 bp, Homo sapiens
ttatactgtaggtgttatg

SEQ ID NO: 5332399 - DNA, 21 bp, Homo sapiens
ttatactgtaggtgttatgta

SEQ ID NO: 5332400 - DNA, 14 bp, Homo sapiens
ttatactgtattaa

SEQ ID NO: 5332401 - DNA, 12 bp, Homo sapiens
ttatactgtgaa

SEQ ID NO: 5332402 - DNA, 19 bp, Homo sapiens
ttatactgtgaagttacat

SEQ ID NO: 5332403 - DNA, 21 bp, Homo sapiens
ttatactgtgaagttacatgc

SEQ ID NO: 5332404 - DNA, 17 bp, Homo sapiens
ttatacttaaacagctt

SEQ ID NO: 5332405 - DNA, 18 bp, Homo sapiens
ttatatgttgtaatattt

SEQ ID NO: 5332406 - DNA, 17 bp, Homo sapiens
ttatattaaaaataggt

SEQ ID NO: 5332407 - DNA, 15 bp, Homo sapiens
ttatattaaaatatg

SEQ ID NO: 5332408 - DNA, 21 bp, Homo sapiens
ttatattaaaatatgaaggtt

SEQ ID NO: 5332409 - DNA, 16 bp, Homo sapiens
ttatattaaagaaaaa

SEQ ID NO: 5332410 - DNA, 18 bp, Homo sapiens
ttatattaaataacatgt

SEQ ID NO: 5332411 - DNA, 17 bp, Homo sapiens
ttatattaaccagatat

SEQ ID NO: 5332412 - DNA, 14 bp, Homo sapiens
ttatattaatttgt

SEQ ID NO: 5332413 - DNA, 19 bp, Homo sapiens
ttatattactgtcttttct

SEQ ID NO: 5332414 - DNA, 14 bp, Homo sapiens
ttatattacttttg

SEQ ID NO: 5332415 - DNA, 20 bp, Homo sapiens
ttatattacttttgtaaata

SEQ ID NO: 5332416 - DNA, 16 bp, Homo sapiens
ttatattagagtcaga

SEQ ID NO: 5332417 - DNA, 21 bp, Homo sapiens
ttatattatccataggtttct

SEQ ID NO: 5332418 - DNA, 16 bp, Homo sapiens
ttatattatgaagctt

SEQ ID NO: 5332419 - DNA, 13 bp, Homo sapiens
ttatattatgaat

SEQ ID NO: 5332420 - DNA, 16 bp, Homo sapiens
ttatattatttacatt

SEQ ID NO: 5332421 - DNA, 14 bp, Homo sapiens
ttatattcaaccat

SEQ ID NO: 5332422 - DNA, 18 bp, Homo sapiens
ttatattcaatgcattta

SEQ ID NO: 5332423 - DNA, 13 bp, Homo sapiens
ttatattcacaga

SEQ ID NO: 5332424 - DNA, 16 bp, Homo sapiens
ttatattcacagtttt

SEQ ID NO: 5332425 - DNA, 23 bp, Homo sapiens
ttatattcataaagttacagttt

SEQ ID NO: 5332426 - DNA, 19 bp, Homo sapiens
ttatattcattcagatata

SEQ ID NO: 5332427 - DNA, 22 bp, Homo sapiens
ttatattcattcagatataaga

SEQ ID NO: 5332428 - DNA, 15 bp, Homo sapiens
ttatattccaaggaa

SEQ ID NO: 5332429 - DNA, 22 bp, Homo sapiens
ttatattccaaggaaaattgaa

SEQ ID NO: 5332430 - DNA, 18 bp, Homo sapiens
ttatattcccaaatctca

SEQ ID NO: 5332431 - DNA, 20 bp, Homo sapiens
ttatattcccaaatctcaaa

SEQ ID NO: 5332432 - DNA, 20 bp, Homo sapiens
ttatattctaatagtttttc

SEQ ID NO: 5332433 - DNA, 16 bp, Homo sapiens
ttatattctaattaaa

SEQ ID NO: 5332434 - DNA, 17 bp, Homo sapiens
ttatattctaattaaaa

SEQ ID NO: 5332435 - DNA, 20 bp, Homo sapiens
ttatattgaagacaatttga

SEQ ID NO: 5332436 - DNA, 15 bp, Homo sapiens
ttatattgataacag

SEQ ID NO: 5332437 - DNA, 17 bp, Homo sapiens
ttatattgataagatct

SEQ ID NO: 5332438 - DNA, 12 bp, Homo sapiens
ttatattgcctt

SEQ ID NO: 5332439 - DNA, 15 bp, Homo sapiens
ttatattgggaagct

SEQ ID NO: 5332440 - DNA, 18 bp, Homo sapiens
ttatattggtttgcacaa

SEQ ID NO: 5332441 - DNA, 22 bp, Homo sapiens
ttatattgtaagaaatactgta

SEQ ID NO: 5332442 - DNA, 24 bp, Homo sapiens
ttatattgtaagaaatactgtaca

SEQ ID NO: 5332443 - DNA, 12 bp, Homo sapiens
ttatattgtcct

SEQ ID NO: 5332444 - DNA, 17 bp, Homo sapiens
ttatattgttttataaa

SEQ ID NO: 5332445 - DNA, 19 bp, Homo sapiens
ttatattgttttgtctcct

SEQ ID NO: 5332446 - DNA, 20 bp, Homo sapiens
ttatattgtttttgtattta

SEQ ID NO: 5332447 - DNA, 13 bp, Homo sapiens
ttatatttaactc

SEQ ID NO: 5332448 - DNA, 11 bp, Homo sapiens
ttatatttaat

SEQ ID NO: 5332449 - DNA, 17 bp, Homo sapiens
ttatatttagttatagt

SEQ ID NO: 5332450 - DNA, 22 bp, Homo sapiens
ttatatttagttatagtttcag

SEQ ID NO: 5332451 - DNA, 18 bp, Homo sapiens
ttatatttatgtgtctgt

SEQ ID NO: 5332452 - DNA, 19 bp, Homo sapiens
ttatatttattatataagt

SEQ ID NO: 5332453 - DNA, 17 bp, Homo sapiens
ttatatttattgttaga

SEQ ID NO: 5332454 - DNA, 11 bp, Homo sapiens
ttatatttcaa

SEQ ID NO: 5332455 - DNA, 12 bp, Homo sapiens
ttatatttcaac

SEQ ID NO: 5332456 - DNA, 18 bp, Homo sapiens
ttatatttcaagtacact

SEQ ID NO: 5332457 - DNA, 13 bp, Homo sapiens
ttatatttcaata

SEQ ID NO: 5332458 - DNA, 19 bp, Homo sapiens
ttatatttcaataaatgat

SEQ ID NO: 5332459 - DNA, 22 bp, Homo sapiens
ttatatttcagatgtaatgttt

SEQ ID NO: 5332460 - DNA, 20 bp, Homo sapiens
ttatatttccctaaaataca

SEQ ID NO: 5332461 - DNA, 13 bp, Homo sapiens
ttatatttccttt

SEQ ID NO: 5332462 - DNA, 14 bp, Homo sapiens
ttatatttccttta

SEQ ID NO: 5332463 - DNA, 22 bp, Homo sapiens
ttatatttcctttatgtgaatt

SEQ ID NO: 5332464 - DNA, 15 bp, Homo sapiens
ttatatttctgtgta

SEQ ID NO: 5332465 - DNA, 14 bp, Homo sapiens
ttatatttgaaaaa

SEQ ID NO: 5332466 - DNA, 15 bp, Homo sapiens
ttatatttgaaaaaa

SEQ ID NO: 5332467 - DNA, 14 bp, Homo sapiens
ttatatttgacatg

SEQ ID NO: 5332468 - DNA, 23 bp, Homo sapiens
ttatatttgagtttctttcagat

SEQ ID NO: 5332469 - DNA, 22 bp, Homo sapiens
ttatatttgctttttaaaagat

SEQ ID NO: 5332470 - DNA, 20 bp, Homo sapiens
ttatatttggatgcagagtt

SEQ ID NO: 5332471 - DNA, 13 bp, Homo sapiens
ttatatttgtatc

SEQ ID NO: 5332472 - DNA, 16 bp, Homo sapiens
ttatattttagaaata

SEQ ID NO: 5332473 - DNA, 17 bp, Homo sapiens
ttatattttatgaacat

SEQ ID NO: 5332474 - DNA, 12 bp, Homo sapiens
ttatattttcaa

SEQ ID NO: 5332475 - DNA, 15 bp, Homo sapiens
ttatattttcgtatg

SEQ ID NO: 5332476 - DNA, 20 bp, Homo sapiens
ttatattttcgtatgaaaat

SEQ ID NO: 5332477 - DNA, 13 bp, Homo sapiens
ttatattttctat

SEQ ID NO: 5332478 - DNA, 15 bp, Homo sapiens
ttatattttctatat

SEQ ID NO: 5332479 - DNA, 17 bp, Homo sapiens
ttatattttctattaca

SEQ ID NO: 5332480 - DNA, 24 bp, Homo sapiens
ttatattttctatttctctgtgta

SEQ ID NO: 5332481 - DNA, 18 bp, Homo sapiens
ttatattttgctgtttat

SEQ ID NO: 5332482 - DNA, 20 bp, Homo sapiens
ttatattttgctgtttatga

SEQ ID NO: 5332483 - DNA, 15 bp, Homo sapiens
ttatatttttaaagg

SEQ ID NO: 5332484 - DNA, 17 bp, Homo sapiens
ttatatttttaataaaa

SEQ ID NO: 5332485 - DNA, 16 bp, Homo sapiens
ttatatttttcaaaat

SEQ ID NO: 5332486 - DNA, 15 bp, Homo sapiens
ttatatttttcttaa

SEQ ID NO: 5332487 - DNA, 20 bp, Homo sapiens
ttatatttttcttaaaaagt

SEQ ID NO: 5332488 - DNA, 19 bp, Homo sapiens
ttatatttttgtacatatt

SEQ ID NO: 5332489 - DNA, 18 bp, Homo sapiens
ttatatttttttaactgt

SEQ ID NO: 5332490 - DNA, 23 bp, Homo sapiens
ttatatttttttaactgtgataa

SEQ ID NO: 5332491 - DNA, 21 bp, Homo sapiens
ttatcaaaaaaagactcagcc

SEQ ID NO: 5332492 - DNA, 17 bp, Homo sapiens
ttatcaaaaaacaagtc

SEQ ID NO: 5332493 - DNA, 20 bp, Homo sapiens
ttatcaaaaaacagaaaaac

SEQ ID NO: 5332494 - DNA, 21 bp, Homo sapiens
ttatcaaaaaacagaaaaaca

SEQ ID NO: 5332495 - DNA, 12 bp, Homo sapiens
ttatcaaaaagc

SEQ ID NO: 5332496 - DNA, 18 bp, Homo sapiens
ttatcaaaaagtataaat

SEQ ID NO: 5332497 - DNA, 19 bp, Homo sapiens
ttatcaaaccctagccttg

SEQ ID NO: 5332498 - DNA, 18 bp, Homo sapiens
ttatcaaacttgtgctga

SEQ ID NO: 5332499 - DNA, 22 bp, Homo sapiens
ttatcaaagggtgaaaattatt

SEQ ID NO: 5332500 - DNA, 13 bp, Homo sapiens
ttatcaaatacat

SEQ ID NO: 5332501 - DNA, 15 bp, Homo sapiens
ttatcaaatcattca

SEQ ID NO: 5332502 - DNA, 20 bp, Homo sapiens
ttatcaaatcattcaaaact

SEQ ID NO: 5332503 - DNA, 18 bp, Homo sapiens
ttatcaaccaactgcaca

SEQ ID NO: 5332504 - DNA, 20 bp, Homo sapiens
ttatcaactgtcaaatatgt

SEQ ID NO: 5332505 - DNA, 17 bp, Homo sapiens
ttatcaaggactctggt

SEQ ID NO: 5332506 - DNA, 16 bp, Homo sapiens
ttatcaatagcccagg

SEQ ID NO: 5332507 - DNA, 17 bp, Homo sapiens
ttatcaatatctaatat

SEQ ID NO: 5332508 - DNA, 19 bp, Homo sapiens
ttatcaatatctaatatat

SEQ ID NO: 5332509 - DNA, 19 bp, Homo sapiens
ttatcaattacaacagtga

SEQ ID NO: 5332510 - DNA, 17 bp, Homo sapiens
ttatcaattatattatg

SEQ ID NO: 5332511 - DNA, 18 bp, Homo sapiens
ttatcaatttttcccagt

SEQ ID NO: 5332512 - DNA, 22 bp, Homo sapiens
ttatcaatttttcccagtattt

SEQ ID NO: 5332513 - DNA, 18 bp, Homo sapiens
ttatcacataagagagat

SEQ ID NO: 5332514 - DNA, 18 bp, Homo sapiens
ttatcacatgtatgtttt

SEQ ID NO: 5332515 - DNA, 18 bp, Homo sapiens
ttatcacattatttgcat

SEQ ID NO: 5332516 - DNA, 18 bp, Homo sapiens
ttatcaccacagtaagtt

SEQ ID NO: 5332517 - DNA, 22 bp, Homo sapiens
ttatcaccacagtaagttccta

SEQ ID NO: 5332518 - DNA, 18 bp, Homo sapiens
ttatcaccaggatttata

SEQ ID NO: 5332519 - DNA, 21 bp, Homo sapiens
ttatcacccagaagaaaatag

SEQ ID NO: 5332520 - DNA, 18 bp, Homo sapiens
ttatcacctcattctgaa

SEQ ID NO: 5332521 - DNA, 17 bp, Homo sapiens
ttatcacctctgatggc

SEQ ID NO: 5332522 - DNA, 17 bp, Homo sapiens
ttatcactacaagcttt

SEQ ID NO: 5332523 - DNA, 16 bp, Homo sapiens
ttatcactttaagttt

SEQ ID NO: 5332524 - DNA, 17 bp, Homo sapiens
ttatcactttttgaact

SEQ ID NO: 5332525 - DNA, 18 bp, Homo sapiens
ttatcagaaagatcaaat

SEQ ID NO: 5332526 - DNA, 22 bp, Homo sapiens
ttatcagaaatagaatcacaat

SEQ ID NO: 5332527 - DNA, 21 bp, Homo sapiens
ttatcagaatcaaatctgagc

SEQ ID NO: 5332528 - DNA, 23 bp, Homo sapiens
ttatcagaatcaaatctgagcct

SEQ ID NO: 5332529 - DNA, 15 bp, Homo sapiens
ttatcagagtcatga

SEQ ID NO: 5332530 - DNA, 17 bp, Homo sapiens
ttatcagatacatcact

SEQ ID NO: 5332531 - DNA, 18 bp, Homo sapiens
ttatcagatattttcata

SEQ ID NO: 5332532 - DNA, 21 bp, Homo sapiens
ttatcagattgcttttgtgca

SEQ ID NO: 5332533 - DNA, 17 bp, Homo sapiens
ttatcagccatgtttgg

SEQ ID NO: 5332534 - DNA, 21 bp, Homo sapiens
ttatcagccttttatgtattt

SEQ ID NO: 5332535 - DNA, 15 bp, Homo sapiens
ttatcaggctttcct

SEQ ID NO: 5332536 - DNA, 16 bp, Homo sapiens
ttatcagtaaataact

SEQ ID NO: 5332537 - DNA, 18 bp, Homo sapiens
ttatcagtaatgctaaat

SEQ ID NO: 5332538 - DNA, 20 bp, Homo sapiens
ttatcagtaatgctaaatgt

SEQ ID NO: 5332539 - DNA, 20 bp, Homo sapiens
ttatcagtacaattctttgt

SEQ ID NO: 5332540 - DNA, 17 bp, Homo sapiens
ttatcagtagaaagagt

SEQ ID NO: 5332541 - DNA, 21 bp, Homo sapiens
ttatcagtagaaagagtgtta

SEQ ID NO: 5332542 - DNA, 17 bp, Homo sapiens
ttatcagtgacagagtt

SEQ ID NO: 5332543 - DNA, 23 bp, Homo sapiens
ttatcagtgatggtctcacagag

SEQ ID NO: 5332544 - DNA, 14 bp, Homo sapiens
ttatcagtgcttcc

SEQ ID NO: 5332545 - DNA, 20 bp, Homo sapiens
ttatcagtgtattgatgtta

SEQ ID NO: 5332546 - DNA, 13 bp, Homo sapiens
ttatcagtttcca

SEQ ID NO: 5332547 - DNA, 20 bp, Homo sapiens
ttatcagtttgctaatgttt

SEQ ID NO: 5332548 - DNA, 21 bp, Homo sapiens
ttatcataaacattttacatg

SEQ ID NO: 5332549 - DNA, 19 bp, Homo sapiens
ttatcataagaatttttca

SEQ ID NO: 5332550 - DNA, 14 bp, Homo sapiens
ttatcatatatgct

SEQ ID NO: 5332551 - DNA, 17 bp, Homo sapiens
ttatcatatccttgccc

SEQ ID NO: 5332552 - DNA, 14 bp, Homo sapiens
ttatcatattggtg

SEQ ID NO: 5332553 - DNA, 14 bp, Homo sapiens
ttatcatcaagcag

SEQ ID NO: 5332554 - DNA, 16 bp, Homo sapiens
ttatcatgaagcctgt

SEQ ID NO: 5332555 - DNA, 22 bp, Homo sapiens
ttatcatgaagcctgtggatga

SEQ ID NO: 5332556 - DNA, 14 bp, Homo sapiens
ttatcatgaatttt

SEQ ID NO: 5332557 - DNA, 19 bp, Homo sapiens
ttatcatgaattttaaagt

SEQ ID NO: 5332558 - DNA, 23 bp, Homo sapiens
ttatcatggaatttaatgctgaa

SEQ ID NO: 5332559 - DNA, 21 bp, Homo sapiens
ttatcatggagaatacagaaa

SEQ ID NO: 5332560 - DNA, 16 bp, Homo sapiens
ttatcatggtcctgaa

SEQ ID NO: 5332561 - DNA, 17 bp, Homo sapiens
ttatcatgtgaaatcat

SEQ ID NO: 5332562 - DNA, 11 bp, Homo sapiens
ttatcatgtta

SEQ ID NO: 5332563 - DNA, 17 bp, Homo sapiens
ttatcatgttagtaata

SEQ ID NO: 5332564 - DNA, 20 bp, Homo sapiens
ttatcatgttttataatttg

SEQ ID NO: 5332565 - DNA, 18 bp, Homo sapiens
ttatcattaaaaattacc

SEQ ID NO: 5332566 - DNA, 14 bp, Homo sapiens
ttatcattaaacat

SEQ ID NO: 5332567 - DNA, 18 bp, Homo sapiens
ttatcattaaacatgaat

SEQ ID NO: 5332568 - DNA, 23 bp, Homo sapiens
ttatcattaaccacttatcagtg

SEQ ID NO: 5332569 - DNA, 18 bp, Homo sapiens
ttatcattcaagtgtaaa

SEQ ID NO: 5332570 - DNA, 14 bp, Homo sapiens
ttatcattctgctt

SEQ ID NO: 5332571 - DNA, 12 bp, Homo sapiens
ttatcattgctc

SEQ ID NO: 5332572 - DNA, 22 bp, Homo sapiens
ttatcatttatttttaaaataa

SEQ ID NO: 5332573 - DNA, 18 bp, Homo sapiens
ttatcatttttgtataaa

SEQ ID NO: 5332574 - DNA, 19 bp, Homo sapiens
ttatcatttttgtataaaa

SEQ ID NO: 5332575 - DNA, 15 bp, Homo sapiens
ttatccaaatcttga

SEQ ID NO: 5332576 - DNA, 18 bp, Homo sapiens
ttatccacatgaaaataa

SEQ ID NO: 5332577 - DNA, 12 bp, Homo sapiens
ttatccaggact

SEQ ID NO: 5332578 - DNA, 18 bp, Homo sapiens
ttatccaggactctgtca

SEQ ID NO: 5332579 - DNA, 21 bp, Homo sapiens
ttatccattacgtgcatttaa

SEQ ID NO: 5332580 - DNA, 13 bp, Homo sapiens
ttatccattccca

SEQ ID NO: 5332581 - DNA, 17 bp, Homo sapiens
ttatccatttcttttac

SEQ ID NO: 5332582 - DNA, 16 bp, Homo sapiens
ttatgaaaaaatgttc

SEQ ID NO: 5332583 - DNA, 17 bp, Homo sapiens
ttatgaaaaaatgttca

SEQ ID NO: 5332584 - DNA, 14 bp, Homo sapiens
ttatgaaaaagaag

SEQ ID NO: 5332585 - DNA, 13 bp, Homo sapiens
ttatgaaaaagat

SEQ ID NO: 5332586 - DNA, 15 bp, Homo sapiens
ttatgaaaagataac

SEQ ID NO: 5332587 - DNA, 21 bp, Homo sapiens
ttatgaaaagtactaatagaa

SEQ ID NO: 5332588 - DNA, 15 bp, Homo sapiens
ttatgaaaataaata

SEQ ID NO: 5332589 - DNA, 19 bp, Homo sapiens
ttatgaaaatcctatatct

SEQ ID NO: 5332590 - DNA, 13 bp, Homo sapiens
ttatgaaacttgt

SEQ ID NO: 5332591 - DNA, 14 bp, Homo sapiens
ttatgaaataaaga

SEQ ID NO: 5332592 - DNA, 11 bp, Homo sapiens
ttatgaaatgc

SEQ ID NO: 5332593 - DNA, 16 bp, Homo sapiens
ttatgaaatgccagac

SEQ ID NO: 5332594 - DNA, 17 bp, Homo sapiens
ttatgaaatttcacttc

SEQ ID NO: 5332595 - DNA, 19 bp, Homo sapiens
ttatgaaatttcacttcag

SEQ ID NO: 5332596 - DNA, 15 bp, Homo sapiens
ttatgaacagctgtg

SEQ ID NO: 5332597 - DNA, 14 bp, Homo sapiens
ttatgaacattgta

SEQ ID NO: 5332598 - DNA, 15 bp, Homo sapiens
ttatgaacattgtac

SEQ ID NO: 5332599 - DNA, 21 bp, Homo sapiens
ttatgaacattgtactgttgc

SEQ ID NO: 5332600 - DNA, 21 bp, Homo sapiens
ttatgaactgcatcaagactt

SEQ ID NO: 5332601 - DNA, 15 bp, Homo sapiens
ttatgaactgcatgt

SEQ ID NO: 5332602 - DNA, 18 bp, Homo sapiens
ttatgaagaaaaaataca

SEQ ID NO: 5332603 - DNA, 21 bp, Homo sapiens
ttatgaagaaaaatttgaaaa

SEQ ID NO: 5332604 - DNA, 20 bp, Homo sapiens
ttatgaagaaaatacttaaa

SEQ ID NO: 5332605 - DNA, 23 bp, Homo sapiens
ttatgaagaaaatacttaaatgt

SEQ ID NO: 5332606 - DNA, 22 bp, Homo sapiens
ttatgaagaaggtgaatagcca

SEQ ID NO: 5332607 - DNA, 21 bp, Homo sapiens
ttatgaagaattgccaatctt

SEQ ID NO: 5332608 - DNA, 13 bp, Homo sapiens
ttatgaagatgtt

SEQ ID NO: 5332609 - DNA, 16 bp, Homo sapiens
ttatgaagatgttttt

SEQ ID NO: 5332610 - DNA, 16 bp, Homo sapiens
ttatgaaggaatttga

SEQ ID NO: 5332611 - DNA, 22 bp, Homo sapiens
ttatgaagggccttgagcatct

SEQ ID NO: 5332612 - DNA, 13 bp, Homo sapiens
ttatgaagtttaa

SEQ ID NO: 5332613 - DNA, 22 bp, Homo sapiens
ttatgaagtttttaaaaataaa

SEQ ID NO: 5332614 - DNA, 15 bp, Homo sapiens
ttatgaatagacata

SEQ ID NO: 5332615 - DNA, 23 bp, Homo sapiens
ttatgaatagacataaattgtaa

SEQ ID NO: 5332616 - DNA, 11 bp, Homo sapiens
ttatgaatcaa

SEQ ID NO: 5332617 - DNA, 13 bp, Homo sapiens
ttatgaatcagtg

SEQ ID NO: 5332618 - DNA, 19 bp, Homo sapiens
ttatgaatgagttttacaa

SEQ ID NO: 5332619 - DNA, 17 bp, Homo sapiens
ttatgaatgtgaagcct

SEQ ID NO: 5332620 - DNA, 18 bp, Homo sapiens
ttatgaatgtgaagcctt

SEQ ID NO: 5332621 - DNA, 19 bp, Homo sapiens
ttatgaatgtgaagccttc

SEQ ID NO: 5332622 - DNA, 16 bp, Homo sapiens
ttatgaattattttga

SEQ ID NO: 5332623 - DNA, 13 bp, Homo sapiens
ttatgaattcaca

SEQ ID NO: 5332624 - DNA, 17 bp, Homo sapiens
ttatgacagccatttgt

SEQ ID NO: 5332625 - DNA, 22 bp, Homo sapiens
ttatgacagccctaggaaacta

SEQ ID NO: 5332626 - DNA, 18 bp, Homo sapiens
ttatgacatcacttgtac

SEQ ID NO: 5332627 - DNA, 17 bp, Homo sapiens
ttatgacatttcttaaa

SEQ ID NO: 5332628 - DNA, 19 bp, Homo sapiens
ttatgacatttttctggct

SEQ ID NO: 5332629 - DNA, 23 bp, Homo sapiens
ttatgaccagagcaaaaatgtaa

SEQ ID NO: 5332630 - DNA, 13 bp, Homo sapiens
ttatgactaaaaa

SEQ ID NO: 5332631 - DNA, 16 bp, Homo sapiens
ttatgactaatcctta

SEQ ID NO: 5332632 - DNA, 20 bp, Homo sapiens
ttatgactagcaaacaaaaa

SEQ ID NO: 5332633 - DNA, 15 bp, Homo sapiens
ttatgactatgtaaa

SEQ ID NO: 5332634 - DNA, 15 bp, Homo sapiens
ttatgactgccaaga

SEQ ID NO: 5332635 - DNA, 22 bp, Homo sapiens
ttatgacttcattaataataaa

SEQ ID NO: 5332636 - DNA, 19 bp, Homo sapiens
ttatgactttcctcagaac

SEQ ID NO: 5332637 - DNA, 12 bp, Homo sapiens
ttatgagaaatg

SEQ ID NO: 5332638 - DNA, 13 bp, Homo sapiens
ttatgagaaatgt

SEQ ID NO: 5332639 - DNA, 14 bp, Homo sapiens
ttatgagaaatgta

SEQ ID NO: 5332640 - DNA, 21 bp, Homo sapiens
ttatgagaaatgtaatgcgat

SEQ ID NO: 5332641 - DNA, 22 bp, Homo sapiens
ttatgagaaattagtcacttaa

SEQ ID NO: 5332642 - DNA, 14 bp, Homo sapiens
ttatgagaacatgg

SEQ ID NO: 5332643 - DNA, 22 bp, Homo sapiens
ttatgagaacatggtgtgtgtc

SEQ ID NO: 5332644 - DNA, 18 bp, Homo sapiens
ttatgagaggctgtcata

SEQ ID NO: 5332645 - DNA, 17 bp, Homo sapiens
ttatgagatcactgaac

SEQ ID NO: 5332646 - DNA, 22 bp, Homo sapiens
ttatgagatctaatgtgaaaat

SEQ ID NO: 5332647 - DNA, 21 bp, Homo sapiens
ttatgagatgatgaaaataat

SEQ ID NO: 5332648 - DNA, 20 bp, Homo sapiens
ttatgagcgtcactgcccac

SEQ ID NO: 5332649 - DNA, 18 bp, Homo sapiens
ttatgagctcttcatgtt

SEQ ID NO: 5332650 - DNA, 14 bp, Homo sapiens
ttatgagctgtgag

SEQ ID NO: 5332651 - DNA, 21 bp, Homo sapiens
ttatgagctgtgagaagggtg

SEQ ID NO: 5332652 - DNA, 21 bp, Homo sapiens
ttatgaggaaagcgtttctgt

SEQ ID NO: 5332653 - DNA, 22 bp, Homo sapiens
ttatgaggacgtgtctgttatt

SEQ ID NO: 5332654 - DNA, 18 bp, Homo sapiens
ttatgaggagtgaacatt

SEQ ID NO: 5332655 - DNA, 22 bp, Homo sapiens
ttatgaggcaacctgattgtaa

SEQ ID NO: 5332656 - DNA, 17 bp, Homo sapiens
ttatgaggggaaaaaaa

SEQ ID NO: 5332657 - DNA, 16 bp, Homo sapiens
ttatgagggtactgtg

SEQ ID NO: 5332658 - DNA, 19 bp, Homo sapiens
ttatgagggtcctctactt

SEQ ID NO: 5332659 - DNA, 19 bp, Homo sapiens
ttatgaggtcaagaaatgt

SEQ ID NO: 5332660 - DNA, 19 bp, Homo sapiens
ttatgagttattcatattc

SEQ ID NO: 5332661 - DNA, 16 bp, Homo sapiens
ttatgagtttgccctc

SEQ ID NO: 5332662 - DNA, 13 bp, Homo sapiens
ttatgagtttttg

SEQ ID NO: 5332663 - DNA, 19 bp, Homo sapiens
ttatgataaaatgctttaa

SEQ ID NO: 5332664 - DNA, 22 bp, Homo sapiens
ttatgataaaggcttaggactt

SEQ ID NO: 5332665 - DNA, 21 bp, Homo sapiens
ttatgataaccaagaatgtct

SEQ ID NO: 5332666 - DNA, 21 bp, Homo sapiens
ttatgatagtgcaaggaatga

SEQ ID NO: 5332667 - DNA, 22 bp, Homo sapiens
ttatgatattctcattatttca

SEQ ID NO: 5332668 - DNA, 17 bp, Homo sapiens
ttatgatattgtttaaa

SEQ ID NO: 5332669 - DNA, 22 bp, Homo sapiens
ttatgatattgtttaaaattca

SEQ ID NO: 5332670 - DNA, 13 bp, Homo sapiens
ttatgatccagca

SEQ ID NO: 5332671 - DNA, 23 bp, Homo sapiens
ttatgatccagcagattattcac

SEQ ID NO: 5332672 - DNA, 15 bp, Homo sapiens
ttatgatctaataaa

SEQ ID NO: 5332673 - DNA, 16 bp, Homo sapiens
ttatgatctaataaac

SEQ ID NO: 5332674 - DNA, 18 bp, Homo sapiens
ttatgatctaataaactt

SEQ ID NO: 5332675 - DNA, 19 bp, Homo sapiens
ttatgatctaataaacttt

SEQ ID NO: 5332676 - DNA, 12 bp, Homo sapiens
ttatgatctact

SEQ ID NO: 5332677 - DNA, 23 bp, Homo sapiens
ttatgatgaaaacctacatattc

SEQ ID NO: 5332678 - DNA, 17 bp, Homo sapiens
ttatgatgacaatcaaa

SEQ ID NO: 5332679 - DNA, 13 bp, Homo sapiens
ttatgatgatgaa

SEQ ID NO: 5332680 - DNA, 16 bp, Homo sapiens
ttatgatgcatacagt

SEQ ID NO: 5332681 - DNA, 18 bp, Homo sapiens
ttatgatgcatacagttt

SEQ ID NO: 5332682 - DNA, 13 bp, Homo sapiens
ttatgatgctaag

SEQ ID NO: 5332683 - DNA, 16 bp, Homo sapiens
ttatgatgtgcttaac

SEQ ID NO: 5332684 - DNA, 18 bp, Homo sapiens
ttatgatgtgcttaacag

SEQ ID NO: 5332685 - DNA, 15 bp, Homo sapiens
ttatgatgttttgca

SEQ ID NO: 5332686 - DNA, 15 bp, Homo sapiens
ttatgattatttaaa

SEQ ID NO: 5332687 - DNA, 21 bp, Homo sapiens
ttatgattcaggcttataaca

SEQ ID NO: 5332688 - DNA, 14 bp, Homo sapiens
ttatgatttcatga

SEQ ID NO: 5332689 - DNA, 21 bp, Homo sapiens
ttatgatttcattatcacatg

SEQ ID NO: 5332690 - DNA, 16 bp, Homo sapiens
ttatgattttattaca

SEQ ID NO: 5332691 - DNA, 16 bp, Homo sapiens
ttatgatttttaaaga

SEQ ID NO: 5332692 - DNA, 19 bp, Homo sapiens
ttatgatttttttttcata

SEQ ID NO: 5332693 - DNA, 13 bp, Homo sapiens
ttatgcaaaaaca

SEQ ID NO: 5332694 - DNA, 14 bp, Homo sapiens
ttatgcaaaaacat

SEQ ID NO: 5332695 - DNA, 16 bp, Homo sapiens
ttatgcaaaacttttt

SEQ ID NO: 5332696 - DNA, 17 bp, Homo sapiens
ttatgcaaaagcaagct

SEQ ID NO: 5332697 - DNA, 21 bp, Homo sapiens
ttatgcaaaagcaagctgatt

SEQ ID NO: 5332698 - DNA, 15 bp, Homo sapiens
ttatgcaaaagcagc

SEQ ID NO: 5332699 - DNA, 22 bp, Homo sapiens
ttatgcaaaagcagctaaatgt

SEQ ID NO: 5332700 - DNA, 16 bp, Homo sapiens
ttatgcaaaatttaga

SEQ ID NO: 5332701 - DNA, 13 bp, Homo sapiens
ttatgcaaagtac

SEQ ID NO: 5332702 - DNA, 20 bp, Homo sapiens
ttatgcaaatacaatcagcc

SEQ ID NO: 5332703 - DNA, 20 bp, Homo sapiens
ttatgcaattaggtttttcc

SEQ ID NO: 5332704 - DNA, 13 bp, Homo sapiens
ttatgcacagcct

SEQ ID NO: 5332705 - DNA, 19 bp, Homo sapiens
ttatgcactaaatatgaac

SEQ ID NO: 5332706 - DNA, 12 bp, Homo sapiens
ttatgcactgtg

SEQ ID NO: 5332707 - DNA, 13 bp, Homo sapiens
ttatgcactgtgg

SEQ ID NO: 5332708 - DNA, 19 bp, Homo sapiens
ttatgcacttataaggtgt

SEQ ID NO: 5332709 - DNA, 20 bp, Homo sapiens
ttatgcagaagcagagatga

SEQ ID NO: 5332710 - DNA, 23 bp, Homo sapiens
ttatgcagaagcatattttgctg

SEQ ID NO: 5332711 - DNA, 20 bp, Homo sapiens
ttatgcagcaaatatatgat

SEQ ID NO: 5332712 - DNA, 18 bp, Homo sapiens
ttatgcagtgaactattt

SEQ ID NO: 5332713 - DNA, 15 bp, Homo sapiens
ttatgcagtgctgct

SEQ ID NO: 5332714 - DNA, 16 bp, Homo sapiens
ttatgcatcatttcag

SEQ ID NO: 5332715 - DNA, 11 bp, Homo sapiens
ttatgcatctg

SEQ ID NO: 5332716 - DNA, 17 bp, Homo sapiens
ttatgcatgaaatgaat

SEQ ID NO: 5332717 - DNA, 23 bp, Homo sapiens
ttatgcatgaaatgaatgtctga

SEQ ID NO: 5332718 - DNA, 23 bp, Homo sapiens
ttatgcatgagaactaaatagat

SEQ ID NO: 5332719 - DNA, 22 bp, Homo sapiens
ttatgccaaatgttaactgcca

SEQ ID NO: 5332720 - DNA, 13 bp, Homo sapiens
ttatgccacctga

SEQ ID NO: 5332721 - DNA, 13 bp, Homo sapiens
ttatgccactgct

SEQ ID NO: 5332722 - DNA, 17 bp, Homo sapiens
ttatgcccagcgtttga

SEQ ID NO: 5332723 - DNA, 17 bp, Homo sapiens
ttatgcccatgaacaag

SEQ ID NO: 5332724 - DNA, 20 bp, Homo sapiens
ttatgccggatgtgcttttc

SEQ ID NO: 5332725 - DNA, 23 bp, Homo sapiens
ttatgccgtctcatatttttaca

SEQ ID NO: 5332726 - DNA, 16 bp, Homo sapiens
ttatgcctgagttata

SEQ ID NO: 5332727 - DNA, 17 bp, Homo sapiens
ttatgcctttctctcct

SEQ ID NO: 5332728 - DNA, 21 bp, Homo sapiens
ttatgccttttaaaaatacta

SEQ ID NO: 5332729 - DNA, 19 bp, Homo sapiens
ttatgcggttaattttgaa

SEQ ID NO: 5332730 - DNA, 23 bp, Homo sapiens
ttatgcgtgtgacagtgtatggg

SEQ ID NO: 5332731 - DNA, 22 bp, Homo sapiens
ttatgctaacaaactgaaaaat

SEQ ID NO: 5332732 - DNA, 16 bp, Homo sapiens
ttatgctaagaatttt

SEQ ID NO: 5332733 - DNA, 22 bp, Homo sapiens
ttatgctataaattttttgaaa

SEQ ID NO: 5332734 - DNA, 14 bp, Homo sapiens
ttatgctcagggtc

SEQ ID NO: 5332735 - DNA, 16 bp, Homo sapiens
ttatgctgctgtgaat

SEQ ID NO: 5332736 - DNA, 21 bp, Homo sapiens
ttatgctgtattttaacactt

SEQ ID NO: 5332737 - DNA, 24 bp, Homo sapiens
ttatgctgtattttaacactttgt

SEQ ID NO: 5332738 - DNA, 11 bp, Homo sapiens
ttatgctgttt

SEQ ID NO: 5332739 - DNA, 16 bp, Homo sapiens
ttatgcttaaattcaa

SEQ ID NO: 5332740 - DNA, 14 bp, Homo sapiens
ttatgcttccagaa

SEQ ID NO: 5332741 - DNA, 13 bp, Homo sapiens
ttatgctttaaac

SEQ ID NO: 5332742 - DNA, 18 bp, Homo sapiens
ttatgctttaacttcaga

SEQ ID NO: 5332743 - DNA, 12 bp, Homo sapiens
ttatgctttgaa

SEQ ID NO: 5332744 - DNA, 15 bp, Homo sapiens
ttatgctttgaactt

SEQ ID NO: 5332745 - DNA, 15 bp, Homo sapiens
ttatggaaaaataaa

SEQ ID NO: 5332746 - DNA, 17 bp, Homo sapiens
ttatggaaaaataaaac

SEQ ID NO: 5332747 - DNA, 13 bp, Homo sapiens
ttatggaaaactg

SEQ ID NO: 5332748 - DNA, 19 bp, Homo sapiens
ttatggaagattttaaatt

SEQ ID NO: 5332749 - DNA, 22 bp, Homo sapiens
ttatggaagattttaaattcac

SEQ ID NO: 5332750 - DNA, 15 bp, Homo sapiens
ttatggaatatcatc

SEQ ID NO: 5332751 - DNA, 22 bp, Homo sapiens
ttatggaatctaccaactgttt

SEQ ID NO: 5332752 - DNA, 12 bp, Homo sapiens
ttatggaattaa

SEQ ID NO: 5332753 - DNA, 14 bp, Homo sapiens
ttatggaattgatt

SEQ ID NO: 5332754 - DNA, 22 bp, Homo sapiens
ttatggacaaaattaatacatt

SEQ ID NO: 5332755 - DNA, 21 bp, Homo sapiens
ttatggacaatgacccagtgg

SEQ ID NO: 5332756 - DNA, 19 bp, Homo sapiens
ttatggacatcgatatgaa

SEQ ID NO: 5332757 - DNA, 13 bp, Homo sapiens
ttatggaccactt

SEQ ID NO: 5332758 - DNA, 21 bp, Homo sapiens
ttatggagtcttgtgccaaac

SEQ ID NO: 5332759 - DNA, 17 bp, Homo sapiens
ttattcaatttatttga

SEQ ID NO: 5332760 - DNA, 18 bp, Homo sapiens
ttattcacatatgtctta

SEQ ID NO: 5332761 - DNA, 19 bp, Homo sapiens
ttattcaccatgtaaaaca

SEQ ID NO: 5332762 - DNA, 21 bp, Homo sapiens
ttattcactctcccagaggct

SEQ ID NO: 5332763 - DNA, 14 bp, Homo sapiens
ttattcactgattt

SEQ ID NO: 5332764 - DNA, 20 bp, Homo sapiens
ttattcacttttatttagca

SEQ ID NO: 5332765 - DNA, 20 bp, Homo sapiens
ttattcagcttcatttgtgt

SEQ ID NO: 5332766 - DNA, 20 bp, Homo sapiens
ttattcaggaaaagcctctg

SEQ ID NO: 5332767 - DNA, 23 bp, Homo sapiens
ttattcaggaaaagcctctgtgt

SEQ ID NO: 5332768 - DNA, 20 bp, Homo sapiens
ttattcaggaagataaaaat

SEQ ID NO: 5332769 - DNA, 18 bp, Homo sapiens
ttattcagtagtttgagg

SEQ ID NO: 5332770 - DNA, 18 bp, Homo sapiens
ttattcagtgaaaaagat

SEQ ID NO: 5332771 - DNA, 20 bp, Homo sapiens
ttattcagtgaaaaagatat

SEQ ID NO: 5332772 - DNA, 21 bp, Homo sapiens
ttattcagtgaatttgtccat

SEQ ID NO: 5332773 - DNA, 18 bp, Homo sapiens
ttattcagttaagaaaaa

SEQ ID NO: 5332774 - DNA, 15 bp, Homo sapiens
ttattcataaagaga

SEQ ID NO: 5332775 - DNA, 24 bp, Homo sapiens
ttattcataatgaattataacagt

SEQ ID NO: 5332776 - DNA, 14 bp, Homo sapiens
ttattcataatgtg

SEQ ID NO: 5332777 - DNA, 14 bp, Homo sapiens
ttattcatatgcat

SEQ ID NO: 5332778 - DNA, 22 bp, Homo sapiens
ttattcatgccatctgttttca

SEQ ID NO: 5332779 - DNA, 19 bp, Homo sapiens
ttattcatgtgtacagaaa

SEQ ID NO: 5332780 - DNA, 21 bp, Homo sapiens
ttattcatgtgtacagaaaca

SEQ ID NO: 5332781 - DNA, 22 bp, Homo sapiens
ttattcatgtgtacagaaacaa

SEQ ID NO: 5332782 - DNA, 17 bp, Homo sapiens
ttattcattagctgtga

SEQ ID NO: 5332783 - DNA, 12 bp, Homo sapiens
ttattcattatg

SEQ ID NO: 5332784 - DNA, 23 bp, Homo sapiens
ttattcattctgtgatcatttat

SEQ ID NO: 5332785 - DNA, 15 bp, Homo sapiens
ttattcattgtatga

SEQ ID NO: 5332786 - DNA, 15 bp, Homo sapiens
ttattcatttggtga

SEQ ID NO: 5332787 - DNA, 12 bp, Homo sapiens
ttattccacaaa

SEQ ID NO: 5332788 - DNA, 14 bp, Homo sapiens
ttattccaggagaa

SEQ ID NO: 5332789 - DNA, 19 bp, Homo sapiens
ttattccatattcatgtaa

SEQ ID NO: 5332790 - DNA, 12 bp, Homo sapiens
ttattccatcaa

SEQ ID NO: 5332791 - DNA, 13 bp, Homo sapiens
ttattccatcaat

SEQ ID NO: 5332792 - DNA, 15 bp, Homo sapiens
ttattccatcaataa

SEQ ID NO: 5332793 - DNA, 20 bp, Homo sapiens
ttattccatcaataaatgct

SEQ ID NO: 5332794 - DNA, 23 bp, Homo sapiens
ttattccatgactgcttgcccta

SEQ ID NO: 5332795 - DNA, 19 bp, Homo sapiens
ttattcccaagtatgcctt

SEQ ID NO: 5332796 - DNA, 20 bp, Homo sapiens
ttattcccaagtatgcctta

SEQ ID NO: 5332797 - DNA, 20 bp, Homo sapiens
ttattccccattcttcctag

SEQ ID NO: 5332798 - DNA, 18 bp, Homo sapiens
ttattcccgacgacacat

SEQ ID NO: 5332799 - DNA, 14 bp, Homo sapiens
ttattccctgccca

SEQ ID NO: 5332800 - DNA, 21 bp, Homo sapiens
ttattccctgcccaaaccctt

SEQ ID NO: 5332801 - DNA, 13 bp, Homo sapiens
ttattccgagaat

SEQ ID NO: 5332802 - DNA, 18 bp, Homo sapiens
ttattcctaattcctgta

SEQ ID NO: 5332803 - DNA, 20 bp, Homo sapiens
ttattcctgataataattga

SEQ ID NO: 5332804 - DNA, 17 bp, Homo sapiens
ttattcctgtatgttgt

SEQ ID NO: 5332805 - DNA, 17 bp, Homo sapiens
ttattccttcttactct

SEQ ID NO: 5332806 - DNA, 20 bp, Homo sapiens
ttattccttgctttcatcac

SEQ ID NO: 5332807 - DNA, 12 bp, Homo sapiens
ttattcctttcc

SEQ ID NO: 5332808 - DNA, 14 bp, Homo sapiens
ttattcctttcctt

SEQ ID NO: 5332809 - DNA, 14 bp, Homo sapiens
ttattcctttgaat

SEQ ID NO: 5332810 - DNA, 14 bp, Homo sapiens
ttattcgcccaccc

SEQ ID NO: 5332811 - DNA, 15 bp, Homo sapiens
ttattcgcccacccg

SEQ ID NO: 5332812 - DNA, 18 bp, Homo sapiens
ttattcgtcctttgacaa

SEQ ID NO: 5332813 - DNA, 19 bp, Homo sapiens
ttattctaacaaaaagcaa

SEQ ID NO: 5332814 - DNA, 20 bp, Homo sapiens
ttattctaagccctttgcca

SEQ ID NO: 5332815 - DNA, 14 bp, Homo sapiens
ttattctaataaat

SEQ ID NO: 5332816 - DNA, 13 bp, Homo sapiens
ttattctagatta

SEQ ID NO: 5332817 - DNA, 15 bp, Homo sapiens
ttattctcaaagcag

SEQ ID NO: 5332818 - DNA, 17 bp, Homo sapiens
ttattctcactccacca

SEQ ID NO: 5332819 - DNA, 15 bp, Homo sapiens
ttattctcatttagt

SEQ ID NO: 5332820 - DNA, 13 bp, Homo sapiens
ttattctctgttt

SEQ ID NO: 5332821 - DNA, 22 bp, Homo sapiens
ttattctctgtttgcttttgaa

SEQ ID NO: 5332822 - DNA, 13 bp, Homo sapiens
ttattctgattct

SEQ ID NO: 5332823 - DNA, 21 bp, Homo sapiens
ttattctgggaaatgttttaa

SEQ ID NO: 5332824 - DNA, 20 bp, Homo sapiens
ttattctgtagattctgtgg

SEQ ID NO: 5332825 - DNA, 11 bp, Homo sapiens
ttattctgtat

SEQ ID NO: 5332826 - DNA, 15 bp, Homo sapiens
ttattctgttaatgc

SEQ ID NO: 5332827 - DNA, 12 bp, Homo sapiens
ttattctgttcc

SEQ ID NO: 5332828 - DNA, 22 bp, Homo sapiens
ttattcttaagtaaggacaaag

SEQ ID NO: 5332829 - DNA, 13 bp, Homo sapiens
ttattcttccaag

SEQ ID NO: 5332830 - DNA, 14 bp, Homo sapiens
ttattcttccaagt

SEQ ID NO: 5332831 - DNA, 14 bp, Homo sapiens
ttattcttcttaca

SEQ ID NO: 5332832 - DNA, 13 bp, Homo sapiens
ttattcttgatca

SEQ ID NO: 5332833 - DNA, 14 bp, Homo sapiens
ttattcttgatgaa

SEQ ID NO: 5332834 - DNA, 13 bp, Homo sapiens
ttattcttgctgg

SEQ ID NO: 5332835 - DNA, 12 bp, Homo sapiens
ttattcttggtt

SEQ ID NO: 5332836 - DNA, 14 bp, Homo sapiens
ttattcttgtgaat

SEQ ID NO: 5332837 - DNA, 15 bp, Homo sapiens
ttattctttactatt

SEQ ID NO: 5332838 - DNA, 16 bp, Homo sapiens
ttattctttgaaaaca

SEQ ID NO: 5332839 - DNA, 22 bp, Homo sapiens
ttattctttgaaaacagatgac

SEQ ID NO: 5332840 - DNA, 14 bp, Homo sapiens
ttattctttgcact

SEQ ID NO: 5332841 - DNA, 21 bp, Homo sapiens
ttattgaaaaaaaaaatgttg

SEQ ID NO: 5332842 - DNA, 21 bp, Homo sapiens
ttattgaaatagtttccaaga

SEQ ID NO: 5332843 - DNA, 22 bp, Homo sapiens
ttattgaaatgatttcacagtg

SEQ ID NO: 5332844 - DNA, 22 bp, Homo sapiens
ttattgaagaaacagataccat

SEQ ID NO: 5332845 - DNA, 12 bp, Homo sapiens
ttattgaagcag

SEQ ID NO: 5332846 - DNA, 19 bp, Homo sapiens
ttattgaatatttatacta

SEQ ID NO: 5332847 - DNA, 16 bp, Homo sapiens
ttattgaatcttaatt

SEQ ID NO: 5332848 - DNA, 15 bp, Homo sapiens
ttattgaattagaaa

SEQ ID NO: 5332849 - DNA, 23 bp, Homo sapiens
ttattgaatttgttagactagtt

SEQ ID NO: 5332850 - DNA, 14 bp, Homo sapiens
ttattgacacagaa

SEQ ID NO: 5332851 - DNA, 21 bp, Homo sapiens
ttattgacaggtcttttcaaa

SEQ ID NO: 5332852 - DNA, 16 bp, Homo sapiens
ttattgacatcagtaa

SEQ ID NO: 5332853 - DNA, 14 bp, Homo sapiens
ttattgactcttga

SEQ ID NO: 5332854 - DNA, 17 bp, Homo sapiens
ttattgactcttgagtt

SEQ ID NO: 5332855 - DNA, 14 bp, Homo sapiens
ttattgagaaagag

SEQ ID NO: 5332856 - DNA, 16 bp, Homo sapiens
ttattgagaaagagca

SEQ ID NO: 5332857 - DNA, 23 bp, Homo sapiens
ttattgagaaagagcacttaaga

SEQ ID NO: 5332858 - DNA, 19 bp, Homo sapiens
ttattgagaattttaaatt

SEQ ID NO: 5332859 - DNA, 19 bp, Homo sapiens
ttattgagagagatgtgta

SEQ ID NO: 5332860 - DNA, 19 bp, Homo sapiens
ttattgagcccaaaaacaa

SEQ ID NO: 5332861 - DNA, 14 bp, Homo sapiens
ttattgagctctat

SEQ ID NO: 5332862 - DNA, 23 bp, Homo sapiens
ttattgaggaaaaatatgtgaag

SEQ ID NO: 5332863 - DNA, 23 bp, Homo sapiens
ttattgaggaaaattaatatcac

SEQ ID NO: 5332864 - DNA, 14 bp, Homo sapiens
ttattgagttctga

SEQ ID NO: 5332865 - DNA, 15 bp, Homo sapiens
ttattgagttctgaa

SEQ ID NO: 5332866 - DNA, 20 bp, Homo sapiens
ttattgataagttcatacat

SEQ ID NO: 5332867 - DNA, 15 bp, Homo sapiens
ttattgatcaaaatc

SEQ ID NO: 5332868 - DNA, 19 bp, Homo sapiens
ttattgatcaaaatcaaaa

SEQ ID NO: 5332869 - DNA, 14 bp, Homo sapiens
ttattgatctttgc

SEQ ID NO: 5332870 - DNA, 13 bp, Homo sapiens
ttattgatgaaaa

SEQ ID NO: 5332871 - DNA, 14 bp, Homo sapiens
ttattgatggatat

SEQ ID NO: 5332872 - DNA, 15 bp, Homo sapiens
ttattgattaagtat

SEQ ID NO: 5332873 - DNA, 18 bp, Homo sapiens
ttattgattaagtatatc

SEQ ID NO: 5332874 - DNA, 14 bp, Homo sapiens
ttattgattttctt

SEQ ID NO: 5332875 - DNA, 17 bp, Homo sapiens
ttattgcaaattgagga

SEQ ID NO: 5332876 - DNA, 17 bp, Homo sapiens
ttattgcaataaagtat

SEQ ID NO: 5332877 - DNA, 15 bp, Homo sapiens
ttattgcacattgtt

SEQ ID NO: 5332878 - DNA, 23 bp, Homo sapiens
ttattgcaccattttcaatttgg

SEQ ID NO: 5332879 - DNA, 14 bp, Homo sapiens
ttattgcagaatgt

SEQ ID NO: 5332880 - DNA, 19 bp, Homo sapiens
ttattgcagcgattaataa

SEQ ID NO: 5332881 - DNA, 16 bp, Homo sapiens
ttattgcagtttatca

SEQ ID NO: 5332882 - DNA, 20 bp, Homo sapiens
ttattgccaaataagacagt

SEQ ID NO: 5332883 - DNA, 19 bp, Homo sapiens
ttattgccaggaaaggaga

SEQ ID NO: 5332884 - DNA, 21 bp, Homo sapiens
ttattgcccatgatataactt

SEQ ID NO: 5332885 - DNA, 17 bp, Homo sapiens
ttattgccctaagtgat

SEQ ID NO: 5332886 - DNA, 17 bp, Homo sapiens
ttattgcctctgtctta

SEQ ID NO: 5332887 - DNA, 18 bp, Homo sapiens
ttattgcctctgtcttaa

SEQ ID NO: 5332888 - DNA, 20 bp, Homo sapiens
ttattgccttctcaccagct

SEQ ID NO: 5332889 - DNA, 17 bp, Homo sapiens
ttattgctagtatttga

SEQ ID NO: 5332890 - DNA, 15 bp, Homo sapiens
ttattgctatatttg

SEQ ID NO: 5332891 - DNA, 21 bp, Homo sapiens
ttattgctcgcccagacacca

SEQ ID NO: 5332892 - DNA, 17 bp, Homo sapiens
ttattgctgattttaat

SEQ ID NO: 5332893 - DNA, 20 bp, Homo sapiens
ttattgctgcataaatttgt

SEQ ID NO: 5332894 - DNA, 14 bp, Homo sapiens
ttattgctgcattt

SEQ ID NO: 5332895 - DNA, 15 bp, Homo sapiens
ttattgctgccaaaa

SEQ ID NO: 5332896 - DNA, 18 bp, Homo sapiens
ttattgctggtgcaaaga

SEQ ID NO: 5332897 - DNA, 13 bp, Homo sapiens
ttattgcttcatg

SEQ ID NO: 5332898 - DNA, 23 bp, Homo sapiens
ttattgcttgatacttttgacaa

SEQ ID NO: 5332899 - DNA, 17 bp, Homo sapiens
ttattggaaatgtactt

SEQ ID NO: 5332900 - DNA, 22 bp, Homo sapiens
ttattggaattaacctggtgct

SEQ ID NO: 5332901 - DNA, 15 bp, Homo sapiens
ttattggactccagg

SEQ ID NO: 5332902 - DNA, 18 bp, Homo sapiens
ttattggactccaggcct

SEQ ID NO: 5332903 - DNA, 22 bp, Homo sapiens
ttattggatatttgatatttgg

SEQ ID NO: 5332904 - DNA, 13 bp, Homo sapiens
ttattggatcagt

SEQ ID NO: 5332905 - DNA, 21 bp, Homo sapiens
ttattggatctattgatttga

SEQ ID NO: 5332906 - DNA, 22 bp, Homo sapiens
ttattggattagaccaattact

SEQ ID NO: 5332907 - DNA, 20 bp, Homo sapiens
ttattggcctgctaatagct

SEQ ID NO: 5332908 - DNA, 14 bp, Homo sapiens
ttattggctgagat

SEQ ID NO: 5332909 - DNA, 22 bp, Homo sapiens
ttattggcttgataaacataat

SEQ ID NO: 5332910 - DNA, 16 bp, Homo sapiens
ttattggcttttctga

SEQ ID NO: 5332911 - DNA, 12 bp, Homo sapiens
ttattgggactt

SEQ ID NO: 5332912 - DNA, 16 bp, Homo sapiens
ttattgggcaataaaa

SEQ ID NO: 5332913 - DNA, 17 bp, Homo sapiens
ttattgggcaataaaag

SEQ ID NO: 5332914 - DNA, 17 bp, Homo sapiens
ttattgggcttaatata

SEQ ID NO: 5332915 - DNA, 22 bp, Homo sapiens
ttattggggaattaaatagtgt

SEQ ID NO: 5332916 - DNA, 17 bp, Homo sapiens
ttattggtcttgcccta

SEQ ID NO: 5332917 - DNA, 20 bp, Homo sapiens
ttattggttggtgtgaagaa

SEQ ID NO: 5332918 - DNA, 15 bp, Homo sapiens
ttattggttttgcag

SEQ ID NO: 5332919 - DNA, 15 bp, Homo sapiens
ttattgtaaagttta

SEQ ID NO: 5332920 - DNA, 16 bp, Homo sapiens
ttattgtaacagacat

SEQ ID NO: 5332921 - DNA, 18 bp, Homo sapiens
ttattgtaacagacattg

SEQ ID NO: 5332922 - DNA, 19 bp, Homo sapiens
ttattgtaacagacattgt

SEQ ID NO: 5332923 - DNA, 20 bp, Homo sapiens
ttattgtaacagacattgtt

SEQ ID NO: 5332924 - DNA, 20 bp, Homo sapiens
ttattgtaagttgtacaaat

SEQ ID NO: 5332925 - DNA, 21 bp, Homo sapiens
ttattgtaagttgtacaaatg

SEQ ID NO: 5332926 - DNA, 23 bp, Homo sapiens
ttattgtaagttgtacaaatgta

SEQ ID NO: 5332927 - DNA, 19 bp, Homo sapiens
ttattgtacagctgtttaa

SEQ ID NO: 5332928 - DNA, 17 bp, Homo sapiens
ttattgtaccaaagctg

SEQ ID NO: 5332929 - DNA, 15 bp, Homo sapiens
ttattgtacctctct

SEQ ID NO: 5332930 - DNA, 20 bp, Homo sapiens
ttattgtagaataagtcatt

SEQ ID NO: 5332931 - DNA, 16 bp, Homo sapiens
ttattgtagtttgaaa

SEQ ID NO: 5332932 - DNA, 19 bp, Homo sapiens
ttattgtagtttgaaagtt

SEQ ID NO: 5332933 - DNA, 14 bp, Homo sapiens
ttattgtattctgg

SEQ ID NO: 5332934 - DNA, 13 bp, Homo sapiens
ttattgtcagttt

SEQ ID NO: 5332935 - DNA, 14 bp, Homo sapiens
ttattgtcagtttt

SEQ ID NO: 5332936 - DNA, 20 bp, Homo sapiens
ttattgtcagttttgttcac

SEQ ID NO: 5332937 - DNA, 22 bp, Homo sapiens
ttcaaaacaaccatcctgctca

SEQ ID NO: 5332938 - DNA, 17 bp, Homo sapiens
ttcaaaacattccaaga

SEQ ID NO: 5332939 - DNA, 20 bp, Homo sapiens
ttcaaaaccaagtatcacac

SEQ ID NO: 5332940 - DNA, 22 bp, Homo sapiens
ttcaaaacctgcagttaacagg

SEQ ID NO: 5332941 - DNA, 17 bp, Homo sapiens
ttcaaaaccttttgaaa

SEQ ID NO: 5332942 - DNA, 14 bp, Homo sapiens
ttcaaaactttcag

SEQ ID NO: 5332943 - DNA, 23 bp, Homo sapiens
ttcaaaagaaatttaagttctat

SEQ ID NO: 5332944 - DNA, 14 bp, Homo sapiens
ttcaaaagaagttc

SEQ ID NO: 5332945 - DNA, 19 bp, Homo sapiens
ttcaaaagacatgttgtaa

SEQ ID NO: 5332946 - DNA, 15 bp, Homo sapiens
ttcaaaagattaatg

SEQ ID NO: 5332947 - DNA, 22 bp, Homo sapiens
ttcaaaagcacaaaccctgggg

SEQ ID NO: 5332948 - DNA, 18 bp, Homo sapiens
ttcaaaagtaagaatgca

SEQ ID NO: 5332949 - DNA, 16 bp, Homo sapiens
ttcaaaagtaatgcct

SEQ ID NO: 5332950 - DNA, 22 bp, Homo sapiens
ttcaaaagtaatgcctctgtct

SEQ ID NO: 5332951 - DNA, 12 bp, Homo sapiens
ttcaaaagtatt

SEQ ID NO: 5332952 - DNA, 21 bp, Homo sapiens
ttcaaaagtattttcctgtaa

SEQ ID NO: 5332953 - DNA, 13 bp, Homo sapiens
ttcaaaagtggag

SEQ ID NO: 5332954 - DNA, 12 bp, Homo sapiens
ttcaaaagttcc

SEQ ID NO: 5332955 - DNA, 17 bp, Homo sapiens
ttcaaaagttgaaatta

SEQ ID NO: 5332956 - DNA, 20 bp, Homo sapiens
ttcaaaagtttgtttgctta

SEQ ID NO: 5332957 - DNA, 16 bp, Homo sapiens
ttcaaaataaaaagta

SEQ ID NO: 5332958 - DNA, 15 bp, Homo sapiens
ttcaaaataaaacat

SEQ ID NO: 5332959 - DNA, 12 bp, Homo sapiens
ttcaaaatactt

SEQ ID NO: 5332960 - DNA, 19 bp, Homo sapiens
ttcaaaatagacaagtttt

SEQ ID NO: 5332961 - DNA, 20 bp, Homo sapiens
ttcaaaatagacaagttttg

SEQ ID NO: 5332962 - DNA, 22 bp, Homo sapiens
ttcaaaatagttctatttctat

SEQ ID NO: 5332963 - DNA, 16 bp, Homo sapiens
ttcaaaatatgttctt

SEQ ID NO: 5332964 - DNA, 23 bp, Homo sapiens
ttcaaaatattgagcagaattca

SEQ ID NO: 5332965 - DNA, 15 bp, Homo sapiens
ttcaaaatatttaaa

SEQ ID NO: 5332966 - DNA, 16 bp, Homo sapiens
ttcaaaatccttccaa

SEQ ID NO: 5332967 - DNA, 20 bp, Homo sapiens
ttcaaaatgaagatacacat

SEQ ID NO: 5332968 - DNA, 18 bp, Homo sapiens
ttcaaaatgatagacata

SEQ ID NO: 5332969 - DNA, 19 bp, Homo sapiens
ttcaaaatgatttcctctg

SEQ ID NO: 5332970 - DNA, 12 bp, Homo sapiens
ttcaaaatgcat

SEQ ID NO: 5332971 - DNA, 12 bp, Homo sapiens
ttcaaaatgctc

SEQ ID NO: 5332972 - DNA, 20 bp, Homo sapiens
ttcaaaatgctttttattat

SEQ ID NO: 5332973 - DNA, 17 bp, Homo sapiens
ttcaaaatggaaaatta

SEQ ID NO: 5332974 - DNA, 15 bp, Homo sapiens
ttcaaaatgttatct

SEQ ID NO: 5332975 - DNA, 23 bp, Homo sapiens
ttcaaaatgttatcttctcaagt

SEQ ID NO: 5332976 - DNA, 16 bp, Homo sapiens
ttcaaaattaaatctg

SEQ ID NO: 5332977 - DNA, 17 bp, Homo sapiens
ttcaaaattaaatctgt

SEQ ID NO: 5332978 - DNA, 18 bp, Homo sapiens
ttcaaaattaatagcttt

SEQ ID NO: 5332979 - DNA, 18 bp, Homo sapiens
ttcaaaattgttgcatcc

SEQ ID NO: 5332980 - DNA, 13 bp, Homo sapiens
ttcaaacaagaat

SEQ ID NO: 5332981 - DNA, 13 bp, Homo sapiens
ttcaaacaagtat

SEQ ID NO: 5332982 - DNA, 14 bp, Homo sapiens
ttcaaacaagtatg

SEQ ID NO: 5332983 - DNA, 14 bp, Homo sapiens
ttcaaacaattcaa

SEQ ID NO: 5332984 - DNA, 15 bp, Homo sapiens
ttcaaacacaaatgc

SEQ ID NO: 5332985 - DNA, 13 bp, Homo sapiens
ttcaaacacacag

SEQ ID NO: 5332986 - DNA, 21 bp, Homo sapiens
ttcaaacagcatcaaaataca

SEQ ID NO: 5332987 - DNA, 18 bp, Homo sapiens
ttcaaacagtctcaggaa

SEQ ID NO: 5332988 - DNA, 18 bp, Homo sapiens
ttcaaacatcagctgaat

SEQ ID NO: 5332989 - DNA, 19 bp, Homo sapiens
ttcaaacatcagctgaatt

SEQ ID NO: 5332990 - DNA, 15 bp, Homo sapiens
ttcaaacattttgta

SEQ ID NO: 5332991 - DNA, 23 bp, Homo sapiens
ttcaaaccaatttcttccttcca

SEQ ID NO: 5332992 - DNA, 16 bp, Homo sapiens
ttcaaaccaggatttt

SEQ ID NO: 5332993 - DNA, 15 bp, Homo sapiens
ttcaaaccatttaat

SEQ ID NO: 5332994 - DNA, 20 bp, Homo sapiens
ttcaaaccatttaattcata

SEQ ID NO: 5332995 - DNA, 21 bp, Homo sapiens
ttcaaaccatttaattcataa

SEQ ID NO: 5332996 - DNA, 17 bp, Homo sapiens
ttcaaacctaaaaatca

SEQ ID NO: 5332997 - DNA, 21 bp, Homo sapiens
ttcaaacctcaaatatagtat

SEQ ID NO: 5332998 - DNA, 22 bp, Homo sapiens
ttcaaacctgcaaggcaaagta

SEQ ID NO: 5332999 - DNA, 15 bp, Homo sapiens
ttcaaacctgtgaag

SEQ ID NO: 5333000 - DNA, 18 bp, Homo sapiens
ttcaaactacctatattc

SEQ ID NO: 5333001 - DNA, 20 bp, Homo sapiens
ttcaaactacctatattcct

SEQ ID NO: 5333002 - DNA, 22 bp, Homo sapiens
ttcaaactacctatattccttg

SEQ ID NO: 5333003 - DNA, 20 bp, Homo sapiens
ttcaaactactgtacatttt

SEQ ID NO: 5333004 - DNA, 12 bp, Homo sapiens
ttcaaactactt

SEQ ID NO: 5333005 - DNA, 17 bp, Homo sapiens
ttcaaactcctgacctc

SEQ ID NO: 5333006 - DNA, 19 bp, Homo sapiens
ttcaaactcctgacctcag

SEQ ID NO: 5333007 - DNA, 17 bp, Homo sapiens
ttcaaactgaaaagctg

SEQ ID NO: 5333008 - DNA, 16 bp, Homo sapiens
ttcaaactgaatttgt

SEQ ID NO: 5333009 - DNA, 20 bp, Homo sapiens
ttcaaactgacaacctgtgc

SEQ ID NO: 5333010 - DNA, 20 bp, Homo sapiens
ttcaaactgctggaaatctc

SEQ ID NO: 5333011 - DNA, 21 bp, Homo sapiens
ttcaaactggggcctccagaa

SEQ ID NO: 5333012 - DNA, 19 bp, Homo sapiens
ttcaaactgtgaagcattt

SEQ ID NO: 5333013 - DNA, 13 bp, Homo sapiens
ttcaaacttaaac

SEQ ID NO: 5333014 - DNA, 19 bp, Homo sapiens
ttcaaacttactattttga

SEQ ID NO: 5333015 - DNA, 16 bp, Homo sapiens
ttcaaactttggaaca

SEQ ID NO: 5333016 - DNA, 17 bp, Homo sapiens
ttcaaacttttgaaaga

SEQ ID NO: 5333017 - DNA, 12 bp, Homo sapiens
ttcaaagaaaga

SEQ ID NO: 5333018 - DNA, 21 bp, Homo sapiens
ttcaaagaaagactgtaagct

SEQ ID NO: 5333019 - DNA, 14 bp, Homo sapiens
ttcaaagaaatcca

SEQ ID NO: 5333020 - DNA, 18 bp, Homo sapiens
ttcaaagaacccccctcc

SEQ ID NO: 5333021 - DNA, 19 bp, Homo sapiens
ttcaaagaacccccctccc

SEQ ID NO: 5333022 - DNA, 21 bp, Homo sapiens
ttcaaagaacccccctcccca

SEQ ID NO: 5333023 - DNA, 17 bp, Homo sapiens
ttcaaagacaatcactg

SEQ ID NO: 5333024 - DNA, 21 bp, Homo sapiens
ttcaaagacggagtattcttt

SEQ ID NO: 5333025 - DNA, 15 bp, Homo sapiens
ttcaaagactcaaat

SEQ ID NO: 5333026 - DNA, 18 bp, Homo sapiens
ttcaaagactcaaatttt

SEQ ID NO: 5333027 - DNA, 17 bp, Homo sapiens
ttcaaagactgccacgt

SEQ ID NO: 5333028 - DNA, 15 bp, Homo sapiens
ttcaaagactgtgaa

SEQ ID NO: 5333029 - DNA, 18 bp, Homo sapiens
ttcaaagacttcatttaa

SEQ ID NO: 5333030 - DNA, 20 bp, Homo sapiens
ttcaaagacttcatttaaca

SEQ ID NO: 5333031 - DNA, 23 bp, Homo sapiens
ttcaaagagaaaacatctcatca

SEQ ID NO: 5333032 - DNA, 22 bp, Homo sapiens
ttcaaagaggtgaacattaaaa

SEQ ID NO: 5333033 - DNA, 22 bp, Homo sapiens
ttcaaagataaggcaacaaaat

SEQ ID NO: 5333034 - DNA, 22 bp, Homo sapiens
ttcaaagatacaagaaaaagta

SEQ ID NO: 5333035 - DNA, 15 bp, Homo sapiens
ttcaaagatgcattt

SEQ ID NO: 5333036 - DNA, 17 bp, Homo sapiens
ttcaaagattcaaaatt

SEQ ID NO: 5333037 - DNA, 19 bp, Homo sapiens
ttcaaagcacttaagtgtt

SEQ ID NO: 5333038 - DNA, 23 bp, Homo sapiens
ttcaaagccaagtttatatacaa

SEQ ID NO: 5333039 - DNA, 13 bp, Homo sapiens
ttcaaagccagcg

SEQ ID NO: 5333040 - DNA, 18 bp, Homo sapiens
ttcaaagccatatggaca

SEQ ID NO: 5333041 - DNA, 23 bp, Homo sapiens
ttcaaagccatatggacactgtg

SEQ ID NO: 5333042 - DNA, 14 bp, Homo sapiens
ttcaaagccatttt

SEQ ID NO: 5333043 - DNA, 20 bp, Homo sapiens
ttcaaagccctgcctctgtg

SEQ ID NO: 5333044 - DNA, 12 bp, Homo sapiens
ttcaaagccttc

SEQ ID NO: 5333045 - DNA, 19 bp, Homo sapiens
ttcaaagctaaaatatata

SEQ ID NO: 5333046 - DNA, 22 bp, Homo sapiens
ttcaaagctttttccagaggct

SEQ ID NO: 5333047 - DNA, 15 bp, Homo sapiens
ttcaaaggacaaaag

SEQ ID NO: 5333048 - DNA, 23 bp, Homo sapiens
ttcaaaggccacatacctctctg

SEQ ID NO: 5333049 - DNA, 15 bp, Homo sapiens
ttcaaagggtaaatt

SEQ ID NO: 5333050 - DNA, 16 bp, Homo sapiens
ttcaaaggttctaggt

SEQ ID NO: 5333051 - DNA, 20 bp, Homo sapiens
ttcaaagtactaaaactaga

SEQ ID NO: 5333052 - DNA, 18 bp, Homo sapiens
ttcaaagtatatacagag

SEQ ID NO: 5333053 - DNA, 18 bp, Homo sapiens
ttcaaagtcatgatgttt

SEQ ID NO: 5333054 - DNA, 14 bp, Homo sapiens
ttcaaagtgcctgg

SEQ ID NO: 5333055 - DNA, 18 bp, Homo sapiens
ttcaaagtgcctgggctc

SEQ ID NO: 5333056 - DNA, 22 bp, Homo sapiens
ttcaaagtgtatatttattcat

SEQ ID NO: 5333057 - DNA, 19 bp, Homo sapiens
ttcaaagtgtgtctgggat

SEQ ID NO: 5333058 - DNA, 21 bp, Homo sapiens
ttcaaagtgttgtgttcctgg

SEQ ID NO: 5333059 - DNA, 23 bp, Homo sapiens
ttcaaagtgttgtgttcctggct

SEQ ID NO: 5333060 - DNA, 18 bp, Homo sapiens
ttcaaagttaattttccc

SEQ ID NO: 5333061 - DNA, 11 bp, Homo sapiens
ttcaaagttgc

SEQ ID NO: 5333062 - DNA, 17 bp, Homo sapiens
ttcaaagttgcctaaat

SEQ ID NO: 5333063 - DNA, 21 bp, Homo sapiens
ttcaaagttgtagttcttgtg

SEQ ID NO: 5333064 - DNA, 20 bp, Homo sapiens
ttcaaagttttgttgtactt

SEQ ID NO: 5333065 - DNA, 15 bp, Homo sapiens
ttcaaataaccctga

SEQ ID NO: 5333066 - DNA, 15 bp, Homo sapiens
ttcaaataactgcag

SEQ ID NO: 5333067 - DNA, 23 bp, Homo sapiens
ttcaaataactgcagaaaaaata

SEQ ID NO: 5333068 - DNA, 14 bp, Homo sapiens
ttcaaatacaaagt

SEQ ID NO: 5333069 - DNA, 16 bp, Homo sapiens
ttcaaatacaaagtaa

SEQ ID NO: 5333070 - DNA, 17 bp, Homo sapiens
ttcaaatacattctaaa

SEQ ID NO: 5333071 - DNA, 14 bp, Homo sapiens
ttcaaatacttcaa

SEQ ID NO: 5333072 - DNA, 19 bp, Homo sapiens
ttcaaatacttcaaatcat

SEQ ID NO: 5333073 - DNA, 13 bp, Homo sapiens
ttcaaatagtata

SEQ ID NO: 5333074 - DNA, 20 bp, Homo sapiens
ttcaaatatgtaaactttaa

SEQ ID NO: 5333075 - DNA, 18 bp, Homo sapiens
ttcaaatattgaatgcct

SEQ ID NO: 5333076 - DNA, 13 bp, Homo sapiens
ttcaaatcagcaa

SEQ ID NO: 5333077 - DNA, 14 bp, Homo sapiens
ttcaaatcagtgat

SEQ ID NO: 5333078 - DNA, 22 bp, Homo sapiens
ttcaaatcagtgatctatgttt

SEQ ID NO: 5333079 - DNA, 18 bp, Homo sapiens
ttcaaatcattccttaga

SEQ ID NO: 5333080 - DNA, 23 bp, Homo sapiens
ttcaaatcattccttagatacct

SEQ ID NO: 5333081 - DNA, 18 bp, Homo sapiens
ttcaaatcccgcagcctc

SEQ ID NO: 5333082 - DNA, 16 bp, Homo sapiens
ttcaaatcctcttttg

SEQ ID NO: 5333083 - DNA, 16 bp, Homo sapiens
ttcaaatcctgccact

SEQ ID NO: 5333084 - DNA, 16 bp, Homo sapiens
ttcaaatccttccaaa

SEQ ID NO: 5333085 - DNA, 16 bp, Homo sapiens
ttcaaatctcttcctt

SEQ ID NO: 5333086 - DNA, 21 bp, Homo sapiens
ttcaaatctgtaatcagcaat

SEQ ID NO: 5333087 - DNA, 13 bp, Homo sapiens
ttcaaatgaagat

SEQ ID NO: 5333088 - DNA, 21 bp, Homo sapiens
ttcaaatgaagattcagcagt

SEQ ID NO: 5333089 - DNA, 22 bp, Homo sapiens
ttcaaatgaagattcagcagtg

SEQ ID NO: 5333090 - DNA, 22 bp, Homo sapiens
ttcaaatgatttttacaagttt

SEQ ID NO: 5333091 - DNA, 12 bp, Homo sapiens
ttcaaatgcaaa

SEQ ID NO: 5333092 - DNA, 15 bp, Homo sapiens
ttcaaatgcagcaat

SEQ ID NO: 5333093 - DNA, 22 bp, Homo sapiens
ttcaaatgcagcaatcccactt

SEQ ID NO: 5333094 - DNA, 23 bp, Homo sapiens
ttcaaatgggagactctttgaaa

SEQ ID NO: 5333095 - DNA, 16 bp, Homo sapiens
ttcaaatgggttttcc

SEQ ID NO: 5333096 - DNA, 20 bp, Homo sapiens
ttcaaatgtcagcttaaaat

SEQ ID NO: 5333097 - DNA, 19 bp, Homo sapiens
ttcaaatgtgcaatttgta

SEQ ID NO: 5333098 - DNA, 22 bp, Homo sapiens
ttcaaatgtgcaatttgtaaat

SEQ ID NO: 5333099 - DNA, 18 bp, Homo sapiens
ttcaaatgtgttttggtc

SEQ ID NO: 5333100 - DNA, 18 bp, Homo sapiens
ttcaaatgttacaaaaaa

SEQ ID NO: 5333101 - DNA, 16 bp, Homo sapiens
ttcaaatgttagatat

SEQ ID NO: 5333102 - DNA, 16 bp, Homo sapiens
ttcaaatgtttgaaaa

SEQ ID NO: 5333103 - DNA, 15 bp, Homo sapiens
ttcaaatgttttaaa

SEQ ID NO: 5333104 - DNA, 20 bp, Homo sapiens
ttcaaattaaagtgctgttt

SEQ ID NO: 5333105 - DNA, 18 bp, Homo sapiens
ttcaaattaatctttcta

SEQ ID NO: 5333106 - DNA, 19 bp, Homo sapiens
ttcaaattagaagacattt

SEQ ID NO: 5333107 - DNA, 16 bp, Homo sapiens
ttcaaattcctgcaaa

SEQ ID NO: 5333108 - DNA, 18 bp, Homo sapiens
ttcaaattcctgcaaaat

SEQ ID NO: 5333109 - DNA, 15 bp, Homo sapiens
ttcaaattctgatta

SEQ ID NO: 5333110 - DNA, 19 bp, Homo sapiens
ttcaaattcttctgaactc

SEQ ID NO: 5333111 - DNA, 22 bp, Homo sapiens
ttcaaattctttttttattatt

SEQ ID NO: 5333112 - DNA, 13 bp, Homo sapiens
ttcaaattgaatt

SEQ ID NO: 5333113 - DNA, 18 bp, Homo sapiens
ttcaaattgagagaatgg

SEQ ID NO: 5333114 - DNA, 15 bp, Homo sapiens
ttcaaattgctgctt

SEQ ID NO: 5333115 - DNA, 16 bp, Homo sapiens
ttcaaattgtcttttg

SEQ ID NO: 5333116 - DNA, 13 bp, Homo sapiens
ttcaaatttcaca

SEQ ID NO: 5333117 - DNA, 12 bp, Homo sapiens
ttcaaatttgat

SEQ ID NO: 5333118 - DNA, 15 bp, Homo sapiens
ttcaaatttgattct

SEQ ID NO: 5333119 - DNA, 19 bp, Homo sapiens
ttcaaatttgattctaaat

SEQ ID NO: 5333120 - DNA, 13 bp, Homo sapiens
ttcaaatttgtgt

SEQ ID NO: 5333121 - DNA, 13 bp, Homo sapiens
ttcaacaaacagt

SEQ ID NO: 5333122 - DNA, 12 bp, Homo sapiens
ttcaacaaacat

SEQ ID NO: 5333123 - DNA, 20 bp, Homo sapiens
ttcaacaaacatttgctgaa

SEQ ID NO: 5333124 - DNA, 21 bp, Homo sapiens
ttcaacaaagaaacaaagatg

SEQ ID NO: 5333125 - DNA, 19 bp, Homo sapiens
ttcaacaaatatcttgtgt

SEQ ID NO: 5333126 - DNA, 22 bp, Homo sapiens
ttcaacaaatattcactggccc

SEQ ID NO: 5333127 - DNA, 20 bp, Homo sapiens
ttcaacaaatttcattgcac

SEQ ID NO: 5333128 - DNA, 22 bp, Homo sapiens
ttcaacaaatttcattgcactt

SEQ ID NO: 5333129 - DNA, 15 bp, Homo sapiens
ttcaacaattctaaa

SEQ ID NO: 5333130 - DNA, 21 bp, Homo sapiens
ttcaacaattggtgtcatttt

SEQ ID NO: 5333131 - DNA, 20 bp, Homo sapiens
ttcaacacagcttgtctctt

SEQ ID NO: 5333132 - DNA, 22 bp, Homo sapiens
ttcaacacagcttgtctcttgc

SEQ ID NO: 5333133 - DNA, 23 bp, Homo sapiens
ttcaacagatgaccgtgtacaat

SEQ ID NO: 5333134 - DNA, 19 bp, Homo sapiens
ttcaacagcaagtgtgaat

SEQ ID NO: 5333135 - DNA, 20 bp, Homo sapiens
ttcaacagttacctccaaaa

SEQ ID NO: 5333136 - DNA, 17 bp, Homo sapiens
ttcaacagtttcaaaat

SEQ ID NO: 5333137 - DNA, 15 bp, Homo sapiens
ttcaacatcaatgtt

SEQ ID NO: 5333138 - DNA, 21 bp, Homo sapiens
ttcaacatcaatgttcattgt

SEQ ID NO: 5333139 - DNA, 15 bp, Homo sapiens
ttcaacatcctgcca

SEQ ID NO: 5333140 - DNA, 17 bp, Homo sapiens
ttcaacatgagtgtatt

SEQ ID NO: 5333141 - DNA, 17 bp, Homo sapiens
ttcaacatgttatttgt

SEQ ID NO: 5333142 - DNA, 18 bp, Homo sapiens
ttcaacattgatttttga

SEQ ID NO: 5333143 - DNA, 19 bp, Homo sapiens
ttcaaccacacctaaatta

SEQ ID NO: 5333144 - DNA, 21 bp, Homo sapiens
ttcaaccacagatttatacaa

SEQ ID NO: 5333145 - DNA, 19 bp, Homo sapiens
ttcaaccactgtaaaatga

SEQ ID NO: 5333146 - DNA, 16 bp, Homo sapiens
ttcaaccagcattcat

SEQ ID NO: 5333147 - DNA, 14 bp, Homo sapiens
ttcaaccagcattt

SEQ ID NO: 5333148 - DNA, 16 bp, Homo sapiens
ttcaaccagcatttta

SEQ ID NO: 5333149 - DNA, 17 bp, Homo sapiens
ttcaaccagcattttac

SEQ ID NO: 5333150 - DNA, 20 bp, Homo sapiens
ttcaaccagcattttactac

SEQ ID NO: 5333151 - DNA, 22 bp, Homo sapiens
ttcaaccatgaggtaaaagagc

SEQ ID NO: 5333152 - DNA, 20 bp, Homo sapiens
ttcaaccccacttcctactg

SEQ ID NO: 5333153 - DNA, 14 bp, Homo sapiens
ttcaaccctgccct

SEQ ID NO: 5333154 - DNA, 16 bp, Homo sapiens
ttcaacctaaatactg

SEQ ID NO: 5333155 - DNA, 20 bp, Homo sapiens
ttcaacctagaaacctttat

SEQ ID NO: 5333156 - DNA, 19 bp, Homo sapiens
ttcaacctggtggcaccag

SEQ ID NO: 5333157 - DNA, 17 bp, Homo sapiens
ttcaaccttaaggactt

SEQ ID NO: 5333158 - DNA, 13 bp, Homo sapiens
ttcaacgcagccc

SEQ ID NO: 5333159 - DNA, 14 bp, Homo sapiens
ttcaacgcagccct

SEQ ID NO: 5333160 - DNA, 19 bp, Homo sapiens
ttcaacgcagccctgcttt

SEQ ID NO: 5333161 - DNA, 16 bp, Homo sapiens
ttcaacggaaagtgct

SEQ ID NO: 5333162 - DNA, 20 bp, Homo sapiens
ttcaacgttggtatgataat

SEQ ID NO: 5333163 - DNA, 15 bp, Homo sapiens
ttcaacgtttcttca

SEQ ID NO: 5333164 - DNA, 20 bp, Homo sapiens
ttcaactacttctcttgcat

SEQ ID NO: 5333165 - DNA, 17 bp, Homo sapiens
ttcaactattcttcatt

SEQ ID NO: 5333166 - DNA, 11 bp, Homo sapiens
ttcaactattt

SEQ ID NO: 5333167 - DNA, 12 bp, Homo sapiens
ttcaactatttt

SEQ ID NO: 5333168 - DNA, 17 bp, Homo sapiens
ttcaactattttattat

SEQ ID NO: 5333169 - DNA, 21 bp, Homo sapiens
ttcaactcctcgacatcactg

SEQ ID NO: 5333170 - DNA, 14 bp, Homo sapiens
ttcaactcctggct

SEQ ID NO: 5333171 - DNA, 13 bp, Homo sapiens
ttcaactcctggg

SEQ ID NO: 5333172 - DNA, 13 bp, Homo sapiens
ttcaactgcccag

SEQ ID NO: 5333173 - DNA, 16 bp, Homo sapiens
ttcaactggaaattaa

SEQ ID NO: 5333174 - DNA, 18 bp, Homo sapiens
ttcaacttaaatcactga

SEQ ID NO: 5333175 - DNA, 14 bp, Homo sapiens
ttcaacttatttca

SEQ ID NO: 5333176 - DNA, 23 bp, Homo sapiens
ttcaacttatttctgaaaaagag

SEQ ID NO: 5333177 - DNA, 17 bp, Homo sapiens
ttcaagaaaaaataaat

SEQ ID NO: 5333178 - DNA, 23 bp, Homo sapiens
ttcaagaaaaaataaatggaaat

SEQ ID NO: 5333179 - DNA, 15 bp, Homo sapiens
ttcaagaaaactgga

SEQ ID NO: 5333180 - DNA, 12 bp, Homo sapiens
ttcaagaaactg

SEQ ID NO: 5333181 - DNA, 20 bp, Homo sapiens
ttcaagaaactgaggaattt

SEQ ID NO: 5333182 - DNA, 21 bp, Homo sapiens
ttcaagaaagatatctatgac

SEQ ID NO: 5333183 - DNA, 22 bp, Homo sapiens
ttcaagaaagccagtcttaaca

SEQ ID NO: 5333184 - DNA, 11 bp, Homo sapiens
ttcaagaaatg

SEQ ID NO: 5333185 - DNA, 14 bp, Homo sapiens
ttcaagaaatgaag

SEQ ID NO: 5333186 - DNA, 17 bp, Homo sapiens
ttcaagaaatgaagagc

SEQ ID NO: 5333187 - DNA, 23 bp, Homo sapiens
ttcaagaataatcacgctttcct

SEQ ID NO: 5333188 - DNA, 20 bp, Homo sapiens
ttcaagaatcagacagcagg

SEQ ID NO: 5333189 - DNA, 11 bp, Homo sapiens
ttcaagaatga

SEQ ID NO: 5333190 - DNA, 22 bp, Homo sapiens
ttcaagacaccaaattccaaac

SEQ ID NO: 5333191 - DNA, 18 bp, Homo sapiens
ttcaagacattaaatcta

SEQ ID NO: 5333192 - DNA, 18 bp, Homo sapiens
ttcaagaccttctcccca

SEQ ID NO: 5333193 - DNA, 16 bp, Homo sapiens
ttcaagacgaggggca

SEQ ID NO: 5333194 - DNA, 21 bp, Homo sapiens
ttcaagactgaaatggcttct

SEQ ID NO: 5333195 - DNA, 19 bp, Homo sapiens
ttcaagacttgagcggagc

SEQ ID NO: 5333196 - DNA, 14 bp, Homo sapiens
ttcaagagaagaaa

SEQ ID NO: 5333197 - DNA, 20 bp, Homo sapiens
ttcaagagaagaaaaaatta

SEQ ID NO: 5333198 - DNA, 18 bp, Homo sapiens
ttcaagagatttaattaa

SEQ ID NO: 5333199 - DNA, 21 bp, Homo sapiens
ttcaagaggagcccccaccct

SEQ ID NO: 5333200 - DNA, 22 bp, Homo sapiens
ttcaagaggagcccccaccctg

SEQ ID NO: 5333201 - DNA, 17 bp, Homo sapiens
ttcaagaggcgtgtgca

SEQ ID NO: 5333202 - DNA, 18 bp, Homo sapiens
ttcaagagggcaagtgga

SEQ ID NO: 5333203 - DNA, 23 bp, Homo sapiens
ttcaagataaggagaaagaaagt

SEQ ID NO: 5333204 - DNA, 13 bp, Homo sapiens
ttcaagatcaaaa

SEQ ID NO: 5333205 - DNA, 21 bp, Homo sapiens
ttcaagatctaaatcatatat

SEQ ID NO: 5333206 - DNA, 17 bp, Homo sapiens
ttcaagatgagcctggg

SEQ ID NO: 5333207 - DNA, 19 bp, Homo sapiens
ttcaagatgagcctgggct

SEQ ID NO: 5333208 - DNA, 21 bp, Homo sapiens
ttcaagatgagcctgggctca

SEQ ID NO: 5333209 - DNA, 19 bp, Homo sapiens
ttcaagatgttatattaaa

SEQ ID NO: 5333210 - DNA, 12 bp, Homo sapiens
ttcaagattcta

SEQ ID NO: 5333211 - DNA, 20 bp, Homo sapiens
ttcaagcaaacatcaaataa

SEQ ID NO: 5333212 - DNA, 21 bp, Homo sapiens
ttcaagcaaacatcaaataaa

SEQ ID NO: 5333213 - DNA, 14 bp, Homo sapiens
ttcaagcaaatatt

SEQ ID NO: 5333214 - DNA, 20 bp, Homo sapiens
ttcaagcaatcctcctgcct

SEQ ID NO: 5333215 - DNA, 16 bp, Homo sapiens
ttcaagcacactggaa

SEQ ID NO: 5333216 - DNA, 18 bp, Homo sapiens
ttcaagcacactggaata

SEQ ID NO: 5333217 - DNA, 19 bp, Homo sapiens
ttcaagcacactggaatat

SEQ ID NO: 5333218 - DNA, 17 bp, Homo sapiens
ttcaagcagtcgtgcct

SEQ ID NO: 5333219 - DNA, 18 bp, Homo sapiens
ttcaagcagtcgtgcctg

SEQ ID NO: 5333220 - DNA, 23 bp, Homo sapiens
ttcaagcagtcgtgcctgtgtcc

SEQ ID NO: 5333221 - DNA, 18 bp, Homo sapiens
ttcaagcattgctaaagt

SEQ ID NO: 5333222 - DNA, 14 bp, Homo sapiens
ttcaagccattcca

SEQ ID NO: 5333223 - DNA, 14 bp, Homo sapiens
ttcaagcccaggct

SEQ ID NO: 5333224 - DNA, 19 bp, Homo sapiens
ttcaagcccaggcttcctg

SEQ ID NO: 5333225 - DNA, 12 bp, Homo sapiens
ttcaagccctcc

SEQ ID NO: 5333226 - DNA, 20 bp, Homo sapiens
ttcaagcctgtgcaatgcat

SEQ ID NO: 5333227 - DNA, 15 bp, Homo sapiens
ttcaagcctgtggga

SEQ ID NO: 5333228 - DNA, 15 bp, Homo sapiens
ttcaagccttccagg

SEQ ID NO: 5333229 - DNA, 21 bp, Homo sapiens
ttcaagcgactctcctgcctc

SEQ ID NO: 5333230 - DNA, 22 bp, Homo sapiens
ttcaagcgactctcctgcctca

SEQ ID NO: 5333231 - DNA, 16 bp, Homo sapiens
ttcaagcgattctctt

SEQ ID NO: 5333232 - DNA, 21 bp, Homo sapiens
ttcaagcgattcttctgcttc

SEQ ID NO: 5333233 - DNA, 15 bp, Homo sapiens
ttcaagcgctccagg

SEQ ID NO: 5333234 - DNA, 14 bp, Homo sapiens
ttcaagctatttaa

SEQ ID NO: 5333235 - DNA, 14 bp, Homo sapiens
ttcaagctctgagg

SEQ ID NO: 5333236 - DNA, 15 bp, Homo sapiens
ttcaagctgagaaaa

SEQ ID NO: 5333237 - DNA, 24 bp, Homo sapiens
ttcaagctgagaaaagtattctca

SEQ ID NO: 5333238 - DNA, 18 bp, Homo sapiens
ttcaagcttttcctttct

SEQ ID NO: 5333239 - DNA, 14 bp, Homo sapiens
ttcaagctttttgt

SEQ ID NO: 5333240 - DNA, 20 bp, Homo sapiens
ttcaagctttttgtgagaaa

SEQ ID NO: 5333241 - DNA, 23 bp, Homo sapiens
ttcaagctttttgtgagaaagag

SEQ ID NO: 5333242 - DNA, 14 bp, Homo sapiens
ttcaaggaaaataa

SEQ ID NO: 5333243 - DNA, 14 bp, Homo sapiens
ttcaaggaaagtga

SEQ ID NO: 5333244 - DNA, 16 bp, Homo sapiens
ttcaaggaagaaaacg

SEQ ID NO: 5333245 - DNA, 18 bp, Homo sapiens
ttcaaggaagaaaacgga

SEQ ID NO: 5333246 - DNA, 19 bp, Homo sapiens
ttcaaggaatagagttttc

SEQ ID NO: 5333247 - DNA, 21 bp, Homo sapiens
ttcaaggaatccatcctgcaa

SEQ ID NO: 5333248 - DNA, 19 bp, Homo sapiens
ttcaaggacattggtgaga

SEQ ID NO: 5333249 - DNA, 16 bp, Homo sapiens
ttcaaggactgtttca

SEQ ID NO: 5333250 - DNA, 22 bp, Homo sapiens
ttcaaggactgtttcagtgtga

SEQ ID NO: 5333251 - DNA, 16 bp, Homo sapiens
ttcaaggagaatatga

SEQ ID NO: 5333252 - DNA, 16 bp, Homo sapiens
ttcaaggatcctgagc

SEQ ID NO: 5333253 - DNA, 19 bp, Homo sapiens
ttcaaggatcctgagccag

SEQ ID NO: 5333254 - DNA, 17 bp, Homo sapiens
ttcaaggcactctagat

SEQ ID NO: 5333255 - DNA, 18 bp, Homo sapiens
ttcaaggcactctagatt

SEQ ID NO: 5333256 - DNA, 21 bp, Homo sapiens
ttcaaggcactctagattcca

SEQ ID NO: 5333257 - DNA, 14 bp, Homo sapiens
ttcaaggcctcccc

SEQ ID NO: 5333258 - DNA, 13 bp, Homo sapiens
ttcaaggccttca

SEQ ID NO: 5333259 - DNA, 13 bp, Homo sapiens
ttcaaggctcaga

SEQ ID NO: 5333260 - DNA, 17 bp, Homo sapiens
ttcaaggctcagaagga

SEQ ID NO: 5333261 - DNA, 13 bp, Homo sapiens
ttcaaggctttaa

SEQ ID NO: 5333262 - DNA, 15 bp, Homo sapiens
ttcaaggtaaaattc

SEQ ID NO: 5333263 - DNA, 18 bp, Homo sapiens
ttcaaggtaaaattctaa

SEQ ID NO: 5333264 - DNA, 19 bp, Homo sapiens
ttcaaggtaaaattctaaa

SEQ ID NO: 5333265 - DNA, 16 bp, Homo sapiens
ttcaaggttttaaaac

SEQ ID NO: 5333266 - DNA, 12 bp, Homo sapiens
ttcaagtaacac

SEQ ID NO: 5333267 - DNA, 21 bp, Homo sapiens
ttcaagtaagatcaagaatct

SEQ ID NO: 5333268 - DNA, 16 bp, Homo sapiens
ttcaagtaataaaaca

SEQ ID NO: 5333269 - DNA, 16 bp, Homo sapiens
ttcaagtaattgtgaa

SEQ ID NO: 5333270 - DNA, 19 bp, Homo sapiens
ttcaagtaattttcatatt

SEQ ID NO: 5333271 - DNA, 17 bp, Homo sapiens
ttcaagtacactgaatt

SEQ ID NO: 5333272 - DNA, 16 bp, Homo sapiens
ttcaagtagctgggat

SEQ ID NO: 5333273 - DNA, 16 bp, Homo sapiens
ttcaagtattaagcag

SEQ ID NO: 5333274 - DNA, 15 bp, Homo sapiens
ttcaagtattatatt

SEQ ID NO: 5333275 - DNA, 15 bp, Homo sapiens
ttcaagtatttaagc

SEQ ID NO: 5333276 - DNA, 19 bp, Homo sapiens
ttcaagtcgcggctgcagg

SEQ ID NO: 5333277 - DNA, 21 bp, Homo sapiens
ttcaagtgactctcctgcctc

SEQ ID NO: 5333278 - DNA, 14 bp, Homo sapiens
ttcaagtgatatat

SEQ ID NO: 5333279 - DNA, 20 bp, Homo sapiens
ttcaagtgatatatgtattt

SEQ ID NO: 5333280 - DNA, 22 bp, Homo sapiens
ttcaagtgatctttcaatatca

SEQ ID NO: 5333281 - DNA, 13 bp, Homo sapiens
ttcaagtgattct

SEQ ID NO: 5333282 - DNA, 17 bp, Homo sapiens
ttcaagtgattctcatg

SEQ ID NO: 5333283 - DNA, 20 bp, Homo sapiens
ttcaagtgattctcctgcct

SEQ ID NO: 5333284 - DNA, 22 bp, Homo sapiens
ttcaagtgattctcctgcctca

SEQ ID NO: 5333285 - DNA, 14 bp, Homo sapiens
ttcaagtgcctaga

SEQ ID NO: 5333286 - DNA, 13 bp, Homo sapiens
ttcaagtgccttt

SEQ ID NO: 5333287 - DNA, 22 bp, Homo sapiens
ttcaagtgccttttgctgcgca

SEQ ID NO: 5333288 - DNA, 18 bp, Homo sapiens
ttcaagtggggctcgcca

SEQ ID NO: 5333289 - DNA, 19 bp, Homo sapiens
ttcaagtgtaaaatatttt

SEQ ID NO: 5333290 - DNA, 17 bp, Homo sapiens
ttcactccccctaaacc

SEQ ID NO: 5333291 - DNA, 23 bp, Homo sapiens
ttcactccggtgtgcctgcagcc

SEQ ID NO: 5333292 - DNA, 13 bp, Homo sapiens
ttcactcctgctt

SEQ ID NO: 5333293 - DNA, 17 bp, Homo sapiens
ttcactcctgcttctct

SEQ ID NO: 5333294 - DNA, 21 bp, Homo sapiens
ttcactcctgcttctctcagc

SEQ ID NO: 5333295 - DNA, 15 bp, Homo sapiens
ttcactctaaaaata

SEQ ID NO: 5333296 - DNA, 19 bp, Homo sapiens
ttcactctaaaaatagaat

SEQ ID NO: 5333297 - DNA, 18 bp, Homo sapiens
ttcactctaagatgttat

SEQ ID NO: 5333298 - DNA, 18 bp, Homo sapiens
ttcactctaagtcatgta

SEQ ID NO: 5333299 - DNA, 19 bp, Homo sapiens
ttcactctaagtcatgtat

SEQ ID NO: 5333300 - DNA, 15 bp, Homo sapiens
ttcactctccagggt

SEQ ID NO: 5333301 - DNA, 13 bp, Homo sapiens
ttcactcttaggc

SEQ ID NO: 5333302 - DNA, 23 bp, Homo sapiens
ttcactcttaggcactttggggg

SEQ ID NO: 5333303 - DNA, 20 bp, Homo sapiens
ttcactcttcaaatgcctga

SEQ ID NO: 5333304 - DNA, 16 bp, Homo sapiens
ttcactcttcacttga

SEQ ID NO: 5333305 - DNA, 15 bp, Homo sapiens
ttcactcttccagaa

SEQ ID NO: 5333306 - DNA, 14 bp, Homo sapiens
ttcactctttccag

SEQ ID NO: 5333307 - DNA, 16 bp, Homo sapiens
ttcactgaacatgcct

SEQ ID NO: 5333308 - DNA, 13 bp, Homo sapiens
ttcactgaatatc

SEQ ID NO: 5333309 - DNA, 19 bp, Homo sapiens
ttcactgaatttcaaacat

SEQ ID NO: 5333310 - DNA, 12 bp, Homo sapiens
ttcactgacact

SEQ ID NO: 5333311 - DNA, 15 bp, Homo sapiens
ttcactgagctcccc

SEQ ID NO: 5333312 - DNA, 16 bp, Homo sapiens
ttcactgagctcccca

SEQ ID NO: 5333313 - DNA, 21 bp, Homo sapiens
ttcactgagctccccagatct

SEQ ID NO: 5333314 - DNA, 14 bp, Homo sapiens
ttcactgagtctca

SEQ ID NO: 5333315 - DNA, 23 bp, Homo sapiens
ttcactgattggaagagtgacct

SEQ ID NO: 5333316 - DNA, 18 bp, Homo sapiens
ttcactgcaaacacacct

SEQ ID NO: 5333317 - DNA, 19 bp, Homo sapiens
ttcactgcaaacacacctt

SEQ ID NO: 5333318 - DNA, 21 bp, Homo sapiens
ttcactgcaaacacaccttgg

SEQ ID NO: 5333319 - DNA, 19 bp, Homo sapiens
ttcactgcaatgtcaaagt

SEQ ID NO: 5333320 - DNA, 15 bp, Homo sapiens
ttcactgcaattttg

SEQ ID NO: 5333321 - DNA, 20 bp, Homo sapiens
ttcactgcatggctcccaca

SEQ ID NO: 5333322 - DNA, 22 bp, Homo sapiens
ttcactgccccacttctggcat

SEQ ID NO: 5333323 - DNA, 13 bp, Homo sapiens
ttcactgccccca

SEQ ID NO: 5333324 - DNA, 13 bp, Homo sapiens
ttcactgccttcc

SEQ ID NO: 5333325 - DNA, 12 bp, Homo sapiens
ttcactgctgct

SEQ ID NO: 5333326 - DNA, 15 bp, Homo sapiens
ttcactgctgctcct

SEQ ID NO: 5333327 - DNA, 21 bp, Homo sapiens
ttcactggaaaggaaagatga

SEQ ID NO: 5333328 - DNA, 15 bp, Homo sapiens
ttcactggagcacaa

SEQ ID NO: 5333329 - DNA, 17 bp, Homo sapiens
ttcactggagcacaata

SEQ ID NO: 5333330 - DNA, 16 bp, Homo sapiens
ttcactggagttacat

SEQ ID NO: 5333331 - DNA, 20 bp, Homo sapiens
ttcactggcataaatctgaa

SEQ ID NO: 5333332 - DNA, 13 bp, Homo sapiens
ttcactggcccaa

SEQ ID NO: 5333333 - DNA, 16 bp, Homo sapiens
ttcactggcgccttct

SEQ ID NO: 5333334 - DNA, 19 bp, Homo sapiens
ttcactggggcatgagatt

SEQ ID NO: 5333335 - DNA, 13 bp, Homo sapiens
ttcactgtaagtt

SEQ ID NO: 5333336 - DNA, 22 bp, Homo sapiens
ttcactgtagaatgatttcatg

SEQ ID NO: 5333337 - DNA, 17 bp, Homo sapiens
ttcactgtagctctaaa

SEQ ID NO: 5333338 - DNA, 11 bp, Homo sapiens
ttcactgtata

SEQ ID NO: 5333339 - DNA, 13 bp, Homo sapiens
ttcactgtataaa

SEQ ID NO: 5333340 - DNA, 15 bp, Homo sapiens
ttcactgtataaact

SEQ ID NO: 5333341 - DNA, 22 bp, Homo sapiens
ttcactgtataaataggagagg

SEQ ID NO: 5333342 - DNA, 13 bp, Homo sapiens
ttcactgtatata

SEQ ID NO: 5333343 - DNA, 19 bp, Homo sapiens
ttcactgtatataaacata

SEQ ID NO: 5333344 - DNA, 17 bp, Homo sapiens
ttcactgtcatcttcaa

SEQ ID NO: 5333345 - DNA, 16 bp, Homo sapiens
ttcactgtctttaatt

SEQ ID NO: 5333346 - DNA, 21 bp, Homo sapiens
ttcactgtgaggggaaggcct

SEQ ID NO: 5333347 - DNA, 12 bp, Homo sapiens
ttcactgtgctg

SEQ ID NO: 5333348 - DNA, 21 bp, Homo sapiens
ttcactgttgaatgcctgtcc

SEQ ID NO: 5333349 - DNA, 20 bp, Homo sapiens
ttcactgttgtacacagtct

SEQ ID NO: 5333350 - DNA, 19 bp, Homo sapiens
ttcactgtttcatctaagt

SEQ ID NO: 5333351 - DNA, 23 bp, Homo sapiens
ttcactgtttcatctaagtgcct

SEQ ID NO: 5333352 - DNA, 18 bp, Homo sapiens
ttcacttaaaagctggct

SEQ ID NO: 5333353 - DNA, 16 bp, Homo sapiens
ttcacttaaactttgt

SEQ ID NO: 5333354 - DNA, 22 bp, Homo sapiens
ttcacttaagttagttccactg

SEQ ID NO: 5333355 - DNA, 13 bp, Homo sapiens
ttcacttaagttt

SEQ ID NO: 5333356 - DNA, 22 bp, Homo sapiens
ttcacttacaagaaaggcctga

SEQ ID NO: 5333357 - DNA, 14 bp, Homo sapiens
ttcacttactctta

SEQ ID NO: 5333358 - DNA, 22 bp, Homo sapiens
ttcacttatgaatgatttgcat

SEQ ID NO: 5333359 - DNA, 15 bp, Homo sapiens
ttcacttcagcttaa

SEQ ID NO: 5333360 - DNA, 16 bp, Homo sapiens
ttcacttcatcttctc

SEQ ID NO: 5333361 - DNA, 12 bp, Homo sapiens
ttcacttcccct

SEQ ID NO: 5333362 - DNA, 20 bp, Homo sapiens
ttcacttcctccagaagcct

SEQ ID NO: 5333363 - DNA, 21 bp, Homo sapiens
ttcacttcctctccacaggag

SEQ ID NO: 5333364 - DNA, 22 bp, Homo sapiens
ttcacttcctctccacaggagc

SEQ ID NO: 5333365 - DNA, 23 bp, Homo sapiens
ttcacttcctctccacaggagcc

SEQ ID NO: 5333366 - DNA, 20 bp, Homo sapiens
ttcacttcgggctgtgtaaa

SEQ ID NO: 5333367 - DNA, 15 bp, Homo sapiens
ttcacttctatttat

SEQ ID NO: 5333368 - DNA, 19 bp, Homo sapiens
ttcacttctgactcttccc

SEQ ID NO: 5333369 - DNA, 13 bp, Homo sapiens
ttcacttctgcat

SEQ ID NO: 5333370 - DNA, 23 bp, Homo sapiens
ttcacttctgcattcctgtaact

SEQ ID NO: 5333371 - DNA, 20 bp, Homo sapiens
ttcacttctgggaaattgaa

SEQ ID NO: 5333372 - DNA, 13 bp, Homo sapiens
ttcacttctttcc

SEQ ID NO: 5333373 - DNA, 19 bp, Homo sapiens
ttcacttgaaattaaagct

SEQ ID NO: 5333374 - DNA, 16 bp, Homo sapiens
ttcacttgagttggct

SEQ ID NO: 5333375 - DNA, 19 bp, Homo sapiens
ttcacttgagttggctgtg

SEQ ID NO: 5333376 - DNA, 15 bp, Homo sapiens
ttcacttgcactggg

SEQ ID NO: 5333377 - DNA, 15 bp, Homo sapiens
ttcacttgccaagtg

SEQ ID NO: 5333378 - DNA, 21 bp, Homo sapiens
ttcacttgtattgactttatg

SEQ ID NO: 5333379 - DNA, 19 bp, Homo sapiens
ttcacttgtgttttaaaat

SEQ ID NO: 5333380 - DNA, 13 bp, Homo sapiens
ttcactttaattc

SEQ ID NO: 5333381 - DNA, 16 bp, Homo sapiens
ttcactttagatgctg

SEQ ID NO: 5333382 - DNA, 14 bp, Homo sapiens
ttcactttcaggaa

SEQ ID NO: 5333383 - DNA, 15 bp, Homo sapiens
ttcactttcattttt

SEQ ID NO: 5333384 - DNA, 15 bp, Homo sapiens
ttcactttcctcagt

SEQ ID NO: 5333385 - DNA, 16 bp, Homo sapiens
ttcactttcttcaaag

SEQ ID NO: 5333386 - DNA, 23 bp, Homo sapiens
ttcactttgaaaagttggaagga

SEQ ID NO: 5333387 - DNA, 22 bp, Homo sapiens
ttcactttgctctcaattaaag

SEQ ID NO: 5333388 - DNA, 14 bp, Homo sapiens
ttcactttggtcac

SEQ ID NO: 5333389 - DNA, 15 bp, Homo sapiens
ttcacttttctgtaa

SEQ ID NO: 5333390 - DNA, 23 bp, Homo sapiens
ttcacttttctgtaaatatacat

SEQ ID NO: 5333391 - DNA, 17 bp, Homo sapiens
ttcacttttgacaaagg

SEQ ID NO: 5333392 - DNA, 20 bp, Homo sapiens
ttcacttttgacaaaggcaa

SEQ ID NO: 5333393 - DNA, 11 bp, Homo sapiens
ttcagaaaaaa

SEQ ID NO: 5333394 - DNA, 12 bp, Homo sapiens
ttcagaaaacag

SEQ ID NO: 5333395 - DNA, 18 bp, Homo sapiens
ttcagaaaacagaaaaaa

SEQ ID NO: 5333396 - DNA, 18 bp, Homo sapiens
ttcagaaaacataatata

SEQ ID NO: 5333397 - DNA, 20 bp, Homo sapiens
ttcagaaaacataatataag

SEQ ID NO: 5333398 - DNA, 23 bp, Homo sapiens
ttcagaaaacccttttctacagt

SEQ ID NO: 5333399 - DNA, 18 bp, Homo sapiens
ttcagaaaacgggaagcg

SEQ ID NO: 5333400 - DNA, 19 bp, Homo sapiens
ttcagaaaacttcaagaca

SEQ ID NO: 5333401 - DNA, 19 bp, Homo sapiens
ttcagaaaatgttctgttt

SEQ ID NO: 5333402 - DNA, 15 bp, Homo sapiens
ttcagaaacagggca

SEQ ID NO: 5333403 - DNA, 15 bp, Homo sapiens
ttcagaaactacaga

SEQ ID NO: 5333404 - DNA, 17 bp, Homo sapiens
ttcagaaactttttcta

SEQ ID NO: 5333405 - DNA, 19 bp, Homo sapiens
ttcagaaactttttctaaa

SEQ ID NO: 5333406 - DNA, 21 bp, Homo sapiens
ttcagaaagcctttcattttg

SEQ ID NO: 5333407 - DNA, 19 bp, Homo sapiens
ttcagaaagggcagcccct

SEQ ID NO: 5333408 - DNA, 23 bp, Homo sapiens
ttcagaaaggggcattttgtact

SEQ ID NO: 5333409 - DNA, 20 bp, Homo sapiens
ttcagaaaggggctcttctg

SEQ ID NO: 5333410 - DNA, 18 bp, Homo sapiens
ttcagaaagtgtgcttta

SEQ ID NO: 5333411 - DNA, 16 bp, Homo sapiens
ttcagaaatagctcct

SEQ ID NO: 5333412 - DNA, 15 bp, Homo sapiens
ttcagaaatataaca

SEQ ID NO: 5333413 - DNA, 17 bp, Homo sapiens
ttcagaaatgctgcctg

SEQ ID NO: 5333414 - DNA, 21 bp, Homo sapiens
ttcagaaatgctgcctgcctg

SEQ ID NO: 5333415 - DNA, 15 bp, Homo sapiens
ttcagaaattaaaat

SEQ ID NO: 5333416 - DNA, 16 bp, Homo sapiens
ttcagaaattctcaaa

SEQ ID NO: 5333417 - DNA, 21 bp, Homo sapiens
ttcagaaattggaacagaatg

SEQ ID NO: 5333418 - DNA, 16 bp, Homo sapiens
ttcagaacatcctcca

SEQ ID NO: 5333419 - DNA, 16 bp, Homo sapiens
ttcagaacctcttccc

SEQ ID NO: 5333420 - DNA, 18 bp, Homo sapiens
ttcagaacctcttcccca

SEQ ID NO: 5333421 - DNA, 16 bp, Homo sapiens
ttcagaactatttaaa

SEQ ID NO: 5333422 - DNA, 20 bp, Homo sapiens
ttcagaactatttaaaataa

SEQ ID NO: 5333423 - DNA, 19 bp, Homo sapiens
ttcagaactgcccttgctg

SEQ ID NO: 5333424 - DNA, 23 bp, Homo sapiens
ttcagaactgcccttgctgcccg

SEQ ID NO: 5333425 - DNA, 17 bp, Homo sapiens
ttcagaacttgtaacta

SEQ ID NO: 5333426 - DNA, 11 bp, Homo sapiens
ttcagaagaat

SEQ ID NO: 5333427 - DNA, 20 bp, Homo sapiens
ttcagaagaatcttcctggc

SEQ ID NO: 5333428 - DNA, 23 bp, Homo sapiens
ttcagaagaatcttcctggcaca

SEQ ID NO: 5333429 - DNA, 16 bp, Homo sapiens
ttcagaagacactgca

SEQ ID NO: 5333430 - DNA, 11 bp, Homo sapiens
ttcagaagacc

SEQ ID NO: 5333431 - DNA, 14 bp, Homo sapiens
ttcagaagcatcac

SEQ ID NO: 5333432 - DNA, 23 bp, Homo sapiens
ttcagaaggtaggggccgtgtcc

SEQ ID NO: 5333433 - DNA, 15 bp, Homo sapiens
ttcagaagtgattta

SEQ ID NO: 5333434 - DNA, 15 bp, Homo sapiens
ttcagaagttaacat

SEQ ID NO: 5333435 - DNA, 18 bp, Homo sapiens
ttcagaagttaacatcaa

SEQ ID NO: 5333436 - DNA, 14 bp, Homo sapiens
ttcagaagtttaaa

SEQ ID NO: 5333437 - DNA, 17 bp, Homo sapiens
ttcagaatatcatcttt

SEQ ID NO: 5333438 - DNA, 14 bp, Homo sapiens
ttcagaatatctta

SEQ ID NO: 5333439 - DNA, 16 bp, Homo sapiens
ttcagaatattttcaa

SEQ ID NO: 5333440 - DNA, 15 bp, Homo sapiens
ttcagaatctgaatg

SEQ ID NO: 5333441 - DNA, 16 bp, Homo sapiens
ttcagaatctttgtta

SEQ ID NO: 5333442 - DNA, 23 bp, Homo sapiens
ttcagaatggcagtcctggaggc

SEQ ID NO: 5333443 - DNA, 24 bp, Homo sapiens
ttcagaatggcagtcctggaggca

SEQ ID NO: 5333444 - DNA, 14 bp, Homo sapiens
ttcagaatgttgtg

SEQ ID NO: 5333445 - DNA, 17 bp, Homo sapiens
ttcagaattaaactttt

SEQ ID NO: 5333446 - DNA, 20 bp, Homo sapiens
ttcagaattatccattacgt

SEQ ID NO: 5333447 - DNA, 13 bp, Homo sapiens
ttcagaatttagt

SEQ ID NO: 5333448 - DNA, 11 bp, Homo sapiens
ttcagacaaca

SEQ ID NO: 5333449 - DNA, 13 bp, Homo sapiens
ttcagacaacatt

SEQ ID NO: 5333450 - DNA, 23 bp, Homo sapiens
ttcagacaatatatcataactta

SEQ ID NO: 5333451 - DNA, 14 bp, Homo sapiens
ttcagacacagctc

SEQ ID NO: 5333452 - DNA, 24 bp, Homo sapiens
ttcagacacagctcttccagggca

SEQ ID NO: 5333453 - DNA, 18 bp, Homo sapiens
ttcagacacaggaaaaat

SEQ ID NO: 5333454 - DNA, 21 bp, Homo sapiens
ttcagacacaggaaaaataaa

SEQ ID NO: 5333455 - DNA, 13 bp, Homo sapiens
ttcagacacattt

SEQ ID NO: 5333456 - DNA, 15 bp, Homo sapiens
ttcagacacattttt

SEQ ID NO: 5333457 - DNA, 20 bp, Homo sapiens
ttcagacacctgttcacaga

SEQ ID NO: 5333458 - DNA, 14 bp, Homo sapiens
ttcagacagctgcc

SEQ ID NO: 5333459 - DNA, 16 bp, Homo sapiens
ttcagacagctgcctg

SEQ ID NO: 5333460 - DNA, 21 bp, Homo sapiens
ttcagacagctgcctgggatc

SEQ ID NO: 5333461 - DNA, 12 bp, Homo sapiens
ttcagacatttt

SEQ ID NO: 5333462 - DNA, 23 bp, Homo sapiens
ttcagacccccccatttcccgca

SEQ ID NO: 5333463 - DNA, 18 bp, Homo sapiens
ttcagacccctgcctgga

SEQ ID NO: 5333464 - DNA, 17 bp, Homo sapiens
ttcagaccctgggtcag

SEQ ID NO: 5333465 - DNA, 15 bp, Homo sapiens
ttcagacgagatcct

SEQ ID NO: 5333466 - DNA, 12 bp, Homo sapiens
ttcagactcaga

SEQ ID NO: 5333467 - DNA, 13 bp, Homo sapiens
ttcagactcagac

SEQ ID NO: 5333468 - DNA, 12 bp, Homo sapiens
ttcagagaagtc

SEQ ID NO: 5333469 - DNA, 17 bp, Homo sapiens
ttcagagaattactatt

SEQ ID NO: 5333470 - DNA, 18 bp, Homo sapiens
ttcagagaattatctcaa

SEQ ID NO: 5333471 - DNA, 22 bp, Homo sapiens
ttcagagaccttaatttatatt

SEQ ID NO: 5333472 - DNA, 16 bp, Homo sapiens
ttcagagactggcagc

SEQ ID NO: 5333473 - DNA, 20 bp, Homo sapiens
ttcagagactggcagccagg

SEQ ID NO: 5333474 - DNA, 15 bp, Homo sapiens
ttcagagagctggta

SEQ ID NO: 5333475 - DNA, 22 bp, Homo sapiens
ttcagagagtcaatgtcattac

SEQ ID NO: 5333476 - DNA, 13 bp, Homo sapiens
ttcagagatcaag

SEQ ID NO: 5333477 - DNA, 18 bp, Homo sapiens
ttcagagcataaaaccta

SEQ ID NO: 5333478 - DNA, 17 bp, Homo sapiens
ttcagagccaagcctta

SEQ ID NO: 5333479 - DNA, 13 bp, Homo sapiens
ttcagagcctagc

SEQ ID NO: 5333480 - DNA, 14 bp, Homo sapiens
ttcagagcctagcc

SEQ ID NO: 5333481 - DNA, 19 bp, Homo sapiens
ttcagagcctagccacctc

SEQ ID NO: 5333482 - DNA, 22 bp, Homo sapiens
ttcagagcctcctttctggctt

SEQ ID NO: 5333483 - DNA, 23 bp, Homo sapiens
ttcagagctgacacaggatgaag

SEQ ID NO: 5333484 - DNA, 13 bp, Homo sapiens
ttcagagctgccc

SEQ ID NO: 5333485 - DNA, 14 bp, Homo sapiens
ttcagagctgccct

SEQ ID NO: 5333486 - DNA, 15 bp, Homo sapiens
ttcagagctgccctc

SEQ ID NO: 5333487 - DNA, 13 bp, Homo sapiens
ttcagaggctcag

SEQ ID NO: 5333488 - DNA, 16 bp, Homo sapiens
ttcagaggctgaggtg

SEQ ID NO: 5333489 - DNA, 19 bp, Homo sapiens
ttcagaggctgcaggactt

SEQ ID NO: 5333490 - DNA, 17 bp, Homo sapiens
ttcagagggaaagtaaa

SEQ ID NO: 5333491 - DNA, 23 bp, Homo sapiens
ttcagagggtaagtaaacagatt

SEQ ID NO: 5333492 - DNA, 22 bp, Homo sapiens
ttcagagggtgtcgtcctgcag

SEQ ID NO: 5333493 - DNA, 17 bp, Homo sapiens
ttcagaggtgaattaat

SEQ ID NO: 5333494 - DNA, 19 bp, Homo sapiens
ttcagaggtggctctggaa

SEQ ID NO: 5333495 - DNA, 19 bp, Homo sapiens
ttcagagtacgtcctgcct

SEQ ID NO: 5333496 - DNA, 21 bp, Homo sapiens
ttcagagtacgtcctgcctgg

SEQ ID NO: 5333497 - DNA, 14 bp, Homo sapiens
ttcagagtgaatca

SEQ ID NO: 5333498 - DNA, 20 bp, Homo sapiens
ttcagagtgaatcatccaga

SEQ ID NO: 5333499 - DNA, 23 bp, Homo sapiens
ttcagagtggctcactggctggg

SEQ ID NO: 5333500 - DNA, 18 bp, Homo sapiens
ttcagagttgtacactgt

SEQ ID NO: 5333501 - DNA, 22 bp, Homo sapiens
ttcagagtttggttaatcagtg

SEQ ID NO: 5333502 - DNA, 15 bp, Homo sapiens
ttcagataaatcatg

SEQ ID NO: 5333503 - DNA, 22 bp, Homo sapiens
ttcagataaatttcaattagat

SEQ ID NO: 5333504 - DNA, 17 bp, Homo sapiens
ttcagataactgttatt

SEQ ID NO: 5333505 - DNA, 23 bp, Homo sapiens
ttcagataactgttatttataat

SEQ ID NO: 5333506 - DNA, 13 bp, Homo sapiens
ttcagataatggt

SEQ ID NO: 5333507 - DNA, 16 bp, Homo sapiens
ttcagataatggtaat

SEQ ID NO: 5333508 - DNA, 18 bp, Homo sapiens
ttcagataatggtaattt

SEQ ID NO: 5333509 - DNA, 21 bp, Homo sapiens
ttcagataatggtaatttagt

SEQ ID NO: 5333510 - DNA, 21 bp, Homo sapiens
ttcagatacagggtgctcctt

SEQ ID NO: 5333511 - DNA, 12 bp, Homo sapiens
ttcagatacatg

SEQ ID NO: 5333512 - DNA, 17 bp, Homo sapiens
ttcagatataagatttg

SEQ ID NO: 5333513 - DNA, 21 bp, Homo sapiens
ttcagatataagatttgtaca

SEQ ID NO: 5333514 - DNA, 15 bp, Homo sapiens
ttcagatatatatca

SEQ ID NO: 5333515 - DNA, 16 bp, Homo sapiens
ttcagatatatttttc

SEQ ID NO: 5333516 - DNA, 16 bp, Homo sapiens
ttcagatatcaaaatt

SEQ ID NO: 5333517 - DNA, 16 bp, Homo sapiens
ttcagatatgattcaa

SEQ ID NO: 5333518 - DNA, 17 bp, Homo sapiens
ttcagatatgattcaaa

SEQ ID NO: 5333519 - DNA, 18 bp, Homo sapiens
ttcagatcaaaatgcctt

SEQ ID NO: 5333520 - DNA, 21 bp, Homo sapiens
ttcagatcaaaatgcctttca

SEQ ID NO: 5333521 - DNA, 16 bp, Homo sapiens
ttcagatcactgaatt

SEQ ID NO: 5333522 - DNA, 18 bp, Homo sapiens
ttcagatcactgaattta

SEQ ID NO: 5333523 - DNA, 17 bp, Homo sapiens
ttcagatcagtgcttga

SEQ ID NO: 5333524 - DNA, 13 bp, Homo sapiens
ttcagatcattta

SEQ ID NO: 5333525 - DNA, 13 bp, Homo sapiens
ttcagatcctacc

SEQ ID NO: 5333526 - DNA, 15 bp, Homo sapiens
ttcagatcctacccc

SEQ ID NO: 5333527 - DNA, 14 bp, Homo sapiens
ttcagatccttcca

SEQ ID NO: 5333528 - DNA, 17 bp, Homo sapiens
ttcagatccttccaaac

SEQ ID NO: 5333529 - DNA, 19 bp, Homo sapiens
ttcagatccttccaaactc

SEQ ID NO: 5333530 - DNA, 20 bp, Homo sapiens
ttcagatccttccaaactct

SEQ ID NO: 5333531 - DNA, 16 bp, Homo sapiens
ttcagatcgtattaat

SEQ ID NO: 5333532 - DNA, 17 bp, Homo sapiens
ttcagatctctaacttc

SEQ ID NO: 5333533 - DNA, 15 bp, Homo sapiens
ttcagatctgaagta

SEQ ID NO: 5333534 - DNA, 19 bp, Homo sapiens
ttcagatcttaatataaat

SEQ ID NO: 5333535 - DNA, 21 bp, Homo sapiens
ttcagatcttaatataaattc

SEQ ID NO: 5333536 - DNA, 13 bp, Homo sapiens
ttcagatgccact

SEQ ID NO: 5333537 - DNA, 14 bp, Homo sapiens
ttcagatgtaatgt

SEQ ID NO: 5333538 - DNA, 16 bp, Homo sapiens
ttcagatgtaatgttt

SEQ ID NO: 5333539 - DNA, 17 bp, Homo sapiens
ttcagatgtaatgtttt

SEQ ID NO: 5333540 - DNA, 13 bp, Homo sapiens
ttcagatgtatgt

SEQ ID NO: 5333541 - DNA, 19 bp, Homo sapiens
ttcagatgtcttctgcctg

SEQ ID NO: 5333542 - DNA, 20 bp, Homo sapiens
ttcagatgtcttctgcctgt

SEQ ID NO: 5333543 - DNA, 23 bp, Homo sapiens
ttcagatgtcttctgcctgttat

SEQ ID NO: 5333544 - DNA, 15 bp, Homo sapiens
ttcagatgtgaacca

SEQ ID NO: 5333545 - DNA, 18 bp, Homo sapiens
ttcagatgtgaaccatta

SEQ ID NO: 5333546 - DNA, 22 bp, Homo sapiens
ttcagatgtgcaataatttgta

SEQ ID NO: 5333547 - DNA, 13 bp, Homo sapiens
ttcagatgtgcat

SEQ ID NO: 5333548 - DNA, 16 bp, Homo sapiens
ttcagatgtggagcca

SEQ ID NO: 5333549 - DNA, 21 bp, Homo sapiens
ttcagattccccactcagcct

SEQ ID NO: 5333550 - DNA, 15 bp, Homo sapiens
ttcagattggacata

SEQ ID NO: 5333551 - DNA, 15 bp, Homo sapiens
ttcagattgtatctg

SEQ ID NO: 5333552 - DNA, 20 bp, Homo sapiens
ttcagattgtggaatgttgg

SEQ ID NO: 5333553 - DNA, 22 bp, Homo sapiens
ttcagattgtggaatgttggat

SEQ ID NO: 5333554 - DNA, 13 bp, Homo sapiens
ttcagatttcaaa

SEQ ID NO: 5333555 - DNA, 15 bp, Homo sapiens
ttcagatttctcttt

SEQ ID NO: 5333556 - DNA, 17 bp, Homo sapiens
ttcagatttgcacaaaa

SEQ ID NO: 5333557 - DNA, 22 bp, Homo sapiens
ttcagattttgataactgttta

SEQ ID NO: 5333558 - DNA, 17 bp, Homo sapiens
ttcagattttttaaaat

SEQ ID NO: 5333559 - DNA, 21 bp, Homo sapiens
ttcagcaaaaatattttatga

SEQ ID NO: 5333560 - DNA, 23 bp, Homo sapiens
ttcagcaaactaaccagcattcc

SEQ ID NO: 5333561 - DNA, 18 bp, Homo sapiens
ttcagcaaatgccttttc

SEQ ID NO: 5333562 - DNA, 19 bp, Homo sapiens
ttcagcaaccctacagtat

SEQ ID NO: 5333563 - DNA, 18 bp, Homo sapiens
ttcagcaagacttctctt

SEQ ID NO: 5333564 - DNA, 17 bp, Homo sapiens
ttcagcaagagagaacc

SEQ ID NO: 5333565 - DNA, 18 bp, Homo sapiens
ttcagcaagagagaacct

SEQ ID NO: 5333566 - DNA, 16 bp, Homo sapiens
ttcagcacaataaata

SEQ ID NO: 5333567 - DNA, 15 bp, Homo sapiens
ttcagcacaccccaa

SEQ ID NO: 5333568 - DNA, 17 bp, Homo sapiens
ttcagcaccaagcatgt

SEQ ID NO: 5333569 - DNA, 21 bp, Homo sapiens
ttcagcaccagttatgtttga

SEQ ID NO: 5333570 - DNA, 15 bp, Homo sapiens
ttcagcacccccacc

SEQ ID NO: 5333571 - DNA, 22 bp, Homo sapiens
ttcagcaccctgggtgccattc

SEQ ID NO: 5333572 - DNA, 23 bp, Homo sapiens
ttcagcaccctgggtgccattcc

SEQ ID NO: 5333573 - DNA, 13 bp, Homo sapiens
ttcagcactgtcc

SEQ ID NO: 5333574 - DNA, 17 bp, Homo sapiens
ttcagcacttgtctcat

SEQ ID NO: 5333575 - DNA, 23 bp, Homo sapiens
ttcagcagaatgactctggaacc

SEQ ID NO: 5333576 - DNA, 23 bp, Homo sapiens
ttcagcagcaaaaccaaactggg

SEQ ID NO: 5333577 - DNA, 16 bp, Homo sapiens
ttcagcagcagctcac

SEQ ID NO: 5333578 - DNA, 17 bp, Homo sapiens
ttcagcagcgtgcaata

SEQ ID NO: 5333579 - DNA, 15 bp, Homo sapiens
ttcagcaggaagggt

SEQ ID NO: 5333580 - DNA, 18 bp, Homo sapiens
ttcagcaggctagacaga

SEQ ID NO: 5333581 - DNA, 11 bp, Homo sapiens
ttcagcagggg

SEQ ID NO: 5333582 - DNA, 14 bp, Homo sapiens
ttcagcagtctaaa

SEQ ID NO: 5333583 - DNA, 16 bp, Homo sapiens
ttcagcagtgcctaaa

SEQ ID NO: 5333584 - DNA, 23 bp, Homo sapiens
ttcagcatacataactgaagcat

SEQ ID NO: 5333585 - DNA, 15 bp, Homo sapiens
ttcagcatctcactt

SEQ ID NO: 5333586 - DNA, 13 bp, Homo sapiens
ttcagcatctgac

SEQ ID NO: 5333587 - DNA, 23 bp, Homo sapiens
ttcagcatgggtccttgatgcca

SEQ ID NO: 5333588 - DNA, 17 bp, Homo sapiens
ttcagcattccctccca

SEQ ID NO: 5333589 - DNA, 20 bp, Homo sapiens
ttcagcattcttagcctgtg

SEQ ID NO: 5333590 - DNA, 20 bp, Homo sapiens
ttcagcatttgttctttgcc

SEQ ID NO: 5333591 - DNA, 18 bp, Homo sapiens
ttcagccacaaagtagtt

SEQ ID NO: 5333592 - DNA, 17 bp, Homo sapiens
ttcagccacatgcccca

SEQ ID NO: 5333593 - DNA, 17 bp, Homo sapiens
ttcagccactgagggac

SEQ ID NO: 5333594 - DNA, 13 bp, Homo sapiens
ttcagccaggtct

SEQ ID NO: 5333595 - DNA, 22 bp, Homo sapiens
ttcagccatgataagaacagag

SEQ ID NO: 5333596 - DNA, 16 bp, Homo sapiens
ttcagcccaccaccct

SEQ ID NO: 5333597 - DNA, 17 bp, Homo sapiens
ttcagcccaccaccctg

SEQ ID NO: 5333598 - DNA, 13 bp, Homo sapiens
ttcagcccaccag

SEQ ID NO: 5333599 - DNA, 10 bp, Homo sapiens
ttcagcccag

SEQ ID NO: 5333600 - DNA, 11 bp, Homo sapiens
ttcagcccagc

SEQ ID NO: 5333601 - DNA, 20 bp, Homo sapiens
ttcagcccatatttcatcgt

SEQ ID NO: 5333602 - DNA, 14 bp, Homo sapiens
ttcagcccccacca

SEQ ID NO: 5333603 - DNA, 16 bp, Homo sapiens
ttcagcccccaccagg

SEQ ID NO: 5333604 - DNA, 15 bp, Homo sapiens
ttcagcccccagccc

SEQ ID NO: 5333605 - DNA, 19 bp, Homo sapiens
ttcagcccctagtgctatt

SEQ ID NO: 5333606 - DNA, 19 bp, Homo sapiens
ttcagcccctgatctctga

SEQ ID NO: 5333607 - DNA, 23 bp, Homo sapiens
ttcagccctaaatctagactcaa

SEQ ID NO: 5333608 - DNA, 12 bp, Homo sapiens
ttcagccctcac

SEQ ID NO: 5333609 - DNA, 15 bp, Homo sapiens
ttcagccctcagaag

SEQ ID NO: 5333610 - DNA, 16 bp, Homo sapiens
ttcagccctggcccct

SEQ ID NO: 5333611 - DNA, 12 bp, Homo sapiens
ttcagccctttg

SEQ ID NO: 5333612 - DNA, 13 bp, Homo sapiens
ttcagccctttgc

SEQ ID NO: 5333613 - DNA, 18 bp, Homo sapiens
ttcagccctttgctctga

SEQ ID NO: 5333614 - DNA, 17 bp, Homo sapiens
ttcagccctttggcttc

SEQ ID NO: 5333615 - DNA, 18 bp, Homo sapiens
ttcagccctttggcttca

SEQ ID NO: 5333616 - DNA, 16 bp, Homo sapiens
ttcagcctactgcctc

SEQ ID NO: 5333617 - DNA, 23 bp, Homo sapiens
ttcagcctagccgacctcagcct

SEQ ID NO: 5333618 - DNA, 18 bp, Homo sapiens
ttcagcctcattcactgt

SEQ ID NO: 5333619 - DNA, 19 bp, Homo sapiens
ttcagcctcattcactgtc

SEQ ID NO: 5333620 - DNA, 14 bp, Homo sapiens
ttcagcctccctca

SEQ ID NO: 5333621 - DNA, 19 bp, Homo sapiens
ttcagcctccctcagcccc

SEQ ID NO: 5333622 - DNA, 15 bp, Homo sapiens
ttcagcctcctgtct

SEQ ID NO: 5333623 - DNA, 14 bp, Homo sapiens
ttcagcctctccca

SEQ ID NO: 5333624 - DNA, 12 bp, Homo sapiens
ttcagcctctgg

SEQ ID NO: 5333625 - DNA, 15 bp, Homo sapiens
ttcagcctgccttct

SEQ ID NO: 5333626 - DNA, 14 bp, Homo sapiens
ttcagcctgcttct

SEQ ID NO: 5333627 - DNA, 17 bp, Homo sapiens
ttcagcctggcctgccc

SEQ ID NO: 5333628 - DNA, 12 bp, Homo sapiens
ttcagccttaat

SEQ ID NO: 5333629 - DNA, 17 bp, Homo sapiens
ttcagccttatccaggt

SEQ ID NO: 5333630 - DNA, 18 bp, Homo sapiens
ttcagccttcaatcaaca

SEQ ID NO: 5333631 - DNA, 16 bp, Homo sapiens
ttcagccttgctgacc

SEQ ID NO: 5333632 - DNA, 24 bp, Homo sapiens
ttcagcgatgtatgcagctatctg

SEQ ID NO: 5333633 - DNA, 15 bp, Homo sapiens
ttcagcgcccccagg

SEQ ID NO: 5333634 - DNA, 14 bp, Homo sapiens
ttcagctaagctag

SEQ ID NO: 5333635 - DNA, 18 bp, Homo sapiens
ttcagctaagggaagaca

SEQ ID NO: 5333636 - DNA, 20 bp, Homo sapiens
ttcagctaagggaagacatt

SEQ ID NO: 5333637 - DNA, 23 bp, Homo sapiens
ttcagctaagggaagacatttct

SEQ ID NO: 5333638 - DNA, 13 bp, Homo sapiens
ttcagctactttc

SEQ ID NO: 5333639 - DNA, 20 bp, Homo sapiens
ttcagctactttccatttgg

SEQ ID NO: 5333640 - DNA, 18 bp, Homo sapiens
ttcagctcaattgttaat

SEQ ID NO: 5333641 - DNA, 18 bp, Homo sapiens
ttcagctcacacatgaga

SEQ ID NO: 5333642 - DNA, 16 bp, Homo sapiens
ttcagctcacgcttca

SEQ ID NO: 5333643 - DNA, 23 bp, Homo sapiens
ttcagctcattatgaaaaacatc

SEQ ID NO: 5333644 - DNA, 22 bp, Homo sapiens
ttcagctcatttaatcccagga

SEQ ID NO: 5333645 - DNA, 22 bp, Homo sapiens
ttcagctccagcccctttccaa

SEQ ID NO: 5333646 - DNA, 17 bp, Homo sapiens
ttcatatacaaacatgt

SEQ ID NO: 5333647 - DNA, 22 bp, Homo sapiens
ttcatatactataattgtaaat

SEQ ID NO: 5333648 - DNA, 13 bp, Homo sapiens
ttcatatatacat

SEQ ID NO: 5333649 - DNA, 21 bp, Homo sapiens
ttcatatatgaggacttgtgt

SEQ ID NO: 5333650 - DNA, 13 bp, Homo sapiens
ttcatatattgca

SEQ ID NO: 5333651 - DNA, 14 bp, Homo sapiens
ttcatatattgcat

SEQ ID NO: 5333652 - DNA, 21 bp, Homo sapiens
ttcatatattgcatttctgta

SEQ ID NO: 5333653 - DNA, 17 bp, Homo sapiens
ttcatatctaatttacc

SEQ ID NO: 5333654 - DNA, 16 bp, Homo sapiens
ttcatatctctccctt

SEQ ID NO: 5333655 - DNA, 17 bp, Homo sapiens
ttcatatgaggggaccc

SEQ ID NO: 5333656 - DNA, 22 bp, Homo sapiens
ttcatatgcagaacgtatttag

SEQ ID NO: 5333657 - DNA, 19 bp, Homo sapiens
ttcatatgctctgctttta

SEQ ID NO: 5333658 - DNA, 17 bp, Homo sapiens
ttcatatgcttcaaact

SEQ ID NO: 5333659 - DNA, 16 bp, Homo sapiens
ttcatatgttgctcag

SEQ ID NO: 5333660 - DNA, 22 bp, Homo sapiens
ttcatattaagacagtgtacaa

SEQ ID NO: 5333661 - DNA, 21 bp, Homo sapiens
ttcatattaatataagtttct

SEQ ID NO: 5333662 - DNA, 23 bp, Homo sapiens
ttcatattaatataagtttcttt

SEQ ID NO: 5333663 - DNA, 13 bp, Homo sapiens
ttcatattacaat

SEQ ID NO: 5333664 - DNA, 17 bp, Homo sapiens
ttcatattaccagaaaa

SEQ ID NO: 5333665 - DNA, 22 bp, Homo sapiens
ttcatattaccagaaaatgagt

SEQ ID NO: 5333666 - DNA, 14 bp, Homo sapiens
ttcatattctttta

SEQ ID NO: 5333667 - DNA, 15 bp, Homo sapiens
ttcatattgagatca

SEQ ID NO: 5333668 - DNA, 19 bp, Homo sapiens
ttcatatttaagtgtattt

SEQ ID NO: 5333669 - DNA, 13 bp, Homo sapiens
ttcatatttaatt

SEQ ID NO: 5333670 - DNA, 15 bp, Homo sapiens
ttcatatttaatttg

SEQ ID NO: 5333671 - DNA, 17 bp, Homo sapiens
ttcatatttaatttgaa

SEQ ID NO: 5333672 - DNA, 20 bp, Homo sapiens
ttcatatttaatttgaagat

SEQ ID NO: 5333673 - DNA, 21 bp, Homo sapiens
ttcatatttacttcttataca

SEQ ID NO: 5333674 - DNA, 15 bp, Homo sapiens
ttcatatttctttgg

SEQ ID NO: 5333675 - DNA, 18 bp, Homo sapiens
ttcatatttgcaataaaa

SEQ ID NO: 5333676 - DNA, 15 bp, Homo sapiens
ttcatatttgcacta

SEQ ID NO: 5333677 - DNA, 17 bp, Homo sapiens
ttcatattttaatttca

SEQ ID NO: 5333678 - DNA, 20 bp, Homo sapiens
ttcatattttaatttcaagc

SEQ ID NO: 5333679 - DNA, 13 bp, Homo sapiens
ttcatattttata

SEQ ID NO: 5333680 - DNA, 16 bp, Homo sapiens
ttcatcaaatggaaga

SEQ ID NO: 5333681 - DNA, 21 bp, Homo sapiens
ttcatcaatatccctcttgta

SEQ ID NO: 5333682 - DNA, 14 bp, Homo sapiens
ttcatcaatcaaat

SEQ ID NO: 5333683 - DNA, 22 bp, Homo sapiens
ttcatcaatcattgtacagttt

SEQ ID NO: 5333684 - DNA, 15 bp, Homo sapiens
ttcatcaatgaatga

SEQ ID NO: 5333685 - DNA, 12 bp, Homo sapiens
ttcatcaatgca

SEQ ID NO: 5333686 - DNA, 13 bp, Homo sapiens
ttcatcaattttt

SEQ ID NO: 5333687 - DNA, 14 bp, Homo sapiens
ttcatcaattttta

SEQ ID NO: 5333688 - DNA, 16 bp, Homo sapiens
ttcatcaatttttata

SEQ ID NO: 5333689 - DNA, 16 bp, Homo sapiens
ttcatcaccagacttt

SEQ ID NO: 5333690 - DNA, 19 bp, Homo sapiens
ttcatcactccaaaaacag

SEQ ID NO: 5333691 - DNA, 14 bp, Homo sapiens
ttcatcagaatgtt

SEQ ID NO: 5333692 - DNA, 19 bp, Homo sapiens
ttcatcatattatacagac

SEQ ID NO: 5333693 - DNA, 15 bp, Homo sapiens
ttcatcatccagatg

SEQ ID NO: 5333694 - DNA, 21 bp, Homo sapiens
ttcatcatcctaagctattca

SEQ ID NO: 5333695 - DNA, 19 bp, Homo sapiens
ttcatcattcacttcactg

SEQ ID NO: 5333696 - DNA, 17 bp, Homo sapiens
ttcatcattccctctca

SEQ ID NO: 5333697 - DNA, 16 bp, Homo sapiens
ttcatcattgttgtgt

SEQ ID NO: 5333698 - DNA, 19 bp, Homo sapiens
ttcatcattgttgtgtata

SEQ ID NO: 5333699 - DNA, 12 bp, Homo sapiens
ttcatcatttca

SEQ ID NO: 5333700 - DNA, 16 bp, Homo sapiens
ttcatcatttcagcca

SEQ ID NO: 5333701 - DNA, 18 bp, Homo sapiens
ttcatcattttctccacc

SEQ ID NO: 5333702 - DNA, 20 bp, Homo sapiens
ttcatccaacttatgttttt

SEQ ID NO: 5333703 - DNA, 16 bp, Homo sapiens
ttcatccaaggaacct

SEQ ID NO: 5333704 - DNA, 17 bp, Homo sapiens
ttcatccaagttaaatg

SEQ ID NO: 5333705 - DNA, 16 bp, Homo sapiens
ttcatccaatgtgaag

SEQ ID NO: 5333706 - DNA, 15 bp, Homo sapiens
ttcatccagaagtgt

SEQ ID NO: 5333707 - DNA, 17 bp, Homo sapiens
ttcatccagcagtgttg

SEQ ID NO: 5333708 - DNA, 23 bp, Homo sapiens
ttcatccagctacttagctggcc

SEQ ID NO: 5333709 - DNA, 17 bp, Homo sapiens
ttcatccaggactgaga

SEQ ID NO: 5333710 - DNA, 21 bp, Homo sapiens
ttcatccaggcccaactgtga

SEQ ID NO: 5333711 - DNA, 16 bp, Homo sapiens
ttcatccagttgcaat

SEQ ID NO: 5333712 - DNA, 18 bp, Homo sapiens
ttcatccagttgcaataa

SEQ ID NO: 5333713 - DNA, 22 bp, Homo sapiens
ttcatccagttgcaataaaata

SEQ ID NO: 5333714 - DNA, 17 bp, Homo sapiens
ttcatccataactgaac

SEQ ID NO: 5333715 - DNA, 16 bp, Homo sapiens
ttcatccatagacaca

SEQ ID NO: 5333716 - DNA, 18 bp, Homo sapiens
ttcatccatcatctgctg

SEQ ID NO: 5333717 - DNA, 15 bp, Homo sapiens
ttcatccatcctgag

SEQ ID NO: 5333718 - DNA, 14 bp, Homo sapiens
ttcatccatttgtt

SEQ ID NO: 5333719 - DNA, 21 bp, Homo sapiens
ttcatcccaacagcccagcaa

SEQ ID NO: 5333720 - DNA, 19 bp, Homo sapiens
ttcatcccaactgtctttt

SEQ ID NO: 5333721 - DNA, 13 bp, Homo sapiens
ttcatcccagccc

SEQ ID NO: 5333722 - DNA, 16 bp, Homo sapiens
ttcatcccatgatgta

SEQ ID NO: 5333723 - DNA, 18 bp, Homo sapiens
ttcatcccatgatgtagt

SEQ ID NO: 5333724 - DNA, 19 bp, Homo sapiens
ttcatcccatgatgtagtg

SEQ ID NO: 5333725 - DNA, 14 bp, Homo sapiens
ttcatcccctcaga

SEQ ID NO: 5333726 - DNA, 15 bp, Homo sapiens
ttcatcccctccccg

SEQ ID NO: 5333727 - DNA, 18 bp, Homo sapiens
ttcatcccgtatcacagt

SEQ ID NO: 5333728 - DNA, 21 bp, Homo sapiens
ttcatcccgtatcacagtgtt

SEQ ID NO: 5333729 - DNA, 16 bp, Homo sapiens
ttcatccgcctgtggg

SEQ ID NO: 5333730 - DNA, 16 bp, Homo sapiens
ttcatccgttgtgact

SEQ ID NO: 5333731 - DNA, 15 bp, Homo sapiens
ttcatcctaacatga

SEQ ID NO: 5333732 - DNA, 13 bp, Homo sapiens
ttcatcctataag

SEQ ID NO: 5333733 - DNA, 16 bp, Homo sapiens
ttcatcctcacatgtg

SEQ ID NO: 5333734 - DNA, 13 bp, Homo sapiens
ttcatcctcagca

SEQ ID NO: 5333735 - DNA, 15 bp, Homo sapiens
ttcatcctcagcaag

SEQ ID NO: 5333736 - DNA, 21 bp, Homo sapiens
ttcatcctcattgcctcctgt

SEQ ID NO: 5333737 - DNA, 15 bp, Homo sapiens
ttcatcctcctcaga

SEQ ID NO: 5333738 - DNA, 20 bp, Homo sapiens
ttcatcctcctccccagctc

SEQ ID NO: 5333739 - DNA, 18 bp, Homo sapiens
ttcatcctgactctgccc

SEQ ID NO: 5333740 - DNA, 16 bp, Homo sapiens
ttcatcctgagcccaa

SEQ ID NO: 5333741 - DNA, 16 bp, Homo sapiens
ttcatcctgcatggga

SEQ ID NO: 5333742 - DNA, 13 bp, Homo sapiens
ttcatcctggcct

SEQ ID NO: 5333743 - DNA, 14 bp, Homo sapiens
ttcatcctggcctc

SEQ ID NO: 5333744 - DNA, 17 bp, Homo sapiens
ttcatcctggcctcctt

SEQ ID NO: 5333745 - DNA, 19 bp, Homo sapiens
ttcatcctggcctcctttt

SEQ ID NO: 5333746 - DNA, 13 bp, Homo sapiens
ttcatcctgtgtc

SEQ ID NO: 5333747 - DNA, 17 bp, Homo sapiens
ttcatccttccatccat

SEQ ID NO: 5333748 - DNA, 17 bp, Homo sapiens
ttcatccttctttcctt

SEQ ID NO: 5333749 - DNA, 12 bp, Homo sapiens
ttcatcctttca

SEQ ID NO: 5333750 - DNA, 15 bp, Homo sapiens
ttcatcctttcactt

SEQ ID NO: 5333751 - DNA, 20 bp, Homo sapiens
ttcatccttttttctcttct

SEQ ID NO: 5333752 - DNA, 23 bp, Homo sapiens
ttcatcgaatctactaattccac

SEQ ID NO: 5333753 - DNA, 14 bp, Homo sapiens
ttcatctaaatgaa

SEQ ID NO: 5333754 - DNA, 20 bp, Homo sapiens
ttcatctaccattttctggt

SEQ ID NO: 5333755 - DNA, 15 bp, Homo sapiens
ttcatctcagctttt

SEQ ID NO: 5333756 - DNA, 20 bp, Homo sapiens
ttcatctcaggtggcatttg

SEQ ID NO: 5333757 - DNA, 23 bp, Homo sapiens
ttcatctcatcaggcaaattgta

SEQ ID NO: 5333758 - DNA, 13 bp, Homo sapiens
ttcatctcattaa

SEQ ID NO: 5333759 - DNA, 15 bp, Homo sapiens
ttcatctcattaatt

SEQ ID NO: 5333760 - DNA, 13 bp, Homo sapiens
ttcatctcattta

SEQ ID NO: 5333761 - DNA, 13 bp, Homo sapiens
ttcatctcctttt

SEQ ID NO: 5333762 - DNA, 14 bp, Homo sapiens
ttcatctccttttg

SEQ ID NO: 5333763 - DNA, 18 bp, Homo sapiens
ttcatctctaacatatga

SEQ ID NO: 5333764 - DNA, 23 bp, Homo sapiens
ttcatctctagggaccagaacca

SEQ ID NO: 5333765 - DNA, 14 bp, Homo sapiens
ttcatctctcagaa

SEQ ID NO: 5333766 - DNA, 21 bp, Homo sapiens
ttcatctctcagaagggaggc

SEQ ID NO: 5333767 - DNA, 16 bp, Homo sapiens
ttcatctctgctgaac

SEQ ID NO: 5333768 - DNA, 12 bp, Homo sapiens
ttcatctctggt

SEQ ID NO: 5333769 - DNA, 12 bp, Homo sapiens
ttcatctcttac

SEQ ID NO: 5333770 - DNA, 15 bp, Homo sapiens
ttcatctcttcaatc

SEQ ID NO: 5333771 - DNA, 16 bp, Homo sapiens
ttcatctcttcaatca

SEQ ID NO: 5333772 - DNA, 16 bp, Homo sapiens
ttcatctctttagaga

SEQ ID NO: 5333773 - DNA, 19 bp, Homo sapiens
ttcatctctttgtcctgaa

SEQ ID NO: 5333774 - DNA, 16 bp, Homo sapiens
ttcatctgaaaagcag

SEQ ID NO: 5333775 - DNA, 20 bp, Homo sapiens
ttcatctgagagaggctaaa

SEQ ID NO: 5333776 - DNA, 18 bp, Homo sapiens
ttcatctgaggagtccaa

SEQ ID NO: 5333777 - DNA, 12 bp, Homo sapiens
ttcatctgccca

SEQ ID NO: 5333778 - DNA, 13 bp, Homo sapiens
ttcatctgctctc

SEQ ID NO: 5333779 - DNA, 21 bp, Homo sapiens
ttcatctgctctccttcctgg

SEQ ID NO: 5333780 - DNA, 17 bp, Homo sapiens
ttcatctgctgctgaaa

SEQ ID NO: 5333781 - DNA, 23 bp, Homo sapiens
ttcatctggaaccatcagaaaca

SEQ ID NO: 5333782 - DNA, 20 bp, Homo sapiens
ttcatctggaggctgcgtcc

SEQ ID NO: 5333783 - DNA, 15 bp, Homo sapiens
ttcatctggattcta

SEQ ID NO: 5333784 - DNA, 18 bp, Homo sapiens
ttcatctgggaaagacat

SEQ ID NO: 5333785 - DNA, 17 bp, Homo sapiens
ttcatctggggatgaca

SEQ ID NO: 5333786 - DNA, 15 bp, Homo sapiens
ttcatctggggtggg

SEQ ID NO: 5333787 - DNA, 20 bp, Homo sapiens
ttcatctgtccatggccttt

SEQ ID NO: 5333788 - DNA, 22 bp, Homo sapiens
ttcatctgtccatggcctttct

SEQ ID NO: 5333789 - DNA, 16 bp, Homo sapiens
ttcatctgtgggatgc

SEQ ID NO: 5333790 - DNA, 18 bp, Homo sapiens
ttcatctgtgggatgctg

SEQ ID NO: 5333791 - DNA, 20 bp, Homo sapiens
ttcatctgtgggatgctgaa

SEQ ID NO: 5333792 - DNA, 22 bp, Homo sapiens
ttcatctgtgtagctgctcttt

SEQ ID NO: 5333793 - DNA, 23 bp, Homo sapiens
ttcatctgttctatgcttcctcg

SEQ ID NO: 5333794 - DNA, 14 bp, Homo sapiens
ttcatctgttgttc

SEQ ID NO: 5333795 - DNA, 14 bp, Homo sapiens
ttcatcttcctgtg

SEQ ID NO: 5333796 - DNA, 20 bp, Homo sapiens
ttcatcttcctgtgtcctga

SEQ ID NO: 5333797 - DNA, 11 bp, Homo sapiens
ttcatcttgaa

SEQ ID NO: 5333798 - DNA, 17 bp, Homo sapiens
ttcatcttgaagttttt

SEQ ID NO: 5333799 - DNA, 17 bp, Homo sapiens
ttcatcttgaattgtaa

SEQ ID NO: 5333800 - DNA, 20 bp, Homo sapiens
ttcatcttgcagcatttact

SEQ ID NO: 5333801 - DNA, 15 bp, Homo sapiens
ttcatctttcagaaa

SEQ ID NO: 5333802 - DNA, 23 bp, Homo sapiens
ttcatctttcagaaataaaagta

SEQ ID NO: 5333803 - DNA, 15 bp, Homo sapiens
ttcatctttccaaat

SEQ ID NO: 5333804 - DNA, 22 bp, Homo sapiens
ttcatctttcctttgctctgga

SEQ ID NO: 5333805 - DNA, 17 bp, Homo sapiens
ttcatcttttattttgg

SEQ ID NO: 5333806 - DNA, 18 bp, Homo sapiens
ttcatcttttattttgga

SEQ ID NO: 5333807 - DNA, 16 bp, Homo sapiens
ttcatcttttgaagag

SEQ ID NO: 5333808 - DNA, 15 bp, Homo sapiens
ttcatgaaaatacca

SEQ ID NO: 5333809 - DNA, 16 bp, Homo sapiens
ttcatgaaaatcctac

SEQ ID NO: 5333810 - DNA, 21 bp, Homo sapiens
ttcatgaaatgattggaatat

SEQ ID NO: 5333811 - DNA, 13 bp, Homo sapiens
ttcatgaaatgct

SEQ ID NO: 5333812 - DNA, 21 bp, Homo sapiens
ttcatgaaatgctatgtcatt

SEQ ID NO: 5333813 - DNA, 14 bp, Homo sapiens
ttcatgaaatgtgt

SEQ ID NO: 5333814 - DNA, 15 bp, Homo sapiens
ttcatgaaatgtgtt

SEQ ID NO: 5333815 - DNA, 21 bp, Homo sapiens
ttcatgaacttcgcatcaaaa

SEQ ID NO: 5333816 - DNA, 17 bp, Homo sapiens
ttcatgaacttggctgt

SEQ ID NO: 5333817 - DNA, 16 bp, Homo sapiens
ttcatgaatattttca

SEQ ID NO: 5333818 - DNA, 23 bp, Homo sapiens
ttcatgaatattttcaagttttt

SEQ ID NO: 5333819 - DNA, 16 bp, Homo sapiens
ttcatgaatcttgaga

SEQ ID NO: 5333820 - DNA, 16 bp, Homo sapiens
ttcatgaatctttcat

SEQ ID NO: 5333821 - DNA, 15 bp, Homo sapiens
ttcatgaatgtgctg

SEQ ID NO: 5333822 - DNA, 19 bp, Homo sapiens
ttcatgaatgtgctggtga

SEQ ID NO: 5333823 - DNA, 14 bp, Homo sapiens
ttcatgaatttctc

SEQ ID NO: 5333824 - DNA, 17 bp, Homo sapiens
ttcatgacaacatgaaa

SEQ ID NO: 5333825 - DNA, 15 bp, Homo sapiens
ttcatgacagaatat

SEQ ID NO: 5333826 - DNA, 22 bp, Homo sapiens
ttcatgacagaatatacacatt

SEQ ID NO: 5333827 - DNA, 23 bp, Homo sapiens
ttcatgacataataaagtatttt

SEQ ID NO: 5333828 - DNA, 16 bp, Homo sapiens
ttcatgacattatgtg

SEQ ID NO: 5333829 - DNA, 22 bp, Homo sapiens
ttcatgagattggtcattaaat

SEQ ID NO: 5333830 - DNA, 16 bp, Homo sapiens
ttcatgagtttttccc

SEQ ID NO: 5333831 - DNA, 23 bp, Homo sapiens
ttcatgatagaaagaataaaatg

SEQ ID NO: 5333832 - DNA, 15 bp, Homo sapiens
ttcatgatagtgtga

SEQ ID NO: 5333833 - DNA, 16 bp, Homo sapiens
ttcatgatgcagtctc

SEQ ID NO: 5333834 - DNA, 14 bp, Homo sapiens
ttcatgatttgcaa

SEQ ID NO: 5333835 - DNA, 22 bp, Homo sapiens
ttcatgatttgcaactttagaa

SEQ ID NO: 5333836 - DNA, 17 bp, Homo sapiens
ttcatgattttgaaatc

SEQ ID NO: 5333837 - DNA, 15 bp, Homo sapiens
ttcatgcaaactctt

SEQ ID NO: 5333838 - DNA, 16 bp, Homo sapiens
ttcatgcaaactcttt

SEQ ID NO: 5333839 - DNA, 17 bp, Homo sapiens
ttcatgcaaactttatt

SEQ ID NO: 5333840 - DNA, 15 bp, Homo sapiens
ttcatgcacttaaag

SEQ ID NO: 5333841 - DNA, 23 bp, Homo sapiens
ttcatgcagacaaagccctgtcc

SEQ ID NO: 5333842 - DNA, 14 bp, Homo sapiens
ttcatgcatggaaa

SEQ ID NO: 5333843 - DNA, 15 bp, Homo sapiens
ttcatgcattactta

SEQ ID NO: 5333844 - DNA, 21 bp, Homo sapiens
ttcatgccaattagcaattga

SEQ ID NO: 5333845 - DNA, 22 bp, Homo sapiens
ttcatgccagctacttcctcct

SEQ ID NO: 5333846 - DNA, 16 bp, Homo sapiens
ttcatgccatctgttt

SEQ ID NO: 5333847 - DNA, 19 bp, Homo sapiens
ttcatgccatctgttttca

SEQ ID NO: 5333848 - DNA, 15 bp, Homo sapiens
ttcatgcctgatgaa

SEQ ID NO: 5333849 - DNA, 14 bp, Homo sapiens
ttcatgcctggggt

SEQ ID NO: 5333850 - DNA, 16 bp, Homo sapiens
ttcatgcctttcatag

SEQ ID NO: 5333851 - DNA, 20 bp, Homo sapiens
ttcatgcctttcatagttta

SEQ ID NO: 5333852 - DNA, 21 bp, Homo sapiens
ttcatgcctttgtaagttatt

SEQ ID NO: 5333853 - DNA, 19 bp, Homo sapiens
ttcatgctatcagaaacag

SEQ ID NO: 5333854 - DNA, 18 bp, Homo sapiens
ttcatgctatctctgtgt

SEQ ID NO: 5333855 - DNA, 13 bp, Homo sapiens
ttcatgctccaag

SEQ ID NO: 5333856 - DNA, 17 bp, Homo sapiens
ttcatgctgaggtgatt

SEQ ID NO: 5333857 - DNA, 22 bp, Homo sapiens
ttcatgctgttcatgaaagatt

SEQ ID NO: 5333858 - DNA, 21 bp, Homo sapiens
ttcatgcttctactgtgacac

SEQ ID NO: 5333859 - DNA, 18 bp, Homo sapiens
ttcatgcttgacatacct

SEQ ID NO: 5333860 - DNA, 15 bp, Homo sapiens
ttcatgcttttctca

SEQ ID NO: 5333861 - DNA, 16 bp, Homo sapiens
ttcatgcttttctcat

SEQ ID NO: 5333862 - DNA, 19 bp, Homo sapiens
ttcatggaaaagccttctt

SEQ ID NO: 5333863 - DNA, 23 bp, Homo sapiens
ttcatggaattggtttaaacttt

SEQ ID NO: 5333864 - DNA, 20 bp, Homo sapiens
ttcatggacactttgaaatg

SEQ ID NO: 5333865 - DNA, 16 bp, Homo sapiens
ttcatggacagctgag

SEQ ID NO: 5333866 - DNA, 16 bp, Homo sapiens
ttcatggaccactgtt

SEQ ID NO: 5333867 - DNA, 18 bp, Homo sapiens
ttcatggagtagcctgga

SEQ ID NO: 5333868 - DNA, 20 bp, Homo sapiens
ttcatggagtagcctggact

SEQ ID NO: 5333869 - DNA, 20 bp, Homo sapiens
ttcatggatagctcagaggt

SEQ ID NO: 5333870 - DNA, 19 bp, Homo sapiens
ttcatggatatttgtcaac

SEQ ID NO: 5333871 - DNA, 14 bp, Homo sapiens
ttcatggcaacatc

SEQ ID NO: 5333872 - DNA, 18 bp, Homo sapiens
ttcatggcaagtggggct

SEQ ID NO: 5333873 - DNA, 21 bp, Homo sapiens
ttcatggcaatgaaaatttta

SEQ ID NO: 5333874 - DNA, 22 bp, Homo sapiens
ttcatggcaatgaaaattttaa

SEQ ID NO: 5333875 - DNA, 17 bp, Homo sapiens
ttcatggcagaaggcaa

SEQ ID NO: 5333876 - DNA, 21 bp, Homo sapiens
ttcatggctgctgttgcttaa

SEQ ID NO: 5333877 - DNA, 15 bp, Homo sapiens
ttcatgggagaacct

SEQ ID NO: 5333878 - DNA, 23 bp, Homo sapiens
ttcatgggcccacagggtaccag

SEQ ID NO: 5333879 - DNA, 15 bp, Homo sapiens
ttcatgggctgtgtg

SEQ ID NO: 5333880 - DNA, 18 bp, Homo sapiens
ttcatggggatctggggg

SEQ ID NO: 5333881 - DNA, 19 bp, Homo sapiens
ttcatggttcaagtattaa

SEQ ID NO: 5333882 - DNA, 17 bp, Homo sapiens
ttcatgtaaactgtgca

SEQ ID NO: 5333883 - DNA, 18 bp, Homo sapiens
ttcatgtaaactgtgcac

SEQ ID NO: 5333884 - DNA, 16 bp, Homo sapiens
ttcatgtaaagaaaaa

SEQ ID NO: 5333885 - DNA, 20 bp, Homo sapiens
ttcatgtaaagtgtcagaag

SEQ ID NO: 5333886 - DNA, 14 bp, Homo sapiens
ttcatgtaaataaa

SEQ ID NO: 5333887 - DNA, 16 bp, Homo sapiens
ttcatgtaaccaagag

SEQ ID NO: 5333888 - DNA, 12 bp, Homo sapiens
ttcatgtaactc

SEQ ID NO: 5333889 - DNA, 16 bp, Homo sapiens
ttcatgtaagtagcaa

SEQ ID NO: 5333890 - DNA, 12 bp, Homo sapiens
ttcatgtaatta

SEQ ID NO: 5333891 - DNA, 13 bp, Homo sapiens
ttcatgtaatttt

SEQ ID NO: 5333892 - DNA, 21 bp, Homo sapiens
ttcatgtacaagatgaaggag

SEQ ID NO: 5333893 - DNA, 15 bp, Homo sapiens
ttcatgtacagaggt

SEQ ID NO: 5333894 - DNA, 16 bp, Homo sapiens
ttcatgtactaccctc

SEQ ID NO: 5333895 - DNA, 21 bp, Homo sapiens
ttcatgtagagaaaagcacac

SEQ ID NO: 5333896 - DNA, 17 bp, Homo sapiens
ttcatgtagtaagattt

SEQ ID NO: 5333897 - DNA, 18 bp, Homo sapiens
ttcatgtatatctaactt

SEQ ID NO: 5333898 - DNA, 12 bp, Homo sapiens
ttcatgtatttc

SEQ ID NO: 5333899 - DNA, 23 bp, Homo sapiens
ttcatgtcatcaaaatctgcaca

SEQ ID NO: 5333900 - DNA, 20 bp, Homo sapiens
ttcatgtccagtgagcagtg

SEQ ID NO: 5333901 - DNA, 23 bp, Homo sapiens
ttcatgtccagtgagcagtgttg

SEQ ID NO: 5333902 - DNA, 17 bp, Homo sapiens
ttcatgtcctgtgtcag

SEQ ID NO: 5333903 - DNA, 19 bp, Homo sapiens
ttcatgtcctgtgtcagtt

SEQ ID NO: 5333904 - DNA, 21 bp, Homo sapiens
ttcatgtcctgtgtcagttta

SEQ ID NO: 5333905 - DNA, 22 bp, Homo sapiens
ttcatgtctctacccactatgc

SEQ ID NO: 5333906 - DNA, 21 bp, Homo sapiens
ttcatgtctgaaacagagaac

SEQ ID NO: 5333907 - DNA, 16 bp, Homo sapiens
ttcatgtcttgtcata

SEQ ID NO: 5333908 - DNA, 17 bp, Homo sapiens
ttcatgtctttactgga

SEQ ID NO: 5333909 - DNA, 15 bp, Homo sapiens
ttcatgtgaaaataa

SEQ ID NO: 5333910 - DNA, 13 bp, Homo sapiens
ttcatgtgcctct

SEQ ID NO: 5333911 - DNA, 21 bp, Homo sapiens
ttcatgtggcattctctctgc

SEQ ID NO: 5333912 - DNA, 23 bp, Homo sapiens
ttcatgtggcattctctctgctc

SEQ ID NO: 5333913 - DNA, 18 bp, Homo sapiens
ttcatgtgtacagaaaca

SEQ ID NO: 5333914 - DNA, 16 bp, Homo sapiens
ttcatgtgtcccagaa

SEQ ID NO: 5333915 - DNA, 23 bp, Homo sapiens
ttcatgtgttgcaaattattcta

SEQ ID NO: 5333916 - DNA, 16 bp, Homo sapiens
ttcatgttagttacct

SEQ ID NO: 5333917 - DNA, 16 bp, Homo sapiens
ttcatgttctgtgtca

SEQ ID NO: 5333918 - DNA, 22 bp, Homo sapiens
ttcatgttgatgactcgaaact

SEQ ID NO: 5333919 - DNA, 22 bp, Homo sapiens
ttcatgttgcacacccactcag

SEQ ID NO: 5333920 - DNA, 20 bp, Homo sapiens
ttcatgttggtttattttca

SEQ ID NO: 5333921 - DNA, 14 bp, Homo sapiens
ttcatgtttggtgc

SEQ ID NO: 5333922 - DNA, 15 bp, Homo sapiens
ttcatgtttggtgca

SEQ ID NO: 5333923 - DNA, 20 bp, Homo sapiens
ttcatgttttagcatttgta

SEQ ID NO: 5333924 - DNA, 13 bp, Homo sapiens
ttcattaaaaaca

SEQ ID NO: 5333925 - DNA, 16 bp, Homo sapiens
ttcattaaaaacattt

SEQ ID NO: 5333926 - DNA, 16 bp, Homo sapiens
ttcattaaaaatgaaa

SEQ ID NO: 5333927 - DNA, 23 bp, Homo sapiens
ttcattaaaatagattatcccac

SEQ ID NO: 5333928 - DNA, 13 bp, Homo sapiens
ttcattaaagaaa

SEQ ID NO: 5333929 - DNA, 14 bp, Homo sapiens
ttcattaaagaaaa

SEQ ID NO: 5333930 - DNA, 13 bp, Homo sapiens
ttcattaaagcat

SEQ ID NO: 5333931 - DNA, 13 bp, Homo sapiens
ttcattaaatgtt

SEQ ID NO: 5333932 - DNA, 14 bp, Homo sapiens
ttcattaaatgttt

SEQ ID NO: 5333933 - DNA, 16 bp, Homo sapiens
ttcattaaatgtttgt

SEQ ID NO: 5333934 - DNA, 23 bp, Homo sapiens
ttcattaaatgtttgttgaataa

SEQ ID NO: 5333935 - DNA, 16 bp, Homo sapiens
ttcattaacaaaatgt

SEQ ID NO: 5333936 - DNA, 14 bp, Homo sapiens
ttcattaataaaat

SEQ ID NO: 5333937 - DNA, 15 bp, Homo sapiens
ttcattaataataaa

SEQ ID NO: 5333938 - DNA, 18 bp, Homo sapiens
ttcattaataataaattc

SEQ ID NO: 5333939 - DNA, 15 bp, Homo sapiens
ttcattaatactgtg

SEQ ID NO: 5333940 - DNA, 23 bp, Homo sapiens
ttcattaattaccctactttcat

SEQ ID NO: 5333941 - DNA, 16 bp, Homo sapiens
ttcattaattcaggca

SEQ ID NO: 5333942 - DNA, 16 bp, Homo sapiens
ttcattacactaaagt

SEQ ID NO: 5333943 - DNA, 19 bp, Homo sapiens
ttcattaccaggtttcatt

SEQ ID NO: 5333944 - DNA, 15 bp, Homo sapiens
ttcattaccctacag

SEQ ID NO: 5333945 - DNA, 17 bp, Homo sapiens
ttcattacctgtagctt

SEQ ID NO: 5333946 - DNA, 13 bp, Homo sapiens
ttcattacctttt

SEQ ID NO: 5333947 - DNA, 20 bp, Homo sapiens
ttcattacttttaaaaatgt

SEQ ID NO: 5333948 - DNA, 14 bp, Homo sapiens
ttcattagctgtga

SEQ ID NO: 5333949 - DNA, 22 bp, Homo sapiens
ttcattaggcaaagtacaaaat

SEQ ID NO: 5333950 - DNA, 17 bp, Homo sapiens
ttcattataatctcaaa

SEQ ID NO: 5333951 - DNA, 23 bp, Homo sapiens
ttcattatcacatgattatagaa

SEQ ID NO: 5333952 - DNA, 14 bp, Homo sapiens
ttcattatctcaaa

SEQ ID NO: 5333953 - DNA, 22 bp, Homo sapiens
ttcattatgcacttttagaaat

SEQ ID NO: 5333954 - DNA, 23 bp, Homo sapiens
ttcattatgcacttttagaaatg

SEQ ID NO: 5333955 - DNA, 17 bp, Homo sapiens
ttcattatgttcatgta

SEQ ID NO: 5333956 - DNA, 20 bp, Homo sapiens
ttcattattcctcagattgc

SEQ ID NO: 5333957 - DNA, 14 bp, Homo sapiens
ttcattattctcat

SEQ ID NO: 5333958 - DNA, 15 bp, Homo sapiens
ttcattattctcata

SEQ ID NO: 5333959 - DNA, 16 bp, Homo sapiens
ttcattatttgtcaaa

SEQ ID NO: 5333960 - DNA, 14 bp, Homo sapiens
ttcattattttgtg

SEQ ID NO: 5333961 - DNA, 15 bp, Homo sapiens
ttcattatttttcaa

SEQ ID NO: 5333962 - DNA, 14 bp, Homo sapiens
ttcattcaaaatgt

SEQ ID NO: 5333963 - DNA, 14 bp, Homo sapiens
ttcattcaacagct

SEQ ID NO: 5333964 - DNA, 24 bp, Homo sapiens
ttcattcaagctatttaatatctg

SEQ ID NO: 5333965 - DNA, 18 bp, Homo sapiens
ttcattcaatagatacca

SEQ ID NO: 5333966 - DNA, 15 bp, Homo sapiens
ttcattcaatattga

SEQ ID NO: 5333967 - DNA, 16 bp, Homo sapiens
ttcattcaatattgac

SEQ ID NO: 5333968 - DNA, 19 bp, Homo sapiens
ttcattcaatattgacatt

SEQ ID NO: 5333969 - DNA, 23 bp, Homo sapiens
ttcattcaatcaacctgcacttc

SEQ ID NO: 5333970 - DNA, 15 bp, Homo sapiens
ttcattcacattaat

SEQ ID NO: 5333971 - DNA, 14 bp, Homo sapiens
ttcattcaccagat

SEQ ID NO: 5333972 - DNA, 21 bp, Homo sapiens
ttcattcaccagatattttgt

SEQ ID NO: 5333973 - DNA, 17 bp, Homo sapiens
ttcattcacttctctta

SEQ ID NO: 5333974 - DNA, 13 bp, Homo sapiens
ttcattcatatta

SEQ ID NO: 5333975 - DNA, 12 bp, Homo sapiens
ttcattcatccc

SEQ ID NO: 5333976 - DNA, 17 bp, Homo sapiens
ttcattcattttgtgta

SEQ ID NO: 5333977 - DNA, 11 bp, Homo sapiens
ttcattccaca

SEQ ID NO: 5333978 - DNA, 15 bp, Homo sapiens
ttcattccagcagct

SEQ ID NO: 5333979 - DNA, 17 bp, Homo sapiens
ttcattccagcagctgc

SEQ ID NO: 5333980 - DNA, 15 bp, Homo sapiens
ttcattccattgcct

SEQ ID NO: 5333981 - DNA, 21 bp, Homo sapiens
ttcattccattgcctagctct

SEQ ID NO: 5333982 - DNA, 14 bp, Homo sapiens
ttcattccatttgc

SEQ ID NO: 5333983 - DNA, 16 bp, Homo sapiens
ttcattccatttgctg

SEQ ID NO: 5333984 - DNA, 15 bp, Homo sapiens
ttcattccccagctc

SEQ ID NO: 5333985 - DNA, 21 bp, Homo sapiens
ttcattccctttcatgatttg

SEQ ID NO: 5333986 - DNA, 14 bp, Homo sapiens
ttcattcctccagg

SEQ ID NO: 5333987 - DNA, 22 bp, Homo sapiens
ttcattccttcagatttggctt

SEQ ID NO: 5333988 - DNA, 21 bp, Homo sapiens
ttcattcgtgggcctgctgct

SEQ ID NO: 5333989 - DNA, 23 bp, Homo sapiens
ttcattctcataattcctacagc

SEQ ID NO: 5333990 - DNA, 16 bp, Homo sapiens
ttcattctcctcctcc

SEQ ID NO: 5333991 - DNA, 15 bp, Homo sapiens
ttcattctcctgcct

SEQ ID NO: 5333992 - DNA, 12 bp, Homo sapiens
ttcattctcctt

SEQ ID NO: 5333993 - DNA, 13 bp, Homo sapiens
ttcattctcttga

SEQ ID NO: 5333994 - DNA, 14 bp, Homo sapiens
ttcattctgagccc

SEQ ID NO: 5333995 - DNA, 18 bp, Homo sapiens
ttcattctgcattgagaa

SEQ ID NO: 5333996 - DNA, 13 bp, Homo sapiens
ttcattctgccaa

SEQ ID NO: 5333997 - DNA, 19 bp, Homo sapiens
ttcattctgtatgtgacta

SEQ ID NO: 5333998 - DNA, 13 bp, Homo sapiens
ttcattctgtgac

SEQ ID NO: 5333999 - DNA, 15 bp, Homo sapiens
ttcattctttactgc

SEQ ID NO: 5334000 - DNA, 16 bp, Homo sapiens
ttcattctttactgca

SEQ ID NO: 5334001 - DNA, 22 bp, Homo sapiens
ttcattgagttggttacttcat

SEQ ID NO: 5334002 - DNA, 15 bp, Homo sapiens
ttcattgcacaatat

SEQ ID NO: 5334003 - DNA, 21 bp, Homo sapiens
ttccactctggattcagcctt

SEQ ID NO: 5334004 - DNA, 18 bp, Homo sapiens
ttccactgaaacctctgt

SEQ ID NO: 5334005 - DNA, 20 bp, Homo sapiens
ttccactgaaacctctgttc

SEQ ID NO: 5334006 - DNA, 18 bp, Homo sapiens
ttccactgatggaaacaa

SEQ ID NO: 5334007 - DNA, 13 bp, Homo sapiens
ttccactgcaaaa

SEQ ID NO: 5334008 - DNA, 20 bp, Homo sapiens
ttccactgcaaatttcaaaa

SEQ ID NO: 5334009 - DNA, 18 bp, Homo sapiens
ttccactgccaaaacaat

SEQ ID NO: 5334010 - DNA, 14 bp, Homo sapiens
ttccactgcctctg

SEQ ID NO: 5334011 - DNA, 17 bp, Homo sapiens
ttccactgcctctgcct

SEQ ID NO: 5334012 - DNA, 17 bp, Homo sapiens
ttccactgcgttgtcca

SEQ ID NO: 5334013 - DNA, 21 bp, Homo sapiens
ttccactgctactgacccaga

SEQ ID NO: 5334014 - DNA, 18 bp, Homo sapiens
ttccacttaacacatgaa

SEQ ID NO: 5334015 - DNA, 21 bp, Homo sapiens
ttccacttagaaattgcattt

SEQ ID NO: 5334016 - DNA, 17 bp, Homo sapiens
ttccacttatagcctct

SEQ ID NO: 5334017 - DNA, 20 bp, Homo sapiens
ttccacttatagcctctgtc

SEQ ID NO: 5334018 - DNA, 16 bp, Homo sapiens
ttccacttcctgcccc

SEQ ID NO: 5334019 - DNA, 18 bp, Homo sapiens
ttccacttcctgccccaa

SEQ ID NO: 5334020 - DNA, 20 bp, Homo sapiens
ttccacttctaactccactg

SEQ ID NO: 5334021 - DNA, 15 bp, Homo sapiens
ttccacttcttcctt

SEQ ID NO: 5334022 - DNA, 20 bp, Homo sapiens
ttccacttcttcctttctct

SEQ ID NO: 5334023 - DNA, 12 bp, Homo sapiens
ttccacttggct

SEQ ID NO: 5334024 - DNA, 19 bp, Homo sapiens
ttccacttgttcattctgt

SEQ ID NO: 5334025 - DNA, 19 bp, Homo sapiens
ttccacttgtttgcactgt

SEQ ID NO: 5334026 - DNA, 23 bp, Homo sapiens
ttccactttgttctttaggagat

SEQ ID NO: 5334027 - DNA, 22 bp, Homo sapiens
ttccactttgttggcccttcca

SEQ ID NO: 5334028 - DNA, 17 bp, Homo sapiens
ttccactttttccagaa

SEQ ID NO: 5334029 - DNA, 20 bp, Homo sapiens
ttccacttttttttgtatgt

SEQ ID NO: 5334030 - DNA, 19 bp, Homo sapiens
ttccagaaaatataaatgc

SEQ ID NO: 5334031 - DNA, 23 bp, Homo sapiens
ttccagaaaatataaatgcatga

SEQ ID NO: 5334032 - DNA, 21 bp, Homo sapiens
ttccagaaagcaggagcagct

SEQ ID NO: 5334033 - DNA, 23 bp, Homo sapiens
ttccagaaagcaggagcagctgt

SEQ ID NO: 5334034 - DNA, 15 bp, Homo sapiens
ttccagaaaggatat

SEQ ID NO: 5334035 - DNA, 20 bp, Homo sapiens
ttccagaacgccctgtgtcc

SEQ ID NO: 5334036 - DNA, 21 bp, Homo sapiens
ttccagaagaaagatggaaat

SEQ ID NO: 5334037 - DNA, 17 bp, Homo sapiens
ttccagaagatgccctc

SEQ ID NO: 5334038 - DNA, 22 bp, Homo sapiens
ttccagaatcttgactttctga

SEQ ID NO: 5334039 - DNA, 15 bp, Homo sapiens
ttccagaatgctgaa

SEQ ID NO: 5334040 - DNA, 16 bp, Homo sapiens
ttccagaatgctgtac

SEQ ID NO: 5334041 - DNA, 11 bp, Homo sapiens
ttccagaattg

SEQ ID NO: 5334042 - DNA, 22 bp, Homo sapiens
ttccagacattctcgcttccct

SEQ ID NO: 5334043 - DNA, 23 bp, Homo sapiens
ttccagaccaataaatttgtaac

SEQ ID NO: 5334044 - DNA, 18 bp, Homo sapiens
ttccagaccacctgccag

SEQ ID NO: 5334045 - DNA, 22 bp, Homo sapiens
ttccagaccacctgccagccat

SEQ ID NO: 5334046 - DNA, 15 bp, Homo sapiens
ttccagacctgcttc

SEQ ID NO: 5334047 - DNA, 20 bp, Homo sapiens
ttccagacctgcttcctgaa

SEQ ID NO: 5334048 - DNA, 23 bp, Homo sapiens
ttccagactcaggttccagaaca

SEQ ID NO: 5334049 - DNA, 23 bp, Homo sapiens
ttccagacttcgctattcccagg

SEQ ID NO: 5334050 - DNA, 20 bp, Homo sapiens
ttccagagaactgcagacct

SEQ ID NO: 5334051 - DNA, 22 bp, Homo sapiens
ttccagagaagcctatttttat

SEQ ID NO: 5334052 - DNA, 18 bp, Homo sapiens
ttccagagagtggctcct

SEQ ID NO: 5334053 - DNA, 19 bp, Homo sapiens
ttccagagagtggctcctc

SEQ ID NO: 5334054 - DNA, 18 bp, Homo sapiens
ttccagagcactgctcca

SEQ ID NO: 5334055 - DNA, 11 bp, Homo sapiens
ttccagagcat

SEQ ID NO: 5334056 - DNA, 13 bp, Homo sapiens
ttccagagcctca

SEQ ID NO: 5334057 - DNA, 18 bp, Homo sapiens
ttccagagctaggctgtg

SEQ ID NO: 5334058 - DNA, 16 bp, Homo sapiens
ttccagagctctgacc

SEQ ID NO: 5334059 - DNA, 18 bp, Homo sapiens
ttccagagctctgaccca

SEQ ID NO: 5334060 - DNA, 16 bp, Homo sapiens
ttccagagctgcttct

SEQ ID NO: 5334061 - DNA, 17 bp, Homo sapiens
ttccagaggacagctct

SEQ ID NO: 5334062 - DNA, 18 bp, Homo sapiens
ttccagaggacagctctg

SEQ ID NO: 5334063 - DNA, 22 bp, Homo sapiens
ttccagaggagagtggcctggg

SEQ ID NO: 5334064 - DNA, 22 bp, Homo sapiens
ttccagaggccctaggcgggat

SEQ ID NO: 5334065 - DNA, 20 bp, Homo sapiens
ttccagaggctattattttc

SEQ ID NO: 5334066 - DNA, 18 bp, Homo sapiens
ttccagagtccggaggca

SEQ ID NO: 5334067 - DNA, 16 bp, Homo sapiens
ttccagagtgctgagg

SEQ ID NO: 5334068 - DNA, 19 bp, Homo sapiens
ttccagagttgttgtttgc

SEQ ID NO: 5334069 - DNA, 20 bp, Homo sapiens
ttccagagttgttgtttgcc

SEQ ID NO: 5334070 - DNA, 23 bp, Homo sapiens
ttccagatatccacataaatgct

SEQ ID NO: 5334071 - DNA, 15 bp, Homo sapiens
ttccagatcccaggc

SEQ ID NO: 5334072 - DNA, 18 bp, Homo sapiens
ttccagatcctctctggg

SEQ ID NO: 5334073 - DNA, 18 bp, Homo sapiens
ttccagatcctggaaatc

SEQ ID NO: 5334074 - DNA, 21 bp, Homo sapiens
ttccagatggcccccagctgg

SEQ ID NO: 5334075 - DNA, 24 bp, Homo sapiens
ttccagcaaaatatatgtttggct

SEQ ID NO: 5334076 - DNA, 22 bp, Homo sapiens
ttccagcaaaatggaagcaaag

SEQ ID NO: 5334077 - DNA, 22 bp, Homo sapiens
ttccagcaattctcctgcctca

SEQ ID NO: 5334078 - DNA, 20 bp, Homo sapiens
ttccagcacaaccttcaagc

SEQ ID NO: 5334079 - DNA, 16 bp, Homo sapiens
ttccagcagaagacaa

SEQ ID NO: 5334080 - DNA, 22 bp, Homo sapiens
ttccagcagtgaatgctagaca

SEQ ID NO: 5334081 - DNA, 15 bp, Homo sapiens
ttccagcattcccag

SEQ ID NO: 5334082 - DNA, 17 bp, Homo sapiens
ttccagcattcccaggt

SEQ ID NO: 5334083 - DNA, 20 bp, Homo sapiens
ttccagcattcccaggtagg

SEQ ID NO: 5334084 - DNA, 21 bp, Homo sapiens
ttccagccacattgagacttt

SEQ ID NO: 5334085 - DNA, 14 bp, Homo sapiens
ttccagccaggccc

SEQ ID NO: 5334086 - DNA, 17 bp, Homo sapiens
ttccagccaggcccagg

SEQ ID NO: 5334087 - DNA, 19 bp, Homo sapiens
ttccagccaggcccaggcc

SEQ ID NO: 5334088 - DNA, 23 bp, Homo sapiens
ttccagccaggcccaggccagcc

SEQ ID NO: 5334089 - DNA, 17 bp, Homo sapiens
ttccagcccaacccact

SEQ ID NO: 5334090 - DNA, 21 bp, Homo sapiens
ttccagccggcatggctggga

SEQ ID NO: 5334091 - DNA, 14 bp, Homo sapiens
ttccagcctgccac

SEQ ID NO: 5334092 - DNA, 11 bp, Homo sapiens
ttccagcctgg

SEQ ID NO: 5334093 - DNA, 13 bp, Homo sapiens
ttccagcctggga

SEQ ID NO: 5334094 - DNA, 21 bp, Homo sapiens
ttccagcctgggacacacaca

SEQ ID NO: 5334095 - DNA, 16 bp, Homo sapiens
ttccagccttatgtgt

SEQ ID NO: 5334096 - DNA, 17 bp, Homo sapiens
ttccagccttatgtgtt

SEQ ID NO: 5334097 - DNA, 22 bp, Homo sapiens
ttccagccttatgtgttacatt

SEQ ID NO: 5334098 - DNA, 15 bp, Homo sapiens
ttccagcctttgtca

SEQ ID NO: 5334099 - DNA, 19 bp, Homo sapiens
ttccagctaagcctgatga

SEQ ID NO: 5334100 - DNA, 13 bp, Homo sapiens
ttccagctacttt

SEQ ID NO: 5334101 - DNA, 11 bp, Homo sapiens
ttccagctcag

SEQ ID NO: 5334102 - DNA, 18 bp, Homo sapiens
ttccagctcagtcccaca

SEQ ID NO: 5334103 - DNA, 22 bp, Homo sapiens
ttccagctcagtcccacagccc

SEQ ID NO: 5334104 - DNA, 15 bp, Homo sapiens
ttccagctccctccc

SEQ ID NO: 5334105 - DNA, 19 bp, Homo sapiens
ttccagctccctcccctgc

SEQ ID NO: 5334106 - DNA, 22 bp, Homo sapiens
ttccagctccctcccctgctca

SEQ ID NO: 5334107 - DNA, 23 bp, Homo sapiens
ttccagctccgtgtttctctaag

SEQ ID NO: 5334108 - DNA, 11 bp, Homo sapiens
ttccagctcct

SEQ ID NO: 5334109 - DNA, 13 bp, Homo sapiens
ttccagctcctca

SEQ ID NO: 5334110 - DNA, 15 bp, Homo sapiens
ttccagctctgcccc

SEQ ID NO: 5334111 - DNA, 11 bp, Homo sapiens
ttccagctggt

SEQ ID NO: 5334112 - DNA, 13 bp, Homo sapiens
ttccagctgtgca

SEQ ID NO: 5334113 - DNA, 16 bp, Homo sapiens
ttccagcttcaggcac

SEQ ID NO: 5334114 - DNA, 21 bp, Homo sapiens
ttccagcttcaggcaccagca

SEQ ID NO: 5334115 - DNA, 12 bp, Homo sapiens
ttccagcttccc

SEQ ID NO: 5334116 - DNA, 15 bp, Homo sapiens
ttccagcttgaggga

SEQ ID NO: 5334117 - DNA, 23 bp, Homo sapiens
ttccagctttctctttgttcttc

SEQ ID NO: 5334118 - DNA, 15 bp, Homo sapiens
ttccaggaaaaaata

SEQ ID NO: 5334119 - DNA, 22 bp, Homo sapiens
ttccaggaaactccacatctgc

SEQ ID NO: 5334120 - DNA, 21 bp, Homo sapiens
ttccaggaaccaaaaagagca

SEQ ID NO: 5334121 - DNA, 15 bp, Homo sapiens
ttccaggaagcacag

SEQ ID NO: 5334122 - DNA, 17 bp, Homo sapiens
ttccaggaatgctgggc

SEQ ID NO: 5334123 - DNA, 19 bp, Homo sapiens
ttccaggaatgctgggccc

SEQ ID NO: 5334124 - DNA, 20 bp, Homo sapiens
ttccaggaattttgtgtgat

SEQ ID NO: 5334125 - DNA, 22 bp, Homo sapiens
ttccaggactctctgcttggat

SEQ ID NO: 5334126 - DNA, 21 bp, Homo sapiens
ttccaggactgtttcaaacat

SEQ ID NO: 5334127 - DNA, 23 bp, Homo sapiens
ttccaggactgtttcaaacatgc

SEQ ID NO: 5334128 - DNA, 23 bp, Homo sapiens
ttccaggagaaagccgggggagg

SEQ ID NO: 5334129 - DNA, 12 bp, Homo sapiens
ttccaggagaag

SEQ ID NO: 5334130 - DNA, 23 bp, Homo sapiens
ttccaggagaagggggctctgcc

SEQ ID NO: 5334131 - DNA, 20 bp, Homo sapiens
ttccaggagcacacggccct

SEQ ID NO: 5334132 - DNA, 17 bp, Homo sapiens
ttccaggagggaaaatg

SEQ ID NO: 5334133 - DNA, 16 bp, Homo sapiens
ttccaggcaccctcag

SEQ ID NO: 5334134 - DNA, 16 bp, Homo sapiens
ttccaggccccaggct

SEQ ID NO: 5334135 - DNA, 18 bp, Homo sapiens
ttccaggccccaggctgg

SEQ ID NO: 5334136 - DNA, 22 bp, Homo sapiens
ttccaggccccaggctggatgc

SEQ ID NO: 5334137 - DNA, 24 bp, Homo sapiens
ttccaggccccaggctggatgctg

SEQ ID NO: 5334138 - DNA, 12 bp, Homo sapiens
ttccaggcccct

SEQ ID NO: 5334139 - DNA, 13 bp, Homo sapiens
ttccaggccctcc

SEQ ID NO: 5334140 - DNA, 21 bp, Homo sapiens
ttccaggctagtccggaccca

SEQ ID NO: 5334141 - DNA, 20 bp, Homo sapiens
ttccaggctatgtataaaat

SEQ ID NO: 5334142 - DNA, 20 bp, Homo sapiens
ttccaggctcttcctggacc

SEQ ID NO: 5334143 - DNA, 14 bp, Homo sapiens
ttccaggctgagag

SEQ ID NO: 5334144 - DNA, 14 bp, Homo sapiens
ttccaggctgagcc

SEQ ID NO: 5334145 - DNA, 19 bp, Homo sapiens
ttccaggctgcatagaagg

SEQ ID NO: 5334146 - DNA, 13 bp, Homo sapiens
ttccaggctggga

SEQ ID NO: 5334147 - DNA, 20 bp, Homo sapiens
ttccaggcttctgctggggc

SEQ ID NO: 5334148 - DNA, 12 bp, Homo sapiens
ttccagggcagc

SEQ ID NO: 5334149 - DNA, 22 bp, Homo sapiens
ttccagggcatccgcagcccag

SEQ ID NO: 5334150 - DNA, 10 bp, Homo sapiens
ttccagggct

SEQ ID NO: 5334151 - DNA, 22 bp, Homo sapiens
ttccagggctggggtgagcctg

SEQ ID NO: 5334152 - DNA, 23 bp, Homo sapiens
ttccagggctggggtgagcctga

SEQ ID NO: 5334153 - DNA, 21 bp, Homo sapiens
ttccagggtcaaagtacagaa

SEQ ID NO: 5334154 - DNA, 17 bp, Homo sapiens
ttccaggtaaaaacaga

SEQ ID NO: 5334155 - DNA, 21 bp, Homo sapiens
ttccaggtacccttctcgctt

SEQ ID NO: 5334156 - DNA, 18 bp, Homo sapiens
ttccaggtatctccagga

SEQ ID NO: 5334157 - DNA, 19 bp, Homo sapiens
ttccaggtatctccaggat

SEQ ID NO: 5334158 - DNA, 21 bp, Homo sapiens
ttccaggtatgggacctgcta

SEQ ID NO: 5334159 - DNA, 17 bp, Homo sapiens
ttccaggtcagaaacca

SEQ ID NO: 5334160 - DNA, 18 bp, Homo sapiens
ttccaggtttaagctgtt

SEQ ID NO: 5334161 - DNA, 21 bp, Homo sapiens
ttccaggtttttctggcattt

SEQ ID NO: 5334162 - DNA, 21 bp, Homo sapiens
ttccagtaaggatttttatgt

SEQ ID NO: 5334163 - DNA, 16 bp, Homo sapiens
ttccagtaatgagctt

SEQ ID NO: 5334164 - DNA, 20 bp, Homo sapiens
ttccagtaggaaaagcaatg

SEQ ID NO: 5334165 - DNA, 15 bp, Homo sapiens
ttccagtagttgaac

SEQ ID NO: 5334166 - DNA, 17 bp, Homo sapiens
ttccagtataaccagct

SEQ ID NO: 5334167 - DNA, 13 bp, Homo sapiens
ttccagtattgaa

SEQ ID NO: 5334168 - DNA, 18 bp, Homo sapiens
ttccagtattgaaaactt

SEQ ID NO: 5334169 - DNA, 17 bp, Homo sapiens
ttccagtcacattgcca

SEQ ID NO: 5334170 - DNA, 22 bp, Homo sapiens
ttccagtcatggccaaatgttc

SEQ ID NO: 5334171 - DNA, 16 bp, Homo sapiens
ttccagtccaattttc

SEQ ID NO: 5334172 - DNA, 21 bp, Homo sapiens
ttccagtccaattttcctaag

SEQ ID NO: 5334173 - DNA, 16 bp, Homo sapiens
ttccagtcccctttct

SEQ ID NO: 5334174 - DNA, 20 bp, Homo sapiens
ttccagtcctaacaaatgct

SEQ ID NO: 5334175 - DNA, 20 bp, Homo sapiens
ttccagtctccaccaggaac

SEQ ID NO: 5334176 - DNA, 22 bp, Homo sapiens
ttccagtctccaccaggaacct

SEQ ID NO: 5334177 - DNA, 13 bp, Homo sapiens
ttccattcttggt

SEQ ID NO: 5334178 - DNA, 14 bp, Homo sapiens
ttccattctttcag

SEQ ID NO: 5334179 - DNA, 19 bp, Homo sapiens
ttccattcttttaaatggg

SEQ ID NO: 5334180 - DNA, 20 bp, Homo sapiens
ttccattcttttaaatgggt

SEQ ID NO: 5334181 - DNA, 14 bp, Homo sapiens
ttccattgaccagc

SEQ ID NO: 5334182 - DNA, 23 bp, Homo sapiens
ttccattgaccagctctcttcct

SEQ ID NO: 5334183 - DNA, 18 bp, Homo sapiens
ttccattgcaaaatagaa

SEQ ID NO: 5334184 - DNA, 22 bp, Homo sapiens
ttccattgcaaaatagaagaag

SEQ ID NO: 5334185 - DNA, 24 bp, Homo sapiens
ttccattgcctcttttcacatttt

SEQ ID NO: 5334186 - DNA, 17 bp, Homo sapiens
ttccattgctcccagtg

SEQ ID NO: 5334187 - DNA, 16 bp, Homo sapiens
ttccattggtccaaga

SEQ ID NO: 5334188 - DNA, 20 bp, Homo sapiens
ttccattggtccaagattcc

SEQ ID NO: 5334189 - DNA, 20 bp, Homo sapiens
ttccattgtagtggcctgtg

SEQ ID NO: 5334190 - DNA, 12 bp, Homo sapiens
ttccattgttgt

SEQ ID NO: 5334191 - DNA, 22 bp, Homo sapiens
ttccattgtttaaaaatacaca

SEQ ID NO: 5334192 - DNA, 17 bp, Homo sapiens
ttccattgtttgaaaca

SEQ ID NO: 5334193 - DNA, 22 bp, Homo sapiens
ttccattgtttgaaacaaagaa

SEQ ID NO: 5334194 - DNA, 20 bp, Homo sapiens
ttccattgtttggagacatt

SEQ ID NO: 5334195 - DNA, 15 bp, Homo sapiens
ttccatttacagtct

SEQ ID NO: 5334196 - DNA, 12 bp, Homo sapiens
ttccatttacta

SEQ ID NO: 5334197 - DNA, 17 bp, Homo sapiens
ttccatttatttatgaa

SEQ ID NO: 5334198 - DNA, 12 bp, Homo sapiens
ttccatttctgg

SEQ ID NO: 5334199 - DNA, 18 bp, Homo sapiens
ttccatttgcatttgttt

SEQ ID NO: 5334200 - DNA, 20 bp, Homo sapiens
ttccatttggattttaaaca

SEQ ID NO: 5334201 - DNA, 15 bp, Homo sapiens
ttccatttggcacta

SEQ ID NO: 5334202 - DNA, 21 bp, Homo sapiens
ttccatttggtgaccatctgt

SEQ ID NO: 5334203 - DNA, 15 bp, Homo sapiens
ttccatttgtattca

SEQ ID NO: 5334204 - DNA, 13 bp, Homo sapiens
ttccattttaatt

SEQ ID NO: 5334205 - DNA, 14 bp, Homo sapiens
ttccattttatgca

SEQ ID NO: 5334206 - DNA, 14 bp, Homo sapiens
ttccattttccccc

SEQ ID NO: 5334207 - DNA, 18 bp, Homo sapiens
ttccattttcccccacta

SEQ ID NO: 5334208 - DNA, 23 bp, Homo sapiens
ttccattttctataagaaaaagg

SEQ ID NO: 5334209 - DNA, 22 bp, Homo sapiens
ttccatttttactaaagcagtg

SEQ ID NO: 5334210 - DNA, 17 bp, Homo sapiens
ttccatttttcctctgt

SEQ ID NO: 5334211 - DNA, 19 bp, Homo sapiens
ttccattttttaaatgttc

SEQ ID NO: 5334212 - DNA, 22 bp, Homo sapiens
ttccattttttttcaaacaagt

SEQ ID NO: 5334213 - DNA, 19 bp, Homo sapiens
ttcccaaaattagggagct

SEQ ID NO: 5334214 - DNA, 17 bp, Homo sapiens
ttcccaaaccaagtgcc

SEQ ID NO: 5334215 - DNA, 18 bp, Homo sapiens
ttcccaaaccaagtgcct

SEQ ID NO: 5334216 - DNA, 16 bp, Homo sapiens
ttcccaaaggactcca

SEQ ID NO: 5334217 - DNA, 17 bp, Homo sapiens
ttcccaaaggactccac

SEQ ID NO: 5334218 - DNA, 20 bp, Homo sapiens
ttcccaaaggactccaccca

SEQ ID NO: 5334219 - DNA, 12 bp, Homo sapiens
ttcccaaaggga

SEQ ID NO: 5334220 - DNA, 21 bp, Homo sapiens
ttcccaaagtcctctgctcca

SEQ ID NO: 5334221 - DNA, 14 bp, Homo sapiens
ttcccaaatcaaaa

SEQ ID NO: 5334222 - DNA, 17 bp, Homo sapiens
ttcccaaatcaaaataa

SEQ ID NO: 5334223 - DNA, 22 bp, Homo sapiens
ttcccaaatcaaaataaaagaa

SEQ ID NO: 5334224 - DNA, 12 bp, Homo sapiens
ttcccaaatgtg

SEQ ID NO: 5334225 - DNA, 20 bp, Homo sapiens
ttcccaaatgtgtgcccagc

SEQ ID NO: 5334226 - DNA, 22 bp, Homo sapiens
ttcccaaatgtgtgcccagctt

SEQ ID NO: 5334227 - DNA, 13 bp, Homo sapiens
ttcccaacacaaa

SEQ ID NO: 5334228 - DNA, 19 bp, Homo sapiens
ttcccaacacttcagactg

SEQ ID NO: 5334229 - DNA, 19 bp, Homo sapiens
ttcccaacccccagccccc

SEQ ID NO: 5334230 - DNA, 16 bp, Homo sapiens
ttcccaacctcccctg

SEQ ID NO: 5334231 - DNA, 19 bp, Homo sapiens
ttcccaacgtgcaaagcca

SEQ ID NO: 5334232 - DNA, 18 bp, Homo sapiens
ttcccaactccagaaagt

SEQ ID NO: 5334233 - DNA, 16 bp, Homo sapiens
ttcccaacttccctgt

SEQ ID NO: 5334234 - DNA, 20 bp, Homo sapiens
ttcccaacttgcctttgaag

SEQ ID NO: 5334235 - DNA, 23 bp, Homo sapiens
ttcccaacttgcctttgaagagt

SEQ ID NO: 5334236 - DNA, 22 bp, Homo sapiens
ttcccaagagcatcatgcctct

SEQ ID NO: 5334237 - DNA, 17 bp, Homo sapiens
ttcccaagatgcctgat

SEQ ID NO: 5334238 - DNA, 23 bp, Homo sapiens
ttcccaagccatggcatgctcct

SEQ ID NO: 5334239 - DNA, 18 bp, Homo sapiens
ttcccaagctctgctcct

SEQ ID NO: 5334240 - DNA, 22 bp, Homo sapiens
ttcccaaggaagctccttcctg

SEQ ID NO: 5334241 - DNA, 14 bp, Homo sapiens
ttcccaaggcagct

SEQ ID NO: 5334242 - DNA, 15 bp, Homo sapiens
ttcccaaggcagctg

SEQ ID NO: 5334243 - DNA, 17 bp, Homo sapiens
ttcccaaggccttaagc

SEQ ID NO: 5334244 - DNA, 13 bp, Homo sapiens
ttcccaagggctg

SEQ ID NO: 5334245 - DNA, 20 bp, Homo sapiens
ttcccaagtaagaggctgga

SEQ ID NO: 5334246 - DNA, 15 bp, Homo sapiens
ttcccaagtatgcct

SEQ ID NO: 5334247 - DNA, 17 bp, Homo sapiens
ttcccaagtcagacaga

SEQ ID NO: 5334248 - DNA, 12 bp, Homo sapiens
ttcccaataaaa

SEQ ID NO: 5334249 - DNA, 16 bp, Homo sapiens
ttcccaataaaagtga

SEQ ID NO: 5334250 - DNA, 12 bp, Homo sapiens
ttcccaataaat

SEQ ID NO: 5334251 - DNA, 21 bp, Homo sapiens
ttcccaatagcactttcattg

SEQ ID NO: 5334252 - DNA, 15 bp, Homo sapiens
ttcccaatatcatgt

SEQ ID NO: 5334253 - DNA, 17 bp, Homo sapiens
ttcccaatatgtagcct

SEQ ID NO: 5334254 - DNA, 14 bp, Homo sapiens
ttcccaatcttctt

SEQ ID NO: 5334255 - DNA, 14 bp, Homo sapiens
ttcccaattaggaa

SEQ ID NO: 5334256 - DNA, 20 bp, Homo sapiens
ttcccaattatcaaaaaaca

SEQ ID NO: 5334257 - DNA, 14 bp, Homo sapiens
ttcccaattcacat

SEQ ID NO: 5334258 - DNA, 17 bp, Homo sapiens
ttcccacaagaaattca

SEQ ID NO: 5334259 - DNA, 20 bp, Homo sapiens
ttcccacaattcttttgaaa

SEQ ID NO: 5334260 - DNA, 15 bp, Homo sapiens
ttcccacacctgcct

SEQ ID NO: 5334261 - DNA, 19 bp, Homo sapiens
ttcccacacgattagcttt

SEQ ID NO: 5334262 - DNA, 19 bp, Homo sapiens
ttcccacagcattcctcca

SEQ ID NO: 5334263 - DNA, 18 bp, Homo sapiens
ttcccacaggacatttct

SEQ ID NO: 5334264 - DNA, 21 bp, Homo sapiens
ttcccacaggagggccagcgc

SEQ ID NO: 5334265 - DNA, 13 bp, Homo sapiens
ttcccacatcttt

SEQ ID NO: 5334266 - DNA, 22 bp, Homo sapiens
ttcccacatctttcctcaagta

SEQ ID NO: 5334267 - DNA, 16 bp, Homo sapiens
ttcccacattaaagaa

SEQ ID NO: 5334268 - DNA, 13 bp, Homo sapiens
ttcccacattcca

SEQ ID NO: 5334269 - DNA, 22 bp, Homo sapiens
ttcccaccaactctctctgccc

SEQ ID NO: 5334270 - DNA, 22 bp, Homo sapiens
ttcccaccagcatgtcactccc

SEQ ID NO: 5334271 - DNA, 14 bp, Homo sapiens
ttcccaccagctcc

SEQ ID NO: 5334272 - DNA, 15 bp, Homo sapiens
ttcccaccagctccc

SEQ ID NO: 5334273 - DNA, 19 bp, Homo sapiens
ttcccaccattcctgcctt

SEQ ID NO: 5334274 - DNA, 21 bp, Homo sapiens
ttcccacccaattcaaaacat

SEQ ID NO: 5334275 - DNA, 12 bp, Homo sapiens
ttcccacccatc

SEQ ID NO: 5334276 - DNA, 16 bp, Homo sapiens
ttcccacccatctcca

SEQ ID NO: 5334277 - DNA, 15 bp, Homo sapiens
ttcccacccccaggc

SEQ ID NO: 5334278 - DNA, 16 bp, Homo sapiens
ttcccacccctacaca

SEQ ID NO: 5334279 - DNA, 13 bp, Homo sapiens
ttcccaccctcca

SEQ ID NO: 5334280 - DNA, 22 bp, Homo sapiens
ttcccaccctccacctctcacg

SEQ ID NO: 5334281 - DNA, 11 bp, Homo sapiens
ttcccaccctg

SEQ ID NO: 5334282 - DNA, 17 bp, Homo sapiens
ttcccaccgccctccct

SEQ ID NO: 5334283 - DNA, 22 bp, Homo sapiens
ttcccaccgccctccctcccca

SEQ ID NO: 5334284 - DNA, 17 bp, Homo sapiens
ttcccacctactgcact

SEQ ID NO: 5334285 - DNA, 19 bp, Homo sapiens
ttcccaccttgtcgctgaa

SEQ ID NO: 5334286 - DNA, 15 bp, Homo sapiens
ttcccacgacaaaaa

SEQ ID NO: 5334287 - DNA, 17 bp, Homo sapiens
ttcccacggccactgca

SEQ ID NO: 5334288 - DNA, 20 bp, Homo sapiens
ttcccacggcctttctagcc

SEQ ID NO: 5334289 - DNA, 23 bp, Homo sapiens
ttcccacgtcttcttgctgcagc

SEQ ID NO: 5334290 - DNA, 21 bp, Homo sapiens
ttcccactccaagcccagccc

SEQ ID NO: 5334291 - DNA, 13 bp, Homo sapiens
ttcccactccagc

SEQ ID NO: 5334292 - DNA, 20 bp, Homo sapiens
ttcccactctgtcgagcctg

SEQ ID NO: 5334293 - DNA, 14 bp, Homo sapiens
ttcccactcttctc

SEQ ID NO: 5334294 - DNA, 10 bp, Homo sapiens
ttcccactgc

SEQ ID NO: 5334295 - DNA, 20 bp, Homo sapiens
ttcccactgcaccccctcct

SEQ ID NO: 5334296 - DNA, 22 bp, Homo sapiens
ttcccactgcggaacaggagtg

SEQ ID NO: 5334297 - DNA, 23 bp, Homo sapiens
ttcccactgcggaacaggagtga

SEQ ID NO: 5334298 - DNA, 14 bp, Homo sapiens
ttcccactggctcc

SEQ ID NO: 5334299 - DNA, 14 bp, Homo sapiens
ttcccactgtcctt

SEQ ID NO: 5334300 - DNA, 15 bp, Homo sapiens
ttcccactgtccttt

SEQ ID NO: 5334301 - DNA, 18 bp, Homo sapiens
ttcccacttcccaccctg

SEQ ID NO: 5334302 - DNA, 18 bp, Homo sapiens
ttcccactttcccacccc

SEQ ID NO: 5334303 - DNA, 12 bp, Homo sapiens
ttcccagaaaac

SEQ ID NO: 5334304 - DNA, 23 bp, Homo sapiens
ttcccagaaggcatatcagtctc

SEQ ID NO: 5334305 - DNA, 12 bp, Homo sapiens
ttcccagaatca

SEQ ID NO: 5334306 - DNA, 17 bp, Homo sapiens
ttcccagaatctctgag

SEQ ID NO: 5334307 - DNA, 23 bp, Homo sapiens
ttcccagaatgttactgactcct

SEQ ID NO: 5334308 - DNA, 11 bp, Homo sapiens
ttcccagacca

SEQ ID NO: 5334309 - DNA, 23 bp, Homo sapiens
ttcccagaccttaagacactgtg

SEQ ID NO: 5334310 - DNA, 16 bp, Homo sapiens
ttcccagactagattt

SEQ ID NO: 5334311 - DNA, 14 bp, Homo sapiens
ttcccagactctgc

SEQ ID NO: 5334312 - DNA, 16 bp, Homo sapiens
ttcccagagaagctca

SEQ ID NO: 5334313 - DNA, 15 bp, Homo sapiens
ttcccagagacagga

SEQ ID NO: 5334314 - DNA, 14 bp, Homo sapiens
ttcccagagacccg

SEQ ID NO: 5334315 - DNA, 19 bp, Homo sapiens
ttcccagagagacgctgtg

SEQ ID NO: 5334316 - DNA, 23 bp, Homo sapiens
ttcccagagcaaaataattttaa

SEQ ID NO: 5334317 - DNA, 10 bp, Homo sapiens
ttcccagagg

SEQ ID NO: 5334318 - DNA, 15 bp, Homo sapiens
ttcccagaggcaggc

SEQ ID NO: 5334319 - DNA, 14 bp, Homo sapiens
ttcccagagggagc

SEQ ID NO: 5334320 - DNA, 14 bp, Homo sapiens
ttcccagcacatga

SEQ ID NO: 5334321 - DNA, 22 bp, Homo sapiens
ttcccagcactatgctttcctt

SEQ ID NO: 5334322 - DNA, 23 bp, Homo sapiens
ttcccagcagctgggccggccag

SEQ ID NO: 5334323 - DNA, 22 bp, Homo sapiens
ttcccagcagtggactcaaaac

SEQ ID NO: 5334324 - DNA, 20 bp, Homo sapiens
ttcccagccatgcccaggac

SEQ ID NO: 5334325 - DNA, 13 bp, Homo sapiens
ttcccagcccagc

SEQ ID NO: 5334326 - DNA, 12 bp, Homo sapiens
ttcccagcccct

SEQ ID NO: 5334327 - DNA, 20 bp, Homo sapiens
ttcccagcccctcctccctc

SEQ ID NO: 5334328 - DNA, 21 bp, Homo sapiens
ttcccagcccctcctccctca

SEQ ID NO: 5334329 - DNA, 18 bp, Homo sapiens
ttcccagccctcatccca

SEQ ID NO: 5334330 - DNA, 20 bp, Homo sapiens
ttcccagccctcatcccact

SEQ ID NO: 5334331 - DNA, 16 bp, Homo sapiens
ttcccagccctttcca

SEQ ID NO: 5334332 - DNA, 19 bp, Homo sapiens
ttcccagccctttccaggg

SEQ ID NO: 5334333 - DNA, 22 bp, Homo sapiens
ttcccagcctcttccattccct

SEQ ID NO: 5334334 - DNA, 23 bp, Homo sapiens
ttcccagcgcatggcgccccggg

SEQ ID NO: 5334335 - DNA, 21 bp, Homo sapiens
ttcccagcggttcctgtgcag

SEQ ID NO: 5334336 - DNA, 23 bp, Homo sapiens
ttcccagctctacattctgctct

SEQ ID NO: 5334337 - DNA, 18 bp, Homo sapiens
ttcccagctctaccctgc

SEQ ID NO: 5334338 - DNA, 18 bp, Homo sapiens
ttcccagctctccctctg

SEQ ID NO: 5334339 - DNA, 20 bp, Homo sapiens
ttcccagctctccctctggc

SEQ ID NO: 5334340 - DNA, 23 bp, Homo sapiens
ttcccagctctccctctggccct

SEQ ID NO: 5334341 - DNA, 19 bp, Homo sapiens
ttcccagctgcccctccct

SEQ ID NO: 5334342 - DNA, 20 bp, Homo sapiens
ttcccagctgcccctccctg

SEQ ID NO: 5334343 - DNA, 18 bp, Homo sapiens
ttcccagctgctcctaga

SEQ ID NO: 5334344 - DNA, 14 bp, Homo sapiens
ttcccagcttcccg

SEQ ID NO: 5334345 - DNA, 11 bp, Homo sapiens
ttcccaggacc

SEQ ID NO: 5334346 - DNA, 13 bp, Homo sapiens
ttcccaggaccct

SEQ ID NO: 5334347 - DNA, 19 bp, Homo sapiens
ttcccaggaccctgaaggg

SEQ ID NO: 5334348 - DNA, 15 bp, Homo sapiens
ttcccaggcagggag

SEQ ID NO: 5334349 - DNA, 17 bp, Homo sapiens
ttcccaggcagggaggg

SEQ ID NO: 5334350 - DNA, 10 bp, Homo sapiens
ttcccaggcc

SEQ ID NO: 5334351 - DNA, 12 bp, Homo sapiens
ttcccaggccag

SEQ ID NO: 5334352 - DNA, 19 bp, Homo sapiens
ttcccaggccaggctcccg

SEQ ID NO: 5334353 - DNA, 14 bp, Homo sapiens
ttcccaggcccttt

SEQ ID NO: 5334354 - DNA, 16 bp, Homo sapiens
ttcccaggccctttgg

SEQ ID NO: 5334355 - DNA, 12 bp, Homo sapiens
ttcccctgctga

SEQ ID NO: 5334356 - DNA, 11 bp, Homo sapiens
ttcccctggcc

SEQ ID NO: 5334357 - DNA, 10 bp, Homo sapiens
ttcccctggg

SEQ ID NO: 5334358 - DNA, 19 bp, Homo sapiens
ttcccctgggatgctgacc

SEQ ID NO: 5334359 - DNA, 12 bp, Homo sapiens
ttcccctgggca

SEQ ID NO: 5334360 - DNA, 21 bp, Homo sapiens
ttcccctggggacccacgtgg

SEQ ID NO: 5334361 - DNA, 13 bp, Homo sapiens
ttcccctgtgtca

SEQ ID NO: 5334362 - DNA, 18 bp, Homo sapiens
ttcccctgtttattcata

SEQ ID NO: 5334363 - DNA, 17 bp, Homo sapiens
ttccccttactctcaca

SEQ ID NO: 5334364 - DNA, 19 bp, Homo sapiens
ttccccttatcctccctgt

SEQ ID NO: 5334365 - DNA, 21 bp, Homo sapiens
ttccccttccactgagggcag

SEQ ID NO: 5334366 - DNA, 12 bp, Homo sapiens
ttccccttccca

SEQ ID NO: 5334367 - DNA, 12 bp, Homo sapiens
ttccccttccct

SEQ ID NO: 5334368 - DNA, 14 bp, Homo sapiens
ttccccttcccttc

SEQ ID NO: 5334369 - DNA, 13 bp, Homo sapiens
ttccccttcctaa

SEQ ID NO: 5334370 - DNA, 14 bp, Homo sapiens
ttccccttcctaag

SEQ ID NO: 5334371 - DNA, 22 bp, Homo sapiens
ttccccttcctaattccacagc

SEQ ID NO: 5334372 - DNA, 14 bp, Homo sapiens
ttccccttccttct

SEQ ID NO: 5334373 - DNA, 19 bp, Homo sapiens
ttccccttgaacctcatta

SEQ ID NO: 5334374 - DNA, 20 bp, Homo sapiens
ttccccttgaacctcattaa

SEQ ID NO: 5334375 - DNA, 22 bp, Homo sapiens
ttccccttgcccagggctcagc

SEQ ID NO: 5334376 - DNA, 13 bp, Homo sapiens
ttccccttgccct

SEQ ID NO: 5334377 - DNA, 21 bp, Homo sapiens
ttccccttgcccttgccctga

SEQ ID NO: 5334378 - DNA, 12 bp, Homo sapiens
ttccccttggac

SEQ ID NO: 5334379 - DNA, 18 bp, Homo sapiens
ttcccctttactcagccc

SEQ ID NO: 5334380 - DNA, 17 bp, Homo sapiens
ttcccctttccccactc

SEQ ID NO: 5334381 - DNA, 13 bp, Homo sapiens
ttcccctttcctg

SEQ ID NO: 5334382 - DNA, 13 bp, Homo sapiens
ttcccctttctct

SEQ ID NO: 5334383 - DNA, 12 bp, Homo sapiens
ttcccctttctt

SEQ ID NO: 5334384 - DNA, 17 bp, Homo sapiens
ttcccctttgtcctgcg

SEQ ID NO: 5334385 - DNA, 20 bp, Homo sapiens
ttccccttttaaggtttcaa

SEQ ID NO: 5334386 - DNA, 18 bp, Homo sapiens
ttccccttttgcctggct

SEQ ID NO: 5334387 - DNA, 14 bp, Homo sapiens
ttcccgaaggccga

SEQ ID NO: 5334388 - DNA, 12 bp, Homo sapiens
ttcccgacccag

SEQ ID NO: 5334389 - DNA, 18 bp, Homo sapiens
ttcccgatggtctctctc

SEQ ID NO: 5334390 - DNA, 21 bp, Homo sapiens
ttcccgatggtctctctccct

SEQ ID NO: 5334391 - DNA, 14 bp, Homo sapiens
ttcccgcagcacca

SEQ ID NO: 5334392 - DNA, 22 bp, Homo sapiens
ttcccgcagcaccagcctgagc

SEQ ID NO: 5334393 - DNA, 19 bp, Homo sapiens
ttcccgcccagcctcactt

SEQ ID NO: 5334394 - DNA, 19 bp, Homo sapiens
ttcccgccccacctcccat

SEQ ID NO: 5334395 - DNA, 23 bp, Homo sapiens
ttcccgccccacctcccatttct

SEQ ID NO: 5334396 - DNA, 19 bp, Homo sapiens
ttcccgccggaggccagct

SEQ ID NO: 5334397 - DNA, 17 bp, Homo sapiens
ttcccgcctcagcctct

SEQ ID NO: 5334398 - DNA, 12 bp, Homo sapiens
ttcccgcctccc

SEQ ID NO: 5334399 - DNA, 21 bp, Homo sapiens
ttcccgccttcaggttcctcc

SEQ ID NO: 5334400 - DNA, 23 bp, Homo sapiens
ttcccgccttcaggttcctccta

SEQ ID NO: 5334401 - DNA, 21 bp, Homo sapiens
ttcccgctcagccctccctgc

SEQ ID NO: 5334402 - DNA, 22 bp, Homo sapiens
ttcccgctcagccctccctgcc

SEQ ID NO: 5334403 - DNA, 12 bp, Homo sapiens
ttcccgctcccc

SEQ ID NO: 5334404 - DNA, 15 bp, Homo sapiens
ttcccgctccccacc

SEQ ID NO: 5334405 - DNA, 17 bp, Homo sapiens
ttcccggagcacagccc

SEQ ID NO: 5334406 - DNA, 19 bp, Homo sapiens
ttcccggagcacagccctg

SEQ ID NO: 5334407 - DNA, 22 bp, Homo sapiens
ttcccggagggaaactgtgaat

SEQ ID NO: 5334408 - DNA, 17 bp, Homo sapiens
ttcccgggccagggctg

SEQ ID NO: 5334409 - DNA, 20 bp, Homo sapiens
ttcccggtcccgagtacagt

SEQ ID NO: 5334410 - DNA, 19 bp, Homo sapiens
ttcccggttcaggaccact

SEQ ID NO: 5334411 - DNA, 18 bp, Homo sapiens
ttcccgtatgctttcttc

SEQ ID NO: 5334412 - DNA, 13 bp, Homo sapiens
ttcccgtctcaga

SEQ ID NO: 5334413 - DNA, 14 bp, Homo sapiens
ttcccgtgcctggg

SEQ ID NO: 5334414 - DNA, 13 bp, Homo sapiens
ttcccgtggcccc

SEQ ID NO: 5334415 - DNA, 17 bp, Homo sapiens
ttcccgtggccccagcc

SEQ ID NO: 5334416 - DNA, 19 bp, Homo sapiens
ttcccgtggccccagcctg

SEQ ID NO: 5334417 - DNA, 19 bp, Homo sapiens
ttcccgtggctttgtgctt

SEQ ID NO: 5334418 - DNA, 14 bp, Homo sapiens
ttcccgtttctcca

SEQ ID NO: 5334419 - DNA, 17 bp, Homo sapiens
ttcccgtttctccacct

SEQ ID NO: 5334420 - DNA, 22 bp, Homo sapiens
ttccctaaaatacatttaaaac

SEQ ID NO: 5334421 - DNA, 14 bp, Homo sapiens
ttccctaaaatgta

SEQ ID NO: 5334422 - DNA, 15 bp, Homo sapiens
ttccctaaactgcag

SEQ ID NO: 5334423 - DNA, 17 bp, Homo sapiens
ttccctaaactgcagcc

SEQ ID NO: 5334424 - DNA, 13 bp, Homo sapiens
ttccctaaagaca

SEQ ID NO: 5334425 - DNA, 12 bp, Homo sapiens
ttccctaaagcc

SEQ ID NO: 5334426 - DNA, 15 bp, Homo sapiens
ttccctaaagtgatg

SEQ ID NO: 5334427 - DNA, 18 bp, Homo sapiens
ttccctaatagcttttta

SEQ ID NO: 5334428 - DNA, 13 bp, Homo sapiens
ttccctaatcttc

SEQ ID NO: 5334429 - DNA, 15 bp, Homo sapiens
ttccctacacagggc

SEQ ID NO: 5334430 - DNA, 19 bp, Homo sapiens
ttccctacattaaacatga

SEQ ID NO: 5334431 - DNA, 17 bp, Homo sapiens
ttccctacccacagggc

SEQ ID NO: 5334432 - DNA, 19 bp, Homo sapiens
ttccctacccacagggcct

SEQ ID NO: 5334433 - DNA, 18 bp, Homo sapiens
ttccctaccctaccccca

SEQ ID NO: 5334434 - DNA, 17 bp, Homo sapiens
ttccctaccctctagag

SEQ ID NO: 5334435 - DNA, 15 bp, Homo sapiens
ttccctacccttcct

SEQ ID NO: 5334436 - DNA, 18 bp, Homo sapiens
ttccctactaacatccca

SEQ ID NO: 5334437 - DNA, 19 bp, Homo sapiens
ttccctacttgataatatt

SEQ ID NO: 5334438 - DNA, 14 bp, Homo sapiens
ttccctacttgcag

SEQ ID NO: 5334439 - DNA, 21 bp, Homo sapiens
ttccctagaaagccatattcc

SEQ ID NO: 5334440 - DNA, 23 bp, Homo sapiens
ttccctagaaagccatattccag

SEQ ID NO: 5334441 - DNA, 10 bp, Homo sapiens
ttccctagag

SEQ ID NO: 5334442 - DNA, 12 bp, Homo sapiens
ttccctagagag

SEQ ID NO: 5334443 - DNA, 15 bp, Homo sapiens
ttccctagagagaat

SEQ ID NO: 5334444 - DNA, 17 bp, Homo sapiens
ttccctagagagaataa

SEQ ID NO: 5334445 - DNA, 20 bp, Homo sapiens
ttccctagagagaataaatt

SEQ ID NO: 5334446 - DNA, 16 bp, Homo sapiens
ttccctagatggttcc

SEQ ID NO: 5334447 - DNA, 21 bp, Homo sapiens
ttccctagatggttccctttg

SEQ ID NO: 5334448 - DNA, 18 bp, Homo sapiens
ttccctaggggacacttc

SEQ ID NO: 5334449 - DNA, 19 bp, Homo sapiens
ttccctagtctattcatta

SEQ ID NO: 5334450 - DNA, 15 bp, Homo sapiens
ttccctatcaaaaca

SEQ ID NO: 5334451 - DNA, 12 bp, Homo sapiens
ttccctatcact

SEQ ID NO: 5334452 - DNA, 15 bp, Homo sapiens
ttccctatccaatca

SEQ ID NO: 5334453 - DNA, 21 bp, Homo sapiens
ttccctattatttccgggtgg

SEQ ID NO: 5334454 - DNA, 22 bp, Homo sapiens
ttccctatttgtgaattctggg

SEQ ID NO: 5334455 - DNA, 22 bp, Homo sapiens
ttccctcaaagcttccattcca

SEQ ID NO: 5334456 - DNA, 14 bp, Homo sapiens
ttccctcaccccct

SEQ ID NO: 5334457 - DNA, 20 bp, Homo sapiens
ttccctcacctttcccatct

SEQ ID NO: 5334458 - DNA, 20 bp, Homo sapiens
ttccctcactcgtctccccc

SEQ ID NO: 5334459 - DNA, 19 bp, Homo sapiens
ttccctcactcttcctcat

SEQ ID NO: 5334460 - DNA, 18 bp, Homo sapiens
ttccctcagccctcatta

SEQ ID NO: 5334461 - DNA, 17 bp, Homo sapiens
ttccctcattctgcatt

SEQ ID NO: 5334462 - DNA, 19 bp, Homo sapiens
ttccctcattctgcattaa

SEQ ID NO: 5334463 - DNA, 12 bp, Homo sapiens
ttccctccaggc

SEQ ID NO: 5334464 - DNA, 22 bp, Homo sapiens
ttccctcccaacagagctgggc

SEQ ID NO: 5334465 - DNA, 14 bp, Homo sapiens
ttccctccccagct

SEQ ID NO: 5334466 - DNA, 22 bp, Homo sapiens
ttccctccctcaaagaaatcct

SEQ ID NO: 5334467 - DNA, 17 bp, Homo sapiens
ttccctccctctcttcc

SEQ ID NO: 5334468 - DNA, 15 bp, Homo sapiens
ttccctccctgctgt

SEQ ID NO: 5334469 - DNA, 17 bp, Homo sapiens
ttccctcccttcctctt

SEQ ID NO: 5334470 - DNA, 19 bp, Homo sapiens
ttccctccgggcaggggag

SEQ ID NO: 5334471 - DNA, 22 bp, Homo sapiens
ttccctcctcccatgtcactgc

SEQ ID NO: 5334472 - DNA, 15 bp, Homo sapiens
ttccctcctgcccag

SEQ ID NO: 5334473 - DNA, 15 bp, Homo sapiens
ttccctcctgctact

SEQ ID NO: 5334474 - DNA, 13 bp, Homo sapiens
ttccctcctggtc

SEQ ID NO: 5334475 - DNA, 16 bp, Homo sapiens
ttccctcctggtcctg

SEQ ID NO: 5334476 - DNA, 18 bp, Homo sapiens
ttccctcctggtcctgga

SEQ ID NO: 5334477 - DNA, 21 bp, Homo sapiens
ttccctcctggtcctggacac

SEQ ID NO: 5334478 - DNA, 20 bp, Homo sapiens
ttccctcctgtgccccagct

SEQ ID NO: 5334479 - DNA, 12 bp, Homo sapiens
ttccctccttgg

SEQ ID NO: 5334480 - DNA, 14 bp, Homo sapiens
ttccctccttttaa

SEQ ID NO: 5334481 - DNA, 18 bp, Homo sapiens
ttccctcggagttcttct

SEQ ID NO: 5334482 - DNA, 23 bp, Homo sapiens
ttccctcgtagttggcaggagct

SEQ ID NO: 5334483 - DNA, 11 bp, Homo sapiens
ttccctctccc

SEQ ID NO: 5334484 - DNA, 12 bp, Homo sapiens
ttccctctccca

SEQ ID NO: 5334485 - DNA, 15 bp, Homo sapiens
ttccctctcccaccc

SEQ ID NO: 5334486 - DNA, 12 bp, Homo sapiens
ttccctctccct

SEQ ID NO: 5334487 - DNA, 13 bp, Homo sapiens
ttccctctcctgc

SEQ ID NO: 5334488 - DNA, 19 bp, Homo sapiens
ttccctctcgctcccctct

SEQ ID NO: 5334489 - DNA, 20 bp, Homo sapiens
ttccctctctcagcacagcc

SEQ ID NO: 5334490 - DNA, 21 bp, Homo sapiens
ttccctctctcagcacagcct

SEQ ID NO: 5334491 - DNA, 14 bp, Homo sapiens
ttccctctctctga

SEQ ID NO: 5334492 - DNA, 21 bp, Homo sapiens
ttccctctctgatgtcccagt

SEQ ID NO: 5334493 - DNA, 13 bp, Homo sapiens
ttccctctctgga

SEQ ID NO: 5334494 - DNA, 16 bp, Homo sapiens
ttccctctcttgcctt

SEQ ID NO: 5334495 - DNA, 23 bp, Homo sapiens
ttccctctgagaattccaaggag

SEQ ID NO: 5334496 - DNA, 22 bp, Homo sapiens
ttccctctgcctgggatgccct

SEQ ID NO: 5334497 - DNA, 17 bp, Homo sapiens
ttccctctgctcagcca

SEQ ID NO: 5334498 - DNA, 12 bp, Homo sapiens
ttccctctgctg

SEQ ID NO: 5334499 - DNA, 24 bp, Homo sapiens
ttccctctgggcacgcctgctggc

SEQ ID NO: 5334500 - DNA, 15 bp, Homo sapiens
ttccctctgggcctg

SEQ ID NO: 5334501 - DNA, 16 bp, Homo sapiens
ttccctcttccctggt

SEQ ID NO: 5334502 - DNA, 18 bp, Homo sapiens
ttccctcttctaacccaa

SEQ ID NO: 5334503 - DNA, 19 bp, Homo sapiens
ttccctcttctaacccaac

SEQ ID NO: 5334504 - DNA, 17 bp, Homo sapiens
ttccctcttgtgctcag

SEQ ID NO: 5334505 - DNA, 22 bp, Homo sapiens
ttccctctttcatctcctgagt

SEQ ID NO: 5334506 - DNA, 19 bp, Homo sapiens
ttccctctttccccacctc

SEQ ID NO: 5334507 - DNA, 20 bp, Homo sapiens
ttccctctttccccacctct

SEQ ID NO: 5334508 - DNA, 20 bp, Homo sapiens
ttccctctttcttataatac

SEQ ID NO: 5334509 - DNA, 14 bp, Homo sapiens
ttccctctttggct

SEQ ID NO: 5334510 - DNA, 15 bp, Homo sapiens
ttccctcttttctta

SEQ ID NO: 5334511 - DNA, 17 bp, Homo sapiens
ttccctcttttcttact

SEQ ID NO: 5334512 - DNA, 20 bp, Homo sapiens
ttccctgaaaacccagagag

SEQ ID NO: 5334513 - DNA, 20 bp, Homo sapiens
ttccctgaacatctgtgtgt

SEQ ID NO: 5334514 - DNA, 18 bp, Homo sapiens
ttccctgaacgttttctt

SEQ ID NO: 5334515 - DNA, 21 bp, Homo sapiens
ttccctgaatctgtgcctgca

SEQ ID NO: 5334516 - DNA, 22 bp, Homo sapiens
ttccctgacactgtctgctgcc

SEQ ID NO: 5334517 - DNA, 16 bp, Homo sapiens
ttccctgactcattct

SEQ ID NO: 5334518 - DNA, 17 bp, Homo sapiens
ttccctgacttgcttta

SEQ ID NO: 5334519 - DNA, 23 bp, Homo sapiens
ttccctgagaaacccaccagcct

SEQ ID NO: 5334520 - DNA, 19 bp, Homo sapiens
ttccctgatggcctttgga

SEQ ID NO: 5334521 - DNA, 19 bp, Homo sapiens
ttccctgattgacctgctc

SEQ ID NO: 5334522 - DNA, 12 bp, Homo sapiens
ttccctgcaacc

SEQ ID NO: 5334523 - DNA, 16 bp, Homo sapiens
ttccctgcaccctgga

SEQ ID NO: 5334524 - DNA, 22 bp, Homo sapiens
ttccctgcactaaagccagcct

SEQ ID NO: 5334525 - DNA, 16 bp, Homo sapiens
ttccctgcagacctca

SEQ ID NO: 5334526 - DNA, 23 bp, Homo sapiens
ttccctgcagacctcaagccatc

SEQ ID NO: 5334527 - DNA, 14 bp, Homo sapiens
ttccctgcagctga

SEQ ID NO: 5334528 - DNA, 23 bp, Homo sapiens
ttccctgcagggcgcccctggga

SEQ ID NO: 5334529 - DNA, 18 bp, Homo sapiens
ttccctgccacatccagc

SEQ ID NO: 5334530 - DNA, 12 bp, Homo sapiens
ttccctgcccaa

SEQ ID NO: 5334531 - DNA, 23 bp, Homo sapiens
ttccctgcccaatcctccctgga

SEQ ID NO: 5334532 - DNA, 13 bp, Homo sapiens
ttccctgcccctg

SEQ ID NO: 5334533 - DNA, 22 bp, Homo sapiens
ttccctgcccgaggtcgctgca

SEQ ID NO: 5334534 - DNA, 14 bp, Homo sapiens
ttcctcagactcta

SEQ ID NO: 5334535 - DNA, 16 bp, Homo sapiens
ttcctcagatccccag

SEQ ID NO: 5334536 - DNA, 20 bp, Homo sapiens
ttcctcagattcaataatga

SEQ ID NO: 5334537 - DNA, 19 bp, Homo sapiens
ttcctcagccagcctcgcc

SEQ ID NO: 5334538 - DNA, 21 bp, Homo sapiens
ttcctcagctctaggctgttc

SEQ ID NO: 5334539 - DNA, 13 bp, Homo sapiens
ttcctcagctgcc

SEQ ID NO: 5334540 - DNA, 14 bp, Homo sapiens
ttcctcagctgcca

SEQ ID NO: 5334541 - DNA, 17 bp, Homo sapiens
ttcctcagctgtacaaa

SEQ ID NO: 5334542 - DNA, 16 bp, Homo sapiens
ttcctcagcttatctc

SEQ ID NO: 5334543 - DNA, 18 bp, Homo sapiens
ttcctcaggaattccaat

SEQ ID NO: 5334544 - DNA, 18 bp, Homo sapiens
ttcctcagggtgtcctga

SEQ ID NO: 5334545 - DNA, 20 bp, Homo sapiens
ttcctcagttgttaacttct

SEQ ID NO: 5334546 - DNA, 18 bp, Homo sapiens
ttcctcatcagtgtcatt

SEQ ID NO: 5334547 - DNA, 22 bp, Homo sapiens
ttcctcatcatgaaaactggga

SEQ ID NO: 5334548 - DNA, 22 bp, Homo sapiens
ttcctcatcctcagatgctcaa

SEQ ID NO: 5334549 - DNA, 12 bp, Homo sapiens
ttcctcatcctt

SEQ ID NO: 5334550 - DNA, 20 bp, Homo sapiens
ttcctcatcctttccctctc

SEQ ID NO: 5334551 - DNA, 17 bp, Homo sapiens
ttcctcatctccatgct

SEQ ID NO: 5334552 - DNA, 19 bp, Homo sapiens
ttcctcatctgcagaatgg

SEQ ID NO: 5334553 - DNA, 16 bp, Homo sapiens
ttcctcatctttaaaa

SEQ ID NO: 5334554 - DNA, 15 bp, Homo sapiens
ttcctcatgaatgta

SEQ ID NO: 5334555 - DNA, 18 bp, Homo sapiens
ttcctcatgaatgtaaat

SEQ ID NO: 5334556 - DNA, 11 bp, Homo sapiens
ttcctcatggc

SEQ ID NO: 5334557 - DNA, 22 bp, Homo sapiens
ttcctcatggctgttatctgtc

SEQ ID NO: 5334558 - DNA, 14 bp, Homo sapiens
ttcctcattaaatt

SEQ ID NO: 5334559 - DNA, 20 bp, Homo sapiens
ttcctcattaatagctgcct

SEQ ID NO: 5334560 - DNA, 13 bp, Homo sapiens
ttcctcattagca

SEQ ID NO: 5334561 - DNA, 16 bp, Homo sapiens
ttcctcattcctgaaa

SEQ ID NO: 5334562 - DNA, 13 bp, Homo sapiens
ttcctcatttgtt

SEQ ID NO: 5334563 - DNA, 20 bp, Homo sapiens
ttcctcatttgttcattaaa

SEQ ID NO: 5334564 - DNA, 15 bp, Homo sapiens
ttcctcattttgaat

SEQ ID NO: 5334565 - DNA, 18 bp, Homo sapiens
ttcctccaaactcctgcc

SEQ ID NO: 5334566 - DNA, 21 bp, Homo sapiens
ttcctccaaactcctgcctgt

SEQ ID NO: 5334567 - DNA, 16 bp, Homo sapiens
ttcctccaaagcctgg

SEQ ID NO: 5334568 - DNA, 18 bp, Homo sapiens
ttcctccaatccccactc

SEQ ID NO: 5334569 - DNA, 21 bp, Homo sapiens
ttcctccaatccccactcctc

SEQ ID NO: 5334570 - DNA, 18 bp, Homo sapiens
ttcctccacagtccccca

SEQ ID NO: 5334571 - DNA, 23 bp, Homo sapiens
ttcctccacatcctttctaaaca

SEQ ID NO: 5334572 - DNA, 15 bp, Homo sapiens
ttcctccagacagat

SEQ ID NO: 5334573 - DNA, 22 bp, Homo sapiens
ttcctccagagacactgagcca

SEQ ID NO: 5334574 - DNA, 22 bp, Homo sapiens
ttcctccagccacctcagtccc

SEQ ID NO: 5334575 - DNA, 13 bp, Homo sapiens
ttcctccagccct

SEQ ID NO: 5334576 - DNA, 15 bp, Homo sapiens
ttcctccagcctccc

SEQ ID NO: 5334577 - DNA, 16 bp, Homo sapiens
ttcctccagctgcacc

SEQ ID NO: 5334578 - DNA, 18 bp, Homo sapiens
ttcctccagtctgttctc

SEQ ID NO: 5334579 - DNA, 22 bp, Homo sapiens
ttcctccatcctcctccttcct

SEQ ID NO: 5334580 - DNA, 17 bp, Homo sapiens
ttcctcccaagaggcca

SEQ ID NO: 5334581 - DNA, 11 bp, Homo sapiens
ttcctcccaat

SEQ ID NO: 5334582 - DNA, 22 bp, Homo sapiens
ttcctcccagttctacaagcat

SEQ ID NO: 5334583 - DNA, 17 bp, Homo sapiens
ttcctccccacactcca

SEQ ID NO: 5334584 - DNA, 20 bp, Homo sapiens
ttcctccccacactccactc

SEQ ID NO: 5334585 - DNA, 20 bp, Homo sapiens
ttcctccccaccctgtccca

SEQ ID NO: 5334586 - DNA, 11 bp, Homo sapiens
ttcctccccag

SEQ ID NO: 5334587 - DNA, 13 bp, Homo sapiens
ttcctccccagca

SEQ ID NO: 5334588 - DNA, 14 bp, Homo sapiens
ttcctccccagcag

SEQ ID NO: 5334589 - DNA, 13 bp, Homo sapiens
ttcctccccagtc

SEQ ID NO: 5334590 - DNA, 18 bp, Homo sapiens
ttcctccccattcctaca

SEQ ID NO: 5334591 - DNA, 17 bp, Homo sapiens
ttcctccccctgcaact

SEQ ID NO: 5334592 - DNA, 22 bp, Homo sapiens
ttcctccccgcctcctcccact

SEQ ID NO: 5334593 - DNA, 12 bp, Homo sapiens
ttcctcccctcg

SEQ ID NO: 5334594 - DNA, 12 bp, Homo sapiens
ttcctcccctgg

SEQ ID NO: 5334595 - DNA, 15 bp, Homo sapiens
ttcctcccctggaag

SEQ ID NO: 5334596 - DNA, 23 bp, Homo sapiens
ttcctcccctggaagttgtcctt

SEQ ID NO: 5334597 - DNA, 19 bp, Homo sapiens
ttcctcccggggccttcct

SEQ ID NO: 5334598 - DNA, 19 bp, Homo sapiens
ttcctccctccctctttcc

SEQ ID NO: 5334599 - DNA, 22 bp, Homo sapiens
ttcctccctccctctttccctc

SEQ ID NO: 5334600 - DNA, 15 bp, Homo sapiens
ttcctccctccctgc

SEQ ID NO: 5334601 - DNA, 22 bp, Homo sapiens
ttcctccctgcttaaaaatgta

SEQ ID NO: 5334602 - DNA, 24 bp, Homo sapiens
ttcctccctggcatgaccatcctg

SEQ ID NO: 5334603 - DNA, 21 bp, Homo sapiens
ttcctccctgtctctgcatct

SEQ ID NO: 5334604 - DNA, 14 bp, Homo sapiens
ttcctcccttctgc

SEQ ID NO: 5334605 - DNA, 15 bp, Homo sapiens
ttcctcccttctgct

SEQ ID NO: 5334606 - DNA, 16 bp, Homo sapiens
ttcctcccttctgcta

SEQ ID NO: 5334607 - DNA, 19 bp, Homo sapiens
ttcctccgtccacccaggc

SEQ ID NO: 5334608 - DNA, 20 bp, Homo sapiens
ttcctccgtccacccaggct

SEQ ID NO: 5334609 - DNA, 22 bp, Homo sapiens
ttcctccgtccacccaggctgc

SEQ ID NO: 5334610 - DNA, 14 bp, Homo sapiens
ttcctcctacctgg

SEQ ID NO: 5334611 - DNA, 13 bp, Homo sapiens
ttcctcctcaggc

SEQ ID NO: 5334612 - DNA, 21 bp, Homo sapiens
ttcctcctcatgaaagcagca

SEQ ID NO: 5334613 - DNA, 20 bp, Homo sapiens
ttcctcctccacagtgctgc

SEQ ID NO: 5334614 - DNA, 14 bp, Homo sapiens
ttcctcctccacca

SEQ ID NO: 5334615 - DNA, 23 bp, Homo sapiens
ttcctcctccacccacccccttt

SEQ ID NO: 5334616 - DNA, 19 bp, Homo sapiens
ttcctcctccatcacctga

SEQ ID NO: 5334617 - DNA, 14 bp, Homo sapiens
ttcctcctcccaag

SEQ ID NO: 5334618 - DNA, 23 bp, Homo sapiens
ttcctcctcccaaggcattctcc

SEQ ID NO: 5334619 - DNA, 21 bp, Homo sapiens
ttcctcctcccagtgccttct

SEQ ID NO: 5334620 - DNA, 16 bp, Homo sapiens
ttcctcctccccgctc

SEQ ID NO: 5334621 - DNA, 23 bp, Homo sapiens
ttcctcctcccctggcaactgct

SEQ ID NO: 5334622 - DNA, 17 bp, Homo sapiens
ttcctcctcctttgcct

SEQ ID NO: 5334623 - DNA, 13 bp, Homo sapiens
ttcctcctctcct

SEQ ID NO: 5334624 - DNA, 14 bp, Homo sapiens
ttcctcctctcctg

SEQ ID NO: 5334625 - DNA, 19 bp, Homo sapiens
ttcctcctgacaccccact

SEQ ID NO: 5334626 - DNA, 14 bp, Homo sapiens
ttcctcctgattct

SEQ ID NO: 5334627 - DNA, 14 bp, Homo sapiens
ttcctcctgcagac

SEQ ID NO: 5334628 - DNA, 15 bp, Homo sapiens
ttcctcctgcagaca

SEQ ID NO: 5334629 - DNA, 23 bp, Homo sapiens
ttcctcctgcagacacctggact

SEQ ID NO: 5334630 - DNA, 13 bp, Homo sapiens
ttcctcctgcctt

SEQ ID NO: 5334631 - DNA, 15 bp, Homo sapiens
ttcctcctgctcata

SEQ ID NO: 5334632 - DNA, 17 bp, Homo sapiens
ttcctcctgtctcctct

SEQ ID NO: 5334633 - DNA, 18 bp, Homo sapiens
ttcctcctttctctgtat

SEQ ID NO: 5334634 - DNA, 21 bp, Homo sapiens
ttcctcctttctctgtatatt

SEQ ID NO: 5334635 - DNA, 15 bp, Homo sapiens
ttcctcgcacagggc

SEQ ID NO: 5334636 - DNA, 23 bp, Homo sapiens
ttcctcgcacagggcatgcctgg

SEQ ID NO: 5334637 - DNA, 16 bp, Homo sapiens
ttcctcggtctccctt

SEQ ID NO: 5334638 - DNA, 19 bp, Homo sapiens
ttcctcggtctcccttccg

SEQ ID NO: 5334639 - DNA, 23 bp, Homo sapiens
ttcctcggtctcccttccgtcca

SEQ ID NO: 5334640 - DNA, 20 bp, Homo sapiens
ttcctcggtgggccagagct

SEQ ID NO: 5334641 - DNA, 21 bp, Homo sapiens
ttcctcggtgggccagagctg

SEQ ID NO: 5334642 - DNA, 22 bp, Homo sapiens
ttcctcggtgggccagagctga

SEQ ID NO: 5334643 - DNA, 22 bp, Homo sapiens
ttcctcgttgggccgctctgat

SEQ ID NO: 5334644 - DNA, 20 bp, Homo sapiens
ttcctcgttttgaaagcagt

SEQ ID NO: 5334645 - DNA, 22 bp, Homo sapiens
ttcctctaacatttttgaggaa

SEQ ID NO: 5334646 - DNA, 15 bp, Homo sapiens
ttcctctaactcact

SEQ ID NO: 5334647 - DNA, 22 bp, Homo sapiens
ttcctctaacttggctcacact

SEQ ID NO: 5334648 - DNA, 15 bp, Homo sapiens
ttcctctaatatgcc

SEQ ID NO: 5334649 - DNA, 22 bp, Homo sapiens
ttcctctaccaccacaccaaat

SEQ ID NO: 5334650 - DNA, 17 bp, Homo sapiens
ttcctctagaagccaag

SEQ ID NO: 5334651 - DNA, 15 bp, Homo sapiens
ttcctctaggcaagc

SEQ ID NO: 5334652 - DNA, 19 bp, Homo sapiens
ttcctctagtgccctccac

SEQ ID NO: 5334653 - DNA, 17 bp, Homo sapiens
ttcctctagttctttgt

SEQ ID NO: 5334654 - DNA, 16 bp, Homo sapiens
ttcctctatactttgt

SEQ ID NO: 5334655 - DNA, 17 bp, Homo sapiens
ttcctctattgatgtac

SEQ ID NO: 5334656 - DNA, 21 bp, Homo sapiens
ttcctctattgatgtacagtc

SEQ ID NO: 5334657 - DNA, 22 bp, Homo sapiens
ttcctctcaaattcagctctga

SEQ ID NO: 5334658 - DNA, 17 bp, Homo sapiens
ttcctctcaccccactc

SEQ ID NO: 5334659 - DNA, 23 bp, Homo sapiens
ttcctctcaccccactcctgtca

SEQ ID NO: 5334660 - DNA, 21 bp, Homo sapiens
ttcctctcactcctgcctccg

SEQ ID NO: 5334661 - DNA, 22 bp, Homo sapiens
ttcctctcactcctgcctccgc

SEQ ID NO: 5334662 - DNA, 21 bp, Homo sapiens
ttcctctcatccttttctcct

SEQ ID NO: 5334663 - DNA, 22 bp, Homo sapiens
ttcctctcatttccagcttctc

SEQ ID NO: 5334664 - DNA, 14 bp, Homo sapiens
ttcctctccacagg

SEQ ID NO: 5334665 - DNA, 12 bp, Homo sapiens
ttcctctccacc

SEQ ID NO: 5334666 - DNA, 17 bp, Homo sapiens
ttcctctccaccctccc

SEQ ID NO: 5334667 - DNA, 14 bp, Homo sapiens
ttcctctccagcct

SEQ ID NO: 5334668 - DNA, 16 bp, Homo sapiens
ttcctctccagccttc

SEQ ID NO: 5334669 - DNA, 19 bp, Homo sapiens
ttcctctccagccttctct

SEQ ID NO: 5334670 - DNA, 21 bp, Homo sapiens
ttcctctccagccttctctct

SEQ ID NO: 5334671 - DNA, 19 bp, Homo sapiens
ttcctctcccattcaccct

SEQ ID NO: 5334672 - DNA, 14 bp, Homo sapiens
ttcctctccctcag

SEQ ID NO: 5334673 - DNA, 16 bp, Homo sapiens
ttcctctcccttccct

SEQ ID NO: 5334674 - DNA, 15 bp, Homo sapiens
ttcctctccttccca

SEQ ID NO: 5334675 - DNA, 19 bp, Homo sapiens
ttcctctccttcgtatccc

SEQ ID NO: 5334676 - DNA, 16 bp, Homo sapiens
ttcctctcgcggccct

SEQ ID NO: 5334677 - DNA, 20 bp, Homo sapiens
ttcctctcgcggccctcagt

SEQ ID NO: 5334678 - DNA, 14 bp, Homo sapiens
ttcctctctaagtg

SEQ ID NO: 5334679 - DNA, 14 bp, Homo sapiens
ttcctctctccaga

SEQ ID NO: 5334680 - DNA, 14 bp, Homo sapiens
ttcctctctctcac

SEQ ID NO: 5334681 - DNA, 14 bp, Homo sapiens
ttcctctctctctc

SEQ ID NO: 5334682 - DNA, 11 bp, Homo sapiens
ttcctctctgg

SEQ ID NO: 5334683 - DNA, 19 bp, Homo sapiens
ttcctctctgtctgtctct

SEQ ID NO: 5334684 - DNA, 18 bp, Homo sapiens
ttcctctctttgttctca

SEQ ID NO: 5334685 - DNA, 16 bp, Homo sapiens
ttcctctgagcccagc

SEQ ID NO: 5334686 - DNA, 17 bp, Homo sapiens
ttcctctgagcccagct

SEQ ID NO: 5334687 - DNA, 21 bp, Homo sapiens
ttcctctgagcccagctgcct

SEQ ID NO: 5334688 - DNA, 14 bp, Homo sapiens
ttcctctgagcctt

SEQ ID NO: 5334689 - DNA, 15 bp, Homo sapiens
ttcctctgatttcaa

SEQ ID NO: 5334690 - DNA, 10 bp, Homo sapiens
ttcctctgca

SEQ ID NO: 5334691 - DNA, 14 bp, Homo sapiens
ttcctctgcacgct

SEQ ID NO: 5334692 - DNA, 16 bp, Homo sapiens
ttcctctgcaggacac

SEQ ID NO: 5334693 - DNA, 23 bp, Homo sapiens
ttcctctgccatgtttttcccct

SEQ ID NO: 5334694 - DNA, 14 bp, Homo sapiens
ttcctctgcctgcc

SEQ ID NO: 5334695 - DNA, 16 bp, Homo sapiens
ttcctctgcctgcccc

SEQ ID NO: 5334696 - DNA, 14 bp, Homo sapiens
ttcctctgctaaat

SEQ ID NO: 5334697 - DNA, 16 bp, Homo sapiens
ttcctctgctaaattg

SEQ ID NO: 5334698 - DNA, 11 bp, Homo sapiens
ttcctctgctc

SEQ ID NO: 5334699 - DNA, 14 bp, Homo sapiens
ttcctctgctcacc

SEQ ID NO: 5334700 - DNA, 13 bp, Homo sapiens
ttcctctgctgca

SEQ ID NO: 5334701 - DNA, 18 bp, Homo sapiens
ttcctctgctgcatcccc

SEQ ID NO: 5334702 - DNA, 19 bp, Homo sapiens
ttcctctgctgcatcccct

SEQ ID NO: 5334703 - DNA, 13 bp, Homo sapiens
ttcctctgctttg

SEQ ID NO: 5334704 - DNA, 15 bp, Homo sapiens
ttcctctgctttgaa

SEQ ID NO: 5334705 - DNA, 15 bp, Homo sapiens
ttcctctggccgcag

SEQ ID NO: 5334706 - DNA, 18 bp, Homo sapiens
ttcctctgggtttctaag

SEQ ID NO: 5334707 - DNA, 16 bp, Homo sapiens
ttcctctggtgtttat

SEQ ID NO: 5334708 - DNA, 13 bp, Homo sapiens
ttcctctgtacag

SEQ ID NO: 5334709 - DNA, 16 bp, Homo sapiens
ttcctctgtacagcaa

SEQ ID NO: 5334710 - DNA, 16 bp, Homo sapiens
ttcctctgtcctctca

SEQ ID NO: 5334711 - DNA, 19 bp, Homo sapiens
ttcctcttaatgtctcaaa

SEQ ID NO: 5334712 - DNA, 14 bp, Homo sapiens
ttccttcaggcagc

SEQ ID NO: 5334713 - DNA, 14 bp, Homo sapiens
ttccttcagggtga

SEQ ID NO: 5334714 - DNA, 22 bp, Homo sapiens
ttccttcagggtgatgccaggt

SEQ ID NO: 5334715 - DNA, 14 bp, Homo sapiens
ttccttcaggtttt

SEQ ID NO: 5334716 - DNA, 15 bp, Homo sapiens
ttccttcagtgcctt

SEQ ID NO: 5334717 - DNA, 12 bp, Homo sapiens
ttccttcagttt

SEQ ID NO: 5334718 - DNA, 14 bp, Homo sapiens
ttccttcagtttgt

SEQ ID NO: 5334719 - DNA, 18 bp, Homo sapiens
ttccttcagtttgtaaag

SEQ ID NO: 5334720 - DNA, 13 bp, Homo sapiens
ttccttcataatt

SEQ ID NO: 5334721 - DNA, 15 bp, Homo sapiens
ttccttcattcatag

SEQ ID NO: 5334722 - DNA, 13 bp, Homo sapiens
ttccttcccactc

SEQ ID NO: 5334723 - DNA, 13 bp, Homo sapiens
ttccttcccagca

SEQ ID NO: 5334724 - DNA, 14 bp, Homo sapiens
ttccttcccatgga

SEQ ID NO: 5334725 - DNA, 13 bp, Homo sapiens
ttccttccctctc

SEQ ID NO: 5334726 - DNA, 23 bp, Homo sapiens
ttccttccctctcctgcttcctc

SEQ ID NO: 5334727 - DNA, 15 bp, Homo sapiens
ttccttccctgctgt

SEQ ID NO: 5334728 - DNA, 12 bp, Homo sapiens
ttccttccctgg

SEQ ID NO: 5334729 - DNA, 14 bp, Homo sapiens
ttccttccctggct

SEQ ID NO: 5334730 - DNA, 22 bp, Homo sapiens
ttccttccctggctacttccct

SEQ ID NO: 5334731 - DNA, 16 bp, Homo sapiens
ttccttccctgtgcct

SEQ ID NO: 5334732 - DNA, 19 bp, Homo sapiens
ttccttcccttttctgttc

SEQ ID NO: 5334733 - DNA, 17 bp, Homo sapiens
ttccttccgctctgagg

SEQ ID NO: 5334734 - DNA, 12 bp, Homo sapiens
ttccttccgctt

SEQ ID NO: 5334735 - DNA, 11 bp, Homo sapiens
ttccttcctaa

SEQ ID NO: 5334736 - DNA, 12 bp, Homo sapiens
ttccttcctaga

SEQ ID NO: 5334737 - DNA, 17 bp, Homo sapiens
ttccttcctctgagcct

SEQ ID NO: 5334738 - DNA, 15 bp, Homo sapiens
ttccttcctctgtaa

SEQ ID NO: 5334739 - DNA, 15 bp, Homo sapiens
ttccttcctgcagac

SEQ ID NO: 5334740 - DNA, 16 bp, Homo sapiens
ttccttccttccctgg

SEQ ID NO: 5334741 - DNA, 15 bp, Homo sapiens
ttccttccttcctcc

SEQ ID NO: 5334742 - DNA, 17 bp, Homo sapiens
ttccttctaaacatttt

SEQ ID NO: 5334743 - DNA, 18 bp, Homo sapiens
ttccttctaacatgttat

SEQ ID NO: 5334744 - DNA, 19 bp, Homo sapiens
ttccttctacatgtaatga

SEQ ID NO: 5334745 - DNA, 14 bp, Homo sapiens
ttccttctcatctg

SEQ ID NO: 5334746 - DNA, 19 bp, Homo sapiens
ttccttctcatcttgcctc

SEQ ID NO: 5334747 - DNA, 16 bp, Homo sapiens
ttccttctcattgctg

SEQ ID NO: 5334748 - DNA, 15 bp, Homo sapiens
ttccttctcccatct

SEQ ID NO: 5334749 - DNA, 20 bp, Homo sapiens
ttccttctcccatctcttcc

SEQ ID NO: 5334750 - DNA, 21 bp, Homo sapiens
ttccttctcgtcttcctctct

SEQ ID NO: 5334751 - DNA, 22 bp, Homo sapiens
ttccttctcgtcttcctctctc

SEQ ID NO: 5334752 - DNA, 20 bp, Homo sapiens
ttccttctctactcatgcca

SEQ ID NO: 5334753 - DNA, 17 bp, Homo sapiens
ttccttctctgaacaca

SEQ ID NO: 5334754 - DNA, 15 bp, Homo sapiens
ttccttctgaaaata

SEQ ID NO: 5334755 - DNA, 13 bp, Homo sapiens
ttccttctgaagt

SEQ ID NO: 5334756 - DNA, 17 bp, Homo sapiens
ttccttctgatctgaga

SEQ ID NO: 5334757 - DNA, 22 bp, Homo sapiens
ttccttctgcccttcctccagg

SEQ ID NO: 5334758 - DNA, 17 bp, Homo sapiens
ttccttctgcctgagct

SEQ ID NO: 5334759 - DNA, 13 bp, Homo sapiens
ttccttctggagg

SEQ ID NO: 5334760 - DNA, 21 bp, Homo sapiens
ttccttctggcctctgctgaa

SEQ ID NO: 5334761 - DNA, 18 bp, Homo sapiens
ttccttctggttctaact

SEQ ID NO: 5334762 - DNA, 12 bp, Homo sapiens
ttccttctgtag

SEQ ID NO: 5334763 - DNA, 22 bp, Homo sapiens
ttccttctgtgaagaagccctg

SEQ ID NO: 5334764 - DNA, 14 bp, Homo sapiens
ttccttctgttaag

SEQ ID NO: 5334765 - DNA, 17 bp, Homo sapiens
ttccttctgttaagaaa

SEQ ID NO: 5334766 - DNA, 20 bp, Homo sapiens
ttccttctgttaagaaagga

SEQ ID NO: 5334767 - DNA, 23 bp, Homo sapiens
ttccttctgttaagaaaggatat

SEQ ID NO: 5334768 - DNA, 14 bp, Homo sapiens
ttccttcttcagca

SEQ ID NO: 5334769 - DNA, 14 bp, Homo sapiens
ttccttctttgata

SEQ ID NO: 5334770 - DNA, 19 bp, Homo sapiens
ttccttgaaaataaaaaga

SEQ ID NO: 5334771 - DNA, 13 bp, Homo sapiens
ttccttgaccagc

SEQ ID NO: 5334772 - DNA, 22 bp, Homo sapiens
ttccttgacctgcattgtaaat

SEQ ID NO: 5334773 - DNA, 20 bp, Homo sapiens
ttccttgaggggagccagga

SEQ ID NO: 5334774 - DNA, 17 bp, Homo sapiens
ttccttgcatacaaaca

SEQ ID NO: 5334775 - DNA, 12 bp, Homo sapiens
ttccttgccaca

SEQ ID NO: 5334776 - DNA, 17 bp, Homo sapiens
ttccttgccacaatcac

SEQ ID NO: 5334777 - DNA, 14 bp, Homo sapiens
ttccttgccccaca

SEQ ID NO: 5334778 - DNA, 15 bp, Homo sapiens
ttccttgccccacag

SEQ ID NO: 5334779 - DNA, 15 bp, Homo sapiens
ttccttgcctgtcag

SEQ ID NO: 5334780 - DNA, 12 bp, Homo sapiens
ttccttgcctta

SEQ ID NO: 5334781 - DNA, 14 bp, Homo sapiens
ttccttgccttaat

SEQ ID NO: 5334782 - DNA, 13 bp, Homo sapiens
ttccttgccttct

SEQ ID NO: 5334783 - DNA, 15 bp, Homo sapiens
ttccttgctatttca

SEQ ID NO: 5334784 - DNA, 16 bp, Homo sapiens
ttccttgctatttcaa

SEQ ID NO: 5334785 - DNA, 13 bp, Homo sapiens
ttccttgctcaac

SEQ ID NO: 5334786 - DNA, 13 bp, Homo sapiens
ttccttgctctcc

SEQ ID NO: 5334787 - DNA, 13 bp, Homo sapiens
ttccttgctttta

SEQ ID NO: 5334788 - DNA, 19 bp, Homo sapiens
ttccttgcttttatagttg

SEQ ID NO: 5334789 - DNA, 17 bp, Homo sapiens
ttccttggactcatttt

SEQ ID NO: 5334790 - DNA, 12 bp, Homo sapiens
ttccttggaggc

SEQ ID NO: 5334791 - DNA, 14 bp, Homo sapiens
ttccttggaggcca

SEQ ID NO: 5334792 - DNA, 18 bp, Homo sapiens
ttccttggaggccaccgg

SEQ ID NO: 5334793 - DNA, 20 bp, Homo sapiens
ttccttggaggccaccggga

SEQ ID NO: 5334794 - DNA, 17 bp, Homo sapiens
ttccttggcaattaaaa

SEQ ID NO: 5334795 - DNA, 21 bp, Homo sapiens
ttccttggcatgccttccagc

SEQ ID NO: 5334796 - DNA, 22 bp, Homo sapiens
ttccttggccaagagaagggct

SEQ ID NO: 5334797 - DNA, 16 bp, Homo sapiens
ttccttggcccagcag

SEQ ID NO: 5334798 - DNA, 15 bp, Homo sapiens
ttccttggctcccat

SEQ ID NO: 5334799 - DNA, 21 bp, Homo sapiens
ttccttggctcccattcactc

SEQ ID NO: 5334800 - DNA, 23 bp, Homo sapiens
ttccttggctcccattcactctt

SEQ ID NO: 5334801 - DNA, 13 bp, Homo sapiens
ttccttggctggt

SEQ ID NO: 5334802 - DNA, 15 bp, Homo sapiens
ttccttggctggtgc

SEQ ID NO: 5334803 - DNA, 19 bp, Homo sapiens
ttccttgggcgtctccccc

SEQ ID NO: 5334804 - DNA, 12 bp, Homo sapiens
ttccttgggggg

SEQ ID NO: 5334805 - DNA, 18 bp, Homo sapiens
ttccttgtatttaaatat

SEQ ID NO: 5334806 - DNA, 15 bp, Homo sapiens
ttccttgtcaccagc

SEQ ID NO: 5334807 - DNA, 16 bp, Homo sapiens
ttccttgtccccacac

SEQ ID NO: 5334808 - DNA, 17 bp, Homo sapiens
ttccttgtccccacact

SEQ ID NO: 5334809 - DNA, 15 bp, Homo sapiens
ttccttgtctaaaga

SEQ ID NO: 5334810 - DNA, 15 bp, Homo sapiens
ttccttgtgatccaa

SEQ ID NO: 5334811 - DNA, 19 bp, Homo sapiens
ttccttgtgttttgtcctg

SEQ ID NO: 5334812 - DNA, 20 bp, Homo sapiens
ttccttgtgttttgtcctgc

SEQ ID NO: 5334813 - DNA, 22 bp, Homo sapiens
ttccttgtgttttgtcctgcct

SEQ ID NO: 5334814 - DNA, 16 bp, Homo sapiens
ttccttgttcttccct

SEQ ID NO: 5334815 - DNA, 21 bp, Homo sapiens
ttcctttaacaacatgtttcc

SEQ ID NO: 5334816 - DNA, 16 bp, Homo sapiens
ttcctttacaactaaa

SEQ ID NO: 5334817 - DNA, 16 bp, Homo sapiens
ttcctttaccttttct

SEQ ID NO: 5334818 - DNA, 12 bp, Homo sapiens
ttcctttataat

SEQ ID NO: 5334819 - DNA, 15 bp, Homo sapiens
ttcctttataatatt

SEQ ID NO: 5334820 - DNA, 13 bp, Homo sapiens
ttcctttataatg

SEQ ID NO: 5334821 - DNA, 16 bp, Homo sapiens
ttcctttataattctt

SEQ ID NO: 5334822 - DNA, 15 bp, Homo sapiens
ttcctttatactgtg

SEQ ID NO: 5334823 - DNA, 16 bp, Homo sapiens
ttcctttatactgtga

SEQ ID NO: 5334824 - DNA, 18 bp, Homo sapiens
ttcctttatactgtgaag

SEQ ID NO: 5334825 - DNA, 16 bp, Homo sapiens
ttcctttcaataaagt

SEQ ID NO: 5334826 - DNA, 17 bp, Homo sapiens
ttcctttcaggccaagg

SEQ ID NO: 5334827 - DNA, 15 bp, Homo sapiens
ttcctttcatcctca

SEQ ID NO: 5334828 - DNA, 17 bp, Homo sapiens
ttcctttcatcctcagc

SEQ ID NO: 5334829 - DNA, 19 bp, Homo sapiens
ttcctttcatctctctacc

SEQ ID NO: 5334830 - DNA, 23 bp, Homo sapiens
ttcctttccaacgtttggaagat

SEQ ID NO: 5334831 - DNA, 14 bp, Homo sapiens
ttcctttcccaagc

SEQ ID NO: 5334832 - DNA, 16 bp, Homo sapiens
ttcctttcccagaaaa

SEQ ID NO: 5334833 - DNA, 16 bp, Homo sapiens
ttcctttccccagccc

SEQ ID NO: 5334834 - DNA, 14 bp, Homo sapiens
ttcctttccccctc

SEQ ID NO: 5334835 - DNA, 15 bp, Homo sapiens
ttcctttcccttcct

SEQ ID NO: 5334836 - DNA, 16 bp, Homo sapiens
ttcctttccttcagtc

SEQ ID NO: 5334837 - DNA, 12 bp, Homo sapiens
ttcctttctcac

SEQ ID NO: 5334838 - DNA, 13 bp, Homo sapiens
ttcctttctcacc

SEQ ID NO: 5334839 - DNA, 12 bp, Homo sapiens
ttcctttctccc

SEQ ID NO: 5334840 - DNA, 14 bp, Homo sapiens
ttcctttctcctgc

SEQ ID NO: 5334841 - DNA, 13 bp, Homo sapiens
ttcctttctctcc

SEQ ID NO: 5334842 - DNA, 18 bp, Homo sapiens
ttcctttctctcctggct

SEQ ID NO: 5334843 - DNA, 15 bp, Homo sapiens
ttcctttctctttct

SEQ ID NO: 5334844 - DNA, 17 bp, Homo sapiens
ttcctttctctttctct

SEQ ID NO: 5334845 - DNA, 11 bp, Homo sapiens
ttcctttctgg

SEQ ID NO: 5334846 - DNA, 15 bp, Homo sapiens
ttcctttcttccttc

SEQ ID NO: 5334847 - DNA, 15 bp, Homo sapiens
ttcctttgaacgtgc

SEQ ID NO: 5334848 - DNA, 19 bp, Homo sapiens
ttcctttgaacgtgcttct

SEQ ID NO: 5334849 - DNA, 23 bp, Homo sapiens
ttcctttgaacgtgcttctttgt

SEQ ID NO: 5334850 - DNA, 22 bp, Homo sapiens
ttcctttgaacttgattgccta

SEQ ID NO: 5334851 - DNA, 22 bp, Homo sapiens
ttcctttgaatcctctctctgt

SEQ ID NO: 5334852 - DNA, 18 bp, Homo sapiens
ttcctttgaccaaatagt

SEQ ID NO: 5334853 - DNA, 22 bp, Homo sapiens
ttcctttgagtgtcttctaact

SEQ ID NO: 5334854 - DNA, 11 bp, Homo sapiens
ttcctttgcat

SEQ ID NO: 5334855 - DNA, 19 bp, Homo sapiens
ttcctttgcatattataaa

SEQ ID NO: 5334856 - DNA, 14 bp, Homo sapiens
ttcctttgcattca

SEQ ID NO: 5334857 - DNA, 17 bp, Homo sapiens
ttcctttgcccttcctc

SEQ ID NO: 5334858 - DNA, 20 bp, Homo sapiens
ttcctttgcccttcctcctg

SEQ ID NO: 5334859 - DNA, 13 bp, Homo sapiens
ttcctttgctctg

SEQ ID NO: 5334860 - DNA, 16 bp, Homo sapiens
ttcctttgctctgagg

SEQ ID NO: 5334861 - DNA, 15 bp, Homo sapiens
ttcctttgctctttc

SEQ ID NO: 5334862 - DNA, 16 bp, Homo sapiens
ttcctttggaagaaaa

SEQ ID NO: 5334863 - DNA, 17 bp, Homo sapiens
ttcctttggaagaaaaa

SEQ ID NO: 5334864 - DNA, 14 bp, Homo sapiens
ttcctttggcaata

SEQ ID NO: 5334865 - DNA, 16 bp, Homo sapiens
ttcctttggtgcctca

SEQ ID NO: 5334866 - DNA, 16 bp, Homo sapiens
ttcctttgtcttcaaa

SEQ ID NO: 5334867 - DNA, 17 bp, Homo sapiens
ttcctttgtcttcaaac

SEQ ID NO: 5334868 - DNA, 13 bp, Homo sapiens
ttcctttgttccc

SEQ ID NO: 5334869 - DNA, 18 bp, Homo sapiens
ttcctttgttccctaagt

SEQ ID NO: 5334870 - DNA, 21 bp, Homo sapiens
ttcctttgtttttttttcctg

SEQ ID NO: 5334871 - DNA, 21 bp, Homo sapiens
ttccttttaaaacacttccat

SEQ ID NO: 5334872 - DNA, 17 bp, Homo sapiens
ttccttttaagaaagct

SEQ ID NO: 5334873 - DNA, 21 bp, Homo sapiens
ttccttttaagtaaggtccaa

SEQ ID NO: 5334874 - DNA, 12 bp, Homo sapiens
ttccttttaatt

SEQ ID NO: 5334875 - DNA, 20 bp, Homo sapiens
ttccttttagcctagttcat

SEQ ID NO: 5334876 - DNA, 12 bp, Homo sapiens
ttccttttatca

SEQ ID NO: 5334877 - DNA, 14 bp, Homo sapiens
ttccttttcatctg

SEQ ID NO: 5334878 - DNA, 14 bp, Homo sapiens
ttccttttccctgc

SEQ ID NO: 5334879 - DNA, 17 bp, Homo sapiens
ttccttttctctgcttg

SEQ ID NO: 5334880 - DNA, 14 bp, Homo sapiens
ttccttttcttcct

SEQ ID NO: 5334881 - DNA, 18 bp, Homo sapiens
ttccttttcttccttctt

SEQ ID NO: 5334882 - DNA, 20 bp, Homo sapiens
ttccttttcttgtctctgag

SEQ ID NO: 5334883 - DNA, 23 bp, Homo sapiens
ttccttttctttctccctaacca

SEQ ID NO: 5334884 - DNA, 23 bp, Homo sapiens
ttccttttgaaagaatcagtctt

SEQ ID NO: 5334885 - DNA, 17 bp, Homo sapiens
ttccttttgaagctcaa

SEQ ID NO: 5334886 - DNA, 14 bp, Homo sapiens
ttccttttggaaca

SEQ ID NO: 5334887 - DNA, 16 bp, Homo sapiens
ttccttttggaacatt

SEQ ID NO: 5334888 - DNA, 17 bp, Homo sapiens
ttccttttggcctcctg

SEQ ID NO: 5334889 - DNA, 14 bp, Homo sapiens
ttccttttgtaaaa

SEQ ID NO: 5334890 - DNA, 18 bp, Homo sapiens
ttccttttgtaaagtaaa

SEQ ID NO: 5334891 - DNA, 21 bp, Homo sapiens
ttccttttgtaaagtaaaata

SEQ ID NO: 5334892 - DNA, 16 bp, Homo sapiens
ttcctttttaaatgtg

SEQ ID NO: 5334893 - DNA, 17 bp, Homo sapiens
ttcctttttaaatgtga

SEQ ID NO: 5334894 - DNA, 18 bp, Homo sapiens
ttctaagtttctaagatt

SEQ ID NO: 5334895 - DNA, 20 bp, Homo sapiens
ttctaagtttctaagattct

SEQ ID NO: 5334896 - DNA, 17 bp, Homo sapiens
ttctaataaagccattt

SEQ ID NO: 5334897 - DNA, 21 bp, Homo sapiens
ttctaataaagccatttctta

SEQ ID NO: 5334898 - DNA, 16 bp, Homo sapiens
ttctaataaatatact

SEQ ID NO: 5334899 - DNA, 13 bp, Homo sapiens
ttctaataaatta

SEQ ID NO: 5334900 - DNA, 14 bp, Homo sapiens
ttctaataactgct

SEQ ID NO: 5334901 - DNA, 20 bp, Homo sapiens
ttctaataagctagttgaat

SEQ ID NO: 5334902 - DNA, 19 bp, Homo sapiens
ttctaataatttctaatgt

SEQ ID NO: 5334903 - DNA, 16 bp, Homo sapiens
ttctaatactttgttt

SEQ ID NO: 5334904 - DNA, 12 bp, Homo sapiens
ttctaatagaac

SEQ ID NO: 5334905 - DNA, 18 bp, Homo sapiens
ttctaatagaactcagtt

SEQ ID NO: 5334906 - DNA, 13 bp, Homo sapiens
ttctaatataatg

SEQ ID NO: 5334907 - DNA, 22 bp, Homo sapiens
ttctaatatatttttatattta

SEQ ID NO: 5334908 - DNA, 16 bp, Homo sapiens
ttctaatattcacatg

SEQ ID NO: 5334909 - DNA, 13 bp, Homo sapiens
ttctaatcaaaag

SEQ ID NO: 5334910 - DNA, 15 bp, Homo sapiens
ttctaatcacagtgt

SEQ ID NO: 5334911 - DNA, 19 bp, Homo sapiens
ttctaatcacagtgttgca

SEQ ID NO: 5334912 - DNA, 19 bp, Homo sapiens
ttctaatccttttccttat

SEQ ID NO: 5334913 - DNA, 14 bp, Homo sapiens
ttctaatctcttta

SEQ ID NO: 5334914 - DNA, 21 bp, Homo sapiens
ttctaatctctttattaaaac

SEQ ID NO: 5334915 - DNA, 15 bp, Homo sapiens
ttctaatctgctatg

SEQ ID NO: 5334916 - DNA, 12 bp, Homo sapiens
ttctaatcttaa

SEQ ID NO: 5334917 - DNA, 23 bp, Homo sapiens
ttctaatcttaaatcagaataaa

SEQ ID NO: 5334918 - DNA, 21 bp, Homo sapiens
ttctaatgaggagagaaaata

SEQ ID NO: 5334919 - DNA, 23 bp, Homo sapiens
ttctaatgaggagagaaaatata

SEQ ID NO: 5334920 - DNA, 16 bp, Homo sapiens
ttctaatgatggccca

SEQ ID NO: 5334921 - DNA, 23 bp, Homo sapiens
ttctaatgatggcccattctact

SEQ ID NO: 5334922 - DNA, 22 bp, Homo sapiens
ttctaatgattatagataaata

SEQ ID NO: 5334923 - DNA, 18 bp, Homo sapiens
ttctaatgccttttgaat

SEQ ID NO: 5334924 - DNA, 17 bp, Homo sapiens
ttctaatggaatggttt

SEQ ID NO: 5334925 - DNA, 12 bp, Homo sapiens
ttctaatggtaa

SEQ ID NO: 5334926 - DNA, 16 bp, Homo sapiens
ttctaatggtaacttt

SEQ ID NO: 5334927 - DNA, 19 bp, Homo sapiens
ttctaatggtaacttttgt

SEQ ID NO: 5334928 - DNA, 18 bp, Homo sapiens
ttctaatgtaaattttaa

SEQ ID NO: 5334929 - DNA, 19 bp, Homo sapiens
ttctaatgttctaaattct

SEQ ID NO: 5334930 - DNA, 18 bp, Homo sapiens
ttctaatgtttactatat

SEQ ID NO: 5334931 - DNA, 13 bp, Homo sapiens
ttctaatgtttct

SEQ ID NO: 5334932 - DNA, 17 bp, Homo sapiens
ttctaattaaaattgtg

SEQ ID NO: 5334933 - DNA, 23 bp, Homo sapiens
ttctaattaaaattgtgcataat

SEQ ID NO: 5334934 - DNA, 22 bp, Homo sapiens
ttctaattaaccttactaatta

SEQ ID NO: 5334935 - DNA, 20 bp, Homo sapiens
ttctaattaataaattattt

SEQ ID NO: 5334936 - DNA, 13 bp, Homo sapiens
ttctaattaatag

SEQ ID NO: 5334937 - DNA, 13 bp, Homo sapiens
ttctaattcttca

SEQ ID NO: 5334938 - DNA, 18 bp, Homo sapiens
ttctaattcttcattata

SEQ ID NO: 5334939 - DNA, 14 bp, Homo sapiens
ttctaattgccatg

SEQ ID NO: 5334940 - DNA, 14 bp, Homo sapiens
ttctaattgcttat

SEQ ID NO: 5334941 - DNA, 18 bp, Homo sapiens
ttctaattggcagattgt

SEQ ID NO: 5334942 - DNA, 20 bp, Homo sapiens
ttctaattggctttactatt

SEQ ID NO: 5334943 - DNA, 23 bp, Homo sapiens
ttctaattgtaagtgaaattaag

SEQ ID NO: 5334944 - DNA, 15 bp, Homo sapiens
ttctaatttgaatga

SEQ ID NO: 5334945 - DNA, 16 bp, Homo sapiens
ttctaatttgaatgaa

SEQ ID NO: 5334946 - DNA, 22 bp, Homo sapiens
ttctaatttgctgctgataatg

SEQ ID NO: 5334947 - DNA, 16 bp, Homo sapiens
ttctaattttgtgctc

SEQ ID NO: 5334948 - DNA, 17 bp, Homo sapiens
ttctaattttgtgctct

SEQ ID NO: 5334949 - DNA, 15 bp, Homo sapiens
ttctacaaaagaagt

SEQ ID NO: 5334950 - DNA, 13 bp, Homo sapiens
ttctacaaccaga

SEQ ID NO: 5334951 - DNA, 14 bp, Homo sapiens
ttctacaaccagag

SEQ ID NO: 5334952 - DNA, 20 bp, Homo sapiens
ttctacaactgattgcaaca

SEQ ID NO: 5334953 - DNA, 12 bp, Homo sapiens
ttctacaattaa

SEQ ID NO: 5334954 - DNA, 17 bp, Homo sapiens
ttctacaattaatagtt

SEQ ID NO: 5334955 - DNA, 15 bp, Homo sapiens
ttctacacagagcag

SEQ ID NO: 5334956 - DNA, 22 bp, Homo sapiens
ttctacacagtgggaactctga

SEQ ID NO: 5334957 - DNA, 18 bp, Homo sapiens
ttctacacatatatgtat

SEQ ID NO: 5334958 - DNA, 19 bp, Homo sapiens
ttctacacatatatgtata

SEQ ID NO: 5334959 - DNA, 18 bp, Homo sapiens
ttctacacattgctacct

SEQ ID NO: 5334960 - DNA, 22 bp, Homo sapiens
ttctacacatttcatctaattt

SEQ ID NO: 5334961 - DNA, 14 bp, Homo sapiens
ttctacacctggac

SEQ ID NO: 5334962 - DNA, 21 bp, Homo sapiens
ttctacactttatacttgcct

SEQ ID NO: 5334963 - DNA, 15 bp, Homo sapiens
ttctacagaacctga

SEQ ID NO: 5334964 - DNA, 17 bp, Homo sapiens
ttctacagaacctgagg

SEQ ID NO: 5334965 - DNA, 14 bp, Homo sapiens
ttctacagaataat

SEQ ID NO: 5334966 - DNA, 21 bp, Homo sapiens
ttctacagagaaaatgaattt

SEQ ID NO: 5334967 - DNA, 22 bp, Homo sapiens
ttctacagagaaaatgaatttg

SEQ ID NO: 5334968 - DNA, 15 bp, Homo sapiens
ttctacagcaaattt

SEQ ID NO: 5334969 - DNA, 20 bp, Homo sapiens
ttctacagcaaatttataat

SEQ ID NO: 5334970 - DNA, 13 bp, Homo sapiens
ttctacagcctaa

SEQ ID NO: 5334971 - DNA, 14 bp, Homo sapiens
ttctacagttaatt

SEQ ID NO: 5334972 - DNA, 22 bp, Homo sapiens
ttctacataagtaattcaagaa

SEQ ID NO: 5334973 - DNA, 15 bp, Homo sapiens
ttctacataattgtg

SEQ ID NO: 5334974 - DNA, 15 bp, Homo sapiens
ttctacatagatgct

SEQ ID NO: 5334975 - DNA, 19 bp, Homo sapiens
ttctacatgtaatgacact

SEQ ID NO: 5334976 - DNA, 23 bp, Homo sapiens
ttctacatgtgagatagttttca

SEQ ID NO: 5334977 - DNA, 16 bp, Homo sapiens
ttctacatttcttaga

SEQ ID NO: 5334978 - DNA, 18 bp, Homo sapiens
ttctaccaactggaagca

SEQ ID NO: 5334979 - DNA, 15 bp, Homo sapiens
ttctaccaagctgtc

SEQ ID NO: 5334980 - DNA, 18 bp, Homo sapiens
ttctaccacacacagcct

SEQ ID NO: 5334981 - DNA, 21 bp, Homo sapiens
ttctaccacacagcagcagtt

SEQ ID NO: 5334982 - DNA, 20 bp, Homo sapiens
ttctaccaccgcatcctcac

SEQ ID NO: 5334983 - DNA, 17 bp, Homo sapiens
ttctaccaggcaaattc

SEQ ID NO: 5334984 - DNA, 22 bp, Homo sapiens
ttctaccatgaacagaaaacat

SEQ ID NO: 5334985 - DNA, 19 bp, Homo sapiens
ttctacccagcgagccctg

SEQ ID NO: 5334986 - DNA, 16 bp, Homo sapiens
ttctacccgttccaaa

SEQ ID NO: 5334987 - DNA, 17 bp, Homo sapiens
ttctacccgttccaaaa

SEQ ID NO: 5334988 - DNA, 20 bp, Homo sapiens
ttctaccctagccattcctg

SEQ ID NO: 5334989 - DNA, 18 bp, Homo sapiens
ttctaccggagagagaat

SEQ ID NO: 5334990 - DNA, 23 bp, Homo sapiens
ttctacctataacactctaggat

SEQ ID NO: 5334991 - DNA, 17 bp, Homo sapiens
ttctacctcagcagcag

SEQ ID NO: 5334992 - DNA, 12 bp, Homo sapiens
ttctacctccca

SEQ ID NO: 5334993 - DNA, 23 bp, Homo sapiens
ttctacctgtacacattcctgca

SEQ ID NO: 5334994 - DNA, 18 bp, Homo sapiens
ttctaccttgaggtcttt

SEQ ID NO: 5334995 - DNA, 15 bp, Homo sapiens
ttctacctttgtaaa

SEQ ID NO: 5334996 - DNA, 17 bp, Homo sapiens
ttctacctttgtaaaac

SEQ ID NO: 5334997 - DNA, 15 bp, Homo sapiens
ttctacgtcatgtat

SEQ ID NO: 5334998 - DNA, 19 bp, Homo sapiens
ttctacgtcatgtatttta

SEQ ID NO: 5334999 - DNA, 20 bp, Homo sapiens
ttctactaaaaatacaaaaa

SEQ ID NO: 5335000 - DNA, 15 bp, Homo sapiens
ttctactatatacat

SEQ ID NO: 5335001 - DNA, 16 bp, Homo sapiens
ttctactcctgcctca

SEQ ID NO: 5335002 - DNA, 16 bp, Homo sapiens
ttctactctagatggc

SEQ ID NO: 5335003 - DNA, 22 bp, Homo sapiens
ttctactctagatggcaacatt

SEQ ID NO: 5335004 - DNA, 14 bp, Homo sapiens
ttctactctcccat

SEQ ID NO: 5335005 - DNA, 16 bp, Homo sapiens
ttctactgccttgaaa

SEQ ID NO: 5335006 - DNA, 19 bp, Homo sapiens
ttctactgccttgaaaaat

SEQ ID NO: 5335007 - DNA, 12 bp, Homo sapiens
ttctactggaaa

SEQ ID NO: 5335008 - DNA, 18 bp, Homo sapiens
ttctactggaaaaaaata

SEQ ID NO: 5335009 - DNA, 17 bp, Homo sapiens
ttctactggcctgtaat

SEQ ID NO: 5335010 - DNA, 18 bp, Homo sapiens
ttctactgtactttttta

SEQ ID NO: 5335011 - DNA, 17 bp, Homo sapiens
ttctactgtcaaatgat

SEQ ID NO: 5335012 - DNA, 19 bp, Homo sapiens
ttctactgtcaaatgatgt

SEQ ID NO: 5335013 - DNA, 23 bp, Homo sapiens
ttctactgttatgtgagaacatt

SEQ ID NO: 5335014 - DNA, 18 bp, Homo sapiens
ttctactgttcaatttca

SEQ ID NO: 5335015 - DNA, 14 bp, Homo sapiens
ttctacttcccctg

SEQ ID NO: 5335016 - DNA, 19 bp, Homo sapiens
ttctacttcccctgggatg

SEQ ID NO: 5335017 - DNA, 14 bp, Homo sapiens
ttctacttcctgta

SEQ ID NO: 5335018 - DNA, 19 bp, Homo sapiens
ttctacttgcactagcatg

SEQ ID NO: 5335019 - DNA, 14 bp, Homo sapiens
ttctacttgctctg

SEQ ID NO: 5335020 - DNA, 23 bp, Homo sapiens
ttctacttgctctggacctgccc

SEQ ID NO: 5335021 - DNA, 13 bp, Homo sapiens
ttctacttgtaaa

SEQ ID NO: 5335022 - DNA, 14 bp, Homo sapiens
ttctactttgaaat

SEQ ID NO: 5335023 - DNA, 21 bp, Homo sapiens
ttctactttgaaatatttaat

SEQ ID NO: 5335024 - DNA, 19 bp, Homo sapiens
ttctactttgatatgactg

SEQ ID NO: 5335025 - DNA, 16 bp, Homo sapiens
ttctacttttaaataa

SEQ ID NO: 5335026 - DNA, 18 bp, Homo sapiens
ttctactttttccttcct

SEQ ID NO: 5335027 - DNA, 22 bp, Homo sapiens
ttctactttttccttcctgccc

SEQ ID NO: 5335028 - DNA, 23 bp, Homo sapiens
ttctactttttccttcctgccct

SEQ ID NO: 5335029 - DNA, 17 bp, Homo sapiens
ttctagaaactctggct

SEQ ID NO: 5335030 - DNA, 19 bp, Homo sapiens
ttctagaaactctggctca

SEQ ID NO: 5335031 - DNA, 22 bp, Homo sapiens
ttctagaaagagaaacagttgg

SEQ ID NO: 5335032 - DNA, 19 bp, Homo sapiens
ttctagaaagtactttggc

SEQ ID NO: 5335033 - DNA, 21 bp, Homo sapiens
ttctagaacacctgccttcta

SEQ ID NO: 5335034 - DNA, 13 bp, Homo sapiens
ttctagaaccact

SEQ ID NO: 5335035 - DNA, 14 bp, Homo sapiens
ttctagaaccactt

SEQ ID NO: 5335036 - DNA, 16 bp, Homo sapiens
ttctagaacctgggct

SEQ ID NO: 5335037 - DNA, 22 bp, Homo sapiens
ttctagaagataacattttcaa

SEQ ID NO: 5335038 - DNA, 23 bp, Homo sapiens
ttctagaagataacattttcaat

SEQ ID NO: 5335039 - DNA, 21 bp, Homo sapiens
ttctagaagtttcccttcctc

SEQ ID NO: 5335040 - DNA, 12 bp, Homo sapiens
ttctagacagag

SEQ ID NO: 5335041 - DNA, 14 bp, Homo sapiens
ttctagacataact

SEQ ID NO: 5335042 - DNA, 20 bp, Homo sapiens
ttctagaccctatacatttt

SEQ ID NO: 5335043 - DNA, 17 bp, Homo sapiens
ttctagacgcccctccc

SEQ ID NO: 5335044 - DNA, 18 bp, Homo sapiens
ttctagacgcccctccca

SEQ ID NO: 5335045 - DNA, 21 bp, Homo sapiens
ttctagacgcccctcccaagc

SEQ ID NO: 5335046 - DNA, 16 bp, Homo sapiens
ttctagactgtgaaga

SEQ ID NO: 5335047 - DNA, 22 bp, Homo sapiens
ttctagacttcagaacatgctg

SEQ ID NO: 5335048 - DNA, 20 bp, Homo sapiens
ttctagacttccccatcccg

SEQ ID NO: 5335049 - DNA, 11 bp, Homo sapiens
ttctagagaca

SEQ ID NO: 5335050 - DNA, 15 bp, Homo sapiens
ttctagagacacatt

SEQ ID NO: 5335051 - DNA, 15 bp, Homo sapiens
ttctagaggctcatg

SEQ ID NO: 5335052 - DNA, 18 bp, Homo sapiens
ttctagaggctcatggcc

SEQ ID NO: 5335053 - DNA, 22 bp, Homo sapiens
ttctagagttttatagcctgga

SEQ ID NO: 5335054 - DNA, 16 bp, Homo sapiens
ttctagatacaataaa

SEQ ID NO: 5335055 - DNA, 18 bp, Homo sapiens
ttctagatacaataaatt

SEQ ID NO: 5335056 - DNA, 19 bp, Homo sapiens
ttctagatcactgtgctta

SEQ ID NO: 5335057 - DNA, 16 bp, Homo sapiens
ttctagatcagagagc

SEQ ID NO: 5335058 - DNA, 23 bp, Homo sapiens
ttctagatcagatgctccaagat

SEQ ID NO: 5335059 - DNA, 16 bp, Homo sapiens
ttctagatcctgcacc

SEQ ID NO: 5335060 - DNA, 21 bp, Homo sapiens
ttctagatcctgcaccccagc

SEQ ID NO: 5335061 - DNA, 22 bp, Homo sapiens
ttctagatcctgcaccccagca

SEQ ID NO: 5335062 - DNA, 14 bp, Homo sapiens
ttctagatgacata

SEQ ID NO: 5335063 - DNA, 12 bp, Homo sapiens
ttctagatgatt

SEQ ID NO: 5335064 - DNA, 22 bp, Homo sapiens
ttctagatgattaaataagatt

SEQ ID NO: 5335065 - DNA, 14 bp, Homo sapiens
ttctagattacttt

SEQ ID NO: 5335066 - DNA, 15 bp, Homo sapiens
ttctagattatgtct

SEQ ID NO: 5335067 - DNA, 14 bp, Homo sapiens
ttctagcactggcc

SEQ ID NO: 5335068 - DNA, 15 bp, Homo sapiens
ttctagcactggcct

SEQ ID NO: 5335069 - DNA, 16 bp, Homo sapiens
ttctagcactggcctg

SEQ ID NO: 5335070 - DNA, 14 bp, Homo sapiens
ttctagcagagtga

SEQ ID NO: 5335071 - DNA, 20 bp, Homo sapiens
ttctcatcatattgtatgta

SEQ ID NO: 5335072 - DNA, 15 bp, Homo sapiens
ttctcatcctgcagg

SEQ ID NO: 5335073 - DNA, 14 bp, Homo sapiens
ttctcatctcccca

SEQ ID NO: 5335074 - DNA, 20 bp, Homo sapiens
ttctcatctgcacccttctt

SEQ ID NO: 5335075 - DNA, 18 bp, Homo sapiens
ttctcatcttaaaaatat

SEQ ID NO: 5335076 - DNA, 16 bp, Homo sapiens
ttctcatcttgtaaat

SEQ ID NO: 5335077 - DNA, 13 bp, Homo sapiens
ttctcatgaagca

SEQ ID NO: 5335078 - DNA, 17 bp, Homo sapiens
ttctcatgaagctaata

SEQ ID NO: 5335079 - DNA, 22 bp, Homo sapiens
ttctcatgacggcttttgtcag

SEQ ID NO: 5335080 - DNA, 14 bp, Homo sapiens
ttctcatgactcct

SEQ ID NO: 5335081 - DNA, 18 bp, Homo sapiens
ttctcatgagctgtgttc

SEQ ID NO: 5335082 - DNA, 23 bp, Homo sapiens
ttctcatgataccacctttactg

SEQ ID NO: 5335083 - DNA, 13 bp, Homo sapiens
ttctcatgcttct

SEQ ID NO: 5335084 - DNA, 14 bp, Homo sapiens
ttctcatgtatctt

SEQ ID NO: 5335085 - DNA, 14 bp, Homo sapiens
ttctcatgtctcag

SEQ ID NO: 5335086 - DNA, 17 bp, Homo sapiens
ttctcatgtgatccttt

SEQ ID NO: 5335087 - DNA, 18 bp, Homo sapiens
ttctcatgtgctttgtag

SEQ ID NO: 5335088 - DNA, 22 bp, Homo sapiens
ttctcatgtgctttgtagctta

SEQ ID NO: 5335089 - DNA, 20 bp, Homo sapiens
ttctcatgttccttttgaaa

SEQ ID NO: 5335090 - DNA, 22 bp, Homo sapiens
ttctcatgttgaagctttaaga

SEQ ID NO: 5335091 - DNA, 18 bp, Homo sapiens
ttctcattaaaatccagt

SEQ ID NO: 5335092 - DNA, 22 bp, Homo sapiens
ttctcattaaaatccagtatta

SEQ ID NO: 5335093 - DNA, 21 bp, Homo sapiens
ttctcattacttgttgcctat

SEQ ID NO: 5335094 - DNA, 20 bp, Homo sapiens
ttctcattagagatctgaaa

SEQ ID NO: 5335095 - DNA, 13 bp, Homo sapiens
ttctcattatgaa

SEQ ID NO: 5335096 - DNA, 19 bp, Homo sapiens
ttctcattcccatgtggaa

SEQ ID NO: 5335097 - DNA, 12 bp, Homo sapiens
ttctcattcctg

SEQ ID NO: 5335098 - DNA, 13 bp, Homo sapiens
ttctcattgctct

SEQ ID NO: 5335099 - DNA, 15 bp, Homo sapiens
ttctcattgctgccc

SEQ ID NO: 5335100 - DNA, 21 bp, Homo sapiens
ttctcattggaaatttagcat

SEQ ID NO: 5335101 - DNA, 14 bp, Homo sapiens
ttctcattgtttgt

SEQ ID NO: 5335102 - DNA, 11 bp, Homo sapiens
ttctcatttag

SEQ ID NO: 5335103 - DNA, 13 bp, Homo sapiens
ttctcatttatgt

SEQ ID NO: 5335104 - DNA, 15 bp, Homo sapiens
ttctcatttgaaatg

SEQ ID NO: 5335105 - DNA, 19 bp, Homo sapiens
ttctcatttgtttttctca

SEQ ID NO: 5335106 - DNA, 15 bp, Homo sapiens
ttctcattttaaaca

SEQ ID NO: 5335107 - DNA, 20 bp, Homo sapiens
ttctcattttcaatgcacat

SEQ ID NO: 5335108 - DNA, 22 bp, Homo sapiens
ttctcattttttaaaaaagctt

SEQ ID NO: 5335109 - DNA, 13 bp, Homo sapiens
ttctccaaataaa

SEQ ID NO: 5335110 - DNA, 22 bp, Homo sapiens
ttctccaaataaaaattagatg

SEQ ID NO: 5335111 - DNA, 14 bp, Homo sapiens
ttctccaaatgatt

SEQ ID NO: 5335112 - DNA, 23 bp, Homo sapiens
ttctccaaatgattttcatcaat

SEQ ID NO: 5335113 - DNA, 14 bp, Homo sapiens
ttctccaaccccgg

SEQ ID NO: 5335114 - DNA, 16 bp, Homo sapiens
ttctccaagcaggaca

SEQ ID NO: 5335115 - DNA, 15 bp, Homo sapiens
ttctccaaggaaacc

SEQ ID NO: 5335116 - DNA, 12 bp, Homo sapiens
ttctccaagtgg

SEQ ID NO: 5335117 - DNA, 20 bp, Homo sapiens
ttctccaatgctctggagtg

SEQ ID NO: 5335118 - DNA, 19 bp, Homo sapiens
ttctccacaacagcctggg

SEQ ID NO: 5335119 - DNA, 12 bp, Homo sapiens
ttctccacactc

SEQ ID NO: 5335120 - DNA, 15 bp, Homo sapiens
ttctccacactccac

SEQ ID NO: 5335121 - DNA, 16 bp, Homo sapiens
ttctccacccaccagt

SEQ ID NO: 5335122 - DNA, 14 bp, Homo sapiens
ttctccaccccagc

SEQ ID NO: 5335123 - DNA, 21 bp, Homo sapiens
ttctccacctcccacaaagga

SEQ ID NO: 5335124 - DNA, 15 bp, Homo sapiens
ttctccacctgccag

SEQ ID NO: 5335125 - DNA, 18 bp, Homo sapiens
ttctccacctgccaggga

SEQ ID NO: 5335126 - DNA, 14 bp, Homo sapiens
ttctccactcagtt

SEQ ID NO: 5335127 - DNA, 14 bp, Homo sapiens
ttctccactgtgca

SEQ ID NO: 5335128 - DNA, 18 bp, Homo sapiens
ttctccactgtgcacacc

SEQ ID NO: 5335129 - DNA, 20 bp, Homo sapiens
ttctccacttcatttttaag

SEQ ID NO: 5335130 - DNA, 15 bp, Homo sapiens
ttctccagaaattta

SEQ ID NO: 5335131 - DNA, 14 bp, Homo sapiens
ttctccagaatgta

SEQ ID NO: 5335132 - DNA, 13 bp, Homo sapiens
ttctccagaccca

SEQ ID NO: 5335133 - DNA, 19 bp, Homo sapiens
ttctccagacccaccacac

SEQ ID NO: 5335134 - DNA, 18 bp, Homo sapiens
ttctccagacccagaggc

SEQ ID NO: 5335135 - DNA, 21 bp, Homo sapiens
ttctccagccaccaaggctgc

SEQ ID NO: 5335136 - DNA, 15 bp, Homo sapiens
ttctccagcccacac

SEQ ID NO: 5335137 - DNA, 21 bp, Homo sapiens
ttctccagcccacacccctcc

SEQ ID NO: 5335138 - DNA, 20 bp, Homo sapiens
ttctccagcccatgctggct

SEQ ID NO: 5335139 - DNA, 23 bp, Homo sapiens
ttctccagcctggacccccagct

SEQ ID NO: 5335140 - DNA, 17 bp, Homo sapiens
ttctccagcttcagctc

SEQ ID NO: 5335141 - DNA, 19 bp, Homo sapiens
ttctccaggattccaaagt

SEQ ID NO: 5335142 - DNA, 20 bp, Homo sapiens
ttctccagggaattcttaca

SEQ ID NO: 5335143 - DNA, 20 bp, Homo sapiens
ttctccaggtctcacgggca

SEQ ID NO: 5335144 - DNA, 15 bp, Homo sapiens
ttctccagttagaat

SEQ ID NO: 5335145 - DNA, 20 bp, Homo sapiens
ttctccagtttcagaagcag

SEQ ID NO: 5335146 - DNA, 20 bp, Homo sapiens
ttctccataagtggagaaat

SEQ ID NO: 5335147 - DNA, 20 bp, Homo sapiens
ttctccatcccctccctgcc

SEQ ID NO: 5335148 - DNA, 12 bp, Homo sapiens
ttctccatcttt

SEQ ID NO: 5335149 - DNA, 14 bp, Homo sapiens
ttctccatgctgca

SEQ ID NO: 5335150 - DNA, 14 bp, Homo sapiens
ttctccatggagcc

SEQ ID NO: 5335151 - DNA, 18 bp, Homo sapiens
ttctccatggccctgcca

SEQ ID NO: 5335152 - DNA, 13 bp, Homo sapiens
ttctccattacac

SEQ ID NO: 5335153 - DNA, 20 bp, Homo sapiens
ttctccattccctagcagga

SEQ ID NO: 5335154 - DNA, 17 bp, Homo sapiens
ttctccatttaagacac

SEQ ID NO: 5335155 - DNA, 13 bp, Homo sapiens
ttctcccaaagat

SEQ ID NO: 5335156 - DNA, 14 bp, Homo sapiens
ttctcccaaagatt

SEQ ID NO: 5335157 - DNA, 18 bp, Homo sapiens
ttctcccaactcagcctg

SEQ ID NO: 5335158 - DNA, 23 bp, Homo sapiens
ttctcccaactcagcctgttcct

SEQ ID NO: 5335159 - DNA, 15 bp, Homo sapiens
ttctcccaagaaacc

SEQ ID NO: 5335160 - DNA, 16 bp, Homo sapiens
ttctcccaagctgatt

SEQ ID NO: 5335161 - DNA, 23 bp, Homo sapiens
ttctcccaattcatcctcactca

SEQ ID NO: 5335162 - DNA, 10 bp, Homo sapiens
ttctcccacc

SEQ ID NO: 5335163 - DNA, 11 bp, Homo sapiens
ttctcccactc

SEQ ID NO: 5335164 - DNA, 12 bp, Homo sapiens
ttctcccagcac

SEQ ID NO: 5335165 - DNA, 19 bp, Homo sapiens
ttctcccagcactgcctcc

SEQ ID NO: 5335166 - DNA, 21 bp, Homo sapiens
ttctcccagcctcttatcact

SEQ ID NO: 5335167 - DNA, 11 bp, Homo sapiens
ttctcccagcg

SEQ ID NO: 5335168 - DNA, 10 bp, Homo sapiens
ttctcccagg

SEQ ID NO: 5335169 - DNA, 15 bp, Homo sapiens
ttctcccaggaagct

SEQ ID NO: 5335170 - DNA, 12 bp, Homo sapiens
ttctcccaggcc

SEQ ID NO: 5335171 - DNA, 19 bp, Homo sapiens
ttctcccaggtaccagctg

SEQ ID NO: 5335172 - DNA, 23 bp, Homo sapiens
ttctcccagtatgttttaacaaa

SEQ ID NO: 5335173 - DNA, 22 bp, Homo sapiens
ttctccccaatgagacttgcct

SEQ ID NO: 5335174 - DNA, 19 bp, Homo sapiens
ttctccccagagctgcctg

SEQ ID NO: 5335175 - DNA, 15 bp, Homo sapiens
ttctccccagctccc

SEQ ID NO: 5335176 - DNA, 17 bp, Homo sapiens
ttctcccccccggggct

SEQ ID NO: 5335177 - DNA, 23 bp, Homo sapiens
ttctcccccccggggctgggttg

SEQ ID NO: 5335178 - DNA, 21 bp, Homo sapiens
ttctcccccgacactgctgca

SEQ ID NO: 5335179 - DNA, 16 bp, Homo sapiens
ttctcccccgccctgc

SEQ ID NO: 5335180 - DNA, 15 bp, Homo sapiens
ttctccccctcagct

SEQ ID NO: 5335181 - DNA, 16 bp, Homo sapiens
ttctccccctcagctc

SEQ ID NO: 5335182 - DNA, 19 bp, Homo sapiens
ttctcccccttgtcttccc

SEQ ID NO: 5335183 - DNA, 23 bp, Homo sapiens
ttctccccgcagcccgcctgccg

SEQ ID NO: 5335184 - DNA, 13 bp, Homo sapiens
ttctcccctccct

SEQ ID NO: 5335185 - DNA, 17 bp, Homo sapiens
ttctcccctctctttct

SEQ ID NO: 5335186 - DNA, 15 bp, Homo sapiens
ttctcccctcttctg

SEQ ID NO: 5335187 - DNA, 16 bp, Homo sapiens
ttctcccctcttctga

SEQ ID NO: 5335188 - DNA, 15 bp, Homo sapiens
ttctcccctgcactg

SEQ ID NO: 5335189 - DNA, 16 bp, Homo sapiens
ttctcccctgcactgt

SEQ ID NO: 5335190 - DNA, 20 bp, Homo sapiens
ttctcccctgcactgtaaaa

SEQ ID NO: 5335191 - DNA, 21 bp, Homo sapiens
ttctcccctgcactgtaaaat

SEQ ID NO: 5335192 - DNA, 15 bp, Homo sapiens
ttctcccctgccccc

SEQ ID NO: 5335193 - DNA, 16 bp, Homo sapiens
ttctcccctgccccca

SEQ ID NO: 5335194 - DNA, 17 bp, Homo sapiens
ttctcccctgcccccag

SEQ ID NO: 5335195 - DNA, 18 bp, Homo sapiens
ttctcccctgcccccagg

SEQ ID NO: 5335196 - DNA, 21 bp, Homo sapiens
ttctcccctgcccccaggact

SEQ ID NO: 5335197 - DNA, 14 bp, Homo sapiens
ttctcccctgccct

SEQ ID NO: 5335198 - DNA, 23 bp, Homo sapiens
ttctcccctgcccttcctcctga

SEQ ID NO: 5335199 - DNA, 16 bp, Homo sapiens
ttctcccctgccggtg

SEQ ID NO: 5335200 - DNA, 18 bp, Homo sapiens
ttctccccttccatttct

SEQ ID NO: 5335201 - DNA, 22 bp, Homo sapiens
ttctccccttccatttctgcct

SEQ ID NO: 5335202 - DNA, 19 bp, Homo sapiens
ttctccccttcctggacac

SEQ ID NO: 5335203 - DNA, 22 bp, Homo sapiens
ttctccccttcctggacacact

SEQ ID NO: 5335204 - DNA, 16 bp, Homo sapiens
ttctcccgccattggc

SEQ ID NO: 5335205 - DNA, 18 bp, Homo sapiens
ttctcccgccattggcct

SEQ ID NO: 5335206 - DNA, 16 bp, Homo sapiens
ttctcccgcctcagcc

SEQ ID NO: 5335207 - DNA, 21 bp, Homo sapiens
ttctcccgcttcctggcctcc

SEQ ID NO: 5335208 - DNA, 17 bp, Homo sapiens
ttctcccgggactctgc

SEQ ID NO: 5335209 - DNA, 12 bp, Homo sapiens
ttctccctagcc

SEQ ID NO: 5335210 - DNA, 12 bp, Homo sapiens
ttctccctcacc

SEQ ID NO: 5335211 - DNA, 13 bp, Homo sapiens
ttctccctcaccc

SEQ ID NO: 5335212 - DNA, 15 bp, Homo sapiens
ttctccctccatggc

SEQ ID NO: 5335213 - DNA, 20 bp, Homo sapiens
ttctccctccttcccttcct

SEQ ID NO: 5335214 - DNA, 13 bp, Homo sapiens
ttctccctctgga

SEQ ID NO: 5335215 - DNA, 15 bp, Homo sapiens
ttctccctgcagcct

SEQ ID NO: 5335216 - DNA, 11 bp, Homo sapiens
ttctccctgga

SEQ ID NO: 5335217 - DNA, 20 bp, Homo sapiens
ttctccctggatttttacca

SEQ ID NO: 5335218 - DNA, 22 bp, Homo sapiens
ttctccctggggaggacccctg

SEQ ID NO: 5335219 - DNA, 23 bp, Homo sapiens
ttctccctggttttaccccagct

SEQ ID NO: 5335220 - DNA, 21 bp, Homo sapiens
ttctcccttctgctcccatcc

SEQ ID NO: 5335221 - DNA, 18 bp, Homo sapiens
ttctccctttctctctcc

SEQ ID NO: 5335222 - DNA, 19 bp, Homo sapiens
ttctccctttctctctcct

SEQ ID NO: 5335223 - DNA, 18 bp, Homo sapiens
ttctcccttttgacacag

SEQ ID NO: 5335224 - DNA, 23 bp, Homo sapiens
ttctccgactgctagggagtggt

SEQ ID NO: 5335225 - DNA, 17 bp, Homo sapiens
ttctccgccagcctcct

SEQ ID NO: 5335226 - DNA, 18 bp, Homo sapiens
ttctccgccagcctcctc

SEQ ID NO: 5335227 - DNA, 19 bp, Homo sapiens
ttctccggggtctgtgctg

SEQ ID NO: 5335228 - DNA, 13 bp, Homo sapiens
ttctccgggtcct

SEQ ID NO: 5335229 - DNA, 15 bp, Homo sapiens
ttctccgggtcctcc

SEQ ID NO: 5335230 - DNA, 16 bp, Homo sapiens
ttctccgggtcctcct

SEQ ID NO: 5335231 - DNA, 19 bp, Homo sapiens
ttctcctaatgctctgaaa

SEQ ID NO: 5335232 - DNA, 16 bp, Homo sapiens
ttctcctactttacac

SEQ ID NO: 5335233 - DNA, 14 bp, Homo sapiens
ttctcctaggagaa

SEQ ID NO: 5335234 - DNA, 22 bp, Homo sapiens
ttctcctatctaccttccttca

SEQ ID NO: 5335235 - DNA, 16 bp, Homo sapiens
ttctcctcaggacaag

SEQ ID NO: 5335236 - DNA, 20 bp, Homo sapiens
ttctcctcagtggcttctcc

SEQ ID NO: 5335237 - DNA, 21 bp, Homo sapiens
ttctcctcagtggcttctcca

SEQ ID NO: 5335238 - DNA, 19 bp, Homo sapiens
ttctcctcatccatttctt

SEQ ID NO: 5335239 - DNA, 14 bp, Homo sapiens
ttctcctcatttaa

SEQ ID NO: 5335240 - DNA, 15 bp, Homo sapiens
ttctcctccaaatgc

SEQ ID NO: 5335241 - DNA, 23 bp, Homo sapiens
ttctcctccatgggagaaaatag

SEQ ID NO: 5335242 - DNA, 12 bp, Homo sapiens
ttctcctcccaa

SEQ ID NO: 5335243 - DNA, 22 bp, Homo sapiens
ttctcctcccagcgtgtgtatc

SEQ ID NO: 5335244 - DNA, 13 bp, Homo sapiens
ttctcctcccagg

SEQ ID NO: 5335245 - DNA, 14 bp, Homo sapiens
ttctcctccccacc

SEQ ID NO: 5335246 - DNA, 16 bp, Homo sapiens
ttctcctccccacctg

SEQ ID NO: 5335247 - DNA, 19 bp, Homo sapiens
ttctcctcccttccttttc

SEQ ID NO: 5335248 - DNA, 13 bp, Homo sapiens
ttctcctccgcct

SEQ ID NO: 5335249 - DNA, 14 bp, Homo sapiens
ttctcctctgctag

SEQ ID NO: 5335250 - DNA, 14 bp, Homo sapiens
ttctctgaaaagca

SEQ ID NO: 5335251 - DNA, 18 bp, Homo sapiens
ttctctgaacacaggcag

SEQ ID NO: 5335252 - DNA, 20 bp, Homo sapiens
ttctctgaacacaggcagct

SEQ ID NO: 5335253 - DNA, 24 bp, Homo sapiens
ttctctgaacacaggcagctttct

SEQ ID NO: 5335254 - DNA, 15 bp, Homo sapiens
ttctctgaagggagg

SEQ ID NO: 5335255 - DNA, 18 bp, Homo sapiens
ttctctgagaaccaaaag

SEQ ID NO: 5335256 - DNA, 22 bp, Homo sapiens
ttctctgagtatctcctcgcaa

SEQ ID NO: 5335257 - DNA, 14 bp, Homo sapiens
ttctctgagtggtg

SEQ ID NO: 5335258 - DNA, 15 bp, Homo sapiens
ttctctgatacagaa

SEQ ID NO: 5335259 - DNA, 21 bp, Homo sapiens
ttctctgatcacaacttttct

SEQ ID NO: 5335260 - DNA, 15 bp, Homo sapiens
ttctctgatgcagaa

SEQ ID NO: 5335261 - DNA, 15 bp, Homo sapiens
ttctctgatggcact

SEQ ID NO: 5335262 - DNA, 16 bp, Homo sapiens
ttctctgatggcactt

SEQ ID NO: 5335263 - DNA, 19 bp, Homo sapiens
ttctctgatggcacttttg

SEQ ID NO: 5335264 - DNA, 23 bp, Homo sapiens
ttctctgatttgtaatgagcacc

SEQ ID NO: 5335265 - DNA, 16 bp, Homo sapiens
ttctctgcaattttac

SEQ ID NO: 5335266 - DNA, 17 bp, Homo sapiens
ttctctgcaattttact

SEQ ID NO: 5335267 - DNA, 11 bp, Homo sapiens
ttctctgccaa

SEQ ID NO: 5335268 - DNA, 13 bp, Homo sapiens
ttctctgccagtg

SEQ ID NO: 5335269 - DNA, 16 bp, Homo sapiens
ttctctgcccagccgg

SEQ ID NO: 5335270 - DNA, 16 bp, Homo sapiens
ttctctgcccattccc

SEQ ID NO: 5335271 - DNA, 14 bp, Homo sapiens
ttctctgcccgggc

SEQ ID NO: 5335272 - DNA, 16 bp, Homo sapiens
ttctctgccctccaag

SEQ ID NO: 5335273 - DNA, 21 bp, Homo sapiens
ttctctgccctgccctggcca

SEQ ID NO: 5335274 - DNA, 21 bp, Homo sapiens
ttctctgccgctacctccctc

SEQ ID NO: 5335275 - DNA, 10 bp, Homo sapiens
ttctctgcct

SEQ ID NO: 5335276 - DNA, 17 bp, Homo sapiens
ttctctgcctcacctgg

SEQ ID NO: 5335277 - DNA, 15 bp, Homo sapiens
ttctctgcctccagg

SEQ ID NO: 5335278 - DNA, 21 bp, Homo sapiens
ttctctgcctccctaagttgc

SEQ ID NO: 5335279 - DNA, 19 bp, Homo sapiens
ttctctgcctttgacattt

SEQ ID NO: 5335280 - DNA, 15 bp, Homo sapiens
ttctctgcgagcaac

SEQ ID NO: 5335281 - DNA, 16 bp, Homo sapiens
ttctctgcgagcaaca

SEQ ID NO: 5335282 - DNA, 14 bp, Homo sapiens
ttctctgctccacc

SEQ ID NO: 5335283 - DNA, 16 bp, Homo sapiens
ttctctgctgagggcc

SEQ ID NO: 5335284 - DNA, 23 bp, Homo sapiens
ttctctgctgcatcttacagaag

SEQ ID NO: 5335285 - DNA, 21 bp, Homo sapiens
ttctctgctgcctctgtggaa

SEQ ID NO: 5335286 - DNA, 20 bp, Homo sapiens
ttctctgcttacccttcacc

SEQ ID NO: 5335287 - DNA, 11 bp, Homo sapiens
ttctctgcttg

SEQ ID NO: 5335288 - DNA, 16 bp, Homo sapiens
ttctctgcttgacaga

SEQ ID NO: 5335289 - DNA, 19 bp, Homo sapiens
ttctctgcttttccattct

SEQ ID NO: 5335290 - DNA, 12 bp, Homo sapiens
ttctctggctcc

SEQ ID NO: 5335291 - DNA, 20 bp, Homo sapiens
ttctctgggaccaggctcca

SEQ ID NO: 5335292 - DNA, 12 bp, Homo sapiens
ttctctgggaga

SEQ ID NO: 5335293 - DNA, 23 bp, Homo sapiens
ttctctgggagaaaatcatcaag

SEQ ID NO: 5335294 - DNA, 23 bp, Homo sapiens
ttctctgggtaggtgttgaaaat

SEQ ID NO: 5335295 - DNA, 16 bp, Homo sapiens
ttctctgggtctgatt

SEQ ID NO: 5335296 - DNA, 19 bp, Homo sapiens
ttctctggtaatattgact

SEQ ID NO: 5335297 - DNA, 18 bp, Homo sapiens
ttctctgtaattacaact

SEQ ID NO: 5335298 - DNA, 18 bp, Homo sapiens
ttctctgtacatattagc

SEQ ID NO: 5335299 - DNA, 18 bp, Homo sapiens
ttctctgtacttttcatt

SEQ ID NO: 5335300 - DNA, 21 bp, Homo sapiens
ttctctgtacttttcattctc

SEQ ID NO: 5335301 - DNA, 14 bp, Homo sapiens
ttctctgtatattt

SEQ ID NO: 5335302 - DNA, 12 bp, Homo sapiens
ttctctgtccag

SEQ ID NO: 5335303 - DNA, 15 bp, Homo sapiens
ttctctgtccagggc

SEQ ID NO: 5335304 - DNA, 21 bp, Homo sapiens
ttctctgtccagggcttcaga

SEQ ID NO: 5335305 - DNA, 14 bp, Homo sapiens
ttctctgtcctact

SEQ ID NO: 5335306 - DNA, 20 bp, Homo sapiens
ttctctgtgaacgatttaga

SEQ ID NO: 5335307 - DNA, 12 bp, Homo sapiens
ttctctgtgaag

SEQ ID NO: 5335308 - DNA, 18 bp, Homo sapiens
ttctctgtgcaggagcca

SEQ ID NO: 5335309 - DNA, 20 bp, Homo sapiens
ttctctgtgcaggagccagt

SEQ ID NO: 5335310 - DNA, 16 bp, Homo sapiens
ttctctgtgctctgaa

SEQ ID NO: 5335311 - DNA, 17 bp, Homo sapiens
ttctctgtgctctgaat

SEQ ID NO: 5335312 - DNA, 23 bp, Homo sapiens
ttctctgtgtatgagtgtgaatg

SEQ ID NO: 5335313 - DNA, 18 bp, Homo sapiens
ttctctgtgtctaagatt

SEQ ID NO: 5335314 - DNA, 21 bp, Homo sapiens
ttctctgtgtctaagattcta

SEQ ID NO: 5335315 - DNA, 20 bp, Homo sapiens
ttctctgtgtgcacacccat

SEQ ID NO: 5335316 - DNA, 20 bp, Homo sapiens
ttctctgttaacctacaaaa

SEQ ID NO: 5335317 - DNA, 19 bp, Homo sapiens
ttctctgttggtctgcctt

SEQ ID NO: 5335318 - DNA, 23 bp, Homo sapiens
ttctctgttgtcgtaaagatttg

SEQ ID NO: 5335319 - DNA, 22 bp, Homo sapiens
ttctctgttgtttggttcaggg

SEQ ID NO: 5335320 - DNA, 14 bp, Homo sapiens
ttctcttaacttaa

SEQ ID NO: 5335321 - DNA, 13 bp, Homo sapiens
ttctcttacattt

SEQ ID NO: 5335322 - DNA, 21 bp, Homo sapiens
ttctcttaccactagttgctt

SEQ ID NO: 5335323 - DNA, 13 bp, Homo sapiens
ttctcttacctgt

SEQ ID NO: 5335324 - DNA, 12 bp, Homo sapiens
ttctcttagaaa

SEQ ID NO: 5335325 - DNA, 22 bp, Homo sapiens
ttctcttagaaaaggtgataaa

SEQ ID NO: 5335326 - DNA, 21 bp, Homo sapiens
ttctcttaggtggctctggga

SEQ ID NO: 5335327 - DNA, 19 bp, Homo sapiens
ttctcttattctttacaaa

SEQ ID NO: 5335328 - DNA, 15 bp, Homo sapiens
ttctcttcagtgtgt

SEQ ID NO: 5335329 - DNA, 19 bp, Homo sapiens
ttctcttcattcccactgc

SEQ ID NO: 5335330 - DNA, 22 bp, Homo sapiens
ttctcttccaaccatttatctt

SEQ ID NO: 5335331 - DNA, 21 bp, Homo sapiens
ttctcttccactctccttgct

SEQ ID NO: 5335332 - DNA, 15 bp, Homo sapiens
ttctcttccaggcag

SEQ ID NO: 5335333 - DNA, 18 bp, Homo sapiens
ttctcttccagtttctgt

SEQ ID NO: 5335334 - DNA, 23 bp, Homo sapiens
ttctcttccccttcctgtttcag

SEQ ID NO: 5335335 - DNA, 23 bp, Homo sapiens
ttctcttccctgcgcctgtgatg

SEQ ID NO: 5335336 - DNA, 10 bp, Homo sapiens
ttctcttccg

SEQ ID NO: 5335337 - DNA, 14 bp, Homo sapiens
ttctcttcctaaat

SEQ ID NO: 5335338 - DNA, 13 bp, Homo sapiens
ttctcttcctgta

SEQ ID NO: 5335339 - DNA, 21 bp, Homo sapiens
ttctcttctacccttttcctt

SEQ ID NO: 5335340 - DNA, 23 bp, Homo sapiens
ttctcttctccccttccatttct

SEQ ID NO: 5335341 - DNA, 18 bp, Homo sapiens
ttctcttctctgcaatgc

SEQ ID NO: 5335342 - DNA, 13 bp, Homo sapiens
ttctcttctcttc

SEQ ID NO: 5335343 - DNA, 14 bp, Homo sapiens
ttctcttctcttct

SEQ ID NO: 5335344 - DNA, 14 bp, Homo sapiens
ttctcttcttgaac

SEQ ID NO: 5335345 - DNA, 19 bp, Homo sapiens
ttctcttgaaggtgctgcc

SEQ ID NO: 5335346 - DNA, 16 bp, Homo sapiens
ttctcttgacagtctg

SEQ ID NO: 5335347 - DNA, 17 bp, Homo sapiens
ttctcttgacagtctga

SEQ ID NO: 5335348 - DNA, 14 bp, Homo sapiens
ttctcttgagctgg

SEQ ID NO: 5335349 - DNA, 18 bp, Homo sapiens
ttctcttgagctggcctc

SEQ ID NO: 5335350 - DNA, 22 bp, Homo sapiens
ttctcttgagctggcctctcta

SEQ ID NO: 5335351 - DNA, 12 bp, Homo sapiens
ttctcttgcctc

SEQ ID NO: 5335352 - DNA, 14 bp, Homo sapiens
ttctcttgctctcg

SEQ ID NO: 5335353 - DNA, 14 bp, Homo sapiens
ttctcttgctttct

SEQ ID NO: 5335354 - DNA, 19 bp, Homo sapiens
ttctcttggacattgtaaa

SEQ ID NO: 5335355 - DNA, 22 bp, Homo sapiens
ttctcttgggaactgaactcac

SEQ ID NO: 5335356 - DNA, 13 bp, Homo sapiens
ttctcttgggtgg

SEQ ID NO: 5335357 - DNA, 16 bp, Homo sapiens
ttctcttgggtgggac

SEQ ID NO: 5335358 - DNA, 22 bp, Homo sapiens
ttctcttgggtgggacagggct

SEQ ID NO: 5335359 - DNA, 21 bp, Homo sapiens
ttctcttggtgaaataataaa

SEQ ID NO: 5335360 - DNA, 23 bp, Homo sapiens
ttctcttgtataagatcctagat

SEQ ID NO: 5335361 - DNA, 17 bp, Homo sapiens
ttctcttgtctggctgc

SEQ ID NO: 5335362 - DNA, 18 bp, Homo sapiens
ttctcttgtgttcgtgtt

SEQ ID NO: 5335363 - DNA, 20 bp, Homo sapiens
ttctcttgtttaaaaaaaga

SEQ ID NO: 5335364 - DNA, 15 bp, Homo sapiens
ttctctttaactcag

SEQ ID NO: 5335365 - DNA, 15 bp, Homo sapiens
ttctctttaactgtg

SEQ ID NO: 5335366 - DNA, 14 bp, Homo sapiens
ttctctttcaaaaa

SEQ ID NO: 5335367 - DNA, 15 bp, Homo sapiens
ttctctttcccccac

SEQ ID NO: 5335368 - DNA, 13 bp, Homo sapiens
ttctctttccttg

SEQ ID NO: 5335369 - DNA, 11 bp, Homo sapiens
ttctctttctc

SEQ ID NO: 5335370 - DNA, 13 bp, Homo sapiens
ttctctttctctc

SEQ ID NO: 5335371 - DNA, 15 bp, Homo sapiens
ttctctttctctctc

SEQ ID NO: 5335372 - DNA, 21 bp, Homo sapiens
ttctctttcttattttgtaat

SEQ ID NO: 5335373 - DNA, 22 bp, Homo sapiens
ttctctttcttattttgtaata

SEQ ID NO: 5335374 - DNA, 16 bp, Homo sapiens
ttctctttctttacaa

SEQ ID NO: 5335375 - DNA, 22 bp, Homo sapiens
ttctctttctttacaagatggg

SEQ ID NO: 5335376 - DNA, 19 bp, Homo sapiens
ttctctttgataacaaaaa

SEQ ID NO: 5335377 - DNA, 22 bp, Homo sapiens
ttctctttgattatttgcatgt

SEQ ID NO: 5335378 - DNA, 15 bp, Homo sapiens
ttctctttggaaata

SEQ ID NO: 5335379 - DNA, 23 bp, Homo sapiens
ttctctttggaaatagcatgaca

SEQ ID NO: 5335380 - DNA, 15 bp, Homo sapiens
ttctctttgtgcagt

SEQ ID NO: 5335381 - DNA, 20 bp, Homo sapiens
ttctctttgtttctgtttct

SEQ ID NO: 5335382 - DNA, 22 bp, Homo sapiens
ttctctttgtttctgtttcttg

SEQ ID NO: 5335383 - DNA, 15 bp, Homo sapiens
ttctcttttattctg

SEQ ID NO: 5335384 - DNA, 17 bp, Homo sapiens
ttctctttttccagaat

SEQ ID NO: 5335385 - DNA, 18 bp, Homo sapiens
ttctctttttgatcttgt

SEQ ID NO: 5335386 - DNA, 16 bp, Homo sapiens
ttctcttttttcagag

SEQ ID NO: 5335387 - DNA, 13 bp, Homo sapiens
ttctgaaaaagag

SEQ ID NO: 5335388 - DNA, 15 bp, Homo sapiens
ttctgaaaaatggag

SEQ ID NO: 5335389 - DNA, 18 bp, Homo sapiens
ttctgaaaatagcaggac

SEQ ID NO: 5335390 - DNA, 19 bp, Homo sapiens
ttctgaaaatttatataac

SEQ ID NO: 5335391 - DNA, 18 bp, Homo sapiens
ttctgaaacacacgagca

SEQ ID NO: 5335392 - DNA, 19 bp, Homo sapiens
ttctgaaactcccttgtgt

SEQ ID NO: 5335393 - DNA, 23 bp, Homo sapiens
ttctgaaactcccttgtgttcct

SEQ ID NO: 5335394 - DNA, 21 bp, Homo sapiens
ttctgaaacttcataaatgtt

SEQ ID NO: 5335395 - DNA, 19 bp, Homo sapiens
ttctgaaagagtctttctt

SEQ ID NO: 5335396 - DNA, 19 bp, Homo sapiens
ttctgaaaggtgctttctc

SEQ ID NO: 5335397 - DNA, 23 bp, Homo sapiens
ttctgaaagtaaaacaatttatg

SEQ ID NO: 5335398 - DNA, 13 bp, Homo sapiens
ttctgaaagtgtt

SEQ ID NO: 5335399 - DNA, 12 bp, Homo sapiens
ttctgaaatgtt

SEQ ID NO: 5335400 - DNA, 16 bp, Homo sapiens
ttctgaaatgttctta

SEQ ID NO: 5335401 - DNA, 17 bp, Homo sapiens
ttctgaaattaggaaag

SEQ ID NO: 5335402 - DNA, 12 bp, Homo sapiens
ttctgaacagct

SEQ ID NO: 5335403 - DNA, 16 bp, Homo sapiens
ttctgaacagctggtg

SEQ ID NO: 5335404 - DNA, 22 bp, Homo sapiens
ttctgaacagctggtgtagcta

SEQ ID NO: 5335405 - DNA, 21 bp, Homo sapiens
ttctgaaccagaattacatgt

SEQ ID NO: 5335406 - DNA, 22 bp, Homo sapiens
ttctgaactcaagctgcgttta

SEQ ID NO: 5335407 - DNA, 22 bp, Homo sapiens
ttctgaactccatacagcctct

SEQ ID NO: 5335408 - DNA, 16 bp, Homo sapiens
ttctgaactctgacag

SEQ ID NO: 5335409 - DNA, 16 bp, Homo sapiens
ttctgaactttggaag

SEQ ID NO: 5335410 - DNA, 14 bp, Homo sapiens
ttctgaagaagatg

SEQ ID NO: 5335411 - DNA, 13 bp, Homo sapiens
ttctgaagagcct

SEQ ID NO: 5335412 - DNA, 21 bp, Homo sapiens
ttctgaagatcaatttctccc

SEQ ID NO: 5335413 - DNA, 17 bp, Homo sapiens
ttctgaagcctctaaca

SEQ ID NO: 5335414 - DNA, 13 bp, Homo sapiens
ttctgaagctaga

SEQ ID NO: 5335415 - DNA, 17 bp, Homo sapiens
ttctgaagctagaaaca

SEQ ID NO: 5335416 - DNA, 18 bp, Homo sapiens
ttctgaagctagaaacaa

SEQ ID NO: 5335417 - DNA, 19 bp, Homo sapiens
ttctgaagctgacagcact

SEQ ID NO: 5335418 - DNA, 20 bp, Homo sapiens
ttctgaagctgctgcagctc

SEQ ID NO: 5335419 - DNA, 18 bp, Homo sapiens
ttctgaagcttatgtttc

SEQ ID NO: 5335420 - DNA, 18 bp, Homo sapiens
ttctgaagctttaccagc

SEQ ID NO: 5335421 - DNA, 14 bp, Homo sapiens
ttctgaaggggaaa

SEQ ID NO: 5335422 - DNA, 19 bp, Homo sapiens
ttctgaaggtagcattctt

SEQ ID NO: 5335423 - DNA, 21 bp, Homo sapiens
ttctgaaggttggaactgctg

SEQ ID NO: 5335424 - DNA, 17 bp, Homo sapiens
ttctgaagtctcaagaa

SEQ ID NO: 5335425 - DNA, 20 bp, Homo sapiens
ttctgaagttatatttccta

SEQ ID NO: 5335426 - DNA, 12 bp, Homo sapiens
ttctgaagtttt

SEQ ID NO: 5335427 - DNA, 23 bp, Homo sapiens
ttctggatggattttataggaaa

SEQ ID NO: 5335428 - DNA, 21 bp, Homo sapiens
ttctggatggcatctagccag

SEQ ID NO: 5335429 - DNA, 13 bp, Homo sapiens
ttctggatgtaaa

SEQ ID NO: 5335430 - DNA, 14 bp, Homo sapiens
ttctggatgtaaag

SEQ ID NO: 5335431 - DNA, 15 bp, Homo sapiens
ttctggatgtaaagc

SEQ ID NO: 5335432 - DNA, 15 bp, Homo sapiens
ttctggatgtctggc

SEQ ID NO: 5335433 - DNA, 18 bp, Homo sapiens
ttctggattagcttttcc

SEQ ID NO: 5335434 - DNA, 21 bp, Homo sapiens
ttctggattccccatctcagg

SEQ ID NO: 5335435 - DNA, 20 bp, Homo sapiens
ttctggattttgtcaagcag

SEQ ID NO: 5335436 - DNA, 22 bp, Homo sapiens
ttctggatttttttttctttat

SEQ ID NO: 5335437 - DNA, 21 bp, Homo sapiens
ttctggcaaaaaggagccttt

SEQ ID NO: 5335438 - DNA, 15 bp, Homo sapiens
ttctggcaaacgttt

SEQ ID NO: 5335439 - DNA, 18 bp, Homo sapiens
ttctggcaaatattttgt

SEQ ID NO: 5335440 - DNA, 23 bp, Homo sapiens
ttctggcaaatattttgtcactg

SEQ ID NO: 5335441 - DNA, 17 bp, Homo sapiens
ttctggcacgaaatggc

SEQ ID NO: 5335442 - DNA, 22 bp, Homo sapiens
ttctggcagatgtaggtaaaga

SEQ ID NO: 5335443 - DNA, 11 bp, Homo sapiens
ttctggcagga

SEQ ID NO: 5335444 - DNA, 14 bp, Homo sapiens
ttctggccaggaag

SEQ ID NO: 5335445 - DNA, 14 bp, Homo sapiens
ttctggccggtgct

SEQ ID NO: 5335446 - DNA, 14 bp, Homo sapiens
ttctggcctcagca

SEQ ID NO: 5335447 - DNA, 15 bp, Homo sapiens
ttctggcctccagcc

SEQ ID NO: 5335448 - DNA, 22 bp, Homo sapiens
ttctggcgcccctgcctgtgcc

SEQ ID NO: 5335449 - DNA, 18 bp, Homo sapiens
ttctggctatgcatttga

SEQ ID NO: 5335450 - DNA, 20 bp, Homo sapiens
ttctggctatgcatttgaaa

SEQ ID NO: 5335451 - DNA, 16 bp, Homo sapiens
ttctggctcacaggaa

SEQ ID NO: 5335452 - DNA, 18 bp, Homo sapiens
ttctggctcctgtgtgga

SEQ ID NO: 5335453 - DNA, 15 bp, Homo sapiens
ttctggctgaaaaag

SEQ ID NO: 5335454 - DNA, 16 bp, Homo sapiens
ttctggctgaaaatgg

SEQ ID NO: 5335455 - DNA, 20 bp, Homo sapiens
ttctggctgtagataaataa

SEQ ID NO: 5335456 - DNA, 22 bp, Homo sapiens
ttctggctgtgatcttaaaata

SEQ ID NO: 5335457 - DNA, 21 bp, Homo sapiens
ttctggcttatgctcagaagc

SEQ ID NO: 5335458 - DNA, 18 bp, Homo sapiens
ttctggctttaagccttc

SEQ ID NO: 5335459 - DNA, 16 bp, Homo sapiens
ttctggctttgttctt

SEQ ID NO: 5335460 - DNA, 22 bp, Homo sapiens
ttctgggaaaaacaacatcatt

SEQ ID NO: 5335461 - DNA, 17 bp, Homo sapiens
ttctgggaaacagtccc

SEQ ID NO: 5335462 - DNA, 17 bp, Homo sapiens
ttctgggaaaggtgctc

SEQ ID NO: 5335463 - DNA, 21 bp, Homo sapiens
ttctgggaaaggtgctcaaag

SEQ ID NO: 5335464 - DNA, 23 bp, Homo sapiens
ttctgggaaatggcttgaagcca

SEQ ID NO: 5335465 - DNA, 16 bp, Homo sapiens
ttctgggaactctcct

SEQ ID NO: 5335466 - DNA, 19 bp, Homo sapiens
ttctgggaagcttgagcct

SEQ ID NO: 5335467 - DNA, 20 bp, Homo sapiens
ttctgggaagcttgagcctc

SEQ ID NO: 5335468 - DNA, 21 bp, Homo sapiens
ttctgggaagggagagttctt

SEQ ID NO: 5335469 - DNA, 21 bp, Homo sapiens
ttctgggagcagaaacagcca

SEQ ID NO: 5335470 - DNA, 20 bp, Homo sapiens
ttctgggagttgctgttaat

SEQ ID NO: 5335471 - DNA, 19 bp, Homo sapiens
ttctgggatgcaatactag

SEQ ID NO: 5335472 - DNA, 23 bp, Homo sapiens
ttctgggcaccacaaaatataca

SEQ ID NO: 5335473 - DNA, 19 bp, Homo sapiens
ttctgggcaccctcccacc

SEQ ID NO: 5335474 - DNA, 16 bp, Homo sapiens
ttctgggcagagcctg

SEQ ID NO: 5335475 - DNA, 18 bp, Homo sapiens
ttctgggcagccaggctg

SEQ ID NO: 5335476 - DNA, 19 bp, Homo sapiens
ttctgggcatctgttctgg

SEQ ID NO: 5335477 - DNA, 21 bp, Homo sapiens
ttctgggcatggcagggccag

SEQ ID NO: 5335478 - DNA, 23 bp, Homo sapiens
ttctgggcctgatggagaggaga

SEQ ID NO: 5335479 - DNA, 15 bp, Homo sapiens
ttctgggcgtctgag

SEQ ID NO: 5335480 - DNA, 22 bp, Homo sapiens
ttctgggctactgccactgtgt

SEQ ID NO: 5335481 - DNA, 14 bp, Homo sapiens
ttctgggctctgga

SEQ ID NO: 5335482 - DNA, 13 bp, Homo sapiens
ttctgggctcttt

SEQ ID NO: 5335483 - DNA, 23 bp, Homo sapiens
ttctgggctgcgggaggccctgg

SEQ ID NO: 5335484 - DNA, 14 bp, Homo sapiens
ttctgggctgggaa

SEQ ID NO: 5335485 - DNA, 15 bp, Homo sapiens
ttctgggctggggcc

SEQ ID NO: 5335486 - DNA, 18 bp, Homo sapiens
ttctgggctttctcctgg

SEQ ID NO: 5335487 - DNA, 19 bp, Homo sapiens
ttctgggctttctcctgga

SEQ ID NO: 5335488 - DNA, 20 bp, Homo sapiens
ttctgggctttctcctggag

SEQ ID NO: 5335489 - DNA, 23 bp, Homo sapiens
ttctggggaaaaaaaagagactg

SEQ ID NO: 5335490 - DNA, 23 bp, Homo sapiens
ttctggggaaagacactgcctgg

SEQ ID NO: 5335491 - DNA, 23 bp, Homo sapiens
ttctggggaattactttcctcct

SEQ ID NO: 5335492 - DNA, 15 bp, Homo sapiens
ttctggggaggaagg

SEQ ID NO: 5335493 - DNA, 21 bp, Homo sapiens
ttctggggagggacacagagg

SEQ ID NO: 5335494 - DNA, 18 bp, Homo sapiens
ttctggggcaggctgggc

SEQ ID NO: 5335495 - DNA, 19 bp, Homo sapiens
ttctggggcaggctgggcc

SEQ ID NO: 5335496 - DNA, 21 bp, Homo sapiens
ttctggggcaggctgggccat

SEQ ID NO: 5335497 - DNA, 15 bp, Homo sapiens
ttctggggccagccc

SEQ ID NO: 5335498 - DNA, 16 bp, Homo sapiens
ttctggggcccaggaa

SEQ ID NO: 5335499 - DNA, 17 bp, Homo sapiens
ttctggggcccaggaag

SEQ ID NO: 5335500 - DNA, 15 bp, Homo sapiens
ttctggggccccacc

SEQ ID NO: 5335501 - DNA, 14 bp, Homo sapiens
ttctggggcccctt

SEQ ID NO: 5335502 - DNA, 18 bp, Homo sapiens
ttctggggcccgcctgcc

SEQ ID NO: 5335503 - DNA, 16 bp, Homo sapiens
ttctgggggaaaaagc

SEQ ID NO: 5335504 - DNA, 20 bp, Homo sapiens
ttctgggggaaaaagccata

SEQ ID NO: 5335505 - DNA, 20 bp, Homo sapiens
ttctggggggacccagtgca

SEQ ID NO: 5335506 - DNA, 19 bp, Homo sapiens
ttctggggggagaaaaaaa

SEQ ID NO: 5335507 - DNA, 21 bp, Homo sapiens
ttctgggggtaggatgaagag

SEQ ID NO: 5335508 - DNA, 15 bp, Homo sapiens
ttctggggtttttct

SEQ ID NO: 5335509 - DNA, 18 bp, Homo sapiens
ttctgggtccctgctccc

SEQ ID NO: 5335510 - DNA, 16 bp, Homo sapiens
ttctgggtcttttgct

SEQ ID NO: 5335511 - DNA, 22 bp, Homo sapiens
ttctgggtgatggaaactgcca

SEQ ID NO: 5335512 - DNA, 13 bp, Homo sapiens
ttctgggtgattt

SEQ ID NO: 5335513 - DNA, 18 bp, Homo sapiens
ttctgggtggttgccctt

SEQ ID NO: 5335514 - DNA, 16 bp, Homo sapiens
ttctgggtgttgacca

SEQ ID NO: 5335515 - DNA, 20 bp, Homo sapiens
ttctgggtttgaagctgctg

SEQ ID NO: 5335516 - DNA, 21 bp, Homo sapiens
ttctgggtttgaagctgctgt

SEQ ID NO: 5335517 - DNA, 17 bp, Homo sapiens
ttctgggtttgcccagt

SEQ ID NO: 5335518 - DNA, 16 bp, Homo sapiens
ttctgggttttctgaa

SEQ ID NO: 5335519 - DNA, 17 bp, Homo sapiens
ttctgggttttctgaaa

SEQ ID NO: 5335520 - DNA, 17 bp, Homo sapiens
ttctggtaacctgtggt

SEQ ID NO: 5335521 - DNA, 17 bp, Homo sapiens
ttctggtagatagaaat

SEQ ID NO: 5335522 - DNA, 17 bp, Homo sapiens
ttctggtagctccacaa

SEQ ID NO: 5335523 - DNA, 15 bp, Homo sapiens
ttctggtataattgt

SEQ ID NO: 5335524 - DNA, 22 bp, Homo sapiens
ttctggtcaagggctgtcattg

SEQ ID NO: 5335525 - DNA, 21 bp, Homo sapiens
ttctggtccctcttctctcct

SEQ ID NO: 5335526 - DNA, 17 bp, Homo sapiens
ttctggtccctggaaat

SEQ ID NO: 5335527 - DNA, 13 bp, Homo sapiens
ttctggtccttag

SEQ ID NO: 5335528 - DNA, 14 bp, Homo sapiens
ttctggtccttttt

SEQ ID NO: 5335529 - DNA, 19 bp, Homo sapiens
ttctggtctcgtcttccgt

SEQ ID NO: 5335530 - DNA, 13 bp, Homo sapiens
ttctggtctgtgt

SEQ ID NO: 5335531 - DNA, 13 bp, Homo sapiens
ttctggtgactgc

SEQ ID NO: 5335532 - DNA, 19 bp, Homo sapiens
ttctggtgaggccttgctc

SEQ ID NO: 5335533 - DNA, 19 bp, Homo sapiens
ttctggtgcctatttattc

SEQ ID NO: 5335534 - DNA, 20 bp, Homo sapiens
ttctggtgctactccatgca

SEQ ID NO: 5335535 - DNA, 19 bp, Homo sapiens
ttctggtggggtgtgttcc

SEQ ID NO: 5335536 - DNA, 17 bp, Homo sapiens
ttctggtgtgttaacat

SEQ ID NO: 5335537 - DNA, 23 bp, Homo sapiens
ttctggtgttggacaagcttctg

SEQ ID NO: 5335538 - DNA, 22 bp, Homo sapiens
ttctggtgtttggtttcttcat

SEQ ID NO: 5335539 - DNA, 16 bp, Homo sapiens
ttctggttagctcagc

SEQ ID NO: 5335540 - DNA, 15 bp, Homo sapiens
ttctggttatttatg

SEQ ID NO: 5335541 - DNA, 18 bp, Homo sapiens
ttctggttccaaaccagt

SEQ ID NO: 5335542 - DNA, 14 bp, Homo sapiens
ttctggttccattt

SEQ ID NO: 5335543 - DNA, 16 bp, Homo sapiens
ttctggttccctgctg

SEQ ID NO: 5335544 - DNA, 14 bp, Homo sapiens
ttctggttctaaca

SEQ ID NO: 5335545 - DNA, 14 bp, Homo sapiens
ttctggttctaact

SEQ ID NO: 5335546 - DNA, 17 bp, Homo sapiens
ttctggttcttgaaaat

SEQ ID NO: 5335547 - DNA, 21 bp, Homo sapiens
ttctggttcttgtgttggctg

SEQ ID NO: 5335548 - DNA, 14 bp, Homo sapiens
ttctggttgatttg

SEQ ID NO: 5335549 - DNA, 20 bp, Homo sapiens
ttctggttgtttttgttctt

SEQ ID NO: 5335550 - DNA, 23 bp, Homo sapiens
ttctggtttagtgttctgtattt

SEQ ID NO: 5335551 - DNA, 15 bp, Homo sapiens
ttctggtttcccttt

SEQ ID NO: 5335552 - DNA, 11 bp, Homo sapiens
ttctgtaaaat

SEQ ID NO: 5335553 - DNA, 13 bp, Homo sapiens
ttctgtaaacaga

SEQ ID NO: 5335554 - DNA, 14 bp, Homo sapiens
ttctgtaaatggaa

SEQ ID NO: 5335555 - DNA, 12 bp, Homo sapiens
ttctgtaacaaa

SEQ ID NO: 5335556 - DNA, 13 bp, Homo sapiens
ttctgtaacaaat

SEQ ID NO: 5335557 - DNA, 19 bp, Homo sapiens
ttctgtaagaaacctactg

SEQ ID NO: 5335558 - DNA, 16 bp, Homo sapiens
ttctgtaaggggcagc

SEQ ID NO: 5335559 - DNA, 22 bp, Homo sapiens
ttctgtaaggggcagcagttga

SEQ ID NO: 5335560 - DNA, 20 bp, Homo sapiens
ttctgtaaggtcttacattg

SEQ ID NO: 5335561 - DNA, 23 bp, Homo sapiens
ttctgtaattatatctaaaatat

SEQ ID NO: 5335562 - DNA, 21 bp, Homo sapiens
ttctgtaattcaggtttttcc

SEQ ID NO: 5335563 - DNA, 22 bp, Homo sapiens
ttctgtaattcaggtttttcct

SEQ ID NO: 5335564 - DNA, 19 bp, Homo sapiens
ttctgtaattcttctcctt

SEQ ID NO: 5335565 - DNA, 23 bp, Homo sapiens
ttctgtacaaagtactagctaaa

SEQ ID NO: 5335566 - DNA, 15 bp, Homo sapiens
ttctgtaccaaaaat

SEQ ID NO: 5335567 - DNA, 12 bp, Homo sapiens
ttctgtaccagt

SEQ ID NO: 5335568 - DNA, 16 bp, Homo sapiens
ttctgtactaaacatt

SEQ ID NO: 5335569 - DNA, 18 bp, Homo sapiens
ttctgtactcaaatgtag

SEQ ID NO: 5335570 - DNA, 15 bp, Homo sapiens
ttctgtactgttact

SEQ ID NO: 5335571 - DNA, 18 bp, Homo sapiens
ttctgtacttagaaagta

SEQ ID NO: 5335572 - DNA, 17 bp, Homo sapiens
ttctgtacttcctgagt

SEQ ID NO: 5335573 - DNA, 18 bp, Homo sapiens
ttctgtactttttggcat

SEQ ID NO: 5335574 - DNA, 13 bp, Homo sapiens
ttctgtagaaatg

SEQ ID NO: 5335575 - DNA, 14 bp, Homo sapiens
ttctgtagaaatgg

SEQ ID NO: 5335576 - DNA, 22 bp, Homo sapiens
ttctgtagaaatggttgtatta

SEQ ID NO: 5335577 - DNA, 17 bp, Homo sapiens
ttctgtagagccaatta

SEQ ID NO: 5335578 - DNA, 14 bp, Homo sapiens
ttctgtagcctgaa

SEQ ID NO: 5335579 - DNA, 18 bp, Homo sapiens
ttctgtagcttatctgcc

SEQ ID NO: 5335580 - DNA, 14 bp, Homo sapiens
ttctgtagctttct

SEQ ID NO: 5335581 - DNA, 21 bp, Homo sapiens
ttctgtaggagagactggcca

SEQ ID NO: 5335582 - DNA, 20 bp, Homo sapiens
ttctgtagtactccttaaga

SEQ ID NO: 5335583 - DNA, 21 bp, Homo sapiens
ttctgtagtttttaattaaaa

SEQ ID NO: 5335584 - DNA, 11 bp, Homo sapiens
ttctgtataaa

SEQ ID NO: 5335585 - DNA, 13 bp, Homo sapiens
ttctgtatacaac

SEQ ID NO: 5335586 - DNA, 21 bp, Homo sapiens
ttctgtatacaaccctggcat

SEQ ID NO: 5335587 - DNA, 19 bp, Homo sapiens
ttctgtatactgtaaaagt

SEQ ID NO: 5335588 - DNA, 23 bp, Homo sapiens
ttctgtatagacaggagaagaaa

SEQ ID NO: 5335589 - DNA, 17 bp, Homo sapiens
ttctgtatataaatggg

SEQ ID NO: 5335590 - DNA, 16 bp, Homo sapiens
ttctgtatatactttt

SEQ ID NO: 5335591 - DNA, 17 bp, Homo sapiens
ttctgtatatacttttt

SEQ ID NO: 5335592 - DNA, 21 bp, Homo sapiens
ttctgtatatagatgtctgtg

SEQ ID NO: 5335593 - DNA, 22 bp, Homo sapiens
ttctgtatatttgtcatgacag

SEQ ID NO: 5335594 - DNA, 17 bp, Homo sapiens
ttctgtatcaagcccct

SEQ ID NO: 5335595 - DNA, 23 bp, Homo sapiens
ttctgtatcaagcccctgtctaa

SEQ ID NO: 5335596 - DNA, 13 bp, Homo sapiens
ttctgtatgcatc

SEQ ID NO: 5335597 - DNA, 17 bp, Homo sapiens
ttctgtatgcatcagat

SEQ ID NO: 5335598 - DNA, 20 bp, Homo sapiens
ttctgtatgtgacaacattt

SEQ ID NO: 5335599 - DNA, 19 bp, Homo sapiens
ttctgtatttaattataaa

SEQ ID NO: 5335600 - DNA, 13 bp, Homo sapiens
ttctgtatttcct

SEQ ID NO: 5335601 - DNA, 11 bp, Homo sapiens
ttctgtatttg

SEQ ID NO: 5335602 - DNA, 15 bp, Homo sapiens
ttctgtatttgaaag

SEQ ID NO: 5335603 - DNA, 22 bp, Homo sapiens
ttctgtttctattctctcctca

SEQ ID NO: 5335604 - DNA, 11 bp, Homo sapiens
ttctgtttctt

SEQ ID NO: 5335605 - DNA, 12 bp, Homo sapiens
ttctgtttcttg

SEQ ID NO: 5335606 - DNA, 17 bp, Homo sapiens
ttctgtttcttgctctc

SEQ ID NO: 5335607 - DNA, 11 bp, Homo sapiens
ttctgtttgaa

SEQ ID NO: 5335608 - DNA, 14 bp, Homo sapiens
ttctgtttgattct

SEQ ID NO: 5335609 - DNA, 19 bp, Homo sapiens
ttctgtttgcgtacttgta

SEQ ID NO: 5335610 - DNA, 20 bp, Homo sapiens
ttctgtttggcacttgtatt

SEQ ID NO: 5335611 - DNA, 21 bp, Homo sapiens
ttctgtttggcacttgtattt

SEQ ID NO: 5335612 - DNA, 12 bp, Homo sapiens
ttctgtttgtta

SEQ ID NO: 5335613 - DNA, 23 bp, Homo sapiens
ttctgtttgtttaagctgagcca

SEQ ID NO: 5335614 - DNA, 17 bp, Homo sapiens
ttctgttttcccccagc

SEQ ID NO: 5335615 - DNA, 23 bp, Homo sapiens
ttctgttttcgtaccttcccact

SEQ ID NO: 5335616 - DNA, 15 bp, Homo sapiens
ttctgttttctgttt

SEQ ID NO: 5335617 - DNA, 17 bp, Homo sapiens
ttctgttttgcctgaag

SEQ ID NO: 5335618 - DNA, 17 bp, Homo sapiens
ttctgttttgtaaatgt

SEQ ID NO: 5335619 - DNA, 22 bp, Homo sapiens
ttctgtttttaaaaattagcct

SEQ ID NO: 5335620 - DNA, 13 bp, Homo sapiens
ttctgtttttaat

SEQ ID NO: 5335621 - DNA, 15 bp, Homo sapiens
ttctgtttttctcaa

SEQ ID NO: 5335622 - DNA, 17 bp, Homo sapiens
ttctgtttttctcaaat

SEQ ID NO: 5335623 - DNA, 17 bp, Homo sapiens
ttcttaaaaaattgaaa

SEQ ID NO: 5335624 - DNA, 20 bp, Homo sapiens
ttcttaaaaaatttatactt

SEQ ID NO: 5335625 - DNA, 20 bp, Homo sapiens
ttcttaaaaactgtgtatca

SEQ ID NO: 5335626 - DNA, 14 bp, Homo sapiens
ttcttaaaaatgca

SEQ ID NO: 5335627 - DNA, 20 bp, Homo sapiens
ttcttaaaaatgcatttaag

SEQ ID NO: 5335628 - DNA, 13 bp, Homo sapiens
ttcttaaaacact

SEQ ID NO: 5335629 - DNA, 12 bp, Homo sapiens
ttcttaaaacta

SEQ ID NO: 5335630 - DNA, 23 bp, Homo sapiens
ttcttaaaagaaatcttgcttca

SEQ ID NO: 5335631 - DNA, 15 bp, Homo sapiens
ttcttaaaagggaaa

SEQ ID NO: 5335632 - DNA, 13 bp, Homo sapiens
ttcttaaaattca

SEQ ID NO: 5335633 - DNA, 23 bp, Homo sapiens
ttcttaaaattcaagaaaataaa

SEQ ID NO: 5335634 - DNA, 17 bp, Homo sapiens
ttcttaaacaaatgtat

SEQ ID NO: 5335635 - DNA, 23 bp, Homo sapiens
ttcttaaaccaacctttaaaatt

SEQ ID NO: 5335636 - DNA, 14 bp, Homo sapiens
ttcttaaactttca

SEQ ID NO: 5335637 - DNA, 15 bp, Homo sapiens
ttcttaaagcttttt

SEQ ID NO: 5335638 - DNA, 15 bp, Homo sapiens
ttcttaaaggaaaag

SEQ ID NO: 5335639 - DNA, 16 bp, Homo sapiens
ttcttaaaggcctgga

SEQ ID NO: 5335640 - DNA, 19 bp, Homo sapiens
ttcttaaaggcctggaacc

SEQ ID NO: 5335641 - DNA, 17 bp, Homo sapiens
ttcttaaagtcaagatt

SEQ ID NO: 5335642 - DNA, 13 bp, Homo sapiens
ttcttaaagttga

SEQ ID NO: 5335643 - DNA, 18 bp, Homo sapiens
ttcttaaataagaaactt

SEQ ID NO: 5335644 - DNA, 16 bp, Homo sapiens
ttcttaaataatgctt

SEQ ID NO: 5335645 - DNA, 12 bp, Homo sapiens
ttcttaaatata

SEQ ID NO: 5335646 - DNA, 19 bp, Homo sapiens
ttcttaaatatatgattta

SEQ ID NO: 5335647 - DNA, 21 bp, Homo sapiens
ttcttaaatatcttttatgtt

SEQ ID NO: 5335648 - DNA, 16 bp, Homo sapiens
ttcttaaatatgtata

SEQ ID NO: 5335649 - DNA, 20 bp, Homo sapiens
ttcttaaatctttcttcaaa

SEQ ID NO: 5335650 - DNA, 16 bp, Homo sapiens
ttcttaacaaactctt

SEQ ID NO: 5335651 - DNA, 22 bp, Homo sapiens
ttcttaactaaatttgtctttc

SEQ ID NO: 5335652 - DNA, 16 bp, Homo sapiens
ttcttaacttctgaaa

SEQ ID NO: 5335653 - DNA, 13 bp, Homo sapiens
ttcttaacttctt

SEQ ID NO: 5335654 - DNA, 21 bp, Homo sapiens
ttcttaagaaaacaaactctt

SEQ ID NO: 5335655 - DNA, 14 bp, Homo sapiens
ttcttaagaattca

SEQ ID NO: 5335656 - DNA, 22 bp, Homo sapiens
ttcttaagaccacctcaaattt

SEQ ID NO: 5335657 - DNA, 23 bp, Homo sapiens
ttcttaagacgtgattttgctgt

SEQ ID NO: 5335658 - DNA, 11 bp, Homo sapiens
ttcttaagata

SEQ ID NO: 5335659 - DNA, 14 bp, Homo sapiens
ttcttaataaaact

SEQ ID NO: 5335660 - DNA, 20 bp, Homo sapiens
ttcttaatcttttcacaaat

SEQ ID NO: 5335661 - DNA, 22 bp, Homo sapiens
ttcttaatcttttcacaaataa

SEQ ID NO: 5335662 - DNA, 23 bp, Homo sapiens
ttcttaatgagatatttgtattt

SEQ ID NO: 5335663 - DNA, 18 bp, Homo sapiens
ttcttaatgtaacatgtt

SEQ ID NO: 5335664 - DNA, 12 bp, Homo sapiens
ttcttaatgtct

SEQ ID NO: 5335665 - DNA, 16 bp, Homo sapiens
ttcttaatgtctgtca

SEQ ID NO: 5335666 - DNA, 18 bp, Homo sapiens
ttcttaatgtctgtcaga

SEQ ID NO: 5335667 - DNA, 22 bp, Homo sapiens
ttcttaattaatttgattaaca

SEQ ID NO: 5335668 - DNA, 18 bp, Homo sapiens
ttcttaattattataaaa

SEQ ID NO: 5335669 - DNA, 20 bp, Homo sapiens
ttcttaattattataaaaat

SEQ ID NO: 5335670 - DNA, 21 bp, Homo sapiens
ttcttaattattataaaaata

SEQ ID NO: 5335671 - DNA, 22 bp, Homo sapiens
ttcttaattattataaaaatat

SEQ ID NO: 5335672 - DNA, 17 bp, Homo sapiens
ttcttaatttggaaact

SEQ ID NO: 5335673 - DNA, 22 bp, Homo sapiens
ttcttaatttggaaactaataa

SEQ ID NO: 5335674 - DNA, 21 bp, Homo sapiens
ttcttaatttggatctattta

SEQ ID NO: 5335675 - DNA, 13 bp, Homo sapiens
ttcttaattttgt

SEQ ID NO: 5335676 - DNA, 11 bp, Homo sapiens
ttcttacaaaa

SEQ ID NO: 5335677 - DNA, 22 bp, Homo sapiens
ttcttacaataaaccctccttg

SEQ ID NO: 5335678 - DNA, 20 bp, Homo sapiens
ttcttacaattgcactgctg

SEQ ID NO: 5335679 - DNA, 14 bp, Homo sapiens
ttcttacacactgt

SEQ ID NO: 5335680 - DNA, 14 bp, Homo sapiens
ttcttacacttctt

SEQ ID NO: 5335681 - DNA, 13 bp, Homo sapiens
ttcttacagactg

SEQ ID NO: 5335682 - DNA, 14 bp, Homo sapiens
ttcttacagccaag

SEQ ID NO: 5335683 - DNA, 21 bp, Homo sapiens
ttcttacatctgtaaagaaaa

SEQ ID NO: 5335684 - DNA, 13 bp, Homo sapiens
ttcttacatgttt

SEQ ID NO: 5335685 - DNA, 20 bp, Homo sapiens
ttcttacattattaatcatt

SEQ ID NO: 5335686 - DNA, 14 bp, Homo sapiens
ttcttaccaattgt

SEQ ID NO: 5335687 - DNA, 16 bp, Homo sapiens
ttcttaccgacaagca

SEQ ID NO: 5335688 - DNA, 18 bp, Homo sapiens
ttcttaccgagaaaagga

SEQ ID NO: 5335689 - DNA, 22 bp, Homo sapiens
ttcttacctactattggcccta

SEQ ID NO: 5335690 - DNA, 15 bp, Homo sapiens
ttcttactcctcctc

SEQ ID NO: 5335691 - DNA, 16 bp, Homo sapiens
ttcttactcctcctct

SEQ ID NO: 5335692 - DNA, 13 bp, Homo sapiens
ttcttactgcttg

SEQ ID NO: 5335693 - DNA, 21 bp, Homo sapiens
ttcttagacctcttcctggaa

SEQ ID NO: 5335694 - DNA, 21 bp, Homo sapiens
ttcttagactacatttagaga

SEQ ID NO: 5335695 - DNA, 13 bp, Homo sapiens
ttcttagagatta

SEQ ID NO: 5335696 - DNA, 23 bp, Homo sapiens
ttcttagagccttagcagccctg

SEQ ID NO: 5335697 - DNA, 16 bp, Homo sapiens
ttcttagatatctttt

SEQ ID NO: 5335698 - DNA, 16 bp, Homo sapiens
ttcttagctcaatgag

SEQ ID NO: 5335699 - DNA, 23 bp, Homo sapiens
ttcttagctcttaattgttcatt

SEQ ID NO: 5335700 - DNA, 15 bp, Homo sapiens
ttcttagctgcactg

SEQ ID NO: 5335701 - DNA, 20 bp, Homo sapiens
ttcttagctttttaattgtt

SEQ ID NO: 5335702 - DNA, 20 bp, Homo sapiens
ttcttaggagcaagaagaaa

SEQ ID NO: 5335703 - DNA, 21 bp, Homo sapiens
ttcttaggagcaagaagaaaa

SEQ ID NO: 5335704 - DNA, 20 bp, Homo sapiens
ttcttaggcaccatagaaga

SEQ ID NO: 5335705 - DNA, 23 bp, Homo sapiens
ttcttaggtttactgtgaagaga

SEQ ID NO: 5335706 - DNA, 20 bp, Homo sapiens
ttcttagtgcttcagagttt

SEQ ID NO: 5335707 - DNA, 23 bp, Homo sapiens
ttcttagtgcttcagagtttgtg

SEQ ID NO: 5335708 - DNA, 22 bp, Homo sapiens
ttcttagtgttggtttaatatt

SEQ ID NO: 5335709 - DNA, 13 bp, Homo sapiens
ttcttagttactt

SEQ ID NO: 5335710 - DNA, 22 bp, Homo sapiens
ttcttagttactttggaacact

SEQ ID NO: 5335711 - DNA, 22 bp, Homo sapiens
ttcttagttcatatatcaagaa

SEQ ID NO: 5335712 - DNA, 24 bp, Homo sapiens
ttcttagttcatatatcaagaagt

SEQ ID NO: 5335713 - DNA, 19 bp, Homo sapiens
ttcttagttctcactgttc

SEQ ID NO: 5335714 - DNA, 15 bp, Homo sapiens
ttcttagttgctgta

SEQ ID NO: 5335715 - DNA, 13 bp, Homo sapiens
ttcttataaatat

SEQ ID NO: 5335716 - DNA, 14 bp, Homo sapiens
ttcttatacacatt

SEQ ID NO: 5335717 - DNA, 20 bp, Homo sapiens
ttcttatacagataaaacat

SEQ ID NO: 5335718 - DNA, 21 bp, Homo sapiens
ttcttatacagataaaacatg

SEQ ID NO: 5335719 - DNA, 13 bp, Homo sapiens
ttcttatagaata

SEQ ID NO: 5335720 - DNA, 14 bp, Homo sapiens
ttcttatagaataa

SEQ ID NO: 5335721 - DNA, 13 bp, Homo sapiens
ttcttatagattt

SEQ ID NO: 5335722 - DNA, 22 bp, Homo sapiens
ttcttataggaaagcttgagta

SEQ ID NO: 5335723 - DNA, 16 bp, Homo sapiens
ttcttatatatgtgaa

SEQ ID NO: 5335724 - DNA, 23 bp, Homo sapiens
ttcttatcacataagagagatga

SEQ ID NO: 5335725 - DNA, 19 bp, Homo sapiens
ttcttatccttacactccc

SEQ ID NO: 5335726 - DNA, 15 bp, Homo sapiens
ttcttatcttctgca

SEQ ID NO: 5335727 - DNA, 13 bp, Homo sapiens
ttcttatgatttt

SEQ ID NO: 5335728 - DNA, 18 bp, Homo sapiens
ttcttatgccatataatt

SEQ ID NO: 5335729 - DNA, 23 bp, Homo sapiens
ttcttatgccatgttaatttcat

SEQ ID NO: 5335730 - DNA, 12 bp, Homo sapiens
ttcttatgctta

SEQ ID NO: 5335731 - DNA, 15 bp, Homo sapiens
ttcttatggaattga

SEQ ID NO: 5335732 - DNA, 22 bp, Homo sapiens
ttcttatggaattgatttgcat

SEQ ID NO: 5335733 - DNA, 13 bp, Homo sapiens
ttcttattaacca

SEQ ID NO: 5335734 - DNA, 14 bp, Homo sapiens
ttcttattcaaaga

SEQ ID NO: 5335735 - DNA, 19 bp, Homo sapiens
ttcttattctcactccacc

SEQ ID NO: 5335736 - DNA, 15 bp, Homo sapiens
ttcttattctctgtt

SEQ ID NO: 5335737 - DNA, 17 bp, Homo sapiens
ttcttattctctgtttg

SEQ ID NO: 5335738 - DNA, 15 bp, Homo sapiens
ttcttattgctttta

SEQ ID NO: 5335739 - DNA, 22 bp, Homo sapiens
ttcttatttaaattttcagaaa

SEQ ID NO: 5335740 - DNA, 23 bp, Homo sapiens
ttcttatttaagtatggaatatt

SEQ ID NO: 5335741 - DNA, 17 bp, Homo sapiens
ttcttatttaccctttt

SEQ ID NO: 5335742 - DNA, 13 bp, Homo sapiens
ttcttatttatgt

SEQ ID NO: 5335743 - DNA, 22 bp, Homo sapiens
ttcttatttcccctttccaatt

SEQ ID NO: 5335744 - DNA, 17 bp, Homo sapiens
ttcttatttgaaagtgt

SEQ ID NO: 5335745 - DNA, 14 bp, Homo sapiens
ttcttatttgcaat

SEQ ID NO: 5335746 - DNA, 14 bp, Homo sapiens
ttcttattttgcat

SEQ ID NO: 5335747 - DNA, 16 bp, Homo sapiens
ttcttattttgtaata

SEQ ID NO: 5335748 - DNA, 17 bp, Homo sapiens
ttcttattttgtaataa

SEQ ID NO: 5335749 - DNA, 19 bp, Homo sapiens
ttcttattttgtaataaac

SEQ ID NO: 5335750 - DNA, 20 bp, Homo sapiens
ttcttattttgtaataaact

SEQ ID NO: 5335751 - DNA, 21 bp, Homo sapiens
ttcttattttgtaataaactc

SEQ ID NO: 5335752 - DNA, 22 bp, Homo sapiens
ttcttattttgtaataaactct

SEQ ID NO: 5335753 - DNA, 15 bp, Homo sapiens
ttcttatttttctta

SEQ ID NO: 5335754 - DNA, 23 bp, Homo sapiens
ttcttcaaaatataaaatgccaa

SEQ ID NO: 5335755 - DNA, 20 bp, Homo sapiens
ttcttcaaaatcgatatggt

SEQ ID NO: 5335756 - DNA, 20 bp, Homo sapiens
ttcttcaaaatgtatatatt

SEQ ID NO: 5335757 - DNA, 16 bp, Homo sapiens
ttcttcaaatacaaag

SEQ ID NO: 5335758 - DNA, 20 bp, Homo sapiens
ttcttcaacagggaaaacag

SEQ ID NO: 5335759 - DNA, 17 bp, Homo sapiens
ttcttcaacatcaatgt

SEQ ID NO: 5335760 - DNA, 21 bp, Homo sapiens
ttcttcaacatcaatgttcat

SEQ ID NO: 5335761 - DNA, 22 bp, Homo sapiens
ttcttcaacatcaatgttcatt

SEQ ID NO: 5335762 - DNA, 16 bp, Homo sapiens
ttcttcaactcctggg

SEQ ID NO: 5335763 - DNA, 16 bp, Homo sapiens
ttcttcaactctgaat

SEQ ID NO: 5335764 - DNA, 22 bp, Homo sapiens
ttcttcaactctgaatcaaaag

SEQ ID NO: 5335765 - DNA, 20 bp, Homo sapiens
ttcttcaagccagctctagg

SEQ ID NO: 5335766 - DNA, 15 bp, Homo sapiens
ttcttcaataaaatg

SEQ ID NO: 5335767 - DNA, 19 bp, Homo sapiens
ttcttcaatgtgaaactga

SEQ ID NO: 5335768 - DNA, 15 bp, Homo sapiens
ttcttcaatttgaaa

SEQ ID NO: 5335769 - DNA, 16 bp, Homo sapiens
ttcttcaccaaatctt

SEQ ID NO: 5335770 - DNA, 18 bp, Homo sapiens
ttcttcaccaagtgcaat

SEQ ID NO: 5335771 - DNA, 14 bp, Homo sapiens
ttcttcacccagct

SEQ ID NO: 5335772 - DNA, 16 bp, Homo sapiens
ttcttcacctcttcca

SEQ ID NO: 5335773 - DNA, 13 bp, Homo sapiens
ttcttcactgcaa

SEQ ID NO: 5335774 - DNA, 19 bp, Homo sapiens
ttcttcagaattatccatt

SEQ ID NO: 5335775 - DNA, 11 bp, Homo sapiens
ttcttcagaga

SEQ ID NO: 5335776 - DNA, 16 bp, Homo sapiens
ttcttcagagatcaag

SEQ ID NO: 5335777 - DNA, 12 bp, Homo sapiens
ttcttcagaggg

SEQ ID NO: 5335778 - DNA, 20 bp, Homo sapiens
ttcttcagagtgaagaatct

SEQ ID NO: 5335779 - DNA, 21 bp, Homo sapiens
ttcttcagagtgaagaatctt

SEQ ID NO: 5335780 - DNA, 14 bp, Homo sapiens
ttcttgggctaggt

SEQ ID NO: 5335781 - DNA, 18 bp, Homo sapiens
ttcttggggattcaaaaa

SEQ ID NO: 5335782 - DNA, 19 bp, Homo sapiens
ttcttggggcccagtgcat

SEQ ID NO: 5335783 - DNA, 22 bp, Homo sapiens
ttcttgggggaggccaccccaa

SEQ ID NO: 5335784 - DNA, 19 bp, Homo sapiens
ttcttggggtcccagggaa

SEQ ID NO: 5335785 - DNA, 21 bp, Homo sapiens
ttcttggtaaagtccttttct

SEQ ID NO: 5335786 - DNA, 14 bp, Homo sapiens
ttcttggtatgatc

SEQ ID NO: 5335787 - DNA, 21 bp, Homo sapiens
ttcttggtatttggatatctg

SEQ ID NO: 5335788 - DNA, 16 bp, Homo sapiens
ttcttggtctcagctt

SEQ ID NO: 5335789 - DNA, 14 bp, Homo sapiens
ttcttggtgctctg

SEQ ID NO: 5335790 - DNA, 17 bp, Homo sapiens
ttcttggtgctctgtgt

SEQ ID NO: 5335791 - DNA, 19 bp, Homo sapiens
ttcttggttttctctctgg

SEQ ID NO: 5335792 - DNA, 23 bp, Homo sapiens
ttcttggttttgtattgtttaaa

SEQ ID NO: 5335793 - DNA, 19 bp, Homo sapiens
ttcttgtaaaactgtgaca

SEQ ID NO: 5335794 - DNA, 23 bp, Homo sapiens
ttcttgtaaaactgtgacattcc

SEQ ID NO: 5335795 - DNA, 20 bp, Homo sapiens
ttcttgtaaatctttttgct

SEQ ID NO: 5335796 - DNA, 18 bp, Homo sapiens
ttcttgtaactttcttca

SEQ ID NO: 5335797 - DNA, 15 bp, Homo sapiens
ttcttgtaagccatc

SEQ ID NO: 5335798 - DNA, 17 bp, Homo sapiens
ttcttgtaataaatgat

SEQ ID NO: 5335799 - DNA, 12 bp, Homo sapiens
ttcttgtaattt

SEQ ID NO: 5335800 - DNA, 23 bp, Homo sapiens
ttcttgtaatttaaacaggccca

SEQ ID NO: 5335801 - DNA, 13 bp, Homo sapiens
ttcttgtaatttt

SEQ ID NO: 5335802 - DNA, 12 bp, Homo sapiens
ttcttgtacagt

SEQ ID NO: 5335803 - DNA, 14 bp, Homo sapiens
ttcttgtatctgga

SEQ ID NO: 5335804 - DNA, 12 bp, Homo sapiens
ttcttgtattaa

SEQ ID NO: 5335805 - DNA, 12 bp, Homo sapiens
ttcttgtattta

SEQ ID NO: 5335806 - DNA, 18 bp, Homo sapiens
ttcttgtcaatggaagaa

SEQ ID NO: 5335807 - DNA, 14 bp, Homo sapiens
ttcttgtcacaaat

SEQ ID NO: 5335808 - DNA, 21 bp, Homo sapiens
ttcttgtcagacataaagcca

SEQ ID NO: 5335809 - DNA, 17 bp, Homo sapiens
ttcttgtccacattcta

SEQ ID NO: 5335810 - DNA, 16 bp, Homo sapiens
ttcttgtctataaagc

SEQ ID NO: 5335811 - DNA, 17 bp, Homo sapiens
ttcttgtctataaagca

SEQ ID NO: 5335812 - DNA, 18 bp, Homo sapiens
ttcttgtctataaagcat

SEQ ID NO: 5335813 - DNA, 14 bp, Homo sapiens
ttcttgtctgtgtg

SEQ ID NO: 5335814 - DNA, 14 bp, Homo sapiens
ttcttgtctttatt

SEQ ID NO: 5335815 - DNA, 17 bp, Homo sapiens
ttcttgtctttgtccct

SEQ ID NO: 5335816 - DNA, 19 bp, Homo sapiens
ttcttgtctttgtccctgt

SEQ ID NO: 5335817 - DNA, 22 bp, Homo sapiens
ttcttgtgccatagtcacatgg

SEQ ID NO: 5335818 - DNA, 18 bp, Homo sapiens
ttcttgtgggagacagca

SEQ ID NO: 5335819 - DNA, 20 bp, Homo sapiens
ttcttgtggtgtaaagctgg

SEQ ID NO: 5335820 - DNA, 13 bp, Homo sapiens
ttcttgtggttaa

SEQ ID NO: 5335821 - DNA, 15 bp, Homo sapiens
ttcttgtgtctcctt

SEQ ID NO: 5335822 - DNA, 13 bp, Homo sapiens
ttcttgtgtctgt

SEQ ID NO: 5335823 - DNA, 14 bp, Homo sapiens
ttcttgtgtgttta

SEQ ID NO: 5335824 - DNA, 21 bp, Homo sapiens
ttcttgtgtgtttattgtcaa

SEQ ID NO: 5335825 - DNA, 15 bp, Homo sapiens
ttcttgtgttctgta

SEQ ID NO: 5335826 - DNA, 17 bp, Homo sapiens
ttcttgtgtttgagaac

SEQ ID NO: 5335827 - DNA, 20 bp, Homo sapiens
ttcttgtgttttactgtcag

SEQ ID NO: 5335828 - DNA, 23 bp, Homo sapiens
ttcttgttagtactatatctgtt

SEQ ID NO: 5335829 - DNA, 12 bp, Homo sapiens
ttcttgttcaaa

SEQ ID NO: 5335830 - DNA, 16 bp, Homo sapiens
ttcttgttcatccaag

SEQ ID NO: 5335831 - DNA, 21 bp, Homo sapiens
ttcttgttcatgttttgctaa

SEQ ID NO: 5335832 - DNA, 16 bp, Homo sapiens
ttcttgttctgttttg

SEQ ID NO: 5335833 - DNA, 12 bp, Homo sapiens
ttcttgtttaac

SEQ ID NO: 5335834 - DNA, 13 bp, Homo sapiens
ttcttgtttatca

SEQ ID NO: 5335835 - DNA, 14 bp, Homo sapiens
ttcttgtttccttg

SEQ ID NO: 5335836 - DNA, 15 bp, Homo sapiens
ttcttgtttccttgt

SEQ ID NO: 5335837 - DNA, 15 bp, Homo sapiens
ttcttgttttatata

SEQ ID NO: 5335838 - DNA, 13 bp, Homo sapiens
ttcttgttttgct

SEQ ID NO: 5335839 - DNA, 23 bp, Homo sapiens
ttctttaaaaaacaactatggat

SEQ ID NO: 5335840 - DNA, 23 bp, Homo sapiens
ttctttaaaagaaacttaactgt

SEQ ID NO: 5335841 - DNA, 16 bp, Homo sapiens
ttctttaaaagaatgg

SEQ ID NO: 5335842 - DNA, 19 bp, Homo sapiens
ttctttaaaagaatgggca

SEQ ID NO: 5335843 - DNA, 20 bp, Homo sapiens
ttctttaaacaaatatgaaa

SEQ ID NO: 5335844 - DNA, 16 bp, Homo sapiens
ttctttaaactactga

SEQ ID NO: 5335845 - DNA, 13 bp, Homo sapiens
ttctttaaactgt

SEQ ID NO: 5335846 - DNA, 15 bp, Homo sapiens
ttctttaaagaagaa

SEQ ID NO: 5335847 - DNA, 20 bp, Homo sapiens
ttctttaaagttcttctaag

SEQ ID NO: 5335848 - DNA, 12 bp, Homo sapiens
ttctttaaatca

SEQ ID NO: 5335849 - DNA, 20 bp, Homo sapiens
ttctttaaatcaaaagctgc

SEQ ID NO: 5335850 - DNA, 22 bp, Homo sapiens
ttctttaaatgtgtatttctta

SEQ ID NO: 5335851 - DNA, 13 bp, Homo sapiens
ttctttaaatgtt

SEQ ID NO: 5335852 - DNA, 14 bp, Homo sapiens
ttctttaaatgttt

SEQ ID NO: 5335853 - DNA, 12 bp, Homo sapiens
ttctttaaatta

SEQ ID NO: 5335854 - DNA, 20 bp, Homo sapiens
ttctttaaatttcaaatgtt

SEQ ID NO: 5335855 - DNA, 20 bp, Homo sapiens
ttctttaacatacatctaag

SEQ ID NO: 5335856 - DNA, 19 bp, Homo sapiens
ttctttaactgccgtaatt

SEQ ID NO: 5335857 - DNA, 16 bp, Homo sapiens
ttctttaatatgattc

SEQ ID NO: 5335858 - DNA, 14 bp, Homo sapiens
ttctttaatcaaaa

SEQ ID NO: 5335859 - DNA, 18 bp, Homo sapiens
ttctttaatgcttttata

SEQ ID NO: 5335860 - DNA, 17 bp, Homo sapiens
ttctttaattttggaat

SEQ ID NO: 5335861 - DNA, 18 bp, Homo sapiens
ttctttaattttggaatt

SEQ ID NO: 5335862 - DNA, 20 bp, Homo sapiens
ttctttacaaaacaaactca

SEQ ID NO: 5335863 - DNA, 18 bp, Homo sapiens
ttctttactcggcgtgct

SEQ ID NO: 5335864 - DNA, 17 bp, Homo sapiens
ttctttactcgtcccct

SEQ ID NO: 5335865 - DNA, 18 bp, Homo sapiens
ttctttactgcactcaga

SEQ ID NO: 5335866 - DNA, 14 bp, Homo sapiens
ttctttactggtga

SEQ ID NO: 5335867 - DNA, 19 bp, Homo sapiens
ttctttacttctcacttca

SEQ ID NO: 5335868 - DNA, 13 bp, Homo sapiens
ttctttagaaaac

SEQ ID NO: 5335869 - DNA, 19 bp, Homo sapiens
ttctttagaacaacataaa

SEQ ID NO: 5335870 - DNA, 20 bp, Homo sapiens
ttctttagaatttttaccca

SEQ ID NO: 5335871 - DNA, 19 bp, Homo sapiens
ttctttagagaactgaaaa

SEQ ID NO: 5335872 - DNA, 13 bp, Homo sapiens
ttctttagagatg

SEQ ID NO: 5335873 - DNA, 20 bp, Homo sapiens
ttctttagatttttaaattg

SEQ ID NO: 5335874 - DNA, 20 bp, Homo sapiens
ttctttagcatttttatgca

SEQ ID NO: 5335875 - DNA, 21 bp, Homo sapiens
ttctttagcatttttatgcag

SEQ ID NO: 5335876 - DNA, 20 bp, Homo sapiens
ttctttagtagcaactaaaa

SEQ ID NO: 5335877 - DNA, 12 bp, Homo sapiens
ttctttagtctt

SEQ ID NO: 5335878 - DNA, 23 bp, Homo sapiens
ttctttataaaaagtgaaataag

SEQ ID NO: 5335879 - DNA, 14 bp, Homo sapiens
ttctttataaactt

SEQ ID NO: 5335880 - DNA, 15 bp, Homo sapiens
ttctttataatggct

SEQ ID NO: 5335881 - DNA, 19 bp, Homo sapiens
ttctttataatggctctgg

SEQ ID NO: 5335882 - DNA, 18 bp, Homo sapiens
ttctttataattctactt

SEQ ID NO: 5335883 - DNA, 16 bp, Homo sapiens
ttctttatacaacagt

SEQ ID NO: 5335884 - DNA, 18 bp, Homo sapiens
ttctttatacaacagtgc

SEQ ID NO: 5335885 - DNA, 15 bp, Homo sapiens
ttctttatactctct

SEQ ID NO: 5335886 - DNA, 20 bp, Homo sapiens
ttctttatactctcttccct

SEQ ID NO: 5335887 - DNA, 16 bp, Homo sapiens
ttctttatactgtaat

SEQ ID NO: 5335888 - DNA, 17 bp, Homo sapiens
ttctttatataaggtca

SEQ ID NO: 5335889 - DNA, 18 bp, Homo sapiens
ttctttatatacaataat

SEQ ID NO: 5335890 - DNA, 19 bp, Homo sapiens
ttctttatatctgaaccaa

SEQ ID NO: 5335891 - DNA, 20 bp, Homo sapiens
ttctttatatttatccacta

SEQ ID NO: 5335892 - DNA, 22 bp, Homo sapiens
ttctttattatttttctctctc

SEQ ID NO: 5335893 - DNA, 14 bp, Homo sapiens
ttctttattgcact

SEQ ID NO: 5335894 - DNA, 21 bp, Homo sapiens
ttctttattgcactaggaatt

SEQ ID NO: 5335895 - DNA, 18 bp, Homo sapiens
ttctttattgcttactgt

SEQ ID NO: 5335896 - DNA, 18 bp, Homo sapiens
ttctttatttttgttaat

SEQ ID NO: 5335897 - DNA, 22 bp, Homo sapiens
ttctttattttttaacttatgt

SEQ ID NO: 5335898 - DNA, 19 bp, Homo sapiens
ttctttcaagggctttcct

SEQ ID NO: 5335899 - DNA, 18 bp, Homo sapiens
ttctttcacccatcctag

SEQ ID NO: 5335900 - DNA, 17 bp, Homo sapiens
ttctttcacttgatgtt

SEQ ID NO: 5335901 - DNA, 20 bp, Homo sapiens
ttctttcacttgatgtttgt

SEQ ID NO: 5335902 - DNA, 13 bp, Homo sapiens
ttctttcagatgt

SEQ ID NO: 5335903 - DNA, 12 bp, Homo sapiens
ttctttcagcca

SEQ ID NO: 5335904 - DNA, 14 bp, Homo sapiens
ttctttcattttct

SEQ ID NO: 5335905 - DNA, 14 bp, Homo sapiens
ttctttccaaaggt

SEQ ID NO: 5335906 - DNA, 12 bp, Homo sapiens
ttctttccagaa

SEQ ID NO: 5335907 - DNA, 17 bp, Homo sapiens
ttctttccatgcagact

SEQ ID NO: 5335908 - DNA, 15 bp, Homo sapiens
ttctttccatttgca

SEQ ID NO: 5335909 - DNA, 19 bp, Homo sapiens
ttctttcccatgtatttgt

SEQ ID NO: 5335910 - DNA, 13 bp, Homo sapiens
ttctttccccaga

SEQ ID NO: 5335911 - DNA, 12 bp, Homo sapiens
ttctttccctgg

SEQ ID NO: 5335912 - DNA, 21 bp, Homo sapiens
ttctttcctaccttggtcctg

SEQ ID NO: 5335913 - DNA, 13 bp, Homo sapiens
ttctttcctccca

SEQ ID NO: 5335914 - DNA, 14 bp, Homo sapiens
ttctttcctcccag

SEQ ID NO: 5335915 - DNA, 16 bp, Homo sapiens
ttctttccttcccaat

SEQ ID NO: 5335916 - DNA, 14 bp, Homo sapiens
ttctttccttcctt

SEQ ID NO: 5335917 - DNA, 21 bp, Homo sapiens
ttctttccttccttttttcct

SEQ ID NO: 5335918 - DNA, 18 bp, Homo sapiens
ttctttcctttactcctg

SEQ ID NO: 5335919 - DNA, 18 bp, Homo sapiens
ttctttctaaaacacatt

SEQ ID NO: 5335920 - DNA, 13 bp, Homo sapiens
ttctttctagaaa

SEQ ID NO: 5335921 - DNA, 22 bp, Homo sapiens
ttctttctagtggtctttgtaa

SEQ ID NO: 5335922 - DNA, 12 bp, Homo sapiens
ttctttctatgt

SEQ ID NO: 5335923 - DNA, 23 bp, Homo sapiens
ttctttctcttccctccttccct

SEQ ID NO: 5335924 - DNA, 21 bp, Homo sapiens
ttctttctgctctatactgtg

SEQ ID NO: 5335925 - DNA, 12 bp, Homo sapiens
ttctttctgctg

SEQ ID NO: 5335926 - DNA, 13 bp, Homo sapiens
ttctttctgctgg

SEQ ID NO: 5335927 - DNA, 12 bp, Homo sapiens
ttctttctggac

SEQ ID NO: 5335928 - DNA, 17 bp, Homo sapiens
ttctttctggctatgca

SEQ ID NO: 5335929 - DNA, 12 bp, Homo sapiens
ttctttctgtct

SEQ ID NO: 5335930 - DNA, 15 bp, Homo sapiens
ttctttctgtcttta

SEQ ID NO: 5335931 - DNA, 15 bp, Homo sapiens
ttctttcttagaaat

SEQ ID NO: 5335932 - DNA, 13 bp, Homo sapiens
ttctttcttcctc

SEQ ID NO: 5335933 - DNA, 15 bp, Homo sapiens
ttctttcttcctctg

SEQ ID NO: 5335934 - DNA, 12 bp, Homo sapiens
ttctttcttggt

SEQ ID NO: 5335935 - DNA, 13 bp, Homo sapiens
ttctttctttgtt

SEQ ID NO: 5335936 - DNA, 22 bp, Homo sapiens
ttctttcttttaagcagaccca

SEQ ID NO: 5335937 - DNA, 13 bp, Homo sapiens
ttctttcttttta

SEQ ID NO: 5335938 - DNA, 20 bp, Homo sapiens
ttctttgaaaaaaaataaat

SEQ ID NO: 5335939 - DNA, 18 bp, Homo sapiens
ttctttgaaatgctaaac

SEQ ID NO: 5335940 - DNA, 13 bp, Homo sapiens
ttctttgaagtta

SEQ ID NO: 5335941 - DNA, 17 bp, Homo sapiens
ttctttgaataaatgtc

SEQ ID NO: 5335942 - DNA, 11 bp, Homo sapiens
ttctttgaatg

SEQ ID NO: 5335943 - DNA, 22 bp, Homo sapiens
ttctttgaattttcattttaca

SEQ ID NO: 5335944 - DNA, 12 bp, Homo sapiens
ttctttgagaag

SEQ ID NO: 5335945 - DNA, 22 bp, Homo sapiens
ttctttgataagatgaggaaat

SEQ ID NO: 5335946 - DNA, 15 bp, Homo sapiens
ttctttgatagtgta

SEQ ID NO: 5335947 - DNA, 15 bp, Homo sapiens
ttctttgatcatgaa

SEQ ID NO: 5335948 - DNA, 22 bp, Homo sapiens
ttctttgatcatgaataactga

SEQ ID NO: 5335949 - DNA, 18 bp, Homo sapiens
ttctttgatctggacaga

SEQ ID NO: 5335950 - DNA, 21 bp, Homo sapiens
ttctttgatgttaacacattt

SEQ ID NO: 5335951 - DNA, 16 bp, Homo sapiens
ttctttgatttaactg

SEQ ID NO: 5335952 - DNA, 18 bp, Homo sapiens
ttctttgatttgtaccat

SEQ ID NO: 5335953 - DNA, 19 bp, Homo sapiens
ttctttgatttgtaccatt

SEQ ID NO: 5335954 - DNA, 16 bp, Homo sapiens
ttctttgcaaagtatt

SEQ ID NO: 5335955 - DNA, 22 bp, Homo sapiens
ttctttgcaccaaagacatcag

SEQ ID NO: 5335956 - DNA, 18 bp, Homo sapiens
ttctttgcagctgcccag

SEQ ID NO: 5335957 - DNA, 13 bp, Homo sapiens
ttctttgcagtga

SEQ ID NO: 5335958 - DNA, 15 bp, Homo sapiens
ttctttgcagtgaag

SEQ ID NO: 5335959 - DNA, 13 bp, Homo sapiens
ttctttgccagag

SEQ ID NO: 5335960 - DNA, 22 bp, Homo sapiens
ttgaactttgacctctgcagca

SEQ ID NO: 5335961 - DNA, 16 bp, Homo sapiens
ttgaactttgggtacc

SEQ ID NO: 5335962 - DNA, 15 bp, Homo sapiens
ttgaactttttttaa

SEQ ID NO: 5335963 - DNA, 15 bp, Homo sapiens
ttgaagaactgcact

SEQ ID NO: 5335964 - DNA, 16 bp, Homo sapiens
ttgaagaactgcactt

SEQ ID NO: 5335965 - DNA, 22 bp, Homo sapiens
ttgaagaagaaccagcccagcc

SEQ ID NO: 5335966 - DNA, 23 bp, Homo sapiens
ttgaagaagaaccagcccagcct

SEQ ID NO: 5335967 - DNA, 14 bp, Homo sapiens
ttgaagaaggcaag

SEQ ID NO: 5335968 - DNA, 16 bp, Homo sapiens
ttgaagaaggcaaggc

SEQ ID NO: 5335969 - DNA, 14 bp, Homo sapiens
ttgaagaaggtgga

SEQ ID NO: 5335970 - DNA, 21 bp, Homo sapiens
ttgaagaatatttaagaaaag

SEQ ID NO: 5335971 - DNA, 15 bp, Homo sapiens
ttgaagaatctgccc

SEQ ID NO: 5335972 - DNA, 13 bp, Homo sapiens
ttgaagaatgaac

SEQ ID NO: 5335973 - DNA, 15 bp, Homo sapiens
ttgaagaatgaacaa

SEQ ID NO: 5335974 - DNA, 14 bp, Homo sapiens
ttgaagaattgtag

SEQ ID NO: 5335975 - DNA, 15 bp, Homo sapiens
ttgaagacaatttga

SEQ ID NO: 5335976 - DNA, 16 bp, Homo sapiens
ttgaagacaatttgat

SEQ ID NO: 5335977 - DNA, 19 bp, Homo sapiens
ttgaagacacagcctcccc

SEQ ID NO: 5335978 - DNA, 15 bp, Homo sapiens
ttgaagacactgaaa

SEQ ID NO: 5335979 - DNA, 22 bp, Homo sapiens
ttgaagacactgaaatatacac

SEQ ID NO: 5335980 - DNA, 18 bp, Homo sapiens
ttgaagaccaatcaaata

SEQ ID NO: 5335981 - DNA, 19 bp, Homo sapiens
ttgaagaccaatcaaatat

SEQ ID NO: 5335982 - DNA, 18 bp, Homo sapiens
ttgaagacggaaaacaat

SEQ ID NO: 5335983 - DNA, 13 bp, Homo sapiens
ttgaagacgtgga

SEQ ID NO: 5335984 - DNA, 20 bp, Homo sapiens
ttgaagacttcaaaatattg

SEQ ID NO: 5335985 - DNA, 21 bp, Homo sapiens
ttgaagacttcctctctaccc

SEQ ID NO: 5335986 - DNA, 18 bp, Homo sapiens
ttgaagagaaaaaagtca

SEQ ID NO: 5335987 - DNA, 19 bp, Homo sapiens
ttgaagagaaaaaagtcac

SEQ ID NO: 5335988 - DNA, 17 bp, Homo sapiens
ttgaagagagagctgag

SEQ ID NO: 5335989 - DNA, 18 bp, Homo sapiens
ttgaagagcctgacaagt

SEQ ID NO: 5335990 - DNA, 13 bp, Homo sapiens
ttgaagaggaaaa

SEQ ID NO: 5335991 - DNA, 14 bp, Homo sapiens
ttgaagagtgaaat

SEQ ID NO: 5335992 - DNA, 14 bp, Homo sapiens
ttgaagatacacaa

SEQ ID NO: 5335993 - DNA, 18 bp, Homo sapiens
ttgaagatacacaagagg

SEQ ID NO: 5335994 - DNA, 14 bp, Homo sapiens
ttgaagatgctgcc

SEQ ID NO: 5335995 - DNA, 16 bp, Homo sapiens
ttgaagatgtccccca

SEQ ID NO: 5335996 - DNA, 13 bp, Homo sapiens
ttgaagattcagg

SEQ ID NO: 5335997 - DNA, 22 bp, Homo sapiens
ttgaagattctatgttaatatt

SEQ ID NO: 5335998 - DNA, 11 bp, Homo sapiens
ttgaagcaaat

SEQ ID NO: 5335999 - DNA, 19 bp, Homo sapiens
ttgaagcaactacaacttc

SEQ ID NO: 5336000 - DNA, 12 bp, Homo sapiens
ttgaagcagagt

SEQ ID NO: 5336001 - DNA, 19 bp, Homo sapiens
ttgaagcatagataatatt

SEQ ID NO: 5336002 - DNA, 23 bp, Homo sapiens
ttgaagcatagataatattgttt

SEQ ID NO: 5336003 - DNA, 19 bp, Homo sapiens
ttgaagcatgctctgtaag

SEQ ID NO: 5336004 - DNA, 16 bp, Homo sapiens
ttgaagcatttcaaag

SEQ ID NO: 5336005 - DNA, 22 bp, Homo sapiens
ttgaagcatttcaaagccctgc

SEQ ID NO: 5336006 - DNA, 23 bp, Homo sapiens
ttgaagccaaactgttggaagtt

SEQ ID NO: 5336007 - DNA, 14 bp, Homo sapiens
ttgaagccaaagaa

SEQ ID NO: 5336008 - DNA, 17 bp, Homo sapiens
ttgaagccgactctggc

SEQ ID NO: 5336009 - DNA, 16 bp, Homo sapiens
ttgaagccgctcccgg

SEQ ID NO: 5336010 - DNA, 17 bp, Homo sapiens
ttgaagcctaaatttgt

SEQ ID NO: 5336011 - DNA, 19 bp, Homo sapiens
ttgaagcctaaatttgtgc

SEQ ID NO: 5336012 - DNA, 13 bp, Homo sapiens
ttgaagcctgctc

SEQ ID NO: 5336013 - DNA, 15 bp, Homo sapiens
ttgaagccttttgtt

SEQ ID NO: 5336014 - DNA, 13 bp, Homo sapiens
ttgaagccttttt

SEQ ID NO: 5336015 - DNA, 14 bp, Homo sapiens
ttgaagctaagatt

SEQ ID NO: 5336016 - DNA, 15 bp, Homo sapiens
ttgaagctaattatt

SEQ ID NO: 5336017 - DNA, 20 bp, Homo sapiens
ttgaagctcaactgttgcca

SEQ ID NO: 5336018 - DNA, 15 bp, Homo sapiens
ttgaagctcagaaag

SEQ ID NO: 5336019 - DNA, 13 bp, Homo sapiens
ttgaagctctggt

SEQ ID NO: 5336020 - DNA, 14 bp, Homo sapiens
ttgaagctgaaaat

SEQ ID NO: 5336021 - DNA, 16 bp, Homo sapiens
ttgaagcttgtatctg

SEQ ID NO: 5336022 - DNA, 16 bp, Homo sapiens
ttgaaggaaaaattca

SEQ ID NO: 5336023 - DNA, 17 bp, Homo sapiens
ttgaaggaaaatgatac

SEQ ID NO: 5336024 - DNA, 13 bp, Homo sapiens
ttgaaggaaacag

SEQ ID NO: 5336025 - DNA, 17 bp, Homo sapiens
ttgaaggaaagatttgt

SEQ ID NO: 5336026 - DNA, 21 bp, Homo sapiens
ttgaaggaaagctatatctat

SEQ ID NO: 5336027 - DNA, 20 bp, Homo sapiens
ttgaaggaacagtgctgttc

SEQ ID NO: 5336028 - DNA, 20 bp, Homo sapiens
ttgaaggaacttaaaacttt

SEQ ID NO: 5336029 - DNA, 23 bp, Homo sapiens
ttgaaggaatacaatatatagct

SEQ ID NO: 5336030 - DNA, 19 bp, Homo sapiens
ttgaaggacaacagcatct

SEQ ID NO: 5336031 - DNA, 21 bp, Homo sapiens
ttgaaggactaatagaaaagt

SEQ ID NO: 5336032 - DNA, 16 bp, Homo sapiens
ttgaaggagaacctgt

SEQ ID NO: 5336033 - DNA, 14 bp, Homo sapiens
ttgaaggatgctgt

SEQ ID NO: 5336034 - DNA, 21 bp, Homo sapiens
ttgaaggatgctgtcttcgta

SEQ ID NO: 5336035 - DNA, 17 bp, Homo sapiens
ttgaaggattgcatcct

SEQ ID NO: 5336036 - DNA, 15 bp, Homo sapiens
ttgaaggcagaaagc

SEQ ID NO: 5336037 - DNA, 16 bp, Homo sapiens
ttgaaggcagtctgaa

SEQ ID NO: 5336038 - DNA, 18 bp, Homo sapiens
ttgaaggcgaggctgccc

SEQ ID NO: 5336039 - DNA, 20 bp, Homo sapiens
ttgaagggaaaagggatgat

SEQ ID NO: 5336040 - DNA, 15 bp, Homo sapiens
ttgaagggaaatcaa

SEQ ID NO: 5336041 - DNA, 17 bp, Homo sapiens
ttgaagggaaatcaatt

SEQ ID NO: 5336042 - DNA, 13 bp, Homo sapiens
ttgaagggagaag

SEQ ID NO: 5336043 - DNA, 18 bp, Homo sapiens
ttgaagggagaagacact

SEQ ID NO: 5336044 - DNA, 20 bp, Homo sapiens
ttgaagggccagagccaggg

SEQ ID NO: 5336045 - DNA, 15 bp, Homo sapiens
ttgaagggcccagga

SEQ ID NO: 5336046 - DNA, 23 bp, Homo sapiens
ttgaagggctttattaaagaaat

SEQ ID NO: 5336047 - DNA, 14 bp, Homo sapiens
ttgaaggggagaga

SEQ ID NO: 5336048 - DNA, 22 bp, Homo sapiens
ttgaaggggcttctaatgaccc

SEQ ID NO: 5336049 - DNA, 18 bp, Homo sapiens
ttgaaggtaataaataca

SEQ ID NO: 5336050 - DNA, 19 bp, Homo sapiens
ttgaaggtagaatgttttc

SEQ ID NO: 5336051 - DNA, 16 bp, Homo sapiens
ttgaaggtcacagaag

SEQ ID NO: 5336052 - DNA, 22 bp, Homo sapiens
ttgaaggtgataagggaaaaga

SEQ ID NO: 5336053 - DNA, 15 bp, Homo sapiens
ttgaaggtgctgcca

SEQ ID NO: 5336054 - DNA, 14 bp, Homo sapiens
ttgaaggtttttga

SEQ ID NO: 5336055 - DNA, 15 bp, Homo sapiens
ttgaagtaaactgca

SEQ ID NO: 5336056 - DNA, 18 bp, Homo sapiens
ttgaagtaactataacaa

SEQ ID NO: 5336057 - DNA, 12 bp, Homo sapiens
ttgaagtaatga

SEQ ID NO: 5336058 - DNA, 16 bp, Homo sapiens
ttgaagtaatgaattt

SEQ ID NO: 5336059 - DNA, 17 bp, Homo sapiens
ttgaagtacttaacata

SEQ ID NO: 5336060 - DNA, 18 bp, Homo sapiens
ttgaagtatggtgtgttc

SEQ ID NO: 5336061 - DNA, 19 bp, Homo sapiens
ttgaagtatggtgtgttca

SEQ ID NO: 5336062 - DNA, 12 bp, Homo sapiens
ttgaagtcagcc

SEQ ID NO: 5336063 - DNA, 14 bp, Homo sapiens
ttgaagtcagccac

SEQ ID NO: 5336064 - DNA, 15 bp, Homo sapiens
ttgaagtcatgctcc

SEQ ID NO: 5336065 - DNA, 11 bp, Homo sapiens
ttgaagtcttg

SEQ ID NO: 5336066 - DNA, 20 bp, Homo sapiens
ttgaagtgactgttgtacca

SEQ ID NO: 5336067 - DNA, 17 bp, Homo sapiens
ttgaagtgcatgttaaa

SEQ ID NO: 5336068 - DNA, 18 bp, Homo sapiens
ttgaagtgcatgttaaaa

SEQ ID NO: 5336069 - DNA, 22 bp, Homo sapiens
ttgaagtgcctctgattctatg

SEQ ID NO: 5336070 - DNA, 19 bp, Homo sapiens
ttgaagtggtttctaagat

SEQ ID NO: 5336071 - DNA, 16 bp, Homo sapiens
ttgaagtgtcttctgt

SEQ ID NO: 5336072 - DNA, 23 bp, Homo sapiens
ttgaagttagctttaacttaaat

SEQ ID NO: 5336073 - DNA, 19 bp, Homo sapiens
ttgaagttatttagaaata

SEQ ID NO: 5336074 - DNA, 14 bp, Homo sapiens
ttgaagttctgaaa

SEQ ID NO: 5336075 - DNA, 19 bp, Homo sapiens
ttgaagttgggtgtttcca

SEQ ID NO: 5336076 - DNA, 23 bp, Homo sapiens
ttgaagttggtttagctttggaa

SEQ ID NO: 5336077 - DNA, 22 bp, Homo sapiens
ttgaagttgtgttaacaatgca

SEQ ID NO: 5336078 - DNA, 21 bp, Homo sapiens
ttgaagttgtttatcaacttc

SEQ ID NO: 5336079 - DNA, 14 bp, Homo sapiens
ttgaagtttacatt

SEQ ID NO: 5336080 - DNA, 15 bp, Homo sapiens
ttgaagtttacattt

SEQ ID NO: 5336081 - DNA, 12 bp, Homo sapiens
ttgaagtttgaa

SEQ ID NO: 5336082 - DNA, 22 bp, Homo sapiens
ttgaataaaaaacatttgtaca

SEQ ID NO: 5336083 - DNA, 23 bp, Homo sapiens
ttgaataaaaaacatttgtacat

SEQ ID NO: 5336084 - DNA, 13 bp, Homo sapiens
ttgaataaaaagt

SEQ ID NO: 5336085 - DNA, 14 bp, Homo sapiens
ttgaataaaaagtg

SEQ ID NO: 5336086 - DNA, 15 bp, Homo sapiens
ttgaataaaaagtga

SEQ ID NO: 5336087 - DNA, 19 bp, Homo sapiens
ttgaataaaaagtgaactt

SEQ ID NO: 5336088 - DNA, 21 bp, Homo sapiens
ttgaataaaaagtgaactttt

SEQ ID NO: 5336089 - DNA, 16 bp, Homo sapiens
ttgaataaaagtgcac

SEQ ID NO: 5336090 - DNA, 12 bp, Homo sapiens
ttgaataaacat

SEQ ID NO: 5336091 - DNA, 18 bp, Homo sapiens
ttgaataaacataaaagc

SEQ ID NO: 5336092 - DNA, 12 bp, Homo sapiens
ttgaataaacta

SEQ ID NO: 5336093 - DNA, 22 bp, Homo sapiens
ttgaataaactccccagcgtat

SEQ ID NO: 5336094 - DNA, 16 bp, Homo sapiens
ttgaataaactctccc

SEQ ID NO: 5336095 - DNA, 23 bp, Homo sapiens
ttgaataaactctcccctttctt

SEQ ID NO: 5336096 - DNA, 12 bp, Homo sapiens
ttgaataaagag

SEQ ID NO: 5336097 - DNA, 21 bp, Homo sapiens
ttgaataaagtattctagtgt

SEQ ID NO: 5336098 - DNA, 22 bp, Homo sapiens
ttgaataaatgagaaaaaatgc

SEQ ID NO: 5336099 - DNA, 19 bp, Homo sapiens
ttgaataaatgtatctgaa

SEQ ID NO: 5336100 - DNA, 20 bp, Homo sapiens
ttgaataaatgtatctgaat

SEQ ID NO: 5336101 - DNA, 12 bp, Homo sapiens
ttgaataataag

SEQ ID NO: 5336102 - DNA, 15 bp, Homo sapiens
ttgaataatgacaga

SEQ ID NO: 5336103 - DNA, 12 bp, Homo sapiens
ttgaataatggt

SEQ ID NO: 5336104 - DNA, 19 bp, Homo sapiens
ttgaataatgtctagattt

SEQ ID NO: 5336105 - DNA, 16 bp, Homo sapiens
ttgaatacaggtaact

SEQ ID NO: 5336106 - DNA, 18 bp, Homo sapiens
ttgaatacatttgtattt

SEQ ID NO: 5336107 - DNA, 19 bp, Homo sapiens
ttgaatacatttgtattta

SEQ ID NO: 5336108 - DNA, 16 bp, Homo sapiens
ttgaataccattaaaa

SEQ ID NO: 5336109 - DNA, 19 bp, Homo sapiens
ttgaataccattaaaactg

SEQ ID NO: 5336110 - DNA, 21 bp, Homo sapiens
ttgaatacccccagagacctt

SEQ ID NO: 5336111 - DNA, 16 bp, Homo sapiens
ttgaatactctgccct

SEQ ID NO: 5336112 - DNA, 17 bp, Homo sapiens
ttgaatactgtctgtat

SEQ ID NO: 5336113 - DNA, 12 bp, Homo sapiens
ttgaatacttga

SEQ ID NO: 5336114 - DNA, 16 bp, Homo sapiens
ttgaatacttgaacca

SEQ ID NO: 5336115 - DNA, 15 bp, Homo sapiens
ttgaatactttgaat

SEQ ID NO: 5336116 - DNA, 18 bp, Homo sapiens
ttgaatactttgaatgtg

SEQ ID NO: 5336117 - DNA, 17 bp, Homo sapiens
ttgaatagattttctct

SEQ ID NO: 5336118 - DNA, 14 bp, Homo sapiens
ttgaatagcttatg

SEQ ID NO: 5336119 - DNA, 19 bp, Homo sapiens
ttgaatagtggaacatttt

SEQ ID NO: 5336120 - DNA, 17 bp, Homo sapiens
ttgaatagtttatttct

SEQ ID NO: 5336121 - DNA, 18 bp, Homo sapiens
ttgaatataagaaaatgc

SEQ ID NO: 5336122 - DNA, 20 bp, Homo sapiens
ttgaatataagaaaatgctt

SEQ ID NO: 5336123 - DNA, 15 bp, Homo sapiens
ttgaatataatagat

SEQ ID NO: 5336124 - DNA, 20 bp, Homo sapiens
ttgaatataatatatttgtg

SEQ ID NO: 5336125 - DNA, 21 bp, Homo sapiens
ttgaatataatatatttgtgt

SEQ ID NO: 5336126 - DNA, 16 bp, Homo sapiens
ttgaatatagcctgcc

SEQ ID NO: 5336127 - DNA, 12 bp, Homo sapiens
ttgaatatatat

SEQ ID NO: 5336128 - DNA, 22 bp, Homo sapiens
ttgaatatctttcgataaacaa

SEQ ID NO: 5336129 - DNA, 19 bp, Homo sapiens
ttgaatatgccttaattta

SEQ ID NO: 5336130 - DNA, 15 bp, Homo sapiens
ttgaatatggacaag

SEQ ID NO: 5336131 - DNA, 21 bp, Homo sapiens
ttgaatattactcctattttt

SEQ ID NO: 5336132 - DNA, 23 bp, Homo sapiens
ttgaatattactcctatttttgt

SEQ ID NO: 5336133 - DNA, 14 bp, Homo sapiens
ttgaatattatata

SEQ ID NO: 5336134 - DNA, 13 bp, Homo sapiens
ttgaatattgtgt

SEQ ID NO: 5336135 - DNA, 16 bp, Homo sapiens
ttgaatatttaagaaa

SEQ ID NO: 5336136 - DNA, 21 bp, Homo sapiens
ttgaatatttattcagtgact

SEQ ID NO: 5336137 - DNA, 16 bp, Homo sapiens
ttgaatattttttgaa

SEQ ID NO: 5336138 - DNA, 10 bp, Homo sapiens
ttgaatcaat

SEQ ID NO: 5336139 - DNA, 22 bp, Homo sapiens
ttgaatcaataatatattttct

SEQ ID NO: 5336140 - DNA, 22 bp, Homo sapiens
ttgaatcagtttttaaaatatt

SEQ ID NO: 5336141 - DNA, 20 bp, Homo sapiens
ttgaatccaaatctgtcctc

SEQ ID NO: 5336142 - DNA, 21 bp, Homo sapiens
ttgaatctatgaacctgaaaa

SEQ ID NO: 5336143 - DNA, 18 bp, Homo sapiens
ttgaatctatttcactta

SEQ ID NO: 5336144 - DNA, 18 bp, Homo sapiens
ttgaatctctaaaatgct

SEQ ID NO: 5336145 - DNA, 23 bp, Homo sapiens
ttgaatctgattggacattttct

SEQ ID NO: 5336146 - DNA, 23 bp, Homo sapiens
ttgaatcttgtctcaatgctcat

SEQ ID NO: 5336147 - DNA, 11 bp, Homo sapiens
ttgaatgaaaa

SEQ ID NO: 5336148 - DNA, 15 bp, Homo sapiens
ttgaatgaaattcca

SEQ ID NO: 5336149 - DNA, 21 bp, Homo sapiens
ttgaatgacaacagaagcttc

SEQ ID NO: 5336150 - DNA, 13 bp, Homo sapiens
ttgaatgactgac

SEQ ID NO: 5336151 - DNA, 22 bp, Homo sapiens
ttgaatgagacctggaacaaat

SEQ ID NO: 5336152 - DNA, 23 bp, Homo sapiens
ttgaatgagatgattcagaaggg

SEQ ID NO: 5336153 - DNA, 12 bp, Homo sapiens
ttgaatgataat

SEQ ID NO: 5336154 - DNA, 16 bp, Homo sapiens
ttgaatgcaaaccata

SEQ ID NO: 5336155 - DNA, 23 bp, Homo sapiens
ttgaatgcattttgtttggtatt

SEQ ID NO: 5336156 - DNA, 22 bp, Homo sapiens
ttgaatgccttatttttgaatt

SEQ ID NO: 5336157 - DNA, 13 bp, Homo sapiens
ttgaatgctgcca

SEQ ID NO: 5336158 - DNA, 23 bp, Homo sapiens
ttgaatgctgccagtgtggagtg

SEQ ID NO: 5336159 - DNA, 22 bp, Homo sapiens
ttgaatggagattctgattcag

SEQ ID NO: 5336160 - DNA, 17 bp, Homo sapiens
ttgaatggcttttctta

SEQ ID NO: 5336161 - DNA, 18 bp, Homo sapiens
ttgaatgggggaggccca

SEQ ID NO: 5336162 - DNA, 20 bp, Homo sapiens
ttgaatggtgttgtatgcct

SEQ ID NO: 5336163 - DNA, 22 bp, Homo sapiens
ttgaatggttaataaaactgca

SEQ ID NO: 5336164 - DNA, 16 bp, Homo sapiens
ttgaatgtaaaacagg

SEQ ID NO: 5336165 - DNA, 13 bp, Homo sapiens
ttgaatgtacaaa

SEQ ID NO: 5336166 - DNA, 12 bp, Homo sapiens
ttgaatgtacct

SEQ ID NO: 5336167 - DNA, 15 bp, Homo sapiens
ttgaatgtattcttt

SEQ ID NO: 5336168 - DNA, 20 bp, Homo sapiens
ttgaatgtattgttctgttt

SEQ ID NO: 5336169 - DNA, 14 bp, Homo sapiens
ttgaatgtattttg

SEQ ID NO: 5336170 - DNA, 15 bp, Homo sapiens
ttgaatgtattttgg

SEQ ID NO: 5336171 - DNA, 16 bp, Homo sapiens
ttgaatgtcaatcata

SEQ ID NO: 5336172 - DNA, 13 bp, Homo sapiens
ttgaatgtccaaa

SEQ ID NO: 5336173 - DNA, 23 bp, Homo sapiens
ttgaatgtccaaaatttatattt

SEQ ID NO: 5336174 - DNA, 21 bp, Homo sapiens
ttgaatgtccccattctataa

SEQ ID NO: 5336175 - DNA, 16 bp, Homo sapiens
ttgaatgtcttttgaa

SEQ ID NO: 5336176 - DNA, 20 bp, Homo sapiens
ttgaatgttaaataaattgt

SEQ ID NO: 5336177 - DNA, 17 bp, Homo sapiens
ttgaatgttaagaattg

SEQ ID NO: 5336178 - DNA, 14 bp, Homo sapiens
ttgaatgttaagca

SEQ ID NO: 5336179 - DNA, 17 bp, Homo sapiens
ttgaatgttagatgctt

SEQ ID NO: 5336180 - DNA, 16 bp, Homo sapiens
ttgaatgtttatgttc

SEQ ID NO: 5336181 - DNA, 21 bp, Homo sapiens
ttgaatgttttcaaaaccaag

SEQ ID NO: 5336182 - DNA, 22 bp, Homo sapiens
ttgaattaaattaggaataaat

SEQ ID NO: 5336183 - DNA, 12 bp, Homo sapiens
ttgaattacaac

SEQ ID NO: 5336184 - DNA, 12 bp, Homo sapiens
ttgaattacaga

SEQ ID NO: 5336185 - DNA, 21 bp, Homo sapiens
ttgaattacagggaagaaatc

SEQ ID NO: 5336186 - DNA, 23 bp, Homo sapiens
ttgaattacagggaagaaatcaa

SEQ ID NO: 5336187 - DNA, 16 bp, Homo sapiens
ttgaattagaaaatta

SEQ ID NO: 5336188 - DNA, 14 bp, Homo sapiens
ttgaattagaaaca

SEQ ID NO: 5336189 - DNA, 23 bp, Homo sapiens
ttgaattagattatttctgtatt

SEQ ID NO: 5336190 - DNA, 18 bp, Homo sapiens
ttgaattagtatttcagt

SEQ ID NO: 5336191 - DNA, 23 bp, Homo sapiens
ttgaattatccacatgaaaataa

SEQ ID NO: 5336192 - DNA, 13 bp, Homo sapiens
ttgaattatcttg

SEQ ID NO: 5336193 - DNA, 22 bp, Homo sapiens
ttgaattatcttggttgaaaat

SEQ ID NO: 5336194 - DNA, 13 bp, Homo sapiens
ttgaattcattat

SEQ ID NO: 5336195 - DNA, 12 bp, Homo sapiens
ttgaattcgttt

SEQ ID NO: 5336196 - DNA, 15 bp, Homo sapiens
ttgaattcgtttctg

SEQ ID NO: 5336197 - DNA, 21 bp, Homo sapiens
ttgaattcttggttgaggaaa

SEQ ID NO: 5336198 - DNA, 20 bp, Homo sapiens
ttgaattgggggagtcatgg

SEQ ID NO: 5336199 - DNA, 19 bp, Homo sapiens
ttgaattgtgtattgatgc

SEQ ID NO: 5336200 - DNA, 21 bp, Homo sapiens
ttgaattgtgtcttaatctct

SEQ ID NO: 5336201 - DNA, 21 bp, Homo sapiens
ttgaattgtgtggagaagtgt

SEQ ID NO: 5336202 - DNA, 13 bp, Homo sapiens
ttgaattgttaca

SEQ ID NO: 5336203 - DNA, 18 bp, Homo sapiens
ttgaattgttatgaaaat

SEQ ID NO: 5336204 - DNA, 12 bp, Homo sapiens
ttgaatttaaca

SEQ ID NO: 5336205 - DNA, 16 bp, Homo sapiens
ttgaatttaacaatgc

SEQ ID NO: 5336206 - DNA, 16 bp, Homo sapiens
ttgaatttcctatctg

SEQ ID NO: 5336207 - DNA, 12 bp, Homo sapiens
ttgaatttgcat

SEQ ID NO: 5336208 - DNA, 15 bp, Homo sapiens
ttgaattttattgaa

SEQ ID NO: 5336209 - DNA, 18 bp, Homo sapiens
ttgaattttcaaaggctt

SEQ ID NO: 5336210 - DNA, 16 bp, Homo sapiens
ttgaattttcaagcat

SEQ ID NO: 5336211 - DNA, 14 bp, Homo sapiens
ttgaattttcattt

SEQ ID NO: 5336212 - DNA, 15 bp, Homo sapiens
ttgaattttcatttt

SEQ ID NO: 5336213 - DNA, 18 bp, Homo sapiens
ttgaattttcccactgca

SEQ ID NO: 5336214 - DNA, 22 bp, Homo sapiens
ttgaattttgtttttattttca

SEQ ID NO: 5336215 - DNA, 16 bp, Homo sapiens
ttgaatttttcctatg

SEQ ID NO: 5336216 - DNA, 23 bp, Homo sapiens
ttgaatttttttctgcacagctt

SEQ ID NO: 5336217 - DNA, 15 bp, Homo sapiens
ttgacaaaaatgttt

SEQ ID NO: 5336218 - DNA, 21 bp, Homo sapiens
ttgacaaaacctaacttgcgc

SEQ ID NO: 5336219 - DNA, 15 bp, Homo sapiens
ttgacaaaataacat

SEQ ID NO: 5336220 - DNA, 13 bp, Homo sapiens
ttgacaaacacaa

SEQ ID NO: 5336221 - DNA, 18 bp, Homo sapiens
ttgacaaacacaattcta

SEQ ID NO: 5336222 - DNA, 14 bp, Homo sapiens
ttgacaaagtgcct

SEQ ID NO: 5336223 - DNA, 13 bp, Homo sapiens
ttgacaaatctgt

SEQ ID NO: 5336224 - DNA, 22 bp, Homo sapiens
ttgacaaatctgtgtatattat

SEQ ID NO: 5336225 - DNA, 14 bp, Homo sapiens
ttgacaacaaatta

SEQ ID NO: 5336226 - DNA, 16 bp, Homo sapiens
ttgacaacacatgtgg

SEQ ID NO: 5336227 - DNA, 12 bp, Homo sapiens
ttgacaacatct

SEQ ID NO: 5336228 - DNA, 13 bp, Homo sapiens
ttgacaacatggc

SEQ ID NO: 5336229 - DNA, 22 bp, Homo sapiens
ttgacaacatggcttctccttt

SEQ ID NO: 5336230 - DNA, 23 bp, Homo sapiens
ttgacaacatggcttctcctttg

SEQ ID NO: 5336231 - DNA, 18 bp, Homo sapiens
ttgacaacattttattac

SEQ ID NO: 5336232 - DNA, 16 bp, Homo sapiens
ttgacaaccatgagac

SEQ ID NO: 5336233 - DNA, 14 bp, Homo sapiens
ttgacaacctagaa

SEQ ID NO: 5336234 - DNA, 17 bp, Homo sapiens
ttgacaacctagaatgt

SEQ ID NO: 5336235 - DNA, 19 bp, Homo sapiens
ttgacaagctaggaaagag

SEQ ID NO: 5336236 - DNA, 14 bp, Homo sapiens
ttgacaagctggct

SEQ ID NO: 5336237 - DNA, 18 bp, Homo sapiens
ttgacaaggtcaaattta

SEQ ID NO: 5336238 - DNA, 20 bp, Homo sapiens
ttgacaaggtgtttctctgt

SEQ ID NO: 5336239 - DNA, 22 bp, Homo sapiens
ttgacaagtcattttaacttta

SEQ ID NO: 5336240 - DNA, 15 bp, Homo sapiens
ttgacaagtgtcttt

SEQ ID NO: 5336241 - DNA, 21 bp, Homo sapiens
ttgacaagttgcgacggagag

SEQ ID NO: 5336242 - DNA, 16 bp, Homo sapiens
ttgacaataaaatatt

SEQ ID NO: 5336243 - DNA, 18 bp, Homo sapiens
ttgacaataaatgtgctt

SEQ ID NO: 5336244 - DNA, 12 bp, Homo sapiens
ttgacaatcaaa

SEQ ID NO: 5336245 - DNA, 18 bp, Homo sapiens
ttgacaatcaaagaaaag

SEQ ID NO: 5336246 - DNA, 15 bp, Homo sapiens
ttgacaattcctaga

SEQ ID NO: 5336247 - DNA, 17 bp, Homo sapiens
ttgacaattctgggtgc

SEQ ID NO: 5336248 - DNA, 16 bp, Homo sapiens
ttgacaattgggagct

SEQ ID NO: 5336249 - DNA, 15 bp, Homo sapiens
ttgacacaattggaa

SEQ ID NO: 5336250 - DNA, 13 bp, Homo sapiens
ttgacacacagca

SEQ ID NO: 5336251 - DNA, 17 bp, Homo sapiens
ttgacacactcaccatt

SEQ ID NO: 5336252 - DNA, 21 bp, Homo sapiens
ttgacacactcaccatttaat

SEQ ID NO: 5336253 - DNA, 11 bp, Homo sapiens
ttgacacagtt

SEQ ID NO: 5336254 - DNA, 17 bp, Homo sapiens
ttgacacatatgaacac

SEQ ID NO: 5336255 - DNA, 19 bp, Homo sapiens
ttgacacatatgaacacag

SEQ ID NO: 5336256 - DNA, 23 bp, Homo sapiens
ttgacacatccgccttttgtata

SEQ ID NO: 5336257 - DNA, 20 bp, Homo sapiens
ttgacacattgcacacacag

SEQ ID NO: 5336258 - DNA, 21 bp, Homo sapiens
ttgacacattgcacacacagt

SEQ ID NO: 5336259 - DNA, 21 bp, Homo sapiens
ttgacaccaaatattttcaag

SEQ ID NO: 5336260 - DNA, 22 bp, Homo sapiens
ttgacaccacttagatttaaag

SEQ ID NO: 5336261 - DNA, 12 bp, Homo sapiens
ttgacaccaggg

SEQ ID NO: 5336262 - DNA, 16 bp, Homo sapiens
ttgacacctagattat

SEQ ID NO: 5336263 - DNA, 20 bp, Homo sapiens
ttgacacctgtcttgaataa

SEQ ID NO: 5336264 - DNA, 18 bp, Homo sapiens
ttgacacggtgaaatcca

SEQ ID NO: 5336265 - DNA, 15 bp, Homo sapiens
ttgacactgaaataa

SEQ ID NO: 5336266 - DNA, 14 bp, Homo sapiens
ttgacactgaactt

SEQ ID NO: 5336267 - DNA, 17 bp, Homo sapiens
ttgacactgactagagt

SEQ ID NO: 5336268 - DNA, 12 bp, Homo sapiens
ttgacactgagc

SEQ ID NO: 5336269 - DNA, 17 bp, Homo sapiens
ttgacactgtccctctt

SEQ ID NO: 5336270 - DNA, 13 bp, Homo sapiens
ttgacactgtttt

SEQ ID NO: 5336271 - DNA, 14 bp, Homo sapiens
ttgacactgttttc

SEQ ID NO: 5336272 - DNA, 19 bp, Homo sapiens
ttgacactgttttccttac

SEQ ID NO: 5336273 - DNA, 17 bp, Homo sapiens
ttgacacttaaaaatgg

SEQ ID NO: 5336274 - DNA, 19 bp, Homo sapiens
ttgacacttaaaaatggtt

SEQ ID NO: 5336275 - DNA, 22 bp, Homo sapiens
ttgacacttatagattgaaatt

SEQ ID NO: 5336276 - DNA, 18 bp, Homo sapiens
ttgacacttccattgttt

SEQ ID NO: 5336277 - DNA, 18 bp, Homo sapiens
ttgacacttttcatatca

SEQ ID NO: 5336278 - DNA, 19 bp, Homo sapiens
ttgacacttttcatatcat

SEQ ID NO: 5336279 - DNA, 15 bp, Homo sapiens
ttgacagaaagcagt

SEQ ID NO: 5336280 - DNA, 16 bp, Homo sapiens
ttgacagaaagcagtt

SEQ ID NO: 5336281 - DNA, 23 bp, Homo sapiens
ttgacagaaccctttgggagcaa

SEQ ID NO: 5336282 - DNA, 17 bp, Homo sapiens
ttgacagactatttgct

SEQ ID NO: 5336283 - DNA, 22 bp, Homo sapiens
ttgacagagttggtgttcataa

SEQ ID NO: 5336284 - DNA, 17 bp, Homo sapiens
ttgacagatcaagctgt

SEQ ID NO: 5336285 - DNA, 23 bp, Homo sapiens
ttgacagcaaaatgttgaagaaa

SEQ ID NO: 5336286 - DNA, 12 bp, Homo sapiens
ttgacagctcag

SEQ ID NO: 5336287 - DNA, 14 bp, Homo sapiens
ttgacagctttgct

SEQ ID NO: 5336288 - DNA, 18 bp, Homo sapiens
ttgacagctttgctgctg

SEQ ID NO: 5336289 - DNA, 12 bp, Homo sapiens
ttgacagggcac

SEQ ID NO: 5336290 - DNA, 19 bp, Homo sapiens
ttgacagggcacaccgggc

SEQ ID NO: 5336291 - DNA, 18 bp, Homo sapiens
ttgacaggtacttggagg

SEQ ID NO: 5336292 - DNA, 19 bp, Homo sapiens
ttgacaggtcttttcaaat

SEQ ID NO: 5336293 - DNA, 14 bp, Homo sapiens
ttgacagtatattt

SEQ ID NO: 5336294 - DNA, 14 bp, Homo sapiens
ttgacagtgagagg

SEQ ID NO: 5336295 - DNA, 14 bp, Homo sapiens
ttgacagtgttttt

SEQ ID NO: 5336296 - DNA, 14 bp, Homo sapiens
ttgacagttactta

SEQ ID NO: 5336297 - DNA, 19 bp, Homo sapiens
ttgacagtttttgacattt

SEQ ID NO: 5336298 - DNA, 15 bp, Homo sapiens
ttgacataaagttga

SEQ ID NO: 5336299 - DNA, 22 bp, Homo sapiens
ttgacataagatggttgaccaa

SEQ ID NO: 5336300 - DNA, 18 bp, Homo sapiens
ttgacataggtcataaag

SEQ ID NO: 5336301 - DNA, 17 bp, Homo sapiens
ttgacatagtctggctg

SEQ ID NO: 5336302 - DNA, 16 bp, Homo sapiens
ttgacatatttaatgt

SEQ ID NO: 5336303 - DNA, 18 bp, Homo sapiens
ttgacatatttaatgttt

SEQ ID NO: 5336304 - DNA, 16 bp, Homo sapiens
ttgacatcaactgcat

SEQ ID NO: 5336305 - DNA, 16 bp, Homo sapiens
ttgacatccaaatcta

SEQ ID NO: 5336306 - DNA, 17 bp, Homo sapiens
ttgacatccaaatctag

SEQ ID NO: 5336307 - DNA, 12 bp, Homo sapiens
ttgacatccagc

SEQ ID NO: 5336308 - DNA, 18 bp, Homo sapiens
ttgacatctaattcaaga

SEQ ID NO: 5336309 - DNA, 20 bp, Homo sapiens
ttgacatgaccctctgtccc

SEQ ID NO: 5336310 - DNA, 15 bp, Homo sapiens
ttgacatgatataca

SEQ ID NO: 5336311 - DNA, 11 bp, Homo sapiens
ttgacatgcac

SEQ ID NO: 5336312 - DNA, 13 bp, Homo sapiens
ttgacatgggaca

SEQ ID NO: 5336313 - DNA, 15 bp, Homo sapiens
ttgacatgggtattt

SEQ ID NO: 5336314 - DNA, 14 bp, Homo sapiens
ttgacatgtacaga

SEQ ID NO: 5336315 - DNA, 22 bp, Homo sapiens
ttgacattatgttttatttaaa

SEQ ID NO: 5336316 - DNA, 11 bp, Homo sapiens
ttgacattcct

SEQ ID NO: 5336317 - DNA, 15 bp, Homo sapiens
ttgaggcattcactg

SEQ ID NO: 5336318 - DNA, 20 bp, Homo sapiens
ttgaggccaagaatattgca

SEQ ID NO: 5336319 - DNA, 15 bp, Homo sapiens
ttgaggccaagatgg

SEQ ID NO: 5336320 - DNA, 15 bp, Homo sapiens
ttgaggccccaactc

SEQ ID NO: 5336321 - DNA, 16 bp, Homo sapiens
ttgaggccgaagctgc

SEQ ID NO: 5336322 - DNA, 18 bp, Homo sapiens
ttgaggccgcatctttct

SEQ ID NO: 5336323 - DNA, 16 bp, Homo sapiens
ttgaggcctgacgtgg

SEQ ID NO: 5336324 - DNA, 17 bp, Homo sapiens
ttgaggctctgtcactg

SEQ ID NO: 5336325 - DNA, 20 bp, Homo sapiens
ttgaggctctgtcactgagc

SEQ ID NO: 5336326 - DNA, 15 bp, Homo sapiens
ttgaggctgcagcag

SEQ ID NO: 5336327 - DNA, 20 bp, Homo sapiens
ttgaggcttatatttgtgta

SEQ ID NO: 5336328 - DNA, 17 bp, Homo sapiens
ttgaggcttctccttct

SEQ ID NO: 5336329 - DNA, 17 bp, Homo sapiens
ttgaggctttgtgttgt

SEQ ID NO: 5336330 - DNA, 18 bp, Homo sapiens
ttgagggaaaacataata

SEQ ID NO: 5336331 - DNA, 14 bp, Homo sapiens
ttgagggaaggttc

SEQ ID NO: 5336332 - DNA, 14 bp, Homo sapiens
ttgagggaatgaca

SEQ ID NO: 5336333 - DNA, 21 bp, Homo sapiens
ttgagggacgactttctttaa

SEQ ID NO: 5336334 - DNA, 20 bp, Homo sapiens
ttgagggacgatctttgaat

SEQ ID NO: 5336335 - DNA, 17 bp, Homo sapiens
ttgagggactgcctctg

SEQ ID NO: 5336336 - DNA, 20 bp, Homo sapiens
ttgagggactgcctctgcca

SEQ ID NO: 5336337 - DNA, 22 bp, Homo sapiens
ttgagggagctgggagaccctc

SEQ ID NO: 5336338 - DNA, 12 bp, Homo sapiens
ttgagggagggc

SEQ ID NO: 5336339 - DNA, 13 bp, Homo sapiens
ttgagggatgctg

SEQ ID NO: 5336340 - DNA, 12 bp, Homo sapiens
ttgagggccagg

SEQ ID NO: 5336341 - DNA, 21 bp, Homo sapiens
ttgagggcccagagcaggaag

SEQ ID NO: 5336342 - DNA, 21 bp, Homo sapiens
ttgagggcccagccaggagca

SEQ ID NO: 5336343 - DNA, 14 bp, Homo sapiens
ttgaggggaggtgg

SEQ ID NO: 5336344 - DNA, 16 bp, Homo sapiens
ttgaggggaggtggcc

SEQ ID NO: 5336345 - DNA, 17 bp, Homo sapiens
ttgaggggccccagcgt

SEQ ID NO: 5336346 - DNA, 15 bp, Homo sapiens
ttgaggggcctggag

SEQ ID NO: 5336347 - DNA, 19 bp, Homo sapiens
ttgaggggctccccagagg

SEQ ID NO: 5336348 - DNA, 16 bp, Homo sapiens
ttgaggggctcctgga

SEQ ID NO: 5336349 - DNA, 22 bp, Homo sapiens
ttgagggtcattttcctttctg

SEQ ID NO: 5336350 - DNA, 17 bp, Homo sapiens
ttgagggtggggtaagg

SEQ ID NO: 5336351 - DNA, 18 bp, Homo sapiens
ttgagggtgtaaccagta

SEQ ID NO: 5336352 - DNA, 19 bp, Homo sapiens
ttgaggtactctgcacata

SEQ ID NO: 5336353 - DNA, 16 bp, Homo sapiens
ttgaggtagaggaaaa

SEQ ID NO: 5336354 - DNA, 21 bp, Homo sapiens
ttgaggtaggagaattgcttg

SEQ ID NO: 5336355 - DNA, 13 bp, Homo sapiens
ttgaggtcaggag

SEQ ID NO: 5336356 - DNA, 14 bp, Homo sapiens
ttgaggtcaggagt

SEQ ID NO: 5336357 - DNA, 21 bp, Homo sapiens
ttgaggtccagccctggctga

SEQ ID NO: 5336358 - DNA, 15 bp, Homo sapiens
ttgaggtctcagccc

SEQ ID NO: 5336359 - DNA, 15 bp, Homo sapiens
ttgaggtctgttctt

SEQ ID NO: 5336360 - DNA, 18 bp, Homo sapiens
ttgaggtcttttacatac

SEQ ID NO: 5336361 - DNA, 14 bp, Homo sapiens
ttgaggtgaaatgg

SEQ ID NO: 5336362 - DNA, 14 bp, Homo sapiens
ttgaggtgcaagga

SEQ ID NO: 5336363 - DNA, 14 bp, Homo sapiens
ttgaggtttagcaa

SEQ ID NO: 5336364 - DNA, 17 bp, Homo sapiens
ttgaggtttggaagagt

SEQ ID NO: 5336365 - DNA, 17 bp, Homo sapiens
ttgaggttttgtaaaac

SEQ ID NO: 5336366 - DNA, 19 bp, Homo sapiens
ttgaggttttgtaaaactg

SEQ ID NO: 5336367 - DNA, 22 bp, Homo sapiens
ttgaggtttttaaatatatatt

SEQ ID NO: 5336368 - DNA, 12 bp, Homo sapiens
ttgagtaaaact

SEQ ID NO: 5336369 - DNA, 23 bp, Homo sapiens
ttgagtaaataacaactccctga

SEQ ID NO: 5336370 - DNA, 15 bp, Homo sapiens
ttgagtaagaacatc

SEQ ID NO: 5336371 - DNA, 16 bp, Homo sapiens
ttgagtaatattacat

SEQ ID NO: 5336372 - DNA, 19 bp, Homo sapiens
ttgagtaatattacatttc

SEQ ID NO: 5336373 - DNA, 16 bp, Homo sapiens
ttgagtaatggtgtag

SEQ ID NO: 5336374 - DNA, 13 bp, Homo sapiens
ttgagtaatgtga

SEQ ID NO: 5336375 - DNA, 16 bp, Homo sapiens
ttgagtaattctagac

SEQ ID NO: 5336376 - DNA, 18 bp, Homo sapiens
ttgagtacagaattcaac

SEQ ID NO: 5336377 - DNA, 21 bp, Homo sapiens
ttgagtacctactgtgtgcca

SEQ ID NO: 5336378 - DNA, 15 bp, Homo sapiens
ttgagtagacacatt

SEQ ID NO: 5336379 - DNA, 17 bp, Homo sapiens
ttgagtataagaaatgc

SEQ ID NO: 5336380 - DNA, 18 bp, Homo sapiens
ttgagtatcactttaact

SEQ ID NO: 5336381 - DNA, 15 bp, Homo sapiens
ttgagtattgtttaa

SEQ ID NO: 5336382 - DNA, 22 bp, Homo sapiens
ttgagtattgtttaaaatgtaa

SEQ ID NO: 5336383 - DNA, 20 bp, Homo sapiens
ttgagtatttgctgtttgtc

SEQ ID NO: 5336384 - DNA, 21 bp, Homo sapiens
ttgagtcaggagcttattaca

SEQ ID NO: 5336385 - DNA, 22 bp, Homo sapiens
ttgagtcattgacttcatttta

SEQ ID NO: 5336386 - DNA, 13 bp, Homo sapiens
ttgagtccagtgt

SEQ ID NO: 5336387 - DNA, 14 bp, Homo sapiens
ttgagtccagtgtg

SEQ ID NO: 5336388 - DNA, 17 bp, Homo sapiens
ttgagtcctaggactta

SEQ ID NO: 5336389 - DNA, 15 bp, Homo sapiens
ttgagtctatttttg

SEQ ID NO: 5336390 - DNA, 17 bp, Homo sapiens
ttgagtctcaggccctg

SEQ ID NO: 5336391 - DNA, 18 bp, Homo sapiens
ttgagtctcctctctgag

SEQ ID NO: 5336392 - DNA, 12 bp, Homo sapiens
ttgagtctctga

SEQ ID NO: 5336393 - DNA, 17 bp, Homo sapiens
ttgagtctctgaatttg

SEQ ID NO: 5336394 - DNA, 21 bp, Homo sapiens
ttgagtctgtgttgtgtcctg

SEQ ID NO: 5336395 - DNA, 23 bp, Homo sapiens
ttgagtctgtgttgtgtcctgac

SEQ ID NO: 5336396 - DNA, 17 bp, Homo sapiens
ttgagtcttcacattta

SEQ ID NO: 5336397 - DNA, 21 bp, Homo sapiens
ttgagtgacagctttctggga

SEQ ID NO: 5336398 - DNA, 23 bp, Homo sapiens
ttgagtgagccgggaccgtgcca

SEQ ID NO: 5336399 - DNA, 15 bp, Homo sapiens
ttgagtgcactgact

SEQ ID NO: 5336400 - DNA, 18 bp, Homo sapiens
ttgagtgccaatttctta

SEQ ID NO: 5336401 - DNA, 18 bp, Homo sapiens
ttgagtgctgggggaggc

SEQ ID NO: 5336402 - DNA, 21 bp, Homo sapiens
ttgagtggacagcagctggac

SEQ ID NO: 5336403 - DNA, 17 bp, Homo sapiens
ttgagtggatgatgttt

SEQ ID NO: 5336404 - DNA, 13 bp, Homo sapiens
ttgagtggctgtc

SEQ ID NO: 5336405 - DNA, 22 bp, Homo sapiens
ttgagtggggggaacgcccact

SEQ ID NO: 5336406 - DNA, 18 bp, Homo sapiens
ttgagtgggtatttctta

SEQ ID NO: 5336407 - DNA, 22 bp, Homo sapiens
ttgagttaacaggacagttgat

SEQ ID NO: 5336408 - DNA, 21 bp, Homo sapiens
ttgagttacattaaaataaac

SEQ ID NO: 5336409 - DNA, 22 bp, Homo sapiens
ttgagttattccacaaacacat

SEQ ID NO: 5336410 - DNA, 15 bp, Homo sapiens
ttgagttcctctgca

SEQ ID NO: 5336411 - DNA, 22 bp, Homo sapiens
ttgagttctgattgtgttgaag

SEQ ID NO: 5336412 - DNA, 23 bp, Homo sapiens
ttgagttcttcctgtaatcttgt

SEQ ID NO: 5336413 - DNA, 23 bp, Homo sapiens
ttgagttgacttctgacaaaggt

SEQ ID NO: 5336414 - DNA, 18 bp, Homo sapiens
ttgagttgatgggggcca

SEQ ID NO: 5336415 - DNA, 17 bp, Homo sapiens
ttgagttggctgtgttc

SEQ ID NO: 5336416 - DNA, 20 bp, Homo sapiens
ttgagttgggggtattttct

SEQ ID NO: 5336417 - DNA, 14 bp, Homo sapiens
ttgagttgtaaaga

SEQ ID NO: 5336418 - DNA, 17 bp, Homo sapiens
ttgagttgtttttgtat

SEQ ID NO: 5336419 - DNA, 18 bp, Homo sapiens
ttgagttgtttttgtata

SEQ ID NO: 5336420 - DNA, 19 bp, Homo sapiens
ttgagttgtttttgtatat

SEQ ID NO: 5336421 - DNA, 18 bp, Homo sapiens
ttgagtttaagtctctga

SEQ ID NO: 5336422 - DNA, 18 bp, Homo sapiens
ttgagtttataattcagg

SEQ ID NO: 5336423 - DNA, 12 bp, Homo sapiens
ttgagtttcaga

SEQ ID NO: 5336424 - DNA, 19 bp, Homo sapiens
ttgagtttcagctggaaac

SEQ ID NO: 5336425 - DNA, 20 bp, Homo sapiens
ttgagtttcagctggaaact

SEQ ID NO: 5336426 - DNA, 19 bp, Homo sapiens
ttgagtttcctcaggctgc

SEQ ID NO: 5336427 - DNA, 23 bp, Homo sapiens
ttgagtttgtcgctcatgtgtgc

SEQ ID NO: 5336428 - DNA, 15 bp, Homo sapiens
ttgagtttttcctcc

SEQ ID NO: 5336429 - DNA, 22 bp, Homo sapiens
ttgataaaaacccaaaatacag

SEQ ID NO: 5336430 - DNA, 23 bp, Homo sapiens
ttgataaagagagccctggtcct

SEQ ID NO: 5336431 - DNA, 22 bp, Homo sapiens
ttgataaagattttttaataat

SEQ ID NO: 5336432 - DNA, 14 bp, Homo sapiens
ttgataaagtttct

SEQ ID NO: 5336433 - DNA, 22 bp, Homo sapiens
ttgataaatagtgttattgaga

SEQ ID NO: 5336434 - DNA, 13 bp, Homo sapiens
ttgataaatatat

SEQ ID NO: 5336435 - DNA, 20 bp, Homo sapiens
ttgataaatatatatgatca

SEQ ID NO: 5336436 - DNA, 18 bp, Homo sapiens
ttgataaatcattttatg

SEQ ID NO: 5336437 - DNA, 11 bp, Homo sapiens
ttgataaatta

SEQ ID NO: 5336438 - DNA, 12 bp, Homo sapiens
ttgataacaaaa

SEQ ID NO: 5336439 - DNA, 14 bp, Homo sapiens
ttgataacagcact

SEQ ID NO: 5336440 - DNA, 12 bp, Homo sapiens
ttgataacagct

SEQ ID NO: 5336441 - DNA, 17 bp, Homo sapiens
ttgataacatggaaatg

SEQ ID NO: 5336442 - DNA, 18 bp, Homo sapiens
ttgataagatcttttatt

SEQ ID NO: 5336443 - DNA, 21 bp, Homo sapiens
ttgataagctattgtctgtaa

SEQ ID NO: 5336444 - DNA, 18 bp, Homo sapiens
ttgataaggaacatttat

SEQ ID NO: 5336445 - DNA, 20 bp, Homo sapiens
ttgataagggactgatgttt

SEQ ID NO: 5336446 - DNA, 21 bp, Homo sapiens
ttgataagggactgatgtttg

SEQ ID NO: 5336447 - DNA, 17 bp, Homo sapiens
ttgataataaaattcat

SEQ ID NO: 5336448 - DNA, 17 bp, Homo sapiens
ttgataatatataaaca

SEQ ID NO: 5336449 - DNA, 19 bp, Homo sapiens
ttgataatcaactgggctg

SEQ ID NO: 5336450 - DNA, 16 bp, Homo sapiens
ttgataatcttcaggt

SEQ ID NO: 5336451 - DNA, 14 bp, Homo sapiens
ttgataatgataaa

SEQ ID NO: 5336452 - DNA, 23 bp, Homo sapiens
ttgataatgctttcacaacattt

SEQ ID NO: 5336453 - DNA, 13 bp, Homo sapiens
ttgataatgttaa

SEQ ID NO: 5336454 - DNA, 17 bp, Homo sapiens
ttgataattcaacattt

SEQ ID NO: 5336455 - DNA, 15 bp, Homo sapiens
ttgataatttcaggg

SEQ ID NO: 5336456 - DNA, 14 bp, Homo sapiens
ttgataattttcct

SEQ ID NO: 5336457 - DNA, 13 bp, Homo sapiens
ttgatacaaacca

SEQ ID NO: 5336458 - DNA, 17 bp, Homo sapiens
ttgatacaaaccactgt

SEQ ID NO: 5336459 - DNA, 20 bp, Homo sapiens
ttgatacaaatgtttataac

SEQ ID NO: 5336460 - DNA, 13 bp, Homo sapiens
ttgatacataata

SEQ ID NO: 5336461 - DNA, 19 bp, Homo sapiens
ttgatacatataattcttt

SEQ ID NO: 5336462 - DNA, 17 bp, Homo sapiens
ttgatacattcaaattt

SEQ ID NO: 5336463 - DNA, 13 bp, Homo sapiens
ttgatacatttat

SEQ ID NO: 5336464 - DNA, 20 bp, Homo sapiens
ttgatacatttatcttctgt

SEQ ID NO: 5336465 - DNA, 13 bp, Homo sapiens
ttgatacccctgg

SEQ ID NO: 5336466 - DNA, 16 bp, Homo sapiens
ttgatacccctgggga

SEQ ID NO: 5336467 - DNA, 17 bp, Homo sapiens
ttgatactacagtttgt

SEQ ID NO: 5336468 - DNA, 22 bp, Homo sapiens
ttgatactgaatgcataaataa

SEQ ID NO: 5336469 - DNA, 13 bp, Homo sapiens
ttgatactgttgc

SEQ ID NO: 5336470 - DNA, 20 bp, Homo sapiens
ttgatactgttgcacgtgtg

SEQ ID NO: 5336471 - DNA, 13 bp, Homo sapiens
ttgatacttgtaa

SEQ ID NO: 5336472 - DNA, 17 bp, Homo sapiens
ttgatacttgttcaaaa

SEQ ID NO: 5336473 - DNA, 18 bp, Homo sapiens
ttgatacttgttccagat

SEQ ID NO: 5336474 - DNA, 13 bp, Homo sapiens
ttgatacttgttt

SEQ ID NO: 5336475 - DNA, 19 bp, Homo sapiens
ttgatagaaaatccttcag

SEQ ID NO: 5336476 - DNA, 16 bp, Homo sapiens
ttgatagaaaggaaca

SEQ ID NO: 5336477 - DNA, 21 bp, Homo sapiens
ttgatagaaaggaacacgttt

SEQ ID NO: 5336478 - DNA, 13 bp, Homo sapiens
ttgatagaaccat

SEQ ID NO: 5336479 - DNA, 12 bp, Homo sapiens
ttgatagactta

SEQ ID NO: 5336480 - DNA, 15 bp, Homo sapiens
ttgatagatgtttgg

SEQ ID NO: 5336481 - DNA, 23 bp, Homo sapiens
ttgatagcacagaccctgccctg

SEQ ID NO: 5336482 - DNA, 19 bp, Homo sapiens
ttgatagctttatttttta

SEQ ID NO: 5336483 - DNA, 20 bp, Homo sapiens
ttgataggaataattttcta

SEQ ID NO: 5336484 - DNA, 23 bp, Homo sapiens
ttgataggccgttggttgtctga

SEQ ID NO: 5336485 - DNA, 21 bp, Homo sapiens
ttgataggcctagtacaatct

SEQ ID NO: 5336486 - DNA, 19 bp, Homo sapiens
ttgatagtgatgtatttta

SEQ ID NO: 5336487 - DNA, 17 bp, Homo sapiens
ttgatagtgcttcttgt

SEQ ID NO: 5336488 - DNA, 17 bp, Homo sapiens
ttgatagttctataaga

SEQ ID NO: 5336489 - DNA, 20 bp, Homo sapiens
ttgatagtttacaaacaaga

SEQ ID NO: 5336490 - DNA, 15 bp, Homo sapiens
ttgatagtttcattt

SEQ ID NO: 5336491 - DNA, 19 bp, Homo sapiens
ttgatagtttcatttacaa

SEQ ID NO: 5336492 - DNA, 18 bp, Homo sapiens
ttgatataaataaaacat

SEQ ID NO: 5336493 - DNA, 14 bp, Homo sapiens
ttgatataataatt

SEQ ID NO: 5336494 - DNA, 14 bp, Homo sapiens
ttgcaatggcagcc

SEQ ID NO: 5336495 - DNA, 19 bp, Homo sapiens
ttgcaatggcagccttggc

SEQ ID NO: 5336496 - DNA, 20 bp, Homo sapiens
ttgcaatggtgttgccctga

SEQ ID NO: 5336497 - DNA, 19 bp, Homo sapiens
ttgcaattaaacttccaaa

SEQ ID NO: 5336498 - DNA, 22 bp, Homo sapiens
ttgcaattagaaatattaaaga

SEQ ID NO: 5336499 - DNA, 16 bp, Homo sapiens
ttgcaattagcattct

SEQ ID NO: 5336500 - DNA, 17 bp, Homo sapiens
ttgcaattattctaatt

SEQ ID NO: 5336501 - DNA, 17 bp, Homo sapiens
ttgcaattgtttaagaa

SEQ ID NO: 5336502 - DNA, 19 bp, Homo sapiens
ttgcaattgtttaagaatc

SEQ ID NO: 5336503 - DNA, 20 bp, Homo sapiens
ttgcaattgtttaagaatca

SEQ ID NO: 5336504 - DNA, 14 bp, Homo sapiens
ttgcaatttgaagg

SEQ ID NO: 5336505 - DNA, 15 bp, Homo sapiens
ttgcaatttgaaggt

SEQ ID NO: 5336506 - DNA, 21 bp, Homo sapiens
ttgcaatttgagccatttaaa

SEQ ID NO: 5336507 - DNA, 23 bp, Homo sapiens
ttgcacaaaaagataccttaaaa

SEQ ID NO: 5336508 - DNA, 19 bp, Homo sapiens
ttgcacaaaccaattaaac

SEQ ID NO: 5336509 - DNA, 22 bp, Homo sapiens
ttgcacaagcttgtatatacat

SEQ ID NO: 5336510 - DNA, 12 bp, Homo sapiens
ttgcacaatatt

SEQ ID NO: 5336511 - DNA, 21 bp, Homo sapiens
ttgcacaatattgaacttttt

SEQ ID NO: 5336512 - DNA, 16 bp, Homo sapiens
ttgcacaatatttctt

SEQ ID NO: 5336513 - DNA, 23 bp, Homo sapiens
ttgcacaatatttcttttgttgt

SEQ ID NO: 5336514 - DNA, 13 bp, Homo sapiens
ttgcacaatttga

SEQ ID NO: 5336515 - DNA, 23 bp, Homo sapiens
ttgcacaatttgagcaattcatt

SEQ ID NO: 5336516 - DNA, 16 bp, Homo sapiens
ttgcacacaaaacatc

SEQ ID NO: 5336517 - DNA, 19 bp, Homo sapiens
ttgcacacagggaggctgt

SEQ ID NO: 5336518 - DNA, 17 bp, Homo sapiens
ttgcacacatcatctgt

SEQ ID NO: 5336519 - DNA, 19 bp, Homo sapiens
ttgcacacatcatctgtaa

SEQ ID NO: 5336520 - DNA, 16 bp, Homo sapiens
ttgcacacccactgcc

SEQ ID NO: 5336521 - DNA, 15 bp, Homo sapiens
ttgcacacttcaaat

SEQ ID NO: 5336522 - DNA, 17 bp, Homo sapiens
ttgcacacttccccatc

SEQ ID NO: 5336523 - DNA, 14 bp, Homo sapiens
ttgcacagaatttg

SEQ ID NO: 5336524 - DNA, 17 bp, Homo sapiens
ttgcacagacatctcct

SEQ ID NO: 5336525 - DNA, 20 bp, Homo sapiens
ttgcacagagcacacttatt

SEQ ID NO: 5336526 - DNA, 13 bp, Homo sapiens
ttgcacagagtga

SEQ ID NO: 5336527 - DNA, 18 bp, Homo sapiens
ttgcacagcatctcagct

SEQ ID NO: 5336528 - DNA, 19 bp, Homo sapiens
ttgcacagggattctcaca

SEQ ID NO: 5336529 - DNA, 21 bp, Homo sapiens
ttgcacagtcactgctcttca

SEQ ID NO: 5336530 - DNA, 17 bp, Homo sapiens
ttgcacagtggtctgga

SEQ ID NO: 5336531 - DNA, 13 bp, Homo sapiens
ttgcacagtgtgt

SEQ ID NO: 5336532 - DNA, 19 bp, Homo sapiens
ttgcacataggaaactttt

SEQ ID NO: 5336533 - DNA, 14 bp, Homo sapiens
ttgcacatatattt

SEQ ID NO: 5336534 - DNA, 17 bp, Homo sapiens
ttgcacatctctgcagt

SEQ ID NO: 5336535 - DNA, 17 bp, Homo sapiens
ttgcacatgaatgcagt

SEQ ID NO: 5336536 - DNA, 14 bp, Homo sapiens
ttgcacatgggatt

SEQ ID NO: 5336537 - DNA, 15 bp, Homo sapiens
ttgcacatgtcttaa

SEQ ID NO: 5336538 - DNA, 22 bp, Homo sapiens
ttgcacatgtcttaatgaagtt

SEQ ID NO: 5336539 - DNA, 11 bp, Homo sapiens
ttgcacattaa

SEQ ID NO: 5336540 - DNA, 15 bp, Homo sapiens
ttgcacattccaaaa

SEQ ID NO: 5336541 - DNA, 23 bp, Homo sapiens
ttgcacattccaaaattcatttc

SEQ ID NO: 5336542 - DNA, 12 bp, Homo sapiens
ttgcacattgtt

SEQ ID NO: 5336543 - DNA, 14 bp, Homo sapiens
ttgcacattgttca

SEQ ID NO: 5336544 - DNA, 23 bp, Homo sapiens
ttgcacattgttgtttttttaat

SEQ ID NO: 5336545 - DNA, 18 bp, Homo sapiens
ttgcacatttgaattcat

SEQ ID NO: 5336546 - DNA, 12 bp, Homo sapiens
ttgcacattttg

SEQ ID NO: 5336547 - DNA, 16 bp, Homo sapiens
ttgcacatttttttct

SEQ ID NO: 5336548 - DNA, 20 bp, Homo sapiens
ttgcaccaattaagtgttga

SEQ ID NO: 5336549 - DNA, 21 bp, Homo sapiens
ttgcaccaattaagtgttgaa

SEQ ID NO: 5336550 - DNA, 23 bp, Homo sapiens
ttgcaccagttttatccataatg

SEQ ID NO: 5336551 - DNA, 23 bp, Homo sapiens
ttgcaccatactccttgcttcct

SEQ ID NO: 5336552 - DNA, 16 bp, Homo sapiens
ttgcaccattctttct

SEQ ID NO: 5336553 - DNA, 23 bp, Homo sapiens
ttgcaccattctttcttggtgca

SEQ ID NO: 5336554 - DNA, 12 bp, Homo sapiens
ttgcacccagcc

SEQ ID NO: 5336555 - DNA, 15 bp, Homo sapiens
ttgcacccagcccag

SEQ ID NO: 5336556 - DNA, 15 bp, Homo sapiens
ttgcacccagccctg

SEQ ID NO: 5336557 - DNA, 19 bp, Homo sapiens
ttgcacccagccctggtct

SEQ ID NO: 5336558 - DNA, 22 bp, Homo sapiens
ttgcaccccaaagctttcctgc

SEQ ID NO: 5336559 - DNA, 13 bp, Homo sapiens
ttgcacccctccc

SEQ ID NO: 5336560 - DNA, 16 bp, Homo sapiens
ttgcaccgcctgccct

SEQ ID NO: 5336561 - DNA, 17 bp, Homo sapiens
ttgcaccgtcctcagca

SEQ ID NO: 5336562 - DNA, 18 bp, Homo sapiens
ttgcacctatctcagcca

SEQ ID NO: 5336563 - DNA, 15 bp, Homo sapiens
ttgcacctgcagcca

SEQ ID NO: 5336564 - DNA, 22 bp, Homo sapiens
ttgcacctgcagccaagcaaat

SEQ ID NO: 5336565 - DNA, 14 bp, Homo sapiens
ttgcaccttattca

SEQ ID NO: 5336566 - DNA, 16 bp, Homo sapiens
ttgcaccttattcaga

SEQ ID NO: 5336567 - DNA, 20 bp, Homo sapiens
ttgcacgcccatgtgtgagt

SEQ ID NO: 5336568 - DNA, 12 bp, Homo sapiens
ttgcacggctgc

SEQ ID NO: 5336569 - DNA, 14 bp, Homo sapiens
ttgcacggctgctg

SEQ ID NO: 5336570 - DNA, 15 bp, Homo sapiens
ttgcacgtggcctct

SEQ ID NO: 5336571 - DNA, 21 bp, Homo sapiens
ttgcactaaaatgaggatcca

SEQ ID NO: 5336572 - DNA, 22 bp, Homo sapiens
ttgcactaaaatgaggatccag

SEQ ID NO: 5336573 - DNA, 19 bp, Homo sapiens
ttgcactacattatggaat

SEQ ID NO: 5336574 - DNA, 14 bp, Homo sapiens
ttgcactaggaatt

SEQ ID NO: 5336575 - DNA, 15 bp, Homo sapiens
ttgcactaggaattc

SEQ ID NO: 5336576 - DNA, 16 bp, Homo sapiens
ttgcactaggaattct

SEQ ID NO: 5336577 - DNA, 22 bp, Homo sapiens
ttgcactaggaattctttgcat

SEQ ID NO: 5336578 - DNA, 23 bp, Homo sapiens
ttgcactaggaattctttgcatt

SEQ ID NO: 5336579 - DNA, 13 bp, Homo sapiens
ttgcactaggtca

SEQ ID NO: 5336580 - DNA, 18 bp, Homo sapiens
ttgcactatgaaaatcag

SEQ ID NO: 5336581 - DNA, 16 bp, Homo sapiens
ttgcactatttccaca

SEQ ID NO: 5336582 - DNA, 17 bp, Homo sapiens
ttgcactcaaatcttaa

SEQ ID NO: 5336583 - DNA, 21 bp, Homo sapiens
ttgcactcaaatcttaagaaa

SEQ ID NO: 5336584 - DNA, 21 bp, Homo sapiens
ttgcactcaagttgtttaact

SEQ ID NO: 5336585 - DNA, 17 bp, Homo sapiens
ttgcactccacacatct

SEQ ID NO: 5336586 - DNA, 18 bp, Homo sapiens
ttgcactccacacatctt

SEQ ID NO: 5336587 - DNA, 15 bp, Homo sapiens
ttgcactccagcctg

SEQ ID NO: 5336588 - DNA, 16 bp, Homo sapiens
ttgcactcctcacaca

SEQ ID NO: 5336589 - DNA, 17 bp, Homo sapiens
ttgcactccttccctaa

SEQ ID NO: 5336590 - DNA, 22 bp, Homo sapiens
ttgcactctaaaaggttcaggg

SEQ ID NO: 5336591 - DNA, 14 bp, Homo sapiens
ttgcactgaacagg

SEQ ID NO: 5336592 - DNA, 12 bp, Homo sapiens
ttgcactgaagt

SEQ ID NO: 5336593 - DNA, 16 bp, Homo sapiens
ttgcactgaagtttga

SEQ ID NO: 5336594 - DNA, 15 bp, Homo sapiens
ttgcactgacaagat

SEQ ID NO: 5336595 - DNA, 16 bp, Homo sapiens
ttgcactgacaagatg

SEQ ID NO: 5336596 - DNA, 12 bp, Homo sapiens
ttgcactgaggg

SEQ ID NO: 5336597 - DNA, 13 bp, Homo sapiens
ttgcactgagggc

SEQ ID NO: 5336598 - DNA, 21 bp, Homo sapiens
ttgcactgagggccacactat

SEQ ID NO: 5336599 - DNA, 13 bp, Homo sapiens
ttgcactgcttta

SEQ ID NO: 5336600 - DNA, 21 bp, Homo sapiens
ttgcactggtcatcagtattg

SEQ ID NO: 5336601 - DNA, 13 bp, Homo sapiens
ttgcactgtccag

SEQ ID NO: 5336602 - DNA, 21 bp, Homo sapiens
ttgcactgtggtcgtcaactt

SEQ ID NO: 5336603 - DNA, 16 bp, Homo sapiens
ttgcactgtttaatca

SEQ ID NO: 5336604 - DNA, 14 bp, Homo sapiens
ttgcactgtttgca

SEQ ID NO: 5336605 - DNA, 19 bp, Homo sapiens
ttgcacttaaaaattagca

SEQ ID NO: 5336606 - DNA, 18 bp, Homo sapiens
ttgcacttattgtcccct

SEQ ID NO: 5336607 - DNA, 21 bp, Homo sapiens
ttgcacttcaaaaaagcttaa

SEQ ID NO: 5336608 - DNA, 23 bp, Homo sapiens
ttgcacttcggataattttcatt

SEQ ID NO: 5336609 - DNA, 22 bp, Homo sapiens
ttgcacttctaagactttactt

SEQ ID NO: 5336610 - DNA, 19 bp, Homo sapiens
ttgcacttctgttatcagg

SEQ ID NO: 5336611 - DNA, 18 bp, Homo sapiens
ttgcacttgtggaatatg

SEQ ID NO: 5336612 - DNA, 19 bp, Homo sapiens
ttgcactttataaacactg

SEQ ID NO: 5336613 - DNA, 15 bp, Homo sapiens
ttgcactttcagact

SEQ ID NO: 5336614 - DNA, 20 bp, Homo sapiens
ttgcactttttaagtttgaa

SEQ ID NO: 5336615 - DNA, 19 bp, Homo sapiens
ttgcagaaaagcacctgcc

SEQ ID NO: 5336616 - DNA, 17 bp, Homo sapiens
ttgcagaacatgagtgc

SEQ ID NO: 5336617 - DNA, 11 bp, Homo sapiens
ttgcagaactg

SEQ ID NO: 5336618 - DNA, 11 bp, Homo sapiens
ttgcagaagaa

SEQ ID NO: 5336619 - DNA, 15 bp, Homo sapiens
ttgcagaagaaactc

SEQ ID NO: 5336620 - DNA, 16 bp, Homo sapiens
ttgcagaagagggtgt

SEQ ID NO: 5336621 - DNA, 20 bp, Homo sapiens
ttgcagaagagggtgtgttt

SEQ ID NO: 5336622 - DNA, 13 bp, Homo sapiens
ttgcagaaggaaa

SEQ ID NO: 5336623 - DNA, 20 bp, Homo sapiens
ttgcagaagggggtctcttc

SEQ ID NO: 5336624 - DNA, 13 bp, Homo sapiens
ttgcagaagttct

SEQ ID NO: 5336625 - DNA, 19 bp, Homo sapiens
ttgcagaagttcttagtgt

SEQ ID NO: 5336626 - DNA, 18 bp, Homo sapiens
ttgcagacaggaatctta

SEQ ID NO: 5336627 - DNA, 16 bp, Homo sapiens
ttgcagacaggcaagc

SEQ ID NO: 5336628 - DNA, 21 bp, Homo sapiens
ttgcagacagtgttttgcaca

SEQ ID NO: 5336629 - DNA, 20 bp, Homo sapiens
ttgcagacctgggactttag

SEQ ID NO: 5336630 - DNA, 23 bp, Homo sapiens
ttgcagacgggcaagaagctgct

SEQ ID NO: 5336631 - DNA, 18 bp, Homo sapiens
ttgcagagaagccttggt

SEQ ID NO: 5336632 - DNA, 19 bp, Homo sapiens
ttgcagagacaggacctga

SEQ ID NO: 5336633 - DNA, 12 bp, Homo sapiens
ttgcagagactc

SEQ ID NO: 5336634 - DNA, 19 bp, Homo sapiens
ttgcagagatttcctccat

SEQ ID NO: 5336635 - DNA, 20 bp, Homo sapiens
ttgcagagatttcctccatg

SEQ ID NO: 5336636 - DNA, 19 bp, Homo sapiens
ttgcagaggagcccagtgg

SEQ ID NO: 5336637 - DNA, 14 bp, Homo sapiens
ttgcagagtaaatc

SEQ ID NO: 5336638 - DNA, 21 bp, Homo sapiens
ttgcagagtggaaactcagcc

SEQ ID NO: 5336639 - DNA, 13 bp, Homo sapiens
ttgcagatgaaat

SEQ ID NO: 5336640 - DNA, 14 bp, Homo sapiens
ttgcagatgaagta

SEQ ID NO: 5336641 - DNA, 14 bp, Homo sapiens
ttgcagatgtattg

SEQ ID NO: 5336642 - DNA, 15 bp, Homo sapiens
ttgcagatgtattga

SEQ ID NO: 5336643 - DNA, 19 bp, Homo sapiens
ttgcagattattttagtct

SEQ ID NO: 5336644 - DNA, 18 bp, Homo sapiens
ttgcagattcatttttct

SEQ ID NO: 5336645 - DNA, 15 bp, Homo sapiens
ttgcagattgaagca

SEQ ID NO: 5336646 - DNA, 18 bp, Homo sapiens
ttgcagattgaagcattt

SEQ ID NO: 5336647 - DNA, 18 bp, Homo sapiens
ttgcagcactcacacagg

SEQ ID NO: 5336648 - DNA, 14 bp, Homo sapiens
ttgcagcagaagcc

SEQ ID NO: 5336649 - DNA, 15 bp, Homo sapiens
ttgcagcagaagcca

SEQ ID NO: 5336650 - DNA, 22 bp, Homo sapiens
ttgcagcagaagccaaattttt

SEQ ID NO: 5336651 - DNA, 17 bp, Homo sapiens
ttgcagcagataacttt

SEQ ID NO: 5336652 - DNA, 12 bp, Homo sapiens
ttgcagcagtga

SEQ ID NO: 5336653 - DNA, 14 bp, Homo sapiens
ttgcagcagttgct

SEQ ID NO: 5336654 - DNA, 20 bp, Homo sapiens
ttgcagcatatcgtttaatt

SEQ ID NO: 5336655 - DNA, 18 bp, Homo sapiens
ttgcagccgcagagaaat

SEQ ID NO: 5336656 - DNA, 14 bp, Homo sapiens
ttgcagcctagtag

SEQ ID NO: 5336657 - DNA, 21 bp, Homo sapiens
ttgcagcctagtaggagctga

SEQ ID NO: 5336658 - DNA, 22 bp, Homo sapiens
ttgcagcctgctctagtgggac

SEQ ID NO: 5336659 - DNA, 21 bp, Homo sapiens
ttgcagccttgcgctgtccca

SEQ ID NO: 5336660 - DNA, 15 bp, Homo sapiens
ttgcagcgactggca

SEQ ID NO: 5336661 - DNA, 18 bp, Homo sapiens
ttgcagcgattaataaca

SEQ ID NO: 5336662 - DNA, 15 bp, Homo sapiens
ttgcagcggctcctg

SEQ ID NO: 5336663 - DNA, 23 bp, Homo sapiens
ttgcagctaaggaggggaaaaaa

SEQ ID NO: 5336664 - DNA, 17 bp, Homo sapiens
ttgcagctcccattcta

SEQ ID NO: 5336665 - DNA, 21 bp, Homo sapiens
ttgcagctgctggttttggtt

SEQ ID NO: 5336666 - DNA, 18 bp, Homo sapiens
ttgcagctgcttttgcag

SEQ ID NO: 5336667 - DNA, 11 bp, Homo sapiens
ttgcagctgtg

SEQ ID NO: 5336668 - DNA, 12 bp, Homo sapiens
ttgcagctgttt

SEQ ID NO: 5336669 - DNA, 21 bp, Homo sapiens
ttgcagctgttttcaaagccc

SEQ ID NO: 5336670 - DNA, 21 bp, Homo sapiens
ttgcagcttaaagagcacagg

SEQ ID NO: 5336671 - DNA, 23 bp, Homo sapiens
ttgcaggaccttgggcacatctg

SEQ ID NO: 5336672 - DNA, 9 bp, Homo sapiens
ttgcaggag

SEQ ID NO: 5336673 - DNA, 19 bp, Homo sapiens
ttgcaggagttcctttccc

SEQ ID NO: 5336674 - DNA, 20 bp, Homo sapiens
ttgcaggatctgtctgtgca

SEQ ID NO: 5336675 - DNA, 21 bp, Homo sapiens
ttgcaggatctgtctgtgcac

SEQ ID NO: 5336676 - DNA, 15 bp, Homo sapiens
ttgcaggattccctt

SEQ ID NO: 5336677 - DNA, 19 bp, Homo sapiens
ttgcaggattcccttctgg

SEQ ID NO: 5336678 - DNA, 20 bp, Homo sapiens
ttgcaggatttttagagcat

SEQ ID NO: 5336679 - DNA, 22 bp, Homo sapiens
ttgcaggatttttagagcatta

SEQ ID NO: 5336680 - DNA, 20 bp, Homo sapiens
ttgcaggcaaatgtaaagtc

SEQ ID NO: 5336681 - DNA, 12 bp, Homo sapiens
ttgcaggcaagc

SEQ ID NO: 5336682 - DNA, 20 bp, Homo sapiens
ttgcaggccaggttatgcct

SEQ ID NO: 5336683 - DNA, 20 bp, Homo sapiens
ttgcaggccagtggacagag

SEQ ID NO: 5336684 - DNA, 18 bp, Homo sapiens
ttgcaggctctgggctca

SEQ ID NO: 5336685 - DNA, 20 bp, Homo sapiens
ttgcaggctctgggctcagg

SEQ ID NO: 5336686 - DNA, 19 bp, Homo sapiens
ttgcaggctgtaaggcatg

SEQ ID NO: 5336687 - DNA, 18 bp, Homo sapiens
ttgcagggagcatggctg

SEQ ID NO: 5336688 - DNA, 18 bp, Homo sapiens
ttgcagggagctcaagcc

SEQ ID NO: 5336689 - DNA, 21 bp, Homo sapiens
ttgcagggcagccccacaact

SEQ ID NO: 5336690 - DNA, 16 bp, Homo sapiens
ttgcaggggactgggc

SEQ ID NO: 5336691 - DNA, 17 bp, Homo sapiens
ttgcaggggtccctgct

SEQ ID NO: 5336692 - DNA, 16 bp, Homo sapiens
ttgcaggtgaccagaa

SEQ ID NO: 5336693 - DNA, 14 bp, Homo sapiens
ttgcaggtgccaat

SEQ ID NO: 5336694 - DNA, 23 bp, Homo sapiens
ttgcaggtggccaagttcctcta

SEQ ID NO: 5336695 - DNA, 16 bp, Homo sapiens
ttgcaggttcatggat

SEQ ID NO: 5336696 - DNA, 18 bp, Homo sapiens
ttgcagtaattcaactgg

SEQ ID NO: 5336697 - DNA, 15 bp, Homo sapiens
ttgcagtacatcaaa

SEQ ID NO: 5336698 - DNA, 20 bp, Homo sapiens
ttgcagtagagtcatctcca

SEQ ID NO: 5336699 - DNA, 14 bp, Homo sapiens
ttgcagtatgaact

SEQ ID NO: 5336700 - DNA, 20 bp, Homo sapiens
ttgcagtatttttaaatatg

SEQ ID NO: 5336701 - DNA, 22 bp, Homo sapiens
ttgcagtcactctagtcaatga

SEQ ID NO: 5336702 - DNA, 14 bp, Homo sapiens
ttgcagtcagaaga

SEQ ID NO: 5336703 - DNA, 21 bp, Homo sapiens
ttgcagtccagctctttagaa

SEQ ID NO: 5336704 - DNA, 21 bp, Homo sapiens
ttgcagtcccaagcggtgtct

SEQ ID NO: 5336705 - DNA, 23 bp, Homo sapiens
ttgcagtcccaagcggtgtctct

SEQ ID NO: 5336706 - DNA, 22 bp, Homo sapiens
ttgcagtctgtattttccacct

SEQ ID NO: 5336707 - DNA, 16 bp, Homo sapiens
ttgcagtctttccccc

SEQ ID NO: 5336708 - DNA, 14 bp, Homo sapiens
ttgcagtcttttgc

SEQ ID NO: 5336709 - DNA, 22 bp, Homo sapiens
ttgcagtcttttgctgtgctgt

SEQ ID NO: 5336710 - DNA, 14 bp, Homo sapiens
ttgcagtctttttt

SEQ ID NO: 5336711 - DNA, 23 bp, Homo sapiens
ttgcagtgagcagggtggggtct

SEQ ID NO: 5336712 - DNA, 13 bp, Homo sapiens
ttgcagtgagcca

SEQ ID NO: 5336713 - DNA, 16 bp, Homo sapiens
ttgcagtggcctggcc

SEQ ID NO: 5336714 - DNA, 18 bp, Homo sapiens
ttgcagtggcctggccgt

SEQ ID NO: 5336715 - DNA, 19 bp, Homo sapiens
ttgcagtgtgaatgctggg

SEQ ID NO: 5336716 - DNA, 13 bp, Homo sapiens
ttgcagtgttaag

SEQ ID NO: 5336717 - DNA, 16 bp, Homo sapiens
ttgcagtgttaagata

SEQ ID NO: 5336718 - DNA, 23 bp, Homo sapiens
ttgcagttagactcaaagaagta

SEQ ID NO: 5336719 - DNA, 22 bp, Homo sapiens
ttgcagttagccccagaaaatg

SEQ ID NO: 5336720 - DNA, 14 bp, Homo sapiens
ttgcagttatgtta

SEQ ID NO: 5336721 - DNA, 16 bp, Homo sapiens
ttgcagttcaaatcct

SEQ ID NO: 5336722 - DNA, 20 bp, Homo sapiens
ttgcagttcaaatcctcacc

SEQ ID NO: 5336723 - DNA, 20 bp, Homo sapiens
ttgcagttcatactgaatga

SEQ ID NO: 5336724 - DNA, 21 bp, Homo sapiens
ttgcagttcccacattaaaga

SEQ ID NO: 5336725 - DNA, 13 bp, Homo sapiens
ttgcagttcttga

SEQ ID NO: 5336726 - DNA, 22 bp, Homo sapiens
ttgcagttgatgtgtctttttt

SEQ ID NO: 5336727 - DNA, 19 bp, Homo sapiens
ttgcagttggactctcagg

SEQ ID NO: 5336728 - DNA, 21 bp, Homo sapiens
ttgcagttggactctcaggga

SEQ ID NO: 5336729 - DNA, 17 bp, Homo sapiens
ttgcagttgtgatataa

SEQ ID NO: 5336730 - DNA, 18 bp, Homo sapiens
ttgcagtttacagtattt

SEQ ID NO: 5336731 - DNA, 18 bp, Homo sapiens
ttgcagtttatcattcaa

SEQ ID NO: 5336732 - DNA, 19 bp, Homo sapiens
ttgcagtttatcattcaag

SEQ ID NO: 5336733 - DNA, 23 bp, Homo sapiens
ttgcagtttatcattcaagtgta

SEQ ID NO: 5336734 - DNA, 21 bp, Homo sapiens
ttgcagtttcatgtatgtata

SEQ ID NO: 5336735 - DNA, 21 bp, Homo sapiens
ttgcagttttgtaagccctct

SEQ ID NO: 5336736 - DNA, 15 bp, Homo sapiens
ttgcagtttttcatt

SEQ ID NO: 5336737 - DNA, 19 bp, Homo sapiens
ttgcataatgcaatcaaaa

SEQ ID NO: 5336738 - DNA, 18 bp, Homo sapiens
ttgcatacaccactgcaa

SEQ ID NO: 5336739 - DNA, 16 bp, Homo sapiens
ttgcatactattaaac

SEQ ID NO: 5336740 - DNA, 14 bp, Homo sapiens
ttgcatactgaaaa

SEQ ID NO: 5336741 - DNA, 17 bp, Homo sapiens
ttgcatactttgtattt

SEQ ID NO: 5336742 - DNA, 12 bp, Homo sapiens
ttgcatagaata

SEQ ID NO: 5336743 - DNA, 13 bp, Homo sapiens
ttgcatagaataa

SEQ ID NO: 5336744 - DNA, 14 bp, Homo sapiens
ttgcatagaattca

SEQ ID NO: 5336745 - DNA, 22 bp, Homo sapiens
ttgcatagtaccaatcatttta

SEQ ID NO: 5336746 - DNA, 17 bp, Homo sapiens
ttgcatagttctagtgc

SEQ ID NO: 5336747 - DNA, 23 bp, Homo sapiens
ttgcatataacttatattgtaag

SEQ ID NO: 5336748 - DNA, 23 bp, Homo sapiens
ttgcatataagggaagtagttat

SEQ ID NO: 5336749 - DNA, 15 bp, Homo sapiens
ttgcatatatgttct

SEQ ID NO: 5336750 - DNA, 18 bp, Homo sapiens
ttgcatatcacccttccc

SEQ ID NO: 5336751 - DNA, 19 bp, Homo sapiens
ttgcatatcagtcatgact

SEQ ID NO: 5336752 - DNA, 16 bp, Homo sapiens
ttgcatattctattgt

SEQ ID NO: 5336753 - DNA, 17 bp, Homo sapiens
ttgcatattgcatacta

SEQ ID NO: 5336754 - DNA, 20 bp, Homo sapiens
ttgcatatttttctaaagaa

SEQ ID NO: 5336755 - DNA, 20 bp, Homo sapiens
ttgcatcaaggggtcactta

SEQ ID NO: 5336756 - DNA, 21 bp, Homo sapiens
ttgcatcacaatttgttgaat

SEQ ID NO: 5336757 - DNA, 20 bp, Homo sapiens
ttgcatcactgtatcatttt

SEQ ID NO: 5336758 - DNA, 22 bp, Homo sapiens
ttgcatcacttaacggaccaaa

SEQ ID NO: 5336759 - DNA, 13 bp, Homo sapiens
ttgcatcatttaa

SEQ ID NO: 5336760 - DNA, 16 bp, Homo sapiens
ttgcatcatttaactg

SEQ ID NO: 5336761 - DNA, 18 bp, Homo sapiens
ttgcatccaactccagga

SEQ ID NO: 5336762 - DNA, 14 bp, Homo sapiens
ttgcatccattgtt

SEQ ID NO: 5336763 - DNA, 14 bp, Homo sapiens
ttgcatcctaagga

SEQ ID NO: 5336764 - DNA, 15 bp, Homo sapiens
ttgcatcctatttgg

SEQ ID NO: 5336765 - DNA, 14 bp, Homo sapiens
ttgcatcctgctgg

SEQ ID NO: 5336766 - DNA, 15 bp, Homo sapiens
ttgcatctacctgct

SEQ ID NO: 5336767 - DNA, 16 bp, Homo sapiens
ttgcatctacctgctc

SEQ ID NO: 5336768 - DNA, 19 bp, Homo sapiens
ttgcatctacctgctcctt

SEQ ID NO: 5336769 - DNA, 15 bp, Homo sapiens
ttgcatctgcacata

SEQ ID NO: 5336770 - DNA, 21 bp, Homo sapiens
ttgcatctgcacataggcagt

SEQ ID NO: 5336771 - DNA, 21 bp, Homo sapiens
ttgcatctgggtagctgtaag

SEQ ID NO: 5336772 - DNA, 16 bp, Homo sapiens
ttgcatgaagagaagc

SEQ ID NO: 5336773 - DNA, 18 bp, Homo sapiens
ttgcatgaccacatagaa

SEQ ID NO: 5336774 - DNA, 17 bp, Homo sapiens
ttgcatgataaacattc

SEQ ID NO: 5336775 - DNA, 17 bp, Homo sapiens
ttgcatgattcttctct

SEQ ID NO: 5336776 - DNA, 15 bp, Homo sapiens
ttgcatgcatgcaaa

SEQ ID NO: 5336777 - DNA, 16 bp, Homo sapiens
ttgcatgcatgcaaat

SEQ ID NO: 5336778 - DNA, 18 bp, Homo sapiens
ttgcatgctgataatcat

SEQ ID NO: 5336779 - DNA, 15 bp, Homo sapiens
ttgcatgctgcttta

SEQ ID NO: 5336780 - DNA, 21 bp, Homo sapiens
ttgcatggaaatcagccaagt

SEQ ID NO: 5336781 - DNA, 23 bp, Homo sapiens
ttgcatggaaatcagccaagttt

SEQ ID NO: 5336782 - DNA, 15 bp, Homo sapiens
ttgcatggagaatgg

SEQ ID NO: 5336783 - DNA, 16 bp, Homo sapiens
ttgcatggtgtgaact

SEQ ID NO: 5336784 - DNA, 17 bp, Homo sapiens
ttgcatggtgtgaacta

SEQ ID NO: 5336785 - DNA, 19 bp, Homo sapiens
ttgcatggtttggagctga

SEQ ID NO: 5336786 - DNA, 13 bp, Homo sapiens
ttgcatgtaaaat

SEQ ID NO: 5336787 - DNA, 14 bp, Homo sapiens
ttgcatgtaaaatg

SEQ ID NO: 5336788 - DNA, 17 bp, Homo sapiens
ttgcatgtaaaatgcag

SEQ ID NO: 5336789 - DNA, 13 bp, Homo sapiens
ttgcatgtagtaa

SEQ ID NO: 5336790 - DNA, 17 bp, Homo sapiens
ttgcatgtagtaacact

SEQ ID NO: 5336791 - DNA, 19 bp, Homo sapiens
ttgcatgtagtaacactaa

SEQ ID NO: 5336792 - DNA, 21 bp, Homo sapiens
ttgcatgtagtaacactaata

SEQ ID NO: 5336793 - DNA, 12 bp, Homo sapiens
ttgcatgtattt

SEQ ID NO: 5336794 - DNA, 21 bp, Homo sapiens
ttgcatgtctaattcatttac

SEQ ID NO: 5336795 - DNA, 22 bp, Homo sapiens
ttgcatgtctaattcatttact

SEQ ID NO: 5336796 - DNA, 17 bp, Homo sapiens
ttgcatgtgactctgaa

SEQ ID NO: 5336797 - DNA, 17 bp, Homo sapiens
ttgcatgttccactaac

SEQ ID NO: 5336798 - DNA, 16 bp, Homo sapiens
ttgcatgtttttgaaa

SEQ ID NO: 5336799 - DNA, 13 bp, Homo sapiens
ttgcattaaattc

SEQ ID NO: 5336800 - DNA, 20 bp, Homo sapiens
ttgcattaataatccttcca

SEQ ID NO: 5336801 - DNA, 22 bp, Homo sapiens
ttgcattcattttctgacatgc

SEQ ID NO: 5336802 - DNA, 13 bp, Homo sapiens
ttgcattccagaa

SEQ ID NO: 5336803 - DNA, 21 bp, Homo sapiens
ttgcattccagaatcttgact

SEQ ID NO: 5336804 - DNA, 17 bp, Homo sapiens
ttgcattccatgatttt

SEQ ID NO: 5336805 - DNA, 16 bp, Homo sapiens
ttgcattctattgcct

SEQ ID NO: 5336806 - DNA, 17 bp, Homo sapiens
ttgcattctattgcctt

SEQ ID NO: 5336807 - DNA, 16 bp, Homo sapiens
ttgcattcttattcat

SEQ ID NO: 5336808 - DNA, 18 bp, Homo sapiens
ttgcattgaacacaaact

SEQ ID NO: 5336809 - DNA, 23 bp, Homo sapiens
ttgcattgaacacaaactgtaaa

SEQ ID NO: 5336810 - DNA, 17 bp, Homo sapiens
ttgcattgaatatatta

SEQ ID NO: 5336811 - DNA, 21 bp, Homo sapiens
ttgcattgaccgcgactaatt

SEQ ID NO: 5336812 - DNA, 19 bp, Homo sapiens
ttgcattgactttccccac

SEQ ID NO: 5336813 - DNA, 17 bp, Homo sapiens
ttgcattgaggaaatat

SEQ ID NO: 5336814 - DNA, 15 bp, Homo sapiens
ttgcattgccaagtg

SEQ ID NO: 5336815 - DNA, 21 bp, Homo sapiens
ttgcatttaaaacagacactg

SEQ ID NO: 5336816 - DNA, 17 bp, Homo sapiens
ttgcatttaaacatgtt

SEQ ID NO: 5336817 - DNA, 21 bp, Homo sapiens
ttgcatttacgcctgtaaatg

SEQ ID NO: 5336818 - DNA, 16 bp, Homo sapiens
ttgcatttacttttaa

SEQ ID NO: 5336819 - DNA, 16 bp, Homo sapiens
ttgcatttagaaatca

SEQ ID NO: 5336820 - DNA, 18 bp, Homo sapiens
ttgcatttagcttctttc

SEQ ID NO: 5336821 - DNA, 18 bp, Homo sapiens
ttgcatttagttttatgg

SEQ ID NO: 5336822 - DNA, 20 bp, Homo sapiens
ttgcatttatatgtaccgta

SEQ ID NO: 5336823 - DNA, 19 bp, Homo sapiens
ttgcatttatgatgcagtt

SEQ ID NO: 5336824 - DNA, 15 bp, Homo sapiens
ttgcatttatggtca

SEQ ID NO: 5336825 - DNA, 17 bp, Homo sapiens
ttgcatttattgcagtt

SEQ ID NO: 5336826 - DNA, 14 bp, Homo sapiens
ttgcatttcagaaa

SEQ ID NO: 5336827 - DNA, 14 bp, Homo sapiens
ttgcatttcatgct

SEQ ID NO: 5336828 - DNA, 13 bp, Homo sapiens
ttgcatttccagc

SEQ ID NO: 5336829 - DNA, 14 bp, Homo sapiens
ttgcatttctgctc

SEQ ID NO: 5336830 - DNA, 11 bp, Homo sapiens
ttgcatttctt

SEQ ID NO: 5336831 - DNA, 14 bp, Homo sapiens
ttgcatttcttgtg

SEQ ID NO: 5336832 - DNA, 15 bp, Homo sapiens
ttgcatttctttatt

SEQ ID NO: 5336833 - DNA, 13 bp, Homo sapiens
ttgcatttgctgt

SEQ ID NO: 5336834 - DNA, 14 bp, Homo sapiens
ttgcatttgctttt

SEQ ID NO: 5336835 - DNA, 12 bp, Homo sapiens
ttgcatttgtaa

SEQ ID NO: 5336836 - DNA, 20 bp, Homo sapiens
ttgcatttgtaccttattga

SEQ ID NO: 5336837 - DNA, 18 bp, Homo sapiens
ttgcatttgttttgttta

SEQ ID NO: 5336838 - DNA, 15 bp, Homo sapiens
ttgcattttgatatt

SEQ ID NO: 5336839 - DNA, 21 bp, Homo sapiens
ttgcatttttattaaagcatt

SEQ ID NO: 5336840 - DNA, 13 bp, Homo sapiens
ttgcatttttgtt

SEQ ID NO: 5336841 - DNA, 17 bp, Homo sapiens
ttgcatttttgttttga

SEQ ID NO: 5336842 - DNA, 18 bp, Homo sapiens
ttgcatttttgttttgaa

SEQ ID NO: 5336843 - DNA, 17 bp, Homo sapiens
ttgcattttttaaattt

SEQ ID NO: 5336844 - DNA, 17 bp, Homo sapiens
ttgccaaaaaaaaaaga

SEQ ID NO: 5336845 - DNA, 19 bp, Homo sapiens
ttgccaaaaagtgaaataa

SEQ ID NO: 5336846 - DNA, 23 bp, Homo sapiens
ttgccaaaaagtgaaataatgtg

SEQ ID NO: 5336847 - DNA, 13 bp, Homo sapiens
ttgccaaaaccaa

SEQ ID NO: 5336848 - DNA, 19 bp, Homo sapiens
ttgccaaaacccagctgca

SEQ ID NO: 5336849 - DNA, 19 bp, Homo sapiens
ttgccttgcttctcccatt

SEQ ID NO: 5336850 - DNA, 22 bp, Homo sapiens
ttgccttgcttctcccatttcc

SEQ ID NO: 5336851 - DNA, 20 bp, Homo sapiens
ttgccttgtatgcaaatgag

SEQ ID NO: 5336852 - DNA, 22 bp, Homo sapiens
ttgccttgtatgcaaatgagtt

SEQ ID NO: 5336853 - DNA, 23 bp, Homo sapiens
ttgcctttaatattttgtaatat

SEQ ID NO: 5336854 - DNA, 18 bp, Homo sapiens
ttgcctttaggcaggaag

SEQ ID NO: 5336855 - DNA, 22 bp, Homo sapiens
ttgcctttagtgatcacagcag

SEQ ID NO: 5336856 - DNA, 21 bp, Homo sapiens
ttgcctttctgggagcagaaa

SEQ ID NO: 5336857 - DNA, 16 bp, Homo sapiens
ttgcctttgaatgtta

SEQ ID NO: 5336858 - DNA, 18 bp, Homo sapiens
ttgcctttgctcttataa

SEQ ID NO: 5336859 - DNA, 12 bp, Homo sapiens
ttgcctttgtaa

SEQ ID NO: 5336860 - DNA, 17 bp, Homo sapiens
ttgcctttgtagttaat

SEQ ID NO: 5336861 - DNA, 17 bp, Homo sapiens
ttgcctttgttttgatg

SEQ ID NO: 5336862 - DNA, 16 bp, Homo sapiens
ttgccttttatgtaaa

SEQ ID NO: 5336863 - DNA, 17 bp, Homo sapiens
ttgccttttatgtaaat

SEQ ID NO: 5336864 - DNA, 23 bp, Homo sapiens
ttgccttttcttcccctcctgta

SEQ ID NO: 5336865 - DNA, 18 bp, Homo sapiens
ttgccttttgttaatgca

SEQ ID NO: 5336866 - DNA, 22 bp, Homo sapiens
ttgcctttttaagtaaaaaaga

SEQ ID NO: 5336867 - DNA, 19 bp, Homo sapiens
ttgcctttttacagccaac

SEQ ID NO: 5336868 - DNA, 12 bp, Homo sapiens
ttgcctttttca

SEQ ID NO: 5336869 - DNA, 15 bp, Homo sapiens
ttgcctttttcatta

SEQ ID NO: 5336870 - DNA, 17 bp, Homo sapiens
ttgcctttttcattatt

SEQ ID NO: 5336871 - DNA, 17 bp, Homo sapiens
ttgcctttttcattttc

SEQ ID NO: 5336872 - DNA, 12 bp, Homo sapiens
ttgcctttttct

SEQ ID NO: 5336873 - DNA, 14 bp, Homo sapiens
ttgccttttttatc

SEQ ID NO: 5336874 - DNA, 24 bp, Homo sapiens
ttgccttttttatcatttctactg

SEQ ID NO: 5336875 - DNA, 21 bp, Homo sapiens
ttgcgaatattttgtaaatta

SEQ ID NO: 5336876 - DNA, 19 bp, Homo sapiens
ttgcgaatccaagctccct

SEQ ID NO: 5336877 - DNA, 12 bp, Homo sapiens
ttgcgaccacca

SEQ ID NO: 5336878 - DNA, 22 bp, Homo sapiens
ttgcgacgcgggcttctggagc

SEQ ID NO: 5336879 - DNA, 12 bp, Homo sapiens
ttgcgagagatg

SEQ ID NO: 5336880 - DNA, 15 bp, Homo sapiens
ttgcgagagatgtgt

SEQ ID NO: 5336881 - DNA, 13 bp, Homo sapiens
ttgcgatgtgttt

SEQ ID NO: 5336882 - DNA, 14 bp, Homo sapiens
ttgcgatgtgtttt

SEQ ID NO: 5336883 - DNA, 15 bp, Homo sapiens
ttgcgatgtgtttta

SEQ ID NO: 5336884 - DNA, 23 bp, Homo sapiens
ttgcgccactgcactccagcctg

SEQ ID NO: 5336885 - DNA, 22 bp, Homo sapiens
ttgcgccatctgtgcacactaa

SEQ ID NO: 5336886 - DNA, 15 bp, Homo sapiens
ttgcgcctaatgtgt

SEQ ID NO: 5336887 - DNA, 20 bp, Homo sapiens
ttgcgcctttgtattataaa

SEQ ID NO: 5336888 - DNA, 20 bp, Homo sapiens
ttgcgctcctggcccagcct

SEQ ID NO: 5336889 - DNA, 13 bp, Homo sapiens
ttgcgctctgggt

SEQ ID NO: 5336890 - DNA, 16 bp, Homo sapiens
ttgcgctggtggacca

SEQ ID NO: 5336891 - DNA, 17 bp, Homo sapiens
ttgcgctgtcccaggca

SEQ ID NO: 5336892 - DNA, 13 bp, Homo sapiens
ttgcgctgttgcg

SEQ ID NO: 5336893 - DNA, 13 bp, Homo sapiens
ttgcggaagccat

SEQ ID NO: 5336894 - DNA, 14 bp, Homo sapiens
ttgcggaagccata

SEQ ID NO: 5336895 - DNA, 15 bp, Homo sapiens
ttgcggaagccatag

SEQ ID NO: 5336896 - DNA, 20 bp, Homo sapiens
ttgcggaagccatagggggc

SEQ ID NO: 5336897 - DNA, 23 bp, Homo sapiens
ttgcggcctgttgggcagagctg

SEQ ID NO: 5336898 - DNA, 14 bp, Homo sapiens
ttgcggctcctcag

SEQ ID NO: 5336899 - DNA, 17 bp, Homo sapiens
ttgcggggcctgtctca

SEQ ID NO: 5336900 - DNA, 21 bp, Homo sapiens
ttgcggggcttttaaaaggaa

SEQ ID NO: 5336901 - DNA, 19 bp, Homo sapiens
ttgcgggggagctggaaat

SEQ ID NO: 5336902 - DNA, 20 bp, Homo sapiens
ttgcgggggagctggaaata

SEQ ID NO: 5336903 - DNA, 15 bp, Homo sapiens
ttgcggggggaggga

SEQ ID NO: 5336904 - DNA, 16 bp, Homo sapiens
ttgcgtacttgtaata

SEQ ID NO: 5336905 - DNA, 14 bp, Homo sapiens
ttgcgtcaagtcta

SEQ ID NO: 5336906 - DNA, 20 bp, Homo sapiens
ttgcgtcaggagcagcatca

SEQ ID NO: 5336907 - DNA, 21 bp, Homo sapiens
ttgcgtggaattgtgctgagt

SEQ ID NO: 5336908 - DNA, 15 bp, Homo sapiens
ttgcgtggactctgc

SEQ ID NO: 5336909 - DNA, 19 bp, Homo sapiens
ttgcgtggtccttaggctt

SEQ ID NO: 5336910 - DNA, 18 bp, Homo sapiens
ttgcgtgtctgtttcctt

SEQ ID NO: 5336911 - DNA, 16 bp, Homo sapiens
ttgcgttacacccttt

SEQ ID NO: 5336912 - DNA, 19 bp, Homo sapiens
ttgcgttagaatgaggagg

SEQ ID NO: 5336913 - DNA, 20 bp, Homo sapiens
ttgctaaaaaaagtgcatga

SEQ ID NO: 5336914 - DNA, 15 bp, Homo sapiens
ttgctaaaaaataaa

SEQ ID NO: 5336915 - DNA, 20 bp, Homo sapiens
ttgctaaaacagcttcctgt

SEQ ID NO: 5336916 - DNA, 15 bp, Homo sapiens
ttgctaaaagcatgt

SEQ ID NO: 5336917 - DNA, 21 bp, Homo sapiens
ttgctaaaagcatgtatagtt

SEQ ID NO: 5336918 - DNA, 18 bp, Homo sapiens
ttgctaaaatattttaga

SEQ ID NO: 5336919 - DNA, 14 bp, Homo sapiens
ttgctaaacactgc

SEQ ID NO: 5336920 - DNA, 17 bp, Homo sapiens
ttgctaaacactgcgct

SEQ ID NO: 5336921 - DNA, 16 bp, Homo sapiens
ttgctaaagcactttg

SEQ ID NO: 5336922 - DNA, 12 bp, Homo sapiens
ttgctaaatgta

SEQ ID NO: 5336923 - DNA, 15 bp, Homo sapiens
ttgctaaattataaa

SEQ ID NO: 5336924 - DNA, 20 bp, Homo sapiens
ttgctaacagcaacacaaag

SEQ ID NO: 5336925 - DNA, 23 bp, Homo sapiens
ttgctaacagcaacacaaagctt

SEQ ID NO: 5336926 - DNA, 17 bp, Homo sapiens
ttgctaaccactgtctg

SEQ ID NO: 5336927 - DNA, 12 bp, Homo sapiens
ttgctaactgaa

SEQ ID NO: 5336928 - DNA, 19 bp, Homo sapiens
ttgctaactgaactttgaa

SEQ ID NO: 5336929 - DNA, 15 bp, Homo sapiens
ttgctaactgggtta

SEQ ID NO: 5336930 - DNA, 12 bp, Homo sapiens
ttgctaactggt

SEQ ID NO: 5336931 - DNA, 15 bp, Homo sapiens
ttgctaactggttaa

SEQ ID NO: 5336932 - DNA, 19 bp, Homo sapiens
ttgctaagataattaaatg

SEQ ID NO: 5336933 - DNA, 19 bp, Homo sapiens
ttgctaagtaaatctcttc

SEQ ID NO: 5336934 - DNA, 21 bp, Homo sapiens
ttgctaagtaaatctcttctg

SEQ ID NO: 5336935 - DNA, 12 bp, Homo sapiens
ttgctaataatg

SEQ ID NO: 5336936 - DNA, 18 bp, Homo sapiens
ttgctaataccaaaattg

SEQ ID NO: 5336937 - DNA, 20 bp, Homo sapiens
ttgctaataccaactatttc

SEQ ID NO: 5336938 - DNA, 22 bp, Homo sapiens
ttgctaataccaactatttcaa

SEQ ID NO: 5336939 - DNA, 23 bp, Homo sapiens
ttgctaataccaactatttcaat

SEQ ID NO: 5336940 - DNA, 16 bp, Homo sapiens
ttgctaatcaaagcca

SEQ ID NO: 5336941 - DNA, 22 bp, Homo sapiens
ttgctaatcaaagccagggtct

SEQ ID NO: 5336942 - DNA, 18 bp, Homo sapiens
ttgctaatcagtgtctca

SEQ ID NO: 5336943 - DNA, 21 bp, Homo sapiens
ttgctaatcagtgtctcacac

SEQ ID NO: 5336944 - DNA, 13 bp, Homo sapiens
ttgctaatgttgc

SEQ ID NO: 5336945 - DNA, 15 bp, Homo sapiens
ttgctaattttctca

SEQ ID NO: 5336946 - DNA, 23 bp, Homo sapiens
ttgctaattttctcaaaagcatt

SEQ ID NO: 5336947 - DNA, 17 bp, Homo sapiens
ttgctaatttttattaa

SEQ ID NO: 5336948 - DNA, 12 bp, Homo sapiens
ttgctacaaatt

SEQ ID NO: 5336949 - DNA, 18 bp, Homo sapiens
ttgctacaaatttatgca

SEQ ID NO: 5336950 - DNA, 17 bp, Homo sapiens
ttgctacaataaatgct

SEQ ID NO: 5336951 - DNA, 18 bp, Homo sapiens
ttgctacaataaatgctg

SEQ ID NO: 5336952 - DNA, 18 bp, Homo sapiens
ttgctacacttacaagta

SEQ ID NO: 5336953 - DNA, 13 bp, Homo sapiens
ttgctacataatt

SEQ ID NO: 5336954 - DNA, 16 bp, Homo sapiens
ttgctacataattatc

SEQ ID NO: 5336955 - DNA, 20 bp, Homo sapiens
ttgctacatcagagtgtatt

SEQ ID NO: 5336956 - DNA, 22 bp, Homo sapiens
ttgctacatcagagtgtatttt

SEQ ID NO: 5336957 - DNA, 22 bp, Homo sapiens
ttgctaccaaaaactagacatt

SEQ ID NO: 5336958 - DNA, 14 bp, Homo sapiens
ttgctaccaagttt

SEQ ID NO: 5336959 - DNA, 12 bp, Homo sapiens
ttgctaccagta

SEQ ID NO: 5336960 - DNA, 15 bp, Homo sapiens
ttgctaccagtattt

SEQ ID NO: 5336961 - DNA, 21 bp, Homo sapiens
ttgctacctcagtgctcctgg

SEQ ID NO: 5336962 - DNA, 19 bp, Homo sapiens
ttgctacctgtgagcatcc

SEQ ID NO: 5336963 - DNA, 14 bp, Homo sapiens
ttgctacgtgcctc

SEQ ID NO: 5336964 - DNA, 20 bp, Homo sapiens
ttgctactataatcaaatga

SEQ ID NO: 5336965 - DNA, 13 bp, Homo sapiens
ttgctactgatgc

SEQ ID NO: 5336966 - DNA, 19 bp, Homo sapiens
ttgctactgttgtaagaat

SEQ ID NO: 5336967 - DNA, 16 bp, Homo sapiens
ttgctagaattgattt

SEQ ID NO: 5336968 - DNA, 18 bp, Homo sapiens
ttgctagagctcctccct

SEQ ID NO: 5336969 - DNA, 15 bp, Homo sapiens
ttgctagaggtggca

SEQ ID NO: 5336970 - DNA, 22 bp, Homo sapiens
ttgctagcaacaacttactaaa

SEQ ID NO: 5336971 - DNA, 20 bp, Homo sapiens
ttgctagccagcattccata

SEQ ID NO: 5336972 - DNA, 17 bp, Homo sapiens
ttgctaggagccccagc

SEQ ID NO: 5336973 - DNA, 15 bp, Homo sapiens
ttgctagtatttgaa

SEQ ID NO: 5336974 - DNA, 18 bp, Homo sapiens
ttgctagtatttgaatta

SEQ ID NO: 5336975 - DNA, 20 bp, Homo sapiens
ttgctagtgatacactgtat

SEQ ID NO: 5336976 - DNA, 21 bp, Homo sapiens
ttgctagtgatacactgtatc

SEQ ID NO: 5336977 - DNA, 17 bp, Homo sapiens
ttgctagtgatttcatt

SEQ ID NO: 5336978 - DNA, 15 bp, Homo sapiens
ttgctagtgtctttg

SEQ ID NO: 5336979 - DNA, 16 bp, Homo sapiens
ttgctagttctgctgc

SEQ ID NO: 5336980 - DNA, 17 bp, Homo sapiens
ttgctagttctgctgcc

SEQ ID NO: 5336981 - DNA, 21 bp, Homo sapiens
ttgctagttttttgcttctct

SEQ ID NO: 5336982 - DNA, 12 bp, Homo sapiens
ttgctatagtga

SEQ ID NO: 5336983 - DNA, 21 bp, Homo sapiens
ttgctatagtgacatgcagtt

SEQ ID NO: 5336984 - DNA, 13 bp, Homo sapiens
ttgctatcaagaa

SEQ ID NO: 5336985 - DNA, 16 bp, Homo sapiens
ttgctatcaagaaatg

SEQ ID NO: 5336986 - DNA, 19 bp, Homo sapiens
ttgctatcatatattataa

SEQ ID NO: 5336987 - DNA, 14 bp, Homo sapiens
ttgctatcctgcag

SEQ ID NO: 5336988 - DNA, 21 bp, Homo sapiens
ttgctatctaatggggaaatg

SEQ ID NO: 5336989 - DNA, 19 bp, Homo sapiens
ttgctatctctcaagagtg

SEQ ID NO: 5336990 - DNA, 14 bp, Homo sapiens
ttgctatcttaatt

SEQ ID NO: 5336991 - DNA, 22 bp, Homo sapiens
ttgctatggcaggataagaaag

SEQ ID NO: 5336992 - DNA, 17 bp, Homo sapiens
ttgctatgttcttctgt

SEQ ID NO: 5336993 - DNA, 12 bp, Homo sapiens
ttgctattctgt

SEQ ID NO: 5336994 - DNA, 15 bp, Homo sapiens
ttgctattctgtccc

SEQ ID NO: 5336995 - DNA, 16 bp, Homo sapiens
ttgctattctgtccct

SEQ ID NO: 5336996 - DNA, 15 bp, Homo sapiens
ttgctattgtaaata

SEQ ID NO: 5336997 - DNA, 14 bp, Homo sapiens
ttgctattgtaagg

SEQ ID NO: 5336998 - DNA, 18 bp, Homo sapiens
ttgctattgtaaggtctt

SEQ ID NO: 5336999 - DNA, 20 bp, Homo sapiens
ttgctattgtaaggtctttg

SEQ ID NO: 5337000 - DNA, 21 bp, Homo sapiens
ttgctattgtaaggtctttgt

SEQ ID NO: 5337001 - DNA, 12 bp, Homo sapiens
ttgctatttcaa

SEQ ID NO: 5337002 - DNA, 12 bp, Homo sapiens
ttgctatttcta

SEQ ID NO: 5337003 - DNA, 17 bp, Homo sapiens
ttgctcaaaattgcttc

SEQ ID NO: 5337004 - DNA, 22 bp, Homo sapiens
ttgctcaaaattgcttctaaaa

SEQ ID NO: 5337005 - DNA, 18 bp, Homo sapiens
ttgctcaagttcaccagc

SEQ ID NO: 5337006 - DNA, 21 bp, Homo sapiens
ttgctcaagttcattgatgac

SEQ ID NO: 5337007 - DNA, 21 bp, Homo sapiens
ttgctcaccaagctgttccac

SEQ ID NO: 5337008 - DNA, 15 bp, Homo sapiens
ttgctcacccaggac

SEQ ID NO: 5337009 - DNA, 20 bp, Homo sapiens
ttgctcacccaggacctctg

SEQ ID NO: 5337010 - DNA, 21 bp, Homo sapiens
ttgctcacccaggacctctgg

SEQ ID NO: 5337011 - DNA, 20 bp, Homo sapiens
ttgctcactcactcactcca

SEQ ID NO: 5337012 - DNA, 23 bp, Homo sapiens
ttgctcactcactcactccaaga

SEQ ID NO: 5337013 - DNA, 12 bp, Homo sapiens
ttgctcactcag

SEQ ID NO: 5337014 - DNA, 20 bp, Homo sapiens
ttgctcactcaggactttga

SEQ ID NO: 5337015 - DNA, 20 bp, Homo sapiens
ttgctcagacgagacaccct

SEQ ID NO: 5337016 - DNA, 16 bp, Homo sapiens
ttgctcagagtgaaga

SEQ ID NO: 5337017 - DNA, 19 bp, Homo sapiens
ttgctcagatagatctgtg

SEQ ID NO: 5337018 - DNA, 14 bp, Homo sapiens
ttgctcagccccag

SEQ ID NO: 5337019 - DNA, 17 bp, Homo sapiens
ttgctcagccccagctt

SEQ ID NO: 5337020 - DNA, 14 bp, Homo sapiens
ttgctcagcccgct

SEQ ID NO: 5337021 - DNA, 15 bp, Homo sapiens
ttgctcagcccgctt

SEQ ID NO: 5337022 - DNA, 20 bp, Homo sapiens
ttgctcagcccgcttggcca

SEQ ID NO: 5337023 - DNA, 13 bp, Homo sapiens
ttgctcagtctcc

SEQ ID NO: 5337024 - DNA, 17 bp, Homo sapiens
ttgctcagtgcctcctg

SEQ ID NO: 5337025 - DNA, 21 bp, Homo sapiens
ttgctcagtgcctcctggccg

SEQ ID NO: 5337026 - DNA, 15 bp, Homo sapiens
ttgctcataagtaaa

SEQ ID NO: 5337027 - DNA, 15 bp, Homo sapiens
ttgctttagagacag

SEQ ID NO: 5337028 - DNA, 19 bp, Homo sapiens
ttgctttagtatgctggct

SEQ ID NO: 5337029 - DNA, 16 bp, Homo sapiens
ttgctttataaataaa

SEQ ID NO: 5337030 - DNA, 21 bp, Homo sapiens
ttgctttataatttctaccca

SEQ ID NO: 5337031 - DNA, 12 bp, Homo sapiens
ttgctttcaatt

SEQ ID NO: 5337032 - DNA, 13 bp, Homo sapiens
ttgctttcactct

SEQ ID NO: 5337033 - DNA, 10 bp, Homo sapiens
ttgctttcct

SEQ ID NO: 5337034 - DNA, 14 bp, Homo sapiens
ttgctttcctttcc

SEQ ID NO: 5337035 - DNA, 16 bp, Homo sapiens
ttgctttctattatca

SEQ ID NO: 5337036 - DNA, 15 bp, Homo sapiens
ttgctttctctctca

SEQ ID NO: 5337037 - DNA, 18 bp, Homo sapiens
ttgctttctttagaattt

SEQ ID NO: 5337038 - DNA, 21 bp, Homo sapiens
ttgctttgaagtagctctttt

SEQ ID NO: 5337039 - DNA, 22 bp, Homo sapiens
ttgctttgagacctttcctctc

SEQ ID NO: 5337040 - DNA, 14 bp, Homo sapiens
ttgctttgccaaaa

SEQ ID NO: 5337041 - DNA, 19 bp, Homo sapiens
ttgctttgccaaaatacca

SEQ ID NO: 5337042 - DNA, 18 bp, Homo sapiens
ttgctttgccagagcagg

SEQ ID NO: 5337043 - DNA, 13 bp, Homo sapiens
ttgctttgcccaa

SEQ ID NO: 5337044 - DNA, 16 bp, Homo sapiens
ttgctttgcccaagat

SEQ ID NO: 5337045 - DNA, 11 bp, Homo sapiens
ttgctttgctg

SEQ ID NO: 5337046 - DNA, 14 bp, Homo sapiens
ttgctttgctgcac

SEQ ID NO: 5337047 - DNA, 12 bp, Homo sapiens
ttgctttgcttt

SEQ ID NO: 5337048 - DNA, 16 bp, Homo sapiens
ttgctttggatacaca

SEQ ID NO: 5337049 - DNA, 18 bp, Homo sapiens
ttgctttgggattttctt

SEQ ID NO: 5337050 - DNA, 19 bp, Homo sapiens
ttgctttggttaaaaatgg

SEQ ID NO: 5337051 - DNA, 22 bp, Homo sapiens
ttgctttgtaagtgaaaaacat

SEQ ID NO: 5337052 - DNA, 13 bp, Homo sapiens
ttgctttgtatgc

SEQ ID NO: 5337053 - DNA, 13 bp, Homo sapiens
ttgctttgtctgg

SEQ ID NO: 5337054 - DNA, 15 bp, Homo sapiens
ttgctttgtgttctt

SEQ ID NO: 5337055 - DNA, 23 bp, Homo sapiens
ttgctttgttaaaaaaaaaaaga

SEQ ID NO: 5337056 - DNA, 14 bp, Homo sapiens
ttgctttgttgcac

SEQ ID NO: 5337057 - DNA, 14 bp, Homo sapiens
ttgctttgtttaag

SEQ ID NO: 5337058 - DNA, 21 bp, Homo sapiens
ttgcttttaaaactacttagc

SEQ ID NO: 5337059 - DNA, 15 bp, Homo sapiens
ttgcttttaaaattt

SEQ ID NO: 5337060 - DNA, 14 bp, Homo sapiens
ttgcttttaattaa

SEQ ID NO: 5337061 - DNA, 14 bp, Homo sapiens
ttgcttttagaaaa

SEQ ID NO: 5337062 - DNA, 18 bp, Homo sapiens
ttgcttttatcagtgtta

SEQ ID NO: 5337063 - DNA, 19 bp, Homo sapiens
ttgcttttcactggcataa

SEQ ID NO: 5337064 - DNA, 13 bp, Homo sapiens
ttgcttttcatgc

SEQ ID NO: 5337065 - DNA, 17 bp, Homo sapiens
ttgcttttcatgcaaac

SEQ ID NO: 5337066 - DNA, 21 bp, Homo sapiens
ttgcttttccctcttttctta

SEQ ID NO: 5337067 - DNA, 23 bp, Homo sapiens
ttgcttttgaaggaatacaatat

SEQ ID NO: 5337068 - DNA, 14 bp, Homo sapiens
ttgcttttgagaga

SEQ ID NO: 5337069 - DNA, 15 bp, Homo sapiens
ttgcttttgagagaa

SEQ ID NO: 5337070 - DNA, 14 bp, Homo sapiens
ttgcttttgcctct

SEQ ID NO: 5337071 - DNA, 13 bp, Homo sapiens
ttgcttttgcttc

SEQ ID NO: 5337072 - DNA, 13 bp, Homo sapiens
ttgcttttgtgaa

SEQ ID NO: 5337073 - DNA, 12 bp, Homo sapiens
ttgcttttgtgc

SEQ ID NO: 5337074 - DNA, 21 bp, Homo sapiens
ttgctttttaaactgatgtat

SEQ ID NO: 5337075 - DNA, 12 bp, Homo sapiens
ttgctttttcac

SEQ ID NO: 5337076 - DNA, 19 bp, Homo sapiens
ttgctttttcacagtcact

SEQ ID NO: 5337077 - DNA, 15 bp, Homo sapiens
ttgctttttcttctc

SEQ ID NO: 5337078 - DNA, 15 bp, Homo sapiens
ttgcttttttccaaa

SEQ ID NO: 5337079 - DNA, 13 bp, Homo sapiens
ttgcttttttgta

SEQ ID NO: 5337080 - DNA, 13 bp, Homo sapiens
ttggaaaaaaatt

SEQ ID NO: 5337081 - DNA, 14 bp, Homo sapiens
ttggaaaaaaatta

SEQ ID NO: 5337082 - DNA, 21 bp, Homo sapiens
ttggaaaaaaattacaaaatg

SEQ ID NO: 5337083 - DNA, 17 bp, Homo sapiens
ttggaaaaaactctgaa

SEQ ID NO: 5337084 - DNA, 20 bp, Homo sapiens
ttggaaaaagaaagaaacac

SEQ ID NO: 5337085 - DNA, 13 bp, Homo sapiens
ttggaaaaagtga

SEQ ID NO: 5337086 - DNA, 21 bp, Homo sapiens
ttggaaaaatgggtcttttat

SEQ ID NO: 5337087 - DNA, 20 bp, Homo sapiens
ttggaaaacgatttaattta

SEQ ID NO: 5337088 - DNA, 14 bp, Homo sapiens
ttggaaaagaaaca

SEQ ID NO: 5337089 - DNA, 14 bp, Homo sapiens
ttggaaaagaaatc

SEQ ID NO: 5337090 - DNA, 16 bp, Homo sapiens
ttggaaaagaaatcaa

SEQ ID NO: 5337091 - DNA, 21 bp, Homo sapiens
ttggaaaagaaatcaattttt

SEQ ID NO: 5337092 - DNA, 17 bp, Homo sapiens
ttggaaaataaattatt

SEQ ID NO: 5337093 - DNA, 19 bp, Homo sapiens
ttggaaaataataaaagaa

SEQ ID NO: 5337094 - DNA, 20 bp, Homo sapiens
ttggaaaatgacattttact

SEQ ID NO: 5337095 - DNA, 15 bp, Homo sapiens
ttggaaaatgtgtct

SEQ ID NO: 5337096 - DNA, 13 bp, Homo sapiens
ttggaaacaaatc

SEQ ID NO: 5337097 - DNA, 17 bp, Homo sapiens
ttggaaacactaaatgt

SEQ ID NO: 5337098 - DNA, 19 bp, Homo sapiens
ttggaaacactaaatgtta

SEQ ID NO: 5337099 - DNA, 21 bp, Homo sapiens
ttggaaacactaaatgttaaa

SEQ ID NO: 5337100 - DNA, 23 bp, Homo sapiens
ttggaaacagtataatttgacaa

SEQ ID NO: 5337101 - DNA, 21 bp, Homo sapiens
ttggaaacatttttgagatat

SEQ ID NO: 5337102 - DNA, 19 bp, Homo sapiens
ttggaaactaataaaatat

SEQ ID NO: 5337103 - DNA, 17 bp, Homo sapiens
ttggaaagaacatttaa

SEQ ID NO: 5337104 - DNA, 17 bp, Homo sapiens
ttggaaagagtaggaag

SEQ ID NO: 5337105 - DNA, 21 bp, Homo sapiens
ttggaaagatgttaagcattt

SEQ ID NO: 5337106 - DNA, 22 bp, Homo sapiens
ttggaaagcacaaacttctgta

SEQ ID NO: 5337107 - DNA, 22 bp, Homo sapiens
ttggaaagctcctagcagagag

SEQ ID NO: 5337108 - DNA, 13 bp, Homo sapiens
ttggaaaggaaaa

SEQ ID NO: 5337109 - DNA, 21 bp, Homo sapiens
ttggaaaggaatgcaaagatg

SEQ ID NO: 5337110 - DNA, 16 bp, Homo sapiens
ttggaaaggaccaaat

SEQ ID NO: 5337111 - DNA, 18 bp, Homo sapiens
ttggaaaggggaggagct

SEQ ID NO: 5337112 - DNA, 17 bp, Homo sapiens
ttggaaaggtttcaaga

SEQ ID NO: 5337113 - DNA, 22 bp, Homo sapiens
ttggaaagtacactctgctgtt

SEQ ID NO: 5337114 - DNA, 12 bp, Homo sapiens
ttggaaagtcag

SEQ ID NO: 5337115 - DNA, 18 bp, Homo sapiens
ttggaaagttactgtaaa

SEQ ID NO: 5337116 - DNA, 20 bp, Homo sapiens
ttggaaagttactgtaaatg

SEQ ID NO: 5337117 - DNA, 17 bp, Homo sapiens
ttggaaagttcagccag

SEQ ID NO: 5337118 - DNA, 15 bp, Homo sapiens
ttggaaataaaaatg

SEQ ID NO: 5337119 - DNA, 17 bp, Homo sapiens
ttggaaataaaaatgtt

SEQ ID NO: 5337120 - DNA, 17 bp, Homo sapiens
ttggaaataaaccattg

SEQ ID NO: 5337121 - DNA, 21 bp, Homo sapiens
ttggaaataaaccattggaca

SEQ ID NO: 5337122 - DNA, 18 bp, Homo sapiens
ttggaaatagaaagaagc

SEQ ID NO: 5337123 - DNA, 14 bp, Homo sapiens
ttggaaatattaaa

SEQ ID NO: 5337124 - DNA, 17 bp, Homo sapiens
ttggaaatattaaaaga

SEQ ID NO: 5337125 - DNA, 13 bp, Homo sapiens
ttggaaatattca

SEQ ID NO: 5337126 - DNA, 18 bp, Homo sapiens
ttggaaatcaaatgtaaa

SEQ ID NO: 5337127 - DNA, 12 bp, Homo sapiens
ttggaaatcttt

SEQ ID NO: 5337128 - DNA, 16 bp, Homo sapiens
ttggaaatggggagct

SEQ ID NO: 5337129 - DNA, 17 bp, Homo sapiens
ttggaaatggggagctg

SEQ ID NO: 5337130 - DNA, 18 bp, Homo sapiens
ttggaaatggggagctgg

SEQ ID NO: 5337131 - DNA, 19 bp, Homo sapiens
ttggaaatggggagctggc

SEQ ID NO: 5337132 - DNA, 21 bp, Homo sapiens
ttggaaatgtacttttggata

SEQ ID NO: 5337133 - DNA, 18 bp, Homo sapiens
ttggaaatgtctgctggt

SEQ ID NO: 5337134 - DNA, 13 bp, Homo sapiens
ttggaaatgtgtt

SEQ ID NO: 5337135 - DNA, 18 bp, Homo sapiens
ttggaaattcctgtactg

SEQ ID NO: 5337136 - DNA, 23 bp, Homo sapiens
ttggaaattgggtgtgccctggc

SEQ ID NO: 5337137 - DNA, 19 bp, Homo sapiens
ttggaaattgttgtatatc

SEQ ID NO: 5337138 - DNA, 16 bp, Homo sapiens
ttggaaatttagcatt

SEQ ID NO: 5337139 - DNA, 23 bp, Homo sapiens
ttggaaatttccattaaaggtgg

SEQ ID NO: 5337140 - DNA, 19 bp, Homo sapiens
ttggaacactgtttaggta

SEQ ID NO: 5337141 - DNA, 19 bp, Homo sapiens
ttggaacagtaatcagttt

SEQ ID NO: 5337142 - DNA, 14 bp, Homo sapiens
ttggaacagtgttt

SEQ ID NO: 5337143 - DNA, 22 bp, Homo sapiens
ttggaacatgtcggagtagaaa

SEQ ID NO: 5337144 - DNA, 22 bp, Homo sapiens
ttggaacattggaatgttctca

SEQ ID NO: 5337145 - DNA, 13 bp, Homo sapiens
ttggaaccaaagt

SEQ ID NO: 5337146 - DNA, 14 bp, Homo sapiens
ttggaaccttgttt

SEQ ID NO: 5337147 - DNA, 19 bp, Homo sapiens
ttggaaccttgttttggac

SEQ ID NO: 5337148 - DNA, 22 bp, Homo sapiens
ttggaacgacaaaatgaaacag

SEQ ID NO: 5337149 - DNA, 22 bp, Homo sapiens
ttggaactaacacgtgatgtga

SEQ ID NO: 5337150 - DNA, 16 bp, Homo sapiens
ttggaactctgcttga

SEQ ID NO: 5337151 - DNA, 17 bp, Homo sapiens
ttggaactgaagggggc

SEQ ID NO: 5337152 - DNA, 13 bp, Homo sapiens
ttggaactgcacc

SEQ ID NO: 5337153 - DNA, 16 bp, Homo sapiens
ttggaactgcaccacc

SEQ ID NO: 5337154 - DNA, 16 bp, Homo sapiens
ttggaactggaggcag

SEQ ID NO: 5337155 - DNA, 14 bp, Homo sapiens
ttggaacttacaaa

SEQ ID NO: 5337156 - DNA, 14 bp, Homo sapiens
ttggaacttgcctg

SEQ ID NO: 5337157 - DNA, 20 bp, Homo sapiens
ttggaactttctgttcccta

SEQ ID NO: 5337158 - DNA, 12 bp, Homo sapiens
ttggaagaaaaa

SEQ ID NO: 5337159 - DNA, 16 bp, Homo sapiens
ttggaagaaaaaatct

SEQ ID NO: 5337160 - DNA, 12 bp, Homo sapiens
ttggaagaagtg

SEQ ID NO: 5337161 - DNA, 20 bp, Homo sapiens
ttggaagaagttttttactt

SEQ ID NO: 5337162 - DNA, 22 bp, Homo sapiens
ttggaagaagttttttactttg

SEQ ID NO: 5337163 - DNA, 15 bp, Homo sapiens
ttggaagaccccacc

SEQ ID NO: 5337164 - DNA, 15 bp, Homo sapiens
ttggaagagaatcac

SEQ ID NO: 5337165 - DNA, 23 bp, Homo sapiens
ttggaagagacaaagatttcttc

SEQ ID NO: 5337166 - DNA, 15 bp, Homo sapiens
ttggaagagcagcac

SEQ ID NO: 5337167 - DNA, 16 bp, Homo sapiens
ttggaagagcagcacc

SEQ ID NO: 5337168 - DNA, 21 bp, Homo sapiens
ttggaagcaggttaaatgttt

SEQ ID NO: 5337169 - DNA, 14 bp, Homo sapiens
ttggaagctctgtt

SEQ ID NO: 5337170 - DNA, 20 bp, Homo sapiens
ttggaagctgattcccagag

SEQ ID NO: 5337171 - DNA, 22 bp, Homo sapiens
ttggaagctgattcccagagca

SEQ ID NO: 5337172 - DNA, 14 bp, Homo sapiens
ttggaaggagaggg

SEQ ID NO: 5337173 - DNA, 15 bp, Homo sapiens
ttggaaggagcagaa

SEQ ID NO: 5337174 - DNA, 13 bp, Homo sapiens
ttggaaggatctg

SEQ ID NO: 5337175 - DNA, 16 bp, Homo sapiens
ttggaaggggccttgc

SEQ ID NO: 5337176 - DNA, 22 bp, Homo sapiens
ttggaagggggagacaggaagt

SEQ ID NO: 5337177 - DNA, 23 bp, Homo sapiens
ttggaagggggagacaggaagtt

SEQ ID NO: 5337178 - DNA, 18 bp, Homo sapiens
ttggaaggtcttttgagg

SEQ ID NO: 5337179 - DNA, 13 bp, Homo sapiens
ttggaaggtttta

SEQ ID NO: 5337180 - DNA, 12 bp, Homo sapiens
ttggaagtgaaa

SEQ ID NO: 5337181 - DNA, 20 bp, Homo sapiens
ttggaagtgaaaactttgta

SEQ ID NO: 5337182 - DNA, 21 bp, Homo sapiens
ttggaagtgttcaagaaataa

SEQ ID NO: 5337183 - DNA, 17 bp, Homo sapiens
ttggaagtgttccctga

SEQ ID NO: 5337184 - DNA, 18 bp, Homo sapiens
ttggaagtttagctctga

SEQ ID NO: 5337185 - DNA, 19 bp, Homo sapiens
ttggaagtttagctctgag

SEQ ID NO: 5337186 - DNA, 21 bp, Homo sapiens
ttggaagtttagctctgagaa

SEQ ID NO: 5337187 - DNA, 15 bp, Homo sapiens
ttggaagttttaatc

SEQ ID NO: 5337188 - DNA, 16 bp, Homo sapiens
ttggaataataatttt

SEQ ID NO: 5337189 - DNA, 23 bp, Homo sapiens
ttggaataataattttcctccta

SEQ ID NO: 5337190 - DNA, 13 bp, Homo sapiens
ttggaatactttt

SEQ ID NO: 5337191 - DNA, 15 bp, Homo sapiens
ttggaatataattgt

SEQ ID NO: 5337192 - DNA, 23 bp, Homo sapiens
ttggaatattaaaaaacttcatg

SEQ ID NO: 5337193 - DNA, 22 bp, Homo sapiens
ttggaatattccactatttgca

SEQ ID NO: 5337194 - DNA, 18 bp, Homo sapiens
ttggaatatttgaataat

SEQ ID NO: 5337195 - DNA, 13 bp, Homo sapiens
ttggaatatttta

SEQ ID NO: 5337196 - DNA, 22 bp, Homo sapiens
ttggaatattttatcctgtatt

SEQ ID NO: 5337197 - DNA, 15 bp, Homo sapiens
ttggaatctagaaga

SEQ ID NO: 5337198 - DNA, 19 bp, Homo sapiens
ttggaatcttcacctcaga

SEQ ID NO: 5337199 - DNA, 21 bp, Homo sapiens
ttggaatcttcacctcagagt

SEQ ID NO: 5337200 - DNA, 23 bp, Homo sapiens
ttggaatgactggggagggctgc

SEQ ID NO: 5337201 - DNA, 13 bp, Homo sapiens
ttggaatgcacag

SEQ ID NO: 5337202 - DNA, 22 bp, Homo sapiens
ttggaatgcagaggtctccaaa

SEQ ID NO: 5337203 - DNA, 17 bp, Homo sapiens
ttggaatgggcagctca

SEQ ID NO: 5337204 - DNA, 11 bp, Homo sapiens
ttggaatgtta

SEQ ID NO: 5337205 - DNA, 20 bp, Homo sapiens
ttggaatgttgttaaatgct

SEQ ID NO: 5337206 - DNA, 20 bp, Homo sapiens
ttggcccccttcaggagcct

SEQ ID NO: 5337207 - DNA, 11 bp, Homo sapiens
ttggcccctct

SEQ ID NO: 5337208 - DNA, 16 bp, Homo sapiens
ttggcccctggaacct

SEQ ID NO: 5337209 - DNA, 16 bp, Homo sapiens
ttggcccctgtgtgag

SEQ ID NO: 5337210 - DNA, 22 bp, Homo sapiens
ttggccctcctcagctccctgc

SEQ ID NO: 5337211 - DNA, 13 bp, Homo sapiens
ttggccctgcccc

SEQ ID NO: 5337212 - DNA, 15 bp, Homo sapiens
ttggccctgcgccct

SEQ ID NO: 5337213 - DNA, 14 bp, Homo sapiens
ttggccctggagcc

SEQ ID NO: 5337214 - DNA, 15 bp, Homo sapiens
ttggcccttgtcttt

SEQ ID NO: 5337215 - DNA, 16 bp, Homo sapiens
ttggcccttgtctttt

SEQ ID NO: 5337216 - DNA, 17 bp, Homo sapiens
ttggccctttaatattt

SEQ ID NO: 5337217 - DNA, 17 bp, Homo sapiens
ttggccgagctcctggg

SEQ ID NO: 5337218 - DNA, 15 bp, Homo sapiens
ttggccggctggccg

SEQ ID NO: 5337219 - DNA, 21 bp, Homo sapiens
ttggccgggcgcggtggctca

SEQ ID NO: 5337220 - DNA, 22 bp, Homo sapiens
ttggcctcaagcaaggaagcag

SEQ ID NO: 5337221 - DNA, 15 bp, Homo sapiens
ttggcctcagctggc

SEQ ID NO: 5337222 - DNA, 18 bp, Homo sapiens
ttggcctcagggccagga

SEQ ID NO: 5337223 - DNA, 20 bp, Homo sapiens
ttggcctcagggccaggaag

SEQ ID NO: 5337224 - DNA, 10 bp, Homo sapiens
ttggcctccc

SEQ ID NO: 5337225 - DNA, 14 bp, Homo sapiens
ttggcctcccagaa

SEQ ID NO: 5337226 - DNA, 13 bp, Homo sapiens
ttggcctccggcc

SEQ ID NO: 5337227 - DNA, 18 bp, Homo sapiens
ttggcctcctgcaaagtc

SEQ ID NO: 5337228 - DNA, 15 bp, Homo sapiens
ttggcctcctgcttc

SEQ ID NO: 5337229 - DNA, 17 bp, Homo sapiens
ttggcctcgcctgggcc

SEQ ID NO: 5337230 - DNA, 18 bp, Homo sapiens
ttggcctcgcctgggccc

SEQ ID NO: 5337231 - DNA, 14 bp, Homo sapiens
ttggcctctgtctc

SEQ ID NO: 5337232 - DNA, 17 bp, Homo sapiens
ttggcctgaacagatgt

SEQ ID NO: 5337233 - DNA, 11 bp, Homo sapiens
ttggcctgagt

SEQ ID NO: 5337234 - DNA, 11 bp, Homo sapiens
ttggcctgcct

SEQ ID NO: 5337235 - DNA, 13 bp, Homo sapiens
ttggcctgctgtg

SEQ ID NO: 5337236 - DNA, 14 bp, Homo sapiens
ttggcctgctgtga

SEQ ID NO: 5337237 - DNA, 13 bp, Homo sapiens
ttggcctggcctc

SEQ ID NO: 5337238 - DNA, 24 bp, Homo sapiens
ttggcctggtggccatgtcgcctg

SEQ ID NO: 5337239 - DNA, 12 bp, Homo sapiens
ttggcctgtcac

SEQ ID NO: 5337240 - DNA, 19 bp, Homo sapiens
ttggcctgtttgatgtatg

SEQ ID NO: 5337241 - DNA, 21 bp, Homo sapiens
ttggcctgtttgatgtatgtg

SEQ ID NO: 5337242 - DNA, 16 bp, Homo sapiens
ttggccttaactggcc

SEQ ID NO: 5337243 - DNA, 21 bp, Homo sapiens
ttggccttaagaactgtgtct

SEQ ID NO: 5337244 - DNA, 21 bp, Homo sapiens
ttggccttggcttttctagcc

SEQ ID NO: 5337245 - DNA, 15 bp, Homo sapiens
ttggcctttcctgga

SEQ ID NO: 5337246 - DNA, 18 bp, Homo sapiens
ttggcctttcctggaagc

SEQ ID NO: 5337247 - DNA, 12 bp, Homo sapiens
ttggcctttgta

SEQ ID NO: 5337248 - DNA, 13 bp, Homo sapiens
ttggcctttgtaa

SEQ ID NO: 5337249 - DNA, 18 bp, Homo sapiens
ttggcgaatctcaaaatt

SEQ ID NO: 5337250 - DNA, 18 bp, Homo sapiens
ttggcgctattacaaata

SEQ ID NO: 5337251 - DNA, 22 bp, Homo sapiens
ttggcggggaggaggaaatccc

SEQ ID NO: 5337252 - DNA, 21 bp, Homo sapiens
ttggcgggggcacgtgtgggc

SEQ ID NO: 5337253 - DNA, 22 bp, Homo sapiens
ttggcgggtccacttgccaggg

SEQ ID NO: 5337254 - DNA, 17 bp, Homo sapiens
ttggcgtaggctacaga

SEQ ID NO: 5337255 - DNA, 22 bp, Homo sapiens
ttggcgtaggctacagagaagc

SEQ ID NO: 5337256 - DNA, 14 bp, Homo sapiens
ttggcgtgtcccag

SEQ ID NO: 5337257 - DNA, 20 bp, Homo sapiens
ttggcgtgtgtccctgtggt

SEQ ID NO: 5337258 - DNA, 20 bp, Homo sapiens
ttggctaactatatttgctt

SEQ ID NO: 5337259 - DNA, 21 bp, Homo sapiens
ttggctagaggttcaaagata

SEQ ID NO: 5337260 - DNA, 22 bp, Homo sapiens
ttggctagtactttgatgctcc

SEQ ID NO: 5337261 - DNA, 18 bp, Homo sapiens
ttggctattgaagatgct

SEQ ID NO: 5337262 - DNA, 21 bp, Homo sapiens
ttggctattgaagatgctgcc

SEQ ID NO: 5337263 - DNA, 18 bp, Homo sapiens
ttggctatttctgtgtcc

SEQ ID NO: 5337264 - DNA, 17 bp, Homo sapiens
ttggctatttgaaatac

SEQ ID NO: 5337265 - DNA, 17 bp, Homo sapiens
ttggctcaataaagatt

SEQ ID NO: 5337266 - DNA, 18 bp, Homo sapiens
ttggctcacaaggcccag

SEQ ID NO: 5337267 - DNA, 18 bp, Homo sapiens
ttggctcacactcgacat

SEQ ID NO: 5337268 - DNA, 22 bp, Homo sapiens
ttggctcacccaagcaaggcca

SEQ ID NO: 5337269 - DNA, 12 bp, Homo sapiens
ttggctcagaaa

SEQ ID NO: 5337270 - DNA, 20 bp, Homo sapiens
ttggctcagacacctagact

SEQ ID NO: 5337271 - DNA, 13 bp, Homo sapiens
ttggctcagacat

SEQ ID NO: 5337272 - DNA, 13 bp, Homo sapiens
ttggctcaggcag

SEQ ID NO: 5337273 - DNA, 15 bp, Homo sapiens
ttggctcaggcagac

SEQ ID NO: 5337274 - DNA, 17 bp, Homo sapiens
ttggctcccatcttttg

SEQ ID NO: 5337275 - DNA, 22 bp, Homo sapiens
ttggctcccattcactcttcca

SEQ ID NO: 5337276 - DNA, 15 bp, Homo sapiens
ttggctcccgggggc

SEQ ID NO: 5337277 - DNA, 18 bp, Homo sapiens
ttggctcctgagaaaggt

SEQ ID NO: 5337278 - DNA, 20 bp, Homo sapiens
ttggctcctgagaaaggtga

SEQ ID NO: 5337279 - DNA, 14 bp, Homo sapiens
ttggctcctttccc

SEQ ID NO: 5337280 - DNA, 18 bp, Homo sapiens
ttggctcctttcccacag

SEQ ID NO: 5337281 - DNA, 21 bp, Homo sapiens
ttggctcgaatctctgtgcct

SEQ ID NO: 5337282 - DNA, 22 bp, Homo sapiens
ttggctcgaatctctgtgcctt

SEQ ID NO: 5337283 - DNA, 15 bp, Homo sapiens
ttggctcgggacttc

SEQ ID NO: 5337284 - DNA, 17 bp, Homo sapiens
ttggctcgggacttcaa

SEQ ID NO: 5337285 - DNA, 21 bp, Homo sapiens
ttggctcgggacttcaaaatc

SEQ ID NO: 5337286 - DNA, 13 bp, Homo sapiens
ttggctctcccac

SEQ ID NO: 5337287 - DNA, 12 bp, Homo sapiens
ttggctctgagg

SEQ ID NO: 5337288 - DNA, 12 bp, Homo sapiens
ttggctctgcca

SEQ ID NO: 5337289 - DNA, 20 bp, Homo sapiens
ttggctctggagacagcccc

SEQ ID NO: 5337290 - DNA, 15 bp, Homo sapiens
ttggctctgttgctg

SEQ ID NO: 5337291 - DNA, 16 bp, Homo sapiens
ttggctcttaaggctt

SEQ ID NO: 5337292 - DNA, 16 bp, Homo sapiens
ttggctgacccctctg

SEQ ID NO: 5337293 - DNA, 15 bp, Homo sapiens
ttggctgactggggc

SEQ ID NO: 5337294 - DNA, 14 bp, Homo sapiens
ttggctgcaggaag

SEQ ID NO: 5337295 - DNA, 15 bp, Homo sapiens
ttggctgcaggaaga

SEQ ID NO: 5337296 - DNA, 21 bp, Homo sapiens
ttggctgcaggaagaaacttt

SEQ ID NO: 5337297 - DNA, 22 bp, Homo sapiens
ttggctgcaggcagcaaaaaca

SEQ ID NO: 5337298 - DNA, 22 bp, Homo sapiens
ttggctgcaggtgttctgctga

SEQ ID NO: 5337299 - DNA, 16 bp, Homo sapiens
ttggctgccaagagtc

SEQ ID NO: 5337300 - DNA, 20 bp, Homo sapiens
ttggctgcgctaacccccag

SEQ ID NO: 5337301 - DNA, 16 bp, Homo sapiens
ttggctgcgtactcca

SEQ ID NO: 5337302 - DNA, 11 bp, Homo sapiens
ttggctgctga

SEQ ID NO: 5337303 - DNA, 15 bp, Homo sapiens
ttggctgctgaaggc

SEQ ID NO: 5337304 - DNA, 15 bp, Homo sapiens
ttggctgctgccacc

SEQ ID NO: 5337305 - DNA, 16 bp, Homo sapiens
ttggctgcttcctgtg

SEQ ID NO: 5337306 - DNA, 17 bp, Homo sapiens
ttggctggatcagggaa

SEQ ID NO: 5337307 - DNA, 21 bp, Homo sapiens
ttggctgggggcctcagtgcc

SEQ ID NO: 5337308 - DNA, 18 bp, Homo sapiens
ttggctgggtgttttcaa

SEQ ID NO: 5337309 - DNA, 19 bp, Homo sapiens
ttggctggtagcagcaggc

SEQ ID NO: 5337310 - DNA, 21 bp, Homo sapiens
ttggctggtagcagcaggctc

SEQ ID NO: 5337311 - DNA, 21 bp, Homo sapiens
ttggctggtgccgaagtgttt

SEQ ID NO: 5337312 - DNA, 21 bp, Homo sapiens
ttggctgtagaaggagacaga

SEQ ID NO: 5337313 - DNA, 12 bp, Homo sapiens
ttggctgtccag

SEQ ID NO: 5337314 - DNA, 12 bp, Homo sapiens
ttggctgtcctt

SEQ ID NO: 5337315 - DNA, 17 bp, Homo sapiens
ttggctgtccttcccct

SEQ ID NO: 5337316 - DNA, 12 bp, Homo sapiens
ttggctgtctga

SEQ ID NO: 5337317 - DNA, 13 bp, Homo sapiens
ttggctgtgacct

SEQ ID NO: 5337318 - DNA, 18 bp, Homo sapiens
ttggctgtgacctcttca

SEQ ID NO: 5337319 - DNA, 17 bp, Homo sapiens
ttggctgtgaggcccct

SEQ ID NO: 5337320 - DNA, 15 bp, Homo sapiens
ttggctgtgtctaaa

SEQ ID NO: 5337321 - DNA, 17 bp, Homo sapiens
ttggctgtgtctaaact

SEQ ID NO: 5337322 - DNA, 20 bp, Homo sapiens
ttggctgtgtctaaactgca

SEQ ID NO: 5337323 - DNA, 16 bp, Homo sapiens
ttggctgttccagact

SEQ ID NO: 5337324 - DNA, 18 bp, Homo sapiens
ttggcttaaagtgaagga

SEQ ID NO: 5337325 - DNA, 20 bp, Homo sapiens
ttggcttaaagtgaaggaaa

SEQ ID NO: 5337326 - DNA, 14 bp, Homo sapiens
ttggcttataaaca

SEQ ID NO: 5337327 - DNA, 14 bp, Homo sapiens
ttggcttataattc

SEQ ID NO: 5337328 - DNA, 21 bp, Homo sapiens
ttggcttcaaggatggagatg

SEQ ID NO: 5337329 - DNA, 16 bp, Homo sapiens
ttggcttcctccgtcc

SEQ ID NO: 5337330 - DNA, 18 bp, Homo sapiens
ttggcttcctctgctgca

SEQ ID NO: 5337331 - DNA, 19 bp, Homo sapiens
ttggcttcctctgctgcat

SEQ ID NO: 5337332 - DNA, 17 bp, Homo sapiens
ttggcttctcagcccct

SEQ ID NO: 5337333 - DNA, 11 bp, Homo sapiens
ttggcttctgt

SEQ ID NO: 5337334 - DNA, 18 bp, Homo sapiens
ttggcttctgtttctagt

SEQ ID NO: 5337335 - DNA, 19 bp, Homo sapiens
ttggcttcttctttaggat

SEQ ID NO: 5337336 - DNA, 16 bp, Homo sapiens
ttggcttgcactttgt

SEQ ID NO: 5337337 - DNA, 17 bp, Homo sapiens
ttggcttgtgatctggg

SEQ ID NO: 5337338 - DNA, 17 bp, Homo sapiens
ttggcttgttattgcct

SEQ ID NO: 5337339 - DNA, 12 bp, Homo sapiens
ttggctttcaag

SEQ ID NO: 5337340 - DNA, 15 bp, Homo sapiens
ttggctttcataaat

SEQ ID NO: 5337341 - DNA, 21 bp, Homo sapiens
ttggctttcatgaggaggcag

SEQ ID NO: 5337342 - DNA, 12 bp, Homo sapiens
ttggctttctcc

SEQ ID NO: 5337343 - DNA, 15 bp, Homo sapiens
ttggctttctccctc

SEQ ID NO: 5337344 - DNA, 20 bp, Homo sapiens
ttggctttgcagctgctgtc

SEQ ID NO: 5337345 - DNA, 23 bp, Homo sapiens
ttggctttgcccacccctcactc

SEQ ID NO: 5337346 - DNA, 21 bp, Homo sapiens
ttggcttttcttatttaaaat

SEQ ID NO: 5337347 - DNA, 18 bp, Homo sapiens
ttggctttttactattaa

SEQ ID NO: 5337348 - DNA, 22 bp, Homo sapiens
ttggctttttccaaatgcttct

SEQ ID NO: 5337349 - DNA, 13 bp, Homo sapiens
ttggcttttttcc

SEQ ID NO: 5337350 - DNA, 21 bp, Homo sapiens
ttgggaaaaaaacttggcact

SEQ ID NO: 5337351 - DNA, 14 bp, Homo sapiens
ttgggaaaaactgg

SEQ ID NO: 5337352 - DNA, 21 bp, Homo sapiens
ttgggaaaaactggctttttc

SEQ ID NO: 5337353 - DNA, 16 bp, Homo sapiens
ttgggaaaaattattt

SEQ ID NO: 5337354 - DNA, 16 bp, Homo sapiens
ttgggaaaacatttgc

SEQ ID NO: 5337355 - DNA, 17 bp, Homo sapiens
ttgggaaaacatttgct

SEQ ID NO: 5337356 - DNA, 17 bp, Homo sapiens
ttgggaaaagaagctgt

SEQ ID NO: 5337357 - DNA, 21 bp, Homo sapiens
ttgggaaaagcccacaggcct

SEQ ID NO: 5337358 - DNA, 15 bp, Homo sapiens
ttgggaaacactttg

SEQ ID NO: 5337359 - DNA, 15 bp, Homo sapiens
ttgggaaacttctag

SEQ ID NO: 5337360 - DNA, 16 bp, Homo sapiens
ttgggaaacttggctc

SEQ ID NO: 5337361 - DNA, 19 bp, Homo sapiens
ttgggaaacttgtcacttg

SEQ ID NO: 5337362 - DNA, 16 bp, Homo sapiens
ttgggaaagcccagac

SEQ ID NO: 5337363 - DNA, 15 bp, Homo sapiens
ttgggaaatacaaga

SEQ ID NO: 5337364 - DNA, 22 bp, Homo sapiens
ttgggaaatgtagccctgggtt

SEQ ID NO: 5337365 - DNA, 23 bp, Homo sapiens
ttgggaaattaaatccaataaaa

SEQ ID NO: 5337366 - DNA, 20 bp, Homo sapiens
ttgggaaattcttgcactgt

SEQ ID NO: 5337367 - DNA, 15 bp, Homo sapiens
ttgggaacactggcc

SEQ ID NO: 5337368 - DNA, 18 bp, Homo sapiens
ttgggaactgaactcact

SEQ ID NO: 5337369 - DNA, 16 bp, Homo sapiens
ttgggaagattctcta

SEQ ID NO: 5337370 - DNA, 18 bp, Homo sapiens
ttgggaagcagtttcaga

SEQ ID NO: 5337371 - DNA, 22 bp, Homo sapiens
ttgggaaggaaatatatttgta

SEQ ID NO: 5337372 - DNA, 14 bp, Homo sapiens
ttgggaaggacaca

SEQ ID NO: 5337373 - DNA, 21 bp, Homo sapiens
ttgggaaggggacccccgccc

SEQ ID NO: 5337374 - DNA, 19 bp, Homo sapiens
ttgggaaggtgtttaaaga

SEQ ID NO: 5337375 - DNA, 21 bp, Homo sapiens
ttgggaaggtgtttaaagagt

SEQ ID NO: 5337376 - DNA, 19 bp, Homo sapiens
ttgggaagtctcagcctgg

SEQ ID NO: 5337377 - DNA, 20 bp, Homo sapiens
ttgggaagtttgctgtgctt

SEQ ID NO: 5337378 - DNA, 14 bp, Homo sapiens
ttgggaataaatat

SEQ ID NO: 5337379 - DNA, 17 bp, Homo sapiens
ttgggaatatttgaatc

SEQ ID NO: 5337380 - DNA, 13 bp, Homo sapiens
ttgggaatgcaat

SEQ ID NO: 5337381 - DNA, 20 bp, Homo sapiens
ttgggaattgcatgccatct

SEQ ID NO: 5337382 - DNA, 17 bp, Homo sapiens
ttgggacagccattttc

SEQ ID NO: 5337383 - DNA, 21 bp, Homo sapiens
ttgggacagccattttccaac

SEQ ID NO: 5337384 - DNA, 18 bp, Homo sapiens
ttgggaccagaagtgttt

SEQ ID NO: 5337385 - DNA, 19 bp, Homo sapiens
ttgggggcactcagccacg

SEQ ID NO: 5337386 - DNA, 14 bp, Homo sapiens
ttgggggctggtgc

SEQ ID NO: 5337387 - DNA, 15 bp, Homo sapiens
ttgggggcttccctg

SEQ ID NO: 5337388 - DNA, 19 bp, Homo sapiens
ttggggggaaagagggagc

SEQ ID NO: 5337389 - DNA, 20 bp, Homo sapiens
ttggggggaaagagggagca

SEQ ID NO: 5337390 - DNA, 22 bp, Homo sapiens
ttggggggaaagagggagcaac

SEQ ID NO: 5337391 - DNA, 19 bp, Homo sapiens
ttggggggaaggggaccct

SEQ ID NO: 5337392 - DNA, 23 bp, Homo sapiens
ttggggggaatgctcctctcttt

SEQ ID NO: 5337393 - DNA, 16 bp, Homo sapiens
ttggggggcatatatt

SEQ ID NO: 5337394 - DNA, 21 bp, Homo sapiens
ttggggggccaaagaaggcag

SEQ ID NO: 5337395 - DNA, 20 bp, Homo sapiens
ttggggggccgggcaggtcc

SEQ ID NO: 5337396 - DNA, 22 bp, Homo sapiens
ttggggggctgaggtgggagga

SEQ ID NO: 5337397 - DNA, 19 bp, Homo sapiens
ttgggggggaccctgcctc

SEQ ID NO: 5337398 - DNA, 21 bp, Homo sapiens
ttgggggggccaaaaggaaaa

SEQ ID NO: 5337399 - DNA, 21 bp, Homo sapiens
ttgggggggctcccgtggcct

SEQ ID NO: 5337400 - DNA, 20 bp, Homo sapiens
ttgggggggtggccgctgag

SEQ ID NO: 5337401 - DNA, 20 bp, Homo sapiens
ttgggggttggatgggaaga

SEQ ID NO: 5337402 - DNA, 22 bp, Homo sapiens
ttggggtacccactgctctggt

SEQ ID NO: 5337403 - DNA, 23 bp, Homo sapiens
ttggggtagaccttgagggtggg

SEQ ID NO: 5337404 - DNA, 21 bp, Homo sapiens
ttggggtataggtctcatctc

SEQ ID NO: 5337405 - DNA, 19 bp, Homo sapiens
ttggggtcaccaccctccc

SEQ ID NO: 5337406 - DNA, 21 bp, Homo sapiens
ttggggtcatgaagggctgga

SEQ ID NO: 5337407 - DNA, 16 bp, Homo sapiens
ttggggtctgccacca

SEQ ID NO: 5337408 - DNA, 22 bp, Homo sapiens
ttggggtggcgcgcctgccttt

SEQ ID NO: 5337409 - DNA, 14 bp, Homo sapiens
ttggggtgggaggg

SEQ ID NO: 5337410 - DNA, 19 bp, Homo sapiens
ttggggtggggcgggaggc

SEQ ID NO: 5337411 - DNA, 15 bp, Homo sapiens
ttggggtgggggcca

SEQ ID NO: 5337412 - DNA, 20 bp, Homo sapiens
ttggggtgggggccaggcct

SEQ ID NO: 5337413 - DNA, 18 bp, Homo sapiens
ttggggtgtggggtgggg

SEQ ID NO: 5337414 - DNA, 22 bp, Homo sapiens
ttggggttttttttttctgaat

SEQ ID NO: 5337415 - DNA, 17 bp, Homo sapiens
ttgggtaaaatactttt

SEQ ID NO: 5337416 - DNA, 19 bp, Homo sapiens
ttgggtaagggactccaga

SEQ ID NO: 5337417 - DNA, 23 bp, Homo sapiens
ttgggtagaaagagatacagagg

SEQ ID NO: 5337418 - DNA, 17 bp, Homo sapiens
ttgggtagatgggtggg

SEQ ID NO: 5337419 - DNA, 20 bp, Homo sapiens
ttgggtagctgccacttgaa

SEQ ID NO: 5337420 - DNA, 14 bp, Homo sapiens
ttgggtaggcggga

SEQ ID NO: 5337421 - DNA, 18 bp, Homo sapiens
ttgggtagggcagacatg

SEQ ID NO: 5337422 - DNA, 13 bp, Homo sapiens
ttgggtatttgat

SEQ ID NO: 5337423 - DNA, 21 bp, Homo sapiens
ttgggtcaaggacagggctga

SEQ ID NO: 5337424 - DNA, 19 bp, Homo sapiens
ttgggtcagatttatttgt

SEQ ID NO: 5337425 - DNA, 19 bp, Homo sapiens
ttgggtcaggttcttgcct

SEQ ID NO: 5337426 - DNA, 12 bp, Homo sapiens
ttgggtccagga

SEQ ID NO: 5337427 - DNA, 14 bp, Homo sapiens
ttgggtccaggagg

SEQ ID NO: 5337428 - DNA, 14 bp, Homo sapiens
ttgggtctcactct

SEQ ID NO: 5337429 - DNA, 22 bp, Homo sapiens
ttgggtctcactctctggggaa

SEQ ID NO: 5337430 - DNA, 21 bp, Homo sapiens
ttgggtctctctcggcccctg

SEQ ID NO: 5337431 - DNA, 16 bp, Homo sapiens
ttgggtctgccctgcc

SEQ ID NO: 5337432 - DNA, 15 bp, Homo sapiens
ttgggtgaagagctt

SEQ ID NO: 5337433 - DNA, 21 bp, Homo sapiens
ttgggtgaatatggtggaaaa

SEQ ID NO: 5337434 - DNA, 15 bp, Homo sapiens
ttgggtgcctcctgc

SEQ ID NO: 5337435 - DNA, 17 bp, Homo sapiens
ttgggtggagaagccat

SEQ ID NO: 5337436 - DNA, 12 bp, Homo sapiens
ttgggtggagga

SEQ ID NO: 5337437 - DNA, 19 bp, Homo sapiens
ttgggtggctcactactga

SEQ ID NO: 5337438 - DNA, 23 bp, Homo sapiens
ttgggtgggacagggcttctcct

SEQ ID NO: 5337439 - DNA, 21 bp, Homo sapiens
ttgggtggggctcctgggagg

SEQ ID NO: 5337440 - DNA, 20 bp, Homo sapiens
ttgggtggggggcttcatac

SEQ ID NO: 5337441 - DNA, 21 bp, Homo sapiens
ttgggtggggggcttcataca

SEQ ID NO: 5337442 - DNA, 17 bp, Homo sapiens
ttgggtgggttaagtgg

SEQ ID NO: 5337443 - DNA, 19 bp, Homo sapiens
ttgggtgtaacaggtctcc

SEQ ID NO: 5337444 - DNA, 19 bp, Homo sapiens
ttgggtgtattctctgtaa

SEQ ID NO: 5337445 - DNA, 13 bp, Homo sapiens
ttgggtgtattgt

SEQ ID NO: 5337446 - DNA, 18 bp, Homo sapiens
ttgggtgtgccctggctc

SEQ ID NO: 5337447 - DNA, 20 bp, Homo sapiens
ttgggtgtgccctggctccc

SEQ ID NO: 5337448 - DNA, 22 bp, Homo sapiens
ttgggtgtggtgtcaccagcct

SEQ ID NO: 5337449 - DNA, 23 bp, Homo sapiens
ttgggtgtggtgtcaccagcctg

SEQ ID NO: 5337450 - DNA, 12 bp, Homo sapiens
ttgggtgttcca

SEQ ID NO: 5337451 - DNA, 18 bp, Homo sapiens
ttgggttagacctacagg

SEQ ID NO: 5337452 - DNA, 20 bp, Homo sapiens
ttgggttaggagaagtcaag

SEQ ID NO: 5337453 - DNA, 22 bp, Homo sapiens
ttgggttcaagcgattcttctg

SEQ ID NO: 5337454 - DNA, 21 bp, Homo sapiens
ttgggttcatgatgcagtctc

SEQ ID NO: 5337455 - DNA, 20 bp, Homo sapiens
ttgggttccaaccaggcagt

SEQ ID NO: 5337456 - DNA, 22 bp, Homo sapiens
ttgggtttcacgagtgttcctg

SEQ ID NO: 5337457 - DNA, 18 bp, Homo sapiens
ttgggtttggccagggag

SEQ ID NO: 5337458 - DNA, 14 bp, Homo sapiens
ttgggttttatcag

SEQ ID NO: 5337459 - DNA, 17 bp, Homo sapiens
ttgggtttttgctgttt

SEQ ID NO: 5337460 - DNA, 16 bp, Homo sapiens
ttgggttttttctgtt

SEQ ID NO: 5337461 - DNA, 17 bp, Homo sapiens
ttgggttttttctgttt

SEQ ID NO: 5337462 - DNA, 19 bp, Homo sapiens
ttgggttttttctgttttt

SEQ ID NO: 5337463 - DNA, 17 bp, Homo sapiens
ttgggtttttttgttgt

SEQ ID NO: 5337464 - DNA, 22 bp, Homo sapiens
ttggtaaaaacagcagctcata

SEQ ID NO: 5337465 - DNA, 20 bp, Homo sapiens
ttggtaaaaatgctgctctc

SEQ ID NO: 5337466 - DNA, 18 bp, Homo sapiens
ttggtaaaactcactgtg

SEQ ID NO: 5337467 - DNA, 12 bp, Homo sapiens
ttggtaaacctt

SEQ ID NO: 5337468 - DNA, 16 bp, Homo sapiens
ttggtaaagactggct

SEQ ID NO: 5337469 - DNA, 23 bp, Homo sapiens
ttggtaaaggaaccagtcagctg

SEQ ID NO: 5337470 - DNA, 22 bp, Homo sapiens
ttggtaaaggtatgtaaacttt

SEQ ID NO: 5337471 - DNA, 21 bp, Homo sapiens
ttggtaaattctggtatacat

SEQ ID NO: 5337472 - DNA, 22 bp, Homo sapiens
ttggtaaattgtaaacagctaa

SEQ ID NO: 5337473 - DNA, 16 bp, Homo sapiens
ttggtaaatttcccca

SEQ ID NO: 5337474 - DNA, 21 bp, Homo sapiens
ttggtaaatttccccaacagt

SEQ ID NO: 5337475 - DNA, 21 bp, Homo sapiens
ttggtaacatcctttctattg

SEQ ID NO: 5337476 - DNA, 17 bp, Homo sapiens
ttggtaacgaatttaaa

SEQ ID NO: 5337477 - DNA, 22 bp, Homo sapiens
ttggtaacgaatttaaaatgta

SEQ ID NO: 5337478 - DNA, 18 bp, Homo sapiens
ttggtaactctgtaattc

SEQ ID NO: 5337479 - DNA, 20 bp, Homo sapiens
ttggtaactgattacctgcc

SEQ ID NO: 5337480 - DNA, 14 bp, Homo sapiens
ttggtaacttttgt

SEQ ID NO: 5337481 - DNA, 15 bp, Homo sapiens
ttggtaagagttaaa

SEQ ID NO: 5337482 - DNA, 15 bp, Homo sapiens
ttggtaagcttccag

SEQ ID NO: 5337483 - DNA, 13 bp, Homo sapiens
ttggtaagggaag

SEQ ID NO: 5337484 - DNA, 12 bp, Homo sapiens
ttggtaataaca

SEQ ID NO: 5337485 - DNA, 13 bp, Homo sapiens
ttggtaataacaa

SEQ ID NO: 5337486 - DNA, 20 bp, Homo sapiens
ttggtaatcccctaaaataa

SEQ ID NO: 5337487 - DNA, 16 bp, Homo sapiens
ttggtaatgtgtcaaa

SEQ ID NO: 5337488 - DNA, 13 bp, Homo sapiens
ttggtacaaaaat

SEQ ID NO: 5337489 - DNA, 18 bp, Homo sapiens
ttggtacccccaaacccc

SEQ ID NO: 5337490 - DNA, 13 bp, Homo sapiens
ttggtaccttgca

SEQ ID NO: 5337491 - DNA, 17 bp, Homo sapiens
ttggtaccttgcacaca

SEQ ID NO: 5337492 - DNA, 22 bp, Homo sapiens
ttggtactactagatgtcttta

SEQ ID NO: 5337493 - DNA, 13 bp, Homo sapiens
ttggtactgtaat

SEQ ID NO: 5337494 - DNA, 21 bp, Homo sapiens
ttggtagagaaggagcagaaa

SEQ ID NO: 5337495 - DNA, 13 bp, Homo sapiens
ttggtagagttta

SEQ ID NO: 5337496 - DNA, 19 bp, Homo sapiens
ttggtagatgcatgacttg

SEQ ID NO: 5337497 - DNA, 18 bp, Homo sapiens
ttggtagattaaatatag

SEQ ID NO: 5337498 - DNA, 15 bp, Homo sapiens
ttggtagcaaagtaa

SEQ ID NO: 5337499 - DNA, 22 bp, Homo sapiens
ttggtagccatttggtagatgt

SEQ ID NO: 5337500 - DNA, 15 bp, Homo sapiens
ttggtaggtaaatct

SEQ ID NO: 5337501 - DNA, 21 bp, Homo sapiens
ttggtagtgtccccagcctac

SEQ ID NO: 5337502 - DNA, 21 bp, Homo sapiens
ttggtagttctgtgcctcccc

SEQ ID NO: 5337503 - DNA, 16 bp, Homo sapiens
ttggtataaggtacat

SEQ ID NO: 5337504 - DNA, 16 bp, Homo sapiens
ttggtatctcaggtct

SEQ ID NO: 5337505 - DNA, 14 bp, Homo sapiens
ttggtattaaagaa

SEQ ID NO: 5337506 - DNA, 17 bp, Homo sapiens
ttggtattaaagaatgc

SEQ ID NO: 5337507 - DNA, 15 bp, Homo sapiens
ttggtattcaatttg

SEQ ID NO: 5337508 - DNA, 17 bp, Homo sapiens
ttggtattcaatttgat

SEQ ID NO: 5337509 - DNA, 13 bp, Homo sapiens
ttggtatttactg

SEQ ID NO: 5337510 - DNA, 16 bp, Homo sapiens
ttggtatttatctatt

SEQ ID NO: 5337511 - DNA, 15 bp, Homo sapiens
ttggtatttatgtaa

SEQ ID NO: 5337512 - DNA, 15 bp, Homo sapiens
ttggtatttgaaaca

SEQ ID NO: 5337513 - DNA, 20 bp, Homo sapiens
ttggtatttggatatctgtt

SEQ ID NO: 5337514 - DNA, 16 bp, Homo sapiens
ttggtattttataagc

SEQ ID NO: 5337515 - DNA, 14 bp, Homo sapiens
ttggtcaaactttt

SEQ ID NO: 5337516 - DNA, 17 bp, Homo sapiens
ttggtcaaactttttcc

SEQ ID NO: 5337517 - DNA, 19 bp, Homo sapiens
ttggtcaaactttttccag

SEQ ID NO: 5337518 - DNA, 11 bp, Homo sapiens
ttggtcaaatt

SEQ ID NO: 5337519 - DNA, 21 bp, Homo sapiens
ttggtcaagaaaggaggggag

SEQ ID NO: 5337520 - DNA, 22 bp, Homo sapiens
ttggtcacaaagctatttaagt

SEQ ID NO: 5337521 - DNA, 23 bp, Homo sapiens
ttggtcactccagtagctcctgg

SEQ ID NO: 5337522 - DNA, 15 bp, Homo sapiens
ttggtcagaggagtg

SEQ ID NO: 5337523 - DNA, 20 bp, Homo sapiens
ttggtcagagtaagctgctt

SEQ ID NO: 5337524 - DNA, 23 bp, Homo sapiens
ttggtcatgtgggtcttccaggg

SEQ ID NO: 5337525 - DNA, 15 bp, Homo sapiens
ttggtcattgaggga

SEQ ID NO: 5337526 - DNA, 23 bp, Homo sapiens
ttggtcatttgccaactaatttt

SEQ ID NO: 5337527 - DNA, 12 bp, Homo sapiens
ttggtccagagc

SEQ ID NO: 5337528 - DNA, 22 bp, Homo sapiens
ttggtccagagcggaggctgtg

SEQ ID NO: 5337529 - DNA, 16 bp, Homo sapiens
ttggtcccccttccat

SEQ ID NO: 5337530 - DNA, 12 bp, Homo sapiens
ttggtcccctcc

SEQ ID NO: 5337531 - DNA, 23 bp, Homo sapiens
ttggtcccgtgcagcttctgtcc

SEQ ID NO: 5337532 - DNA, 16 bp, Homo sapiens
ttggtcctgcctaaat

SEQ ID NO: 5337533 - DNA, 22 bp, Homo sapiens
ttggtcctgcctaaatttcaca

SEQ ID NO: 5337534 - DNA, 14 bp, Homo sapiens
ttggtcctgtcccc

SEQ ID NO: 5337535 - DNA, 14 bp, Homo sapiens
ttggtcctttacac

SEQ ID NO: 5337536 - DNA, 14 bp, Homo sapiens
ttggtcctttctcc

SEQ ID NO: 5337537 - DNA, 22 bp, Homo sapiens
ttggtcgagtctttgtgtgtta

SEQ ID NO: 5337538 - DNA, 14 bp, Homo sapiens
ttggtctcagcttc

SEQ ID NO: 5337539 - DNA, 15 bp, Homo sapiens
ttggtctcatgcccc

SEQ ID NO: 5337540 - DNA, 19 bp, Homo sapiens
ttggtctccatttttccca

SEQ ID NO: 5337541 - DNA, 21 bp, Homo sapiens
ttggtctcccatatgcagaaa

SEQ ID NO: 5337542 - DNA, 16 bp, Homo sapiens
ttggtctctatctcct

SEQ ID NO: 5337543 - DNA, 17 bp, Homo sapiens
ttggtctgccttctgct

SEQ ID NO: 5337544 - DNA, 14 bp, Homo sapiens
ttggtctgctggtg

SEQ ID NO: 5337545 - DNA, 17 bp, Homo sapiens
ttggtctgggacttcct

SEQ ID NO: 5337546 - DNA, 16 bp, Homo sapiens
ttggtctgtactgatt

SEQ ID NO: 5337547 - DNA, 20 bp, Homo sapiens
ttggtctgtactgattcaat

SEQ ID NO: 5337548 - DNA, 16 bp, Homo sapiens
ttggtctgtgagatgc

SEQ ID NO: 5337549 - DNA, 13 bp, Homo sapiens
ttggtctgtgtga

SEQ ID NO: 5337550 - DNA, 18 bp, Homo sapiens
ttggtctgtgttctcaac

SEQ ID NO: 5337551 - DNA, 16 bp, Homo sapiens
ttggtcttaggtcttc

SEQ ID NO: 5337552 - DNA, 19 bp, Homo sapiens
ttggtcttaggtcttcctg

SEQ ID NO: 5337553 - DNA, 21 bp, Homo sapiens
ttggtcttgaagtctgtacag

SEQ ID NO: 5337554 - DNA, 15 bp, Homo sapiens
ttggtctttctacat

SEQ ID NO: 5337555 - DNA, 13 bp, Homo sapiens
ttggtctttgtat

SEQ ID NO: 5337556 - DNA, 19 bp, Homo sapiens
ttggtcttttttctgggtc

SEQ ID NO: 5337557 - DNA, 22 bp, Homo sapiens
ttggtgaaaataagaaagaatt

SEQ ID NO: 5337558 - DNA, 17 bp, Homo sapiens
ttggtgaaataataaaa

SEQ ID NO: 5337559 - DNA, 14 bp, Homo sapiens
ttggtgaacacaca

SEQ ID NO: 5337560 - DNA, 12 bp, Homo sapiens
ttggtgaataaa

SEQ ID NO: 5337561 - DNA, 16 bp, Homo sapiens
ttgtaatttaaaataa

SEQ ID NO: 5337562 - DNA, 23 bp, Homo sapiens
ttgtaatttaaacatttgttcct

SEQ ID NO: 5337563 - DNA, 20 bp, Homo sapiens
ttgtaatttaaggtctgttt

SEQ ID NO: 5337564 - DNA, 16 bp, Homo sapiens
ttgtaatttaatgaaa

SEQ ID NO: 5337565 - DNA, 20 bp, Homo sapiens
ttgtaatttaatgaaaaggt

SEQ ID NO: 5337566 - DNA, 15 bp, Homo sapiens
ttgtaatttgaagat

SEQ ID NO: 5337567 - DNA, 17 bp, Homo sapiens
ttgtaatttgaattggg

SEQ ID NO: 5337568 - DNA, 19 bp, Homo sapiens
ttgtaattttaaaagtcta

SEQ ID NO: 5337569 - DNA, 12 bp, Homo sapiens
ttgtaattttct

SEQ ID NO: 5337570 - DNA, 16 bp, Homo sapiens
ttgtaattttcttgat

SEQ ID NO: 5337571 - DNA, 21 bp, Homo sapiens
ttgtaattttgttcctgttta

SEQ ID NO: 5337572 - DNA, 22 bp, Homo sapiens
ttgtaattttgttcctgtttat

SEQ ID NO: 5337573 - DNA, 22 bp, Homo sapiens
ttgtaatttttggggaaaaaag

SEQ ID NO: 5337574 - DNA, 23 bp, Homo sapiens
ttgtaatttttggggaaaaaagc

SEQ ID NO: 5337575 - DNA, 17 bp, Homo sapiens
ttgtaatttttttctag

SEQ ID NO: 5337576 - DNA, 16 bp, Homo sapiens
ttgtaatttttttgaa

SEQ ID NO: 5337577 - DNA, 16 bp, Homo sapiens
ttgtacaaaaaaaaag

SEQ ID NO: 5337578 - DNA, 15 bp, Homo sapiens
ttgtacaaactttgt

SEQ ID NO: 5337579 - DNA, 17 bp, Homo sapiens
ttgtacaaactttgttt

SEQ ID NO: 5337580 - DNA, 18 bp, Homo sapiens
ttgtacaaagtaaaaata

SEQ ID NO: 5337581 - DNA, 17 bp, Homo sapiens
ttgtacaaagtattaag

SEQ ID NO: 5337582 - DNA, 17 bp, Homo sapiens
ttgtacaaagttttcct

SEQ ID NO: 5337583 - DNA, 19 bp, Homo sapiens
ttgtacaaagttttccttt

SEQ ID NO: 5337584 - DNA, 18 bp, Homo sapiens
ttgtacaaataaacctga

SEQ ID NO: 5337585 - DNA, 15 bp, Homo sapiens
ttgtacaaatgtatt

SEQ ID NO: 5337586 - DNA, 16 bp, Homo sapiens
ttgtacaaatgtattt

SEQ ID NO: 5337587 - DNA, 19 bp, Homo sapiens
ttgtacaaatgtattttga

SEQ ID NO: 5337588 - DNA, 15 bp, Homo sapiens
ttgtacaaggtaatt

SEQ ID NO: 5337589 - DNA, 14 bp, Homo sapiens
ttgtacaataaatt

SEQ ID NO: 5337590 - DNA, 17 bp, Homo sapiens
ttgtacaatcaaaacac

SEQ ID NO: 5337591 - DNA, 23 bp, Homo sapiens
ttgtacaatcaaaacacactact

SEQ ID NO: 5337592 - DNA, 17 bp, Homo sapiens
ttgtacaatcatgttct

SEQ ID NO: 5337593 - DNA, 19 bp, Homo sapiens
ttgtacaatcatgttctgg

SEQ ID NO: 5337594 - DNA, 19 bp, Homo sapiens
ttgtacaattaagttacaa

SEQ ID NO: 5337595 - DNA, 19 bp, Homo sapiens
ttgtacaattactaaattg

SEQ ID NO: 5337596 - DNA, 20 bp, Homo sapiens
ttgtacaattactgtgagaa

SEQ ID NO: 5337597 - DNA, 15 bp, Homo sapiens
ttgtacacagtctgt

SEQ ID NO: 5337598 - DNA, 17 bp, Homo sapiens
ttgtacacatatacata

SEQ ID NO: 5337599 - DNA, 18 bp, Homo sapiens
ttgtacacatatacatat

SEQ ID NO: 5337600 - DNA, 21 bp, Homo sapiens
ttgtacacatatacatatgat

SEQ ID NO: 5337601 - DNA, 13 bp, Homo sapiens
ttgtacactatct

SEQ ID NO: 5337602 - DNA, 17 bp, Homo sapiens
ttgtacagaatatttct

SEQ ID NO: 5337603 - DNA, 12 bp, Homo sapiens
ttgtacagaatt

SEQ ID NO: 5337604 - DNA, 16 bp, Homo sapiens
ttgtacagaattttta

SEQ ID NO: 5337605 - DNA, 12 bp, Homo sapiens
ttgtacagacaa

SEQ ID NO: 5337606 - DNA, 13 bp, Homo sapiens
ttgtacagacaac

SEQ ID NO: 5337607 - DNA, 19 bp, Homo sapiens
ttgtacagacgtatgctta

SEQ ID NO: 5337608 - DNA, 18 bp, Homo sapiens
ttgtacagattctttatt

SEQ ID NO: 5337609 - DNA, 16 bp, Homo sapiens
ttgtacagctgtttaa

SEQ ID NO: 5337610 - DNA, 14 bp, Homo sapiens
ttgtacaggactgt

SEQ ID NO: 5337611 - DNA, 17 bp, Homo sapiens
ttgtacaggggccatgc

SEQ ID NO: 5337612 - DNA, 16 bp, Homo sapiens
ttgtacagtaatatgt

SEQ ID NO: 5337613 - DNA, 17 bp, Homo sapiens
ttgtacagtggagaaat

SEQ ID NO: 5337614 - DNA, 22 bp, Homo sapiens
ttgtacagttaactctcccagg

SEQ ID NO: 5337615 - DNA, 11 bp, Homo sapiens
ttgtacagttc

SEQ ID NO: 5337616 - DNA, 16 bp, Homo sapiens
ttgtacagtttaaaat

SEQ ID NO: 5337617 - DNA, 16 bp, Homo sapiens
ttgtacagtttgctgt

SEQ ID NO: 5337618 - DNA, 18 bp, Homo sapiens
ttgtacagtttgtttaca

SEQ ID NO: 5337619 - DNA, 19 bp, Homo sapiens
ttgtacataaaattttcta

SEQ ID NO: 5337620 - DNA, 14 bp, Homo sapiens
ttgtacataatgcg

SEQ ID NO: 5337621 - DNA, 22 bp, Homo sapiens
ttgtacatatcctttggtcctg

SEQ ID NO: 5337622 - DNA, 18 bp, Homo sapiens
ttgtacatatgtaaaata

SEQ ID NO: 5337623 - DNA, 16 bp, Homo sapiens
ttgtacatattggaaa

SEQ ID NO: 5337624 - DNA, 14 bp, Homo sapiens
ttgtacatattttt

SEQ ID NO: 5337625 - DNA, 23 bp, Homo sapiens
ttgtacatctggcttattttaat

SEQ ID NO: 5337626 - DNA, 12 bp, Homo sapiens
ttgtacatgaaa

SEQ ID NO: 5337627 - DNA, 20 bp, Homo sapiens
ttgtacatgataagacattt

SEQ ID NO: 5337628 - DNA, 20 bp, Homo sapiens
ttgtacatgtaacattaaag

SEQ ID NO: 5337629 - DNA, 19 bp, Homo sapiens
ttgtacatgtatgaaattg

SEQ ID NO: 5337630 - DNA, 22 bp, Homo sapiens
ttgtacattacactaaattatt

SEQ ID NO: 5337631 - DNA, 12 bp, Homo sapiens
ttgtacattatg

SEQ ID NO: 5337632 - DNA, 15 bp, Homo sapiens
ttgtacattatgtta

SEQ ID NO: 5337633 - DNA, 21 bp, Homo sapiens
ttgtacattatgttattggaa

SEQ ID NO: 5337634 - DNA, 13 bp, Homo sapiens
ttgtacattcctg

SEQ ID NO: 5337635 - DNA, 22 bp, Homo sapiens
ttgtacattttggatttcttta

SEQ ID NO: 5337636 - DNA, 14 bp, Homo sapiens
ttgtacatttttga

SEQ ID NO: 5337637 - DNA, 23 bp, Homo sapiens
ttgtacatttttgatcaaatgta

SEQ ID NO: 5337638 - DNA, 16 bp, Homo sapiens
ttgtaccaaaacatcc

SEQ ID NO: 5337639 - DNA, 17 bp, Homo sapiens
ttgtaccacagtttctt

SEQ ID NO: 5337640 - DNA, 20 bp, Homo sapiens
ttgtaccacttttgcaaata

SEQ ID NO: 5337641 - DNA, 18 bp, Homo sapiens
ttgtaccagcccaggcaa

SEQ ID NO: 5337642 - DNA, 22 bp, Homo sapiens
ttgtaccagtgaatttttgcaa

SEQ ID NO: 5337643 - DNA, 14 bp, Homo sapiens
ttgtaccagtgtga

SEQ ID NO: 5337644 - DNA, 16 bp, Homo sapiens
ttgtaccagtgtgaat

SEQ ID NO: 5337645 - DNA, 17 bp, Homo sapiens
ttgtaccatattgctct

SEQ ID NO: 5337646 - DNA, 15 bp, Homo sapiens
ttgtaccccccaacc

SEQ ID NO: 5337647 - DNA, 21 bp, Homo sapiens
ttgtaccccccaacccctgag

SEQ ID NO: 5337648 - DNA, 17 bp, Homo sapiens
ttgtaccctctccaggc

SEQ ID NO: 5337649 - DNA, 15 bp, Homo sapiens
ttgtacctaagtaaa

SEQ ID NO: 5337650 - DNA, 16 bp, Homo sapiens
ttgtacctatgtgaca

SEQ ID NO: 5337651 - DNA, 15 bp, Homo sapiens
ttgtacctatttctg

SEQ ID NO: 5337652 - DNA, 18 bp, Homo sapiens
ttgtacctatttctgatg

SEQ ID NO: 5337653 - DNA, 21 bp, Homo sapiens
ttgtacgaagagtatttttga

SEQ ID NO: 5337654 - DNA, 23 bp, Homo sapiens
ttgtacgaagagtatttttgaca

SEQ ID NO: 5337655 - DNA, 21 bp, Homo sapiens
ttgtacgacgtcagatgttta

SEQ ID NO: 5337656 - DNA, 16 bp, Homo sapiens
ttgtacgttatatatt

SEQ ID NO: 5337657 - DNA, 20 bp, Homo sapiens
ttgtacgttatatattgtat

SEQ ID NO: 5337658 - DNA, 16 bp, Homo sapiens
ttgtacgtttaaagtg

SEQ ID NO: 5337659 - DNA, 17 bp, Homo sapiens
ttgtacgtttaaagtgt

SEQ ID NO: 5337660 - DNA, 18 bp, Homo sapiens
ttgtacgtttaaagtgta

SEQ ID NO: 5337661 - DNA, 23 bp, Homo sapiens
ttgtactaaagccaaacatatat

SEQ ID NO: 5337662 - DNA, 22 bp, Homo sapiens
ttgtactaatctgagattgtgt

SEQ ID NO: 5337663 - DNA, 18 bp, Homo sapiens
ttgtactacagttctttt

SEQ ID NO: 5337664 - DNA, 13 bp, Homo sapiens
ttgtactatgtta

SEQ ID NO: 5337665 - DNA, 15 bp, Homo sapiens
ttgtactcaatttta

SEQ ID NO: 5337666 - DNA, 15 bp, Homo sapiens
ttgtactccagcctg

SEQ ID NO: 5337667 - DNA, 16 bp, Homo sapiens
ttgtactccagcctgg

SEQ ID NO: 5337668 - DNA, 17 bp, Homo sapiens
ttgtactccagcctggg

SEQ ID NO: 5337669 - DNA, 15 bp, Homo sapiens
ttgtactctgcttta

SEQ ID NO: 5337670 - DNA, 21 bp, Homo sapiens
ttgtactgaatttttttgtaa

SEQ ID NO: 5337671 - DNA, 12 bp, Homo sapiens
ttgtactgggac

SEQ ID NO: 5337672 - DNA, 14 bp, Homo sapiens
ttgtactgtgctga

SEQ ID NO: 5337673 - DNA, 16 bp, Homo sapiens
ttgtactgtgctgatt

SEQ ID NO: 5337674 - DNA, 22 bp, Homo sapiens
ttgtactgttgctttaatatga

SEQ ID NO: 5337675 - DNA, 17 bp, Homo sapiens
ttgtactgtttaatgtt

SEQ ID NO: 5337676 - DNA, 13 bp, Homo sapiens
ttgtacttacact

SEQ ID NO: 5337677 - DNA, 23 bp, Homo sapiens
ttgtacttagccagttcaaagtg

SEQ ID NO: 5337678 - DNA, 12 bp, Homo sapiens
ttgtacttctgc

SEQ ID NO: 5337679 - DNA, 12 bp, Homo sapiens
ttgtacttctgt

SEQ ID NO: 5337680 - DNA, 15 bp, Homo sapiens
ttgtacttctgtgtt

SEQ ID NO: 5337681 - DNA, 18 bp, Homo sapiens
ttgtacttctgtgttcat

SEQ ID NO: 5337682 - DNA, 18 bp, Homo sapiens
ttgtacttggagtaattg

SEQ ID NO: 5337683 - DNA, 19 bp, Homo sapiens
ttgtacttgtgtttgctta

SEQ ID NO: 5337684 - DNA, 18 bp, Homo sapiens
ttgtacttgttcttttct

SEQ ID NO: 5337685 - DNA, 15 bp, Homo sapiens
ttgtactttatcatg

SEQ ID NO: 5337686 - DNA, 19 bp, Homo sapiens
ttgtactttatttttctga

SEQ ID NO: 5337687 - DNA, 22 bp, Homo sapiens
ttgtactttctgttaaaatgca

SEQ ID NO: 5337688 - DNA, 13 bp, Homo sapiens
ttgtactttgaaa

SEQ ID NO: 5337689 - DNA, 19 bp, Homo sapiens
ttgtacttttctggttcca

SEQ ID NO: 5337690 - DNA, 21 bp, Homo sapiens
ttgtacttttggcatgaaagt

SEQ ID NO: 5337691 - DNA, 16 bp, Homo sapiens
ttgtacttttttctta

SEQ ID NO: 5337692 - DNA, 17 bp, Homo sapiens
ttgtacttttttcttaa

SEQ ID NO: 5337693 - DNA, 14 bp, Homo sapiens
ttgtagaaagctaa

SEQ ID NO: 5337694 - DNA, 22 bp, Homo sapiens
ttgtagaaagctaatacaaaac

SEQ ID NO: 5337695 - DNA, 13 bp, Homo sapiens
ttgtagaaatctg

SEQ ID NO: 5337696 - DNA, 16 bp, Homo sapiens
ttgtagaaatctgtaa

SEQ ID NO: 5337697 - DNA, 14 bp, Homo sapiens
ttgtagaaattctt

SEQ ID NO: 5337698 - DNA, 22 bp, Homo sapiens
ttgtagaaattcttaatttgga

SEQ ID NO: 5337699 - DNA, 19 bp, Homo sapiens
ttgtagaacttgttgctga

SEQ ID NO: 5337700 - DNA, 20 bp, Homo sapiens
ttgtagaagatggactctga

SEQ ID NO: 5337701 - DNA, 17 bp, Homo sapiens
ttgtagaaggagccttg

SEQ ID NO: 5337702 - DNA, 22 bp, Homo sapiens
ttgtagaagggttatattttac

SEQ ID NO: 5337703 - DNA, 17 bp, Homo sapiens
ttgtagaagtcacattc

SEQ ID NO: 5337704 - DNA, 19 bp, Homo sapiens
ttgtagaatgtattgtacc

SEQ ID NO: 5337705 - DNA, 16 bp, Homo sapiens
ttgtagacacttactt

SEQ ID NO: 5337706 - DNA, 16 bp, Homo sapiens
ttgtagaccactgtcc

SEQ ID NO: 5337707 - DNA, 12 bp, Homo sapiens
ttgtagactctt

SEQ ID NO: 5337708 - DNA, 22 bp, Homo sapiens
ttgtagacttcctttataatat

SEQ ID NO: 5337709 - DNA, 23 bp, Homo sapiens
ttgtagagaacacgcgtatttac

SEQ ID NO: 5337710 - DNA, 23 bp, Homo sapiens
ttgtagagacagggtctcactgt

SEQ ID NO: 5337711 - DNA, 18 bp, Homo sapiens
ttgtagagagagctgtat

SEQ ID NO: 5337712 - DNA, 15 bp, Homo sapiens
ttgtagagccagggt

SEQ ID NO: 5337713 - DNA, 16 bp, Homo sapiens
ttgtagagtcaatcat

SEQ ID NO: 5337714 - DNA, 18 bp, Homo sapiens
ttgtagagtgtagactgt

SEQ ID NO: 5337715 - DNA, 14 bp, Homo sapiens
ttgtagagttgtac

SEQ ID NO: 5337716 - DNA, 20 bp, Homo sapiens
ttgtagagttgtactgcttt

SEQ ID NO: 5337717 - DNA, 18 bp, Homo sapiens
ttgtagatacaatcagct

SEQ ID NO: 5337718 - DNA, 22 bp, Homo sapiens
ttgtagatacaatcagctgctt

SEQ ID NO: 5337719 - DNA, 21 bp, Homo sapiens
ttgtagatgaacatctctgtt

SEQ ID NO: 5337720 - DNA, 16 bp, Homo sapiens
ttgtagatggcacttt

SEQ ID NO: 5337721 - DNA, 23 bp, Homo sapiens
ttgtagattaggtcttgctggaa

SEQ ID NO: 5337722 - DNA, 15 bp, Homo sapiens
ttgtagattgattgt

SEQ ID NO: 5337723 - DNA, 12 bp, Homo sapiens
ttgtagatttga

SEQ ID NO: 5337724 - DNA, 19 bp, Homo sapiens
ttgtagcagattgtttcct

SEQ ID NO: 5337725 - DNA, 16 bp, Homo sapiens
ttgtagcataactgta

SEQ ID NO: 5337726 - DNA, 15 bp, Homo sapiens
ttgtagcatcctgga

SEQ ID NO: 5337727 - DNA, 23 bp, Homo sapiens
ttgtagcatttaaaatggaaaat

SEQ ID NO: 5337728 - DNA, 16 bp, Homo sapiens
ttgtagcatttcttga

SEQ ID NO: 5337729 - DNA, 15 bp, Homo sapiens
ttgtagcattttcct

SEQ ID NO: 5337730 - DNA, 15 bp, Homo sapiens
ttgtagcatttttat

SEQ ID NO: 5337731 - DNA, 17 bp, Homo sapiens
ttgtagccaaagaaatt

SEQ ID NO: 5337732 - DNA, 12 bp, Homo sapiens
ttgtagccagcc

SEQ ID NO: 5337733 - DNA, 15 bp, Homo sapiens
ttgtagccatggctg

SEQ ID NO: 5337734 - DNA, 17 bp, Homo sapiens
ttgtagcccaggctgga

SEQ ID NO: 5337735 - DNA, 16 bp, Homo sapiens
ttgtagcctaatattc

SEQ ID NO: 5337736 - DNA, 15 bp, Homo sapiens
ttgtagctaacagtg

SEQ ID NO: 5337737 - DNA, 22 bp, Homo sapiens
ttgtagctcttagtcctccctg

SEQ ID NO: 5337738 - DNA, 18 bp, Homo sapiens
ttgtagctggggctttga

SEQ ID NO: 5337739 - DNA, 16 bp, Homo sapiens
ttgtattgtttctaca

SEQ ID NO: 5337740 - DNA, 17 bp, Homo sapiens
ttgtattgtttctacaa

SEQ ID NO: 5337741 - DNA, 16 bp, Homo sapiens
ttgtattgttttccca

SEQ ID NO: 5337742 - DNA, 14 bp, Homo sapiens
ttgtattgttttct

SEQ ID NO: 5337743 - DNA, 17 bp, Homo sapiens
ttgtatttaaaaacatt

SEQ ID NO: 5337744 - DNA, 15 bp, Homo sapiens
ttgtatttaaaacat

SEQ ID NO: 5337745 - DNA, 19 bp, Homo sapiens
ttgtatttaaaacatttca

SEQ ID NO: 5337746 - DNA, 23 bp, Homo sapiens
ttgtatttaaatgaaagtgagac

SEQ ID NO: 5337747 - DNA, 12 bp, Homo sapiens
ttgtatttaaga

SEQ ID NO: 5337748 - DNA, 15 bp, Homo sapiens
ttgtatttatggaag

SEQ ID NO: 5337749 - DNA, 22 bp, Homo sapiens
ttgtatttatggattaaaaact

SEQ ID NO: 5337750 - DNA, 14 bp, Homo sapiens
ttgtatttatgtat

SEQ ID NO: 5337751 - DNA, 16 bp, Homo sapiens
ttgtatttatgtgtat

SEQ ID NO: 5337752 - DNA, 15 bp, Homo sapiens
ttgtatttattcaat

SEQ ID NO: 5337753 - DNA, 14 bp, Homo sapiens
ttgtatttattctt

SEQ ID NO: 5337754 - DNA, 18 bp, Homo sapiens
ttgtatttcaaatatcta

SEQ ID NO: 5337755 - DNA, 14 bp, Homo sapiens
ttgtatttctatac

SEQ ID NO: 5337756 - DNA, 15 bp, Homo sapiens
ttgtatttctatatt

SEQ ID NO: 5337757 - DNA, 19 bp, Homo sapiens
ttgtatttctcttgtcctt

SEQ ID NO: 5337758 - DNA, 11 bp, Homo sapiens
ttgtatttctt

SEQ ID NO: 5337759 - DNA, 19 bp, Homo sapiens
ttgtatttcttttatatat

SEQ ID NO: 5337760 - DNA, 23 bp, Homo sapiens
ttgtatttggaatatttgaataa

SEQ ID NO: 5337761 - DNA, 19 bp, Homo sapiens
ttgtatttgtattctctgc

SEQ ID NO: 5337762 - DNA, 9 bp, Homo sapiens
ttgtatttt

SEQ ID NO: 5337763 - DNA, 11 bp, Homo sapiens
ttgtattttaa

SEQ ID NO: 5337764 - DNA, 18 bp, Homo sapiens
ttgtattttaactacttt

SEQ ID NO: 5337765 - DNA, 21 bp, Homo sapiens
ttgtattttaataaactttga

SEQ ID NO: 5337766 - DNA, 20 bp, Homo sapiens
ttgtattttactaataaaat

SEQ ID NO: 5337767 - DNA, 17 bp, Homo sapiens
ttgtattttagatatat

SEQ ID NO: 5337768 - DNA, 21 bp, Homo sapiens
ttgtattttagatatattctc

SEQ ID NO: 5337769 - DNA, 16 bp, Homo sapiens
ttgtattttcatgaaa

SEQ ID NO: 5337770 - DNA, 21 bp, Homo sapiens
ttgtattttccaagtgtgcat

SEQ ID NO: 5337771 - DNA, 16 bp, Homo sapiens
ttgtattttccataca

SEQ ID NO: 5337772 - DNA, 18 bp, Homo sapiens
ttgtattttgattatttt

SEQ ID NO: 5337773 - DNA, 12 bp, Homo sapiens
ttgtattttgca

SEQ ID NO: 5337774 - DNA, 13 bp, Homo sapiens
ttgtattttgcat

SEQ ID NO: 5337775 - DNA, 19 bp, Homo sapiens
ttgtattttgcatctgacc

SEQ ID NO: 5337776 - DNA, 20 bp, Homo sapiens
ttgtattttgtacaaagtaa

SEQ ID NO: 5337777 - DNA, 17 bp, Homo sapiens
ttgtattttgtacattt

SEQ ID NO: 5337778 - DNA, 14 bp, Homo sapiens
ttgtattttgttaa

SEQ ID NO: 5337779 - DNA, 19 bp, Homo sapiens
ttgtattttgttaaagctg

SEQ ID NO: 5337780 - DNA, 16 bp, Homo sapiens
ttgtatttttgttgtt

SEQ ID NO: 5337781 - DNA, 20 bp, Homo sapiens
ttgtattttttgttgaaagt

SEQ ID NO: 5337782 - DNA, 16 bp, Homo sapiens
ttgtatttttttccaa

SEQ ID NO: 5337783 - DNA, 20 bp, Homo sapiens
ttgtatttttttgcaagtga

SEQ ID NO: 5337784 - DNA, 21 bp, Homo sapiens
ttgtatttttttgcaagtgaa

SEQ ID NO: 5337785 - DNA, 17 bp, Homo sapiens
ttgtcaaaaagcaactg

SEQ ID NO: 5337786 - DNA, 18 bp, Homo sapiens
ttgtcaaaactccactca

SEQ ID NO: 5337787 - DNA, 14 bp, Homo sapiens
ttgtcaaaattgtt

SEQ ID NO: 5337788 - DNA, 22 bp, Homo sapiens
ttgtcaaactgtagaaatgatg

SEQ ID NO: 5337789 - DNA, 13 bp, Homo sapiens
ttgtcaaagaagc

SEQ ID NO: 5337790 - DNA, 22 bp, Homo sapiens
ttgtcaaatgtcattatgtaga

SEQ ID NO: 5337791 - DNA, 15 bp, Homo sapiens
ttgtcaacacaaaga

SEQ ID NO: 5337792 - DNA, 20 bp, Homo sapiens
ttgtcaacagatttaaagaa

SEQ ID NO: 5337793 - DNA, 13 bp, Homo sapiens
ttgtcaacattgt

SEQ ID NO: 5337794 - DNA, 15 bp, Homo sapiens
ttgtcaacattgtga

SEQ ID NO: 5337795 - DNA, 15 bp, Homo sapiens
ttgtcaactgcttgt

SEQ ID NO: 5337796 - DNA, 21 bp, Homo sapiens
ttgtcaataaattttaaatgt

SEQ ID NO: 5337797 - DNA, 17 bp, Homo sapiens
ttgtcaataaggagcat

SEQ ID NO: 5337798 - DNA, 14 bp, Homo sapiens
ttgtcaatattaaa

SEQ ID NO: 5337799 - DNA, 18 bp, Homo sapiens
ttgtcaatattaaataca

SEQ ID NO: 5337800 - DNA, 18 bp, Homo sapiens
ttgtcacaacactgaacc

SEQ ID NO: 5337801 - DNA, 20 bp, Homo sapiens
ttgtcacacccatggcctca

SEQ ID NO: 5337802 - DNA, 14 bp, Homo sapiens
ttgtcacagctctt

SEQ ID NO: 5337803 - DNA, 22 bp, Homo sapiens
ttgtcacattatttattaaaaa

SEQ ID NO: 5337804 - DNA, 17 bp, Homo sapiens
ttgtcaccagatctgat

SEQ ID NO: 5337805 - DNA, 14 bp, Homo sapiens
ttgtcacccaggct

SEQ ID NO: 5337806 - DNA, 16 bp, Homo sapiens
ttgtcacccaggctgg

SEQ ID NO: 5337807 - DNA, 17 bp, Homo sapiens
ttgtcaccgcaggtgct

SEQ ID NO: 5337808 - DNA, 14 bp, Homo sapiens
ttgtcacctatgag

SEQ ID NO: 5337809 - DNA, 17 bp, Homo sapiens
ttgtcacctctctctga

SEQ ID NO: 5337810 - DNA, 22 bp, Homo sapiens
ttgtcacctctgtgacccctcc

SEQ ID NO: 5337811 - DNA, 15 bp, Homo sapiens
ttgtcacctgcttct

SEQ ID NO: 5337812 - DNA, 17 bp, Homo sapiens
ttgtcaccttcacctcc

SEQ ID NO: 5337813 - DNA, 20 bp, Homo sapiens
ttgtcacgccagacttccca

SEQ ID NO: 5337814 - DNA, 18 bp, Homo sapiens
ttgtcacgcttcttcttt

SEQ ID NO: 5337815 - DNA, 20 bp, Homo sapiens
ttgtcactatcttcacaagt

SEQ ID NO: 5337816 - DNA, 16 bp, Homo sapiens
ttgtcactatgctatt

SEQ ID NO: 5337817 - DNA, 13 bp, Homo sapiens
ttgtcactgaata

SEQ ID NO: 5337818 - DNA, 17 bp, Homo sapiens
ttgtcactgagaagatg

SEQ ID NO: 5337819 - DNA, 20 bp, Homo sapiens
ttgtcactgctgtaaagcaa

SEQ ID NO: 5337820 - DNA, 12 bp, Homo sapiens
ttgtcactgtct

SEQ ID NO: 5337821 - DNA, 15 bp, Homo sapiens
ttgtcactgtcttca

SEQ ID NO: 5337822 - DNA, 20 bp, Homo sapiens
ttgtcacttctgctgtacag

SEQ ID NO: 5337823 - DNA, 21 bp, Homo sapiens
ttgtcacttctgctgtacaga

SEQ ID NO: 5337824 - DNA, 15 bp, Homo sapiens
ttgtcacttgccaca

SEQ ID NO: 5337825 - DNA, 16 bp, Homo sapiens
ttgtcacttgccacat

SEQ ID NO: 5337826 - DNA, 15 bp, Homo sapiens
ttgtcacttttcctt

SEQ ID NO: 5337827 - DNA, 21 bp, Homo sapiens
ttgtcactttttatgctattt

SEQ ID NO: 5337828 - DNA, 17 bp, Homo sapiens
ttgtcacttttttataa

SEQ ID NO: 5337829 - DNA, 16 bp, Homo sapiens
ttgtcagaatgttgtg

SEQ ID NO: 5337830 - DNA, 14 bp, Homo sapiens
ttgtcagacataaa

SEQ ID NO: 5337831 - DNA, 16 bp, Homo sapiens
ttgtcagacataaagc

SEQ ID NO: 5337832 - DNA, 14 bp, Homo sapiens
ttgtcagactttaa

SEQ ID NO: 5337833 - DNA, 18 bp, Homo sapiens
ttgtcagactttaaagaa

SEQ ID NO: 5337834 - DNA, 19 bp, Homo sapiens
ttgtcagagatgttttcaa

SEQ ID NO: 5337835 - DNA, 15 bp, Homo sapiens
ttgtcagagctggga

SEQ ID NO: 5337836 - DNA, 23 bp, Homo sapiens
ttgtcagcatctgaccatctgtg

SEQ ID NO: 5337837 - DNA, 15 bp, Homo sapiens
ttgtcagccacctcc

SEQ ID NO: 5337838 - DNA, 20 bp, Homo sapiens
ttgtcagccatcgtcctggg

SEQ ID NO: 5337839 - DNA, 15 bp, Homo sapiens
ttgtcagcctgtgct

SEQ ID NO: 5337840 - DNA, 23 bp, Homo sapiens
ttgtcagggagtgttccctatcc

SEQ ID NO: 5337841 - DNA, 19 bp, Homo sapiens
ttgtcagggtctccttcct

SEQ ID NO: 5337842 - DNA, 23 bp, Homo sapiens
ttgtcagtgtagacacaggtcac

SEQ ID NO: 5337843 - DNA, 17 bp, Homo sapiens
ttgtcagtttatcttaa

SEQ ID NO: 5337844 - DNA, 16 bp, Homo sapiens
ttgtcataaaatgcat

SEQ ID NO: 5337845 - DNA, 20 bp, Homo sapiens
ttgtcataaaatgctatttt

SEQ ID NO: 5337846 - DNA, 22 bp, Homo sapiens
ttgtcataacatttaaagagat

SEQ ID NO: 5337847 - DNA, 17 bp, Homo sapiens
ttgtcatataaacctga

SEQ ID NO: 5337848 - DNA, 21 bp, Homo sapiens
ttgtcatataagattcatatt

SEQ ID NO: 5337849 - DNA, 16 bp, Homo sapiens
ttgtcatatattcatg

SEQ ID NO: 5337850 - DNA, 20 bp, Homo sapiens
ttgtcatatattcatgtaat

SEQ ID NO: 5337851 - DNA, 23 bp, Homo sapiens
ttgtcatatattcatgtaataaa

SEQ ID NO: 5337852 - DNA, 21 bp, Homo sapiens
ttgtcatatcagcacatattt

SEQ ID NO: 5337853 - DNA, 23 bp, Homo sapiens
ttgtcatccacacaacaccagga

SEQ ID NO: 5337854 - DNA, 21 bp, Homo sapiens
ttgtcatgaactgtactactc

SEQ ID NO: 5337855 - DNA, 12 bp, Homo sapiens
ttgtcatgacag

SEQ ID NO: 5337856 - DNA, 17 bp, Homo sapiens
ttgtcatgagtccatga

SEQ ID NO: 5337857 - DNA, 12 bp, Homo sapiens
ttgtcatgtgta

SEQ ID NO: 5337858 - DNA, 14 bp, Homo sapiens
ttgtcatgtgtata

SEQ ID NO: 5337859 - DNA, 16 bp, Homo sapiens
ttgtcatgttatgcag

SEQ ID NO: 5337860 - DNA, 14 bp, Homo sapiens
ttgtcattaaaggt

SEQ ID NO: 5337861 - DNA, 23 bp, Homo sapiens
ttgtcattactgcctttggaaga

SEQ ID NO: 5337862 - DNA, 20 bp, Homo sapiens
ttgtcattagcctgagtaga

SEQ ID NO: 5337863 - DNA, 16 bp, Homo sapiens
ttgtcattctgctaat

SEQ ID NO: 5337864 - DNA, 18 bp, Homo sapiens
ttgtcattgagcctggca

SEQ ID NO: 5337865 - DNA, 18 bp, Homo sapiens
ttgtcattgctttactgg

SEQ ID NO: 5337866 - DNA, 15 bp, Homo sapiens
ttgtcattgttttca

SEQ ID NO: 5337867 - DNA, 18 bp, Homo sapiens
ttgtcatttaccctggtg

SEQ ID NO: 5337868 - DNA, 13 bp, Homo sapiens
ttgtcatttataa

SEQ ID NO: 5337869 - DNA, 15 bp, Homo sapiens
ttgtcatttccaaat

SEQ ID NO: 5337870 - DNA, 20 bp, Homo sapiens
ttgtcattttcattagcaaa

SEQ ID NO: 5337871 - DNA, 15 bp, Homo sapiens
ttgtcattttctcca

SEQ ID NO: 5337872 - DNA, 14 bp, Homo sapiens
ttgtcattttggtc

SEQ ID NO: 5337873 - DNA, 19 bp, Homo sapiens
ttgtcattttttttctttg

SEQ ID NO: 5337874 - DNA, 15 bp, Homo sapiens
ttgtccaaacaggtg

SEQ ID NO: 5337875 - DNA, 17 bp, Homo sapiens
ttgtccaaagtttattt

SEQ ID NO: 5337876 - DNA, 18 bp, Homo sapiens
ttgtccaacaactgtcag

SEQ ID NO: 5337877 - DNA, 21 bp, Homo sapiens
ttgtccaacccgaggcccgca

SEQ ID NO: 5337878 - DNA, 22 bp, Homo sapiens
ttgtccaatggctgtaaactat

SEQ ID NO: 5337879 - DNA, 22 bp, Homo sapiens
ttgtccaattgttgacagttct

SEQ ID NO: 5337880 - DNA, 15 bp, Homo sapiens
ttgtccaatttgtaa

SEQ ID NO: 5337881 - DNA, 18 bp, Homo sapiens
ttgtccaatttgtaagta

SEQ ID NO: 5337882 - DNA, 20 bp, Homo sapiens
ttgtccacagtctcccattc

SEQ ID NO: 5337883 - DNA, 21 bp, Homo sapiens
ttgtccacattctacttcagc

SEQ ID NO: 5337884 - DNA, 14 bp, Homo sapiens
ttgtccacccacct

SEQ ID NO: 5337885 - DNA, 21 bp, Homo sapiens
ttgtccaccttttaagttaat

SEQ ID NO: 5337886 - DNA, 13 bp, Homo sapiens
ttgtccagagctg

SEQ ID NO: 5337887 - DNA, 13 bp, Homo sapiens
ttgtccagcgcct

SEQ ID NO: 5337888 - DNA, 19 bp, Homo sapiens
ttgtccagctgagcgccag

SEQ ID NO: 5337889 - DNA, 13 bp, Homo sapiens
ttgtccaggaagt

SEQ ID NO: 5337890 - DNA, 20 bp, Homo sapiens
ttgtccaggctggagtgcaa

SEQ ID NO: 5337891 - DNA, 20 bp, Homo sapiens
ttgtccaggttgatcttgaa

SEQ ID NO: 5337892 - DNA, 18 bp, Homo sapiens
ttgtccatatcagacctc

SEQ ID NO: 5337893 - DNA, 17 bp, Homo sapiens
ttgtccatcttgtttca

SEQ ID NO: 5337894 - DNA, 17 bp, Homo sapiens
ttgtccatgcctacaga

SEQ ID NO: 5337895 - DNA, 20 bp, Homo sapiens
ttgtccatgcctacagataa

SEQ ID NO: 5337896 - DNA, 15 bp, Homo sapiens
ttgtccatgtgcttc

SEQ ID NO: 5337897 - DNA, 20 bp, Homo sapiens
ttgtccattccaatacattg

SEQ ID NO: 5337898 - DNA, 18 bp, Homo sapiens
ttgtccatttacctggaa

SEQ ID NO: 5337899 - DNA, 14 bp, Homo sapiens
ttgtccatttatgg

SEQ ID NO: 5337900 - DNA, 20 bp, Homo sapiens
ttgtcccaaggaatcagcag

SEQ ID NO: 5337901 - DNA, 19 bp, Homo sapiens
ttgtcccaattaaaatact

SEQ ID NO: 5337902 - DNA, 21 bp, Homo sapiens
ttgtcccagaggctgccccac

SEQ ID NO: 5337903 - DNA, 14 bp, Homo sapiens
ttgtcccatctgcc

SEQ ID NO: 5337904 - DNA, 19 bp, Homo sapiens
ttgtcccatgtggcttgtt

SEQ ID NO: 5337905 - DNA, 15 bp, Homo sapiens
ttgtcccatttcctt

SEQ ID NO: 5337906 - DNA, 23 bp, Homo sapiens
ttgtcccatttccttggaggcca

SEQ ID NO: 5337907 - DNA, 21 bp, Homo sapiens
ttgtcccattttccccttcct

SEQ ID NO: 5337908 - DNA, 24 bp, Homo sapiens
ttgtccccaatcccggtcatgctt

SEQ ID NO: 5337909 - DNA, 17 bp, Homo sapiens
ttgtccccaatgaatat

SEQ ID NO: 5337910 - DNA, 18 bp, Homo sapiens
ttgtccccaccgcagaca

SEQ ID NO: 5337911 - DNA, 15 bp, Homo sapiens
ttgtccccagagaca

SEQ ID NO: 5337912 - DNA, 13 bp, Homo sapiens
ttgtccccagggc

SEQ ID NO: 5337913 - DNA, 11 bp, Homo sapiens
ttgtccccagt

SEQ ID NO: 5337914 - DNA, 12 bp, Homo sapiens
ttgtcccctgct

SEQ ID NO: 5337915 - DNA, 15 bp, Homo sapiens
ttgtccctactttct

SEQ ID NO: 5337916 - DNA, 17 bp, Homo sapiens
ttgtccctctgccccat

SEQ ID NO: 5337917 - DNA, 16 bp, Homo sapiens
ttgtgaaacacagctg

SEQ ID NO: 5337918 - DNA, 14 bp, Homo sapiens
ttgtgaaaccacag

SEQ ID NO: 5337919 - DNA, 20 bp, Homo sapiens
ttgtgaaactaaaattttct

SEQ ID NO: 5337920 - DNA, 13 bp, Homo sapiens
ttgtgaaagaagg

SEQ ID NO: 5337921 - DNA, 14 bp, Homo sapiens
ttgtgaaagaatgt

SEQ ID NO: 5337922 - DNA, 13 bp, Homo sapiens
ttgtgaaagtgta

SEQ ID NO: 5337923 - DNA, 22 bp, Homo sapiens
ttgtgaaatcagtatcagaata

SEQ ID NO: 5337924 - DNA, 23 bp, Homo sapiens
ttgtgaaatggccaggatcctct

SEQ ID NO: 5337925 - DNA, 20 bp, Homo sapiens
ttgtgaaatgtaacatgaag

SEQ ID NO: 5337926 - DNA, 14 bp, Homo sapiens
ttgtgaaattgtgt

SEQ ID NO: 5337927 - DNA, 16 bp, Homo sapiens
ttgtgaaattgtgtag

SEQ ID NO: 5337928 - DNA, 16 bp, Homo sapiens
ttgtgaaatttcatga

SEQ ID NO: 5337929 - DNA, 16 bp, Homo sapiens
ttgtgaaatttgttaa

SEQ ID NO: 5337930 - DNA, 21 bp, Homo sapiens
ttgtgaaatttttcatatttt

SEQ ID NO: 5337931 - DNA, 11 bp, Homo sapiens
ttgtgaacaga

SEQ ID NO: 5337932 - DNA, 20 bp, Homo sapiens
ttgtgaacatgatagttaaa

SEQ ID NO: 5337933 - DNA, 13 bp, Homo sapiens
ttgtgaaccaatg

SEQ ID NO: 5337934 - DNA, 17 bp, Homo sapiens
ttgtgaaccaatgcaag

SEQ ID NO: 5337935 - DNA, 23 bp, Homo sapiens
ttgtgaaccatggtgaagtgctt

SEQ ID NO: 5337936 - DNA, 14 bp, Homo sapiens
ttgtgaacgctgtg

SEQ ID NO: 5337937 - DNA, 22 bp, Homo sapiens
ttgtgaacgctgtgatgctgtg

SEQ ID NO: 5337938 - DNA, 12 bp, Homo sapiens
ttgtgaactgga

SEQ ID NO: 5337939 - DNA, 21 bp, Homo sapiens
ttgtgaactggaagaaagcaa

SEQ ID NO: 5337940 - DNA, 19 bp, Homo sapiens
ttgtgaacttcacaagaat

SEQ ID NO: 5337941 - DNA, 19 bp, Homo sapiens
ttgtgaagaattattcagt

SEQ ID NO: 5337942 - DNA, 22 bp, Homo sapiens
ttgtgaagccatgagttccaga

SEQ ID NO: 5337943 - DNA, 13 bp, Homo sapiens
ttgtgaagccctg

SEQ ID NO: 5337944 - DNA, 19 bp, Homo sapiens
ttgtgaagctaatgaccaa

SEQ ID NO: 5337945 - DNA, 19 bp, Homo sapiens
ttgtgaaggaaaaacatgc

SEQ ID NO: 5337946 - DNA, 13 bp, Homo sapiens
ttgtgaaggcagg

SEQ ID NO: 5337947 - DNA, 22 bp, Homo sapiens
ttgtgaaggccatgatattttg

SEQ ID NO: 5337948 - DNA, 17 bp, Homo sapiens
ttgtgaaggtggaaata

SEQ ID NO: 5337949 - DNA, 18 bp, Homo sapiens
ttgtgaaggtggaaataa

SEQ ID NO: 5337950 - DNA, 14 bp, Homo sapiens
ttgtgaagtacata

SEQ ID NO: 5337951 - DNA, 22 bp, Homo sapiens
ttgtgaagtacccgttcacatt

SEQ ID NO: 5337952 - DNA, 17 bp, Homo sapiens
ttgtgaagtgattgaca

SEQ ID NO: 5337953 - DNA, 19 bp, Homo sapiens
ttgtgaagtgattgacatt

SEQ ID NO: 5337954 - DNA, 22 bp, Homo sapiens
ttgtgaatacattctttgctag

SEQ ID NO: 5337955 - DNA, 17 bp, Homo sapiens
ttgtgaatatttggaat

SEQ ID NO: 5337956 - DNA, 23 bp, Homo sapiens
ttgtgaatcaagggtcaggcctt

SEQ ID NO: 5337957 - DNA, 19 bp, Homo sapiens
ttgtgaatcttaacatttt

SEQ ID NO: 5337958 - DNA, 16 bp, Homo sapiens
ttgtgaatgcttctca

SEQ ID NO: 5337959 - DNA, 12 bp, Homo sapiens
ttgtgaatgttc

SEQ ID NO: 5337960 - DNA, 18 bp, Homo sapiens
ttgtgaattaggctgtaa

SEQ ID NO: 5337961 - DNA, 19 bp, Homo sapiens
ttgtgaattaggctgtaac

SEQ ID NO: 5337962 - DNA, 18 bp, Homo sapiens
ttgtgaattatactttgt

SEQ ID NO: 5337963 - DNA, 15 bp, Homo sapiens
ttgtgaattgcctgc

SEQ ID NO: 5337964 - DNA, 20 bp, Homo sapiens
ttgtgaattgcctgccatgg

SEQ ID NO: 5337965 - DNA, 14 bp, Homo sapiens
ttgtgacaaaaaat

SEQ ID NO: 5337966 - DNA, 22 bp, Homo sapiens
ttgtgacaaaaaattaaagcat

SEQ ID NO: 5337967 - DNA, 21 bp, Homo sapiens
ttgtgacagcgatggcaggcc

SEQ ID NO: 5337968 - DNA, 20 bp, Homo sapiens
ttgtgaccaatacatttgta

SEQ ID NO: 5337969 - DNA, 21 bp, Homo sapiens
ttgtgaccactgaattcactc

SEQ ID NO: 5337970 - DNA, 16 bp, Homo sapiens
ttgtgacctgaagttc

SEQ ID NO: 5337971 - DNA, 16 bp, Homo sapiens
ttgtgacgattattta

SEQ ID NO: 5337972 - DNA, 22 bp, Homo sapiens
ttgtgacgattatttatttctg

SEQ ID NO: 5337973 - DNA, 20 bp, Homo sapiens
ttgtgactaattgtataaca

SEQ ID NO: 5337974 - DNA, 22 bp, Homo sapiens
ttgtgactaattgtataacagg

SEQ ID NO: 5337975 - DNA, 21 bp, Homo sapiens
ttgtgactagtgctgaagctt

SEQ ID NO: 5337976 - DNA, 23 bp, Homo sapiens
ttgtgactagtgctgaagcttat

SEQ ID NO: 5337977 - DNA, 21 bp, Homo sapiens
ttgtgactatatagagatgtt

SEQ ID NO: 5337978 - DNA, 14 bp, Homo sapiens
ttgtgactattaaa

SEQ ID NO: 5337979 - DNA, 16 bp, Homo sapiens
ttgtgactattaaatg

SEQ ID NO: 5337980 - DNA, 18 bp, Homo sapiens
ttgtgactctaagctcag

SEQ ID NO: 5337981 - DNA, 14 bp, Homo sapiens
ttgtgactgaaggg

SEQ ID NO: 5337982 - DNA, 19 bp, Homo sapiens
ttgtgactgccaggataaa

SEQ ID NO: 5337983 - DNA, 15 bp, Homo sapiens
ttgtgactggcaccc

SEQ ID NO: 5337984 - DNA, 16 bp, Homo sapiens
ttgtgactgtatataa

SEQ ID NO: 5337985 - DNA, 16 bp, Homo sapiens
ttgtgacttcactgta

SEQ ID NO: 5337986 - DNA, 14 bp, Homo sapiens
ttgtgactttttaa

SEQ ID NO: 5337987 - DNA, 17 bp, Homo sapiens
ttgtgagaattactgtt

SEQ ID NO: 5337988 - DNA, 21 bp, Homo sapiens
ttgtgagagaggacctccatg

SEQ ID NO: 5337989 - DNA, 23 bp, Homo sapiens
ttgtgagataaaactctcctttt

SEQ ID NO: 5337990 - DNA, 19 bp, Homo sapiens
ttgtgagatgatttgtact

SEQ ID NO: 5337991 - DNA, 17 bp, Homo sapiens
ttgtgagccctctaggg

SEQ ID NO: 5337992 - DNA, 21 bp, Homo sapiens
ttgtgagccctctagggcagg

SEQ ID NO: 5337993 - DNA, 18 bp, Homo sapiens
ttgtgagccttgctgcca

SEQ ID NO: 5337994 - DNA, 16 bp, Homo sapiens
ttgtgaggaaagtcat

SEQ ID NO: 5337995 - DNA, 22 bp, Homo sapiens
ttgtgaggaaagtcattggctt

SEQ ID NO: 5337996 - DNA, 13 bp, Homo sapiens
ttgtgaggaagcc

SEQ ID NO: 5337997 - DNA, 21 bp, Homo sapiens
ttgtgaggaagccgctggggc

SEQ ID NO: 5337998 - DNA, 20 bp, Homo sapiens
ttgtgaggcttctaataaag

SEQ ID NO: 5337999 - DNA, 24 bp, Homo sapiens
ttgtgagggagagaactgagcatc

SEQ ID NO: 5338000 - DNA, 22 bp, Homo sapiens
ttgtgaggtttaacattaaagc

SEQ ID NO: 5338001 - DNA, 13 bp, Homo sapiens
ttgtgagtatgtg

SEQ ID NO: 5338002 - DNA, 14 bp, Homo sapiens
ttgtgagtatgtgt

SEQ ID NO: 5338003 - DNA, 15 bp, Homo sapiens
ttgtgagtatgtgtg

SEQ ID NO: 5338004 - DNA, 21 bp, Homo sapiens
ttgtgagtgactcggtgtaaa

SEQ ID NO: 5338005 - DNA, 14 bp, Homo sapiens
ttgtgagtttgttt

SEQ ID NO: 5338006 - DNA, 16 bp, Homo sapiens
ttgtgagtttgtttct

SEQ ID NO: 5338007 - DNA, 19 bp, Homo sapiens
ttgtgagtttgtttctttg

SEQ ID NO: 5338008 - DNA, 18 bp, Homo sapiens
ttgtgataatagcatttt

SEQ ID NO: 5338009 - DNA, 13 bp, Homo sapiens
ttgtgataattta

SEQ ID NO: 5338010 - DNA, 21 bp, Homo sapiens
ttgtgatagcactttctacaa

SEQ ID NO: 5338011 - DNA, 13 bp, Homo sapiens
ttgtgatatgcac

SEQ ID NO: 5338012 - DNA, 21 bp, Homo sapiens
ttgtgatatttgacagacatc

SEQ ID NO: 5338013 - DNA, 19 bp, Homo sapiens
ttgtgatccaggaataaac

SEQ ID NO: 5338014 - DNA, 15 bp, Homo sapiens
ttgtgatcctgagtc

SEQ ID NO: 5338015 - DNA, 23 bp, Homo sapiens
ttgtgatcctttggggcttctgt

SEQ ID NO: 5338016 - DNA, 13 bp, Homo sapiens
ttgtgatctgttg

SEQ ID NO: 5338017 - DNA, 14 bp, Homo sapiens
ttgtgatcttgctc

SEQ ID NO: 5338018 - DNA, 17 bp, Homo sapiens
ttgtgatgaaaaggcag

SEQ ID NO: 5338019 - DNA, 11 bp, Homo sapiens
ttgtgatgaac

SEQ ID NO: 5338020 - DNA, 15 bp, Homo sapiens
ttgtgatgaatcaat

SEQ ID NO: 5338021 - DNA, 18 bp, Homo sapiens
ttgtgatgtcatacagag

SEQ ID NO: 5338022 - DNA, 13 bp, Homo sapiens
ttgtgatgtttag

SEQ ID NO: 5338023 - DNA, 22 bp, Homo sapiens
ttgtgattacgtgtatgtttct

SEQ ID NO: 5338024 - DNA, 19 bp, Homo sapiens
ttgtgattagacagaacac

SEQ ID NO: 5338025 - DNA, 17 bp, Homo sapiens
ttgtgattatttcactt

SEQ ID NO: 5338026 - DNA, 18 bp, Homo sapiens
ttgtgattatttcacttt

SEQ ID NO: 5338027 - DNA, 21 bp, Homo sapiens
ttgtgattcttccagatgtga

SEQ ID NO: 5338028 - DNA, 21 bp, Homo sapiens
ttgtgattgaaagtatgttgt

SEQ ID NO: 5338029 - DNA, 15 bp, Homo sapiens
ttgtgattggcctgt

SEQ ID NO: 5338030 - DNA, 13 bp, Homo sapiens
ttgtgattggctg

SEQ ID NO: 5338031 - DNA, 23 bp, Homo sapiens
ttgtgatttctttaaaagaatga

SEQ ID NO: 5338032 - DNA, 15 bp, Homo sapiens
ttgtgatttgactgt

SEQ ID NO: 5338033 - DNA, 17 bp, Homo sapiens
ttgtgatttgactgttt

SEQ ID NO: 5338034 - DNA, 16 bp, Homo sapiens
ttgtgatttttgtaat

SEQ ID NO: 5338035 - DNA, 21 bp, Homo sapiens
ttgtgcaaaagcttcaaatta

SEQ ID NO: 5338036 - DNA, 13 bp, Homo sapiens
ttgtgcaaaatat

SEQ ID NO: 5338037 - DNA, 21 bp, Homo sapiens
ttgtgcaaaatatttgactat

SEQ ID NO: 5338038 - DNA, 15 bp, Homo sapiens
ttgtgcaaacatgga

SEQ ID NO: 5338039 - DNA, 23 bp, Homo sapiens
ttgtgcaaacatggagaaatcta

SEQ ID NO: 5338040 - DNA, 19 bp, Homo sapiens
ttgtgcaaaggataaattt

SEQ ID NO: 5338041 - DNA, 21 bp, Homo sapiens
ttgtgcaatgtgtataaacaa

SEQ ID NO: 5338042 - DNA, 16 bp, Homo sapiens
ttgtgcacatgtacat

SEQ ID NO: 5338043 - DNA, 16 bp, Homo sapiens
ttgtgcacatttattt

SEQ ID NO: 5338044 - DNA, 12 bp, Homo sapiens
ttgtgcactgtt

SEQ ID NO: 5338045 - DNA, 15 bp, Homo sapiens
ttgtgcagaaaacat

SEQ ID NO: 5338046 - DNA, 18 bp, Homo sapiens
ttgtgcagaaaacattgt

SEQ ID NO: 5338047 - DNA, 19 bp, Homo sapiens
ttgtgcagaaaacattgtt

SEQ ID NO: 5338048 - DNA, 14 bp, Homo sapiens
ttgtgcagaatctc

SEQ ID NO: 5338049 - DNA, 11 bp, Homo sapiens
ttgtgcagaga

SEQ ID NO: 5338050 - DNA, 13 bp, Homo sapiens
ttgtgcagctttt

SEQ ID NO: 5338051 - DNA, 18 bp, Homo sapiens
ttgtgcagtgttagtatt

SEQ ID NO: 5338052 - DNA, 20 bp, Homo sapiens
ttgtgcatatctgcctcccc

SEQ ID NO: 5338053 - DNA, 21 bp, Homo sapiens
ttgtgcatatctgcctcccct

SEQ ID NO: 5338054 - DNA, 14 bp, Homo sapiens
ttgtgcatatgtta

SEQ ID NO: 5338055 - DNA, 14 bp, Homo sapiens
ttgtgcatgtttac

SEQ ID NO: 5338056 - DNA, 19 bp, Homo sapiens
ttgtgcatgtttactttat

SEQ ID NO: 5338057 - DNA, 16 bp, Homo sapiens
ttgtgcattaaaatta

SEQ ID NO: 5338058 - DNA, 22 bp, Homo sapiens
ttgtgcattatctagatactgt

SEQ ID NO: 5338059 - DNA, 16 bp, Homo sapiens
ttgtgcattctttggt

SEQ ID NO: 5338060 - DNA, 17 bp, Homo sapiens
ttgtgcattctttggta

SEQ ID NO: 5338061 - DNA, 12 bp, Homo sapiens
ttgtgcatttgg

SEQ ID NO: 5338062 - DNA, 15 bp, Homo sapiens
ttgtgcatttgtaaa

SEQ ID NO: 5338063 - DNA, 13 bp, Homo sapiens
ttgtgcattttgt

SEQ ID NO: 5338064 - DNA, 16 bp, Homo sapiens
ttgtgccaactgccag

SEQ ID NO: 5338065 - DNA, 20 bp, Homo sapiens
ttgtgccaagccttctgtga

SEQ ID NO: 5338066 - DNA, 17 bp, Homo sapiens
ttgtgccaatatgtatt

SEQ ID NO: 5338067 - DNA, 13 bp, Homo sapiens
ttgtgccagagga

SEQ ID NO: 5338068 - DNA, 21 bp, Homo sapiens
ttgtgccagaggaatcctggc

SEQ ID NO: 5338069 - DNA, 17 bp, Homo sapiens
ttgtgccagcccggagg

SEQ ID NO: 5338070 - DNA, 22 bp, Homo sapiens
ttgtgccatagtcacatggcct

SEQ ID NO: 5338071 - DNA, 13 bp, Homo sapiens
ttgtgccatctgt

SEQ ID NO: 5338072 - DNA, 19 bp, Homo sapiens
ttgtgccattatatttgca

SEQ ID NO: 5338073 - DNA, 10 bp, Homo sapiens
ttgtgcccac

SEQ ID NO: 5338074 - DNA, 19 bp, Homo sapiens
ttgtgcccacccagggaag

SEQ ID NO: 5338075 - DNA, 20 bp, Homo sapiens
ttgtgcccagggttttgccc

SEQ ID NO: 5338076 - DNA, 22 bp, Homo sapiens
ttgtgcccccaaccatttcctc

SEQ ID NO: 5338077 - DNA, 17 bp, Homo sapiens
ttgtgccctgcctccac

SEQ ID NO: 5338078 - DNA, 19 bp, Homo sapiens
ttgtgccgtaattatgtac

SEQ ID NO: 5338079 - DNA, 17 bp, Homo sapiens
ttgtgcctccctggtga

SEQ ID NO: 5338080 - DNA, 15 bp, Homo sapiens
ttgtgcctggctcag

SEQ ID NO: 5338081 - DNA, 17 bp, Homo sapiens
ttgtgccttaaagacaa

SEQ ID NO: 5338082 - DNA, 13 bp, Homo sapiens
ttgtgccttccct

SEQ ID NO: 5338083 - DNA, 21 bp, Homo sapiens
ttgtgccttcccttctctggt

SEQ ID NO: 5338084 - DNA, 14 bp, Homo sapiens
ttgtgcctttggcc

SEQ ID NO: 5338085 - DNA, 21 bp, Homo sapiens
ttgtgcggtgtgtctccagct

SEQ ID NO: 5338086 - DNA, 16 bp, Homo sapiens
ttgtgctaatttctgt

SEQ ID NO: 5338087 - DNA, 21 bp, Homo sapiens
ttgtgctacttagtaaaaatt

SEQ ID NO: 5338088 - DNA, 18 bp, Homo sapiens
ttgtgctagaaattttca

SEQ ID NO: 5338089 - DNA, 16 bp, Homo sapiens
ttgtgctcaaggaatc

SEQ ID NO: 5338090 - DNA, 11 bp, Homo sapiens
ttgtgctcagt

SEQ ID NO: 5338091 - DNA, 17 bp, Homo sapiens
ttgtgctccaaatgtct

SEQ ID NO: 5338092 - DNA, 18 bp, Homo sapiens
ttgtgctccatagagcag

SEQ ID NO: 5338093 - DNA, 13 bp, Homo sapiens
ttgtgctctttcc

SEQ ID NO: 5338094 - DNA, 17 bp, Homo sapiens
ttgtgctctttcctgcc

SEQ ID NO: 5338095 - DNA, 14 bp, Homo sapiens
ttgttctagagagg

SEQ ID NO: 5338096 - DNA, 16 bp, Homo sapiens
ttgttctagtactgta

SEQ ID NO: 5338097 - DNA, 17 bp, Homo sapiens
ttgttctatttttcaat

SEQ ID NO: 5338098 - DNA, 13 bp, Homo sapiens
ttgttctcagctc

SEQ ID NO: 5338099 - DNA, 11 bp, Homo sapiens
ttgttctcatt

SEQ ID NO: 5338100 - DNA, 23 bp, Homo sapiens
ttgttctcctccattgctgttgt

SEQ ID NO: 5338101 - DNA, 16 bp, Homo sapiens
ttgttctctaggaaaa

SEQ ID NO: 5338102 - DNA, 12 bp, Homo sapiens
ttgttctgagca

SEQ ID NO: 5338103 - DNA, 13 bp, Homo sapiens
ttgttctgagtaa

SEQ ID NO: 5338104 - DNA, 19 bp, Homo sapiens
ttgttctggctcttccagg

SEQ ID NO: 5338105 - DNA, 20 bp, Homo sapiens
ttgttctggctcttccaggc

SEQ ID NO: 5338106 - DNA, 23 bp, Homo sapiens
ttgttctgggagttgctgttaat

SEQ ID NO: 5338107 - DNA, 22 bp, Homo sapiens
ttgttctgggtgatttctagaa

SEQ ID NO: 5338108 - DNA, 14 bp, Homo sapiens
ttgttctgggttaa

SEQ ID NO: 5338109 - DNA, 12 bp, Homo sapiens
ttgttctgtatt

SEQ ID NO: 5338110 - DNA, 15 bp, Homo sapiens
ttgttctgtgcaaca

SEQ ID NO: 5338111 - DNA, 23 bp, Homo sapiens
ttgttctgtggttttcccctccc

SEQ ID NO: 5338112 - DNA, 16 bp, Homo sapiens
ttgttctgttaactga

SEQ ID NO: 5338113 - DNA, 13 bp, Homo sapiens
ttgttctgttgtc

SEQ ID NO: 5338114 - DNA, 22 bp, Homo sapiens
ttgttcttaaaaaaataaaata

SEQ ID NO: 5338115 - DNA, 14 bp, Homo sapiens
ttgttcttacacat

SEQ ID NO: 5338116 - DNA, 18 bp, Homo sapiens
ttgttcttattctggcat

SEQ ID NO: 5338117 - DNA, 14 bp, Homo sapiens
ttgttcttcaatgt

SEQ ID NO: 5338118 - DNA, 22 bp, Homo sapiens
ttgttcttcagagatcatggaa

SEQ ID NO: 5338119 - DNA, 21 bp, Homo sapiens
ttgttcttggcaataaatttt

SEQ ID NO: 5338120 - DNA, 21 bp, Homo sapiens
ttgttcttgggagaaaatcaa

SEQ ID NO: 5338121 - DNA, 15 bp, Homo sapiens
ttgttcttggttcct

SEQ ID NO: 5338122 - DNA, 13 bp, Homo sapiens
ttgttcttgtcat

SEQ ID NO: 5338123 - DNA, 11 bp, Homo sapiens
ttgttcttgtt

SEQ ID NO: 5338124 - DNA, 13 bp, Homo sapiens
ttgttctttagag

SEQ ID NO: 5338125 - DNA, 13 bp, Homo sapiens
ttgttctttgcca

SEQ ID NO: 5338126 - DNA, 20 bp, Homo sapiens
ttgttctttgtttagcctga

SEQ ID NO: 5338127 - DNA, 21 bp, Homo sapiens
ttgttgaaagtaaaagttata

SEQ ID NO: 5338128 - DNA, 15 bp, Homo sapiens
ttgttgaagtgctgt

SEQ ID NO: 5338129 - DNA, 19 bp, Homo sapiens
ttgttgaagtgctgtttta

SEQ ID NO: 5338130 - DNA, 22 bp, Homo sapiens
ttgttgaataaatgtatctgaa

SEQ ID NO: 5338131 - DNA, 19 bp, Homo sapiens
ttgttgacagcaaaatgtt

SEQ ID NO: 5338132 - DNA, 23 bp, Homo sapiens
ttgttgacagcaaaatgttgaag

SEQ ID NO: 5338133 - DNA, 18 bp, Homo sapiens
ttgttgacatgagtggaa

SEQ ID NO: 5338134 - DNA, 12 bp, Homo sapiens
ttgttgacattc

SEQ ID NO: 5338135 - DNA, 15 bp, Homo sapiens
ttgttgacattctga

SEQ ID NO: 5338136 - DNA, 17 bp, Homo sapiens
ttgttgactgtgattag

SEQ ID NO: 5338137 - DNA, 14 bp, Homo sapiens
ttgttgacttattt

SEQ ID NO: 5338138 - DNA, 22 bp, Homo sapiens
ttgttgagcatgacagcctgca

SEQ ID NO: 5338139 - DNA, 21 bp, Homo sapiens
ttgttgaggtggtctgaatgt

SEQ ID NO: 5338140 - DNA, 15 bp, Homo sapiens
ttgttgataggaact

SEQ ID NO: 5338141 - DNA, 12 bp, Homo sapiens
ttgttgatattt

SEQ ID NO: 5338142 - DNA, 21 bp, Homo sapiens
ttgttgatgggcacttgagaa

SEQ ID NO: 5338143 - DNA, 23 bp, Homo sapiens
ttgttgatgggcacttgagaact

SEQ ID NO: 5338144 - DNA, 19 bp, Homo sapiens
ttgttgattaatttgagaa

SEQ ID NO: 5338145 - DNA, 15 bp, Homo sapiens
ttgttgattctctcc

SEQ ID NO: 5338146 - DNA, 16 bp, Homo sapiens
ttgttgattttctaga

SEQ ID NO: 5338147 - DNA, 16 bp, Homo sapiens
ttgttgcaagatgtga

SEQ ID NO: 5338148 - DNA, 17 bp, Homo sapiens
ttgttgcaagatgtgaa

SEQ ID NO: 5338149 - DNA, 18 bp, Homo sapiens
ttgttgcagagatttcct

SEQ ID NO: 5338150 - DNA, 22 bp, Homo sapiens
ttgttgcatatagttaaactga

SEQ ID NO: 5338151 - DNA, 17 bp, Homo sapiens
ttgttgcatgtttgaaa

SEQ ID NO: 5338152 - DNA, 12 bp, Homo sapiens
ttgttgcctgca

SEQ ID NO: 5338153 - DNA, 20 bp, Homo sapiens
ttgttgcctgcacccttccc

SEQ ID NO: 5338154 - DNA, 14 bp, Homo sapiens
ttgttgcggatgga

SEQ ID NO: 5338155 - DNA, 14 bp, Homo sapiens
ttgttgctatacat

SEQ ID NO: 5338156 - DNA, 18 bp, Homo sapiens
ttgttgctccctgtgaca

SEQ ID NO: 5338157 - DNA, 22 bp, Homo sapiens
ttgttgctccctgtgacaaaat

SEQ ID NO: 5338158 - DNA, 13 bp, Homo sapiens
ttgttgctgctgc

SEQ ID NO: 5338159 - DNA, 14 bp, Homo sapiens
ttgttgctgctgct

SEQ ID NO: 5338160 - DNA, 18 bp, Homo sapiens
ttgttgctgctgctgctc

SEQ ID NO: 5338161 - DNA, 13 bp, Homo sapiens
ttgttgctgctgt

SEQ ID NO: 5338162 - DNA, 11 bp, Homo sapiens
ttgttgctgtt

SEQ ID NO: 5338163 - DNA, 18 bp, Homo sapiens
ttgttgctgttgatgttt

SEQ ID NO: 5338164 - DNA, 14 bp, Homo sapiens
ttgttgctgttgct

SEQ ID NO: 5338165 - DNA, 14 bp, Homo sapiens
ttgttgcttcttgt

SEQ ID NO: 5338166 - DNA, 19 bp, Homo sapiens
ttgttgcttgtacagtgtc

SEQ ID NO: 5338167 - DNA, 21 bp, Homo sapiens
ttgttggaaaagaatacagaa

SEQ ID NO: 5338168 - DNA, 23 bp, Homo sapiens
ttgttggagtcaaaaagaaccac

SEQ ID NO: 5338169 - DNA, 20 bp, Homo sapiens
ttgttggagtgtttctaata

SEQ ID NO: 5338170 - DNA, 14 bp, Homo sapiens
ttgttggatccgtt

SEQ ID NO: 5338171 - DNA, 20 bp, Homo sapiens
ttgttggatccgtttgacca

SEQ ID NO: 5338172 - DNA, 16 bp, Homo sapiens
ttgttggcacagaaca

SEQ ID NO: 5338173 - DNA, 20 bp, Homo sapiens
ttgttggcagcataaaggcc

SEQ ID NO: 5338174 - DNA, 16 bp, Homo sapiens
ttgttggcatagctct

SEQ ID NO: 5338175 - DNA, 18 bp, Homo sapiens
ttgttggcgtaggctaca

SEQ ID NO: 5338176 - DNA, 21 bp, Homo sapiens
ttgttggcgtaggctacagag

SEQ ID NO: 5338177 - DNA, 22 bp, Homo sapiens
ttgttggcgtaggctacagaga

SEQ ID NO: 5338178 - DNA, 23 bp, Homo sapiens
ttgttggcgtaggctacagagaa

SEQ ID NO: 5338179 - DNA, 15 bp, Homo sapiens
ttgttggctatttga

SEQ ID NO: 5338180 - DNA, 16 bp, Homo sapiens
ttgttggctcagaaaa

SEQ ID NO: 5338181 - DNA, 23 bp, Homo sapiens
ttgttggctttcccttatcaaac

SEQ ID NO: 5338182 - DNA, 20 bp, Homo sapiens
ttgttgggattcctgaccca

SEQ ID NO: 5338183 - DNA, 18 bp, Homo sapiens
ttgttggtaactaatgtt

SEQ ID NO: 5338184 - DNA, 18 bp, Homo sapiens
ttgttggtagcatgtact

SEQ ID NO: 5338185 - DNA, 14 bp, Homo sapiens
ttgttggtcagagg

SEQ ID NO: 5338186 - DNA, 21 bp, Homo sapiens
ttgttggtcgcagctacataa

SEQ ID NO: 5338187 - DNA, 14 bp, Homo sapiens
ttgttggtctgtgt

SEQ ID NO: 5338188 - DNA, 18 bp, Homo sapiens
ttgttggtgaattttcaa

SEQ ID NO: 5338189 - DNA, 21 bp, Homo sapiens
ttgttgtaaaacaaaatttga

SEQ ID NO: 5338190 - DNA, 21 bp, Homo sapiens
ttgttgtacaactcataaata

SEQ ID NO: 5338191 - DNA, 22 bp, Homo sapiens
ttgttgtacccttgttttgaaa

SEQ ID NO: 5338192 - DNA, 12 bp, Homo sapiens
ttgttgtacttt

SEQ ID NO: 5338193 - DNA, 23 bp, Homo sapiens
ttgttgtagattgattgtattgt

SEQ ID NO: 5338194 - DNA, 17 bp, Homo sapiens
ttgttgtataatttcga

SEQ ID NO: 5338195 - DNA, 20 bp, Homo sapiens
ttgttgtataatttcgagat

SEQ ID NO: 5338196 - DNA, 15 bp, Homo sapiens
ttgttgtattcctgc

SEQ ID NO: 5338197 - DNA, 17 bp, Homo sapiens
ttgttgtattcctgcct

SEQ ID NO: 5338198 - DNA, 16 bp, Homo sapiens
ttgttgtcccaatgaa

SEQ ID NO: 5338199 - DNA, 21 bp, Homo sapiens
ttgttgtccttgccccactcc

SEQ ID NO: 5338200 - DNA, 14 bp, Homo sapiens
ttgttgtctacatt

SEQ ID NO: 5338201 - DNA, 16 bp, Homo sapiens
ttgttgtctacattaa

SEQ ID NO: 5338202 - DNA, 12 bp, Homo sapiens
ttgttgtctcca

SEQ ID NO: 5338203 - DNA, 19 bp, Homo sapiens
ttgttgtctccacttgtat

SEQ ID NO: 5338204 - DNA, 20 bp, Homo sapiens
ttgttgtgacacatcaagct

SEQ ID NO: 5338205 - DNA, 13 bp, Homo sapiens
ttgttgtgctttt

SEQ ID NO: 5338206 - DNA, 11 bp, Homo sapiens
ttgttgtgggt

SEQ ID NO: 5338207 - DNA, 18 bp, Homo sapiens
ttgttgtgtgtatatgta

SEQ ID NO: 5338208 - DNA, 22 bp, Homo sapiens
ttgttgtgtgtatatgtattta

SEQ ID NO: 5338209 - DNA, 20 bp, Homo sapiens
ttgttgtgttgagatccagt

SEQ ID NO: 5338210 - DNA, 20 bp, Homo sapiens
ttgttgttattttttgagaa

SEQ ID NO: 5338211 - DNA, 23 bp, Homo sapiens
ttgttgttccccttccctcacac

SEQ ID NO: 5338212 - DNA, 15 bp, Homo sapiens
ttgttgttctgcctg

SEQ ID NO: 5338213 - DNA, 14 bp, Homo sapiens
ttgttgttctgtta

SEQ ID NO: 5338214 - DNA, 21 bp, Homo sapiens
ttgttgttctgttaactgaat

SEQ ID NO: 5338215 - DNA, 14 bp, Homo sapiens
ttgttgtttcagtg

SEQ ID NO: 5338216 - DNA, 14 bp, Homo sapiens
ttgttgtttgccat

SEQ ID NO: 5338217 - DNA, 13 bp, Homo sapiens
ttgttgtttgtaa

SEQ ID NO: 5338218 - DNA, 19 bp, Homo sapiens
ttgttgttttaacctcccc

SEQ ID NO: 5338219 - DNA, 17 bp, Homo sapiens
ttgtttaaaatcatttc

SEQ ID NO: 5338220 - DNA, 18 bp, Homo sapiens
ttgtttaaaatcatttct

SEQ ID NO: 5338221 - DNA, 15 bp, Homo sapiens
ttgtttaaaatgtaa

SEQ ID NO: 5338222 - DNA, 21 bp, Homo sapiens
ttgtttaaacccaagtgctgc

SEQ ID NO: 5338223 - DNA, 22 bp, Homo sapiens
ttgtttaaacccaagtgctgca

SEQ ID NO: 5338224 - DNA, 13 bp, Homo sapiens
ttgtttaaagcaa

SEQ ID NO: 5338225 - DNA, 12 bp, Homo sapiens
ttgtttaaagtt

SEQ ID NO: 5338226 - DNA, 16 bp, Homo sapiens
ttgtttaaatgccaaa

SEQ ID NO: 5338227 - DNA, 12 bp, Homo sapiens
ttgtttaacata

SEQ ID NO: 5338228 - DNA, 23 bp, Homo sapiens
ttgtttaacataaattgtactgt

SEQ ID NO: 5338229 - DNA, 15 bp, Homo sapiens
ttgtttaagaatcat

SEQ ID NO: 5338230 - DNA, 19 bp, Homo sapiens
ttgtttaagaatcatggat

SEQ ID NO: 5338231 - DNA, 19 bp, Homo sapiens
ttgtttaagcatcacatta

SEQ ID NO: 5338232 - DNA, 13 bp, Homo sapiens
ttgtttaatcttt

SEQ ID NO: 5338233 - DNA, 23 bp, Homo sapiens
ttgtttaatggtagttttacagt

SEQ ID NO: 5338234 - DNA, 12 bp, Homo sapiens
ttgtttaatgtt

SEQ ID NO: 5338235 - DNA, 12 bp, Homo sapiens
ttgtttaattgt

SEQ ID NO: 5338236 - DNA, 23 bp, Homo sapiens
ttgtttacaacacagtagtgttc

SEQ ID NO: 5338237 - DNA, 21 bp, Homo sapiens
ttgtttacagcactactctgt

SEQ ID NO: 5338238 - DNA, 22 bp, Homo sapiens
ttgtttacagcactactctgtg

SEQ ID NO: 5338239 - DNA, 17 bp, Homo sapiens
ttgtttacatgcttatt

SEQ ID NO: 5338240 - DNA, 13 bp, Homo sapiens
ttgtttataaaaa

SEQ ID NO: 5338241 - DNA, 18 bp, Homo sapiens
ttgtttataataaaaata

SEQ ID NO: 5338242 - DNA, 17 bp, Homo sapiens
ttgtttataatgttatc

SEQ ID NO: 5338243 - DNA, 13 bp, Homo sapiens
ttgtttatacaca

SEQ ID NO: 5338244 - DNA, 18 bp, Homo sapiens
ttgtttatacctttgcct

SEQ ID NO: 5338245 - DNA, 17 bp, Homo sapiens
ttgtttatatgaaaaca

SEQ ID NO: 5338246 - DNA, 13 bp, Homo sapiens
ttgtttatcaact

SEQ ID NO: 5338247 - DNA, 19 bp, Homo sapiens
ttgtttatctagatgtaaa

SEQ ID NO: 5338248 - DNA, 17 bp, Homo sapiens
ttgtttatgccaaatgt

SEQ ID NO: 5338249 - DNA, 24 bp, Homo sapiens
ttgtttattagatgaattatccta

SEQ ID NO: 5338250 - DNA, 13 bp, Homo sapiens
ttgtttattgagt

SEQ ID NO: 5338251 - DNA, 15 bp, Homo sapiens
ttgtttattgagttt

SEQ ID NO: 5338252 - DNA, 24 bp, Homo sapiens
ttgtttattgagtttgtaggtaaa

SEQ ID NO: 5338253 - DNA, 15 bp, Homo sapiens
ttgtttattgtaaaa

SEQ ID NO: 5338254 - DNA, 13 bp, Homo sapiens
ttgtttatttcat

SEQ ID NO: 5338255 - DNA, 17 bp, Homo sapiens
ttgtttatttttatata

SEQ ID NO: 5338256 - DNA, 15 bp, Homo sapiens
ttgtttatttttcta

SEQ ID NO: 5338257 - DNA, 18 bp, Homo sapiens
ttgtttcaaacacaaatg

SEQ ID NO: 5338258 - DNA, 23 bp, Homo sapiens
ttgtttcaattagaaaaggaaat

SEQ ID NO: 5338259 - DNA, 16 bp, Homo sapiens
ttgtttcactccacca

SEQ ID NO: 5338260 - DNA, 16 bp, Homo sapiens
ttgtttcatctatttt

SEQ ID NO: 5338261 - DNA, 12 bp, Homo sapiens
ttgtttccaaag

SEQ ID NO: 5338262 - DNA, 15 bp, Homo sapiens
ttgtttccaacttgt

SEQ ID NO: 5338263 - DNA, 12 bp, Homo sapiens
ttgtttccatag

SEQ ID NO: 5338264 - DNA, 22 bp, Homo sapiens
ttgtttccccacaaaacaaagc

SEQ ID NO: 5338265 - DNA, 14 bp, Homo sapiens
ttgtttccctgctg

SEQ ID NO: 5338266 - DNA, 15 bp, Homo sapiens
ttgtttccctgctgg

SEQ ID NO: 5338267 - DNA, 19 bp, Homo sapiens
ttgtttcctcttccaaagt

SEQ ID NO: 5338268 - DNA, 21 bp, Homo sapiens
ttgtttcctcttccaaagtaa

SEQ ID NO: 5338269 - DNA, 12 bp, Homo sapiens
ttgtttcctgtg

SEQ ID NO: 5338270 - DNA, 13 bp, Homo sapiens
ttgtttcgctctt

SEQ ID NO: 5338271 - DNA, 19 bp, Homo sapiens
ttgtttcgctctttgagaa

SEQ ID NO: 5338272 - DNA, 17 bp, Homo sapiens
ttgtttcggtgccctgt

SEQ ID NO: 5338273 - DNA, 14 bp, Homo sapiens
ttgtttctactttg

SEQ ID NO: 5338274 - DNA, 14 bp, Homo sapiens
tttaaaaaatacac

SEQ ID NO: 5338275 - DNA, 16 bp, Homo sapiens
tttaaaaaataccatt

SEQ ID NO: 5338276 - DNA, 20 bp, Homo sapiens
tttaaaaaataccattgaaa

SEQ ID NO: 5338277 - DNA, 23 bp, Homo sapiens
tttaaaaaataccattgaaatca

SEQ ID NO: 5338278 - DNA, 21 bp, Homo sapiens
tttaaaaaatatatatataaa

SEQ ID NO: 5338279 - DNA, 14 bp, Homo sapiens
tttaaaaaatattt

SEQ ID NO: 5338280 - DNA, 15 bp, Homo sapiens
tttaaaaaatatttt

SEQ ID NO: 5338281 - DNA, 15 bp, Homo sapiens
tttaaaaaatcaatc

SEQ ID NO: 5338282 - DNA, 21 bp, Homo sapiens
tttaaaaaatcaatcaatggt

SEQ ID NO: 5338283 - DNA, 14 bp, Homo sapiens
tttaaaaaatgaat

SEQ ID NO: 5338284 - DNA, 19 bp, Homo sapiens
tttaaaaaatgagcttcca

SEQ ID NO: 5338285 - DNA, 17 bp, Homo sapiens
tttaaaaaattaatctg

SEQ ID NO: 5338286 - DNA, 17 bp, Homo sapiens
tttaaaaaattatggaa

SEQ ID NO: 5338287 - DNA, 23 bp, Homo sapiens
tttaaaaaattttttgattaatg

SEQ ID NO: 5338288 - DNA, 23 bp, Homo sapiens
tttaaaaacatgagaaatgtgaa

SEQ ID NO: 5338289 - DNA, 13 bp, Homo sapiens
tttaaaaacattt

SEQ ID NO: 5338290 - DNA, 17 bp, Homo sapiens
tttaaaaacatttttta

SEQ ID NO: 5338291 - DNA, 19 bp, Homo sapiens
tttaaaaaccaatcatttt

SEQ ID NO: 5338292 - DNA, 15 bp, Homo sapiens
tttaaaaacctattt

SEQ ID NO: 5338293 - DNA, 15 bp, Homo sapiens
tttaaaaaccttgta

SEQ ID NO: 5338294 - DNA, 16 bp, Homo sapiens
tttaaaaactcttcag

SEQ ID NO: 5338295 - DNA, 13 bp, Homo sapiens
tttaaaaactgga

SEQ ID NO: 5338296 - DNA, 13 bp, Homo sapiens
tttaaaaagaaat

SEQ ID NO: 5338297 - DNA, 13 bp, Homo sapiens
tttaaaaagcaaa

SEQ ID NO: 5338298 - DNA, 14 bp, Homo sapiens
tttaaaaagcaaat

SEQ ID NO: 5338299 - DNA, 19 bp, Homo sapiens
tttaaaaagcagtttttga

SEQ ID NO: 5338300 - DNA, 14 bp, Homo sapiens
tttaaaaagcatgt

SEQ ID NO: 5338301 - DNA, 18 bp, Homo sapiens
tttaaaaagctcactgct

SEQ ID NO: 5338302 - DNA, 16 bp, Homo sapiens
tttaaaaaggcctttg

SEQ ID NO: 5338303 - DNA, 18 bp, Homo sapiens
tttaaaaaggcctttggg

SEQ ID NO: 5338304 - DNA, 21 bp, Homo sapiens
tttaaaaaggcctttgggatt

SEQ ID NO: 5338305 - DNA, 13 bp, Homo sapiens
tttaaaaaggtgc

SEQ ID NO: 5338306 - DNA, 12 bp, Homo sapiens
tttaaaaagtaa

SEQ ID NO: 5338307 - DNA, 18 bp, Homo sapiens
tttaaaaagtaagttaat

SEQ ID NO: 5338308 - DNA, 23 bp, Homo sapiens
tttaaaaagtaccacattccatg

SEQ ID NO: 5338309 - DNA, 16 bp, Homo sapiens
tttaaaaagtattgcc

SEQ ID NO: 5338310 - DNA, 20 bp, Homo sapiens
tttaaaaagtattgccaaac

SEQ ID NO: 5338311 - DNA, 11 bp, Homo sapiens
tttaaaaataa

SEQ ID NO: 5338312 - DNA, 22 bp, Homo sapiens
tttaaaaataaagctactgaat

SEQ ID NO: 5338313 - DNA, 20 bp, Homo sapiens
tttaaaaataagtcaacagt

SEQ ID NO: 5338314 - DNA, 21 bp, Homo sapiens
tttaaaaatacacatggaaaa

SEQ ID NO: 5338315 - DNA, 17 bp, Homo sapiens
tttaaaaatacacttgt

SEQ ID NO: 5338316 - DNA, 14 bp, Homo sapiens
tttaaaaatacata

SEQ ID NO: 5338317 - DNA, 23 bp, Homo sapiens
tttaaaaataccaatcacaagga

SEQ ID NO: 5338318 - DNA, 13 bp, Homo sapiens
tttaaaaatagaa

SEQ ID NO: 5338319 - DNA, 17 bp, Homo sapiens
tttaaaaatagaaacat

SEQ ID NO: 5338320 - DNA, 17 bp, Homo sapiens
tttaaaaatagacactc

SEQ ID NO: 5338321 - DNA, 11 bp, Homo sapiens
tttaaaaatat

SEQ ID NO: 5338322 - DNA, 16 bp, Homo sapiens
tttaaaaatcaacttt

SEQ ID NO: 5338323 - DNA, 15 bp, Homo sapiens
tttaaaaatcataaa

SEQ ID NO: 5338324 - DNA, 19 bp, Homo sapiens
tttaaaaatcataaactgt

SEQ ID NO: 5338325 - DNA, 20 bp, Homo sapiens
tttaaaaatccccaaaaaag

SEQ ID NO: 5338326 - DNA, 15 bp, Homo sapiens
tttaaaaatgaagat

SEQ ID NO: 5338327 - DNA, 17 bp, Homo sapiens
tttaaaaatgatctgta

SEQ ID NO: 5338328 - DNA, 23 bp, Homo sapiens
tttaaaaatgatctgtagttttt

SEQ ID NO: 5338329 - DNA, 12 bp, Homo sapiens
tttaaaaatgca

SEQ ID NO: 5338330 - DNA, 11 bp, Homo sapiens
tttaaaaatgg

SEQ ID NO: 5338331 - DNA, 22 bp, Homo sapiens
tttaaaaatggtatcaaaatta

SEQ ID NO: 5338332 - DNA, 13 bp, Homo sapiens
tttaaaaatgtct

SEQ ID NO: 5338333 - DNA, 19 bp, Homo sapiens
tttaaaaattggcatttta

SEQ ID NO: 5338334 - DNA, 11 bp, Homo sapiens
tttaaaaattt

SEQ ID NO: 5338335 - DNA, 12 bp, Homo sapiens
tttaaaaattta

SEQ ID NO: 5338336 - DNA, 11 bp, Homo sapiens
tttaaaacaaa

SEQ ID NO: 5338337 - DNA, 12 bp, Homo sapiens
tttaaaacaaaa

SEQ ID NO: 5338338 - DNA, 15 bp, Homo sapiens
tttaaaacaagaaag

SEQ ID NO: 5338339 - DNA, 20 bp, Homo sapiens
tttaaaacaagaaagtttcc

SEQ ID NO: 5338340 - DNA, 13 bp, Homo sapiens
tttaaaacaagct

SEQ ID NO: 5338341 - DNA, 15 bp, Homo sapiens
tttaaaacaagctga

SEQ ID NO: 5338342 - DNA, 17 bp, Homo sapiens
tttaaaacaagctgata

SEQ ID NO: 5338343 - DNA, 18 bp, Homo sapiens
tttaaaacaagctgatag

SEQ ID NO: 5338344 - DNA, 23 bp, Homo sapiens
tttaaaacacatgtttttataca

SEQ ID NO: 5338345 - DNA, 13 bp, Homo sapiens
tttaaaacactaa

SEQ ID NO: 5338346 - DNA, 15 bp, Homo sapiens
tttaaaacagcctgg

SEQ ID NO: 5338347 - DNA, 15 bp, Homo sapiens
tttaaaacaggcaaa

SEQ ID NO: 5338348 - DNA, 20 bp, Homo sapiens
tttaaaacatcagaaactga

SEQ ID NO: 5338349 - DNA, 14 bp, Homo sapiens
tttaaaacatgtaa

SEQ ID NO: 5338350 - DNA, 16 bp, Homo sapiens
tttaaaacatgtaata

SEQ ID NO: 5338351 - DNA, 17 bp, Homo sapiens
tttaaaacatttcatgt

SEQ ID NO: 5338352 - DNA, 13 bp, Homo sapiens
tttaaaacatttt

SEQ ID NO: 5338353 - DNA, 13 bp, Homo sapiens
tttaaaaccacta

SEQ ID NO: 5338354 - DNA, 18 bp, Homo sapiens
tttaaaaccataaactgt

SEQ ID NO: 5338355 - DNA, 15 bp, Homo sapiens
tttaaaaccatgcag

SEQ ID NO: 5338356 - DNA, 11 bp, Homo sapiens
tttaaaaccca

SEQ ID NO: 5338357 - DNA, 21 bp, Homo sapiens
tttaaaacccatttaaatttt

SEQ ID NO: 5338358 - DNA, 13 bp, Homo sapiens
tttaaaactatat

SEQ ID NO: 5338359 - DNA, 10 bp, Homo sapiens
tttaaaactc

SEQ ID NO: 5338360 - DNA, 11 bp, Homo sapiens
tttaaaactgt

SEQ ID NO: 5338361 - DNA, 16 bp, Homo sapiens
tttaaaagaaatttat

SEQ ID NO: 5338362 - DNA, 13 bp, Homo sapiens
tttaaaagaatga

SEQ ID NO: 5338363 - DNA, 17 bp, Homo sapiens
tttaaaagaatgggcag

SEQ ID NO: 5338364 - DNA, 16 bp, Homo sapiens
tttaaaagagacaaac

SEQ ID NO: 5338365 - DNA, 22 bp, Homo sapiens
tttaaaagagagagagagaaaa

SEQ ID NO: 5338366 - DNA, 21 bp, Homo sapiens
tttaaaagagccatgtccaaa

SEQ ID NO: 5338367 - DNA, 20 bp, Homo sapiens
tttaaaagatataagactta

SEQ ID NO: 5338368 - DNA, 16 bp, Homo sapiens
tttaaaagatccattt

SEQ ID NO: 5338369 - DNA, 16 bp, Homo sapiens
tttaaaagatcttcaa

SEQ ID NO: 5338370 - DNA, 14 bp, Homo sapiens
tttaaaagattcat

SEQ ID NO: 5338371 - DNA, 22 bp, Homo sapiens
tttaaaagcacaatcactaaac

SEQ ID NO: 5338372 - DNA, 20 bp, Homo sapiens
tttaaaagcagagcattttt

SEQ ID NO: 5338373 - DNA, 15 bp, Homo sapiens
tttaaaagcatgaaa

SEQ ID NO: 5338374 - DNA, 16 bp, Homo sapiens
tttaaaagcatgaaac

SEQ ID NO: 5338375 - DNA, 15 bp, Homo sapiens
tttaaaagcattttt

SEQ ID NO: 5338376 - DNA, 20 bp, Homo sapiens
tttaaaagccctttccaaag

SEQ ID NO: 5338377 - DNA, 17 bp, Homo sapiens
tttaaaaggatgtataa

SEQ ID NO: 5338378 - DNA, 18 bp, Homo sapiens
tttaaaaggtagagtctt

SEQ ID NO: 5338379 - DNA, 19 bp, Homo sapiens
tttaaaaggtattttgaat

SEQ ID NO: 5338380 - DNA, 18 bp, Homo sapiens
tttaaaaggttgactcaa

SEQ ID NO: 5338381 - DNA, 20 bp, Homo sapiens
tttaaaagtaattgtattaa

SEQ ID NO: 5338382 - DNA, 22 bp, Homo sapiens
tttaaaagtataaaactgcttt

SEQ ID NO: 5338383 - DNA, 14 bp, Homo sapiens
tttaaaagtccact

SEQ ID NO: 5338384 - DNA, 22 bp, Homo sapiens
tttaaaagtctattttattatg

SEQ ID NO: 5338385 - DNA, 16 bp, Homo sapiens
tttaaaagtgcacatt

SEQ ID NO: 5338386 - DNA, 18 bp, Homo sapiens
tttaaaagtgtcaagctg

SEQ ID NO: 5338387 - DNA, 18 bp, Homo sapiens
tttaaaagtttgtccttt

SEQ ID NO: 5338388 - DNA, 18 bp, Homo sapiens
tttaaaagttttgttctt

SEQ ID NO: 5338389 - DNA, 16 bp, Homo sapiens
tttaaaataaaagtac

SEQ ID NO: 5338390 - DNA, 16 bp, Homo sapiens
tttaaaataaaatgaa

SEQ ID NO: 5338391 - DNA, 19 bp, Homo sapiens
tttaaaataaaatgaaaat

SEQ ID NO: 5338392 - DNA, 22 bp, Homo sapiens
tttaaaataaaatgaaaattgt

SEQ ID NO: 5338393 - DNA, 14 bp, Homo sapiens
tttaaaataaactg

SEQ ID NO: 5338394 - DNA, 18 bp, Homo sapiens
tttaaaataaactgtaaa

SEQ ID NO: 5338395 - DNA, 23 bp, Homo sapiens
tttaaaataaactgtaaactaat

SEQ ID NO: 5338396 - DNA, 14 bp, Homo sapiens
tttaaaataaagag

SEQ ID NO: 5338397 - DNA, 14 bp, Homo sapiens
tttaaaataaataa

SEQ ID NO: 5338398 - DNA, 24 bp, Homo sapiens
tttaaaataaattcctacaactta

SEQ ID NO: 5338399 - DNA, 18 bp, Homo sapiens
tttaaaataaattctctc

SEQ ID NO: 5338400 - DNA, 22 bp, Homo sapiens
tttaaaataaggataataatca

SEQ ID NO: 5338401 - DNA, 16 bp, Homo sapiens
tttaaaataagtctga

SEQ ID NO: 5338402 - DNA, 17 bp, Homo sapiens
tttaaaataagttaaag

SEQ ID NO: 5338403 - DNA, 20 bp, Homo sapiens
tttaaaataccactgtaatt

SEQ ID NO: 5338404 - DNA, 11 bp, Homo sapiens
tttaaaatact

SEQ ID NO: 5338405 - DNA, 18 bp, Homo sapiens
tttaaaatactgtagata

SEQ ID NO: 5338406 - DNA, 17 bp, Homo sapiens
tttaaaatacttattaa

SEQ ID NO: 5338407 - DNA, 23 bp, Homo sapiens
tttaaaatagaaattttgtaaga

SEQ ID NO: 5338408 - DNA, 15 bp, Homo sapiens
tttaaaatagttttc

SEQ ID NO: 5338409 - DNA, 11 bp, Homo sapiens
tttaaaatata

SEQ ID NO: 5338410 - DNA, 23 bp, Homo sapiens
tttaaaatatatgtctatataca

SEQ ID NO: 5338411 - DNA, 20 bp, Homo sapiens
tttaaaatattgttttccta

SEQ ID NO: 5338412 - DNA, 21 bp, Homo sapiens
tttaaaatatttgaatgaaaa

SEQ ID NO: 5338413 - DNA, 22 bp, Homo sapiens
tttaaaatatttgaatgaaaac

SEQ ID NO: 5338414 - DNA, 13 bp, Homo sapiens
tttaaaatcacta

SEQ ID NO: 5338415 - DNA, 14 bp, Homo sapiens
tttaaaatcactaa

SEQ ID NO: 5338416 - DNA, 19 bp, Homo sapiens
tttaaaatcactaacatta

SEQ ID NO: 5338417 - DNA, 18 bp, Homo sapiens
tttaaaatcagctatttt

SEQ ID NO: 5338418 - DNA, 19 bp, Homo sapiens
tttaaaatcatcagaaagg

SEQ ID NO: 5338419 - DNA, 20 bp, Homo sapiens
tttaaaatctgatttaatgt

SEQ ID NO: 5338420 - DNA, 20 bp, Homo sapiens
tttaaaatcttattaaagtt

SEQ ID NO: 5338421 - DNA, 21 bp, Homo sapiens
tttaaaatcttattaaagttt

SEQ ID NO: 5338422 - DNA, 16 bp, Homo sapiens
tttaaaatcttttcta

SEQ ID NO: 5338423 - DNA, 17 bp, Homo sapiens
tttaaaatgaaatgcat

SEQ ID NO: 5338424 - DNA, 20 bp, Homo sapiens
tttaaaatgaaatgcatttt

SEQ ID NO: 5338425 - DNA, 17 bp, Homo sapiens
tttaaaatgaagcaatt

SEQ ID NO: 5338426 - DNA, 21 bp, Homo sapiens
tttaaaatgcaggtgaacttt

SEQ ID NO: 5338427 - DNA, 21 bp, Homo sapiens
tttaaaatgctcaatttcagc

SEQ ID NO: 5338428 - DNA, 15 bp, Homo sapiens
tttaaaatgctgctt

SEQ ID NO: 5338429 - DNA, 19 bp, Homo sapiens
tttaaaatgcttgggtaca

SEQ ID NO: 5338430 - DNA, 21 bp, Homo sapiens
tttaaaatggacttttgttca

SEQ ID NO: 5338431 - DNA, 20 bp, Homo sapiens
tttaaaatggtttgtcctga

SEQ ID NO: 5338432 - DNA, 18 bp, Homo sapiens
tttaaaatgtaatttaaa

SEQ ID NO: 5338433 - DNA, 21 bp, Homo sapiens
tttaaaatgtaatttaaatga

SEQ ID NO: 5338434 - DNA, 22 bp, Homo sapiens
tttaaaatgtagaagaaagcaa

SEQ ID NO: 5338435 - DNA, 16 bp, Homo sapiens
tttaaaatgtagtttt

SEQ ID NO: 5338436 - DNA, 21 bp, Homo sapiens
tttaaaatgtagttttaaata

SEQ ID NO: 5338437 - DNA, 22 bp, Homo sapiens
tttaaaatgtcttggtcttcta

SEQ ID NO: 5338438 - DNA, 20 bp, Homo sapiens
tttaaaatgtgaggcaataa

SEQ ID NO: 5338439 - DNA, 17 bp, Homo sapiens
tttaaaatgttggtgca

SEQ ID NO: 5338440 - DNA, 19 bp, Homo sapiens
tttaaaattaatcttgctt

SEQ ID NO: 5338441 - DNA, 17 bp, Homo sapiens
tttaaaattatatagca

SEQ ID NO: 5338442 - DNA, 21 bp, Homo sapiens
tttaaaattattaaaaattat

SEQ ID NO: 5338443 - DNA, 16 bp, Homo sapiens
tttaaaattcatggaa

SEQ ID NO: 5338444 - DNA, 20 bp, Homo sapiens
tttaaaattccattatctta

SEQ ID NO: 5338445 - DNA, 15 bp, Homo sapiens
tttaaaattgaatag

SEQ ID NO: 5338446 - DNA, 18 bp, Homo sapiens
tttaaaattgatttttct

SEQ ID NO: 5338447 - DNA, 23 bp, Homo sapiens
tttaaaattgctatgttactatt

SEQ ID NO: 5338448 - DNA, 10 bp, Homo sapiens
tttaaaattt

SEQ ID NO: 5338449 - DNA, 17 bp, Homo sapiens
tttaaaatttgtagaat

SEQ ID NO: 5338450 - DNA, 16 bp, Homo sapiens
tttaaaatttgttctt

SEQ ID NO: 5338451 - DNA, 18 bp, Homo sapiens
tttaaacaaaatttatgt

SEQ ID NO: 5338452 - DNA, 14 bp, Homo sapiens
tttaaattttatgt

SEQ ID NO: 5338453 - DNA, 22 bp, Homo sapiens
tttaaattttatgtcatagaaa

SEQ ID NO: 5338454 - DNA, 22 bp, Homo sapiens
tttaaattttctccagtccctg

SEQ ID NO: 5338455 - DNA, 22 bp, Homo sapiens
tttaaattttcttcagttggtg

SEQ ID NO: 5338456 - DNA, 18 bp, Homo sapiens
tttaaattttctttttgt

SEQ ID NO: 5338457 - DNA, 12 bp, Homo sapiens
tttaaattttta

SEQ ID NO: 5338458 - DNA, 18 bp, Homo sapiens
tttaacaaaaagtgcttc

SEQ ID NO: 5338459 - DNA, 20 bp, Homo sapiens
tttaacaaaacaagaaagaa

SEQ ID NO: 5338460 - DNA, 16 bp, Homo sapiens
tttaacaaaagcaaga

SEQ ID NO: 5338461 - DNA, 12 bp, Homo sapiens
tttaacaaacta

SEQ ID NO: 5338462 - DNA, 16 bp, Homo sapiens
tttaacaacagctggt

SEQ ID NO: 5338463 - DNA, 20 bp, Homo sapiens
tttaacaacatgtttccagc

SEQ ID NO: 5338464 - DNA, 13 bp, Homo sapiens
tttaacaagaaga

SEQ ID NO: 5338465 - DNA, 14 bp, Homo sapiens
tttaacaagtcatt

SEQ ID NO: 5338466 - DNA, 13 bp, Homo sapiens
tttaacaatgaca

SEQ ID NO: 5338467 - DNA, 21 bp, Homo sapiens
tttaacacctgatgtgtacat

SEQ ID NO: 5338468 - DNA, 15 bp, Homo sapiens
tttaacactttgtat

SEQ ID NO: 5338469 - DNA, 18 bp, Homo sapiens
tttaacactttgtattac

SEQ ID NO: 5338470 - DNA, 19 bp, Homo sapiens
tttaacactttttgtgaat

SEQ ID NO: 5338471 - DNA, 12 bp, Homo sapiens
tttaacagaaat

SEQ ID NO: 5338472 - DNA, 13 bp, Homo sapiens
tttaacagaaatt

SEQ ID NO: 5338473 - DNA, 15 bp, Homo sapiens
tttaacagacatgta

SEQ ID NO: 5338474 - DNA, 14 bp, Homo sapiens
tttaacagagtttt

SEQ ID NO: 5338475 - DNA, 22 bp, Homo sapiens
tttaacagatatttaaatttag

SEQ ID NO: 5338476 - DNA, 20 bp, Homo sapiens
tttaacagctgaattatcta

SEQ ID NO: 5338477 - DNA, 14 bp, Homo sapiens
tttaacagctttct

SEQ ID NO: 5338478 - DNA, 15 bp, Homo sapiens
tttaacagctttctc

SEQ ID NO: 5338479 - DNA, 14 bp, Homo sapiens
tttaacataagcta

SEQ ID NO: 5338480 - DNA, 15 bp, Homo sapiens
tttaacatacatcta

SEQ ID NO: 5338481 - DNA, 19 bp, Homo sapiens
tttaacatagtaattctta

SEQ ID NO: 5338482 - DNA, 21 bp, Homo sapiens
tttaacatataatttctttaa

SEQ ID NO: 5338483 - DNA, 14 bp, Homo sapiens
tttaacatatatat

SEQ ID NO: 5338484 - DNA, 17 bp, Homo sapiens
tttaacatctgcagtgt

SEQ ID NO: 5338485 - DNA, 16 bp, Homo sapiens
tttaacatgatttcaa

SEQ ID NO: 5338486 - DNA, 22 bp, Homo sapiens
tttaacattcctcatgaatgta

SEQ ID NO: 5338487 - DNA, 23 bp, Homo sapiens
tttaacattcttggtcacaaagc

SEQ ID NO: 5338488 - DNA, 23 bp, Homo sapiens
tttaacattgattggataaatgc

SEQ ID NO: 5338489 - DNA, 21 bp, Homo sapiens
tttaacatttgccttgcagaa

SEQ ID NO: 5338490 - DNA, 22 bp, Homo sapiens
tttaacattttgttcttacaca

SEQ ID NO: 5338491 - DNA, 23 bp, Homo sapiens
tttaacattttgttcttacacat

SEQ ID NO: 5338492 - DNA, 15 bp, Homo sapiens
tttaaccaaaggtga

SEQ ID NO: 5338493 - DNA, 23 bp, Homo sapiens
tttaaccaaaggtgaaggaatat

SEQ ID NO: 5338494 - DNA, 17 bp, Homo sapiens
tttaaccagtacttcta

SEQ ID NO: 5338495 - DNA, 15 bp, Homo sapiens
tttaaccagttattt

SEQ ID NO: 5338496 - DNA, 21 bp, Homo sapiens
tttaaccatccttaaattatt

SEQ ID NO: 5338497 - DNA, 17 bp, Homo sapiens
tttaaccattaaaactg

SEQ ID NO: 5338498 - DNA, 22 bp, Homo sapiens
tttaaccattattatgcaaaat

SEQ ID NO: 5338499 - DNA, 18 bp, Homo sapiens
tttaacccccctgtacac

SEQ ID NO: 5338500 - DNA, 21 bp, Homo sapiens
tttaaccccgtcaacaaatct

SEQ ID NO: 5338501 - DNA, 21 bp, Homo sapiens
tttaaccctcctgggcccaag

SEQ ID NO: 5338502 - DNA, 19 bp, Homo sapiens
tttaaccgtttttcaagaa

SEQ ID NO: 5338503 - DNA, 19 bp, Homo sapiens
tttaacctaatatcactta

SEQ ID NO: 5338504 - DNA, 15 bp, Homo sapiens
tttaacctatgataa

SEQ ID NO: 5338505 - DNA, 23 bp, Homo sapiens
tttaacctatgttacaccatctt

SEQ ID NO: 5338506 - DNA, 14 bp, Homo sapiens
tttaacctcagaaa

SEQ ID NO: 5338507 - DNA, 13 bp, Homo sapiens
tttaacctctttt

SEQ ID NO: 5338508 - DNA, 21 bp, Homo sapiens
tttaacctgccaacatacttt

SEQ ID NO: 5338509 - DNA, 16 bp, Homo sapiens
tttaacctttgctgta

SEQ ID NO: 5338510 - DNA, 18 bp, Homo sapiens
tttaacctttgctgtagt

SEQ ID NO: 5338511 - DNA, 19 bp, Homo sapiens
tttaacgtatgtatttcat

SEQ ID NO: 5338512 - DNA, 15 bp, Homo sapiens
tttaacgtgaggttt

SEQ ID NO: 5338513 - DNA, 20 bp, Homo sapiens
tttaacgtgaggtttcagta

SEQ ID NO: 5338514 - DNA, 14 bp, Homo sapiens
tttaacgtggcttg

SEQ ID NO: 5338515 - DNA, 23 bp, Homo sapiens
tttaacgtggcttgtagaatttt

SEQ ID NO: 5338516 - DNA, 16 bp, Homo sapiens
tttaactaataaaata

SEQ ID NO: 5338517 - DNA, 15 bp, Homo sapiens
tttaactaatttaaa

SEQ ID NO: 5338518 - DNA, 17 bp, Homo sapiens
tttaactaatttaaacc

SEQ ID NO: 5338519 - DNA, 20 bp, Homo sapiens
tttaactaatttaaaccagc

SEQ ID NO: 5338520 - DNA, 19 bp, Homo sapiens
tttaactactgtattccca

SEQ ID NO: 5338521 - DNA, 14 bp, Homo sapiens
tttaactatgtaat

SEQ ID NO: 5338522 - DNA, 14 bp, Homo sapiens
tttaactatttaga

SEQ ID NO: 5338523 - DNA, 16 bp, Homo sapiens
tttaactatttagaga

SEQ ID NO: 5338524 - DNA, 18 bp, Homo sapiens
tttaactcagatcactac

SEQ ID NO: 5338525 - DNA, 23 bp, Homo sapiens
tttaactcagatcactactgcag

SEQ ID NO: 5338526 - DNA, 17 bp, Homo sapiens
tttaactcatctttaga

SEQ ID NO: 5338527 - DNA, 18 bp, Homo sapiens
tttaactcccctgtttca

SEQ ID NO: 5338528 - DNA, 15 bp, Homo sapiens
tttaactcccttttt

SEQ ID NO: 5338529 - DNA, 18 bp, Homo sapiens
tttaactccctttttaca

SEQ ID NO: 5338530 - DNA, 23 bp, Homo sapiens
tttaactccctttttacacttta

SEQ ID NO: 5338531 - DNA, 17 bp, Homo sapiens
tttaactctactgtgta

SEQ ID NO: 5338532 - DNA, 18 bp, Homo sapiens
tttaactctagaatttgg

SEQ ID NO: 5338533 - DNA, 13 bp, Homo sapiens
tttaactgaaaat

SEQ ID NO: 5338534 - DNA, 14 bp, Homo sapiens
tttaactgagaaat

SEQ ID NO: 5338535 - DNA, 20 bp, Homo sapiens
tttaactgagggctgatctt

SEQ ID NO: 5338536 - DNA, 21 bp, Homo sapiens
tttaactgattaaaaatacct

SEQ ID NO: 5338537 - DNA, 20 bp, Homo sapiens
tttaactgatttaacacttt

SEQ ID NO: 5338538 - DNA, 23 bp, Homo sapiens
tttaactgcactcatagggtgct

SEQ ID NO: 5338539 - DNA, 22 bp, Homo sapiens
tttaactgcagttgactttctc

SEQ ID NO: 5338540 - DNA, 14 bp, Homo sapiens
tttaactgcattct

SEQ ID NO: 5338541 - DNA, 12 bp, Homo sapiens
tttaactgccgt

SEQ ID NO: 5338542 - DNA, 14 bp, Homo sapiens
tttaactgcctaaa

SEQ ID NO: 5338543 - DNA, 18 bp, Homo sapiens
tttaactggcatggatta

SEQ ID NO: 5338544 - DNA, 19 bp, Homo sapiens
tttaactggcttcatttta

SEQ ID NO: 5338545 - DNA, 17 bp, Homo sapiens
tttaactggtgaagaga

SEQ ID NO: 5338546 - DNA, 18 bp, Homo sapiens
tttaactgtgcagtgact

SEQ ID NO: 5338547 - DNA, 13 bp, Homo sapiens
tttaactgtggat

SEQ ID NO: 5338548 - DNA, 15 bp, Homo sapiens
tttaactgtggatat

SEQ ID NO: 5338549 - DNA, 14 bp, Homo sapiens
tttaacttaaatag

SEQ ID NO: 5338550 - DNA, 16 bp, Homo sapiens
tttaacttaatggcac

SEQ ID NO: 5338551 - DNA, 15 bp, Homo sapiens
tttaacttatctcca

SEQ ID NO: 5338552 - DNA, 19 bp, Homo sapiens
tttaacttcatttttctaa

SEQ ID NO: 5338553 - DNA, 18 bp, Homo sapiens
tttaacttccagtggctg

SEQ ID NO: 5338554 - DNA, 15 bp, Homo sapiens
tttaacttgaaaaga

SEQ ID NO: 5338555 - DNA, 13 bp, Homo sapiens
tttaacttgtctt

SEQ ID NO: 5338556 - DNA, 13 bp, Homo sapiens
tttaactttgaaa

SEQ ID NO: 5338557 - DNA, 19 bp, Homo sapiens
tttaagaaaaaaagcaaaa

SEQ ID NO: 5338558 - DNA, 18 bp, Homo sapiens
tttaagaaaaaaagctgc

SEQ ID NO: 5338559 - DNA, 22 bp, Homo sapiens
tttaagaaaaaataacacacat

SEQ ID NO: 5338560 - DNA, 18 bp, Homo sapiens
tttaagaaaaacatgtca

SEQ ID NO: 5338561 - DNA, 22 bp, Homo sapiens
tttaagaaaaaggatgcacaga

SEQ ID NO: 5338562 - DNA, 19 bp, Homo sapiens
tttaagaaaaatgaaaact

SEQ ID NO: 5338563 - DNA, 16 bp, Homo sapiens
tttaagaaaacatttc

SEQ ID NO: 5338564 - DNA, 11 bp, Homo sapiens
tttaagaaaag

SEQ ID NO: 5338565 - DNA, 14 bp, Homo sapiens
tttaagaaaagcac

SEQ ID NO: 5338566 - DNA, 21 bp, Homo sapiens
tttaagaaaagcacttttgtt

SEQ ID NO: 5338567 - DNA, 16 bp, Homo sapiens
tttaagaaaagtattt

SEQ ID NO: 5338568 - DNA, 20 bp, Homo sapiens
tttaagaaaagtattttgaa

SEQ ID NO: 5338569 - DNA, 23 bp, Homo sapiens
tttaagaaaagtattttgaagtt

SEQ ID NO: 5338570 - DNA, 16 bp, Homo sapiens
tttaagaaaatacaat

SEQ ID NO: 5338571 - DNA, 12 bp, Homo sapiens
tttaagaaagag

SEQ ID NO: 5338572 - DNA, 20 bp, Homo sapiens
tttaagaaagcttcttgtga

SEQ ID NO: 5338573 - DNA, 15 bp, Homo sapiens
tttaagaaataactt

SEQ ID NO: 5338574 - DNA, 21 bp, Homo sapiens
tttaagaaccttaatgacaac

SEQ ID NO: 5338575 - DNA, 17 bp, Homo sapiens
tttaagaactaaaatgt

SEQ ID NO: 5338576 - DNA, 12 bp, Homo sapiens
tttaagaacttc

SEQ ID NO: 5338577 - DNA, 19 bp, Homo sapiens
tttaagaacttcattttta

SEQ ID NO: 5338578 - DNA, 15 bp, Homo sapiens
tttaagaatatctgt

SEQ ID NO: 5338579 - DNA, 12 bp, Homo sapiens
tttaagaatcat

SEQ ID NO: 5338580 - DNA, 19 bp, Homo sapiens
tttaagaatggtctcagtg

SEQ ID NO: 5338581 - DNA, 22 bp, Homo sapiens
tttaagacaccaaatataacaa

SEQ ID NO: 5338582 - DNA, 17 bp, Homo sapiens
tttaagacacttccgtc

SEQ ID NO: 5338583 - DNA, 22 bp, Homo sapiens
tttaagacagtcccatcaaaac

SEQ ID NO: 5338584 - DNA, 21 bp, Homo sapiens
tttaagacataaacaaagaca

SEQ ID NO: 5338585 - DNA, 21 bp, Homo sapiens
tttaagacgtgaatgtctcag

SEQ ID NO: 5338586 - DNA, 19 bp, Homo sapiens
tttaagacgtgtttgtgtt

SEQ ID NO: 5338587 - DNA, 23 bp, Homo sapiens
tttaagactagtcccttggataa

SEQ ID NO: 5338588 - DNA, 11 bp, Homo sapiens
tttaagactga

SEQ ID NO: 5338589 - DNA, 15 bp, Homo sapiens
tttaagacttagtta

SEQ ID NO: 5338590 - DNA, 21 bp, Homo sapiens
tttaagacttagttatttctg

SEQ ID NO: 5338591 - DNA, 20 bp, Homo sapiens
tttaagagaacaagcaaata

SEQ ID NO: 5338592 - DNA, 13 bp, Homo sapiens
tttaagagaatta

SEQ ID NO: 5338593 - DNA, 13 bp, Homo sapiens
tttaagagactca

SEQ ID NO: 5338594 - DNA, 14 bp, Homo sapiens
tttaagagatttta

SEQ ID NO: 5338595 - DNA, 16 bp, Homo sapiens
tttaagagccttcaat

SEQ ID NO: 5338596 - DNA, 14 bp, Homo sapiens
tttaagaggcaggg

SEQ ID NO: 5338597 - DNA, 22 bp, Homo sapiens
tttaagagtgaaataattaaaa

SEQ ID NO: 5338598 - DNA, 9 bp, Homo sapiens
tttaagata

SEQ ID NO: 5338599 - DNA, 15 bp, Homo sapiens
tttaagataatagtt

SEQ ID NO: 5338600 - DNA, 14 bp, Homo sapiens
tttaagataattat

SEQ ID NO: 5338601 - DNA, 13 bp, Homo sapiens
tttaagatacaaa

SEQ ID NO: 5338602 - DNA, 16 bp, Homo sapiens
tttaagatatccatct

SEQ ID NO: 5338603 - DNA, 15 bp, Homo sapiens
tttaagatccagaaa

SEQ ID NO: 5338604 - DNA, 13 bp, Homo sapiens
tttaagatcttgg

SEQ ID NO: 5338605 - DNA, 19 bp, Homo sapiens
tttaagatgtacatttaat

SEQ ID NO: 5338606 - DNA, 13 bp, Homo sapiens
tttaagatgtgaa

SEQ ID NO: 5338607 - DNA, 22 bp, Homo sapiens
tttaagatgtgtcttcaatttg

SEQ ID NO: 5338608 - DNA, 14 bp, Homo sapiens
tttaagattgtaat

SEQ ID NO: 5338609 - DNA, 15 bp, Homo sapiens
tttaagattgtaatt

SEQ ID NO: 5338610 - DNA, 22 bp, Homo sapiens
tttaagatttaatttgccaaaa

SEQ ID NO: 5338611 - DNA, 12 bp, Homo sapiens
tttaagattttt

SEQ ID NO: 5338612 - DNA, 14 bp, Homo sapiens
tttaagatttttct

SEQ ID NO: 5338613 - DNA, 16 bp, Homo sapiens
tttaagatttttctca

SEQ ID NO: 5338614 - DNA, 17 bp, Homo sapiens
tttaagatttttctcaa

SEQ ID NO: 5338615 - DNA, 16 bp, Homo sapiens
tttaagcaaatactta

SEQ ID NO: 5338616 - DNA, 14 bp, Homo sapiens
tttaagcaataaaa

SEQ ID NO: 5338617 - DNA, 15 bp, Homo sapiens
tttaagcaataaaac

SEQ ID NO: 5338618 - DNA, 17 bp, Homo sapiens
tttaagcaataaaactg

SEQ ID NO: 5338619 - DNA, 14 bp, Homo sapiens
tttaagcagaattg

SEQ ID NO: 5338620 - DNA, 18 bp, Homo sapiens
tttaagcagaattggaaa

SEQ ID NO: 5338621 - DNA, 19 bp, Homo sapiens
tttaagcagaattggaaaa

SEQ ID NO: 5338622 - DNA, 23 bp, Homo sapiens
tttaagcagactcagctgctata

SEQ ID NO: 5338623 - DNA, 21 bp, Homo sapiens
tttaagcatcacattaaagtt

SEQ ID NO: 5338624 - DNA, 20 bp, Homo sapiens
tttaagcattactcttgtaa

SEQ ID NO: 5338625 - DNA, 21 bp, Homo sapiens
tttaagcattactcttgtaag

SEQ ID NO: 5338626 - DNA, 13 bp, Homo sapiens
tttaagcatttta

SEQ ID NO: 5338627 - DNA, 21 bp, Homo sapiens
tttaagccaaagaaacaagct

SEQ ID NO: 5338628 - DNA, 18 bp, Homo sapiens
tttaagccaataaataat

SEQ ID NO: 5338629 - DNA, 11 bp, Homo sapiens
tttaagccata

SEQ ID NO: 5338630 - DNA, 21 bp, Homo sapiens
tttaatttggtagatgacaaa

SEQ ID NO: 5338631 - DNA, 23 bp, Homo sapiens
tttaatttgtaaaacttctgctc

SEQ ID NO: 5338632 - DNA, 16 bp, Homo sapiens
tttaattttaaaatgt

SEQ ID NO: 5338633 - DNA, 16 bp, Homo sapiens
tttaattttaaagagt

SEQ ID NO: 5338634 - DNA, 17 bp, Homo sapiens
tttaattttaatgctgt

SEQ ID NO: 5338635 - DNA, 12 bp, Homo sapiens
tttaattttcac

SEQ ID NO: 5338636 - DNA, 18 bp, Homo sapiens
tttaattttcacaaaatg

SEQ ID NO: 5338637 - DNA, 18 bp, Homo sapiens
tttaattttcagttctat

SEQ ID NO: 5338638 - DNA, 22 bp, Homo sapiens
tttaattttgacactatatctg

SEQ ID NO: 5338639 - DNA, 14 bp, Homo sapiens
tttaattttttact

SEQ ID NO: 5338640 - DNA, 13 bp, Homo sapiens
tttacaaaaagac

SEQ ID NO: 5338641 - DNA, 18 bp, Homo sapiens
tttacaaaacaaactcat

SEQ ID NO: 5338642 - DNA, 19 bp, Homo sapiens
tttacaaaactacatgaga

SEQ ID NO: 5338643 - DNA, 13 bp, Homo sapiens
tttacaaaactgc

SEQ ID NO: 5338644 - DNA, 23 bp, Homo sapiens
tttacaaaactgccaaaaatata

SEQ ID NO: 5338645 - DNA, 16 bp, Homo sapiens
tttacaaaactgcttt

SEQ ID NO: 5338646 - DNA, 21 bp, Homo sapiens
tttacaaaagatttattgtaa

SEQ ID NO: 5338647 - DNA, 14 bp, Homo sapiens
tttacaaaatgaat

SEQ ID NO: 5338648 - DNA, 19 bp, Homo sapiens
tttacaaaatgaatgcatt

SEQ ID NO: 5338649 - DNA, 13 bp, Homo sapiens
tttacaaaattgc

SEQ ID NO: 5338650 - DNA, 20 bp, Homo sapiens
tttacaaacagatgaaaaaa

SEQ ID NO: 5338651 - DNA, 16 bp, Homo sapiens
tttacaaacctttgtt

SEQ ID NO: 5338652 - DNA, 13 bp, Homo sapiens
tttacaaaggctg

SEQ ID NO: 5338653 - DNA, 23 bp, Homo sapiens
tttacaaaggctgtattcagcaa

SEQ ID NO: 5338654 - DNA, 12 bp, Homo sapiens
tttacaaagtgt

SEQ ID NO: 5338655 - DNA, 14 bp, Homo sapiens
tttacaaataattt

SEQ ID NO: 5338656 - DNA, 18 bp, Homo sapiens
tttacaaatattaagaaa

SEQ ID NO: 5338657 - DNA, 18 bp, Homo sapiens
tttacaaatgaagtattt

SEQ ID NO: 5338658 - DNA, 22 bp, Homo sapiens
tttacaaattaatatttgtgct

SEQ ID NO: 5338659 - DNA, 19 bp, Homo sapiens
tttacaaatttttcctgca

SEQ ID NO: 5338660 - DNA, 17 bp, Homo sapiens
tttacaacaaacactgt

SEQ ID NO: 5338661 - DNA, 20 bp, Homo sapiens
tttacaacataatctagttt

SEQ ID NO: 5338662 - DNA, 18 bp, Homo sapiens
tttacaacatcaccagtg

SEQ ID NO: 5338663 - DNA, 12 bp, Homo sapiens
tttacaactaaa

SEQ ID NO: 5338664 - DNA, 22 bp, Homo sapiens
tttacaactcattccagatccc

SEQ ID NO: 5338665 - DNA, 21 bp, Homo sapiens
tttacaacttgattttttcaa

SEQ ID NO: 5338666 - DNA, 21 bp, Homo sapiens
tttacaagaaaaaatgaattt

SEQ ID NO: 5338667 - DNA, 11 bp, Homo sapiens
tttacaagaag

SEQ ID NO: 5338668 - DNA, 17 bp, Homo sapiens
tttacaagaagtacgaa

SEQ ID NO: 5338669 - DNA, 22 bp, Homo sapiens
tttacaagatccatttgccttt

SEQ ID NO: 5338670 - DNA, 10 bp, Homo sapiens
tttacaagcg

SEQ ID NO: 5338671 - DNA, 19 bp, Homo sapiens
tttacaataaatattctgc

SEQ ID NO: 5338672 - DNA, 17 bp, Homo sapiens
tttacaatgatgccgaa

SEQ ID NO: 5338673 - DNA, 17 bp, Homo sapiens
tttacaatgatttgtaa

SEQ ID NO: 5338674 - DNA, 15 bp, Homo sapiens
tttacaatgtaatta

SEQ ID NO: 5338675 - DNA, 19 bp, Homo sapiens
tttacaatgtaattattta

SEQ ID NO: 5338676 - DNA, 15 bp, Homo sapiens
tttacaatgtattaa

SEQ ID NO: 5338677 - DNA, 13 bp, Homo sapiens
tttacaatgtgaa

SEQ ID NO: 5338678 - DNA, 14 bp, Homo sapiens
tttacaatgtgaat

SEQ ID NO: 5338679 - DNA, 15 bp, Homo sapiens
tttacaatgtgaata

SEQ ID NO: 5338680 - DNA, 23 bp, Homo sapiens
tttacaattgtaaaactgaggca

SEQ ID NO: 5338681 - DNA, 21 bp, Homo sapiens
tttacacaattaattcatccc

SEQ ID NO: 5338682 - DNA, 15 bp, Homo sapiens
tttacacaattctta

SEQ ID NO: 5338683 - DNA, 22 bp, Homo sapiens
tttacacacgtcgttctaatta

SEQ ID NO: 5338684 - DNA, 18 bp, Homo sapiens
tttacacactgtacacat

SEQ ID NO: 5338685 - DNA, 23 bp, Homo sapiens
tttacacactgtacacataagcc

SEQ ID NO: 5338686 - DNA, 12 bp, Homo sapiens
tttacacagaaa

SEQ ID NO: 5338687 - DNA, 23 bp, Homo sapiens
tttacacagagaaatacaaaata

SEQ ID NO: 5338688 - DNA, 14 bp, Homo sapiens
tttacacaggaaga

SEQ ID NO: 5338689 - DNA, 21 bp, Homo sapiens
tttacacagtgagactgtaca

SEQ ID NO: 5338690 - DNA, 22 bp, Homo sapiens
tttacacagtgagactgtacat

SEQ ID NO: 5338691 - DNA, 17 bp, Homo sapiens
tttacacatcttaaaag

SEQ ID NO: 5338692 - DNA, 16 bp, Homo sapiens
tttacacattgacaat

SEQ ID NO: 5338693 - DNA, 20 bp, Homo sapiens
tttacactatataaatggtt

SEQ ID NO: 5338694 - DNA, 14 bp, Homo sapiens
tttacactcaggct

SEQ ID NO: 5338695 - DNA, 22 bp, Homo sapiens
tttacactcaggctttcactat

SEQ ID NO: 5338696 - DNA, 15 bp, Homo sapiens
tttacactctctgta

SEQ ID NO: 5338697 - DNA, 19 bp, Homo sapiens
tttacactctctgtacaaa

SEQ ID NO: 5338698 - DNA, 19 bp, Homo sapiens
tttacactgcggaagccaa

SEQ ID NO: 5338699 - DNA, 13 bp, Homo sapiens
tttacactgtacc

SEQ ID NO: 5338700 - DNA, 14 bp, Homo sapiens
tttacactgtacca

SEQ ID NO: 5338701 - DNA, 13 bp, Homo sapiens
tttacacttgctt

SEQ ID NO: 5338702 - DNA, 15 bp, Homo sapiens
tttacagaatgcatt

SEQ ID NO: 5338703 - DNA, 19 bp, Homo sapiens
tttacagaatgcattaaaa

SEQ ID NO: 5338704 - DNA, 13 bp, Homo sapiens
tttacagaatttt

SEQ ID NO: 5338705 - DNA, 14 bp, Homo sapiens
tttacagcaaaaga

SEQ ID NO: 5338706 - DNA, 15 bp, Homo sapiens
tttacagcattgtct

SEQ ID NO: 5338707 - DNA, 13 bp, Homo sapiens
tttacagcccttg

SEQ ID NO: 5338708 - DNA, 16 bp, Homo sapiens
tttacagcccttggct

SEQ ID NO: 5338709 - DNA, 20 bp, Homo sapiens
tttacagcctcacttgaatg

SEQ ID NO: 5338710 - DNA, 16 bp, Homo sapiens
tttacagctactttaa

SEQ ID NO: 5338711 - DNA, 15 bp, Homo sapiens
tttacagctgtgtta

SEQ ID NO: 5338712 - DNA, 12 bp, Homo sapiens
tttacagctgtt

SEQ ID NO: 5338713 - DNA, 22 bp, Homo sapiens
tttacaggaaaaaaaattctgt

SEQ ID NO: 5338714 - DNA, 19 bp, Homo sapiens
tttacaggatattccaaaa

SEQ ID NO: 5338715 - DNA, 23 bp, Homo sapiens
tttacaggatattccaaaataaa

SEQ ID NO: 5338716 - DNA, 22 bp, Homo sapiens
tttacaggatcatgtaaatgct

SEQ ID NO: 5338717 - DNA, 13 bp, Homo sapiens
tttacaggccctg

SEQ ID NO: 5338718 - DNA, 23 bp, Homo sapiens
tttacagggagcctcctgcccag

SEQ ID NO: 5338719 - DNA, 18 bp, Homo sapiens
tttacaggggttgtgggg

SEQ ID NO: 5338720 - DNA, 13 bp, Homo sapiens
tttacagggtata

SEQ ID NO: 5338721 - DNA, 14 bp, Homo sapiens
tttacagtaaaatt

SEQ ID NO: 5338722 - DNA, 12 bp, Homo sapiens
tttacagtatat

SEQ ID NO: 5338723 - DNA, 20 bp, Homo sapiens
tttacagtatcttcaaaaat

SEQ ID NO: 5338724 - DNA, 19 bp, Homo sapiens
tttacagtatgatgaaaat

SEQ ID NO: 5338725 - DNA, 14 bp, Homo sapiens
tttacagtatttct

SEQ ID NO: 5338726 - DNA, 15 bp, Homo sapiens
tttacagtccttcaa

SEQ ID NO: 5338727 - DNA, 21 bp, Homo sapiens
tttacagtctctttcttcctt

SEQ ID NO: 5338728 - DNA, 21 bp, Homo sapiens
tttacagtgaataaaaggata

SEQ ID NO: 5338729 - DNA, 18 bp, Homo sapiens
tttacagtgaatttctga

SEQ ID NO: 5338730 - DNA, 18 bp, Homo sapiens
tttacagtgtatttaaga

SEQ ID NO: 5338731 - DNA, 17 bp, Homo sapiens
tttacagtgtttctggc

SEQ ID NO: 5338732 - DNA, 22 bp, Homo sapiens
tttacagttagggttttgcaat

SEQ ID NO: 5338733 - DNA, 21 bp, Homo sapiens
tttacagtttcaaaaactgta

SEQ ID NO: 5338734 - DNA, 13 bp, Homo sapiens
tttacagtttgtg

SEQ ID NO: 5338735 - DNA, 22 bp, Homo sapiens
tttacagtttgtgttttaaaaa

SEQ ID NO: 5338736 - DNA, 18 bp, Homo sapiens
tttacataaagactgtgc

SEQ ID NO: 5338737 - DNA, 14 bp, Homo sapiens
tttacataactgcc

SEQ ID NO: 5338738 - DNA, 23 bp, Homo sapiens
tttacataactgccttgaacctg

SEQ ID NO: 5338739 - DNA, 19 bp, Homo sapiens
tttacatagtgcaaaactg

SEQ ID NO: 5338740 - DNA, 16 bp, Homo sapiens
tttacatagttgagat

SEQ ID NO: 5338741 - DNA, 17 bp, Homo sapiens
tttacatagttgagatt

SEQ ID NO: 5338742 - DNA, 19 bp, Homo sapiens
tttacatatagctttgcaa

SEQ ID NO: 5338743 - DNA, 19 bp, Homo sapiens
tttacatattatcatgtct

SEQ ID NO: 5338744 - DNA, 20 bp, Homo sapiens
tttacatattatcatgtcta

SEQ ID NO: 5338745 - DNA, 19 bp, Homo sapiens
tttacatcactttgtgaat

SEQ ID NO: 5338746 - DNA, 14 bp, Homo sapiens
tttacatctatgtg

SEQ ID NO: 5338747 - DNA, 23 bp, Homo sapiens
tttacatctgggatcatgataga

SEQ ID NO: 5338748 - DNA, 18 bp, Homo sapiens
tttacatcttttgggaag

SEQ ID NO: 5338749 - DNA, 14 bp, Homo sapiens
tttacatgaacaca

SEQ ID NO: 5338750 - DNA, 13 bp, Homo sapiens
tttacatgaagta

SEQ ID NO: 5338751 - DNA, 14 bp, Homo sapiens
tttacatgaagtat

SEQ ID NO: 5338752 - DNA, 16 bp, Homo sapiens
tttacatgaagtattt

SEQ ID NO: 5338753 - DNA, 21 bp, Homo sapiens
tttacatgaagtattttttca

SEQ ID NO: 5338754 - DNA, 16 bp, Homo sapiens
tttacatgaggactct

SEQ ID NO: 5338755 - DNA, 20 bp, Homo sapiens
tttacatgataaaaagaaat

SEQ ID NO: 5338756 - DNA, 21 bp, Homo sapiens
tttacatgccccgtttttgag

SEQ ID NO: 5338757 - DNA, 14 bp, Homo sapiens
tttacatgctacta

SEQ ID NO: 5338758 - DNA, 13 bp, Homo sapiens
tttacatgcttat

SEQ ID NO: 5338759 - DNA, 16 bp, Homo sapiens
tttacatgcttattcc

SEQ ID NO: 5338760 - DNA, 22 bp, Homo sapiens
tttacatggctggagctagaat

SEQ ID NO: 5338761 - DNA, 15 bp, Homo sapiens
tttacatgtagtagt

SEQ ID NO: 5338762 - DNA, 21 bp, Homo sapiens
tttacatgtatggttactaaa

SEQ ID NO: 5338763 - DNA, 20 bp, Homo sapiens
tttacatgtgtagcctatgt

SEQ ID NO: 5338764 - DNA, 23 bp, Homo sapiens
tttacattaaagaaatttaatgt

SEQ ID NO: 5338765 - DNA, 16 bp, Homo sapiens
tttacattcaactttt

SEQ ID NO: 5338766 - DNA, 15 bp, Homo sapiens
tttacattctagttc

SEQ ID NO: 5338767 - DNA, 18 bp, Homo sapiens
tttacattgtcctgtagc

SEQ ID NO: 5338768 - DNA, 14 bp, Homo sapiens
tttacattgtgaca

SEQ ID NO: 5338769 - DNA, 22 bp, Homo sapiens
tttacattgtgactgtgtttgc

SEQ ID NO: 5338770 - DNA, 10 bp, Homo sapiens
tttacattta

SEQ ID NO: 5338771 - DNA, 16 bp, Homo sapiens
tttacatttaaagcat

SEQ ID NO: 5338772 - DNA, 17 bp, Homo sapiens
tttacatttaaagcatt

SEQ ID NO: 5338773 - DNA, 20 bp, Homo sapiens
tttacatttaaagcattgct

SEQ ID NO: 5338774 - DNA, 22 bp, Homo sapiens
tttacatttattccttccaaga

SEQ ID NO: 5338775 - DNA, 16 bp, Homo sapiens
tttacatttcttttaa

SEQ ID NO: 5338776 - DNA, 22 bp, Homo sapiens
tttacattttatatttttgtac

SEQ ID NO: 5338777 - DNA, 22 bp, Homo sapiens
tttacattttatggtgcctagt

SEQ ID NO: 5338778 - DNA, 18 bp, Homo sapiens
tttaccaaaaaccatgtt

SEQ ID NO: 5338779 - DNA, 21 bp, Homo sapiens
tttaccaaaaccatccatccc

SEQ ID NO: 5338780 - DNA, 12 bp, Homo sapiens
tttaccaaagca

SEQ ID NO: 5338781 - DNA, 15 bp, Homo sapiens
tttaccaaagcatca

SEQ ID NO: 5338782 - DNA, 15 bp, Homo sapiens
tttaccaacatgtat

SEQ ID NO: 5338783 - DNA, 16 bp, Homo sapiens
tttaccaacatgtatc

SEQ ID NO: 5338784 - DNA, 19 bp, Homo sapiens
tttaccaacatgtatctgt

SEQ ID NO: 5338785 - DNA, 15 bp, Homo sapiens
tttaccaagtacaaa

SEQ ID NO: 5338786 - DNA, 17 bp, Homo sapiens
tttaccaagttatataa

SEQ ID NO: 5338787 - DNA, 21 bp, Homo sapiens
tttaccaagttatataaagag

SEQ ID NO: 5338788 - DNA, 16 bp, Homo sapiens
tttaccaataaactga

SEQ ID NO: 5338789 - DNA, 16 bp, Homo sapiens
tttaccacaaaagcaa

SEQ ID NO: 5338790 - DNA, 11 bp, Homo sapiens
tttaccactgt

SEQ ID NO: 5338791 - DNA, 15 bp, Homo sapiens
tttaccactgtggtt

SEQ ID NO: 5338792 - DNA, 16 bp, Homo sapiens
tttaccacttgctgca

SEQ ID NO: 5338793 - DNA, 13 bp, Homo sapiens
tttaccagaaata

SEQ ID NO: 5338794 - DNA, 23 bp, Homo sapiens
tttaccagcctccgtatttcaga

SEQ ID NO: 5338795 - DNA, 15 bp, Homo sapiens
tttaccatcaaacaa

SEQ ID NO: 5338796 - DNA, 13 bp, Homo sapiens
tttaccatctgaa

SEQ ID NO: 5338797 - DNA, 20 bp, Homo sapiens
tttaccatgcccctgagcaa

SEQ ID NO: 5338798 - DNA, 21 bp, Homo sapiens
tttaccatgctcaatgaaaag

SEQ ID NO: 5338799 - DNA, 14 bp, Homo sapiens
tttaccatgtgcta

SEQ ID NO: 5338800 - DNA, 14 bp, Homo sapiens
tttaccatttgtaa

SEQ ID NO: 5338801 - DNA, 20 bp, Homo sapiens
tttaccatttgtaataaagt

SEQ ID NO: 5338802 - DNA, 23 bp, Homo sapiens
tttaccatttgtaataaagtata

SEQ ID NO: 5338803 - DNA, 14 bp, Homo sapiens
tttacccaaatatg

SEQ ID NO: 5338804 - DNA, 19 bp, Homo sapiens
tttacccacacacagataa

SEQ ID NO: 5338805 - DNA, 21 bp, Homo sapiens
tttacccatatcccctctccc

SEQ ID NO: 5338806 - DNA, 15 bp, Homo sapiens
tttacccatgaagat

SEQ ID NO: 5338807 - DNA, 14 bp, Homo sapiens
tttaccccagctcc

SEQ ID NO: 5338808 - DNA, 17 bp, Homo sapiens
tttaggagattttaggt

SEQ ID NO: 5338809 - DNA, 14 bp, Homo sapiens
tttaggataatctt

SEQ ID NO: 5338810 - DNA, 20 bp, Homo sapiens
tttaggatgaccgtttctta

SEQ ID NO: 5338811 - DNA, 22 bp, Homo sapiens
tttaggatttgtgttttacagt

SEQ ID NO: 5338812 - DNA, 20 bp, Homo sapiens
tttaggcagcctgccgccgt

SEQ ID NO: 5338813 - DNA, 20 bp, Homo sapiens
tttaggccatttgttacagt

SEQ ID NO: 5338814 - DNA, 18 bp, Homo sapiens
tttaggcctcatttcttt

SEQ ID NO: 5338815 - DNA, 20 bp, Homo sapiens
tttaggctattataatatag

SEQ ID NO: 5338816 - DNA, 18 bp, Homo sapiens
tttaggctatttgtaaat

SEQ ID NO: 5338817 - DNA, 19 bp, Homo sapiens
tttaggctcaggacggaag

SEQ ID NO: 5338818 - DNA, 21 bp, Homo sapiens
tttaggcttctatgtccaaca

SEQ ID NO: 5338819 - DNA, 16 bp, Homo sapiens
tttaggcttgaaatct

SEQ ID NO: 5338820 - DNA, 19 bp, Homo sapiens
tttagggagacccaataaa

SEQ ID NO: 5338821 - DNA, 19 bp, Homo sapiens
tttagggagagtcatattt

SEQ ID NO: 5338822 - DNA, 20 bp, Homo sapiens
tttagggagcagatgactga

SEQ ID NO: 5338823 - DNA, 18 bp, Homo sapiens
tttagggagtattctaat

SEQ ID NO: 5338824 - DNA, 21 bp, Homo sapiens
tttagggatctggggaaggac

SEQ ID NO: 5338825 - DNA, 16 bp, Homo sapiens
tttagggccaggcagg

SEQ ID NO: 5338826 - DNA, 15 bp, Homo sapiens
tttagggctgtagac

SEQ ID NO: 5338827 - DNA, 17 bp, Homo sapiens
tttaggggaagtatgtg

SEQ ID NO: 5338828 - DNA, 18 bp, Homo sapiens
tttaggggaagtatgtgt

SEQ ID NO: 5338829 - DNA, 19 bp, Homo sapiens
tttaggggtgttgacacac

SEQ ID NO: 5338830 - DNA, 22 bp, Homo sapiens
tttagggtactaaatttaaatt

SEQ ID NO: 5338831 - DNA, 22 bp, Homo sapiens
tttagggttctaaatgcaataa

SEQ ID NO: 5338832 - DNA, 18 bp, Homo sapiens
tttaggtaaataaagctc

SEQ ID NO: 5338833 - DNA, 22 bp, Homo sapiens
tttaggtcaagaagaagatgga

SEQ ID NO: 5338834 - DNA, 22 bp, Homo sapiens
tttaggtgaattaattaaacat

SEQ ID NO: 5338835 - DNA, 14 bp, Homo sapiens
tttaggtgcctcct

SEQ ID NO: 5338836 - DNA, 18 bp, Homo sapiens
tttaggtgcctcctgtct

SEQ ID NO: 5338837 - DNA, 19 bp, Homo sapiens
tttaggtgtcttttaatga

SEQ ID NO: 5338838 - DNA, 23 bp, Homo sapiens
tttaggttctttgctgcattctg

SEQ ID NO: 5338839 - DNA, 15 bp, Homo sapiens
tttaggttgttacca

SEQ ID NO: 5338840 - DNA, 15 bp, Homo sapiens
tttaggtttgaaagg

SEQ ID NO: 5338841 - DNA, 23 bp, Homo sapiens
tttagtaaaattatctgttctat

SEQ ID NO: 5338842 - DNA, 14 bp, Homo sapiens
tttagtaaatacat

SEQ ID NO: 5338843 - DNA, 21 bp, Homo sapiens
tttagtaaatacatcactgta

SEQ ID NO: 5338844 - DNA, 22 bp, Homo sapiens
tttagtaaatacatcactgtat

SEQ ID NO: 5338845 - DNA, 16 bp, Homo sapiens
tttagtaaatgttatc

SEQ ID NO: 5338846 - DNA, 17 bp, Homo sapiens
tttagtaacatcatttt

SEQ ID NO: 5338847 - DNA, 16 bp, Homo sapiens
tttagtaaggctgtgt

SEQ ID NO: 5338848 - DNA, 17 bp, Homo sapiens
tttagtaatctgtacat

SEQ ID NO: 5338849 - DNA, 16 bp, Homo sapiens
tttagtaatttcctag

SEQ ID NO: 5338850 - DNA, 16 bp, Homo sapiens
tttagtacaatttcaa

SEQ ID NO: 5338851 - DNA, 18 bp, Homo sapiens
tttagtacactatgttct

SEQ ID NO: 5338852 - DNA, 20 bp, Homo sapiens
tttagtacatggagctcagg

SEQ ID NO: 5338853 - DNA, 13 bp, Homo sapiens
tttagtacatttt

SEQ ID NO: 5338854 - DNA, 19 bp, Homo sapiens
tttagtacccacctgagct

SEQ ID NO: 5338855 - DNA, 20 bp, Homo sapiens
tttagtaccttcaaataatt

SEQ ID NO: 5338856 - DNA, 15 bp, Homo sapiens
tttagtagaattcct

SEQ ID NO: 5338857 - DNA, 21 bp, Homo sapiens
tttagtagatattaccagttt

SEQ ID NO: 5338858 - DNA, 22 bp, Homo sapiens
tttagtagcaggtcaaaaacct

SEQ ID NO: 5338859 - DNA, 17 bp, Homo sapiens
tttagtagctcaaaaat

SEQ ID NO: 5338860 - DNA, 13 bp, Homo sapiens
tttagtagctgat

SEQ ID NO: 5338861 - DNA, 16 bp, Homo sapiens
tttagtagctgataaa

SEQ ID NO: 5338862 - DNA, 19 bp, Homo sapiens
tttagtataccagagaagg

SEQ ID NO: 5338863 - DNA, 22 bp, Homo sapiens
tttagtatacgtataaatatca

SEQ ID NO: 5338864 - DNA, 15 bp, Homo sapiens
tttagtatagttttc

SEQ ID NO: 5338865 - DNA, 16 bp, Homo sapiens
tttagtatctttttat

SEQ ID NO: 5338866 - DNA, 13 bp, Homo sapiens
tttagtattcatt

SEQ ID NO: 5338867 - DNA, 21 bp, Homo sapiens
tttagtattcattctgcattg

SEQ ID NO: 5338868 - DNA, 22 bp, Homo sapiens
tttagtattttaggtgctgtta

SEQ ID NO: 5338869 - DNA, 15 bp, Homo sapiens
tttagtcaacatata

SEQ ID NO: 5338870 - DNA, 15 bp, Homo sapiens
tttagtcatgtgacc

SEQ ID NO: 5338871 - DNA, 17 bp, Homo sapiens
tttagtcattaatgtgt

SEQ ID NO: 5338872 - DNA, 13 bp, Homo sapiens
tttagtcattatt

SEQ ID NO: 5338873 - DNA, 16 bp, Homo sapiens
tttagtctaacacagt

SEQ ID NO: 5338874 - DNA, 18 bp, Homo sapiens
tttagtctaccaaaaaca

SEQ ID NO: 5338875 - DNA, 14 bp, Homo sapiens
tttagtctctttat

SEQ ID NO: 5338876 - DNA, 16 bp, Homo sapiens
tttagtctttagaact

SEQ ID NO: 5338877 - DNA, 16 bp, Homo sapiens
tttagtgaaaaactgc

SEQ ID NO: 5338878 - DNA, 24 bp, Homo sapiens
tttagtgaaggcaagtgcaataat

SEQ ID NO: 5338879 - DNA, 23 bp, Homo sapiens
tttagtgactaaaccattgtgca

SEQ ID NO: 5338880 - DNA, 22 bp, Homo sapiens
tttagtgatagatgtagtcttg

SEQ ID NO: 5338881 - DNA, 15 bp, Homo sapiens
tttagtgatatattt

SEQ ID NO: 5338882 - DNA, 15 bp, Homo sapiens
tttagtgattgcttt

SEQ ID NO: 5338883 - DNA, 17 bp, Homo sapiens
tttagtgattgctttta

SEQ ID NO: 5338884 - DNA, 23 bp, Homo sapiens
tttagtgcaaagtataaaattat

SEQ ID NO: 5338885 - DNA, 12 bp, Homo sapiens
tttagtgcaatt

SEQ ID NO: 5338886 - DNA, 14 bp, Homo sapiens
tttagtgccaactt

SEQ ID NO: 5338887 - DNA, 17 bp, Homo sapiens
tttagtgccctgccccc

SEQ ID NO: 5338888 - DNA, 22 bp, Homo sapiens
tttagtgccggctgtggagcaa

SEQ ID NO: 5338889 - DNA, 23 bp, Homo sapiens
tttagtgctcagaatccacaagt

SEQ ID NO: 5338890 - DNA, 19 bp, Homo sapiens
tttagtggaccctgaaatg

SEQ ID NO: 5338891 - DNA, 17 bp, Homo sapiens
tttagtggatggaatat

SEQ ID NO: 5338892 - DNA, 13 bp, Homo sapiens
tttagtggcttca

SEQ ID NO: 5338893 - DNA, 23 bp, Homo sapiens
tttagtgggggatgggtcctcta

SEQ ID NO: 5338894 - DNA, 18 bp, Homo sapiens
tttagtggtggtagaaat

SEQ ID NO: 5338895 - DNA, 16 bp, Homo sapiens
tttagtgtaaaaatga

SEQ ID NO: 5338896 - DNA, 18 bp, Homo sapiens
tttagtgtaaaaatgaga

SEQ ID NO: 5338897 - DNA, 15 bp, Homo sapiens
tttagtgtaaaattg

SEQ ID NO: 5338898 - DNA, 14 bp, Homo sapiens
tttagtgtatatgt

SEQ ID NO: 5338899 - DNA, 17 bp, Homo sapiens
tttagtgtatctttaaa

SEQ ID NO: 5338900 - DNA, 21 bp, Homo sapiens
tttagtgtattttctgtcact

SEQ ID NO: 5338901 - DNA, 15 bp, Homo sapiens
tttagtgtctgacct

SEQ ID NO: 5338902 - DNA, 14 bp, Homo sapiens
tttagtgtgaatat

SEQ ID NO: 5338903 - DNA, 19 bp, Homo sapiens
tttagtgtgtaaaattaat

SEQ ID NO: 5338904 - DNA, 22 bp, Homo sapiens
tttagtgtgtaaaattaatgta

SEQ ID NO: 5338905 - DNA, 15 bp, Homo sapiens
tttagtgtgtgtgca

SEQ ID NO: 5338906 - DNA, 17 bp, Homo sapiens
tttagtgttctgtattt

SEQ ID NO: 5338907 - DNA, 18 bp, Homo sapiens
tttagtgtttatgtttaa

SEQ ID NO: 5338908 - DNA, 19 bp, Homo sapiens
tttagtgtttctttatcta

SEQ ID NO: 5338909 - DNA, 20 bp, Homo sapiens
tttagtgtttttttatttct

SEQ ID NO: 5338910 - DNA, 14 bp, Homo sapiens
tttagttaaaactc

SEQ ID NO: 5338911 - DNA, 17 bp, Homo sapiens
tttagttaaatttctgg

SEQ ID NO: 5338912 - DNA, 22 bp, Homo sapiens
tttagttacgtataatgctttc

SEQ ID NO: 5338913 - DNA, 23 bp, Homo sapiens
tttagttcaatatttgttactgt

SEQ ID NO: 5338914 - DNA, 13 bp, Homo sapiens
tttagttcctgtg

SEQ ID NO: 5338915 - DNA, 18 bp, Homo sapiens
tttagttccttctataca

SEQ ID NO: 5338916 - DNA, 18 bp, Homo sapiens
tttagttgaattccaagt

SEQ ID NO: 5338917 - DNA, 20 bp, Homo sapiens
tttagttgattttaattact

SEQ ID NO: 5338918 - DNA, 18 bp, Homo sapiens
tttagttgcaactttgta

SEQ ID NO: 5338919 - DNA, 20 bp, Homo sapiens
tttagtttctgaactctgac

SEQ ID NO: 5338920 - DNA, 17 bp, Homo sapiens
tttagtttgatcagaca

SEQ ID NO: 5338921 - DNA, 14 bp, Homo sapiens
tttagtttgttaaa

SEQ ID NO: 5338922 - DNA, 18 bp, Homo sapiens
tttagtttgttaattgat

SEQ ID NO: 5338923 - DNA, 13 bp, Homo sapiens
tttagttttattt

SEQ ID NO: 5338924 - DNA, 14 bp, Homo sapiens
tttagttttgcttt

SEQ ID NO: 5338925 - DNA, 16 bp, Homo sapiens
tttagttttgtaactt

SEQ ID NO: 5338926 - DNA, 21 bp, Homo sapiens
tttagttttgtaacttagctt

SEQ ID NO: 5338927 - DNA, 11 bp, Homo sapiens
tttagtttttg

SEQ ID NO: 5338928 - DNA, 15 bp, Homo sapiens
tttagtttttgttct

SEQ ID NO: 5338929 - DNA, 16 bp, Homo sapiens
tttagtttttgttctt

SEQ ID NO: 5338930 - DNA, 17 bp, Homo sapiens
tttataaaaaaaatgaa

SEQ ID NO: 5338931 - DNA, 17 bp, Homo sapiens
tttataaaaaatggtgc

SEQ ID NO: 5338932 - DNA, 14 bp, Homo sapiens
tttataaaaacatt

SEQ ID NO: 5338933 - DNA, 23 bp, Homo sapiens
tttataaaaagatgatcgctgta

SEQ ID NO: 5338934 - DNA, 12 bp, Homo sapiens
tttataaaaagt

SEQ ID NO: 5338935 - DNA, 23 bp, Homo sapiens
tttataaaaataaaaaacactgg

SEQ ID NO: 5338936 - DNA, 14 bp, Homo sapiens
tttataaaaatata

SEQ ID NO: 5338937 - DNA, 13 bp, Homo sapiens
tttataaaactgc

SEQ ID NO: 5338938 - DNA, 17 bp, Homo sapiens
tttataaaagctctaga

SEQ ID NO: 5338939 - DNA, 21 bp, Homo sapiens
tttataaaatagagtgtagtt

SEQ ID NO: 5338940 - DNA, 17 bp, Homo sapiens
tttataaaatataaaca

SEQ ID NO: 5338941 - DNA, 17 bp, Homo sapiens
tttataaaatgtataaa

SEQ ID NO: 5338942 - DNA, 19 bp, Homo sapiens
tttataaaattaaagaaaa

SEQ ID NO: 5338943 - DNA, 17 bp, Homo sapiens
tttataaaattttgctt

SEQ ID NO: 5338944 - DNA, 12 bp, Homo sapiens
tttataaacaga

SEQ ID NO: 5338945 - DNA, 16 bp, Homo sapiens
tttataaacagaaatg

SEQ ID NO: 5338946 - DNA, 20 bp, Homo sapiens
tttataaacatgtccccttc

SEQ ID NO: 5338947 - DNA, 20 bp, Homo sapiens
tttataaaccacttgagcct

SEQ ID NO: 5338948 - DNA, 16 bp, Homo sapiens
tttataaactacaaaa

SEQ ID NO: 5338949 - DNA, 14 bp, Homo sapiens
tttataaacttaat

SEQ ID NO: 5338950 - DNA, 16 bp, Homo sapiens
tttataaactttacct

SEQ ID NO: 5338951 - DNA, 19 bp, Homo sapiens
tttataaagatcatttata

SEQ ID NO: 5338952 - DNA, 14 bp, Homo sapiens
tttataaagcagtt

SEQ ID NO: 5338953 - DNA, 13 bp, Homo sapiens
tttataaaggtct

SEQ ID NO: 5338954 - DNA, 12 bp, Homo sapiens
tttataaagtct

SEQ ID NO: 5338955 - DNA, 20 bp, Homo sapiens
tttataaataaactgttgct

SEQ ID NO: 5338956 - DNA, 15 bp, Homo sapiens
tttataaataacaaa

SEQ ID NO: 5338957 - DNA, 17 bp, Homo sapiens
tttataaatactgcaaa

SEQ ID NO: 5338958 - DNA, 21 bp, Homo sapiens
tttataaatagcatttggaaa

SEQ ID NO: 5338959 - DNA, 21 bp, Homo sapiens
tttataaatatattcaggagt

SEQ ID NO: 5338960 - DNA, 22 bp, Homo sapiens
tttataaatatgtgaaaatgat

SEQ ID NO: 5338961 - DNA, 14 bp, Homo sapiens
tttataaatccagt

SEQ ID NO: 5338962 - DNA, 19 bp, Homo sapiens
tttataaatgcactgtaat

SEQ ID NO: 5338963 - DNA, 12 bp, Homo sapiens
tttataaatgtt

SEQ ID NO: 5338964 - DNA, 15 bp, Homo sapiens
tttataaattaaata

SEQ ID NO: 5338965 - DNA, 15 bp, Homo sapiens
tttataaattactat

SEQ ID NO: 5338966 - DNA, 13 bp, Homo sapiens
tttataacaaata

SEQ ID NO: 5338967 - DNA, 15 bp, Homo sapiens
tttataacaatgtta

SEQ ID NO: 5338968 - DNA, 13 bp, Homo sapiens
tttataacaattg

SEQ ID NO: 5338969 - DNA, 15 bp, Homo sapiens
tttataacaattgat

SEQ ID NO: 5338970 - DNA, 20 bp, Homo sapiens
tttataacagttataaagaa

SEQ ID NO: 5338971 - DNA, 16 bp, Homo sapiens
tttataacatgttaaa

SEQ ID NO: 5338972 - DNA, 20 bp, Homo sapiens
tttataacattgtaaatgat

SEQ ID NO: 5338973 - DNA, 19 bp, Homo sapiens
tttataactagtcctttac

SEQ ID NO: 5338974 - DNA, 15 bp, Homo sapiens
tttataactatataa

SEQ ID NO: 5338975 - DNA, 22 bp, Homo sapiens
tttataactcatcataaaataa

SEQ ID NO: 5338976 - DNA, 14 bp, Homo sapiens
tttataactctagg

SEQ ID NO: 5338977 - DNA, 17 bp, Homo sapiens
tttataactgaaatact

SEQ ID NO: 5338978 - DNA, 13 bp, Homo sapiens
tttataacttttt

SEQ ID NO: 5338979 - DNA, 12 bp, Homo sapiens
tttataagaaaa

SEQ ID NO: 5338980 - DNA, 21 bp, Homo sapiens
tttataagcacagacaattct

SEQ ID NO: 5338981 - DNA, 21 bp, Homo sapiens
tttataagcatcattatttat

SEQ ID NO: 5338982 - DNA, 22 bp, Homo sapiens
tttataagcatcattatttatg

SEQ ID NO: 5338983 - DNA, 23 bp, Homo sapiens
tttataagcatcattatttatgt

SEQ ID NO: 5338984 - DNA, 21 bp, Homo sapiens
tttataagcatttgtattatt

SEQ ID NO: 5338985 - DNA, 22 bp, Homo sapiens
tttataagccagtgttgcctaa

SEQ ID NO: 5338986 - DNA, 17 bp, Homo sapiens
tttataaggctgactct

SEQ ID NO: 5338987 - DNA, 13 bp, Homo sapiens
tttataagggcac

SEQ ID NO: 5338988 - DNA, 13 bp, Homo sapiens
tttataaggtctg

SEQ ID NO: 5338989 - DNA, 13 bp, Homo sapiens
tttataaggtttt

SEQ ID NO: 5338990 - DNA, 19 bp, Homo sapiens
tttataagtcattgtatgt

SEQ ID NO: 5338991 - DNA, 18 bp, Homo sapiens
tttataagtttttgccat

SEQ ID NO: 5338992 - DNA, 15 bp, Homo sapiens
tttataatactacta

SEQ ID NO: 5338993 - DNA, 13 bp, Homo sapiens
tttataataggaa

SEQ ID NO: 5338994 - DNA, 15 bp, Homo sapiens
tttataatattcata

SEQ ID NO: 5338995 - DNA, 14 bp, Homo sapiens
tttataatgactgg

SEQ ID NO: 5338996 - DNA, 20 bp, Homo sapiens
tttataatgatgaacttata

SEQ ID NO: 5338997 - DNA, 17 bp, Homo sapiens
tttataatgattcataa

SEQ ID NO: 5338998 - DNA, 18 bp, Homo sapiens
tttataatgtagcagctc

SEQ ID NO: 5338999 - DNA, 13 bp, Homo sapiens
tttataatgtatt

SEQ ID NO: 5339000 - DNA, 21 bp, Homo sapiens
tttataatgtatttgaaaatt

SEQ ID NO: 5339001 - DNA, 19 bp, Homo sapiens
tttataatgtggatttcct

SEQ ID NO: 5339002 - DNA, 15 bp, Homo sapiens
tttataattaaagaa

SEQ ID NO: 5339003 - DNA, 18 bp, Homo sapiens
tttataattaaagaaaat

SEQ ID NO: 5339004 - DNA, 21 bp, Homo sapiens
tttataattaaagaaaattgc

SEQ ID NO: 5339005 - DNA, 23 bp, Homo sapiens
tttataattaaagaaaattgcca

SEQ ID NO: 5339006 - DNA, 19 bp, Homo sapiens
tttataattcagtatgttt

SEQ ID NO: 5339007 - DNA, 14 bp, Homo sapiens
tttataattggctt

SEQ ID NO: 5339008 - DNA, 22 bp, Homo sapiens
tttataattggtgctatttgaa

SEQ ID NO: 5339009 - DNA, 18 bp, Homo sapiens
tttataatttaaatgata

SEQ ID NO: 5339010 - DNA, 21 bp, Homo sapiens
tttataatttaataaaaagga

SEQ ID NO: 5339011 - DNA, 18 bp, Homo sapiens
tttataattttaagattc

SEQ ID NO: 5339012 - DNA, 12 bp, Homo sapiens
tttatacaaaga

SEQ ID NO: 5339013 - DNA, 16 bp, Homo sapiens
tttatacaaagaaact

SEQ ID NO: 5339014 - DNA, 13 bp, Homo sapiens
tttatacaaatta

SEQ ID NO: 5339015 - DNA, 16 bp, Homo sapiens
tttatacaacagtgct

SEQ ID NO: 5339016 - DNA, 18 bp, Homo sapiens
tttatacaacagtgctaa

SEQ ID NO: 5339017 - DNA, 12 bp, Homo sapiens
tttatacaattg

SEQ ID NO: 5339018 - DNA, 19 bp, Homo sapiens
tttatacaccaattgattt

SEQ ID NO: 5339019 - DNA, 12 bp, Homo sapiens
tttatacactgt

SEQ ID NO: 5339020 - DNA, 14 bp, Homo sapiens
tttatacagctgta

SEQ ID NO: 5339021 - DNA, 18 bp, Homo sapiens
tttatacagctgtattgt

SEQ ID NO: 5339022 - DNA, 22 bp, Homo sapiens
tttatacagctgtattgtctga

SEQ ID NO: 5339023 - DNA, 15 bp, Homo sapiens
tttatacaggggaat

SEQ ID NO: 5339024 - DNA, 19 bp, Homo sapiens
tttatacagtgtacatgta

SEQ ID NO: 5339025 - DNA, 21 bp, Homo sapiens
tttatacatacagagattgta

SEQ ID NO: 5339026 - DNA, 20 bp, Homo sapiens
tttatacatagtcacaaaaa

SEQ ID NO: 5339027 - DNA, 22 bp, Homo sapiens
tttatacatagtcacaaaaatg

SEQ ID NO: 5339028 - DNA, 13 bp, Homo sapiens
tttatacatatca

SEQ ID NO: 5339029 - DNA, 18 bp, Homo sapiens
tttatacatatcagaaaa

SEQ ID NO: 5339030 - DNA, 17 bp, Homo sapiens
tttatacattagtaaat

SEQ ID NO: 5339031 - DNA, 14 bp, Homo sapiens
tttataccagctta

SEQ ID NO: 5339032 - DNA, 18 bp, Homo sapiens
tttatacccccaggaaac

SEQ ID NO: 5339033 - DNA, 22 bp, Homo sapiens
tttatacctcaattttcactgt

SEQ ID NO: 5339034 - DNA, 16 bp, Homo sapiens
tttatacctgtttaaa

SEQ ID NO: 5339035 - DNA, 15 bp, Homo sapiens
tttatacgtgtagct

SEQ ID NO: 5339036 - DNA, 20 bp, Homo sapiens
tttatactatattaactttt

SEQ ID NO: 5339037 - DNA, 21 bp, Homo sapiens
tttatactctagaacatgcac

SEQ ID NO: 5339038 - DNA, 23 bp, Homo sapiens
tttatactctagaacatgcacat

SEQ ID NO: 5339039 - DNA, 14 bp, Homo sapiens
tttatactctcttc

SEQ ID NO: 5339040 - DNA, 16 bp, Homo sapiens
tttatactgagctttt

SEQ ID NO: 5339041 - DNA, 17 bp, Homo sapiens
tttatactggcatgcta

SEQ ID NO: 5339042 - DNA, 12 bp, Homo sapiens
tttatactgtat

SEQ ID NO: 5339043 - DNA, 15 bp, Homo sapiens
tttatactgtgaagt

SEQ ID NO: 5339044 - DNA, 21 bp, Homo sapiens
tttatactgtgaagttacatg

SEQ ID NO: 5339045 - DNA, 14 bp, Homo sapiens
tttatacttaaaaa

SEQ ID NO: 5339046 - DNA, 14 bp, Homo sapiens
tttatacttaaaca

SEQ ID NO: 5339047 - DNA, 15 bp, Homo sapiens
tttatacttcaaatg

SEQ ID NO: 5339048 - DNA, 22 bp, Homo sapiens
tttatacttgagaccaactttt

SEQ ID NO: 5339049 - DNA, 15 bp, Homo sapiens
tttatactttattga

SEQ ID NO: 5339050 - DNA, 17 bp, Homo sapiens
tttatactttattgaaa

SEQ ID NO: 5339051 - DNA, 16 bp, Homo sapiens
tttatagaacagttga

SEQ ID NO: 5339052 - DNA, 14 bp, Homo sapiens
tttatagaagaaat

SEQ ID NO: 5339053 - DNA, 18 bp, Homo sapiens
tttatagaaggaatttgt

SEQ ID NO: 5339054 - DNA, 21 bp, Homo sapiens
tttatagaataatgtgggaag

SEQ ID NO: 5339055 - DNA, 18 bp, Homo sapiens
tttatagacattatgtga

SEQ ID NO: 5339056 - DNA, 13 bp, Homo sapiens
tttatagagataa

SEQ ID NO: 5339057 - DNA, 20 bp, Homo sapiens
tttatagagttcatagaaat

SEQ ID NO: 5339058 - DNA, 12 bp, Homo sapiens
tttatagatcat

SEQ ID NO: 5339059 - DNA, 15 bp, Homo sapiens
tttatagatcatttc

SEQ ID NO: 5339060 - DNA, 21 bp, Homo sapiens
tttatagcaagatattgatca

SEQ ID NO: 5339061 - DNA, 23 bp, Homo sapiens
tttatagcaagatattgatcaaa

SEQ ID NO: 5339062 - DNA, 12 bp, Homo sapiens
tttatagcttcc

SEQ ID NO: 5339063 - DNA, 19 bp, Homo sapiens
tttatagcttccagattac

SEQ ID NO: 5339064 - DNA, 22 bp, Homo sapiens
tttataggaaaaaaactgggat

SEQ ID NO: 5339065 - DNA, 21 bp, Homo sapiens
tttataggactgttctttgct

SEQ ID NO: 5339066 - DNA, 16 bp, Homo sapiens
tttataggataactga

SEQ ID NO: 5339067 - DNA, 21 bp, Homo sapiens
tttataggcagatctttaaat

SEQ ID NO: 5339068 - DNA, 19 bp, Homo sapiens
tttataggggatacttgaa

SEQ ID NO: 5339069 - DNA, 16 bp, Homo sapiens
tttataggtgagaaaa

SEQ ID NO: 5339070 - DNA, 17 bp, Homo sapiens
tttatagtgtgttgtgc

SEQ ID NO: 5339071 - DNA, 16 bp, Homo sapiens
tttatagttaatctat

SEQ ID NO: 5339072 - DNA, 17 bp, Homo sapiens
tttatagttattaaatg

SEQ ID NO: 5339073 - DNA, 18 bp, Homo sapiens
tttatagtttatacagtt

SEQ ID NO: 5339074 - DNA, 12 bp, Homo sapiens
tttatataaaaa

SEQ ID NO: 5339075 - DNA, 15 bp, Homo sapiens
tttatataaagaaaa

SEQ ID NO: 5339076 - DNA, 16 bp, Homo sapiens
tttatataaataaatg

SEQ ID NO: 5339077 - DNA, 14 bp, Homo sapiens
tttatataaatgta

SEQ ID NO: 5339078 - DNA, 15 bp, Homo sapiens
tttatataactacat

SEQ ID NO: 5339079 - DNA, 16 bp, Homo sapiens
tttatatactgctatt

SEQ ID NO: 5339080 - DNA, 14 bp, Homo sapiens
tttatatacttttt

SEQ ID NO: 5339081 - DNA, 20 bp, Homo sapiens
tttatatactttttcatgaa

SEQ ID NO: 5339082 - DNA, 22 bp, Homo sapiens
tttatatagcaagacattatat

SEQ ID NO: 5339083 - DNA, 19 bp, Homo sapiens
tttatatagcttgaaacat

SEQ ID NO: 5339084 - DNA, 19 bp, Homo sapiens
tttatatagtctacagttg

SEQ ID NO: 5339085 - DNA, 14 bp, Homo sapiens
tttatatataaaat

SEQ ID NO: 5339086 - DNA, 17 bp, Homo sapiens
tttatatataaaataaa

SEQ ID NO: 5339087 - DNA, 13 bp, Homo sapiens
tttatatatatat

SEQ ID NO: 5339088 - DNA, 20 bp, Homo sapiens
tttatatatatatataaaga

SEQ ID NO: 5339089 - DNA, 15 bp, Homo sapiens
tttatatatatatgt

SEQ ID NO: 5339090 - DNA, 14 bp, Homo sapiens
tttatatatgaaaa

SEQ ID NO: 5339091 - DNA, 16 bp, Homo sapiens
tttatatatgaaaact

SEQ ID NO: 5339092 - DNA, 19 bp, Homo sapiens
tttatatatgaagtaagtt

SEQ ID NO: 5339093 - DNA, 15 bp, Homo sapiens
tttatatatgaatat

SEQ ID NO: 5339094 - DNA, 15 bp, Homo sapiens
tttatatatggcata

SEQ ID NO: 5339095 - DNA, 17 bp, Homo sapiens
tttatatattatatgga

SEQ ID NO: 5339096 - DNA, 16 bp, Homo sapiens
tttatatattatgtct

SEQ ID NO: 5339097 - DNA, 16 bp, Homo sapiens
tttatatattatgtga

SEQ ID NO: 5339098 - DNA, 21 bp, Homo sapiens
tttatatatttaaaagtgtca

SEQ ID NO: 5339099 - DNA, 13 bp, Homo sapiens
tttatatatttat

SEQ ID NO: 5339100 - DNA, 15 bp, Homo sapiens
tttatatatttataa

SEQ ID NO: 5339101 - DNA, 12 bp, Homo sapiens
tttatatcaaat

SEQ ID NO: 5339102 - DNA, 13 bp, Homo sapiens
tttatatcaaatg

SEQ ID NO: 5339103 - DNA, 18 bp, Homo sapiens
tttatatcacacaatata

SEQ ID NO: 5339104 - DNA, 17 bp, Homo sapiens
tttatatcatgcaaaat

SEQ ID NO: 5339105 - DNA, 19 bp, Homo sapiens
tttatatcattttaaaatg

SEQ ID NO: 5339106 - DNA, 23 bp, Homo sapiens
tttatatccacctacctattcat

SEQ ID NO: 5339107 - DNA, 14 bp, Homo sapiens
tttatatctatagt

SEQ ID NO: 5339108 - DNA, 16 bp, Homo sapiens
tttatatctggaatga

SEQ ID NO: 5339109 - DNA, 16 bp, Homo sapiens
tttatatctgtaatga

SEQ ID NO: 5339110 - DNA, 13 bp, Homo sapiens
tttatatctgtct

SEQ ID NO: 5339111 - DNA, 14 bp, Homo sapiens
tttatatcttggca

SEQ ID NO: 5339112 - DNA, 16 bp, Homo sapiens
tttatatgaaatgttt

SEQ ID NO: 5339113 - DNA, 14 bp, Homo sapiens
tttatatgaacata

SEQ ID NO: 5339114 - DNA, 21 bp, Homo sapiens
tttatatgaagaaaatcactt

SEQ ID NO: 5339115 - DNA, 17 bp, Homo sapiens
tttatatgaagataagt

SEQ ID NO: 5339116 - DNA, 19 bp, Homo sapiens
tttatatgaagataagtgt

SEQ ID NO: 5339117 - DNA, 15 bp, Homo sapiens
tttatatgaagcaag

SEQ ID NO: 5339118 - DNA, 17 bp, Homo sapiens
tttatatgaagcaagct

SEQ ID NO: 5339119 - DNA, 19 bp, Homo sapiens
tttatatgaagcaagctgt

SEQ ID NO: 5339120 - DNA, 19 bp, Homo sapiens
tttatatgaagtattaaaa

SEQ ID NO: 5339121 - DNA, 14 bp, Homo sapiens
tttatatgccaccg

SEQ ID NO: 5339122 - DNA, 18 bp, Homo sapiens
tttatatgccctcaagta

SEQ ID NO: 5339123 - DNA, 21 bp, Homo sapiens
tttatatgcttctgttttata

SEQ ID NO: 5339124 - DNA, 12 bp, Homo sapiens
tttatatggcgt

SEQ ID NO: 5339125 - DNA, 18 bp, Homo sapiens
tttatatggggaatatat

SEQ ID NO: 5339126 - DNA, 19 bp, Homo sapiens
tttatatgtaaatgtgtta

SEQ ID NO: 5339127 - DNA, 21 bp, Homo sapiens
tttatatgtatggatctatat

SEQ ID NO: 5339128 - DNA, 21 bp, Homo sapiens
tttatatgtatgtgtttagaa

SEQ ID NO: 5339129 - DNA, 14 bp, Homo sapiens
tttatatgtcaaag

SEQ ID NO: 5339130 - DNA, 13 bp, Homo sapiens
tttatatgtcttg

SEQ ID NO: 5339131 - DNA, 12 bp, Homo sapiens
tttatatgttat

SEQ ID NO: 5339132 - DNA, 13 bp, Homo sapiens
tttatatgttatt

SEQ ID NO: 5339133 - DNA, 18 bp, Homo sapiens
tttatattaaataacatg

SEQ ID NO: 5339134 - DNA, 16 bp, Homo sapiens
tttatattacactaca

SEQ ID NO: 5339135 - DNA, 18 bp, Homo sapiens
tttatattactgacattt

SEQ ID NO: 5339136 - DNA, 20 bp, Homo sapiens
tttatattacttttgtaaat

SEQ ID NO: 5339137 - DNA, 16 bp, Homo sapiens
tttatattagaagtgt

SEQ ID NO: 5339138 - DNA, 19 bp, Homo sapiens
tttatattagttgctttgt

SEQ ID NO: 5339139 - DNA, 12 bp, Homo sapiens
tttatattattg

SEQ ID NO: 5339140 - DNA, 18 bp, Homo sapiens
tttatattcagtgaaaag

SEQ ID NO: 5339141 - DNA, 23 bp, Homo sapiens
tttatattcatcaaataaacctt

SEQ ID NO: 5339142 - DNA, 20 bp, Homo sapiens
tttatattccatttacataa

SEQ ID NO: 5339143 - DNA, 12 bp, Homo sapiens
tttatattctaa

SEQ ID NO: 5339144 - DNA, 20 bp, Homo sapiens
tttatattctgaaaggaaat

SEQ ID NO: 5339145 - DNA, 12 bp, Homo sapiens
tttatattgaaa

SEQ ID NO: 5339146 - DNA, 14 bp, Homo sapiens
tttatattgaaaaa

SEQ ID NO: 5339147 - DNA, 18 bp, Homo sapiens
tttatattgggaagctgt

SEQ ID NO: 5339148 - DNA, 16 bp, Homo sapiens
tttatattgtaaatat

SEQ ID NO: 5339149 - DNA, 19 bp, Homo sapiens
tttatattgtaaatattgt

SEQ ID NO: 5339150 - DNA, 14 bp, Homo sapiens
tttatattgtagca

SEQ ID NO: 5339151 - DNA, 16 bp, Homo sapiens
tttatattgttttgtc

SEQ ID NO: 5339152 - DNA, 20 bp, Homo sapiens
tttatattgtttttatatat

SEQ ID NO: 5339153 - DNA, 21 bp, Homo sapiens
tttatatttaaaaaattaaaa

SEQ ID NO: 5339154 - DNA, 19 bp, Homo sapiens
tttatatttaaaaattgtt

SEQ ID NO: 5339155 - DNA, 20 bp, Homo sapiens
tttatatttaaaaattgttt

SEQ ID NO: 5339156 - DNA, 15 bp, Homo sapiens
tttatatttaaatta

SEQ ID NO: 5339157 - DNA, 13 bp, Homo sapiens
tttatatttaatt

SEQ ID NO: 5339158 - DNA, 18 bp, Homo sapiens
tttatatttaattattaa

SEQ ID NO: 5339159 - DNA, 21 bp, Homo sapiens
tttatatttaatttttacatg

SEQ ID NO: 5339160 - DNA, 13 bp, Homo sapiens
tttatatttacta

SEQ ID NO: 5339161 - DNA, 16 bp, Homo sapiens
tttatatttagtaact

SEQ ID NO: 5339162 - DNA, 13 bp, Homo sapiens
tttatatttcaag

SEQ ID NO: 5339163 - DNA, 16 bp, Homo sapiens
tttatatttcaataaa

SEQ ID NO: 5339164 - DNA, 18 bp, Homo sapiens
tttatatttcaataaatg

SEQ ID NO: 5339165 - DNA, 12 bp, Homo sapiens
tttattgcatat

SEQ ID NO: 5339166 - DNA, 20 bp, Homo sapiens
tttattgcatggtgtgaact

SEQ ID NO: 5339167 - DNA, 23 bp, Homo sapiens
tttattgccatattaaaatctga

SEQ ID NO: 5339168 - DNA, 12 bp, Homo sapiens
tttattgccatt

SEQ ID NO: 5339169 - DNA, 12 bp, Homo sapiens
tttattgccttc

SEQ ID NO: 5339170 - DNA, 13 bp, Homo sapiens
tttattgccttct

SEQ ID NO: 5339171 - DNA, 23 bp, Homo sapiens
tttattgccttttaatttttaat

SEQ ID NO: 5339172 - DNA, 17 bp, Homo sapiens
tttattgctagtatttg

SEQ ID NO: 5339173 - DNA, 23 bp, Homo sapiens
tttattgctgcattttaagcata

SEQ ID NO: 5339174 - DNA, 16 bp, Homo sapiens
tttattggctgagata

SEQ ID NO: 5339175 - DNA, 21 bp, Homo sapiens
tttattggcttttctgatcca

SEQ ID NO: 5339176 - DNA, 17 bp, Homo sapiens
tttattggggtgacctt

SEQ ID NO: 5339177 - DNA, 20 bp, Homo sapiens
tttattggtaaattctggta

SEQ ID NO: 5339178 - DNA, 17 bp, Homo sapiens
tttattggttttgcaga

SEQ ID NO: 5339179 - DNA, 22 bp, Homo sapiens
tttattgtaacagacattgttt

SEQ ID NO: 5339180 - DNA, 13 bp, Homo sapiens
tttattgtacaga

SEQ ID NO: 5339181 - DNA, 21 bp, Homo sapiens
tttattgtacagactgtttta

SEQ ID NO: 5339182 - DNA, 19 bp, Homo sapiens
tttattgtaccaaagctgt

SEQ ID NO: 5339183 - DNA, 14 bp, Homo sapiens
tttattgtattctg

SEQ ID NO: 5339184 - DNA, 16 bp, Homo sapiens
tttattgtcaaagtgg

SEQ ID NO: 5339185 - DNA, 14 bp, Homo sapiens
tttattgtgctggg

SEQ ID NO: 5339186 - DNA, 22 bp, Homo sapiens
tttattgtgtttgtcattagcc

SEQ ID NO: 5339187 - DNA, 17 bp, Homo sapiens
tttattgtgtttttaat

SEQ ID NO: 5339188 - DNA, 17 bp, Homo sapiens
tttattgttaatacaag

SEQ ID NO: 5339189 - DNA, 15 bp, Homo sapiens
tttatttaaaactct

SEQ ID NO: 5339190 - DNA, 14 bp, Homo sapiens
tttatttaaaagat

SEQ ID NO: 5339191 - DNA, 22 bp, Homo sapiens
tttatttaaactgttctgtgtg

SEQ ID NO: 5339192 - DNA, 14 bp, Homo sapiens
tttatttaaagcat

SEQ ID NO: 5339193 - DNA, 15 bp, Homo sapiens
tttatttaaatgtct

SEQ ID NO: 5339194 - DNA, 12 bp, Homo sapiens
tttatttaagga

SEQ ID NO: 5339195 - DNA, 19 bp, Homo sapiens
tttatttaatttcataaat

SEQ ID NO: 5339196 - DNA, 21 bp, Homo sapiens
tttatttaatttcataaattg

SEQ ID NO: 5339197 - DNA, 16 bp, Homo sapiens
tttatttacagctgtg

SEQ ID NO: 5339198 - DNA, 11 bp, Homo sapiens
tttatttacta

SEQ ID NO: 5339199 - DNA, 15 bp, Homo sapiens
tttatttagaaactg

SEQ ID NO: 5339200 - DNA, 17 bp, Homo sapiens
tttatttagaaactggt

SEQ ID NO: 5339201 - DNA, 14 bp, Homo sapiens
tttatttagcttta

SEQ ID NO: 5339202 - DNA, 15 bp, Homo sapiens
tttatttagttttta

SEQ ID NO: 5339203 - DNA, 19 bp, Homo sapiens
tttatttagtttttaacaa

SEQ ID NO: 5339204 - DNA, 15 bp, Homo sapiens
tttatttataaacta

SEQ ID NO: 5339205 - DNA, 15 bp, Homo sapiens
tttatttatatttat

SEQ ID NO: 5339206 - DNA, 15 bp, Homo sapiens
tttatttatcaaaat

SEQ ID NO: 5339207 - DNA, 14 bp, Homo sapiens
tttatttatggctt

SEQ ID NO: 5339208 - DNA, 14 bp, Homo sapiens
tttatttatgttct

SEQ ID NO: 5339209 - DNA, 22 bp, Homo sapiens
tttatttattaaacttcagcaa

SEQ ID NO: 5339210 - DNA, 14 bp, Homo sapiens
tttatttattaaga

SEQ ID NO: 5339211 - DNA, 16 bp, Homo sapiens
tttatttattgtgtgt

SEQ ID NO: 5339212 - DNA, 14 bp, Homo sapiens
tttatttatttaca

SEQ ID NO: 5339213 - DNA, 15 bp, Homo sapiens
tttatttcaatgtaa

SEQ ID NO: 5339214 - DNA, 16 bp, Homo sapiens
tttatttcagcaaact

SEQ ID NO: 5339215 - DNA, 13 bp, Homo sapiens
tttatttcattca

SEQ ID NO: 5339216 - DNA, 18 bp, Homo sapiens
tttatttccacataaagg

SEQ ID NO: 5339217 - DNA, 13 bp, Homo sapiens
tttatttccagtg

SEQ ID NO: 5339218 - DNA, 13 bp, Homo sapiens
tttatttcctccc

SEQ ID NO: 5339219 - DNA, 11 bp, Homo sapiens
tttatttcctg

SEQ ID NO: 5339220 - DNA, 12 bp, Homo sapiens
tttatttcctgc

SEQ ID NO: 5339221 - DNA, 20 bp, Homo sapiens
tttatttcctgtatgttgta

SEQ ID NO: 5339222 - DNA, 16 bp, Homo sapiens
tttatttctactgtca

SEQ ID NO: 5339223 - DNA, 12 bp, Homo sapiens
tttatttctatc

SEQ ID NO: 5339224 - DNA, 13 bp, Homo sapiens
tttatttctcctt

SEQ ID NO: 5339225 - DNA, 16 bp, Homo sapiens
tttatttctccttttg

SEQ ID NO: 5339226 - DNA, 21 bp, Homo sapiens
tttatttctctggcaaacttt

SEQ ID NO: 5339227 - DNA, 13 bp, Homo sapiens
tttatttctgaag

SEQ ID NO: 5339228 - DNA, 11 bp, Homo sapiens
tttatttctgt

SEQ ID NO: 5339229 - DNA, 12 bp, Homo sapiens
tttatttctgtc

SEQ ID NO: 5339230 - DNA, 13 bp, Homo sapiens
tttatttcttaaa

SEQ ID NO: 5339231 - DNA, 15 bp, Homo sapiens
tttatttctttgtga

SEQ ID NO: 5339232 - DNA, 23 bp, Homo sapiens
tttatttgaacaatgaagttgaa

SEQ ID NO: 5339233 - DNA, 12 bp, Homo sapiens
tttatttgcaaa

SEQ ID NO: 5339234 - DNA, 23 bp, Homo sapiens
tttatttgcaaatatactttact

SEQ ID NO: 5339235 - DNA, 16 bp, Homo sapiens
tttatttgcaacattt

SEQ ID NO: 5339236 - DNA, 21 bp, Homo sapiens
tttatttgcaatttgagccat

SEQ ID NO: 5339237 - DNA, 14 bp, Homo sapiens
tttatttggcataa

SEQ ID NO: 5339238 - DNA, 14 bp, Homo sapiens
tttatttgtaaagt

SEQ ID NO: 5339239 - DNA, 15 bp, Homo sapiens
tttatttgtaatttt

SEQ ID NO: 5339240 - DNA, 23 bp, Homo sapiens
tttatttgtaattttaaaagtct

SEQ ID NO: 5339241 - DNA, 15 bp, Homo sapiens
tttatttgtgaaact

SEQ ID NO: 5339242 - DNA, 13 bp, Homo sapiens
tttatttgttgag

SEQ ID NO: 5339243 - DNA, 18 bp, Homo sapiens
tttatttgttgagagtgt

SEQ ID NO: 5339244 - DNA, 16 bp, Homo sapiens
tttattttaaacattt

SEQ ID NO: 5339245 - DNA, 16 bp, Homo sapiens
tttattttaaccagtt

SEQ ID NO: 5339246 - DNA, 13 bp, Homo sapiens
tttattttaatac

SEQ ID NO: 5339247 - DNA, 15 bp, Homo sapiens
tttattttaatgtat

SEQ ID NO: 5339248 - DNA, 19 bp, Homo sapiens
tttattttacagctcatta

SEQ ID NO: 5339249 - DNA, 13 bp, Homo sapiens
tttattttacatt

SEQ ID NO: 5339250 - DNA, 14 bp, Homo sapiens
tttattttactatt

SEQ ID NO: 5339251 - DNA, 17 bp, Homo sapiens
tttattttactattgga

SEQ ID NO: 5339252 - DNA, 12 bp, Homo sapiens
tttattttatga

SEQ ID NO: 5339253 - DNA, 15 bp, Homo sapiens
tttattttatgagaa

SEQ ID NO: 5339254 - DNA, 16 bp, Homo sapiens
tttattttcaaatctg

SEQ ID NO: 5339255 - DNA, 11 bp, Homo sapiens
tttattttcat

SEQ ID NO: 5339256 - DNA, 19 bp, Homo sapiens
tttattttcattctgccaa

SEQ ID NO: 5339257 - DNA, 19 bp, Homo sapiens
tttattttcccttcatgtt

SEQ ID NO: 5339258 - DNA, 16 bp, Homo sapiens
tttattttcctcccca

SEQ ID NO: 5339259 - DNA, 10 bp, Homo sapiens
tttattttct

SEQ ID NO: 5339260 - DNA, 11 bp, Homo sapiens
tttattttctt

SEQ ID NO: 5339261 - DNA, 16 bp, Homo sapiens
tttattttcttttgaa

SEQ ID NO: 5339262 - DNA, 21 bp, Homo sapiens
tttattttcttttgtaaatgt

SEQ ID NO: 5339263 - DNA, 15 bp, Homo sapiens
tttattttgaatgta

SEQ ID NO: 5339264 - DNA, 14 bp, Homo sapiens
tttattttgacata

SEQ ID NO: 5339265 - DNA, 14 bp, Homo sapiens
tttattttgctccc

SEQ ID NO: 5339266 - DNA, 18 bp, Homo sapiens
tttattttggaactatga

SEQ ID NO: 5339267 - DNA, 21 bp, Homo sapiens
tttattttggcttcatttcaa

SEQ ID NO: 5339268 - DNA, 14 bp, Homo sapiens
tttattttgtaata

SEQ ID NO: 5339269 - DNA, 15 bp, Homo sapiens
tttattttgtatgaa

SEQ ID NO: 5339270 - DNA, 18 bp, Homo sapiens
tttattttgtatttttga

SEQ ID NO: 5339271 - DNA, 14 bp, Homo sapiens
tttattttgtggga

SEQ ID NO: 5339272 - DNA, 20 bp, Homo sapiens
tttattttgtgtttaggaac

SEQ ID NO: 5339273 - DNA, 19 bp, Homo sapiens
tttatttttagaattttgt

SEQ ID NO: 5339274 - DNA, 17 bp, Homo sapiens
tttatttttcatattgt

SEQ ID NO: 5339275 - DNA, 18 bp, Homo sapiens
tttatttttctctttctc

SEQ ID NO: 5339276 - DNA, 15 bp, Homo sapiens
tttatttttctgtta

SEQ ID NO: 5339277 - DNA, 17 bp, Homo sapiens
tttatttttcttgtctt

SEQ ID NO: 5339278 - DNA, 13 bp, Homo sapiens
tttatttttgaac

SEQ ID NO: 5339279 - DNA, 13 bp, Homo sapiens
tttatttttgcaa

SEQ ID NO: 5339280 - DNA, 14 bp, Homo sapiens
tttatttttgcaaa

SEQ ID NO: 5339281 - DNA, 17 bp, Homo sapiens
tttatttttgcacaact

SEQ ID NO: 5339282 - DNA, 16 bp, Homo sapiens
tttatttttggcaaag

SEQ ID NO: 5339283 - DNA, 20 bp, Homo sapiens
tttatttttgtatattgtat

SEQ ID NO: 5339284 - DNA, 17 bp, Homo sapiens
tttattttttaaatgta

SEQ ID NO: 5339285 - DNA, 21 bp, Homo sapiens
tttattttttaacatgaaagc

SEQ ID NO: 5339286 - DNA, 14 bp, Homo sapiens
tttattttttaagt

SEQ ID NO: 5339287 - DNA, 16 bp, Homo sapiens
tttattttttagtgca

SEQ ID NO: 5339288 - DNA, 13 bp, Homo sapiens
tttattttttggg

SEQ ID NO: 5339289 - DNA, 17 bp, Homo sapiens
tttattttttgtaactc

SEQ ID NO: 5339290 - DNA, 17 bp, Homo sapiens
tttattttttgtgagtg

SEQ ID NO: 5339291 - DNA, 22 bp, Homo sapiens
tttatttttttgatggctaaga

SEQ ID NO: 5339292 - DNA, 15 bp, Homo sapiens
tttattttttttcaa

SEQ ID NO: 5339293 - DNA, 17 bp, Homo sapiens
tttattttttttcaaaa

SEQ ID NO: 5339294 - DNA, 17 bp, Homo sapiens
tttattttttttggcct

SEQ ID NO: 5339295 - DNA, 23 bp, Homo sapiens
tttcaaaaaaaaaaaaaaagact

SEQ ID NO: 5339296 - DNA, 19 bp, Homo sapiens
tttcaaaaaagtcaacaaa

SEQ ID NO: 5339297 - DNA, 13 bp, Homo sapiens
tttcaaaaacatt

SEQ ID NO: 5339298 - DNA, 21 bp, Homo sapiens
tttcaaaaatctgaagattgt

SEQ ID NO: 5339299 - DNA, 23 bp, Homo sapiens
tttcaaaaatctgaagattgttt

SEQ ID NO: 5339300 - DNA, 13 bp, Homo sapiens
tttcaaaagaaga

SEQ ID NO: 5339301 - DNA, 21 bp, Homo sapiens
tttcaaaagccttaccttgaa

SEQ ID NO: 5339302 - DNA, 20 bp, Homo sapiens
tttcaaaaggtattatacat

SEQ ID NO: 5339303 - DNA, 17 bp, Homo sapiens
tttcaaaagtgatctgt

SEQ ID NO: 5339304 - DNA, 17 bp, Homo sapiens
tttcaaaataaactggg

SEQ ID NO: 5339305 - DNA, 13 bp, Homo sapiens
tttcaaaatacat

SEQ ID NO: 5339306 - DNA, 11 bp, Homo sapiens
tttcaaaatag

SEQ ID NO: 5339307 - DNA, 20 bp, Homo sapiens
tttcaaaatagaaaagttat

SEQ ID NO: 5339308 - DNA, 21 bp, Homo sapiens
tttcaaaatatattttcagta

SEQ ID NO: 5339309 - DNA, 17 bp, Homo sapiens
tttcaaaatatgtgtat

SEQ ID NO: 5339310 - DNA, 13 bp, Homo sapiens
tttcaaaatcaaa

SEQ ID NO: 5339311 - DNA, 17 bp, Homo sapiens
tttcaaaatcaaagtta

SEQ ID NO: 5339312 - DNA, 19 bp, Homo sapiens
tttcaaaatccaaaaagaa

SEQ ID NO: 5339313 - DNA, 22 bp, Homo sapiens
tttcaaaatgaagatacacatt

SEQ ID NO: 5339314 - DNA, 15 bp, Homo sapiens
tttcaaaatgaattt

SEQ ID NO: 5339315 - DNA, 12 bp, Homo sapiens
tttcaaaatgca

SEQ ID NO: 5339316 - DNA, 15 bp, Homo sapiens
tttcaaaatgcatgt

SEQ ID NO: 5339317 - DNA, 12 bp, Homo sapiens
tttcaaaatgct

SEQ ID NO: 5339318 - DNA, 15 bp, Homo sapiens
tttcaaaattgttgc

SEQ ID NO: 5339319 - DNA, 16 bp, Homo sapiens
tttcaaacaagaaaca

SEQ ID NO: 5339320 - DNA, 23 bp, Homo sapiens
tttcaaacaagaaacatttcaga

SEQ ID NO: 5339321 - DNA, 17 bp, Homo sapiens
tttcaaacacaaatgca

SEQ ID NO: 5339322 - DNA, 18 bp, Homo sapiens
tttcaaacagcatcaaaa

SEQ ID NO: 5339323 - DNA, 20 bp, Homo sapiens
tttcaaacagcatcaaaata

SEQ ID NO: 5339324 - DNA, 21 bp, Homo sapiens
tttcaaacagcatcaaaatac

SEQ ID NO: 5339325 - DNA, 23 bp, Homo sapiens
tttcaaacagcatcaaaatacaa

SEQ ID NO: 5339326 - DNA, 16 bp, Homo sapiens
tttcaaacatatataa

SEQ ID NO: 5339327 - DNA, 17 bp, Homo sapiens
tttcaaacatatataac

SEQ ID NO: 5339328 - DNA, 20 bp, Homo sapiens
tttcaaacatcagctgaatt

SEQ ID NO: 5339329 - DNA, 22 bp, Homo sapiens
tttcaaacatcagctgaattca

SEQ ID NO: 5339330 - DNA, 21 bp, Homo sapiens
tttcaaacattgagactgcta

SEQ ID NO: 5339331 - DNA, 22 bp, Homo sapiens
tttcaaaccagtatacaagata

SEQ ID NO: 5339332 - DNA, 22 bp, Homo sapiens
tttcaaactccaaggttccctt

SEQ ID NO: 5339333 - DNA, 18 bp, Homo sapiens
tttcaaactgatacagat

SEQ ID NO: 5339334 - DNA, 13 bp, Homo sapiens
tttcaaacttaaa

SEQ ID NO: 5339335 - DNA, 15 bp, Homo sapiens
tttcaaactttacta

SEQ ID NO: 5339336 - DNA, 18 bp, Homo sapiens
tttcaaacttttgaaaga

SEQ ID NO: 5339337 - DNA, 22 bp, Homo sapiens
tttcaaacttttgaaagatgta

SEQ ID NO: 5339338 - DNA, 17 bp, Homo sapiens
tttcaaagaactcctga

SEQ ID NO: 5339339 - DNA, 23 bp, Homo sapiens
tttcaaagacaatcactgaaaca

SEQ ID NO: 5339340 - DNA, 19 bp, Homo sapiens
tttcaaagacttcatttaa

SEQ ID NO: 5339341 - DNA, 23 bp, Homo sapiens
tttcaaagacttcatttaacact

SEQ ID NO: 5339342 - DNA, 14 bp, Homo sapiens
tttcaaagatgctg

SEQ ID NO: 5339343 - DNA, 16 bp, Homo sapiens
tttcaaagattcaaaa

SEQ ID NO: 5339344 - DNA, 21 bp, Homo sapiens
tttcaaagcaattgaaatgca

SEQ ID NO: 5339345 - DNA, 19 bp, Homo sapiens
tttcaaagcacttaagtgt

SEQ ID NO: 5339346 - DNA, 20 bp, Homo sapiens
tttcatgaggggaaagggag

SEQ ID NO: 5339347 - DNA, 16 bp, Homo sapiens
tttcatgattagaaat

SEQ ID NO: 5339348 - DNA, 14 bp, Homo sapiens
tttcatgattagac

SEQ ID NO: 5339349 - DNA, 19 bp, Homo sapiens
tttcatgatttgcaacttt

SEQ ID NO: 5339350 - DNA, 13 bp, Homo sapiens
tttcatgcacact

SEQ ID NO: 5339351 - DNA, 20 bp, Homo sapiens
tttcatgccattttatttct

SEQ ID NO: 5339352 - DNA, 23 bp, Homo sapiens
tttcatgcgatgacacttgtaca

SEQ ID NO: 5339353 - DNA, 19 bp, Homo sapiens
tttcatgctatcagaaaca

SEQ ID NO: 5339354 - DNA, 17 bp, Homo sapiens
tttcatgctctgcaaaa

SEQ ID NO: 5339355 - DNA, 19 bp, Homo sapiens
tttcatgctctgcaaaagg

SEQ ID NO: 5339356 - DNA, 13 bp, Homo sapiens
tttcatgcttcca

SEQ ID NO: 5339357 - DNA, 13 bp, Homo sapiens
tttcatgctttat

SEQ ID NO: 5339358 - DNA, 18 bp, Homo sapiens
tttcatggagtagagtca

SEQ ID NO: 5339359 - DNA, 19 bp, Homo sapiens
tttcatggcaatgaaaatt

SEQ ID NO: 5339360 - DNA, 18 bp, Homo sapiens
tttcatggcccttcaaat

SEQ ID NO: 5339361 - DNA, 20 bp, Homo sapiens
tttcatggctgctgttgctt

SEQ ID NO: 5339362 - DNA, 20 bp, Homo sapiens
tttcatggtgaaaatgtact

SEQ ID NO: 5339363 - DNA, 14 bp, Homo sapiens
tttcatggtttata

SEQ ID NO: 5339364 - DNA, 15 bp, Homo sapiens
tttcatgtaaaaagt

SEQ ID NO: 5339365 - DNA, 11 bp, Homo sapiens
tttcatgtaac

SEQ ID NO: 5339366 - DNA, 15 bp, Homo sapiens
tttcatgtaagttta

SEQ ID NO: 5339367 - DNA, 20 bp, Homo sapiens
tttcatgtactgcattattt

SEQ ID NO: 5339368 - DNA, 13 bp, Homo sapiens
tttcatgtagaac

SEQ ID NO: 5339369 - DNA, 20 bp, Homo sapiens
tttcatgtagattttagttc

SEQ ID NO: 5339370 - DNA, 22 bp, Homo sapiens
tttcatgtagccagcagaactg

SEQ ID NO: 5339371 - DNA, 15 bp, Homo sapiens
tttcatgtatttctt

SEQ ID NO: 5339372 - DNA, 15 bp, Homo sapiens
tttcatgtccataaa

SEQ ID NO: 5339373 - DNA, 13 bp, Homo sapiens
tttcatgtcttgt

SEQ ID NO: 5339374 - DNA, 17 bp, Homo sapiens
tttcatgtctttccact

SEQ ID NO: 5339375 - DNA, 20 bp, Homo sapiens
tttcatgtgatctattactc

SEQ ID NO: 5339376 - DNA, 23 bp, Homo sapiens
tttcatgtgatctattactctga

SEQ ID NO: 5339377 - DNA, 19 bp, Homo sapiens
tttcatgtgtgtgagtttg

SEQ ID NO: 5339378 - DNA, 20 bp, Homo sapiens
tttcatgtgttgcaaattat

SEQ ID NO: 5339379 - DNA, 12 bp, Homo sapiens
tttcatgttaat

SEQ ID NO: 5339380 - DNA, 17 bp, Homo sapiens
tttcatgttcactgtga

SEQ ID NO: 5339381 - DNA, 14 bp, Homo sapiens
tttcatgttctgtg

SEQ ID NO: 5339382 - DNA, 23 bp, Homo sapiens
tttcatgttgcacacccactcag

SEQ ID NO: 5339383 - DNA, 16 bp, Homo sapiens
tttcatgttttaacaa

SEQ ID NO: 5339384 - DNA, 19 bp, Homo sapiens
tttcatgttttaacaaaaa

SEQ ID NO: 5339385 - DNA, 16 bp, Homo sapiens
tttcatgttttagcat

SEQ ID NO: 5339386 - DNA, 22 bp, Homo sapiens
tttcatgttttagcatttgtat

SEQ ID NO: 5339387 - DNA, 16 bp, Homo sapiens
tttcatgttttgtgac

SEQ ID NO: 5339388 - DNA, 17 bp, Homo sapiens
tttcatgttttgtgact

SEQ ID NO: 5339389 - DNA, 13 bp, Homo sapiens
tttcattaaagca

SEQ ID NO: 5339390 - DNA, 14 bp, Homo sapiens
tttcattaaagcat

SEQ ID NO: 5339391 - DNA, 16 bp, Homo sapiens
tttcattaaagcattt

SEQ ID NO: 5339392 - DNA, 14 bp, Homo sapiens
tttcattaaaggct

SEQ ID NO: 5339393 - DNA, 16 bp, Homo sapiens
tttcattaaaggcttc

SEQ ID NO: 5339394 - DNA, 17 bp, Homo sapiens
tttcattaaataaattt

SEQ ID NO: 5339395 - DNA, 13 bp, Homo sapiens
tttcattaaatgg

SEQ ID NO: 5339396 - DNA, 16 bp, Homo sapiens
tttcattaagttgtaa

SEQ ID NO: 5339397 - DNA, 21 bp, Homo sapiens
tttcattaatacagggcattt

SEQ ID NO: 5339398 - DNA, 16 bp, Homo sapiens
tttcattacatttctg

SEQ ID NO: 5339399 - DNA, 18 bp, Homo sapiens
tttcattacctgtagctt

SEQ ID NO: 5339400 - DNA, 21 bp, Homo sapiens
tttcattactgcccagatgtt

SEQ ID NO: 5339401 - DNA, 23 bp, Homo sapiens
tttcattactgcccagatgtttt

SEQ ID NO: 5339402 - DNA, 15 bp, Homo sapiens
tttcattacttgaat

SEQ ID NO: 5339403 - DNA, 20 bp, Homo sapiens
tttcattacttttaaaaatg

SEQ ID NO: 5339404 - DNA, 14 bp, Homo sapiens
tttcattagataca

SEQ ID NO: 5339405 - DNA, 13 bp, Homo sapiens
tttcattagcaaa

SEQ ID NO: 5339406 - DNA, 22 bp, Homo sapiens
tttcattagcagttgctcacat

SEQ ID NO: 5339407 - DNA, 23 bp, Homo sapiens
tttcattatctgtactgaaagca

SEQ ID NO: 5339408 - DNA, 13 bp, Homo sapiens
tttcattattagt

SEQ ID NO: 5339409 - DNA, 21 bp, Homo sapiens
tttcattattagtactgctct

SEQ ID NO: 5339410 - DNA, 14 bp, Homo sapiens
tttcattattctca

SEQ ID NO: 5339411 - DNA, 16 bp, Homo sapiens
tttcattatttcaagg

SEQ ID NO: 5339412 - DNA, 19 bp, Homo sapiens
tttcattattttattatga

SEQ ID NO: 5339413 - DNA, 20 bp, Homo sapiens
tttcattcaacacattttta

SEQ ID NO: 5339414 - DNA, 15 bp, Homo sapiens
tttcattcattttaa

SEQ ID NO: 5339415 - DNA, 17 bp, Homo sapiens
tttcattccaaagggga

SEQ ID NO: 5339416 - DNA, 11 bp, Homo sapiens
tttcattccat

SEQ ID NO: 5339417 - DNA, 17 bp, Homo sapiens
tttcattccattgccta

SEQ ID NO: 5339418 - DNA, 19 bp, Homo sapiens
tttcattcccccttcctag

SEQ ID NO: 5339419 - DNA, 23 bp, Homo sapiens
tttcattcccccttcctagtgaa

SEQ ID NO: 5339420 - DNA, 13 bp, Homo sapiens
tttcattccctgc

SEQ ID NO: 5339421 - DNA, 13 bp, Homo sapiens
tttcattccctgt

SEQ ID NO: 5339422 - DNA, 22 bp, Homo sapiens
tttcattctcctcctcctccct

SEQ ID NO: 5339423 - DNA, 14 bp, Homo sapiens
tttcattctcttga

SEQ ID NO: 5339424 - DNA, 17 bp, Homo sapiens
tttcattctgaatctga

SEQ ID NO: 5339425 - DNA, 14 bp, Homo sapiens
tttcattctgccaa

SEQ ID NO: 5339426 - DNA, 16 bp, Homo sapiens
tttcattctggtcctt

SEQ ID NO: 5339427 - DNA, 13 bp, Homo sapiens
tttcattcttctc

SEQ ID NO: 5339428 - DNA, 14 bp, Homo sapiens
tttcattcttctca

SEQ ID NO: 5339429 - DNA, 21 bp, Homo sapiens
tttcattgatatgaaaaatat

SEQ ID NO: 5339430 - DNA, 15 bp, Homo sapiens
tttcattgcactttc

SEQ ID NO: 5339431 - DNA, 18 bp, Homo sapiens
tttcattgccagtgtctt

SEQ ID NO: 5339432 - DNA, 22 bp, Homo sapiens
tttcattgctgggcttgtctgt

SEQ ID NO: 5339433 - DNA, 23 bp, Homo sapiens
tttcattgctgtgtcacactctg

SEQ ID NO: 5339434 - DNA, 15 bp, Homo sapiens
tttcattggatgcag

SEQ ID NO: 5339435 - DNA, 22 bp, Homo sapiens
tttcattggtacacgtgtaaca

SEQ ID NO: 5339436 - DNA, 20 bp, Homo sapiens
tttcattgtatgatgtgttg

SEQ ID NO: 5339437 - DNA, 16 bp, Homo sapiens
tttcattgtctgtgaa

SEQ ID NO: 5339438 - DNA, 13 bp, Homo sapiens
tttcattgtgatt

SEQ ID NO: 5339439 - DNA, 17 bp, Homo sapiens
tttcattgtgtatcagt

SEQ ID NO: 5339440 - DNA, 12 bp, Homo sapiens
tttcattgtgtt

SEQ ID NO: 5339441 - DNA, 23 bp, Homo sapiens
tttcatttaagggaaagaaaatg

SEQ ID NO: 5339442 - DNA, 21 bp, Homo sapiens
tttcatttacaatttcaaaag

SEQ ID NO: 5339443 - DNA, 15 bp, Homo sapiens
tttcatttatactgt

SEQ ID NO: 5339444 - DNA, 20 bp, Homo sapiens
tttcatttatctataattta

SEQ ID NO: 5339445 - DNA, 16 bp, Homo sapiens
tttcatttcaaaatgc

SEQ ID NO: 5339446 - DNA, 12 bp, Homo sapiens
tttcatttcaca

SEQ ID NO: 5339447 - DNA, 11 bp, Homo sapiens
tttcatttctt

SEQ ID NO: 5339448 - DNA, 22 bp, Homo sapiens
tttcatttcttacgttctttca

SEQ ID NO: 5339449 - DNA, 12 bp, Homo sapiens
tttcatttgctg

SEQ ID NO: 5339450 - DNA, 20 bp, Homo sapiens
tttcatttggggcatttgta

SEQ ID NO: 5339451 - DNA, 22 bp, Homo sapiens
tttcatttggggcatttgtaaa

SEQ ID NO: 5339452 - DNA, 11 bp, Homo sapiens
tttcatttgta

SEQ ID NO: 5339453 - DNA, 15 bp, Homo sapiens
tttcatttgtaaaaa

SEQ ID NO: 5339454 - DNA, 14 bp, Homo sapiens
tttcatttgtacaa

SEQ ID NO: 5339455 - DNA, 19 bp, Homo sapiens
tttcatttgtacaaggtaa

SEQ ID NO: 5339456 - DNA, 18 bp, Homo sapiens
tttcattttaatatataa

SEQ ID NO: 5339457 - DNA, 17 bp, Homo sapiens
tttcattttattttaat

SEQ ID NO: 5339458 - DNA, 18 bp, Homo sapiens
tttcattttcatctcatt

SEQ ID NO: 5339459 - DNA, 14 bp, Homo sapiens
tttcattttccaat

SEQ ID NO: 5339460 - DNA, 15 bp, Homo sapiens
tttcattttctctcc

SEQ ID NO: 5339461 - DNA, 14 bp, Homo sapiens
tttcattttctgca

SEQ ID NO: 5339462 - DNA, 18 bp, Homo sapiens
tttcattttgaaaagtat

SEQ ID NO: 5339463 - DNA, 23 bp, Homo sapiens
tttcattttgcagaaggaaatga

SEQ ID NO: 5339464 - DNA, 23 bp, Homo sapiens
tttcattttgctttaattttagc

SEQ ID NO: 5339465 - DNA, 20 bp, Homo sapiens
tttcattttttgcatcagta

SEQ ID NO: 5339466 - DNA, 15 bp, Homo sapiens
tttcatttttttcca

SEQ ID NO: 5339467 - DNA, 22 bp, Homo sapiens
tttccaaaacaaaaagatgtct

SEQ ID NO: 5339468 - DNA, 20 bp, Homo sapiens
tttccaaaacaatttctttt

SEQ ID NO: 5339469 - DNA, 21 bp, Homo sapiens
tttccaaaacaatttcttttt

SEQ ID NO: 5339470 - DNA, 24 bp, Homo sapiens
tttccaaaagtggcctctttgtct

SEQ ID NO: 5339471 - DNA, 22 bp, Homo sapiens
tttccaaaataaaaaccttcca

SEQ ID NO: 5339472 - DNA, 19 bp, Homo sapiens
tttccaaaatctcccattt

SEQ ID NO: 5339473 - DNA, 16 bp, Homo sapiens
tttccaaaatttttca

SEQ ID NO: 5339474 - DNA, 16 bp, Homo sapiens
tttccaaacaacagaa

SEQ ID NO: 5339475 - DNA, 22 bp, Homo sapiens
tttccaaacaatttagccagaa

SEQ ID NO: 5339476 - DNA, 23 bp, Homo sapiens
tttccaaacaatttagccagaat

SEQ ID NO: 5339477 - DNA, 17 bp, Homo sapiens
tttccaaacatccaaaa

SEQ ID NO: 5339478 - DNA, 22 bp, Homo sapiens
tttccaaactgttgtctagtat

SEQ ID NO: 5339479 - DNA, 11 bp, Homo sapiens
tttccaaagag

SEQ ID NO: 5339480 - DNA, 15 bp, Homo sapiens
tttccaaagagccat

SEQ ID NO: 5339481 - DNA, 18 bp, Homo sapiens
tttccaaagataatgtta

SEQ ID NO: 5339482 - DNA, 13 bp, Homo sapiens
tttccaaaggcat

SEQ ID NO: 5339483 - DNA, 14 bp, Homo sapiens
tttccaaaggcatt

SEQ ID NO: 5339484 - DNA, 17 bp, Homo sapiens
tttccaaagtgcatgtc

SEQ ID NO: 5339485 - DNA, 21 bp, Homo sapiens
tttccaaagtgcatgtcacat

SEQ ID NO: 5339486 - DNA, 13 bp, Homo sapiens
tttccaaatacat

SEQ ID NO: 5339487 - DNA, 16 bp, Homo sapiens
tttccaaatgaaaaat

SEQ ID NO: 5339488 - DNA, 22 bp, Homo sapiens
tttccaaatgtggcctccatgt

SEQ ID NO: 5339489 - DNA, 17 bp, Homo sapiens
tttccaaattaaaacaa

SEQ ID NO: 5339490 - DNA, 17 bp, Homo sapiens
tttccaaattattaatt

SEQ ID NO: 5339491 - DNA, 15 bp, Homo sapiens
tttccaaattcacaa

SEQ ID NO: 5339492 - DNA, 17 bp, Homo sapiens
tttccaaattcctagaa

SEQ ID NO: 5339493 - DNA, 22 bp, Homo sapiens
tttccaacacacacaacgtaaa

SEQ ID NO: 5339494 - DNA, 20 bp, Homo sapiens
tttccaacaccacagacaca

SEQ ID NO: 5339495 - DNA, 11 bp, Homo sapiens
tttccaacagc

SEQ ID NO: 5339496 - DNA, 12 bp, Homo sapiens
tttccaacagca

SEQ ID NO: 5339497 - DNA, 18 bp, Homo sapiens
tttccaacatacaattta

SEQ ID NO: 5339498 - DNA, 18 bp, Homo sapiens
tttccaactactaataga

SEQ ID NO: 5339499 - DNA, 17 bp, Homo sapiens
tttccaagagaactaaa

SEQ ID NO: 5339500 - DNA, 16 bp, Homo sapiens
tttccaagagctgagg

SEQ ID NO: 5339501 - DNA, 16 bp, Homo sapiens
tttccaagcaaaatct

SEQ ID NO: 5339502 - DNA, 15 bp, Homo sapiens
tttccaagccctcag

SEQ ID NO: 5339503 - DNA, 22 bp, Homo sapiens
tttccaagcctgggccactggc

SEQ ID NO: 5339504 - DNA, 23 bp, Homo sapiens
tttccaagcctgggccactggca

SEQ ID NO: 5339505 - DNA, 14 bp, Homo sapiens
tttccaagctcctt

SEQ ID NO: 5339506 - DNA, 18 bp, Homo sapiens
tttccaaggagctgagaa

SEQ ID NO: 5339507 - DNA, 13 bp, Homo sapiens
tttccaagtgtat

SEQ ID NO: 5339508 - DNA, 16 bp, Homo sapiens
tttccaagtgtataat

SEQ ID NO: 5339509 - DNA, 19 bp, Homo sapiens
tttccaagtgtataatgtt

SEQ ID NO: 5339510 - DNA, 21 bp, Homo sapiens
tttccaagttcctgcactcca

SEQ ID NO: 5339511 - DNA, 20 bp, Homo sapiens
tttccaagtttattgccctc

SEQ ID NO: 5339512 - DNA, 17 bp, Homo sapiens
tttccaatatgtgattt

SEQ ID NO: 5339513 - DNA, 14 bp, Homo sapiens
tttccaatcaacag

SEQ ID NO: 5339514 - DNA, 16 bp, Homo sapiens
tttccaattatttgac

SEQ ID NO: 5339515 - DNA, 14 bp, Homo sapiens
tttccaattccact

SEQ ID NO: 5339516 - DNA, 19 bp, Homo sapiens
tttccacaaaatctgtcca

SEQ ID NO: 5339517 - DNA, 19 bp, Homo sapiens
tttccacaccatcaccctc

SEQ ID NO: 5339518 - DNA, 20 bp, Homo sapiens
tttccacagttgctgctcct

SEQ ID NO: 5339519 - DNA, 14 bp, Homo sapiens
tttccacataaagg

SEQ ID NO: 5339520 - DNA, 16 bp, Homo sapiens
tttccacataaatttt

SEQ ID NO: 5339521 - DNA, 23 bp, Homo sapiens
tttccacataaggaaactgggtt

SEQ ID NO: 5339522 - DNA, 19 bp, Homo sapiens
tttccacatccccaccctc

SEQ ID NO: 5339523 - DNA, 15 bp, Homo sapiens
tttccacatgctctg

SEQ ID NO: 5339524 - DNA, 22 bp, Homo sapiens
tttcctgctcctccagtacaat

SEQ ID NO: 5339525 - DNA, 13 bp, Homo sapiens
tttcctgctgtct

SEQ ID NO: 5339526 - DNA, 20 bp, Homo sapiens
tttcctggaattgccagctg

SEQ ID NO: 5339527 - DNA, 21 bp, Homo sapiens
tttcctggacatcctcttctg

SEQ ID NO: 5339528 - DNA, 16 bp, Homo sapiens
tttcctggagtgccct

SEQ ID NO: 5339529 - DNA, 18 bp, Homo sapiens
tttcctggagtgccctgc

SEQ ID NO: 5339530 - DNA, 21 bp, Homo sapiens
tttcctggataaaaaagaaaa

SEQ ID NO: 5339531 - DNA, 23 bp, Homo sapiens
tttcctggcactgcttccagtga

SEQ ID NO: 5339532 - DNA, 19 bp, Homo sapiens
tttcctggccctccactcc

SEQ ID NO: 5339533 - DNA, 16 bp, Homo sapiens
tttcctggcctcagag

SEQ ID NO: 5339534 - DNA, 18 bp, Homo sapiens
tttcctggcctcagagct

SEQ ID NO: 5339535 - DNA, 22 bp, Homo sapiens
tttcctgggaatggaataacta

SEQ ID NO: 5339536 - DNA, 23 bp, Homo sapiens
tttcctgggaatggaataactat

SEQ ID NO: 5339537 - DNA, 15 bp, Homo sapiens
tttcctgggccagaa

SEQ ID NO: 5339538 - DNA, 12 bp, Homo sapiens
tttcctgggcct

SEQ ID NO: 5339539 - DNA, 22 bp, Homo sapiens
tttcctgggtggctactctgtg

SEQ ID NO: 5339540 - DNA, 22 bp, Homo sapiens
tttcctggtgccaatttcaagt

SEQ ID NO: 5339541 - DNA, 15 bp, Homo sapiens
tttcctgtaatatat

SEQ ID NO: 5339542 - DNA, 19 bp, Homo sapiens
tttcctgtaatatatttat

SEQ ID NO: 5339543 - DNA, 20 bp, Homo sapiens
tttcctgtaatatatttata

SEQ ID NO: 5339544 - DNA, 12 bp, Homo sapiens
tttcctgtacaa

SEQ ID NO: 5339545 - DNA, 13 bp, Homo sapiens
tttcctgtacaat

SEQ ID NO: 5339546 - DNA, 15 bp, Homo sapiens
tttcctgtcaatata

SEQ ID NO: 5339547 - DNA, 16 bp, Homo sapiens
tttcctgtcaatatat

SEQ ID NO: 5339548 - DNA, 23 bp, Homo sapiens
tttcctgtcagtgtttttgaaac

SEQ ID NO: 5339549 - DNA, 20 bp, Homo sapiens
tttcctgtcctctttcagct

SEQ ID NO: 5339550 - DNA, 21 bp, Homo sapiens
tttcctgtcctctttcagctc

SEQ ID NO: 5339551 - DNA, 12 bp, Homo sapiens
tttcctgtcctg

SEQ ID NO: 5339552 - DNA, 12 bp, Homo sapiens
tttcctgtctga

SEQ ID NO: 5339553 - DNA, 14 bp, Homo sapiens
tttcctgtgaggat

SEQ ID NO: 5339554 - DNA, 22 bp, Homo sapiens
tttcctgtgccaggactctctt

SEQ ID NO: 5339555 - DNA, 22 bp, Homo sapiens
tttcctgtggttttattacaaa

SEQ ID NO: 5339556 - DNA, 14 bp, Homo sapiens
tttcctgtgtctcc

SEQ ID NO: 5339557 - DNA, 15 bp, Homo sapiens
tttcctgtgtctcca

SEQ ID NO: 5339558 - DNA, 18 bp, Homo sapiens
tttcctgtgtgaagaaag

SEQ ID NO: 5339559 - DNA, 15 bp, Homo sapiens
tttcctgtgtttgtc

SEQ ID NO: 5339560 - DNA, 13 bp, Homo sapiens
tttcctgttcagc

SEQ ID NO: 5339561 - DNA, 15 bp, Homo sapiens
tttcctgttcagcat

SEQ ID NO: 5339562 - DNA, 18 bp, Homo sapiens
tttcctgttcatgacagc

SEQ ID NO: 5339563 - DNA, 22 bp, Homo sapiens
tttcctgttgttttcttaactt

SEQ ID NO: 5339564 - DNA, 17 bp, Homo sapiens
tttcctgtttactgatt

SEQ ID NO: 5339565 - DNA, 22 bp, Homo sapiens
tttcctgtttgaaatatcatgt

SEQ ID NO: 5339566 - DNA, 21 bp, Homo sapiens
tttcctgtttttgttaacttt

SEQ ID NO: 5339567 - DNA, 13 bp, Homo sapiens
tttccttaaacat

SEQ ID NO: 5339568 - DNA, 16 bp, Homo sapiens
tttccttaaactgtgt

SEQ ID NO: 5339569 - DNA, 21 bp, Homo sapiens
tttccttaaatttttagccat

SEQ ID NO: 5339570 - DNA, 19 bp, Homo sapiens
tttccttagacccgccagg

SEQ ID NO: 5339571 - DNA, 19 bp, Homo sapiens
tttccttatagggaaaaat

SEQ ID NO: 5339572 - DNA, 15 bp, Homo sapiens
tttccttattccaca

SEQ ID NO: 5339573 - DNA, 15 bp, Homo sapiens
tttccttatttcaag

SEQ ID NO: 5339574 - DNA, 19 bp, Homo sapiens
tttccttcaagccagcaac

SEQ ID NO: 5339575 - DNA, 12 bp, Homo sapiens
tttccttcaggc

SEQ ID NO: 5339576 - DNA, 15 bp, Homo sapiens
tttccttcaggcagc

SEQ ID NO: 5339577 - DNA, 18 bp, Homo sapiens
tttccttcaggcagctga

SEQ ID NO: 5339578 - DNA, 21 bp, Homo sapiens
tttccttcaggcagctgaaat

SEQ ID NO: 5339579 - DNA, 15 bp, Homo sapiens
tttccttcaggtttt

SEQ ID NO: 5339580 - DNA, 21 bp, Homo sapiens
tttccttcataattttcaaaa

SEQ ID NO: 5339581 - DNA, 16 bp, Homo sapiens
tttccttccactgtag

SEQ ID NO: 5339582 - DNA, 14 bp, Homo sapiens
tttccttccagcct

SEQ ID NO: 5339583 - DNA, 12 bp, Homo sapiens
tttccttccatg

SEQ ID NO: 5339584 - DNA, 13 bp, Homo sapiens
tttccttccatgc

SEQ ID NO: 5339585 - DNA, 17 bp, Homo sapiens
tttccttcccaggccct

SEQ ID NO: 5339586 - DNA, 23 bp, Homo sapiens
tttccttcccaggccctttggct

SEQ ID NO: 5339587 - DNA, 19 bp, Homo sapiens
tttccttccctctcctgct

SEQ ID NO: 5339588 - DNA, 14 bp, Homo sapiens
tttccttccctttt

SEQ ID NO: 5339589 - DNA, 18 bp, Homo sapiens
tttccttcccttttctgt

SEQ ID NO: 5339590 - DNA, 13 bp, Homo sapiens
tttccttcctgcc

SEQ ID NO: 5339591 - DNA, 15 bp, Homo sapiens
tttccttcctgccct

SEQ ID NO: 5339592 - DNA, 16 bp, Homo sapiens
tttccttcctgccctg

SEQ ID NO: 5339593 - DNA, 22 bp, Homo sapiens
tttccttccttcctcctttcct

SEQ ID NO: 5339594 - DNA, 22 bp, Homo sapiens
tttccttcggaatccagtgctt

SEQ ID NO: 5339595 - DNA, 22 bp, Homo sapiens
tttccttctcgtcttcctctct

SEQ ID NO: 5339596 - DNA, 19 bp, Homo sapiens
tttccttctctgtaaccag

SEQ ID NO: 5339597 - DNA, 14 bp, Homo sapiens
tttccttctgaaaa

SEQ ID NO: 5339598 - DNA, 20 bp, Homo sapiens
tttccttctgaagtctgagc

SEQ ID NO: 5339599 - DNA, 18 bp, Homo sapiens
tttccttctgatctgaga

SEQ ID NO: 5339600 - DNA, 13 bp, Homo sapiens
tttccttctggtt

SEQ ID NO: 5339601 - DNA, 19 bp, Homo sapiens
tttccttctggttctaact

SEQ ID NO: 5339602 - DNA, 17 bp, Homo sapiens
tttccttctgttaagaa

SEQ ID NO: 5339603 - DNA, 18 bp, Homo sapiens
tttccttctgttaagaaa

SEQ ID NO: 5339604 - DNA, 19 bp, Homo sapiens
tttccttctgttaagaaag

SEQ ID NO: 5339605 - DNA, 16 bp, Homo sapiens
tttccttcttcagcag

SEQ ID NO: 5339606 - DNA, 22 bp, Homo sapiens
tttccttgaaaataaaaagaga

SEQ ID NO: 5339607 - DNA, 20 bp, Homo sapiens
tttccttgctatttcaataa

SEQ ID NO: 5339608 - DNA, 23 bp, Homo sapiens
tttccttggctcccattcactct

SEQ ID NO: 5339609 - DNA, 14 bp, Homo sapiens
tttccttgtcccgt

SEQ ID NO: 5339610 - DNA, 15 bp, Homo sapiens
tttccttgtctctca

SEQ ID NO: 5339611 - DNA, 19 bp, Homo sapiens
tttccttgtctctcattct

SEQ ID NO: 5339612 - DNA, 19 bp, Homo sapiens
tttccttgtgcctgctcct

SEQ ID NO: 5339613 - DNA, 16 bp, Homo sapiens
tttccttgtgctcctg

SEQ ID NO: 5339614 - DNA, 18 bp, Homo sapiens
tttccttgttggtcagag

SEQ ID NO: 5339615 - DNA, 21 bp, Homo sapiens
tttcctttaaaaaaatttaag

SEQ ID NO: 5339616 - DNA, 15 bp, Homo sapiens
tttcctttaaatact

SEQ ID NO: 5339617 - DNA, 20 bp, Homo sapiens
tttcctttaaatggtaagag

SEQ ID NO: 5339618 - DNA, 16 bp, Homo sapiens
tttcctttaccttttc

SEQ ID NO: 5339619 - DNA, 18 bp, Homo sapiens
tttcctttatactgtgaa

SEQ ID NO: 5339620 - DNA, 15 bp, Homo sapiens
tttcctttatgtgaa

SEQ ID NO: 5339621 - DNA, 19 bp, Homo sapiens
tttcctttatgtgaatttt

SEQ ID NO: 5339622 - DNA, 15 bp, Homo sapiens
tttcctttcctttca

SEQ ID NO: 5339623 - DNA, 19 bp, Homo sapiens
tttcctttcttagctgatg

SEQ ID NO: 5339624 - DNA, 22 bp, Homo sapiens
tttcctttcttttttttcttgg

SEQ ID NO: 5339625 - DNA, 12 bp, Homo sapiens
tttcctttgaac

SEQ ID NO: 5339626 - DNA, 13 bp, Homo sapiens
tttcctttgcacc

SEQ ID NO: 5339627 - DNA, 15 bp, Homo sapiens
tttcctttgcattca

SEQ ID NO: 5339628 - DNA, 13 bp, Homo sapiens
tttcctttgctct

SEQ ID NO: 5339629 - DNA, 12 bp, Homo sapiens
tttcctttggag

SEQ ID NO: 5339630 - DNA, 12 bp, Homo sapiens
tttcctttggca

SEQ ID NO: 5339631 - DNA, 19 bp, Homo sapiens
tttcctttggcaatatcat

SEQ ID NO: 5339632 - DNA, 17 bp, Homo sapiens
tttcctttgtaatcact

SEQ ID NO: 5339633 - DNA, 9 bp, Homo sapiens
tttcctttt

SEQ ID NO: 5339634 - DNA, 14 bp, Homo sapiens
tttccttttaccat

SEQ ID NO: 5339635 - DNA, 19 bp, Homo sapiens
tttccttttcttgtctctg

SEQ ID NO: 5339636 - DNA, 22 bp, Homo sapiens
tttccttttcttgtctctgagg

SEQ ID NO: 5339637 - DNA, 21 bp, Homo sapiens
tttccttttgcaacaagacaa

SEQ ID NO: 5339638 - DNA, 14 bp, Homo sapiens
tttccttttgcaca

SEQ ID NO: 5339639 - DNA, 15 bp, Homo sapiens
tttccttttgctgtg

SEQ ID NO: 5339640 - DNA, 22 bp, Homo sapiens
tttccttttggcctcctgcaaa

SEQ ID NO: 5339641 - DNA, 23 bp, Homo sapiens
tttccttttgtaaagtaaaatat

SEQ ID NO: 5339642 - DNA, 19 bp, Homo sapiens
tttcctttttaatatgctt

SEQ ID NO: 5339643 - DNA, 18 bp, Homo sapiens
tttcctttttgacactga

SEQ ID NO: 5339644 - DNA, 16 bp, Homo sapiens
tttccttttttaaaaa

SEQ ID NO: 5339645 - DNA, 22 bp, Homo sapiens
tttccttttttaaaaaaatttt

SEQ ID NO: 5339646 - DNA, 18 bp, Homo sapiens
tttccttttttatacaca

SEQ ID NO: 5339647 - DNA, 22 bp, Homo sapiens
tttccttttttcccataagaca

SEQ ID NO: 5339648 - DNA, 15 bp, Homo sapiens
tttccttttttgaga

SEQ ID NO: 5339649 - DNA, 17 bp, Homo sapiens
tttccttttttgtctat

SEQ ID NO: 5339650 - DNA, 19 bp, Homo sapiens
tttccttttttgtctatga

SEQ ID NO: 5339651 - DNA, 13 bp, Homo sapiens
tttcgaaactgcc

SEQ ID NO: 5339652 - DNA, 16 bp, Homo sapiens
tttcgaaactgccaag

SEQ ID NO: 5339653 - DNA, 14 bp, Homo sapiens
tttcgaactgtgct

SEQ ID NO: 5339654 - DNA, 14 bp, Homo sapiens
tttcgaagtttgca

SEQ ID NO: 5339655 - DNA, 15 bp, Homo sapiens
tttcgaagtttgcaa

SEQ ID NO: 5339656 - DNA, 16 bp, Homo sapiens
tttcgaataaagtgaa

SEQ ID NO: 5339657 - DNA, 17 bp, Homo sapiens
tttcgaataaagtgaat

SEQ ID NO: 5339658 - DNA, 16 bp, Homo sapiens
tttcgactggtccagc

SEQ ID NO: 5339659 - DNA, 19 bp, Homo sapiens
tttcgactggtccagctct

SEQ ID NO: 5339660 - DNA, 19 bp, Homo sapiens
tttcgacttgcatttttgc

SEQ ID NO: 5339661 - DNA, 15 bp, Homo sapiens
tttcgagaagctgct

SEQ ID NO: 5339662 - DNA, 15 bp, Homo sapiens
tttcgagtaaacttg

SEQ ID NO: 5339663 - DNA, 13 bp, Homo sapiens
tttcgcaaatgtt

SEQ ID NO: 5339664 - DNA, 12 bp, Homo sapiens
tttcgcctcctc

SEQ ID NO: 5339665 - DNA, 17 bp, Homo sapiens
tttcgccttaaactctg

SEQ ID NO: 5339666 - DNA, 13 bp, Homo sapiens
tttcgcctttcct

SEQ ID NO: 5339667 - DNA, 18 bp, Homo sapiens
tttcgcttgcttctgcag

SEQ ID NO: 5339668 - DNA, 23 bp, Homo sapiens
tttcggaaatacactacaaatgt

SEQ ID NO: 5339669 - DNA, 18 bp, Homo sapiens
tttcggacagtttatttg

SEQ ID NO: 5339670 - DNA, 16 bp, Homo sapiens
tttcggagcctgcctc

SEQ ID NO: 5339671 - DNA, 16 bp, Homo sapiens
tttcggctaaaaagaa

SEQ ID NO: 5339672 - DNA, 19 bp, Homo sapiens
tttcgggagccttgtcagt

SEQ ID NO: 5339673 - DNA, 14 bp, Homo sapiens
tttcggggagggcg

SEQ ID NO: 5339674 - DNA, 21 bp, Homo sapiens
tttcgggtgaatctgtctatc

SEQ ID NO: 5339675 - DNA, 15 bp, Homo sapiens
tttcggtctccttaa

SEQ ID NO: 5339676 - DNA, 17 bp, Homo sapiens
tttcggtgccctgtgtc

SEQ ID NO: 5339677 - DNA, 17 bp, Homo sapiens
tttcggtgggacagccc

SEQ ID NO: 5339678 - DNA, 16 bp, Homo sapiens
tttcgtaatagctcag

SEQ ID NO: 5339679 - DNA, 15 bp, Homo sapiens
tttcgtaccttccca

SEQ ID NO: 5339680 - DNA, 17 bp, Homo sapiens
tttcgtaccttcccact

SEQ ID NO: 5339681 - DNA, 17 bp, Homo sapiens
tttcgtataatcttgta

SEQ ID NO: 5339682 - DNA, 13 bp, Homo sapiens
tttcgtatgaaaa

SEQ ID NO: 5339683 - DNA, 13 bp, Homo sapiens
tttcgtcacgagc

SEQ ID NO: 5339684 - DNA, 19 bp, Homo sapiens
tttcgtccacagcttcctg

SEQ ID NO: 5339685 - DNA, 23 bp, Homo sapiens
tttcgtccacagcttcctgtccc

SEQ ID NO: 5339686 - DNA, 18 bp, Homo sapiens
tttcgtgagccccatctt

SEQ ID NO: 5339687 - DNA, 16 bp, Homo sapiens
tttcgtgcatttgtga

SEQ ID NO: 5339688 - DNA, 13 bp, Homo sapiens
tttcgtggggagg

SEQ ID NO: 5339689 - DNA, 15 bp, Homo sapiens
tttcgttaacattga

SEQ ID NO: 5339690 - DNA, 19 bp, Homo sapiens
tttcgttaacattgaccaa

SEQ ID NO: 5339691 - DNA, 22 bp, Homo sapiens
tttcgttaagcagtacatcttg

SEQ ID NO: 5339692 - DNA, 21 bp, Homo sapiens
tttcgttacattgtgtcctgc

SEQ ID NO: 5339693 - DNA, 13 bp, Homo sapiens
tttcgttcagtta

SEQ ID NO: 5339694 - DNA, 21 bp, Homo sapiens
tttcgttggttgtttctctga

SEQ ID NO: 5339695 - DNA, 14 bp, Homo sapiens
tttcgtttctgtat

SEQ ID NO: 5339696 - DNA, 14 bp, Homo sapiens
tttcgtttgtttgt

SEQ ID NO: 5339697 - DNA, 19 bp, Homo sapiens
tttcgtttttcttggggta

SEQ ID NO: 5339698 - DNA, 12 bp, Homo sapiens
tttctaaaaaaa

SEQ ID NO: 5339699 - DNA, 17 bp, Homo sapiens
tttctaaaaaaaaaaac

SEQ ID NO: 5339700 - DNA, 15 bp, Homo sapiens
tttctaaaaagatta

SEQ ID NO: 5339701 - DNA, 17 bp, Homo sapiens
tttctaaaaagctatgt

SEQ ID NO: 5339702 - DNA, 23 bp, Homo sapiens
tttctaaaaagctatgtatcgct

SEQ ID NO: 5339703 - DNA, 20 bp, Homo sapiens
tttctgtagactctaagata

SEQ ID NO: 5339704 - DNA, 12 bp, Homo sapiens
tttctgtataga

SEQ ID NO: 5339705 - DNA, 13 bp, Homo sapiens
tttctgtatatag

SEQ ID NO: 5339706 - DNA, 14 bp, Homo sapiens
tttctgtatataga

SEQ ID NO: 5339707 - DNA, 16 bp, Homo sapiens
tttctgtatattccct

SEQ ID NO: 5339708 - DNA, 18 bp, Homo sapiens
tttctgtatatttgtcat

SEQ ID NO: 5339709 - DNA, 20 bp, Homo sapiens
tttctgtatatttgtcatga

SEQ ID NO: 5339710 - DNA, 15 bp, Homo sapiens
tttctgtatttttta

SEQ ID NO: 5339711 - DNA, 17 bp, Homo sapiens
tttctgtcagtaaaact

SEQ ID NO: 5339712 - DNA, 18 bp, Homo sapiens
tttctgtcagtaaaactc

SEQ ID NO: 5339713 - DNA, 18 bp, Homo sapiens
tttctgtcattgttaaat

SEQ ID NO: 5339714 - DNA, 22 bp, Homo sapiens
tttctgtcctcaggtgaataac

SEQ ID NO: 5339715 - DNA, 14 bp, Homo sapiens
tttctgtcctgtaa

SEQ ID NO: 5339716 - DNA, 18 bp, Homo sapiens
tttctgtcctgtaactgt

SEQ ID NO: 5339717 - DNA, 14 bp, Homo sapiens
tttctgtctcccct

SEQ ID NO: 5339718 - DNA, 14 bp, Homo sapiens
tttctgtctccctt

SEQ ID NO: 5339719 - DNA, 13 bp, Homo sapiens
tttctgtctctct

SEQ ID NO: 5339720 - DNA, 15 bp, Homo sapiens
tttctgtctctgcct

SEQ ID NO: 5339721 - DNA, 12 bp, Homo sapiens
tttctgtgaaag

SEQ ID NO: 5339722 - DNA, 12 bp, Homo sapiens
tttctgtgaagc

SEQ ID NO: 5339723 - DNA, 17 bp, Homo sapiens
tttctgtgaagcccttt

SEQ ID NO: 5339724 - DNA, 13 bp, Homo sapiens
tttctgtgcattc

SEQ ID NO: 5339725 - DNA, 13 bp, Homo sapiens
tttctgtgcccta

SEQ ID NO: 5339726 - DNA, 17 bp, Homo sapiens
tttctgtgccctcctga

SEQ ID NO: 5339727 - DNA, 17 bp, Homo sapiens
tttctgtgcctgaatat

SEQ ID NO: 5339728 - DNA, 22 bp, Homo sapiens
tttctgtggagagtgagaataa

SEQ ID NO: 5339729 - DNA, 24 bp, Homo sapiens
tttctgtggagagtgagaataatt

SEQ ID NO: 5339730 - DNA, 13 bp, Homo sapiens
tttctgtgtaaaa

SEQ ID NO: 5339731 - DNA, 15 bp, Homo sapiens
tttctgtgtaaaatg

SEQ ID NO: 5339732 - DNA, 18 bp, Homo sapiens
tttctgtgtaaaatgagt

SEQ ID NO: 5339733 - DNA, 20 bp, Homo sapiens
tttctgtgtgcaccttacca

SEQ ID NO: 5339734 - DNA, 15 bp, Homo sapiens
tttctgtgtgtcagt

SEQ ID NO: 5339735 - DNA, 21 bp, Homo sapiens
tttctgtgtgtcagttttcat

SEQ ID NO: 5339736 - DNA, 16 bp, Homo sapiens
tttctgtgtgttcctg

SEQ ID NO: 5339737 - DNA, 13 bp, Homo sapiens
tttctgtgtttat

SEQ ID NO: 5339738 - DNA, 19 bp, Homo sapiens
tttctgttatataaatggt

SEQ ID NO: 5339739 - DNA, 16 bp, Homo sapiens
tttctgttatttttaa

SEQ ID NO: 5339740 - DNA, 22 bp, Homo sapiens
tttctgttcagcgttttgcaag

SEQ ID NO: 5339741 - DNA, 14 bp, Homo sapiens
tttctgttcatctc

SEQ ID NO: 5339742 - DNA, 14 bp, Homo sapiens
tttctgttcatctt

SEQ ID NO: 5339743 - DNA, 20 bp, Homo sapiens
tttctgttccaaattcagtt

SEQ ID NO: 5339744 - DNA, 15 bp, Homo sapiens
tttctgttccctgct

SEQ ID NO: 5339745 - DNA, 15 bp, Homo sapiens
tttctgttccttcct

SEQ ID NO: 5339746 - DNA, 18 bp, Homo sapiens
tttctgttcgaagttcat

SEQ ID NO: 5339747 - DNA, 12 bp, Homo sapiens
tttctgttctgc

SEQ ID NO: 5339748 - DNA, 13 bp, Homo sapiens
tttctgttctgcc

SEQ ID NO: 5339749 - DNA, 17 bp, Homo sapiens
tttctgttctgtggaaa

SEQ ID NO: 5339750 - DNA, 19 bp, Homo sapiens
tttctgttctgtggaaagt

SEQ ID NO: 5339751 - DNA, 19 bp, Homo sapiens
tttctgttcttacaaatgt

SEQ ID NO: 5339752 - DNA, 20 bp, Homo sapiens
tttctgttgaagattaacac

SEQ ID NO: 5339753 - DNA, 14 bp, Homo sapiens
tttctgttggataa

SEQ ID NO: 5339754 - DNA, 15 bp, Homo sapiens
tttctgttggattcc

SEQ ID NO: 5339755 - DNA, 19 bp, Homo sapiens
tttctgttggtcttaacta

SEQ ID NO: 5339756 - DNA, 17 bp, Homo sapiens
tttctgttgtaacttat

SEQ ID NO: 5339757 - DNA, 19 bp, Homo sapiens
tttctgttgtaacttatgt

SEQ ID NO: 5339758 - DNA, 18 bp, Homo sapiens
tttctgttgtttctttta

SEQ ID NO: 5339759 - DNA, 13 bp, Homo sapiens
tttctgtttcaaa

SEQ ID NO: 5339760 - DNA, 16 bp, Homo sapiens
tttctgtttcctggcc

SEQ ID NO: 5339761 - DNA, 20 bp, Homo sapiens
tttctgtttctaatttgctg

SEQ ID NO: 5339762 - DNA, 17 bp, Homo sapiens
tttctgtttctgtttat

SEQ ID NO: 5339763 - DNA, 20 bp, Homo sapiens
tttctgtttttatgttttat

SEQ ID NO: 5339764 - DNA, 22 bp, Homo sapiens
tttctgttttttttttttgtat

SEQ ID NO: 5339765 - DNA, 12 bp, Homo sapiens
tttcttaaaaag

SEQ ID NO: 5339766 - DNA, 12 bp, Homo sapiens
tttcttaaaaat

SEQ ID NO: 5339767 - DNA, 17 bp, Homo sapiens
tttcttaaaacacatga

SEQ ID NO: 5339768 - DNA, 14 bp, Homo sapiens
tttcttaaaagtac

SEQ ID NO: 5339769 - DNA, 20 bp, Homo sapiens
tttcttaaaagtactttaaa

SEQ ID NO: 5339770 - DNA, 13 bp, Homo sapiens
tttcttaaaatgt

SEQ ID NO: 5339771 - DNA, 13 bp, Homo sapiens
tttcttaaaccaa

SEQ ID NO: 5339772 - DNA, 18 bp, Homo sapiens
tttcttaaaccttcagtt

SEQ ID NO: 5339773 - DNA, 13 bp, Homo sapiens
tttcttaaataag

SEQ ID NO: 5339774 - DNA, 18 bp, Homo sapiens
tttcttaaataagaaact

SEQ ID NO: 5339775 - DNA, 13 bp, Homo sapiens
tttcttaaatatg

SEQ ID NO: 5339776 - DNA, 22 bp, Homo sapiens
tttcttaaatctttcttcaaat

SEQ ID NO: 5339777 - DNA, 23 bp, Homo sapiens
tttcttaacccctaagactgcct

SEQ ID NO: 5339778 - DNA, 14 bp, Homo sapiens
tttcttaacttctt

SEQ ID NO: 5339779 - DNA, 17 bp, Homo sapiens
tttcttaacttcttgct

SEQ ID NO: 5339780 - DNA, 21 bp, Homo sapiens
tttcttaacttcttgcttctt

SEQ ID NO: 5339781 - DNA, 19 bp, Homo sapiens
tttcttaagaattcaaatt

SEQ ID NO: 5339782 - DNA, 20 bp, Homo sapiens
tttcttaaggcatactagta

SEQ ID NO: 5339783 - DNA, 23 bp, Homo sapiens
tttcttaagtaatgatactgtgt

SEQ ID NO: 5339784 - DNA, 13 bp, Homo sapiens
tttcttaatatat

SEQ ID NO: 5339785 - DNA, 14 bp, Homo sapiens
tttcttaatttgga

SEQ ID NO: 5339786 - DNA, 18 bp, Homo sapiens
tttcttaatttggaaact

SEQ ID NO: 5339787 - DNA, 16 bp, Homo sapiens
tttcttaattttgtct

SEQ ID NO: 5339788 - DNA, 21 bp, Homo sapiens
tttcttacacaagagctggag

SEQ ID NO: 5339789 - DNA, 18 bp, Homo sapiens
tttcttacacacccccag

SEQ ID NO: 5339790 - DNA, 22 bp, Homo sapiens
tttcttacaggcacaaaatgat

SEQ ID NO: 5339791 - DNA, 17 bp, Homo sapiens
tttcttaccagtctcct

SEQ ID NO: 5339792 - DNA, 18 bp, Homo sapiens
tttcttacccaatttccc

SEQ ID NO: 5339793 - DNA, 23 bp, Homo sapiens
tttcttaccttaaaaagtaattg

SEQ ID NO: 5339794 - DNA, 22 bp, Homo sapiens
tttcttagaaatttatttccta

SEQ ID NO: 5339795 - DNA, 13 bp, Homo sapiens
tttcttagacttt

SEQ ID NO: 5339796 - DNA, 22 bp, Homo sapiens
tttcttagctttttaattgttg

SEQ ID NO: 5339797 - DNA, 19 bp, Homo sapiens
tttcttaggagcaagaaga

SEQ ID NO: 5339798 - DNA, 14 bp, Homo sapiens
tttcttagttactt

SEQ ID NO: 5339799 - DNA, 19 bp, Homo sapiens
tttcttagtttcagaagta

SEQ ID NO: 5339800 - DNA, 13 bp, Homo sapiens
tttcttataaatt

SEQ ID NO: 5339801 - DNA, 21 bp, Homo sapiens
tttcttataccttctgacagc

SEQ ID NO: 5339802 - DNA, 13 bp, Homo sapiens
tttcttatagatt

SEQ ID NO: 5339803 - DNA, 14 bp, Homo sapiens
tttcttatagattt

SEQ ID NO: 5339804 - DNA, 14 bp, Homo sapiens
tttcttatgtgaca

SEQ ID NO: 5339805 - DNA, 16 bp, Homo sapiens
tttcttatgtgacatt

SEQ ID NO: 5339806 - DNA, 17 bp, Homo sapiens
tttcttattaaccaaat

SEQ ID NO: 5339807 - DNA, 19 bp, Homo sapiens
tttcttattgaatttgtta

SEQ ID NO: 5339808 - DNA, 14 bp, Homo sapiens
tttcttatttaatt

SEQ ID NO: 5339809 - DNA, 15 bp, Homo sapiens
tttcttatttaatta

SEQ ID NO: 5339810 - DNA, 11 bp, Homo sapiens
tttcttcaaaa

SEQ ID NO: 5339811 - DNA, 12 bp, Homo sapiens
tttcttcaaaat

SEQ ID NO: 5339812 - DNA, 21 bp, Homo sapiens
tttcttcaaaatcgatatggt

SEQ ID NO: 5339813 - DNA, 21 bp, Homo sapiens
tttcttcaaaatgtatatatt

SEQ ID NO: 5339814 - DNA, 22 bp, Homo sapiens
tttcttcaaacagtatataact

SEQ ID NO: 5339815 - DNA, 14 bp, Homo sapiens
tttcttcaaatgtt

SEQ ID NO: 5339816 - DNA, 18 bp, Homo sapiens
tttcttcaacatcaatgt

SEQ ID NO: 5339817 - DNA, 21 bp, Homo sapiens
tttcttcaacatcaatgttca

SEQ ID NO: 5339818 - DNA, 20 bp, Homo sapiens
tttcttcaactctgaatcaa

SEQ ID NO: 5339819 - DNA, 14 bp, Homo sapiens
tttcttcaccaagt

SEQ ID NO: 5339820 - DNA, 16 bp, Homo sapiens
tttcttcactgcaaca

SEQ ID NO: 5339821 - DNA, 19 bp, Homo sapiens
tttcttcactgcaacatga

SEQ ID NO: 5339822 - DNA, 23 bp, Homo sapiens
tttcttcacttcaagctgttatt

SEQ ID NO: 5339823 - DNA, 19 bp, Homo sapiens
tttcttcaggaaaataaat

SEQ ID NO: 5339824 - DNA, 12 bp, Homo sapiens
tttcttcatgag

SEQ ID NO: 5339825 - DNA, 20 bp, Homo sapiens
tttcttcatgcctgatgaaa

SEQ ID NO: 5339826 - DNA, 20 bp, Homo sapiens
tttcttcatgtgcaaagtga

SEQ ID NO: 5339827 - DNA, 15 bp, Homo sapiens
tttcttccacaaaca

SEQ ID NO: 5339828 - DNA, 19 bp, Homo sapiens
tttcttccacccacaaact

SEQ ID NO: 5339829 - DNA, 20 bp, Homo sapiens
tttcttccactaccctccct

SEQ ID NO: 5339830 - DNA, 19 bp, Homo sapiens
tttcttccatcagctctct

SEQ ID NO: 5339831 - DNA, 14 bp, Homo sapiens
tttcttccattcct

SEQ ID NO: 5339832 - DNA, 20 bp, Homo sapiens
tttcttcccaaatcaaaata

SEQ ID NO: 5339833 - DNA, 22 bp, Homo sapiens
tttcttcccaaatcaaaataaa

SEQ ID NO: 5339834 - DNA, 20 bp, Homo sapiens
tttcttcccatttgtaatgt

SEQ ID NO: 5339835 - DNA, 12 bp, Homo sapiens
tttcttccccaa

SEQ ID NO: 5339836 - DNA, 14 bp, Homo sapiens
tttcttccctcatg

SEQ ID NO: 5339837 - DNA, 13 bp, Homo sapiens
tttcttccctgct

SEQ ID NO: 5339838 - DNA, 15 bp, Homo sapiens
tttcttccctgcttt

SEQ ID NO: 5339839 - DNA, 17 bp, Homo sapiens
tttcttcccttcaaggt

SEQ ID NO: 5339840 - DNA, 17 bp, Homo sapiens
tttcttcctaccaagtc

SEQ ID NO: 5339841 - DNA, 23 bp, Homo sapiens
tttcttcctaccaagtcaaactt

SEQ ID NO: 5339842 - DNA, 15 bp, Homo sapiens
tttcttcctccagtc

SEQ ID NO: 5339843 - DNA, 22 bp, Homo sapiens
tttcttcctccagtctgttctc

SEQ ID NO: 5339844 - DNA, 11 bp, Homo sapiens
tttcttcctct

SEQ ID NO: 5339845 - DNA, 14 bp, Homo sapiens
tttcttcctcttct

SEQ ID NO: 5339846 - DNA, 21 bp, Homo sapiens
tttcttccttcctttctctct

SEQ ID NO: 5339847 - DNA, 22 bp, Homo sapiens
tttcttccttctttctcttccc

SEQ ID NO: 5339848 - DNA, 11 bp, Homo sapiens
tttcttccttt

SEQ ID NO: 5339849 - DNA, 14 bp, Homo sapiens
tttcttcctttcta

SEQ ID NO: 5339850 - DNA, 15 bp, Homo sapiens
tttcttctaaacatt

SEQ ID NO: 5339851 - DNA, 18 bp, Homo sapiens
tttcttctagaagataac

SEQ ID NO: 5339852 - DNA, 12 bp, Homo sapiens
tttcttctatgt

SEQ ID NO: 5339853 - DNA, 23 bp, Homo sapiens
tttcttctcctgtgatgtcccag

SEQ ID NO: 5339854 - DNA, 15 bp, Homo sapiens
tttcttctctctgtt

SEQ ID NO: 5339855 - DNA, 16 bp, Homo sapiens
tttcttctctctttgt

SEQ ID NO: 5339856 - DNA, 13 bp, Homo sapiens
tttcttctctgcc

SEQ ID NO: 5339857 - DNA, 17 bp, Homo sapiens
tttcttctctgcctcct

SEQ ID NO: 5339858 - DNA, 13 bp, Homo sapiens
tttcttctctgct

SEQ ID NO: 5339859 - DNA, 14 bp, Homo sapiens
tttcttctctggag

SEQ ID NO: 5339860 - DNA, 20 bp, Homo sapiens
tttcttctctgtgagaaggt

SEQ ID NO: 5339861 - DNA, 19 bp, Homo sapiens
tttcttctcttatcctctc

SEQ ID NO: 5339862 - DNA, 17 bp, Homo sapiens
tttcttctgaagattct

SEQ ID NO: 5339863 - DNA, 12 bp, Homo sapiens
tttcttcttccc

SEQ ID NO: 5339864 - DNA, 12 bp, Homo sapiens
tttcttcttcct

SEQ ID NO: 5339865 - DNA, 13 bp, Homo sapiens
tttcttcttcctg

SEQ ID NO: 5339866 - DNA, 19 bp, Homo sapiens
tttcttcttctaagaagac

SEQ ID NO: 5339867 - DNA, 12 bp, Homo sapiens
tttcttctttcc

SEQ ID NO: 5339868 - DNA, 16 bp, Homo sapiens
tttcttctttccctgg

SEQ ID NO: 5339869 - DNA, 18 bp, Homo sapiens
tttcttctttccctggac

SEQ ID NO: 5339870 - DNA, 12 bp, Homo sapiens
tttcttctttgt

SEQ ID NO: 5339871 - DNA, 16 bp, Homo sapiens
tttcttcttttacttg

SEQ ID NO: 5339872 - DNA, 16 bp, Homo sapiens
tttcttgaacatactt

SEQ ID NO: 5339873 - DNA, 20 bp, Homo sapiens
tttcttgaagaataaattct

SEQ ID NO: 5339874 - DNA, 14 bp, Homo sapiens
tttcttgaattttt

SEQ ID NO: 5339875 - DNA, 23 bp, Homo sapiens
tttcttgaatttttttctgcaca

SEQ ID NO: 5339876 - DNA, 20 bp, Homo sapiens
tttcttgacaaaacctaact

SEQ ID NO: 5339877 - DNA, 16 bp, Homo sapiens
tttcttgacaagctga

SEQ ID NO: 5339878 - DNA, 23 bp, Homo sapiens
tttcttgacaagctgacttggca

SEQ ID NO: 5339879 - DNA, 17 bp, Homo sapiens
tttcttgagatctgctg

SEQ ID NO: 5339880 - DNA, 22 bp, Homo sapiens
tttcttgagtcaaaaaacatga

SEQ ID NO: 5339881 - DNA, 19 bp, Homo sapiens
tttcttgataattttcctt

SEQ ID NO: 5339882 - DNA, 15 bp, Homo sapiens
tttcttgatcttaaa

SEQ ID NO: 5339883 - DNA, 12 bp, Homo sapiens
tttgaattttgt

SEQ ID NO: 5339884 - DNA, 16 bp, Homo sapiens
tttgacaaacacaatt

SEQ ID NO: 5339885 - DNA, 14 bp, Homo sapiens
tttgacaaagaaaa

SEQ ID NO: 5339886 - DNA, 15 bp, Homo sapiens
tttgacaacaaatta

SEQ ID NO: 5339887 - DNA, 13 bp, Homo sapiens
tttgacaacacat

SEQ ID NO: 5339888 - DNA, 14 bp, Homo sapiens
tttgacaacacatg

SEQ ID NO: 5339889 - DNA, 20 bp, Homo sapiens
tttgacaacacatgtgggag

SEQ ID NO: 5339890 - DNA, 22 bp, Homo sapiens
tttgacaacatggcttctcctt

SEQ ID NO: 5339891 - DNA, 14 bp, Homo sapiens
tttgacaactaaaa

SEQ ID NO: 5339892 - DNA, 14 bp, Homo sapiens
tttgacaaggggca

SEQ ID NO: 5339893 - DNA, 19 bp, Homo sapiens
tttgacaatcaaagaaaag

SEQ ID NO: 5339894 - DNA, 20 bp, Homo sapiens
tttgacaattcctagataaa

SEQ ID NO: 5339895 - DNA, 16 bp, Homo sapiens
tttgacacaaagcttc

SEQ ID NO: 5339896 - DNA, 13 bp, Homo sapiens
tttgacacataaa

SEQ ID NO: 5339897 - DNA, 15 bp, Homo sapiens
tttgacactaagaaa

SEQ ID NO: 5339898 - DNA, 18 bp, Homo sapiens
tttgacactatatctgta

SEQ ID NO: 5339899 - DNA, 14 bp, Homo sapiens
tttgacacttccat

SEQ ID NO: 5339900 - DNA, 16 bp, Homo sapiens
tttgacacttccattg

SEQ ID NO: 5339901 - DNA, 18 bp, Homo sapiens
tttgacacttcccagtgg

SEQ ID NO: 5339902 - DNA, 21 bp, Homo sapiens
tttgacagaatatgtttcaaa

SEQ ID NO: 5339903 - DNA, 16 bp, Homo sapiens
tttgacagacatcctt

SEQ ID NO: 5339904 - DNA, 18 bp, Homo sapiens
tttgacagttattttgat

SEQ ID NO: 5339905 - DNA, 18 bp, Homo sapiens
tttgacataatgagtaat

SEQ ID NO: 5339906 - DNA, 19 bp, Homo sapiens
tttgacatgagtctccaga

SEQ ID NO: 5339907 - DNA, 20 bp, Homo sapiens
tttgacatgagtctccagat

SEQ ID NO: 5339908 - DNA, 16 bp, Homo sapiens
tttgacatggaaatga

SEQ ID NO: 5339909 - DNA, 13 bp, Homo sapiens
tttgacatgtgaa

SEQ ID NO: 5339910 - DNA, 20 bp, Homo sapiens
tttgacatttaataactttg

SEQ ID NO: 5339911 - DNA, 15 bp, Homo sapiens
tttgaccactgacag

SEQ ID NO: 5339912 - DNA, 21 bp, Homo sapiens
tttgaccactgacagcctcca

SEQ ID NO: 5339913 - DNA, 21 bp, Homo sapiens
tttgaccagatctttctcttc

SEQ ID NO: 5339914 - DNA, 14 bp, Homo sapiens
tttgaccagtttct

SEQ ID NO: 5339915 - DNA, 20 bp, Homo sapiens
tttgaccatggaaagaaata

SEQ ID NO: 5339916 - DNA, 21 bp, Homo sapiens
tttgaccccgatatattttag

SEQ ID NO: 5339917 - DNA, 18 bp, Homo sapiens
tttgaccccttcctgtct

SEQ ID NO: 5339918 - DNA, 14 bp, Homo sapiens
tttgacctatttta

SEQ ID NO: 5339919 - DNA, 18 bp, Homo sapiens
tttgacctcacagtgacc

SEQ ID NO: 5339920 - DNA, 17 bp, Homo sapiens
tttgacctcctccctgt

SEQ ID NO: 5339921 - DNA, 23 bp, Homo sapiens
tttgacctgttgggagtgaggat

SEQ ID NO: 5339922 - DNA, 18 bp, Homo sapiens
tttgaccttcatttcatg

SEQ ID NO: 5339923 - DNA, 16 bp, Homo sapiens
tttgacgccatcccag

SEQ ID NO: 5339924 - DNA, 19 bp, Homo sapiens
tttgacgccatcccagccc

SEQ ID NO: 5339925 - DNA, 14 bp, Homo sapiens
tttgacggatgatt

SEQ ID NO: 5339926 - DNA, 18 bp, Homo sapiens
tttgacggccttcttggt

SEQ ID NO: 5339927 - DNA, 19 bp, Homo sapiens
tttgacgggaaacaaaact

SEQ ID NO: 5339928 - DNA, 17 bp, Homo sapiens
tttgacgggaggcctca

SEQ ID NO: 5339929 - DNA, 15 bp, Homo sapiens
tttgacgggccaggc

SEQ ID NO: 5339930 - DNA, 17 bp, Homo sapiens
tttgactaaagctatgt

SEQ ID NO: 5339931 - DNA, 19 bp, Homo sapiens
tttgactaacaagaatgta

SEQ ID NO: 5339932 - DNA, 16 bp, Homo sapiens
tttgactaattttaca

SEQ ID NO: 5339933 - DNA, 21 bp, Homo sapiens
tttgactagggattcaggctg

SEQ ID NO: 5339934 - DNA, 17 bp, Homo sapiens
tttgactcattaatttc

SEQ ID NO: 5339935 - DNA, 13 bp, Homo sapiens
tttgactccttac

SEQ ID NO: 5339936 - DNA, 21 bp, Homo sapiens
tttgactctggcaaagctttt

SEQ ID NO: 5339937 - DNA, 21 bp, Homo sapiens
tttgactctgtcacactaaac

SEQ ID NO: 5339938 - DNA, 22 bp, Homo sapiens
tttgactctgtccaactctgta

SEQ ID NO: 5339939 - DNA, 14 bp, Homo sapiens
tttgactcttccgt

SEQ ID NO: 5339940 - DNA, 19 bp, Homo sapiens
tttgactctttcaaagaaa

SEQ ID NO: 5339941 - DNA, 12 bp, Homo sapiens
tttgactctttt

SEQ ID NO: 5339942 - DNA, 14 bp, Homo sapiens
tttgactgtaatgt

SEQ ID NO: 5339943 - DNA, 15 bp, Homo sapiens
tttgactgtgattta

SEQ ID NO: 5339944 - DNA, 20 bp, Homo sapiens
tttgactgtttttacccata

SEQ ID NO: 5339945 - DNA, 16 bp, Homo sapiens
tttgacttaatgtgat

SEQ ID NO: 5339946 - DNA, 23 bp, Homo sapiens
tttgacttaatgtgattactgct

SEQ ID NO: 5339947 - DNA, 19 bp, Homo sapiens
tttgacttaggtttttagg

SEQ ID NO: 5339948 - DNA, 18 bp, Homo sapiens
tttgacttagtaactttt

SEQ ID NO: 5339949 - DNA, 13 bp, Homo sapiens
tttgacttcagct

SEQ ID NO: 5339950 - DNA, 16 bp, Homo sapiens
tttgacttctgagtga

SEQ ID NO: 5339951 - DNA, 19 bp, Homo sapiens
tttgacttgccactgccat

SEQ ID NO: 5339952 - DNA, 12 bp, Homo sapiens
tttgactttaaa

SEQ ID NO: 5339953 - DNA, 15 bp, Homo sapiens
tttgactttaattta

SEQ ID NO: 5339954 - DNA, 15 bp, Homo sapiens
tttgactttcttctg

SEQ ID NO: 5339955 - DNA, 12 bp, Homo sapiens
tttgactttgta

SEQ ID NO: 5339956 - DNA, 13 bp, Homo sapiens
tttgacttttctg

SEQ ID NO: 5339957 - DNA, 15 bp, Homo sapiens
tttgacttttctgta

SEQ ID NO: 5339958 - DNA, 17 bp, Homo sapiens
tttgacttttctgtaat

SEQ ID NO: 5339959 - DNA, 13 bp, Homo sapiens
tttgagaaaaata

SEQ ID NO: 5339960 - DNA, 14 bp, Homo sapiens
tttgagaaaaatag

SEQ ID NO: 5339961 - DNA, 18 bp, Homo sapiens
tttgagaaaatataataa

SEQ ID NO: 5339962 - DNA, 23 bp, Homo sapiens
tttgagaaaatataataaaagaa

SEQ ID NO: 5339963 - DNA, 21 bp, Homo sapiens
tttgagaaacaacaatttcta

SEQ ID NO: 5339964 - DNA, 19 bp, Homo sapiens
tttgagaaagtacagcagt

SEQ ID NO: 5339965 - DNA, 13 bp, Homo sapiens
tttgagaaagtca

SEQ ID NO: 5339966 - DNA, 20 bp, Homo sapiens
tttgagaaatgaaatattgt

SEQ ID NO: 5339967 - DNA, 21 bp, Homo sapiens
tttgagaactccagctggtgc

SEQ ID NO: 5339968 - DNA, 19 bp, Homo sapiens
tttgagaattttgtttcaa

SEQ ID NO: 5339969 - DNA, 16 bp, Homo sapiens
tttgagacaagccctg

SEQ ID NO: 5339970 - DNA, 17 bp, Homo sapiens
tttgagacaagccctgg

SEQ ID NO: 5339971 - DNA, 22 bp, Homo sapiens
tttgagacagtttcttagcttt

SEQ ID NO: 5339972 - DNA, 20 bp, Homo sapiens
tttgagacataaatgttcac

SEQ ID NO: 5339973 - DNA, 19 bp, Homo sapiens
tttgagaccagcctgggca

SEQ ID NO: 5339974 - DNA, 16 bp, Homo sapiens
tttgagaccaggctgg

SEQ ID NO: 5339975 - DNA, 19 bp, Homo sapiens
tttgagaccaggctgggca

SEQ ID NO: 5339976 - DNA, 15 bp, Homo sapiens
tttgagagactgcca

SEQ ID NO: 5339977 - DNA, 18 bp, Homo sapiens
tttgagagagcagccagg

SEQ ID NO: 5339978 - DNA, 20 bp, Homo sapiens
tttgagagagggggcactgt

SEQ ID NO: 5339979 - DNA, 13 bp, Homo sapiens
tttgagagttcta

SEQ ID NO: 5339980 - DNA, 19 bp, Homo sapiens
tttgagataatttaaccct

SEQ ID NO: 5339981 - DNA, 17 bp, Homo sapiens
tttgagatactattttc

SEQ ID NO: 5339982 - DNA, 17 bp, Homo sapiens
tttgagatctggggagg

SEQ ID NO: 5339983 - DNA, 18 bp, Homo sapiens
tttgagattaagaatgcc

SEQ ID NO: 5339984 - DNA, 23 bp, Homo sapiens
tttgagattaagaatgccaggaa

SEQ ID NO: 5339985 - DNA, 17 bp, Homo sapiens
tttgagatttcagctat

SEQ ID NO: 5339986 - DNA, 22 bp, Homo sapiens
tttgagattttttttccgtgtg

SEQ ID NO: 5339987 - DNA, 16 bp, Homo sapiens
tttgagcaattcattt

SEQ ID NO: 5339988 - DNA, 23 bp, Homo sapiens
tttgagcagctgaataacctgca

SEQ ID NO: 5339989 - DNA, 15 bp, Homo sapiens
tttgagcagggctca

SEQ ID NO: 5339990 - DNA, 13 bp, Homo sapiens
tttgagcatgcac

SEQ ID NO: 5339991 - DNA, 16 bp, Homo sapiens
tttgagcatgggttca

SEQ ID NO: 5339992 - DNA, 19 bp, Homo sapiens
tttgagcgcagagtaaaat

SEQ ID NO: 5339993 - DNA, 21 bp, Homo sapiens
tttgagcgcagagtaaaataa

SEQ ID NO: 5339994 - DNA, 20 bp, Homo sapiens
tttgagctctgcagcccagg

SEQ ID NO: 5339995 - DNA, 17 bp, Homo sapiens
tttgagctgccttccct

SEQ ID NO: 5339996 - DNA, 12 bp, Homo sapiens
tttgaggaaact

SEQ ID NO: 5339997 - DNA, 15 bp, Homo sapiens
tttgaggaaactcat

SEQ ID NO: 5339998 - DNA, 18 bp, Homo sapiens
tttgaggaaatttgcagc

SEQ ID NO: 5339999 - DNA, 22 bp, Homo sapiens
tttgaggaagtggctgtccctg

SEQ ID NO: 5340000 - DNA, 21 bp, Homo sapiens
tttgaggaattatcatgggaa

SEQ ID NO: 5340001 - DNA, 11 bp, Homo sapiens
tttgaggagac

SEQ ID NO: 5340002 - DNA, 22 bp, Homo sapiens
tttgaggagcagcttcagttgt

SEQ ID NO: 5340003 - DNA, 15 bp, Homo sapiens
tttgaggatatattt

SEQ ID NO: 5340004 - DNA, 21 bp, Homo sapiens
tttgaggatatattttcactt

SEQ ID NO: 5340005 - DNA, 22 bp, Homo sapiens
tttgaggatgggatgtattttt

SEQ ID NO: 5340006 - DNA, 16 bp, Homo sapiens
tttgaggattagttta

SEQ ID NO: 5340007 - DNA, 19 bp, Homo sapiens
tttgaggattagtttagaa

SEQ ID NO: 5340008 - DNA, 22 bp, Homo sapiens
tttgaggattagtttagaacag

SEQ ID NO: 5340009 - DNA, 23 bp, Homo sapiens
tttgaggattagtttagaacagg

SEQ ID NO: 5340010 - DNA, 15 bp, Homo sapiens
tttgaggcaaatcta

SEQ ID NO: 5340011 - DNA, 22 bp, Homo sapiens
tttgaggccagtaattcgtttg

SEQ ID NO: 5340012 - DNA, 22 bp, Homo sapiens
tttgaggccgaagctgctgtga

SEQ ID NO: 5340013 - DNA, 21 bp, Homo sapiens
tttgaggctctgtcactgagc

SEQ ID NO: 5340014 - DNA, 15 bp, Homo sapiens
tttgaggctgcagcg

SEQ ID NO: 5340015 - DNA, 16 bp, Homo sapiens
tttgaggcttaaacaa

SEQ ID NO: 5340016 - DNA, 20 bp, Homo sapiens
tttgaggctttcaggtttta

SEQ ID NO: 5340017 - DNA, 18 bp, Homo sapiens
tttgagggactgcctctg

SEQ ID NO: 5340018 - DNA, 20 bp, Homo sapiens
tttgagggactgcctctgcc

SEQ ID NO: 5340019 - DNA, 18 bp, Homo sapiens
tttgagggcccagccagg

SEQ ID NO: 5340020 - DNA, 23 bp, Homo sapiens
tttgagggcccagccaggagcag

SEQ ID NO: 5340021 - DNA, 21 bp, Homo sapiens
tttgaggggcctgtgtggagg

SEQ ID NO: 5340022 - DNA, 21 bp, Homo sapiens
tttgagggtgtatattttctg

SEQ ID NO: 5340023 - DNA, 18 bp, Homo sapiens
tttgaggtagaggaaaat

SEQ ID NO: 5340024 - DNA, 20 bp, Homo sapiens
tttgaggtcaagtaagaaga

SEQ ID NO: 5340025 - DNA, 23 bp, Homo sapiens
tttgaggtcaagtaagaagacat

SEQ ID NO: 5340026 - DNA, 19 bp, Homo sapiens
tttgaggtctacattcttg

SEQ ID NO: 5340027 - DNA, 22 bp, Homo sapiens
tttgaggtctgttctttccaaa

SEQ ID NO: 5340028 - DNA, 16 bp, Homo sapiens
tttgaggtggaagagg

SEQ ID NO: 5340029 - DNA, 18 bp, Homo sapiens
tttgaggttttgtaaaac

SEQ ID NO: 5340030 - DNA, 20 bp, Homo sapiens
tttgagtaaaaagacatttt

SEQ ID NO: 5340031 - DNA, 14 bp, Homo sapiens
tttgagtaaatatt

SEQ ID NO: 5340032 - DNA, 14 bp, Homo sapiens
tttgagtaatgtga

SEQ ID NO: 5340033 - DNA, 14 bp, Homo sapiens
tttgagtacagata

SEQ ID NO: 5340034 - DNA, 12 bp, Homo sapiens
tttgagtcattg

SEQ ID NO: 5340035 - DNA, 15 bp, Homo sapiens
tttgagtcattgact

SEQ ID NO: 5340036 - DNA, 22 bp, Homo sapiens
tttgagtcccttccaggccatc

SEQ ID NO: 5340037 - DNA, 20 bp, Homo sapiens
tttgagtcctaggacttaaa

SEQ ID NO: 5340038 - DNA, 22 bp, Homo sapiens
tttgagtcttttttttttaagt

SEQ ID NO: 5340039 - DNA, 20 bp, Homo sapiens
tttgagtgaattagaccttt

SEQ ID NO: 5340040 - DNA, 13 bp, Homo sapiens
tttgagtgacagc

SEQ ID NO: 5340041 - DNA, 22 bp, Homo sapiens
tttgagtgacagctttctggga

SEQ ID NO: 5340042 - DNA, 15 bp, Homo sapiens
tttgagtgatcatta

SEQ ID NO: 5340043 - DNA, 17 bp, Homo sapiens
tttgagtgccaatttct

SEQ ID NO: 5340044 - DNA, 16 bp, Homo sapiens
tttgagtggatgatgt

SEQ ID NO: 5340045 - DNA, 21 bp, Homo sapiens
tttgagtggatggaggagaaa

SEQ ID NO: 5340046 - DNA, 14 bp, Homo sapiens
tttgagtgtactgt

SEQ ID NO: 5340047 - DNA, 19 bp, Homo sapiens
tttgagtgtcaggctctga

SEQ ID NO: 5340048 - DNA, 14 bp, Homo sapiens
tttgagtgttttaa

SEQ ID NO: 5340049 - DNA, 13 bp, Homo sapiens
tttgagttctaca

SEQ ID NO: 5340050 - DNA, 19 bp, Homo sapiens
tttgagttgattgagaaga

SEQ ID NO: 5340051 - DNA, 17 bp, Homo sapiens
tttgagttggctttgct

SEQ ID NO: 5340052 - DNA, 19 bp, Homo sapiens
tttgagtttcctttaaata

SEQ ID NO: 5340053 - DNA, 15 bp, Homo sapiens
tttgagtttctttca

SEQ ID NO: 5340054 - DNA, 15 bp, Homo sapiens
tttgagtttgcctca

SEQ ID NO: 5340055 - DNA, 18 bp, Homo sapiens
tttgataaaatattttaa

SEQ ID NO: 5340056 - DNA, 19 bp, Homo sapiens
tttgataaagtaataatgt

SEQ ID NO: 5340057 - DNA, 18 bp, Homo sapiens
tttgataaagtttctcag

SEQ ID NO: 5340058 - DNA, 22 bp, Homo sapiens
tttgataaattatgtttgtact

SEQ ID NO: 5340059 - DNA, 12 bp, Homo sapiens
tttgataacatt

SEQ ID NO: 5340060 - DNA, 14 bp, Homo sapiens
tttgctacaaattt

SEQ ID NO: 5340061 - DNA, 16 bp, Homo sapiens
tttgctacaaatttat

SEQ ID NO: 5340062 - DNA, 17 bp, Homo sapiens
tttgctacaaatttatg

SEQ ID NO: 5340063 - DNA, 12 bp, Homo sapiens
tttgctacaata

SEQ ID NO: 5340064 - DNA, 14 bp, Homo sapiens
tttgctacaataaa

SEQ ID NO: 5340065 - DNA, 17 bp, Homo sapiens
tttgctacaataaatgc

SEQ ID NO: 5340066 - DNA, 18 bp, Homo sapiens
tttgctacaataaatgct

SEQ ID NO: 5340067 - DNA, 16 bp, Homo sapiens
tttgctaccaaagaat

SEQ ID NO: 5340068 - DNA, 13 bp, Homo sapiens
tttgctactgagt

SEQ ID NO: 5340069 - DNA, 21 bp, Homo sapiens
tttgctactgttgtaagaatt

SEQ ID NO: 5340070 - DNA, 21 bp, Homo sapiens
tttgctagactctagacaaga

SEQ ID NO: 5340071 - DNA, 15 bp, Homo sapiens
tttgctagatggaat

SEQ ID NO: 5340072 - DNA, 20 bp, Homo sapiens
tttgctagcagtaaaagatg

SEQ ID NO: 5340073 - DNA, 24 bp, Homo sapiens
tttgctagcagtaaaagatgaagt

SEQ ID NO: 5340074 - DNA, 14 bp, Homo sapiens
tttgctaggagccc

SEQ ID NO: 5340075 - DNA, 24 bp, Homo sapiens
tttgctagttggagtgcttgttta

SEQ ID NO: 5340076 - DNA, 20 bp, Homo sapiens
tttgctataatcattagttt

SEQ ID NO: 5340077 - DNA, 22 bp, Homo sapiens
tttgctataatcattagtttta

SEQ ID NO: 5340078 - DNA, 18 bp, Homo sapiens
tttgctatcatatattat

SEQ ID NO: 5340079 - DNA, 13 bp, Homo sapiens
tttgctatctgaa

SEQ ID NO: 5340080 - DNA, 19 bp, Homo sapiens
tttgctatcttaattttgg

SEQ ID NO: 5340081 - DNA, 15 bp, Homo sapiens
tttgctatttgcttt

SEQ ID NO: 5340082 - DNA, 15 bp, Homo sapiens
tttgctcaatatgat

SEQ ID NO: 5340083 - DNA, 17 bp, Homo sapiens
tttgctcagaacacatt

SEQ ID NO: 5340084 - DNA, 19 bp, Homo sapiens
tttgctcagaacacattct

SEQ ID NO: 5340085 - DNA, 18 bp, Homo sapiens
tttgctcagcttctccaa

SEQ ID NO: 5340086 - DNA, 15 bp, Homo sapiens
tttgctcataagtaa

SEQ ID NO: 5340087 - DNA, 19 bp, Homo sapiens
tttgctcataagtaaatgt

SEQ ID NO: 5340088 - DNA, 17 bp, Homo sapiens
tttgctcatatttccca

SEQ ID NO: 5340089 - DNA, 13 bp, Homo sapiens
tttgctcatggaa

SEQ ID NO: 5340090 - DNA, 13 bp, Homo sapiens
tttgctcatgtaa

SEQ ID NO: 5340091 - DNA, 17 bp, Homo sapiens
tttgctcccccatttta

SEQ ID NO: 5340092 - DNA, 21 bp, Homo sapiens
tttgctcccccattttaactt

SEQ ID NO: 5340093 - DNA, 23 bp, Homo sapiens
tttgctccccttccccttccttc

SEQ ID NO: 5340094 - DNA, 13 bp, Homo sapiens
tttgctccctctg

SEQ ID NO: 5340095 - DNA, 14 bp, Homo sapiens
tttgctccctctgt

SEQ ID NO: 5340096 - DNA, 15 bp, Homo sapiens
tttgctctaaaatat

SEQ ID NO: 5340097 - DNA, 20 bp, Homo sapiens
tttgctctaccaaatagtga

SEQ ID NO: 5340098 - DNA, 20 bp, Homo sapiens
tttgctctccctcccttctt

SEQ ID NO: 5340099 - DNA, 22 bp, Homo sapiens
tttgctctctgtgaccctaaga

SEQ ID NO: 5340100 - DNA, 12 bp, Homo sapiens
tttgctctgccc

SEQ ID NO: 5340101 - DNA, 23 bp, Homo sapiens
tttgctctgtgaactatcccctg

SEQ ID NO: 5340102 - DNA, 12 bp, Homo sapiens
tttgctctgtgg

SEQ ID NO: 5340103 - DNA, 15 bp, Homo sapiens
tttgctctgtggtaa

SEQ ID NO: 5340104 - DNA, 23 bp, Homo sapiens
tttgctcttcataataaaccttg

SEQ ID NO: 5340105 - DNA, 13 bp, Homo sapiens
tttgctgaaattt

SEQ ID NO: 5340106 - DNA, 15 bp, Homo sapiens
tttgctgaagaagac

SEQ ID NO: 5340107 - DNA, 11 bp, Homo sapiens
tttgctgaatt

SEQ ID NO: 5340108 - DNA, 13 bp, Homo sapiens
tttgctgaattca

SEQ ID NO: 5340109 - DNA, 12 bp, Homo sapiens
tttgctgacagg

SEQ ID NO: 5340110 - DNA, 21 bp, Homo sapiens
tttgctgatttcccctcttcc

SEQ ID NO: 5340111 - DNA, 13 bp, Homo sapiens
tttgctgatttct

SEQ ID NO: 5340112 - DNA, 15 bp, Homo sapiens
tttgctgcacaaaca

SEQ ID NO: 5340113 - DNA, 17 bp, Homo sapiens
tttgctgcacagcagga

SEQ ID NO: 5340114 - DNA, 17 bp, Homo sapiens
tttgctgcattttacac

SEQ ID NO: 5340115 - DNA, 10 bp, Homo sapiens
tttgctgccc

SEQ ID NO: 5340116 - DNA, 18 bp, Homo sapiens
tttgctgcccctgtctgg

SEQ ID NO: 5340117 - DNA, 12 bp, Homo sapiens
tttgctgccctg

SEQ ID NO: 5340118 - DNA, 13 bp, Homo sapiens
tttgctgccctgg

SEQ ID NO: 5340119 - DNA, 16 bp, Homo sapiens
tttgctgccctggggc

SEQ ID NO: 5340120 - DNA, 15 bp, Homo sapiens
tttgctgccttctgt

SEQ ID NO: 5340121 - DNA, 22 bp, Homo sapiens
tttgctgccttctgtctcttgc

SEQ ID NO: 5340122 - DNA, 20 bp, Homo sapiens
tttgctgctaatattttcct

SEQ ID NO: 5340123 - DNA, 22 bp, Homo sapiens
tttgctgctaccgccctgggct

SEQ ID NO: 5340124 - DNA, 21 bp, Homo sapiens
tttgctgctataattctatac

SEQ ID NO: 5340125 - DNA, 16 bp, Homo sapiens
tttgctgctatgaaaa

SEQ ID NO: 5340126 - DNA, 17 bp, Homo sapiens
tttgctgctatgaaaat

SEQ ID NO: 5340127 - DNA, 19 bp, Homo sapiens
tttgctggaaaatctgtaa

SEQ ID NO: 5340128 - DNA, 14 bp, Homo sapiens
tttgctggaagaaa

SEQ ID NO: 5340129 - DNA, 20 bp, Homo sapiens
tttgctggagtcctgttctc

SEQ ID NO: 5340130 - DNA, 14 bp, Homo sapiens
tttgctggagtgct

SEQ ID NO: 5340131 - DNA, 19 bp, Homo sapiens
tttgctggagtgctggctc

SEQ ID NO: 5340132 - DNA, 12 bp, Homo sapiens
tttgctgggaga

SEQ ID NO: 5340133 - DNA, 19 bp, Homo sapiens
tttgctgggcagtttttct

SEQ ID NO: 5340134 - DNA, 19 bp, Homo sapiens
tttgctggggccgaaagaa

SEQ ID NO: 5340135 - DNA, 20 bp, Homo sapiens
tttgctggttgtaaatactt

SEQ ID NO: 5340136 - DNA, 12 bp, Homo sapiens
tttgctgtaaga

SEQ ID NO: 5340137 - DNA, 18 bp, Homo sapiens
tttgctgtactcttgctg

SEQ ID NO: 5340138 - DNA, 21 bp, Homo sapiens
tttgctgtagaagatggcact

SEQ ID NO: 5340139 - DNA, 23 bp, Homo sapiens
tttgctgtatacaaacaggtgct

SEQ ID NO: 5340140 - DNA, 12 bp, Homo sapiens
tttgctgtcaca

SEQ ID NO: 5340141 - DNA, 21 bp, Homo sapiens
tttgctgtcactttctctctt

SEQ ID NO: 5340142 - DNA, 14 bp, Homo sapiens
tttgctgtctctta

SEQ ID NO: 5340143 - DNA, 14 bp, Homo sapiens
tttgctgtgaacaa

SEQ ID NO: 5340144 - DNA, 19 bp, Homo sapiens
tttgctgtgaggctgtcct

SEQ ID NO: 5340145 - DNA, 12 bp, Homo sapiens
tttgctgtgcca

SEQ ID NO: 5340146 - DNA, 22 bp, Homo sapiens
tttgctgtgtagttccctctgc

SEQ ID NO: 5340147 - DNA, 23 bp, Homo sapiens
tttgctgtgtagttccctctgcc

SEQ ID NO: 5340148 - DNA, 16 bp, Homo sapiens
tttgctgtgtgaaatc

SEQ ID NO: 5340149 - DNA, 18 bp, Homo sapiens
tttgctgtgtgaaatctt

SEQ ID NO: 5340150 - DNA, 21 bp, Homo sapiens
tttgctgtgtgaaatctttca

SEQ ID NO: 5340151 - DNA, 16 bp, Homo sapiens
tttgctgttactgctt

SEQ ID NO: 5340152 - DNA, 12 bp, Homo sapiens
tttgctgttatc

SEQ ID NO: 5340153 - DNA, 20 bp, Homo sapiens
tttgctgttttaaattgcat

SEQ ID NO: 5340154 - DNA, 21 bp, Homo sapiens
tttgcttaaaattttactttt

SEQ ID NO: 5340155 - DNA, 20 bp, Homo sapiens
tttgcttaaatcagttggag

SEQ ID NO: 5340156 - DNA, 12 bp, Homo sapiens
tttgcttaacat

SEQ ID NO: 5340157 - DNA, 16 bp, Homo sapiens
tttgcttaacattaga

SEQ ID NO: 5340158 - DNA, 13 bp, Homo sapiens
tttgcttaatttc

SEQ ID NO: 5340159 - DNA, 14 bp, Homo sapiens
tttgcttacagtga

SEQ ID NO: 5340160 - DNA, 20 bp, Homo sapiens
tttgcttaccaaaagctcag

SEQ ID NO: 5340161 - DNA, 16 bp, Homo sapiens
tttgcttaccttttcc

SEQ ID NO: 5340162 - DNA, 15 bp, Homo sapiens
tttgcttattgttcc

SEQ ID NO: 5340163 - DNA, 17 bp, Homo sapiens
tttgcttatttatattc

SEQ ID NO: 5340164 - DNA, 18 bp, Homo sapiens
tttgcttatttatattca

SEQ ID NO: 5340165 - DNA, 11 bp, Homo sapiens
tttgcttcccc

SEQ ID NO: 5340166 - DNA, 10 bp, Homo sapiens
tttgcttccg

SEQ ID NO: 5340167 - DNA, 20 bp, Homo sapiens
tttgcttcctagtaagtcag

SEQ ID NO: 5340168 - DNA, 21 bp, Homo sapiens
tttgcttccttgcttttatgt

SEQ ID NO: 5340169 - DNA, 11 bp, Homo sapiens
tttgcttctcc

SEQ ID NO: 5340170 - DNA, 12 bp, Homo sapiens
tttgcttctcca

SEQ ID NO: 5340171 - DNA, 14 bp, Homo sapiens
tttgcttgaaagaa

SEQ ID NO: 5340172 - DNA, 17 bp, Homo sapiens
tttgcttgaacacagta

SEQ ID NO: 5340173 - DNA, 20 bp, Homo sapiens
tttgcttgcagtagattttc

SEQ ID NO: 5340174 - DNA, 22 bp, Homo sapiens
tttgcttggaaattccttgccc

SEQ ID NO: 5340175 - DNA, 12 bp, Homo sapiens
tttgcttggcag

SEQ ID NO: 5340176 - DNA, 13 bp, Homo sapiens
tttgcttggtgct

SEQ ID NO: 5340177 - DNA, 18 bp, Homo sapiens
tttgcttgtactgggaca

SEQ ID NO: 5340178 - DNA, 16 bp, Homo sapiens
tttgctttaaaacaag

SEQ ID NO: 5340179 - DNA, 12 bp, Homo sapiens
tttgctttaatg

SEQ ID NO: 5340180 - DNA, 12 bp, Homo sapiens
tttgctttaatt

SEQ ID NO: 5340181 - DNA, 16 bp, Homo sapiens
tttgctttaattgctt

SEQ ID NO: 5340182 - DNA, 17 bp, Homo sapiens
tttgctttaattttagc

SEQ ID NO: 5340183 - DNA, 23 bp, Homo sapiens
tttgctttatgggtttggcttgt

SEQ ID NO: 5340184 - DNA, 14 bp, Homo sapiens
tttgctttcagatg

SEQ ID NO: 5340185 - DNA, 22 bp, Homo sapiens
tttgctttcagatgcagttttc

SEQ ID NO: 5340186 - DNA, 19 bp, Homo sapiens
tttgctttcggtactgtaa

SEQ ID NO: 5340187 - DNA, 14 bp, Homo sapiens
tttgctttcttctt

SEQ ID NO: 5340188 - DNA, 15 bp, Homo sapiens
tttgctttcttgtct

SEQ ID NO: 5340189 - DNA, 17 bp, Homo sapiens
tttgctttgaaaatatt

SEQ ID NO: 5340190 - DNA, 15 bp, Homo sapiens
tttgctttgctttct

SEQ ID NO: 5340191 - DNA, 18 bp, Homo sapiens
tttgctttgctttctgct

SEQ ID NO: 5340192 - DNA, 19 bp, Homo sapiens
tttgctttggttaaaaatg

SEQ ID NO: 5340193 - DNA, 14 bp, Homo sapiens
tttgctttgtttaa

SEQ ID NO: 5340194 - DNA, 17 bp, Homo sapiens
tttgcttttcactggca

SEQ ID NO: 5340195 - DNA, 20 bp, Homo sapiens
tttgcttttgaacgtatgtg

SEQ ID NO: 5340196 - DNA, 18 bp, Homo sapiens
tttgcttttgtatatcct

SEQ ID NO: 5340197 - DNA, 14 bp, Homo sapiens
tttgctttttgctt

SEQ ID NO: 5340198 - DNA, 22 bp, Homo sapiens
tttggaaaaatgggtcttttat

SEQ ID NO: 5340199 - DNA, 21 bp, Homo sapiens
tttggaaaacgatttaattta

SEQ ID NO: 5340200 - DNA, 12 bp, Homo sapiens
tttggaaaataa

SEQ ID NO: 5340201 - DNA, 16 bp, Homo sapiens
tttggaaaataacttt

SEQ ID NO: 5340202 - DNA, 15 bp, Homo sapiens
tttggaaaatgcatt

SEQ ID NO: 5340203 - DNA, 13 bp, Homo sapiens
tttggaaacaaca

SEQ ID NO: 5340204 - DNA, 16 bp, Homo sapiens
tttggaaactaataaa

SEQ ID NO: 5340205 - DNA, 17 bp, Homo sapiens
tttggaaactaataaaa

SEQ ID NO: 5340206 - DNA, 17 bp, Homo sapiens
tttggaaactgctaaat

SEQ ID NO: 5340207 - DNA, 23 bp, Homo sapiens
tttggaaagacctgtgaggggaa

SEQ ID NO: 5340208 - DNA, 16 bp, Homo sapiens
tttggaaagactggac

SEQ ID NO: 5340209 - DNA, 23 bp, Homo sapiens
tttggaaagagcaccctcgagaa

SEQ ID NO: 5340210 - DNA, 20 bp, Homo sapiens
tttggaaagttactgtaaat

SEQ ID NO: 5340211 - DNA, 10 bp, Homo sapiens
tttggaaata

SEQ ID NO: 5340212 - DNA, 19 bp, Homo sapiens
tttggaaatgatttactgg

SEQ ID NO: 5340213 - DNA, 23 bp, Homo sapiens
tttggaaattaggttgaaacata

SEQ ID NO: 5340214 - DNA, 22 bp, Homo sapiens
tttggaaccaaagtctaaactg

SEQ ID NO: 5340215 - DNA, 13 bp, Homo sapiens
tttggaaccttgt

SEQ ID NO: 5340216 - DNA, 15 bp, Homo sapiens
tttggaacgcagttg

SEQ ID NO: 5340217 - DNA, 13 bp, Homo sapiens
tttggaagaattc

SEQ ID NO: 5340218 - DNA, 21 bp, Homo sapiens
tttggaagacatatattatat

SEQ ID NO: 5340219 - DNA, 18 bp, Homo sapiens
tttggaataatttctatt

SEQ ID NO: 5340220 - DNA, 17 bp, Homo sapiens
tttggaatactttttgt

SEQ ID NO: 5340221 - DNA, 16 bp, Homo sapiens
tttggaatatttgaat

SEQ ID NO: 5340222 - DNA, 15 bp, Homo sapiens
tttggaatattttat

SEQ ID NO: 5340223 - DNA, 14 bp, Homo sapiens
tttggaatctagaa

SEQ ID NO: 5340224 - DNA, 16 bp, Homo sapiens
tttggaatctagaaga

SEQ ID NO: 5340225 - DNA, 17 bp, Homo sapiens
tttggaatctagaagaa

SEQ ID NO: 5340226 - DNA, 18 bp, Homo sapiens
tttggaatctagaagaaa

SEQ ID NO: 5340227 - DNA, 20 bp, Homo sapiens
tttggaatctagaagaaatg

SEQ ID NO: 5340228 - DNA, 12 bp, Homo sapiens
tttggaattaca

SEQ ID NO: 5340229 - DNA, 12 bp, Homo sapiens
tttggaattcag

SEQ ID NO: 5340230 - DNA, 21 bp, Homo sapiens
tttggaattgaacgactgtat

SEQ ID NO: 5340231 - DNA, 20 bp, Homo sapiens
tttggaattgaactctctgc

SEQ ID NO: 5340232 - DNA, 13 bp, Homo sapiens
tttggaatttgaa

SEQ ID NO: 5340233 - DNA, 14 bp, Homo sapiens
tttggaattttgtg

SEQ ID NO: 5340234 - DNA, 19 bp, Homo sapiens
tttggacaaaatggaatac

SEQ ID NO: 5340235 - DNA, 13 bp, Homo sapiens
tttggacagctga

SEQ ID NO: 5340236 - DNA, 13 bp, Homo sapiens
tttggacagtggc

SEQ ID NO: 5340237 - DNA, 21 bp, Homo sapiens
tttggaccaaaaaccagtatt

SEQ ID NO: 5340238 - DNA, 19 bp, Homo sapiens
tttggaccctgaggcccag

SEQ ID NO: 5340239 - DNA, 19 bp, Homo sapiens
tttggacctaaatggcctc

SEQ ID NO: 5340240 - DNA, 14 bp, Homo sapiens
tttgtattttcatg

SEQ ID NO: 5340241 - DNA, 15 bp, Homo sapiens
tttgtattttcatga

SEQ ID NO: 5340242 - DNA, 23 bp, Homo sapiens
tttgtattttccaagtgtgcata

SEQ ID NO: 5340243 - DNA, 17 bp, Homo sapiens
tttgtattttgcatact

SEQ ID NO: 5340244 - DNA, 23 bp, Homo sapiens
tttgtattttgtgtgaccaactg

SEQ ID NO: 5340245 - DNA, 17 bp, Homo sapiens
tttgtattttgtttaaa

SEQ ID NO: 5340246 - DNA, 14 bp, Homo sapiens
tttgtatttttaat

SEQ ID NO: 5340247 - DNA, 13 bp, Homo sapiens
tttgtatttttag

SEQ ID NO: 5340248 - DNA, 19 bp, Homo sapiens
tttgtatttttagtagaga

SEQ ID NO: 5340249 - DNA, 14 bp, Homo sapiens
tttgtattttttcc

SEQ ID NO: 5340250 - DNA, 15 bp, Homo sapiens
tttgtattttttcct

SEQ ID NO: 5340251 - DNA, 17 bp, Homo sapiens
tttgtattttttcctta

SEQ ID NO: 5340252 - DNA, 16 bp, Homo sapiens
tttgtatttttttcca

SEQ ID NO: 5340253 - DNA, 18 bp, Homo sapiens
tttgtatttttttccaag

SEQ ID NO: 5340254 - DNA, 17 bp, Homo sapiens
tttgtatttttttgcaa

SEQ ID NO: 5340255 - DNA, 23 bp, Homo sapiens
tttgtcaaaagttggtgttgaca

SEQ ID NO: 5340256 - DNA, 16 bp, Homo sapiens
tttgtcaaactgtaga

SEQ ID NO: 5340257 - DNA, 17 bp, Homo sapiens
tttgtcaaactgtagaa

SEQ ID NO: 5340258 - DNA, 17 bp, Homo sapiens
tttgtcaacttcagttg

SEQ ID NO: 5340259 - DNA, 17 bp, Homo sapiens
tttgtcaatgacagttt

SEQ ID NO: 5340260 - DNA, 23 bp, Homo sapiens
tttgtcacaatcctaacacatta

SEQ ID NO: 5340261 - DNA, 19 bp, Homo sapiens
tttgtcacagctcttgttt

SEQ ID NO: 5340262 - DNA, 16 bp, Homo sapiens
tttgtcacattattta

SEQ ID NO: 5340263 - DNA, 18 bp, Homo sapiens
tttgtcacattatttatt

SEQ ID NO: 5340264 - DNA, 21 bp, Homo sapiens
tttgtcacattatttattaaa

SEQ ID NO: 5340265 - DNA, 15 bp, Homo sapiens
tttgtcacttttcct

SEQ ID NO: 5340266 - DNA, 20 bp, Homo sapiens
tttgtcacttttttataaaa

SEQ ID NO: 5340267 - DNA, 15 bp, Homo sapiens
tttgtcagcatctga

SEQ ID NO: 5340268 - DNA, 21 bp, Homo sapiens
tttgtcagcatctgaccatct

SEQ ID NO: 5340269 - DNA, 23 bp, Homo sapiens
tttgtcagcatctgaccatctgt

SEQ ID NO: 5340270 - DNA, 17 bp, Homo sapiens
tttgtcagtaaatactc

SEQ ID NO: 5340271 - DNA, 20 bp, Homo sapiens
tttgtcagtctgagtcatca

SEQ ID NO: 5340272 - DNA, 14 bp, Homo sapiens
tttgtcagttcttg

SEQ ID NO: 5340273 - DNA, 18 bp, Homo sapiens
tttgtcagtttatcttaa

SEQ ID NO: 5340274 - DNA, 19 bp, Homo sapiens
tttgtcataaaatgctatt

SEQ ID NO: 5340275 - DNA, 22 bp, Homo sapiens
tttgtcatatattcatgtaata

SEQ ID NO: 5340276 - DNA, 20 bp, Homo sapiens
tttgtcatgacagtgcttgc

SEQ ID NO: 5340277 - DNA, 21 bp, Homo sapiens
tttgtcatgacagtgcttgca

SEQ ID NO: 5340278 - DNA, 20 bp, Homo sapiens
tttgtcatgttatgcagtga

SEQ ID NO: 5340279 - DNA, 18 bp, Homo sapiens
tttgtcattatgatttca

SEQ ID NO: 5340280 - DNA, 14 bp, Homo sapiens
tttgtcattttcat

SEQ ID NO: 5340281 - DNA, 15 bp, Homo sapiens
tttgtcattttcatt

SEQ ID NO: 5340282 - DNA, 12 bp, Homo sapiens
tttgtcattttg

SEQ ID NO: 5340283 - DNA, 17 bp, Homo sapiens
tttgtcattttgaagct

SEQ ID NO: 5340284 - DNA, 14 bp, Homo sapiens
tttgtccaatgtgg

SEQ ID NO: 5340285 - DNA, 24 bp, Homo sapiens
tttgtccacccacttagtccactc

SEQ ID NO: 5340286 - DNA, 18 bp, Homo sapiens
tttgtccatcagattctg

SEQ ID NO: 5340287 - DNA, 18 bp, Homo sapiens
tttgtccatcttgtttca

SEQ ID NO: 5340288 - DNA, 21 bp, Homo sapiens
tttgtccatcttgtttcattt

SEQ ID NO: 5340289 - DNA, 22 bp, Homo sapiens
tttgtccattccattaataact

SEQ ID NO: 5340290 - DNA, 16 bp, Homo sapiens
tttgtccatttgtaaa

SEQ ID NO: 5340291 - DNA, 11 bp, Homo sapiens
tttgtcccaga

SEQ ID NO: 5340292 - DNA, 19 bp, Homo sapiens
tttgtcccagcctggggct

SEQ ID NO: 5340293 - DNA, 18 bp, Homo sapiens
tttgtcccagtcagaaat

SEQ ID NO: 5340294 - DNA, 22 bp, Homo sapiens
tttgtcccatctctaccccctc

SEQ ID NO: 5340295 - DNA, 15 bp, Homo sapiens
tttgtcccatttcct

SEQ ID NO: 5340296 - DNA, 16 bp, Homo sapiens
tttgtccccagggccc

SEQ ID NO: 5340297 - DNA, 17 bp, Homo sapiens
tttgtcccctcacctcc

SEQ ID NO: 5340298 - DNA, 14 bp, Homo sapiens
tttgtcccctgctt

SEQ ID NO: 5340299 - DNA, 14 bp, Homo sapiens
tttgtccctgttgg

SEQ ID NO: 5340300 - DNA, 17 bp, Homo sapiens
tttgtcctaaaacacct

SEQ ID NO: 5340301 - DNA, 18 bp, Homo sapiens
tttgtcctcatgtgagaa

SEQ ID NO: 5340302 - DNA, 12 bp, Homo sapiens
tttgtcctgaat

SEQ ID NO: 5340303 - DNA, 19 bp, Homo sapiens
tttgtcctgcagtgctcat

SEQ ID NO: 5340304 - DNA, 17 bp, Homo sapiens
tttgtcctttatgtatt

SEQ ID NO: 5340305 - DNA, 17 bp, Homo sapiens
tttgtccttttatttct

SEQ ID NO: 5340306 - DNA, 18 bp, Homo sapiens
tttgtcgagtttacttca

SEQ ID NO: 5340307 - DNA, 18 bp, Homo sapiens
tttgtcgggttctcccat

SEQ ID NO: 5340308 - DNA, 11 bp, Homo sapiens
tttgtctaaaa

SEQ ID NO: 5340309 - DNA, 14 bp, Homo sapiens
tttgtctaaaacaa

SEQ ID NO: 5340310 - DNA, 16 bp, Homo sapiens
tttgtctaaaacaata

SEQ ID NO: 5340311 - DNA, 15 bp, Homo sapiens
tttgtctaaaatgcc

SEQ ID NO: 5340312 - DNA, 13 bp, Homo sapiens
tttgtctaaacaa

SEQ ID NO: 5340313 - DNA, 17 bp, Homo sapiens
tttgtctacgtttagtt

SEQ ID NO: 5340314 - DNA, 11 bp, Homo sapiens
tttgtctactt

SEQ ID NO: 5340315 - DNA, 16 bp, Homo sapiens
tttgtctatgaagttg

SEQ ID NO: 5340316 - DNA, 20 bp, Homo sapiens
tttgtctatgaagttgctgt

SEQ ID NO: 5340317 - DNA, 22 bp, Homo sapiens
tttgtctcacttttaaaaagaa

SEQ ID NO: 5340318 - DNA, 21 bp, Homo sapiens
tttgtctcattttgtatgtat

SEQ ID NO: 5340319 - DNA, 15 bp, Homo sapiens
tttgtctccaaagaa

SEQ ID NO: 5340320 - DNA, 14 bp, Homo sapiens
tttgtctcctacct

SEQ ID NO: 5340321 - DNA, 18 bp, Homo sapiens
tttgtctcctactctgtg

SEQ ID NO: 5340322 - DNA, 19 bp, Homo sapiens
tttgtctcctactctgtgt

SEQ ID NO: 5340323 - DNA, 21 bp, Homo sapiens
tttgtctctcctggctgggcc

SEQ ID NO: 5340324 - DNA, 14 bp, Homo sapiens
tttgtctcttacat

SEQ ID NO: 5340325 - DNA, 12 bp, Homo sapiens
tttgtctcttct

SEQ ID NO: 5340326 - DNA, 20 bp, Homo sapiens
tttgtctgatattggtgtga

SEQ ID NO: 5340327 - DNA, 14 bp, Homo sapiens
tttgtctggcctca

SEQ ID NO: 5340328 - DNA, 23 bp, Homo sapiens
tttgtctgtacatactggcctct

SEQ ID NO: 5340329 - DNA, 13 bp, Homo sapiens
tttgtctgtctcc

SEQ ID NO: 5340330 - DNA, 17 bp, Homo sapiens
tttgtctgtcttcatag

SEQ ID NO: 5340331 - DNA, 14 bp, Homo sapiens
tttgtctgtgtgct

SEQ ID NO: 5340332 - DNA, 18 bp, Homo sapiens
tttgtctgtgtgctacta

SEQ ID NO: 5340333 - DNA, 17 bp, Homo sapiens
tttgtctgtttttactc

SEQ ID NO: 5340334 - DNA, 13 bp, Homo sapiens
tttgtcttaaaaa

SEQ ID NO: 5340335 - DNA, 14 bp, Homo sapiens
tttgtcttaaaaag

SEQ ID NO: 5340336 - DNA, 23 bp, Homo sapiens
tttgtcttaaaaagtggaaaaat

SEQ ID NO: 5340337 - DNA, 20 bp, Homo sapiens
tttgtcttatatatatttct

SEQ ID NO: 5340338 - DNA, 15 bp, Homo sapiens
tttgtcttattctta

SEQ ID NO: 5340339 - DNA, 15 bp, Homo sapiens
tttgtcttcccttct

SEQ ID NO: 5340340 - DNA, 20 bp, Homo sapiens
tttgtcttcccttctttgca

SEQ ID NO: 5340341 - DNA, 13 bp, Homo sapiens
tttgtcttgcatt

SEQ ID NO: 5340342 - DNA, 15 bp, Homo sapiens
tttgtcttgcatttt

SEQ ID NO: 5340343 - DNA, 20 bp, Homo sapiens
tttgtcttgcgggtctgtca

SEQ ID NO: 5340344 - DNA, 16 bp, Homo sapiens
tttgtcttgtacttct

SEQ ID NO: 5340345 - DNA, 19 bp, Homo sapiens
tttgtcttgtacttctgtg

SEQ ID NO: 5340346 - DNA, 20 bp, Homo sapiens
tttgtcttgtacttctgtgt

SEQ ID NO: 5340347 - DNA, 23 bp, Homo sapiens
tttgtcttgtacttctgtgttca

SEQ ID NO: 5340348 - DNA, 21 bp, Homo sapiens
tttgtcttgtgtttctttagt

SEQ ID NO: 5340349 - DNA, 18 bp, Homo sapiens
tttgtctttctgcagaaa

SEQ ID NO: 5340350 - DNA, 17 bp, Homo sapiens
tttgtctttttccttta

SEQ ID NO: 5340351 - DNA, 18 bp, Homo sapiens
tttgtgaaacagacttgt

SEQ ID NO: 5340352 - DNA, 21 bp, Homo sapiens
tttgtgaaacagttgctgtga

SEQ ID NO: 5340353 - DNA, 14 bp, Homo sapiens
tttgtgaaagacat

SEQ ID NO: 5340354 - DNA, 22 bp, Homo sapiens
tttgtgaaagtgccaaaataaa

SEQ ID NO: 5340355 - DNA, 20 bp, Homo sapiens
tttgtgaaatttttcatatt

SEQ ID NO: 5340356 - DNA, 21 bp, Homo sapiens
tttgtgaaatttttcatattt

SEQ ID NO: 5340357 - DNA, 22 bp, Homo sapiens
tttgtgaacaagtccctgtaat

SEQ ID NO: 5340358 - DNA, 16 bp, Homo sapiens
tttgtgaacattctgt

SEQ ID NO: 5340359 - DNA, 20 bp, Homo sapiens
tttgtgaacgctgtgatgct

SEQ ID NO: 5340360 - DNA, 21 bp, Homo sapiens
tttgtgaacgctgtgatgctg

SEQ ID NO: 5340361 - DNA, 12 bp, Homo sapiens
tttgtgaactgg

SEQ ID NO: 5340362 - DNA, 15 bp, Homo sapiens
tttgtgaactggaag

SEQ ID NO: 5340363 - DNA, 21 bp, Homo sapiens
tttgtgaactggaagaaagca

SEQ ID NO: 5340364 - DNA, 20 bp, Homo sapiens
tttgtgaaggtggaaataaa

SEQ ID NO: 5340365 - DNA, 18 bp, Homo sapiens
tttgtgaagtgattgaca

SEQ ID NO: 5340366 - DNA, 19 bp, Homo sapiens
tttgtgaagtgattgacat

SEQ ID NO: 5340367 - DNA, 23 bp, Homo sapiens
tttgtgaatggattggattattt

SEQ ID NO: 5340368 - DNA, 15 bp, Homo sapiens
tttgtgaatttgcaa

SEQ ID NO: 5340369 - DNA, 15 bp, Homo sapiens
tttgtgacattcctt

SEQ ID NO: 5340370 - DNA, 22 bp, Homo sapiens
tttgtgactaattgtataacag

SEQ ID NO: 5340371 - DNA, 21 bp, Homo sapiens
tttgtgactagaaattcttaa

SEQ ID NO: 5340372 - DNA, 22 bp, Homo sapiens
tttgtgactatatagagatgtt

SEQ ID NO: 5340373 - DNA, 23 bp, Homo sapiens
tttgtgactctttcctaaagcca

SEQ ID NO: 5340374 - DNA, 22 bp, Homo sapiens
tttgtgagaaacatctcaataa

SEQ ID NO: 5340375 - DNA, 14 bp, Homo sapiens
tttgtgagaagaaa

SEQ ID NO: 5340376 - DNA, 16 bp, Homo sapiens
tttgtgagcaggctgt

SEQ ID NO: 5340377 - DNA, 22 bp, Homo sapiens
tttgtgagcatgggtgtgccct

SEQ ID NO: 5340378 - DNA, 18 bp, Homo sapiens
tttgtgagccttgctgcc

SEQ ID NO: 5340379 - DNA, 13 bp, Homo sapiens
tttgtgagtattc

SEQ ID NO: 5340380 - DNA, 19 bp, Homo sapiens
tttgtgatatggagccctg

SEQ ID NO: 5340381 - DNA, 23 bp, Homo sapiens
tttgtgatattaaatttcaaatg

SEQ ID NO: 5340382 - DNA, 20 bp, Homo sapiens
tttgtgatctgtccttccaa

SEQ ID NO: 5340383 - DNA, 14 bp, Homo sapiens
tttgtgatgaaaag

SEQ ID NO: 5340384 - DNA, 22 bp, Homo sapiens
tttgtgatgaaaaggcagcatt

SEQ ID NO: 5340385 - DNA, 12 bp, Homo sapiens
tttgtgatgaat

SEQ ID NO: 5340386 - DNA, 15 bp, Homo sapiens
tttgtgatgaataaa

SEQ ID NO: 5340387 - DNA, 23 bp, Homo sapiens
tttgtgatgaataaaataattat

SEQ ID NO: 5340388 - DNA, 24 bp, Homo sapiens
tttgtgatgaatctacatttgttt

SEQ ID NO: 5340389 - DNA, 17 bp, Homo sapiens
tttgtgatgatgctgtg

SEQ ID NO: 5340390 - DNA, 18 bp, Homo sapiens
tttgtgatgatgctgtga

SEQ ID NO: 5340391 - DNA, 19 bp, Homo sapiens
tttgtgatggagtgctgtt

SEQ ID NO: 5340392 - DNA, 21 bp, Homo sapiens
tttgtgatggagtgctgtttt

SEQ ID NO: 5340393 - DNA, 17 bp, Homo sapiens
tttgtgatggtctctgg

SEQ ID NO: 5340394 - DNA, 15 bp, Homo sapiens
tttgtgattcaatct

SEQ ID NO: 5340395 - DNA, 21 bp, Homo sapiens
tttgtgattcttccagatgtg

SEQ ID NO: 5340396 - DNA, 21 bp, Homo sapiens
tttgtgcaaacatggagaaat

SEQ ID NO: 5340397 - DNA, 18 bp, Homo sapiens
tttgtgcaacataacaat

SEQ ID NO: 5340398 - DNA, 15 bp, Homo sapiens
tttgtgcagaatctc

SEQ ID NO: 5340399 - DNA, 14 bp, Homo sapiens
tttgtgcagtgatt

SEQ ID NO: 5340400 - DNA, 21 bp, Homo sapiens
tttgtgcatgtatattactga

SEQ ID NO: 5340401 - DNA, 18 bp, Homo sapiens
tttgtgcattctttggta

SEQ ID NO: 5340402 - DNA, 20 bp, Homo sapiens
tttgtgccatgttcaaaaga

SEQ ID NO: 5340403 - DNA, 20 bp, Homo sapiens
tttgtgcctggcttctttct

SEQ ID NO: 5340404 - DNA, 23 bp, Homo sapiens
tttgtgccttaaaaggagagaag

SEQ ID NO: 5340405 - DNA, 19 bp, Homo sapiens
tttgtgctaaatcctagca

SEQ ID NO: 5340406 - DNA, 21 bp, Homo sapiens
tttgtgctagaaattttcaag

SEQ ID NO: 5340407 - DNA, 20 bp, Homo sapiens
tttgtgctatagtatttgat

SEQ ID NO: 5340408 - DNA, 16 bp, Homo sapiens
tttgtgctccattttt

SEQ ID NO: 5340409 - DNA, 19 bp, Homo sapiens
tttgtgctggtgtatgtgt

SEQ ID NO: 5340410 - DNA, 14 bp, Homo sapiens
tttgtgctgtgggc

SEQ ID NO: 5340411 - DNA, 17 bp, Homo sapiens
tttgtgctgtgggcagc

SEQ ID NO: 5340412 - DNA, 20 bp, Homo sapiens
tttgtgcttgtcattccaga

SEQ ID NO: 5340413 - DNA, 18 bp, Homo sapiens
tttgtgcttgttcttcct

SEQ ID NO: 5340414 - DNA, 23 bp, Homo sapiens
tttgtgcttttagtaaaaacatt

SEQ ID NO: 5340415 - DNA, 23 bp, Homo sapiens
tttgtggactgtgggtctggact

SEQ ID NO: 5340416 - DNA, 23 bp, Homo sapiens
ttttaaaccagggatgtctgttg

SEQ ID NO: 5340417 - DNA, 17 bp, Homo sapiens
ttttaaacgtggattgt

SEQ ID NO: 5340418 - DNA, 23 bp, Homo sapiens
ttttaaacgttaaaagtgtacaa

SEQ ID NO: 5340419 - DNA, 14 bp, Homo sapiens
ttttaaactagtaa

SEQ ID NO: 5340420 - DNA, 21 bp, Homo sapiens
ttttaaactctttttgggtcc

SEQ ID NO: 5340421 - DNA, 14 bp, Homo sapiens
ttttaaactgatgt

SEQ ID NO: 5340422 - DNA, 16 bp, Homo sapiens
ttttaaactgatgtat

SEQ ID NO: 5340423 - DNA, 15 bp, Homo sapiens
ttttaaactgcagtt

SEQ ID NO: 5340424 - DNA, 14 bp, Homo sapiens
ttttaaactgtaca

SEQ ID NO: 5340425 - DNA, 23 bp, Homo sapiens
ttttaaagaaaaaaattgaaatg

SEQ ID NO: 5340426 - DNA, 19 bp, Homo sapiens
ttttaaagaaaagatgaaa

SEQ ID NO: 5340427 - DNA, 17 bp, Homo sapiens
ttttaaagaaaatgtgt

SEQ ID NO: 5340428 - DNA, 22 bp, Homo sapiens
ttttaaagaagaagtggatcta

SEQ ID NO: 5340429 - DNA, 16 bp, Homo sapiens
ttttaaagaagtctct

SEQ ID NO: 5340430 - DNA, 12 bp, Homo sapiens
ttttaaagaatt

SEQ ID NO: 5340431 - DNA, 14 bp, Homo sapiens
ttttaaagaatttc

SEQ ID NO: 5340432 - DNA, 13 bp, Homo sapiens
ttttaaagacatg

SEQ ID NO: 5340433 - DNA, 21 bp, Homo sapiens
ttttaaagacccaacttgcca

SEQ ID NO: 5340434 - DNA, 18 bp, Homo sapiens
ttttaaagacccctaacc

SEQ ID NO: 5340435 - DNA, 21 bp, Homo sapiens
ttttaaagacctgacaccttt

SEQ ID NO: 5340436 - DNA, 20 bp, Homo sapiens
ttttaaagatctgtaagtaa

SEQ ID NO: 5340437 - DNA, 11 bp, Homo sapiens
ttttaaagatt

SEQ ID NO: 5340438 - DNA, 18 bp, Homo sapiens
ttttaaagctttccccca

SEQ ID NO: 5340439 - DNA, 20 bp, Homo sapiens
ttttaaaggaatgtgaaatt

SEQ ID NO: 5340440 - DNA, 19 bp, Homo sapiens
ttttaaaggcattagagtc

SEQ ID NO: 5340441 - DNA, 20 bp, Homo sapiens
ttttaaaggtagagatgtgt

SEQ ID NO: 5340442 - DNA, 21 bp, Homo sapiens
ttttaaaggtagagatgtgtg

SEQ ID NO: 5340443 - DNA, 18 bp, Homo sapiens
ttttaaaggtggattttg

SEQ ID NO: 5340444 - DNA, 22 bp, Homo sapiens
ttttaaaggttggaatctttta

SEQ ID NO: 5340445 - DNA, 22 bp, Homo sapiens
ttttaaagtaaacttgtgtatt

SEQ ID NO: 5340446 - DNA, 12 bp, Homo sapiens
ttttaaagtaat

SEQ ID NO: 5340447 - DNA, 14 bp, Homo sapiens
ttttaaagtacttt

SEQ ID NO: 5340448 - DNA, 21 bp, Homo sapiens
ttttaaagtcttgctgtggtc

SEQ ID NO: 5340449 - DNA, 13 bp, Homo sapiens
ttttaaagtgatt

SEQ ID NO: 5340450 - DNA, 19 bp, Homo sapiens
ttttaaagtgattaaacgt

SEQ ID NO: 5340451 - DNA, 12 bp, Homo sapiens
ttttaaagtgta

SEQ ID NO: 5340452 - DNA, 13 bp, Homo sapiens
ttttaaagtgttt

SEQ ID NO: 5340453 - DNA, 17 bp, Homo sapiens
ttttaaagttagtatct

SEQ ID NO: 5340454 - DNA, 12 bp, Homo sapiens
ttttaaagttca

SEQ ID NO: 5340455 - DNA, 22 bp, Homo sapiens
ttttaaagttcttattttagta

SEQ ID NO: 5340456 - DNA, 20 bp, Homo sapiens
ttttaaagtttgttcactta

SEQ ID NO: 5340457 - DNA, 17 bp, Homo sapiens
ttttaaataaaagcaca

SEQ ID NO: 5340458 - DNA, 23 bp, Homo sapiens
ttttaaataaactttttttcaat

SEQ ID NO: 5340459 - DNA, 13 bp, Homo sapiens
ttttaaataacct

SEQ ID NO: 5340460 - DNA, 12 bp, Homo sapiens
ttttaaataaga

SEQ ID NO: 5340461 - DNA, 16 bp, Homo sapiens
ttttaaataatgtatt

SEQ ID NO: 5340462 - DNA, 13 bp, Homo sapiens
ttttaaatatatt

SEQ ID NO: 5340463 - DNA, 18 bp, Homo sapiens
ttttaaatatgaacaaag

SEQ ID NO: 5340464 - DNA, 15 bp, Homo sapiens
ttttaaatattttct

SEQ ID NO: 5340465 - DNA, 17 bp, Homo sapiens
ttttaaatattttctat

SEQ ID NO: 5340466 - DNA, 19 bp, Homo sapiens
ttttaaatcaaaaactttt

SEQ ID NO: 5340467 - DNA, 13 bp, Homo sapiens
ttttaaatcaagg

SEQ ID NO: 5340468 - DNA, 12 bp, Homo sapiens
ttttaaatcatc

SEQ ID NO: 5340469 - DNA, 12 bp, Homo sapiens
ttttaaatcatt

SEQ ID NO: 5340470 - DNA, 15 bp, Homo sapiens
ttttaaatcattcat

SEQ ID NO: 5340471 - DNA, 15 bp, Homo sapiens
ttttaaatcatttca

SEQ ID NO: 5340472 - DNA, 18 bp, Homo sapiens
ttttaaatcctgttgaaa

SEQ ID NO: 5340473 - DNA, 21 bp, Homo sapiens
ttttaaatcgccttgaacaaa

SEQ ID NO: 5340474 - DNA, 18 bp, Homo sapiens
ttttaaatgatcatgaaa

SEQ ID NO: 5340475 - DNA, 12 bp, Homo sapiens
ttttaaatgcac

SEQ ID NO: 5340476 - DNA, 22 bp, Homo sapiens
ttttaaatggacaatggactgt

SEQ ID NO: 5340477 - DNA, 15 bp, Homo sapiens
ttttaaatgtggaat

SEQ ID NO: 5340478 - DNA, 13 bp, Homo sapiens
ttttaaatgtgtt

SEQ ID NO: 5340479 - DNA, 21 bp, Homo sapiens
ttttaaattataacttaaaat

SEQ ID NO: 5340480 - DNA, 16 bp, Homo sapiens
ttttaaattataagga

SEQ ID NO: 5340481 - DNA, 19 bp, Homo sapiens
ttttaaattatgttttact

SEQ ID NO: 5340482 - DNA, 19 bp, Homo sapiens
ttttaaattctgctcctga

SEQ ID NO: 5340483 - DNA, 18 bp, Homo sapiens
ttttaaattgtcataatt

SEQ ID NO: 5340484 - DNA, 20 bp, Homo sapiens
ttttaaatttgccagtttta

SEQ ID NO: 5340485 - DNA, 13 bp, Homo sapiens
ttttaaattttct

SEQ ID NO: 5340486 - DNA, 15 bp, Homo sapiens
ttttaaattttctcc

SEQ ID NO: 5340487 - DNA, 17 bp, Homo sapiens
ttttaaattttcttcag

SEQ ID NO: 5340488 - DNA, 16 bp, Homo sapiens
ttttaaattttgtaat

SEQ ID NO: 5340489 - DNA, 18 bp, Homo sapiens
ttttaacaaatgttttca

SEQ ID NO: 5340490 - DNA, 19 bp, Homo sapiens
ttttaacaagaagatgaat

SEQ ID NO: 5340491 - DNA, 19 bp, Homo sapiens
ttttaacaataactactgt

SEQ ID NO: 5340492 - DNA, 22 bp, Homo sapiens
ttttaacaataactactgtgtt

SEQ ID NO: 5340493 - DNA, 19 bp, Homo sapiens
ttttaacacacataaagga

SEQ ID NO: 5340494 - DNA, 18 bp, Homo sapiens
ttttaacactttgtatta

SEQ ID NO: 5340495 - DNA, 12 bp, Homo sapiens
ttttaacagcat

SEQ ID NO: 5340496 - DNA, 21 bp, Homo sapiens
ttttaacagcatgctgctttg

SEQ ID NO: 5340497 - DNA, 23 bp, Homo sapiens
ttttaacagttagtaatggtgct

SEQ ID NO: 5340498 - DNA, 23 bp, Homo sapiens
ttttaacatagagaactgtcacc

SEQ ID NO: 5340499 - DNA, 12 bp, Homo sapiens
ttttaacatctt

SEQ ID NO: 5340500 - DNA, 15 bp, Homo sapiens
ttttaacatgtgtta

SEQ ID NO: 5340501 - DNA, 12 bp, Homo sapiens
ttttaaccaaag

SEQ ID NO: 5340502 - DNA, 16 bp, Homo sapiens
ttttaaccaaaggtga

SEQ ID NO: 5340503 - DNA, 21 bp, Homo sapiens
ttttaaccaaggaggggccag

SEQ ID NO: 5340504 - DNA, 17 bp, Homo sapiens
ttttaaccatccttaaa

SEQ ID NO: 5340505 - DNA, 16 bp, Homo sapiens
ttttaaccccgtcaac

SEQ ID NO: 5340506 - DNA, 20 bp, Homo sapiens
ttttaaccccgtcaacaaat

SEQ ID NO: 5340507 - DNA, 20 bp, Homo sapiens
ttttaaccctttaatgaact

SEQ ID NO: 5340508 - DNA, 16 bp, Homo sapiens
ttttaacctaatatca

SEQ ID NO: 5340509 - DNA, 18 bp, Homo sapiens
ttttaacctctttaagta

SEQ ID NO: 5340510 - DNA, 20 bp, Homo sapiens
ttttaactaaattttaaagc

SEQ ID NO: 5340511 - DNA, 15 bp, Homo sapiens
ttttaactacataaa

SEQ ID NO: 5340512 - DNA, 23 bp, Homo sapiens
ttttaactacctcaactggtcag

SEQ ID NO: 5340513 - DNA, 13 bp, Homo sapiens
ttttaactcaata

SEQ ID NO: 5340514 - DNA, 14 bp, Homo sapiens
ttttaactctgtct

SEQ ID NO: 5340515 - DNA, 20 bp, Homo sapiens
ttttaactgatttaacactt

SEQ ID NO: 5340516 - DNA, 14 bp, Homo sapiens
ttttaactgctgca

SEQ ID NO: 5340517 - DNA, 18 bp, Homo sapiens
ttttaactgcttcaagtg

SEQ ID NO: 5340518 - DNA, 15 bp, Homo sapiens
ttttaactggcatgt

SEQ ID NO: 5340519 - DNA, 14 bp, Homo sapiens
ttttaacttctata

SEQ ID NO: 5340520 - DNA, 13 bp, Homo sapiens
ttttaacttcttt

SEQ ID NO: 5340521 - DNA, 13 bp, Homo sapiens
ttttaacttgaaa

SEQ ID NO: 5340522 - DNA, 23 bp, Homo sapiens
ttttaacttgaaaagattgcaaa

SEQ ID NO: 5340523 - DNA, 16 bp, Homo sapiens
ttttaactttaagttt

SEQ ID NO: 5340524 - DNA, 19 bp, Homo sapiens
ttttaactttaagtttcag

SEQ ID NO: 5340525 - DNA, 14 bp, Homo sapiens
ttttaactttgaaa

SEQ ID NO: 5340526 - DNA, 16 bp, Homo sapiens
ttttaactttgaaagt

SEQ ID NO: 5340527 - DNA, 20 bp, Homo sapiens
ttttaactttgtggtaactt

SEQ ID NO: 5340528 - DNA, 14 bp, Homo sapiens
ttttaactttgttt

SEQ ID NO: 5340529 - DNA, 17 bp, Homo sapiens
ttttaacttttaattta

SEQ ID NO: 5340530 - DNA, 16 bp, Homo sapiens
ttttaactttttctaa

SEQ ID NO: 5340531 - DNA, 18 bp, Homo sapiens
ttttaagaaaaaataaaa

SEQ ID NO: 5340532 - DNA, 12 bp, Homo sapiens
ttttaagaaaca

SEQ ID NO: 5340533 - DNA, 12 bp, Homo sapiens
ttttaagaaaga

SEQ ID NO: 5340534 - DNA, 22 bp, Homo sapiens
ttttaagaaagaaatactgtat

SEQ ID NO: 5340535 - DNA, 18 bp, Homo sapiens
ttttaagaaaggaagcaa

SEQ ID NO: 5340536 - DNA, 13 bp, Homo sapiens
ttttaagaaatgt

SEQ ID NO: 5340537 - DNA, 15 bp, Homo sapiens
ttttaagaaggcatt

SEQ ID NO: 5340538 - DNA, 21 bp, Homo sapiens
ttttaagacattttcatgctt

SEQ ID NO: 5340539 - DNA, 13 bp, Homo sapiens
ttttaagacgtga

SEQ ID NO: 5340540 - DNA, 22 bp, Homo sapiens
ttttaagacgtgaatgtctcag

SEQ ID NO: 5340541 - DNA, 17 bp, Homo sapiens
ttttaagactgtaatgt

SEQ ID NO: 5340542 - DNA, 22 bp, Homo sapiens
ttttaagactgtaatgtgtact

SEQ ID NO: 5340543 - DNA, 12 bp, Homo sapiens
ttttaagagaca

SEQ ID NO: 5340544 - DNA, 20 bp, Homo sapiens
ttttaagaggctttggccca

SEQ ID NO: 5340545 - DNA, 14 bp, Homo sapiens
ttttaagatagtgt

SEQ ID NO: 5340546 - DNA, 21 bp, Homo sapiens
ttttaagattccttttcttgt

SEQ ID NO: 5340547 - DNA, 22 bp, Homo sapiens
ttttaagattccttttcttgtt

SEQ ID NO: 5340548 - DNA, 12 bp, Homo sapiens
ttttaagatttc

SEQ ID NO: 5340549 - DNA, 12 bp, Homo sapiens
ttttaagatttt

SEQ ID NO: 5340550 - DNA, 18 bp, Homo sapiens
ttttaagatttttctcaa

SEQ ID NO: 5340551 - DNA, 16 bp, Homo sapiens
ttttaagcaaatgcat

SEQ ID NO: 5340552 - DNA, 16 bp, Homo sapiens
ttttaagcagactcag

SEQ ID NO: 5340553 - DNA, 23 bp, Homo sapiens
ttttaagcagactcagctgctat

SEQ ID NO: 5340554 - DNA, 16 bp, Homo sapiens
ttttaagcattactct

SEQ ID NO: 5340555 - DNA, 22 bp, Homo sapiens
ttttaagcattactcttgtaag

SEQ ID NO: 5340556 - DNA, 22 bp, Homo sapiens
ttttaagccaatataatgggct

SEQ ID NO: 5340557 - DNA, 23 bp, Homo sapiens
ttttaagcccatcaattatagaa

SEQ ID NO: 5340558 - DNA, 16 bp, Homo sapiens
ttttaagcctttgaag

SEQ ID NO: 5340559 - DNA, 21 bp, Homo sapiens
ttttaagcgtaattttgccaa

SEQ ID NO: 5340560 - DNA, 18 bp, Homo sapiens
ttttaagctaaaatgtta

SEQ ID NO: 5340561 - DNA, 21 bp, Homo sapiens
ttttaagctaggaaaagaaat

SEQ ID NO: 5340562 - DNA, 17 bp, Homo sapiens
ttttaagctatcagcaa

SEQ ID NO: 5340563 - DNA, 19 bp, Homo sapiens
ttttaagctccatgtgcat

SEQ ID NO: 5340564 - DNA, 15 bp, Homo sapiens
ttttaagctctgagc

SEQ ID NO: 5340565 - DNA, 17 bp, Homo sapiens
ttttaagcttgaagatt

SEQ ID NO: 5340566 - DNA, 12 bp, Homo sapiens
ttttaaggaaac

SEQ ID NO: 5340567 - DNA, 16 bp, Homo sapiens
ttttaaggactgactg

SEQ ID NO: 5340568 - DNA, 19 bp, Homo sapiens
ttttaaggactgactgagg

SEQ ID NO: 5340569 - DNA, 20 bp, Homo sapiens
ttttaaggcaaataaagatg

SEQ ID NO: 5340570 - DNA, 15 bp, Homo sapiens
ttttaagggggaaaa

SEQ ID NO: 5340571 - DNA, 20 bp, Homo sapiens
ttttaaggtctaatcagtga

SEQ ID NO: 5340572 - DNA, 21 bp, Homo sapiens
ttttaaggtctttcagtactt

SEQ ID NO: 5340573 - DNA, 21 bp, Homo sapiens
ttttaaggtgagttctcacta

SEQ ID NO: 5340574 - DNA, 17 bp, Homo sapiens
ttttaaggtttcaacaa

SEQ ID NO: 5340575 - DNA, 18 bp, Homo sapiens
ttttaaggtttcaacaaa

SEQ ID NO: 5340576 - DNA, 17 bp, Homo sapiens
ttttaaggtttgcaaat

SEQ ID NO: 5340577 - DNA, 22 bp, Homo sapiens
ttttaaggtttgcaaattaaaa

SEQ ID NO: 5340578 - DNA, 15 bp, Homo sapiens
ttttaagtaacttaa

SEQ ID NO: 5340579 - DNA, 16 bp, Homo sapiens
ttttaagtaatttcat

SEQ ID NO: 5340580 - DNA, 16 bp, Homo sapiens
ttttaagtagaaaaat

SEQ ID NO: 5340581 - DNA, 23 bp, Homo sapiens
ttttaagtagaaaaattgtttcc

SEQ ID NO: 5340582 - DNA, 21 bp, Homo sapiens
ttttaagtattgcatctgtat

SEQ ID NO: 5340583 - DNA, 15 bp, Homo sapiens
ttttaagtatttagg

SEQ ID NO: 5340584 - DNA, 18 bp, Homo sapiens
ttttaagtatttatatat

SEQ ID NO: 5340585 - DNA, 19 bp, Homo sapiens
ttttaagtatttatatatt

SEQ ID NO: 5340586 - DNA, 21 bp, Homo sapiens
ttttaagtcaacactatatat

SEQ ID NO: 5340587 - DNA, 22 bp, Homo sapiens
ttttaagtgacataattgtcca

SEQ ID NO: 5340588 - DNA, 23 bp, Homo sapiens
ttttaagtgacataattgtccag

SEQ ID NO: 5340589 - DNA, 15 bp, Homo sapiens
ttttaagtgctgcat

SEQ ID NO: 5340590 - DNA, 20 bp, Homo sapiens
ttttaagtggactctctgac

SEQ ID NO: 5340591 - DNA, 22 bp, Homo sapiens
ttttaagtgggctcctgacaat

SEQ ID NO: 5340592 - DNA, 15 bp, Homo sapiens
ttttaagtggtttga

SEQ ID NO: 5340593 - DNA, 14 bp, Homo sapiens
ttttaagtgtttcg

SEQ ID NO: 5340594 - DNA, 20 bp, Homo sapiens
ttttattttgtaattattgt

SEQ ID NO: 5340595 - DNA, 13 bp, Homo sapiens
ttttatttttcta

SEQ ID NO: 5340596 - DNA, 22 bp, Homo sapiens
ttttatttttgaacccctgtgt

SEQ ID NO: 5340597 - DNA, 15 bp, Homo sapiens
ttttcaaaaaaatgt

SEQ ID NO: 5340598 - DNA, 20 bp, Homo sapiens
ttttcaaaaaagtcaacaaa

SEQ ID NO: 5340599 - DNA, 15 bp, Homo sapiens
ttttcaaaaatgctg

SEQ ID NO: 5340600 - DNA, 16 bp, Homo sapiens
ttttcaaaagaagaca

SEQ ID NO: 5340601 - DNA, 14 bp, Homo sapiens
ttttcaaaagataa

SEQ ID NO: 5340602 - DNA, 17 bp, Homo sapiens
ttttcaaaaggtattat

SEQ ID NO: 5340603 - DNA, 12 bp, Homo sapiens
ttttcaaaataa

SEQ ID NO: 5340604 - DNA, 14 bp, Homo sapiens
ttttcaaaatcaaa

SEQ ID NO: 5340605 - DNA, 20 bp, Homo sapiens
ttttcaaacaagtatgaatc

SEQ ID NO: 5340606 - DNA, 22 bp, Homo sapiens
ttttcaaaccagtatacaagat

SEQ ID NO: 5340607 - DNA, 17 bp, Homo sapiens
ttttcaaacctcaaata

SEQ ID NO: 5340608 - DNA, 20 bp, Homo sapiens
ttttcaaactgctgcatact

SEQ ID NO: 5340609 - DNA, 12 bp, Homo sapiens
ttttcaaagcaa

SEQ ID NO: 5340610 - DNA, 19 bp, Homo sapiens
ttttcaaagggacttttgt

SEQ ID NO: 5340611 - DNA, 20 bp, Homo sapiens
ttttcaaatatgtaaacttt

SEQ ID NO: 5340612 - DNA, 23 bp, Homo sapiens
ttttcaaatatgtaaactttaac

SEQ ID NO: 5340613 - DNA, 13 bp, Homo sapiens
ttttcaaatattg

SEQ ID NO: 5340614 - DNA, 22 bp, Homo sapiens
ttttcaaatattgaatgcctta

SEQ ID NO: 5340615 - DNA, 17 bp, Homo sapiens
ttttcaaatcaagaaaa

SEQ ID NO: 5340616 - DNA, 13 bp, Homo sapiens
ttttcaaatctgg

SEQ ID NO: 5340617 - DNA, 23 bp, Homo sapiens
ttttcaaatgcagcaatcccact

SEQ ID NO: 5340618 - DNA, 21 bp, Homo sapiens
ttttcaaatgtttgaaaacaa

SEQ ID NO: 5340619 - DNA, 20 bp, Homo sapiens
ttttcaacaaatatcttgtg

SEQ ID NO: 5340620 - DNA, 22 bp, Homo sapiens
ttttcaacagtgaagacagaag

SEQ ID NO: 5340621 - DNA, 18 bp, Homo sapiens
ttttcaaccataaaagaa

SEQ ID NO: 5340622 - DNA, 12 bp, Homo sapiens
ttttcaacccca

SEQ ID NO: 5340623 - DNA, 17 bp, Homo sapiens
ttttcaacctctagaat

SEQ ID NO: 5340624 - DNA, 16 bp, Homo sapiens
ttttcaacttcttcta

SEQ ID NO: 5340625 - DNA, 23 bp, Homo sapiens
ttttcaacttcttctatatccaa

SEQ ID NO: 5340626 - DNA, 18 bp, Homo sapiens
ttttcaagaaaactggaa

SEQ ID NO: 5340627 - DNA, 14 bp, Homo sapiens
ttttcaagaaaaga

SEQ ID NO: 5340628 - DNA, 15 bp, Homo sapiens
ttttcaagaaaattt

SEQ ID NO: 5340629 - DNA, 21 bp, Homo sapiens
ttttcaagaaaattttgcaga

SEQ ID NO: 5340630 - DNA, 23 bp, Homo sapiens
ttttcaagaaaattttgcagaag

SEQ ID NO: 5340631 - DNA, 15 bp, Homo sapiens
ttttcaagaaactga

SEQ ID NO: 5340632 - DNA, 13 bp, Homo sapiens
ttttcaagaaatg

SEQ ID NO: 5340633 - DNA, 18 bp, Homo sapiens
ttttcaagattctaaagc

SEQ ID NO: 5340634 - DNA, 16 bp, Homo sapiens
ttttcaagcaaatatt

SEQ ID NO: 5340635 - DNA, 22 bp, Homo sapiens
ttttcaagcatctcctgaggat

SEQ ID NO: 5340636 - DNA, 17 bp, Homo sapiens
ttttcaaggcacattga

SEQ ID NO: 5340637 - DNA, 18 bp, Homo sapiens
ttttcaaggcttatattc

SEQ ID NO: 5340638 - DNA, 16 bp, Homo sapiens
ttttcaagtatttaag

SEQ ID NO: 5340639 - DNA, 20 bp, Homo sapiens
ttttcaagtttttcatactg

SEQ ID NO: 5340640 - DNA, 22 bp, Homo sapiens
ttttcaataaaacttttccaat

SEQ ID NO: 5340641 - DNA, 13 bp, Homo sapiens
ttttcaataactg

SEQ ID NO: 5340642 - DNA, 16 bp, Homo sapiens
ttttcaataactggaa

SEQ ID NO: 5340643 - DNA, 16 bp, Homo sapiens
ttttcaataagatgta

SEQ ID NO: 5340644 - DNA, 15 bp, Homo sapiens
ttttcaataatgtga

SEQ ID NO: 5340645 - DNA, 14 bp, Homo sapiens
ttttcaatatattg

SEQ ID NO: 5340646 - DNA, 15 bp, Homo sapiens
ttttcaatatattga

SEQ ID NO: 5340647 - DNA, 22 bp, Homo sapiens
ttttcaatatattgaacttttg

SEQ ID NO: 5340648 - DNA, 16 bp, Homo sapiens
ttttcaatatatttgt

SEQ ID NO: 5340649 - DNA, 22 bp, Homo sapiens
ttttcaatatgcaagcagcttt

SEQ ID NO: 5340650 - DNA, 14 bp, Homo sapiens
ttttcaatatttat

SEQ ID NO: 5340651 - DNA, 18 bp, Homo sapiens
ttttcaatgaaacaaaga

SEQ ID NO: 5340652 - DNA, 17 bp, Homo sapiens
ttttcaatgtactgtat

SEQ ID NO: 5340653 - DNA, 16 bp, Homo sapiens
ttttcaatgtctaaaa

SEQ ID NO: 5340654 - DNA, 20 bp, Homo sapiens
ttttcaatgtctaaaaacat

SEQ ID NO: 5340655 - DNA, 14 bp, Homo sapiens
ttttcaatgtgatt

SEQ ID NO: 5340656 - DNA, 10 bp, Homo sapiens
ttttcaatta

SEQ ID NO: 5340657 - DNA, 15 bp, Homo sapiens
ttttcaattaaacgg

SEQ ID NO: 5340658 - DNA, 16 bp, Homo sapiens
ttttcaattaaacgga

SEQ ID NO: 5340659 - DNA, 17 bp, Homo sapiens
ttttcaattaaacggat

SEQ ID NO: 5340660 - DNA, 21 bp, Homo sapiens
ttttcaattaaacggattatt

SEQ ID NO: 5340661 - DNA, 13 bp, Homo sapiens
ttttcaattatgt

SEQ ID NO: 5340662 - DNA, 20 bp, Homo sapiens
ttttcaattcaaaaatgtac

SEQ ID NO: 5340663 - DNA, 13 bp, Homo sapiens
ttttcaatttgga

SEQ ID NO: 5340664 - DNA, 12 bp, Homo sapiens
ttttcacaaaat

SEQ ID NO: 5340665 - DNA, 13 bp, Homo sapiens
ttttcacaaaatg

SEQ ID NO: 5340666 - DNA, 13 bp, Homo sapiens
ttttcacaaataa

SEQ ID NO: 5340667 - DNA, 21 bp, Homo sapiens
ttttcacactggtaaatgtta

SEQ ID NO: 5340668 - DNA, 15 bp, Homo sapiens
ttttcacagcaacat

SEQ ID NO: 5340669 - DNA, 14 bp, Homo sapiens
ttttcacagcacta

SEQ ID NO: 5340670 - DNA, 19 bp, Homo sapiens
ttttcacagctttgaggaa

SEQ ID NO: 5340671 - DNA, 20 bp, Homo sapiens
ttttcacagctttgaggaac

SEQ ID NO: 5340672 - DNA, 22 bp, Homo sapiens
ttttcacataaatgcagcccat

SEQ ID NO: 5340673 - DNA, 13 bp, Homo sapiens
ttttcacatatct

SEQ ID NO: 5340674 - DNA, 18 bp, Homo sapiens
ttttcacatccttgactt

SEQ ID NO: 5340675 - DNA, 18 bp, Homo sapiens
ttttcacattagaagaca

SEQ ID NO: 5340676 - DNA, 19 bp, Homo sapiens
ttttcaccagatttgctaa

SEQ ID NO: 5340677 - DNA, 19 bp, Homo sapiens
ttttcaccaggggtgctca

SEQ ID NO: 5340678 - DNA, 17 bp, Homo sapiens
ttttcacctccttcaat

SEQ ID NO: 5340679 - DNA, 23 bp, Homo sapiens
ttttcacctggaagcatttgttt

SEQ ID NO: 5340680 - DNA, 17 bp, Homo sapiens
ttttcacggaagttttc

SEQ ID NO: 5340681 - DNA, 19 bp, Homo sapiens
ttttcactctaagtcatgt

SEQ ID NO: 5340682 - DNA, 23 bp, Homo sapiens
ttttcactctaagtcatgtatgt

SEQ ID NO: 5340683 - DNA, 13 bp, Homo sapiens
ttttcactgcctg

SEQ ID NO: 5340684 - DNA, 14 bp, Homo sapiens
ttttcactgcctgt

SEQ ID NO: 5340685 - DNA, 11 bp, Homo sapiens
ttttcactgct

SEQ ID NO: 5340686 - DNA, 16 bp, Homo sapiens
ttttcactgctgctcc

SEQ ID NO: 5340687 - DNA, 16 bp, Homo sapiens
ttttcactgtagaatg

SEQ ID NO: 5340688 - DNA, 17 bp, Homo sapiens
ttttcactgtttcctat

SEQ ID NO: 5340689 - DNA, 20 bp, Homo sapiens
ttttcacttcctctccacag

SEQ ID NO: 5340690 - DNA, 21 bp, Homo sapiens
ttttcacttcctctccacagg

SEQ ID NO: 5340691 - DNA, 13 bp, Homo sapiens
ttttcacttctta

SEQ ID NO: 5340692 - DNA, 12 bp, Homo sapiens
ttttcacttgta

SEQ ID NO: 5340693 - DNA, 19 bp, Homo sapiens
ttttcacttgtcttgctct

SEQ ID NO: 5340694 - DNA, 16 bp, Homo sapiens
ttttcactttctgtct

SEQ ID NO: 5340695 - DNA, 18 bp, Homo sapiens
ttttcactttgtgattat

SEQ ID NO: 5340696 - DNA, 15 bp, Homo sapiens
ttttcagaaaatatt

SEQ ID NO: 5340697 - DNA, 23 bp, Homo sapiens
ttttcagaaaatattatgtgttt

SEQ ID NO: 5340698 - DNA, 20 bp, Homo sapiens
ttttcagaaacagggcagca

SEQ ID NO: 5340699 - DNA, 17 bp, Homo sapiens
ttttcagaacctcttcc

SEQ ID NO: 5340700 - DNA, 15 bp, Homo sapiens
ttttcagaagaaatt

SEQ ID NO: 5340701 - DNA, 17 bp, Homo sapiens
ttttcagaatctgaatg

SEQ ID NO: 5340702 - DNA, 21 bp, Homo sapiens
ttttcagaatctgaatgtaat

SEQ ID NO: 5340703 - DNA, 24 bp, Homo sapiens
ttttcagaattgaaggagaaaatg

SEQ ID NO: 5340704 - DNA, 14 bp, Homo sapiens
ttttcagactgtgc

SEQ ID NO: 5340705 - DNA, 15 bp, Homo sapiens
ttttcagagaattat

SEQ ID NO: 5340706 - DNA, 17 bp, Homo sapiens
ttttcagagttttctaa

SEQ ID NO: 5340707 - DNA, 15 bp, Homo sapiens
ttttcagatataaaa

SEQ ID NO: 5340708 - DNA, 19 bp, Homo sapiens
ttttcagatataaaagact

SEQ ID NO: 5340709 - DNA, 19 bp, Homo sapiens
ttttcagattgtaaaggta

SEQ ID NO: 5340710 - DNA, 13 bp, Homo sapiens
ttttcagatttgc

SEQ ID NO: 5340711 - DNA, 15 bp, Homo sapiens
ttttcagatttgcac

SEQ ID NO: 5340712 - DNA, 17 bp, Homo sapiens
ttttcagatttgcacaa

SEQ ID NO: 5340713 - DNA, 18 bp, Homo sapiens
ttttcagatttgcacaaa

SEQ ID NO: 5340714 - DNA, 18 bp, Homo sapiens
ttttcagcaaattccaga

SEQ ID NO: 5340715 - DNA, 20 bp, Homo sapiens
ttttcagcacccccacccac

SEQ ID NO: 5340716 - DNA, 20 bp, Homo sapiens
ttttcagcagcaaaaccaaa

SEQ ID NO: 5340717 - DNA, 21 bp, Homo sapiens
ttttcagcataaatgggaact

SEQ ID NO: 5340718 - DNA, 21 bp, Homo sapiens
ttttcagctaggaacaaatct

SEQ ID NO: 5340719 - DNA, 23 bp, Homo sapiens
ttttcagctaggaacaaatcttc

SEQ ID NO: 5340720 - DNA, 13 bp, Homo sapiens
ttttcagctgagc

SEQ ID NO: 5340721 - DNA, 14 bp, Homo sapiens
ttttcagctgagcc

SEQ ID NO: 5340722 - DNA, 21 bp, Homo sapiens
ttttcaggaaatctacttcct

SEQ ID NO: 5340723 - DNA, 22 bp, Homo sapiens
ttttcaggctcgccaaggccta

SEQ ID NO: 5340724 - DNA, 23 bp, Homo sapiens
ttttcagtaccaaagaaacacca

SEQ ID NO: 5340725 - DNA, 15 bp, Homo sapiens
ttttcagtagtgagc

SEQ ID NO: 5340726 - DNA, 15 bp, Homo sapiens
ttttcagtatactgt

SEQ ID NO: 5340727 - DNA, 17 bp, Homo sapiens
ttttcagtatactgtgt

SEQ ID NO: 5340728 - DNA, 18 bp, Homo sapiens
ttttcagtatactgtgtg

SEQ ID NO: 5340729 - DNA, 19 bp, Homo sapiens
ttttcagtatactgtgtgg

SEQ ID NO: 5340730 - DNA, 19 bp, Homo sapiens
ttttcagtattatatgtac

SEQ ID NO: 5340731 - DNA, 19 bp, Homo sapiens
ttttcagtcccctctctct

SEQ ID NO: 5340732 - DNA, 23 bp, Homo sapiens
ttttcagtcttgtagtgtgtgct

SEQ ID NO: 5340733 - DNA, 15 bp, Homo sapiens
ttttcagtgcatcat

SEQ ID NO: 5340734 - DNA, 18 bp, Homo sapiens
ttttcagtgctttctcaa

SEQ ID NO: 5340735 - DNA, 16 bp, Homo sapiens
ttttcagtggaactct

SEQ ID NO: 5340736 - DNA, 19 bp, Homo sapiens
ttttcagtggaactctaaa

SEQ ID NO: 5340737 - DNA, 13 bp, Homo sapiens
ttttcagtgtgat

SEQ ID NO: 5340738 - DNA, 13 bp, Homo sapiens
ttttcagttactt

SEQ ID NO: 5340739 - DNA, 23 bp, Homo sapiens
ttttcagttcaaagtcatgatgt

SEQ ID NO: 5340740 - DNA, 14 bp, Homo sapiens
ttttcagttctatt

SEQ ID NO: 5340741 - DNA, 12 bp, Homo sapiens
ttttcagttgtt

SEQ ID NO: 5340742 - DNA, 15 bp, Homo sapiens
ttttcagttgttctt

SEQ ID NO: 5340743 - DNA, 14 bp, Homo sapiens
ttttcagttgttta

SEQ ID NO: 5340744 - DNA, 14 bp, Homo sapiens
ttttcagtttaatt

SEQ ID NO: 5340745 - DNA, 20 bp, Homo sapiens
ttttcagtttcaattcagtg

SEQ ID NO: 5340746 - DNA, 14 bp, Homo sapiens
ttttcagttttcag

SEQ ID NO: 5340747 - DNA, 14 bp, Homo sapiens
ttttcataaacaag

SEQ ID NO: 5340748 - DNA, 15 bp, Homo sapiens
ttttcataaactgag

SEQ ID NO: 5340749 - DNA, 17 bp, Homo sapiens
ttttcataacttgctga

SEQ ID NO: 5340750 - DNA, 13 bp, Homo sapiens
ttttcataataaa

SEQ ID NO: 5340751 - DNA, 17 bp, Homo sapiens
ttttcataattcattta

SEQ ID NO: 5340752 - DNA, 18 bp, Homo sapiens
ttttcatacattttctaa

SEQ ID NO: 5340753 - DNA, 13 bp, Homo sapiens
ttttcatactgta

SEQ ID NO: 5340754 - DNA, 19 bp, Homo sapiens
ttttcatactgtacacatt

SEQ ID NO: 5340755 - DNA, 15 bp, Homo sapiens
ttttcatagatgtgt

SEQ ID NO: 5340756 - DNA, 16 bp, Homo sapiens
ttttcatagatttgaa

SEQ ID NO: 5340757 - DNA, 22 bp, Homo sapiens
ttttcatagatttgaaaaactt

SEQ ID NO: 5340758 - DNA, 15 bp, Homo sapiens
ttttcataggtctga

SEQ ID NO: 5340759 - DNA, 13 bp, Homo sapiens
ttttcatatcatt

SEQ ID NO: 5340760 - DNA, 16 bp, Homo sapiens
ttttcatatcatttct

SEQ ID NO: 5340761 - DNA, 13 bp, Homo sapiens
ttttcatattgtg

SEQ ID NO: 5340762 - DNA, 16 bp, Homo sapiens
ttttcatattttaatt

SEQ ID NO: 5340763 - DNA, 22 bp, Homo sapiens
ttttcatcaaaaagccttattt

SEQ ID NO: 5340764 - DNA, 19 bp, Homo sapiens
ttttcatcaatttaaaatc

SEQ ID NO: 5340765 - DNA, 14 bp, Homo sapiens
ttttcatcattgtt

SEQ ID NO: 5340766 - DNA, 17 bp, Homo sapiens
ttttcatcatttcagcc

SEQ ID NO: 5340767 - DNA, 20 bp, Homo sapiens
ttttcatccataactgaaca

SEQ ID NO: 5340768 - DNA, 11 bp, Homo sapiens
ttttcatccca

SEQ ID NO: 5340769 - DNA, 13 bp, Homo sapiens
ttttcatcctaaa

SEQ ID NO: 5340770 - DNA, 15 bp, Homo sapiens
ttttcatctgttgtt

SEQ ID NO: 5340771 - DNA, 19 bp, Homo sapiens
ttttcatcttcagttgtct

SEQ ID NO: 5340772 - DNA, 16 bp, Homo sapiens
ttttcatgacagaata

SEQ ID NO: 5340773 - DNA, 17 bp, Homo sapiens
ttttccttcagatattt

SEQ ID NO: 5340774 - DNA, 13 bp, Homo sapiens
ttttccttcataa

SEQ ID NO: 5340775 - DNA, 14 bp, Homo sapiens
ttttccttcataat

SEQ ID NO: 5340776 - DNA, 21 bp, Homo sapiens
ttttccttccaatgtctggag

SEQ ID NO: 5340777 - DNA, 15 bp, Homo sapiens
ttttccttccatgct

SEQ ID NO: 5340778 - DNA, 15 bp, Homo sapiens
ttttccttcctgccc

SEQ ID NO: 5340779 - DNA, 23 bp, Homo sapiens
ttttccttctgaagtctgagccc

SEQ ID NO: 5340780 - DNA, 15 bp, Homo sapiens
ttttccttgaagccg

SEQ ID NO: 5340781 - DNA, 13 bp, Homo sapiens
ttttccttgcata

SEQ ID NO: 5340782 - DNA, 14 bp, Homo sapiens
ttttccttgcctgt

SEQ ID NO: 5340783 - DNA, 20 bp, Homo sapiens
ttttccttgctatttcaata

SEQ ID NO: 5340784 - DNA, 21 bp, Homo sapiens
ttttccttgctatttcaataa

SEQ ID NO: 5340785 - DNA, 11 bp, Homo sapiens
ttttccttgtg

SEQ ID NO: 5340786 - DNA, 15 bp, Homo sapiens
ttttcctttagatca

SEQ ID NO: 5340787 - DNA, 11 bp, Homo sapiens
ttttcctttat

SEQ ID NO: 5340788 - DNA, 12 bp, Homo sapiens
ttttcctttctg

SEQ ID NO: 5340789 - DNA, 14 bp, Homo sapiens
ttttcctttcttcc

SEQ ID NO: 5340790 - DNA, 10 bp, Homo sapiens
ttttcctttg

SEQ ID NO: 5340791 - DNA, 15 bp, Homo sapiens
ttttcctttggactg

SEQ ID NO: 5340792 - DNA, 12 bp, Homo sapiens
ttttcctttgta

SEQ ID NO: 5340793 - DNA, 13 bp, Homo sapiens
ttttcctttgtgc

SEQ ID NO: 5340794 - DNA, 14 bp, Homo sapiens
ttttccttttctta

SEQ ID NO: 5340795 - DNA, 16 bp, Homo sapiens
ttttccttttcttaaa

SEQ ID NO: 5340796 - DNA, 12 bp, Homo sapiens
ttttccttttgc

SEQ ID NO: 5340797 - DNA, 19 bp, Homo sapiens
ttttccttttgtgtaattt

SEQ ID NO: 5340798 - DNA, 20 bp, Homo sapiens
ttttcctttttcttcgctgg

SEQ ID NO: 5340799 - DNA, 16 bp, Homo sapiens
ttttcgaaaatcaaat

SEQ ID NO: 5340800 - DNA, 23 bp, Homo sapiens
ttttcgaacattctttgcctggt

SEQ ID NO: 5340801 - DNA, 14 bp, Homo sapiens
ttttcgatgatgat

SEQ ID NO: 5340802 - DNA, 14 bp, Homo sapiens
ttttcgcctttcct

SEQ ID NO: 5340803 - DNA, 21 bp, Homo sapiens
ttttcgcttgcttctgcagca

SEQ ID NO: 5340804 - DNA, 21 bp, Homo sapiens
ttttcggaggccccactgatg

SEQ ID NO: 5340805 - DNA, 14 bp, Homo sapiens
ttttcggcagcctt

SEQ ID NO: 5340806 - DNA, 19 bp, Homo sapiens
ttttcggccccatgtatct

SEQ ID NO: 5340807 - DNA, 15 bp, Homo sapiens
ttttcgtaccttccc

SEQ ID NO: 5340808 - DNA, 17 bp, Homo sapiens
ttttcgtaccttcccac

SEQ ID NO: 5340809 - DNA, 19 bp, Homo sapiens
ttttcgtatgaaaatgagt

SEQ ID NO: 5340810 - DNA, 16 bp, Homo sapiens
ttttcgtgcatttgtg

SEQ ID NO: 5340811 - DNA, 16 bp, Homo sapiens
ttttcgtgtggatctt

SEQ ID NO: 5340812 - DNA, 23 bp, Homo sapiens
ttttcgtttagaatcagaataaa

SEQ ID NO: 5340813 - DNA, 19 bp, Homo sapiens
ttttctaaaaaaaaaaact

SEQ ID NO: 5340814 - DNA, 20 bp, Homo sapiens
ttttctaaaaagctatgtat

SEQ ID NO: 5340815 - DNA, 23 bp, Homo sapiens
ttttctaaaaagctatgtatcgc

SEQ ID NO: 5340816 - DNA, 20 bp, Homo sapiens
ttttctaaaaagtcaattca

SEQ ID NO: 5340817 - DNA, 21 bp, Homo sapiens
ttttctaaaacattcccctcc

SEQ ID NO: 5340818 - DNA, 14 bp, Homo sapiens
ttttctaaaagctt

SEQ ID NO: 5340819 - DNA, 20 bp, Homo sapiens
ttttctaaacctgtgcctcc

SEQ ID NO: 5340820 - DNA, 21 bp, Homo sapiens
ttttctaaacctgtgcctccc

SEQ ID NO: 5340821 - DNA, 18 bp, Homo sapiens
ttttctaaacgtaagcac

SEQ ID NO: 5340822 - DNA, 15 bp, Homo sapiens
ttttctaaagaaata

SEQ ID NO: 5340823 - DNA, 18 bp, Homo sapiens
ttttctaaagaaattaca

SEQ ID NO: 5340824 - DNA, 18 bp, Homo sapiens
ttttctaaagtaaaaaca

SEQ ID NO: 5340825 - DNA, 14 bp, Homo sapiens
ttttctaaagtgct

SEQ ID NO: 5340826 - DNA, 16 bp, Homo sapiens
ttttctaaataaaaat

SEQ ID NO: 5340827 - DNA, 15 bp, Homo sapiens
ttttctaaatgttat

SEQ ID NO: 5340828 - DNA, 16 bp, Homo sapiens
ttttctaaatgtttct

SEQ ID NO: 5340829 - DNA, 23 bp, Homo sapiens
ttttctaacagaaagcatgattt

SEQ ID NO: 5340830 - DNA, 13 bp, Homo sapiens
ttttctaactgta

SEQ ID NO: 5340831 - DNA, 23 bp, Homo sapiens
ttttctaactgtaaatcacttgt

SEQ ID NO: 5340832 - DNA, 13 bp, Homo sapiens
ttttctaagaaaa

SEQ ID NO: 5340833 - DNA, 19 bp, Homo sapiens
ttttctaagacagttttta

SEQ ID NO: 5340834 - DNA, 13 bp, Homo sapiens
ttttctaagagaa

SEQ ID NO: 5340835 - DNA, 15 bp, Homo sapiens
ttttctaagagaagt

SEQ ID NO: 5340836 - DNA, 19 bp, Homo sapiens
ttttctaagcaatttcttg

SEQ ID NO: 5340837 - DNA, 21 bp, Homo sapiens
ttttctaagcaatttcttgct

SEQ ID NO: 5340838 - DNA, 21 bp, Homo sapiens
ttttctaatactaatgttatt

SEQ ID NO: 5340839 - DNA, 16 bp, Homo sapiens
ttttctacaagtattc

SEQ ID NO: 5340840 - DNA, 21 bp, Homo sapiens
ttttctacagcaaatttataa

SEQ ID NO: 5340841 - DNA, 22 bp, Homo sapiens
ttttctactcgagttacagaca

SEQ ID NO: 5340842 - DNA, 22 bp, Homo sapiens
ttttctactttaaattgtggat

SEQ ID NO: 5340843 - DNA, 13 bp, Homo sapiens
ttttctactttga

SEQ ID NO: 5340844 - DNA, 19 bp, Homo sapiens
ttttctagaaatacacttt

SEQ ID NO: 5340845 - DNA, 13 bp, Homo sapiens
ttttctagacttt

SEQ ID NO: 5340846 - DNA, 13 bp, Homo sapiens
ttttctagagaca

SEQ ID NO: 5340847 - DNA, 13 bp, Homo sapiens
ttttctagagtta

SEQ ID NO: 5340848 - DNA, 22 bp, Homo sapiens
ttttctagcctatttacctgca

SEQ ID NO: 5340849 - DNA, 21 bp, Homo sapiens
ttttctagctataacaactct

SEQ ID NO: 5340850 - DNA, 21 bp, Homo sapiens
ttttctagtcagtaaacattt

SEQ ID NO: 5340851 - DNA, 12 bp, Homo sapiens
ttttctagtgta

SEQ ID NO: 5340852 - DNA, 22 bp, Homo sapiens
ttttctagtgtatcaaaatgct

SEQ ID NO: 5340853 - DNA, 20 bp, Homo sapiens
ttttctagtttcagtaaata

SEQ ID NO: 5340854 - DNA, 23 bp, Homo sapiens
ttttctagttttatacaaagaca

SEQ ID NO: 5340855 - DNA, 22 bp, Homo sapiens
ttttctatagctcttctattta

SEQ ID NO: 5340856 - DNA, 11 bp, Homo sapiens
ttttctatata

SEQ ID NO: 5340857 - DNA, 23 bp, Homo sapiens
ttttctatatagttccttgcctt

SEQ ID NO: 5340858 - DNA, 15 bp, Homo sapiens
ttttctatatttgga

SEQ ID NO: 5340859 - DNA, 11 bp, Homo sapiens
ttttctatgaa

SEQ ID NO: 5340860 - DNA, 21 bp, Homo sapiens
ttttctatgaaagctatgaat

SEQ ID NO: 5340861 - DNA, 18 bp, Homo sapiens
ttttctatgtactagtac

SEQ ID NO: 5340862 - DNA, 16 bp, Homo sapiens
ttttctattaaaagac

SEQ ID NO: 5340863 - DNA, 17 bp, Homo sapiens
ttttctattaaaagact

SEQ ID NO: 5340864 - DNA, 18 bp, Homo sapiens
ttttctattaaaagactc

SEQ ID NO: 5340865 - DNA, 20 bp, Homo sapiens
ttttctattaaaagactcat

SEQ ID NO: 5340866 - DNA, 19 bp, Homo sapiens
ttttctattatttttataa

SEQ ID NO: 5340867 - DNA, 23 bp, Homo sapiens
ttttctattgttactctggttct

SEQ ID NO: 5340868 - DNA, 18 bp, Homo sapiens
ttttctatttcactggag

SEQ ID NO: 5340869 - DNA, 20 bp, Homo sapiens
ttttctatttctctgtgtat

SEQ ID NO: 5340870 - DNA, 22 bp, Homo sapiens
ttttctattttgttttttaagt

SEQ ID NO: 5340871 - DNA, 19 bp, Homo sapiens
ttttctatttttcttctaa

SEQ ID NO: 5340872 - DNA, 23 bp, Homo sapiens
ttttctatttttgattgtgttga

SEQ ID NO: 5340873 - DNA, 20 bp, Homo sapiens
ttttctcaaagttttgaaaa

SEQ ID NO: 5340874 - DNA, 12 bp, Homo sapiens
ttttctcaaata

SEQ ID NO: 5340875 - DNA, 16 bp, Homo sapiens
ttttctcactgaagct

SEQ ID NO: 5340876 - DNA, 20 bp, Homo sapiens
ttttctcagactcaccaact

SEQ ID NO: 5340877 - DNA, 15 bp, Homo sapiens
ttttctccaccaact

SEQ ID NO: 5340878 - DNA, 18 bp, Homo sapiens
ttttctccacccaaaccc

SEQ ID NO: 5340879 - DNA, 13 bp, Homo sapiens
ttttctccagctc

SEQ ID NO: 5340880 - DNA, 21 bp, Homo sapiens
ttttctccagggttcaccatg

SEQ ID NO: 5340881 - DNA, 12 bp, Homo sapiens
ttttctccagtc

SEQ ID NO: 5340882 - DNA, 16 bp, Homo sapiens
ttttctccatgtctgt

SEQ ID NO: 5340883 - DNA, 12 bp, Homo sapiens
ttttctcccaag

SEQ ID NO: 5340884 - DNA, 17 bp, Homo sapiens
ttttctccctagaaaca

SEQ ID NO: 5340885 - DNA, 12 bp, Homo sapiens
ttttctccctct

SEQ ID NO: 5340886 - DNA, 23 bp, Homo sapiens
ttttctccctggatttttaccag

SEQ ID NO: 5340887 - DNA, 21 bp, Homo sapiens
ttttctccgggtcctcctaag

SEQ ID NO: 5340888 - DNA, 13 bp, Homo sapiens
ttttctcctccca

SEQ ID NO: 5340889 - DNA, 14 bp, Homo sapiens
ttttctcctccgcc

SEQ ID NO: 5340890 - DNA, 14 bp, Homo sapiens
ttttctcctctgct

SEQ ID NO: 5340891 - DNA, 21 bp, Homo sapiens
ttttctcgagtccaaaatcat

SEQ ID NO: 5340892 - DNA, 20 bp, Homo sapiens
ttttctctactttaaatttt

SEQ ID NO: 5340893 - DNA, 20 bp, Homo sapiens
ttttctctaggaaatatact

SEQ ID NO: 5340894 - DNA, 20 bp, Homo sapiens
ttttctctatacatagagct

SEQ ID NO: 5340895 - DNA, 10 bp, Homo sapiens
ttttctctca

SEQ ID NO: 5340896 - DNA, 19 bp, Homo sapiens
ttttctctcaaatgataca

SEQ ID NO: 5340897 - DNA, 21 bp, Homo sapiens
ttttctctcaacaccatgatt

SEQ ID NO: 5340898 - DNA, 11 bp, Homo sapiens
ttttctctcca

SEQ ID NO: 5340899 - DNA, 16 bp, Homo sapiens
ttttctctcctgtcct

SEQ ID NO: 5340900 - DNA, 13 bp, Homo sapiens
ttttctctctgga

SEQ ID NO: 5340901 - DNA, 17 bp, Homo sapiens
ttttctctgaacacatt

SEQ ID NO: 5340902 - DNA, 21 bp, Homo sapiens
ttttctctgcataagtaatta

SEQ ID NO: 5340903 - DNA, 20 bp, Homo sapiens
ttttctctgcatttaaaaaa

SEQ ID NO: 5340904 - DNA, 11 bp, Homo sapiens
ttttctctgga

SEQ ID NO: 5340905 - DNA, 13 bp, Homo sapiens
ttttctctggaaa

SEQ ID NO: 5340906 - DNA, 14 bp, Homo sapiens
ttttctctgtgtgg

SEQ ID NO: 5340907 - DNA, 20 bp, Homo sapiens
ttttctctgtgtggttcagc

SEQ ID NO: 5340908 - DNA, 21 bp, Homo sapiens
ttttctcttagaacattgtat

SEQ ID NO: 5340909 - DNA, 14 bp, Homo sapiens
ttttctcttcatat

SEQ ID NO: 5340910 - DNA, 19 bp, Homo sapiens
ttttctcttcccttcccag

SEQ ID NO: 5340911 - DNA, 12 bp, Homo sapiens
ttttctcttctg

SEQ ID NO: 5340912 - DNA, 23 bp, Homo sapiens
ttttctctttcctctaactcatt

SEQ ID NO: 5340913 - DNA, 14 bp, Homo sapiens
ttttctctttgtgg

SEQ ID NO: 5340914 - DNA, 14 bp, Homo sapiens
ttttctcttttcct

SEQ ID NO: 5340915 - DNA, 9 bp, Homo sapiens
ttttctgaa

SEQ ID NO: 5340916 - DNA, 15 bp, Homo sapiens
ttttctgaaacacac

SEQ ID NO: 5340917 - DNA, 14 bp, Homo sapiens
ttttctgaacaaaa

SEQ ID NO: 5340918 - DNA, 17 bp, Homo sapiens
ttttctgaactccattt

SEQ ID NO: 5340919 - DNA, 12 bp, Homo sapiens
ttttctgaataa

SEQ ID NO: 5340920 - DNA, 13 bp, Homo sapiens
ttttctgaataaa

SEQ ID NO: 5340921 - DNA, 15 bp, Homo sapiens
ttttctgaatcttct

SEQ ID NO: 5340922 - DNA, 16 bp, Homo sapiens
ttttctgaatcttctg

SEQ ID NO: 5340923 - DNA, 17 bp, Homo sapiens
ttttctgaatcttctga

SEQ ID NO: 5340924 - DNA, 18 bp, Homo sapiens
ttttctgacatgcattgt

SEQ ID NO: 5340925 - DNA, 14 bp, Homo sapiens
ttttctgaccaaaa

SEQ ID NO: 5340926 - DNA, 22 bp, Homo sapiens
ttttctgaggatagtagttaaa

SEQ ID NO: 5340927 - DNA, 18 bp, Homo sapiens
ttttctgatatgtttgta

SEQ ID NO: 5340928 - DNA, 20 bp, Homo sapiens
ttttctgatgacataataaa

SEQ ID NO: 5340929 - DNA, 17 bp, Homo sapiens
ttttctgattagctttg

SEQ ID NO: 5340930 - DNA, 18 bp, Homo sapiens
ttttctgattagctttgt

SEQ ID NO: 5340931 - DNA, 21 bp, Homo sapiens
ttttctgattgtaacgttgct

SEQ ID NO: 5340932 - DNA, 23 bp, Homo sapiens
ttttctgattgtaacgttgctgt

SEQ ID NO: 5340933 - DNA, 16 bp, Homo sapiens
ttttctgcaagcctgc

SEQ ID NO: 5340934 - DNA, 13 bp, Homo sapiens
ttttctgcactga

SEQ ID NO: 5340935 - DNA, 12 bp, Homo sapiens
ttttctgcagct

SEQ ID NO: 5340936 - DNA, 14 bp, Homo sapiens
ttttctgcagctgt

SEQ ID NO: 5340937 - DNA, 15 bp, Homo sapiens
ttttctgcagctgtt

SEQ ID NO: 5340938 - DNA, 19 bp, Homo sapiens
ttttctgccactgaggaga

SEQ ID NO: 5340939 - DNA, 12 bp, Homo sapiens
ttttctgccctg

SEQ ID NO: 5340940 - DNA, 12 bp, Homo sapiens
ttttctgctctg

SEQ ID NO: 5340941 - DNA, 13 bp, Homo sapiens
ttttctgctgttt

SEQ ID NO: 5340942 - DNA, 19 bp, Homo sapiens
ttttctgctttagacttga

SEQ ID NO: 5340943 - DNA, 16 bp, Homo sapiens
ttttctgcttttgaaa

SEQ ID NO: 5340944 - DNA, 18 bp, Homo sapiens
ttttctggaaaatgcttc

SEQ ID NO: 5340945 - DNA, 20 bp, Homo sapiens
ttttctggaaaatgcttctt

SEQ ID NO: 5340946 - DNA, 14 bp, Homo sapiens
ttttctggaagaca

SEQ ID NO: 5340947 - DNA, 18 bp, Homo sapiens
ttttctggaatggaattg

SEQ ID NO: 5340948 - DNA, 20 bp, Homo sapiens
ttttctggaatggaattgga

SEQ ID NO: 5340949 - DNA, 12 bp, Homo sapiens
ttttctggacca

SEQ ID NO: 5340950 - DNA, 16 bp, Homo sapiens
ttttctggactctgga

SEQ ID NO: 5340951 - DNA, 13 bp, Homo sapiens
ttttctggattct

SEQ ID NO: 5340952 - DNA, 20 bp, Homo sapiens
ttttctggccagtgtttaaa

SEQ ID NO: 5340953 - DNA, 18 bp, Homo sapiens
ttttggcctgtttgatgt

SEQ ID NO: 5340954 - DNA, 11 bp, Homo sapiens
ttttggccttg

SEQ ID NO: 5340955 - DNA, 14 bp, Homo sapiens
ttttggcctttgta

SEQ ID NO: 5340956 - DNA, 17 bp, Homo sapiens
ttttggcgaatctcaaa

SEQ ID NO: 5340957 - DNA, 19 bp, Homo sapiens
ttttggcgctattacaaat

SEQ ID NO: 5340958 - DNA, 15 bp, Homo sapiens
ttttggctagagttt

SEQ ID NO: 5340959 - DNA, 14 bp, Homo sapiens
ttttggctctccca

SEQ ID NO: 5340960 - DNA, 19 bp, Homo sapiens
ttttggctctcccaccccg

SEQ ID NO: 5340961 - DNA, 18 bp, Homo sapiens
ttttggcttgcttatgtg

SEQ ID NO: 5340962 - DNA, 21 bp, Homo sapiens
ttttgggaaatgctgatttaa

SEQ ID NO: 5340963 - DNA, 18 bp, Homo sapiens
ttttgggaagttaaaggg

SEQ ID NO: 5340964 - DNA, 16 bp, Homo sapiens
ttttgggaggatttga

SEQ ID NO: 5340965 - DNA, 21 bp, Homo sapiens
ttttgggaggggatggcagac

SEQ ID NO: 5340966 - DNA, 14 bp, Homo sapiens
ttttgggatgtctt

SEQ ID NO: 5340967 - DNA, 10 bp, Homo sapiens
ttttgggcca

SEQ ID NO: 5340968 - DNA, 16 bp, Homo sapiens
ttttgggccattaccc

SEQ ID NO: 5340969 - DNA, 17 bp, Homo sapiens
ttttgggccattacccc

SEQ ID NO: 5340970 - DNA, 21 bp, Homo sapiens
ttttggggaactgttgtttga

SEQ ID NO: 5340971 - DNA, 15 bp, Homo sapiens
ttttggggagccaga

SEQ ID NO: 5340972 - DNA, 22 bp, Homo sapiens
ttttggggagggaggggaaatg

SEQ ID NO: 5340973 - DNA, 20 bp, Homo sapiens
ttttggggctgacctgtctt

SEQ ID NO: 5340974 - DNA, 23 bp, Homo sapiens
ttttggggctttcccaggagaaa

SEQ ID NO: 5340975 - DNA, 23 bp, Homo sapiens
ttttggggggcccccctccttgc

SEQ ID NO: 5340976 - DNA, 18 bp, Homo sapiens
ttttggggggtaatcagc

SEQ ID NO: 5340977 - DNA, 19 bp, Homo sapiens
ttttgggggtcatcttgga

SEQ ID NO: 5340978 - DNA, 19 bp, Homo sapiens
ttttggggttgtgttgtca

SEQ ID NO: 5340979 - DNA, 14 bp, Homo sapiens
ttttgggtgaatct

SEQ ID NO: 5340980 - DNA, 19 bp, Homo sapiens
ttttgggtgtttttcatgt

SEQ ID NO: 5340981 - DNA, 16 bp, Homo sapiens
ttttgggttaaaagat

SEQ ID NO: 5340982 - DNA, 15 bp, Homo sapiens
ttttgggttgtttaa

SEQ ID NO: 5340983 - DNA, 17 bp, Homo sapiens
ttttgggtttatttgga

SEQ ID NO: 5340984 - DNA, 18 bp, Homo sapiens
ttttgggtttatttggaa

SEQ ID NO: 5340985 - DNA, 17 bp, Homo sapiens
ttttggtaataacaaac

SEQ ID NO: 5340986 - DNA, 15 bp, Homo sapiens
ttttggtaattgtag

SEQ ID NO: 5340987 - DNA, 14 bp, Homo sapiens
ttttggtagagatg

SEQ ID NO: 5340988 - DNA, 21 bp, Homo sapiens
ttttggtagatcttcaatttg

SEQ ID NO: 5340989 - DNA, 21 bp, Homo sapiens
ttttggtataaggtacatatt

SEQ ID NO: 5340990 - DNA, 23 bp, Homo sapiens
ttttggtattacactgtatttgt

SEQ ID NO: 5340991 - DNA, 14 bp, Homo sapiens
ttttggtatttgaa

SEQ ID NO: 5340992 - DNA, 13 bp, Homo sapiens
ttttggtcaaatt

SEQ ID NO: 5340993 - DNA, 21 bp, Homo sapiens
ttttggtccacttttccagta

SEQ ID NO: 5340994 - DNA, 17 bp, Homo sapiens
ttttggtcccctccctc

SEQ ID NO: 5340995 - DNA, 20 bp, Homo sapiens
ttttggtccttctttcctct

SEQ ID NO: 5340996 - DNA, 18 bp, Homo sapiens
ttttggtctggagggaag

SEQ ID NO: 5340997 - DNA, 23 bp, Homo sapiens
ttttggtcttcagcctccctcag

SEQ ID NO: 5340998 - DNA, 23 bp, Homo sapiens
ttttggtgatgtaaaacagaata

SEQ ID NO: 5340999 - DNA, 18 bp, Homo sapiens
ttttggtggatgtaaata

SEQ ID NO: 5341000 - DNA, 17 bp, Homo sapiens
ttttggtgtgcatctgt

SEQ ID NO: 5341001 - DNA, 15 bp, Homo sapiens
ttttggtgtgccctg

SEQ ID NO: 5341002 - DNA, 16 bp, Homo sapiens
ttttggtgtgccctgt

SEQ ID NO: 5341003 - DNA, 13 bp, Homo sapiens
ttttggtgtgttg

SEQ ID NO: 5341004 - DNA, 22 bp, Homo sapiens
ttttggttaagttggcttctgt

SEQ ID NO: 5341005 - DNA, 23 bp, Homo sapiens
ttttggttgctgatgtttataaa

SEQ ID NO: 5341006 - DNA, 22 bp, Homo sapiens
ttttggttgtcaatattaaata

SEQ ID NO: 5341007 - DNA, 16 bp, Homo sapiens
ttttggttgtcctcaa

SEQ ID NO: 5341008 - DNA, 16 bp, Homo sapiens
ttttggttgtttgctg

SEQ ID NO: 5341009 - DNA, 22 bp, Homo sapiens
ttttggtttgcagatgacaaaa

SEQ ID NO: 5341010 - DNA, 13 bp, Homo sapiens
ttttggttttcta

SEQ ID NO: 5341011 - DNA, 16 bp, Homo sapiens
ttttggttttgttccc

SEQ ID NO: 5341012 - DNA, 20 bp, Homo sapiens
ttttggttttgttcccctcc

SEQ ID NO: 5341013 - DNA, 17 bp, Homo sapiens
ttttggttttgtttctg

SEQ ID NO: 5341014 - DNA, 13 bp, Homo sapiens
ttttgtaaaaaat

SEQ ID NO: 5341015 - DNA, 13 bp, Homo sapiens
ttttgtaaaaact

SEQ ID NO: 5341016 - DNA, 21 bp, Homo sapiens
ttttgtaaaaagggaaaaaga

SEQ ID NO: 5341017 - DNA, 12 bp, Homo sapiens
ttttgtaaaaca

SEQ ID NO: 5341018 - DNA, 12 bp, Homo sapiens
ttttgtaaaaga

SEQ ID NO: 5341019 - DNA, 15 bp, Homo sapiens
ttttgtaaaagaaat

SEQ ID NO: 5341020 - DNA, 12 bp, Homo sapiens
ttttgtaaaata

SEQ ID NO: 5341021 - DNA, 18 bp, Homo sapiens
ttttgtaaaatgtattat

SEQ ID NO: 5341022 - DNA, 18 bp, Homo sapiens
ttttgtaaaattccatgg

SEQ ID NO: 5341023 - DNA, 22 bp, Homo sapiens
ttttgtaaaattccatggatct

SEQ ID NO: 5341024 - DNA, 17 bp, Homo sapiens
ttttgtaaacatttatt

SEQ ID NO: 5341025 - DNA, 20 bp, Homo sapiens
ttttgtaaactgatgtttgt

SEQ ID NO: 5341026 - DNA, 21 bp, Homo sapiens
ttttgtaaactggaattaaaa

SEQ ID NO: 5341027 - DNA, 10 bp, Homo sapiens
ttttgtaaag

SEQ ID NO: 5341028 - DNA, 17 bp, Homo sapiens
ttttgtaaagaaaaata

SEQ ID NO: 5341029 - DNA, 22 bp, Homo sapiens
ttttgtaaagagaccatcttct

SEQ ID NO: 5341030 - DNA, 13 bp, Homo sapiens
ttttgtaaagatt

SEQ ID NO: 5341031 - DNA, 14 bp, Homo sapiens
ttttgtaaagattt

SEQ ID NO: 5341032 - DNA, 20 bp, Homo sapiens
ttttgtaaagatttctgttc

SEQ ID NO: 5341033 - DNA, 18 bp, Homo sapiens
ttttgtaaagtaaaatat

SEQ ID NO: 5341034 - DNA, 19 bp, Homo sapiens
ttttgtaaagtaaaatatg

SEQ ID NO: 5341035 - DNA, 20 bp, Homo sapiens
ttttgtaaagtaaaatatgt

SEQ ID NO: 5341036 - DNA, 13 bp, Homo sapiens
ttttgtaaagtgt

SEQ ID NO: 5341037 - DNA, 14 bp, Homo sapiens
ttttgtaaagtttc

SEQ ID NO: 5341038 - DNA, 23 bp, Homo sapiens
ttttgtaaatgctgtaaatattt

SEQ ID NO: 5341039 - DNA, 13 bp, Homo sapiens
ttttgtaaatgta

SEQ ID NO: 5341040 - DNA, 20 bp, Homo sapiens
ttttgtaaatgttcttggtg

SEQ ID NO: 5341041 - DNA, 13 bp, Homo sapiens
ttttgtaaattaa

SEQ ID NO: 5341042 - DNA, 13 bp, Homo sapiens
ttttgtaaattat

SEQ ID NO: 5341043 - DNA, 15 bp, Homo sapiens
ttttgtaacaaatga

SEQ ID NO: 5341044 - DNA, 12 bp, Homo sapiens
ttttgtaactac

SEQ ID NO: 5341045 - DNA, 14 bp, Homo sapiens
ttttgtaactcttt

SEQ ID NO: 5341046 - DNA, 15 bp, Homo sapiens
ttttgtaactctttg

SEQ ID NO: 5341047 - DNA, 18 bp, Homo sapiens
ttttgtaactctttggct

SEQ ID NO: 5341048 - DNA, 11 bp, Homo sapiens
ttttgtaactg

SEQ ID NO: 5341049 - DNA, 16 bp, Homo sapiens
ttttgtaacttcaaat

SEQ ID NO: 5341050 - DNA, 12 bp, Homo sapiens
ttttgtaacttg

SEQ ID NO: 5341051 - DNA, 11 bp, Homo sapiens
ttttgtaagaa

SEQ ID NO: 5341052 - DNA, 16 bp, Homo sapiens
ttttgtaataaaaggt

SEQ ID NO: 5341053 - DNA, 14 bp, Homo sapiens
ttttgtaataaact

SEQ ID NO: 5341054 - DNA, 17 bp, Homo sapiens
ttttgtaataataaaga

SEQ ID NO: 5341055 - DNA, 13 bp, Homo sapiens
ttttgtaatgaat

SEQ ID NO: 5341056 - DNA, 16 bp, Homo sapiens
ttttgtaatgtgaaaa

SEQ ID NO: 5341057 - DNA, 15 bp, Homo sapiens
ttttgtaattattgt

SEQ ID NO: 5341058 - DNA, 17 bp, Homo sapiens
ttttgtaattcctctag

SEQ ID NO: 5341059 - DNA, 19 bp, Homo sapiens
ttttgtaattcctctagct

SEQ ID NO: 5341060 - DNA, 18 bp, Homo sapiens
ttttgtaattcttatgac

SEQ ID NO: 5341061 - DNA, 20 bp, Homo sapiens
ttttgtaatttgaattgggt

SEQ ID NO: 5341062 - DNA, 14 bp, Homo sapiens
ttttgtaattttct

SEQ ID NO: 5341063 - DNA, 14 bp, Homo sapiens
ttttgtacaattac

SEQ ID NO: 5341064 - DNA, 17 bp, Homo sapiens
ttttgtacaattactaa

SEQ ID NO: 5341065 - DNA, 15 bp, Homo sapiens
ttttgtacactgctg

SEQ ID NO: 5341066 - DNA, 13 bp, Homo sapiens
ttttgtacagaat

SEQ ID NO: 5341067 - DNA, 22 bp, Homo sapiens
ttttgtacagtatttttcagat

SEQ ID NO: 5341068 - DNA, 14 bp, Homo sapiens
ttttgtacatactg

SEQ ID NO: 5341069 - DNA, 16 bp, Homo sapiens
ttttgtacatattgtt

SEQ ID NO: 5341070 - DNA, 12 bp, Homo sapiens
ttttgtacatct

SEQ ID NO: 5341071 - DNA, 18 bp, Homo sapiens
ttttgtacatctggctta

SEQ ID NO: 5341072 - DNA, 11 bp, Homo sapiens
ttttgtacatg

SEQ ID NO: 5341073 - DNA, 14 bp, Homo sapiens
ttttgtacatgtat

SEQ ID NO: 5341074 - DNA, 18 bp, Homo sapiens
ttttgtacattacactaa

SEQ ID NO: 5341075 - DNA, 13 bp, Homo sapiens
ttttgtacattat

SEQ ID NO: 5341076 - DNA, 14 bp, Homo sapiens
ttttgtaccagtga

SEQ ID NO: 5341077 - DNA, 19 bp, Homo sapiens
ttttgtacgcaattctcga

SEQ ID NO: 5341078 - DNA, 21 bp, Homo sapiens
ttttgtacgtgttattattat

SEQ ID NO: 5341079 - DNA, 17 bp, Homo sapiens
ttttgtactgtaaagag

SEQ ID NO: 5341080 - DNA, 12 bp, Homo sapiens
ttttgtactgtg

SEQ ID NO: 5341081 - DNA, 13 bp, Homo sapiens
ttttgtactgtgc

SEQ ID NO: 5341082 - DNA, 16 bp, Homo sapiens
ttttgtactgtgctga

SEQ ID NO: 5341083 - DNA, 22 bp, Homo sapiens
ttttgtagagagagctgtatta

SEQ ID NO: 5341084 - DNA, 12 bp, Homo sapiens
ttttgtagctag

SEQ ID NO: 5341085 - DNA, 16 bp, Homo sapiens
ttttgtaggctgttcc

SEQ ID NO: 5341086 - DNA, 19 bp, Homo sapiens
ttttgtaggtacttttgga

SEQ ID NO: 5341087 - DNA, 13 bp, Homo sapiens
ttttgtataaaat

SEQ ID NO: 5341088 - DNA, 15 bp, Homo sapiens
ttttgtataaaatct

SEQ ID NO: 5341089 - DNA, 14 bp, Homo sapiens
ttttgtataattgg

SEQ ID NO: 5341090 - DNA, 23 bp, Homo sapiens
ttttgtataattggatttcctaa

SEQ ID NO: 5341091 - DNA, 15 bp, Homo sapiens
ttttgtatacaaata

SEQ ID NO: 5341092 - DNA, 21 bp, Homo sapiens
ttttgtatacaaatatattgt

SEQ ID NO: 5341093 - DNA, 13 bp, Homo sapiens
ttttgtatacaga

SEQ ID NO: 5341094 - DNA, 13 bp, Homo sapiens
ttttgtatacatc

SEQ ID NO: 5341095 - DNA, 24 bp, Homo sapiens
ttttgtatagaaaattcttgagaa

SEQ ID NO: 5341096 - DNA, 18 bp, Homo sapiens
ttttgtatagtaaagtga

SEQ ID NO: 5341097 - DNA, 20 bp, Homo sapiens
ttttgtatagttaacacact

SEQ ID NO: 5341098 - DNA, 13 bp, Homo sapiens
ttttgtatatatc

SEQ ID NO: 5341099 - DNA, 13 bp, Homo sapiens
ttttgtatatgat

SEQ ID NO: 5341100 - DNA, 14 bp, Homo sapiens
ttttgtatcaaact

SEQ ID NO: 5341101 - DNA, 13 bp, Homo sapiens
ttttgtatcctcc

SEQ ID NO: 5341102 - DNA, 14 bp, Homo sapiens
ttttgtatcttggg

SEQ ID NO: 5341103 - DNA, 14 bp, Homo sapiens
ttttgtatctttaa

SEQ ID NO: 5341104 - DNA, 21 bp, Homo sapiens
ttttgtatgaaatattaaaca

SEQ ID NO: 5341105 - DNA, 13 bp, Homo sapiens
ttttgtatgcaag

SEQ ID NO: 5341106 - DNA, 11 bp, Homo sapiens
ttttgtatgta

SEQ ID NO: 5341107 - DNA, 13 bp, Homo sapiens
ttttgtatgtaaa

SEQ ID NO: 5341108 - DNA, 17 bp, Homo sapiens
ttttgtatgttaaagag

SEQ ID NO: 5341109 - DNA, 17 bp, Homo sapiens
ttttgtattctctgagc

SEQ ID NO: 5341110 - DNA, 19 bp, Homo sapiens
ttttgtattgattttcaca

SEQ ID NO: 5341111 - DNA, 18 bp, Homo sapiens
ttttgtatttaaaacctt

SEQ ID NO: 5341112 - DNA, 15 bp, Homo sapiens
ttttgtatttaatga

SEQ ID NO: 5341113 - DNA, 12 bp, Homo sapiens
ttttgtatttct

SEQ ID NO: 5341114 - DNA, 18 bp, Homo sapiens
ttttgtatttcttttata

SEQ ID NO: 5341115 - DNA, 16 bp, Homo sapiens
ttttgtattttacatg

SEQ ID NO: 5341116 - DNA, 19 bp, Homo sapiens
ttttgtattttccaagtgt

SEQ ID NO: 5341117 - DNA, 23 bp, Homo sapiens
ttttgtcacattatttattaaaa

SEQ ID NO: 5341118 - DNA, 22 bp, Homo sapiens
ttttgtcacctcaatatttact

SEQ ID NO: 5341119 - DNA, 19 bp, Homo sapiens
ttttgtcagtctgagtcat

SEQ ID NO: 5341120 - DNA, 18 bp, Homo sapiens
ttttgtcataaaatgcta

SEQ ID NO: 5341121 - DNA, 22 bp, Homo sapiens
ttttgtcataaaatgctatttt

SEQ ID NO: 5341122 - DNA, 11 bp, Homo sapiens
ttttgtcatgt

SEQ ID NO: 5341123 - DNA, 14 bp, Homo sapiens
ttttgtcatgttat

SEQ ID NO: 5341124 - DNA, 13 bp, Homo sapiens
ttttgtcattaaa

SEQ ID NO: 5341125 - DNA, 18 bp, Homo sapiens
ttttgtcattttctccat

SEQ ID NO: 5341126 - DNA, 13 bp, Homo sapiens
ttttgtccatctt

SEQ ID NO: 5341127 - DNA, 23 bp, Homo sapiens
ttttgtcccattttccccttcct

SEQ ID NO: 5341128 - DNA, 16 bp, Homo sapiens
ttttgtcccccaactt

SEQ ID NO: 5341129 - DNA, 20 bp, Homo sapiens
ttttgtcccccaacttgaga

SEQ ID NO: 5341130 - DNA, 15 bp, Homo sapiens
ttttgtctacacacc

SEQ ID NO: 5341131 - DNA, 15 bp, Homo sapiens
ttttgtctatgaagt

SEQ ID NO: 5341132 - DNA, 10 bp, Homo sapiens
ttttgtctct

SEQ ID NO: 5341133 - DNA, 14 bp, Homo sapiens
ttttgtctgagcct

SEQ ID NO: 5341134 - DNA, 15 bp, Homo sapiens
tttttcaaaaatgct

SEQ ID NO: 5341135 - DNA, 13 bp, Homo sapiens
tttttcaaaaatt

SEQ ID NO: 5341136 - DNA, 21 bp, Homo sapiens
tttttcaaacaagtatgaatc

SEQ ID NO: 5341137 - DNA, 17 bp, Homo sapiens
tttttcaaagacttcat

SEQ ID NO: 5341138 - DNA, 15 bp, Homo sapiens
tttttcaaagcaatt

SEQ ID NO: 5341139 - DNA, 14 bp, Homo sapiens
tttttcaaatattg

SEQ ID NO: 5341140 - DNA, 9 bp, Homo sapiens
tttttcaac

SEQ ID NO: 5341141 - DNA, 18 bp, Homo sapiens
tttttcaacaaatatctt

SEQ ID NO: 5341142 - DNA, 14 bp, Homo sapiens
tttttcaaccagca

SEQ ID NO: 5341143 - DNA, 22 bp, Homo sapiens
tttttcaaccccaccctgtttg

SEQ ID NO: 5341144 - DNA, 16 bp, Homo sapiens
tttttcaactttgaat

SEQ ID NO: 5341145 - DNA, 13 bp, Homo sapiens
tttttcaaggaag

SEQ ID NO: 5341146 - DNA, 19 bp, Homo sapiens
tttttcaagttgtaaataa

SEQ ID NO: 5341147 - DNA, 17 bp, Homo sapiens
tttttcaatatattgaa

SEQ ID NO: 5341148 - DNA, 20 bp, Homo sapiens
tttttcaatatattgaactt

SEQ ID NO: 5341149 - DNA, 16 bp, Homo sapiens
tttttcaatatttatt

SEQ ID NO: 5341150 - DNA, 21 bp, Homo sapiens
tttttcaatcaactttactgt

SEQ ID NO: 5341151 - DNA, 12 bp, Homo sapiens
tttttcaattaa

SEQ ID NO: 5341152 - DNA, 13 bp, Homo sapiens
tttttcaattaaa

SEQ ID NO: 5341153 - DNA, 15 bp, Homo sapiens
tttttcaattaaacg

SEQ ID NO: 5341154 - DNA, 17 bp, Homo sapiens
tttttcaattaaacgga

SEQ ID NO: 5341155 - DNA, 18 bp, Homo sapiens
tttttcaattaaacggat

SEQ ID NO: 5341156 - DNA, 21 bp, Homo sapiens
tttttcaattaaacggattat

SEQ ID NO: 5341157 - DNA, 18 bp, Homo sapiens
tttttcacaatgtgaaac

SEQ ID NO: 5341158 - DNA, 19 bp, Homo sapiens
tttttcacaatgtgaaact

SEQ ID NO: 5341159 - DNA, 20 bp, Homo sapiens
tttttcaccaggttaaaatt

SEQ ID NO: 5341160 - DNA, 19 bp, Homo sapiens
tttttcacctgaaacactt

SEQ ID NO: 5341161 - DNA, 16 bp, Homo sapiens
tttttcacggaagttt

SEQ ID NO: 5341162 - DNA, 19 bp, Homo sapiens
tttttcactctaagtcatg

SEQ ID NO: 5341163 - DNA, 11 bp, Homo sapiens
tttttcactgt

SEQ ID NO: 5341164 - DNA, 13 bp, Homo sapiens
tttttcacttcta

SEQ ID NO: 5341165 - DNA, 22 bp, Homo sapiens
tttttcactttagctatgtgga

SEQ ID NO: 5341166 - DNA, 14 bp, Homo sapiens
tttttcagaaagtt

SEQ ID NO: 5341167 - DNA, 20 bp, Homo sapiens
tttttcagaggtgaattaat

SEQ ID NO: 5341168 - DNA, 12 bp, Homo sapiens
tttttcagagtt

SEQ ID NO: 5341169 - DNA, 17 bp, Homo sapiens
tttttcagatataaata

SEQ ID NO: 5341170 - DNA, 19 bp, Homo sapiens
tttttcagatataaatact

SEQ ID NO: 5341171 - DNA, 11 bp, Homo sapiens
tttttcagctc

SEQ ID NO: 5341172 - DNA, 24 bp, Homo sapiens
tttttcaggctcgccaaggcctag

SEQ ID NO: 5341173 - DNA, 17 bp, Homo sapiens
tttttcagttccaagaa

SEQ ID NO: 5341174 - DNA, 19 bp, Homo sapiens
tttttcagtttaattctgt

SEQ ID NO: 5341175 - DNA, 15 bp, Homo sapiens
tttttcataaactga

SEQ ID NO: 5341176 - DNA, 20 bp, Homo sapiens
tttttcatactgtacacatt

SEQ ID NO: 5341177 - DNA, 19 bp, Homo sapiens
tttttcatatgtggaaata

SEQ ID NO: 5341178 - DNA, 12 bp, Homo sapiens
tttttcatattt

SEQ ID NO: 5341179 - DNA, 12 bp, Homo sapiens
tttttcatcccc

SEQ ID NO: 5341180 - DNA, 20 bp, Homo sapiens
tttttcatcttcagttgtct

SEQ ID NO: 5341181 - DNA, 18 bp, Homo sapiens
tttttcatgattttgaaa

SEQ ID NO: 5341182 - DNA, 13 bp, Homo sapiens
tttttcatgcaca

SEQ ID NO: 5341183 - DNA, 23 bp, Homo sapiens
tttttcatgcgatgacacttgta

SEQ ID NO: 5341184 - DNA, 13 bp, Homo sapiens
tttttcatgtttt

SEQ ID NO: 5341185 - DNA, 20 bp, Homo sapiens
tttttcattaaataaatttg

SEQ ID NO: 5341186 - DNA, 13 bp, Homo sapiens
tttttcattattt

SEQ ID NO: 5341187 - DNA, 23 bp, Homo sapiens
tttttcattcatcccattaatca

SEQ ID NO: 5341188 - DNA, 13 bp, Homo sapiens
tttttcattcatg

SEQ ID NO: 5341189 - DNA, 16 bp, Homo sapiens
tttttcattcatgaat

SEQ ID NO: 5341190 - DNA, 18 bp, Homo sapiens
tttttcattgtgttttct

SEQ ID NO: 5341191 - DNA, 11 bp, Homo sapiens
tttttcatttc

SEQ ID NO: 5341192 - DNA, 18 bp, Homo sapiens
tttttcattttaaaaagt

SEQ ID NO: 5341193 - DNA, 12 bp, Homo sapiens
tttttcattttt

SEQ ID NO: 5341194 - DNA, 11 bp, Homo sapiens
tttttccaaaa

SEQ ID NO: 5341195 - DNA, 13 bp, Homo sapiens
tttttccaaaaaa

SEQ ID NO: 5341196 - DNA, 19 bp, Homo sapiens
tttttccaaaaaaatactg

SEQ ID NO: 5341197 - DNA, 19 bp, Homo sapiens
tttttccaaaaacaaagtg

SEQ ID NO: 5341198 - DNA, 16 bp, Homo sapiens
tttttccaaaacctca

SEQ ID NO: 5341199 - DNA, 20 bp, Homo sapiens
tttttccaaccaaggaattt

SEQ ID NO: 5341200 - DNA, 14 bp, Homo sapiens
tttttccagaattg

SEQ ID NO: 5341201 - DNA, 14 bp, Homo sapiens
tttttccagattca

SEQ ID NO: 5341202 - DNA, 17 bp, Homo sapiens
tttttccagctccgtgt

SEQ ID NO: 5341203 - DNA, 15 bp, Homo sapiens
tttttccagttccag

SEQ ID NO: 5341204 - DNA, 14 bp, Homo sapiens
tttttccatagttt

SEQ ID NO: 5341205 - DNA, 13 bp, Homo sapiens
tttttccatcatt

SEQ ID NO: 5341206 - DNA, 13 bp, Homo sapiens
tttttccatcttt

SEQ ID NO: 5341207 - DNA, 13 bp, Homo sapiens
tttttccatggac

SEQ ID NO: 5341208 - DNA, 20 bp, Homo sapiens
tttttcccacgtctaactgg

SEQ ID NO: 5341209 - DNA, 11 bp, Homo sapiens
tttttcccagc

SEQ ID NO: 5341210 - DNA, 23 bp, Homo sapiens
tttttcccaggcaaataaaattc

SEQ ID NO: 5341211 - DNA, 21 bp, Homo sapiens
tttttccccagacttgttggc

SEQ ID NO: 5341212 - DNA, 11 bp, Homo sapiens
tttttccccct

SEQ ID NO: 5341213 - DNA, 18 bp, Homo sapiens
tttttccccctatcagtt

SEQ ID NO: 5341214 - DNA, 20 bp, Homo sapiens
tttttcccgtataataaaac

SEQ ID NO: 5341215 - DNA, 18 bp, Homo sapiens
tttttccctatcactgaa

SEQ ID NO: 5341216 - DNA, 19 bp, Homo sapiens
tttttccctccataagttt

SEQ ID NO: 5341217 - DNA, 15 bp, Homo sapiens
tttttccctccccag

SEQ ID NO: 5341218 - DNA, 11 bp, Homo sapiens
tttttccctct

SEQ ID NO: 5341219 - DNA, 20 bp, Homo sapiens
tttttcccttctcttctaac

SEQ ID NO: 5341220 - DNA, 13 bp, Homo sapiens
tttttccgtaaat

SEQ ID NO: 5341221 - DNA, 18 bp, Homo sapiens
tttttcctaagacatttt

SEQ ID NO: 5341222 - DNA, 17 bp, Homo sapiens
tttttcctatgctattg

SEQ ID NO: 5341223 - DNA, 19 bp, Homo sapiens
tttttcctcctttctctgt

SEQ ID NO: 5341224 - DNA, 20 bp, Homo sapiens
tttttcctcctttctctgta

SEQ ID NO: 5341225 - DNA, 16 bp, Homo sapiens
tttttcctcttcagaa

SEQ ID NO: 5341226 - DNA, 14 bp, Homo sapiens
tttttcctggaatt

SEQ ID NO: 5341227 - DNA, 13 bp, Homo sapiens
tttttcctgtcaa

SEQ ID NO: 5341228 - DNA, 17 bp, Homo sapiens
tttttcctgtcctgccc

SEQ ID NO: 5341229 - DNA, 14 bp, Homo sapiens
tttttcctgtcctt

SEQ ID NO: 5341230 - DNA, 19 bp, Homo sapiens
tttttcctgtgaacacata

SEQ ID NO: 5341231 - DNA, 17 bp, Homo sapiens
tttttcctgtgtattaa

SEQ ID NO: 5341232 - DNA, 15 bp, Homo sapiens
tttttccttacataa

SEQ ID NO: 5341233 - DNA, 19 bp, Homo sapiens
tttttccttacataaacat

SEQ ID NO: 5341234 - DNA, 18 bp, Homo sapiens
tttttccttacttttaaa

SEQ ID NO: 5341235 - DNA, 19 bp, Homo sapiens
tttttccttcaaagtttaa

SEQ ID NO: 5341236 - DNA, 22 bp, Homo sapiens
tttttccttcaaagtttaataa

SEQ ID NO: 5341237 - DNA, 17 bp, Homo sapiens
tttttccttgtatttaa

SEQ ID NO: 5341238 - DNA, 22 bp, Homo sapiens
tttttccttgtccccacactcc

SEQ ID NO: 5341239 - DNA, 10 bp, Homo sapiens
tttttccttt

SEQ ID NO: 5341240 - DNA, 18 bp, Homo sapiens
tttttcctttaactgaca

SEQ ID NO: 5341241 - DNA, 12 bp, Homo sapiens
tttttcctttat

SEQ ID NO: 5341242 - DNA, 19 bp, Homo sapiens
tttttcctttataattctt

SEQ ID NO: 5341243 - DNA, 12 bp, Homo sapiens
tttttcctttct

SEQ ID NO: 5341244 - DNA, 17 bp, Homo sapiens
tttttcctttgcattca

SEQ ID NO: 5341245 - DNA, 13 bp, Homo sapiens
tttttccttttca

SEQ ID NO: 5341246 - DNA, 12 bp, Homo sapiens
tttttccttttt

SEQ ID NO: 5341247 - DNA, 16 bp, Homo sapiens
tttttcctttttctga

SEQ ID NO: 5341248 - DNA, 15 bp, Homo sapiens
tttttctaaaacatt

SEQ ID NO: 5341249 - DNA, 18 bp, Homo sapiens
tttttctaaaactaaata

SEQ ID NO: 5341250 - DNA, 22 bp, Homo sapiens
tttttctaaaactaaatagcat

SEQ ID NO: 5341251 - DNA, 13 bp, Homo sapiens
tttttctaaagga

SEQ ID NO: 5341252 - DNA, 14 bp, Homo sapiens
tttttctaagtgta

SEQ ID NO: 5341253 - DNA, 17 bp, Homo sapiens
tttttctacataattgt

SEQ ID NO: 5341254 - DNA, 22 bp, Homo sapiens
tttttctacctgtacacattcc

SEQ ID NO: 5341255 - DNA, 14 bp, Homo sapiens
tttttctagctata

SEQ ID NO: 5341256 - DNA, 21 bp, Homo sapiens
tttttctagtttcagtaaata

SEQ ID NO: 5341257 - DNA, 19 bp, Homo sapiens
tttttctataaatcagtat

SEQ ID NO: 5341258 - DNA, 15 bp, Homo sapiens
tttttctatattatt

SEQ ID NO: 5341259 - DNA, 11 bp, Homo sapiens
tttttctatta

SEQ ID NO: 5341260 - DNA, 18 bp, Homo sapiens
tttttctattaaaagact

SEQ ID NO: 5341261 - DNA, 18 bp, Homo sapiens
tttttctcaaagttttga

SEQ ID NO: 5341262 - DNA, 14 bp, Homo sapiens
tttttctcaaataa

SEQ ID NO: 5341263 - DNA, 14 bp, Homo sapiens
tttttctcatgtat

SEQ ID NO: 5341264 - DNA, 15 bp, Homo sapiens
tttttctccagtgct

SEQ ID NO: 5341265 - DNA, 12 bp, Homo sapiens
tttttctccccg

SEQ ID NO: 5341266 - DNA, 14 bp, Homo sapiens
tttttctccctctg

SEQ ID NO: 5341267 - DNA, 21 bp, Homo sapiens
tttttctcgtccccctccctg

SEQ ID NO: 5341268 - DNA, 12 bp, Homo sapiens
tttttctctcaa

SEQ ID NO: 5341269 - DNA, 18 bp, Homo sapiens
tttttctctcaacaccat

SEQ ID NO: 5341270 - DNA, 10 bp, Homo sapiens
tttttctctt

SEQ ID NO: 5341271 - DNA, 11 bp, Homo sapiens
tttttctcttt

SEQ ID NO: 5341272 - DNA, 10 bp, Homo sapiens
tttttctgaa

SEQ ID NO: 5341273 - DNA, 11 bp, Homo sapiens
tttttctgaat

SEQ ID NO: 5341274 - DNA, 16 bp, Homo sapiens
tttttctgattcaaaa

SEQ ID NO: 5341275 - DNA, 13 bp, Homo sapiens
tttttctgattgt

SEQ ID NO: 5341276 - DNA, 12 bp, Homo sapiens
tttttctgcaca

SEQ ID NO: 5341277 - DNA, 23 bp, Homo sapiens
tttttctgcactgagcagagtct

SEQ ID NO: 5341278 - DNA, 17 bp, Homo sapiens
tttttctgcctgagatt

SEQ ID NO: 5341279 - DNA, 18 bp, Homo sapiens
tttttctgcctgagattc

SEQ ID NO: 5341280 - DNA, 23 bp, Homo sapiens
tttttctgcctgagattctttaa

SEQ ID NO: 5341281 - DNA, 14 bp, Homo sapiens
tttttctgcttttg

SEQ ID NO: 5341282 - DNA, 21 bp, Homo sapiens
tttttctggaggttgataact

SEQ ID NO: 5341283 - DNA, 21 bp, Homo sapiens
tttttctgtaaaagttactaa

SEQ ID NO: 5341284 - DNA, 16 bp, Homo sapiens
tttttctgtaatgtaa

SEQ ID NO: 5341285 - DNA, 16 bp, Homo sapiens
tttttctgtaccagtt

SEQ ID NO: 5341286 - DNA, 13 bp, Homo sapiens
tttttctgtataa

SEQ ID NO: 5341287 - DNA, 22 bp, Homo sapiens
tttttctgtgataactctgcaa

SEQ ID NO: 5341288 - DNA, 11 bp, Homo sapiens
tttttctgtgc

SEQ ID NO: 5341289 - DNA, 14 bp, Homo sapiens
tttttctgttatat

SEQ ID NO: 5341290 - DNA, 15 bp, Homo sapiens
tttttcttaaaaagt

SEQ ID NO: 5341291 - DNA, 21 bp, Homo sapiens
tttttcttaaaagtactttaa

SEQ ID NO: 5341292 - DNA, 21 bp, Homo sapiens
tttttcttcaaatgtttaaac

SEQ ID NO: 5341293 - DNA, 13 bp, Homo sapiens
tttttcttccctt

SEQ ID NO: 5341294 - DNA, 23 bp, Homo sapiens
tttttcttctattaatcaagaga

SEQ ID NO: 5341295 - DNA, 17 bp, Homo sapiens
tttttcttcttttactt

SEQ ID NO: 5341296 - DNA, 22 bp, Homo sapiens
tttttcttgagtactagaattt

SEQ ID NO: 5341297 - DNA, 11 bp, Homo sapiens
tttttcttggt

SEQ ID NO: 5341298 - DNA, 17 bp, Homo sapiens
tttttcttgtctataaa

SEQ ID NO: 5341299 - DNA, 12 bp, Homo sapiens
tttttctttaca

SEQ ID NO: 5341300 - DNA, 20 bp, Homo sapiens
tttttctttcacaaggtata

SEQ ID NO: 5341301 - DNA, 11 bp, Homo sapiens
tttttctttcc

SEQ ID NO: 5341302 - DNA, 15 bp, Homo sapiens
tttttctttgaaatg

SEQ ID NO: 5341303 - DNA, 23 bp, Homo sapiens
tttttctttttaaccctaatctt

SEQ ID NO: 5341304 - DNA, 19 bp, Homo sapiens
tttttctttttccagtgtt

SEQ ID NO: 5341305 - DNA, 17 bp, Homo sapiens
tttttctttttttgcat

SEQ ID NO: 5341306 - DNA, 14 bp, Homo sapiens
tttttgaaaaatat

SEQ ID NO: 5341307 - DNA, 22 bp, Homo sapiens
tttttgaaaaattgtctttcct

SEQ ID NO: 5341308 - DNA, 19 bp, Homo sapiens
tttttgaaaattatgcaaa

SEQ ID NO: 5341309 - DNA, 15 bp, Homo sapiens
tttttgaaacagcag

SEQ ID NO: 5341310 - DNA, 14 bp, Homo sapiens
tttttgaaataata

SEQ ID NO: 5341311 - DNA, 20 bp, Homo sapiens
tttttgaaatgctgaaaatt

SEQ ID NO: 5341312 - DNA, 23 bp, Homo sapiens
tttttgaaccctcggtgtacaca

SEQ ID NO: 5341313 - DNA, 11 bp, Homo sapiens
tttttgaagaa

SEQ ID NO: 5341314 - DNA, 15 bp, Homo sapiens
tttttgaagctgtat

SEQ ID NO: 5341315 - DNA, 21 bp, Homo sapiens
tttttgaaggctttagttctg

SEQ ID NO: 5341316 - DNA, 16 bp, Homo sapiens
aaaacaagctgatagt

SEQ ID NO: 5341317 - DNA, 18 bp, Homo sapiens
aaaacaaggggttacttt

SEQ ID NO: 5341318 - DNA, 22 bp, Homo sapiens
aaaacaagtactggttgacttt

SEQ ID NO: 5341319 - DNA, 20 bp, Homo sapiens
aaaacaagtcatttttgtat

SEQ ID NO: 5341320 - DNA, 22 bp, Homo sapiens
aaaacaagtcatttttgtattt

SEQ ID NO: 5341321 - DNA, 15 bp, Homo sapiens
aaaacaagtgaaata

SEQ ID NO: 5341322 - DNA, 17 bp, Homo sapiens
aaaacaagtgtataact

SEQ ID NO: 5341323 - DNA, 21 bp, Homo sapiens
aaaacaataaatgaatgaata

SEQ ID NO: 5341324 - DNA, 14 bp, Homo sapiens
aaaacaatactaaa

SEQ ID NO: 5341325 - DNA, 16 bp, Homo sapiens
aaaacaatactaaata

SEQ ID NO: 5341326 - DNA, 15 bp, Homo sapiens
aaaacaatatatttg

SEQ ID NO: 5341327 - DNA, 15 bp, Homo sapiens
aaaacaatattgttt

SEQ ID NO: 5341328 - DNA, 14 bp, Homo sapiens
aaaacaatatttat

SEQ ID NO: 5341329 - DNA, 16 bp, Homo sapiens
aaaacacaaaatgaat

SEQ ID NO: 5341330 - DNA, 17 bp, Homo sapiens
aaaacacaaaatgaata

SEQ ID NO: 5341331 - DNA, 13 bp, Homo sapiens
aaaacacacaggt

SEQ ID NO: 5341332 - DNA, 14 bp, Homo sapiens
aaaacacacataaa

SEQ ID NO: 5341333 - DNA, 22 bp, Homo sapiens
aaaacacacgcgcgcacacaca

SEQ ID NO: 5341334 - DNA, 19 bp, Homo sapiens
aaaacacactactacctct

SEQ ID NO: 5341335 - DNA, 11 bp, Homo sapiens
aaaacacagag

SEQ ID NO: 5341336 - DNA, 13 bp, Homo sapiens
aaaacacagtatt

SEQ ID NO: 5341337 - DNA, 21 bp, Homo sapiens
aaaacacagtgtttttgtaaa

SEQ ID NO: 5341338 - DNA, 11 bp, Homo sapiens
aaaacacatga

SEQ ID NO: 5341339 - DNA, 14 bp, Homo sapiens
aaaacacatgatac

SEQ ID NO: 5341340 - DNA, 16 bp, Homo sapiens
aaaacacattatgtat

SEQ ID NO: 5341341 - DNA, 21 bp, Homo sapiens
aaaacacattatgtatcttag

SEQ ID NO: 5341342 - DNA, 18 bp, Homo sapiens
aaaacacattttccatat

SEQ ID NO: 5341343 - DNA, 17 bp, Homo sapiens
aaaacacatttttctta

SEQ ID NO: 5341344 - DNA, 18 bp, Homo sapiens
aaaacaccagctgtatat

SEQ ID NO: 5341345 - DNA, 14 bp, Homo sapiens
aaaacaccagcttt

SEQ ID NO: 5341346 - DNA, 23 bp, Homo sapiens
aaaacaccatcattaagaataat

SEQ ID NO: 5341347 - DNA, 21 bp, Homo sapiens
aaaacacccttgaaaatatat

SEQ ID NO: 5341348 - DNA, 21 bp, Homo sapiens
aaaacaccgcttctgcctttt

SEQ ID NO: 5341349 - DNA, 16 bp, Homo sapiens
aaaacacctaagtgac

SEQ ID NO: 5341350 - DNA, 15 bp, Homo sapiens
aaaacacctagcttt

SEQ ID NO: 5341351 - DNA, 18 bp, Homo sapiens
aaaacacggccctcctgg

SEQ ID NO: 5341352 - DNA, 19 bp, Homo sapiens
aaaacacggccctcctggg

SEQ ID NO: 5341353 - DNA, 14 bp, Homo sapiens
aaaacactagtttt

SEQ ID NO: 5341354 - DNA, 18 bp, Homo sapiens
aaaacactgccatcttag

SEQ ID NO: 5341355 - DNA, 11 bp, Homo sapiens
aaaacactgct

SEQ ID NO: 5341356 - DNA, 22 bp, Homo sapiens
aaaacactggattcatttcatc

SEQ ID NO: 5341357 - DNA, 23 bp, Homo sapiens
aaaacactgtggaactaataaat

SEQ ID NO: 5341358 - DNA, 14 bp, Homo sapiens
aaaacacttatcct

SEQ ID NO: 5341359 - DNA, 19 bp, Homo sapiens
aaaacacttctgtcctgtg

SEQ ID NO: 5341360 - DNA, 12 bp, Homo sapiens
aaaacagaaaaa

SEQ ID NO: 5341361 - DNA, 13 bp, Homo sapiens
aaaacagaaattg

SEQ ID NO: 5341362 - DNA, 14 bp, Homo sapiens
aaaacagaacactt

SEQ ID NO: 5341363 - DNA, 20 bp, Homo sapiens
aaaacagaacgggttctccc

SEQ ID NO: 5341364 - DNA, 17 bp, Homo sapiens
aaaacagacactggcat

SEQ ID NO: 5341365 - DNA, 22 bp, Homo sapiens
aaaacagacatcatgctggtga

SEQ ID NO: 5341366 - DNA, 12 bp, Homo sapiens
aaaacagatatt

SEQ ID NO: 5341367 - DNA, 18 bp, Homo sapiens
aaaacagattctatatta

SEQ ID NO: 5341368 - DNA, 16 bp, Homo sapiens
aaaacagcagtttgtg

SEQ ID NO: 5341369 - DNA, 16 bp, Homo sapiens
aaaacagcattgcttt

SEQ ID NO: 5341370 - DNA, 20 bp, Homo sapiens
aaaacagcattgctttctga

SEQ ID NO: 5341371 - DNA, 17 bp, Homo sapiens
aaaacagccactgaata

SEQ ID NO: 5341372 - DNA, 18 bp, Homo sapiens
aaaacagcctcacagaag

SEQ ID NO: 5341373 - DNA, 18 bp, Homo sapiens
aaaacagctagtagacat

SEQ ID NO: 5341374 - DNA, 15 bp, Homo sapiens
aaaacagctttgtct

SEQ ID NO: 5341375 - DNA, 22 bp, Homo sapiens
aaaacagctttgtctccaaaga

SEQ ID NO: 5341376 - DNA, 17 bp, Homo sapiens
aaaacaggcactgccct

SEQ ID NO: 5341377 - DNA, 23 bp, Homo sapiens
aaaacaggcactgccctggtggc

SEQ ID NO: 5341378 - DNA, 13 bp, Homo sapiens
aaaacaggcagct

SEQ ID NO: 5341379 - DNA, 18 bp, Homo sapiens
aaaacagggccacataga

SEQ ID NO: 5341380 - DNA, 17 bp, Homo sapiens
aaaacaggtagaattat

SEQ ID NO: 5341381 - DNA, 19 bp, Homo sapiens
aaaacaggtatatactttg

SEQ ID NO: 5341382 - DNA, 18 bp, Homo sapiens
aaaacaggtttttgattt

SEQ ID NO: 5341383 - DNA, 17 bp, Homo sapiens
aaaacagtaaatgaaca

SEQ ID NO: 5341384 - DNA, 13 bp, Homo sapiens
aaaacagtatctc

SEQ ID NO: 5341385 - DNA, 13 bp, Homo sapiens
aaaacagtattta

SEQ ID NO: 5341386 - DNA, 21 bp, Homo sapiens
aaaacagtatttattttgtaa

SEQ ID NO: 5341387 - DNA, 19 bp, Homo sapiens
aaaacagtggatcacaaag

SEQ ID NO: 5341388 - DNA, 21 bp, Homo sapiens
aaaacagttggcatgcatccc

SEQ ID NO: 5341389 - DNA, 15 bp, Homo sapiens
aaaacataacataaa

SEQ ID NO: 5341390 - DNA, 20 bp, Homo sapiens
aaaacataatcttctgcctt

SEQ ID NO: 5341391 - DNA, 17 bp, Homo sapiens
aaaacatacttacattt

SEQ ID NO: 5341392 - DNA, 18 bp, Homo sapiens
aaaacatacttacatttc

SEQ ID NO: 5341393 - DNA, 19 bp, Homo sapiens
aaaacatacttacatttca

SEQ ID NO: 5341394 - DNA, 20 bp, Homo sapiens
aaaacatacttacatttcag

SEQ ID NO: 5341395 - DNA, 14 bp, Homo sapiens
aaaacatagactga

SEQ ID NO: 5341396 - DNA, 16 bp, Homo sapiens
aaaacatagcatctca

SEQ ID NO: 5341397 - DNA, 16 bp, Homo sapiens
aaaacatatcaattca

SEQ ID NO: 5341398 - DNA, 19 bp, Homo sapiens
aaaacatatcaattcaaca

SEQ ID NO: 5341399 - DNA, 19 bp, Homo sapiens
aaaacatatgaaatataaa

SEQ ID NO: 5341400 - DNA, 15 bp, Homo sapiens
aaaacatatttcatt

SEQ ID NO: 5341401 - DNA, 21 bp, Homo sapiens
aaaacatatttcattttaaca

SEQ ID NO: 5341402 - DNA, 19 bp, Homo sapiens
aaaacatcactatcaattt

SEQ ID NO: 5341403 - DNA, 19 bp, Homo sapiens
aaaacatcattccttttta

SEQ ID NO: 5341404 - DNA, 20 bp, Homo sapiens
aaaacatccacttaagttct

SEQ ID NO: 5341405 - DNA, 21 bp, Homo sapiens
aaaacatccacttaagttctt

SEQ ID NO: 5341406 - DNA, 22 bp, Homo sapiens
aaaacatccacttaagttcttt

SEQ ID NO: 5341407 - DNA, 15 bp, Homo sapiens
aaaacatcccaaact

SEQ ID NO: 5341408 - DNA, 17 bp, Homo sapiens
aaaacatcccaaacttt

SEQ ID NO: 5341409 - DNA, 20 bp, Homo sapiens
aaaacatcccaaactttaaa

SEQ ID NO: 5341410 - DNA, 21 bp, Homo sapiens
aaaacatcccaaactttaaaa

SEQ ID NO: 5341411 - DNA, 21 bp, Homo sapiens
aaaacatctattctctccaaa

SEQ ID NO: 5341412 - DNA, 14 bp, Homo sapiens
aaaacatctttgaa

SEQ ID NO: 5341413 - DNA, 16 bp, Homo sapiens
aaaacatctttgaaat

SEQ ID NO: 5341414 - DNA, 13 bp, Homo sapiens
aaaacatgagaaa

SEQ ID NO: 5341415 - DNA, 16 bp, Homo sapiens
aaaacatgagaaatgt

SEQ ID NO: 5341416 - DNA, 20 bp, Homo sapiens
aaaacatgagcttacattct

SEQ ID NO: 5341417 - DNA, 19 bp, Homo sapiens
aaaacatggcaataaatgg

SEQ ID NO: 5341418 - DNA, 16 bp, Homo sapiens
aaaacatggtagaatt

SEQ ID NO: 5341419 - DNA, 19 bp, Homo sapiens
aaaacatgtaatataaaga

SEQ ID NO: 5341420 - DNA, 20 bp, Homo sapiens
aaaacatgttagtcaaggac

SEQ ID NO: 5341421 - DNA, 20 bp, Homo sapiens
aaaacatgtttaaatagcct

SEQ ID NO: 5341422 - DNA, 23 bp, Homo sapiens
aaaacatgtttaaatagcctaaa

SEQ ID NO: 5341423 - DNA, 14 bp, Homo sapiens
aaaacattaagaaa

SEQ ID NO: 5341424 - DNA, 15 bp, Homo sapiens
aaaacattagaagaa

SEQ ID NO: 5341425 - DNA, 14 bp, Homo sapiens
aaaacattccaaga

SEQ ID NO: 5341426 - DNA, 14 bp, Homo sapiens
aaaacattgaaata

SEQ ID NO: 5341427 - DNA, 14 bp, Homo sapiens
aaaacattggatta

SEQ ID NO: 5341428 - DNA, 21 bp, Homo sapiens
aaaacattggattatcctgag

SEQ ID NO: 5341429 - DNA, 15 bp, Homo sapiens
aaaacatttaacata

SEQ ID NO: 5341430 - DNA, 19 bp, Homo sapiens
aaaacatttaatattatat

SEQ ID NO: 5341431 - DNA, 13 bp, Homo sapiens
aaaacatttattt

SEQ ID NO: 5341432 - DNA, 22 bp, Homo sapiens
aaaacatttattttgacataaa

SEQ ID NO: 5341433 - DNA, 14 bp, Homo sapiens
aaaacatttcatgt

SEQ ID NO: 5341434 - DNA, 16 bp, Homo sapiens
aaaacatttcatgtat

SEQ ID NO: 5341435 - DNA, 15 bp, Homo sapiens
aaaacatttcttaaa

SEQ ID NO: 5341436 - DNA, 12 bp, Homo sapiens
aaaacatttgaa

SEQ ID NO: 5341437 - DNA, 18 bp, Homo sapiens
aaaacatttggcagaaaa

SEQ ID NO: 5341438 - DNA, 15 bp, Homo sapiens
aaaacattttaaaat

SEQ ID NO: 5341439 - DNA, 21 bp, Homo sapiens
aaaacattttaaaatcaactt

SEQ ID NO: 5341440 - DNA, 17 bp, Homo sapiens
aaaacattttaaatgga

SEQ ID NO: 5341441 - DNA, 19 bp, Homo sapiens
aaaacattttcacacaata

SEQ ID NO: 5341442 - DNA, 18 bp, Homo sapiens
aaaacattttgaaggaaa

SEQ ID NO: 5341443 - DNA, 11 bp, Homo sapiens
aaaacattttt

SEQ ID NO: 5341444 - DNA, 14 bp, Homo sapiens
aaaaccaaactggg

SEQ ID NO: 5341445 - DNA, 17 bp, Homo sapiens
aaaaccaaactgggtct

SEQ ID NO: 5341446 - DNA, 21 bp, Homo sapiens
aaaaccaaacttgttcattta

SEQ ID NO: 5341447 - DNA, 13 bp, Homo sapiens
aaaaccaaagagg

SEQ ID NO: 5341448 - DNA, 22 bp, Homo sapiens
aaaaccaaagagggcttcctct

SEQ ID NO: 5341449 - DNA, 13 bp, Homo sapiens
aaaaccaaataag

SEQ ID NO: 5341450 - DNA, 12 bp, Homo sapiens
aaaaccaaatta

SEQ ID NO: 5341451 - DNA, 16 bp, Homo sapiens
aaaaccaaattagcca

SEQ ID NO: 5341452 - DNA, 17 bp, Homo sapiens
aaaaccaaattttaaaa

SEQ ID NO: 5341453 - DNA, 13 bp, Homo sapiens
aaaaccaatgatt

SEQ ID NO: 5341454 - DNA, 14 bp, Homo sapiens
aaaaccaatgattc

SEQ ID NO: 5341455 - DNA, 23 bp, Homo sapiens
aaaaccaatgattcataacaatg

SEQ ID NO: 5341456 - DNA, 15 bp, Homo sapiens
aaaaccaatgttctc

SEQ ID NO: 5341457 - DNA, 20 bp, Homo sapiens
aaaaccaattcatgaagtga

SEQ ID NO: 5341458 - DNA, 15 bp, Homo sapiens
aaaaccacacaaaga

SEQ ID NO: 5341459 - DNA, 13 bp, Homo sapiens
aaaaccacagata

SEQ ID NO: 5341460 - DNA, 12 bp, Homo sapiens
aaaaccacagca

SEQ ID NO: 5341461 - DNA, 13 bp, Homo sapiens
aaaaccacagcag

SEQ ID NO: 5341462 - DNA, 19 bp, Homo sapiens
aaaaccacagccctgtcag

SEQ ID NO: 5341463 - DNA, 20 bp, Homo sapiens
aaaaccacagccctgtcagt

SEQ ID NO: 5341464 - DNA, 17 bp, Homo sapiens
aaaaccacagctgggca

SEQ ID NO: 5341465 - DNA, 22 bp, Homo sapiens
aaaaccacagttattaattaaa

SEQ ID NO: 5341466 - DNA, 14 bp, Homo sapiens
aaaaccacatgggc

SEQ ID NO: 5341467 - DNA, 22 bp, Homo sapiens
aaaaccacctggttgaatataa

SEQ ID NO: 5341468 - DNA, 21 bp, Homo sapiens
aaaaccagaatcataattttc

SEQ ID NO: 5341469 - DNA, 13 bp, Homo sapiens
aaaaccagaatta

SEQ ID NO: 5341470 - DNA, 15 bp, Homo sapiens
aaaaccagaattagg

SEQ ID NO: 5341471 - DNA, 14 bp, Homo sapiens
aaaaccaggctttc

SEQ ID NO: 5341472 - DNA, 22 bp, Homo sapiens
aaaaccagtctgtgtttacaga

SEQ ID NO: 5341473 - DNA, 19 bp, Homo sapiens
aaaaccagtcttctccctg

SEQ ID NO: 5341474 - DNA, 17 bp, Homo sapiens
aaaaccagttttgctgc

SEQ ID NO: 5341475 - DNA, 17 bp, Homo sapiens
aaaaccataaaataaat

SEQ ID NO: 5341476 - DNA, 20 bp, Homo sapiens
aaaaccataaaataaatttt

SEQ ID NO: 5341477 - DNA, 12 bp, Homo sapiens
aaaaccatattt

SEQ ID NO: 5341478 - DNA, 15 bp, Homo sapiens
aaaaccatattttat

SEQ ID NO: 5341479 - DNA, 22 bp, Homo sapiens
aaaaccatattttattgtattt

SEQ ID NO: 5341480 - DNA, 21 bp, Homo sapiens
aaaaccatcagatatttctta

SEQ ID NO: 5341481 - DNA, 22 bp, Homo sapiens
aaaaccatcagatatttcttat

SEQ ID NO: 5341482 - DNA, 16 bp, Homo sapiens
aaaaccatgcagcttc

SEQ ID NO: 5341483 - DNA, 18 bp, Homo sapiens
aaaaccatgcagcttcat

SEQ ID NO: 5341484 - DNA, 14 bp, Homo sapiens
aaaaccattgcttc

SEQ ID NO: 5341485 - DNA, 21 bp, Homo sapiens
aaaaccatttttgaaccttaa

SEQ ID NO: 5341486 - DNA, 19 bp, Homo sapiens
aaaacccaagtttatttct

SEQ ID NO: 5341487 - DNA, 14 bp, Homo sapiens
aaaacccaatgtca

SEQ ID NO: 5341488 - DNA, 12 bp, Homo sapiens
aaaacccagaga

SEQ ID NO: 5341489 - DNA, 12 bp, Homo sapiens
aaaacccagctg

SEQ ID NO: 5341490 - DNA, 14 bp, Homo sapiens
aaaacccagggcaa

SEQ ID NO: 5341491 - DNA, 12 bp, Homo sapiens
aaaacccatcgt

SEQ ID NO: 5341492 - DNA, 17 bp, Homo sapiens
aaaaccccatagtgcct

SEQ ID NO: 5341493 - DNA, 18 bp, Homo sapiens
aaaaccccccagatatca

SEQ ID NO: 5341494 - DNA, 18 bp, Homo sapiens
aaaacccctaaaaacaaa

SEQ ID NO: 5341495 - DNA, 14 bp, Homo sapiens
aaaagggaggggga

SEQ ID NO: 5341496 - DNA, 14 bp, Homo sapiens
aaaagggagttttt

SEQ ID NO: 5341497 - DNA, 18 bp, Homo sapiens
aaaagggcaataaatgcc

SEQ ID NO: 5341498 - DNA, 23 bp, Homo sapiens
aaaagggcagggcatctcctgtg

SEQ ID NO: 5341499 - DNA, 22 bp, Homo sapiens
aaaagggccaaagaaccaaaga

SEQ ID NO: 5341500 - DNA, 13 bp, Homo sapiens
aaaagggccaggt

SEQ ID NO: 5341501 - DNA, 18 bp, Homo sapiens
aaaagggcggaagagtta

SEQ ID NO: 5341502 - DNA, 19 bp, Homo sapiens
aaaagggctctttagccag

SEQ ID NO: 5341503 - DNA, 13 bp, Homo sapiens
aaaaggggctcct

SEQ ID NO: 5341504 - DNA, 15 bp, Homo sapiens
aaaagggtcaaacct

SEQ ID NO: 5341505 - DNA, 17 bp, Homo sapiens
aaaagggtcagaaggat

SEQ ID NO: 5341506 - DNA, 14 bp, Homo sapiens
aaaaggtaaaactt

SEQ ID NO: 5341507 - DNA, 16 bp, Homo sapiens
aaaaggtaactaactg

SEQ ID NO: 5341508 - DNA, 22 bp, Homo sapiens
aaaaggtagtttttctgtcatt

SEQ ID NO: 5341509 - DNA, 18 bp, Homo sapiens
aaaaggtataaataataa

SEQ ID NO: 5341510 - DNA, 14 bp, Homo sapiens
aaaaggtataatta

SEQ ID NO: 5341511 - DNA, 18 bp, Homo sapiens
aaaaggtattttgaatac

SEQ ID NO: 5341512 - DNA, 23 bp, Homo sapiens
aaaaggtcctacgaaaacggaat

SEQ ID NO: 5341513 - DNA, 15 bp, Homo sapiens
aaaaggtctttaaaa

SEQ ID NO: 5341514 - DNA, 13 bp, Homo sapiens
aaaaggtgaaaat

SEQ ID NO: 5341515 - DNA, 13 bp, Homo sapiens
aaaaggtgaccct

SEQ ID NO: 5341516 - DNA, 20 bp, Homo sapiens
aaaaggtgattaaatattta

SEQ ID NO: 5341517 - DNA, 20 bp, Homo sapiens
aaaaggtgtccttttccttt

SEQ ID NO: 5341518 - DNA, 14 bp, Homo sapiens
aaaaggttaagcca

SEQ ID NO: 5341519 - DNA, 16 bp, Homo sapiens
aaaaggttaataaagt

SEQ ID NO: 5341520 - DNA, 20 bp, Homo sapiens
aaaaggttctgaataatgaa

SEQ ID NO: 5341521 - DNA, 15 bp, Homo sapiens
aaaaggttgaataat

SEQ ID NO: 5341522 - DNA, 19 bp, Homo sapiens
aaaaggttgactcaagttt

SEQ ID NO: 5341523 - DNA, 22 bp, Homo sapiens
aaaaggttgccaaattgctgca

SEQ ID NO: 5341524 - DNA, 19 bp, Homo sapiens
aaaaggtttatgaaaaaga

SEQ ID NO: 5341525 - DNA, 20 bp, Homo sapiens
aaaaggtttatgaaaaagaa

SEQ ID NO: 5341526 - DNA, 22 bp, Homo sapiens
aaaaggtttctttttttttcct

SEQ ID NO: 5341527 - DNA, 13 bp, Homo sapiens
aaaaggtttgaga

SEQ ID NO: 5341528 - DNA, 15 bp, Homo sapiens
aaaaggttttatttt

SEQ ID NO: 5341529 - DNA, 16 bp, Homo sapiens
aaaaggttttattttg

SEQ ID NO: 5341530 - DNA, 23 bp, Homo sapiens
aaaaggttttattttgtaattat

SEQ ID NO: 5341531 - DNA, 23 bp, Homo sapiens
aaaagtaaaacagatttgttcat

SEQ ID NO: 5341532 - DNA, 13 bp, Homo sapiens
aaaagtaaaatgt

SEQ ID NO: 5341533 - DNA, 11 bp, Homo sapiens
aaaagtaaatg

SEQ ID NO: 5341534 - DNA, 20 bp, Homo sapiens
aaaagtaacaaggtgtcttt

SEQ ID NO: 5341535 - DNA, 12 bp, Homo sapiens
aaaagtaacttg

SEQ ID NO: 5341536 - DNA, 22 bp, Homo sapiens
aaaagtaagaacagctcatctt

SEQ ID NO: 5341537 - DNA, 19 bp, Homo sapiens
aaaagtaagggaataaatt

SEQ ID NO: 5341538 - DNA, 13 bp, Homo sapiens
aaaagtaatattt

SEQ ID NO: 5341539 - DNA, 17 bp, Homo sapiens
aaaagtaatctttaaac

SEQ ID NO: 5341540 - DNA, 13 bp, Homo sapiens
aaaagtaatgcct

SEQ ID NO: 5341541 - DNA, 15 bp, Homo sapiens
aaaagtaattaattg

SEQ ID NO: 5341542 - DNA, 14 bp, Homo sapiens
aaaagtaattgtag

SEQ ID NO: 5341543 - DNA, 23 bp, Homo sapiens
aaaagtaattttgtcacattatt

SEQ ID NO: 5341544 - DNA, 20 bp, Homo sapiens
aaaagtacaatgaactgctt

SEQ ID NO: 5341545 - DNA, 13 bp, Homo sapiens
aaaagtacatagt

SEQ ID NO: 5341546 - DNA, 14 bp, Homo sapiens
aaaagtacattgct

SEQ ID NO: 5341547 - DNA, 16 bp, Homo sapiens
aaaagtacattgctta

SEQ ID NO: 5341548 - DNA, 13 bp, Homo sapiens
aaaagtacattta

SEQ ID NO: 5341549 - DNA, 17 bp, Homo sapiens
aaaagtacatttaatac

SEQ ID NO: 5341550 - DNA, 16 bp, Homo sapiens
aaaagtaccagcatgt

SEQ ID NO: 5341551 - DNA, 17 bp, Homo sapiens
aaaagtactttaaaaag

SEQ ID NO: 5341552 - DNA, 13 bp, Homo sapiens
aaaagtagaactt

SEQ ID NO: 5341553 - DNA, 19 bp, Homo sapiens
aaaagtagaattatatcta

SEQ ID NO: 5341554 - DNA, 20 bp, Homo sapiens
aaaagtagagaaatggattc

SEQ ID NO: 5341555 - DNA, 19 bp, Homo sapiens
aaaagtagtttgaatgttt

SEQ ID NO: 5341556 - DNA, 20 bp, Homo sapiens
aaaagtatacttttgtttca

SEQ ID NO: 5341557 - DNA, 17 bp, Homo sapiens
aaaagtatattaaacaa

SEQ ID NO: 5341558 - DNA, 22 bp, Homo sapiens
aaaagtatattaaacaaagttt

SEQ ID NO: 5341559 - DNA, 20 bp, Homo sapiens
aaaagtatattcaaaaatta

SEQ ID NO: 5341560 - DNA, 23 bp, Homo sapiens
aaaagtatgcagattatttgccc

SEQ ID NO: 5341561 - DNA, 19 bp, Homo sapiens
aaaagtatgtgaatatgaa

SEQ ID NO: 5341562 - DNA, 13 bp, Homo sapiens
aaaagtattatca

SEQ ID NO: 5341563 - DNA, 20 bp, Homo sapiens
aaaagtattttgaagtttac

SEQ ID NO: 5341564 - DNA, 19 bp, Homo sapiens
aaaagtatttttttaagtt

SEQ ID NO: 5341565 - DNA, 16 bp, Homo sapiens
aaaagtcacaatgttc

SEQ ID NO: 5341566 - DNA, 19 bp, Homo sapiens
aaaagtcacaatgttcttt

SEQ ID NO: 5341567 - DNA, 14 bp, Homo sapiens
aaaagtcagagaca

SEQ ID NO: 5341568 - DNA, 15 bp, Homo sapiens
aaaagtcagcatttt

SEQ ID NO: 5341569 - DNA, 13 bp, Homo sapiens
aaaagtcataaat

SEQ ID NO: 5341570 - DNA, 14 bp, Homo sapiens
aaaagtcataaatg

SEQ ID NO: 5341571 - DNA, 17 bp, Homo sapiens
aaaagtcataaatgcat

SEQ ID NO: 5341572 - DNA, 16 bp, Homo sapiens
aaaagtcattcagtta

SEQ ID NO: 5341573 - DNA, 22 bp, Homo sapiens
aaaagtccaattttaatttagt

SEQ ID NO: 5341574 - DNA, 20 bp, Homo sapiens
aaaagtccataccttatata

SEQ ID NO: 5341575 - DNA, 21 bp, Homo sapiens
aaaagtccctccctgcctgag

SEQ ID NO: 5341576 - DNA, 20 bp, Homo sapiens
aaaagtccttgcaagaatgg

SEQ ID NO: 5341577 - DNA, 23 bp, Homo sapiens
aaaagtcgttttccaaactgact

SEQ ID NO: 5341578 - DNA, 16 bp, Homo sapiens
aaaagtctacctgtgt

SEQ ID NO: 5341579 - DNA, 14 bp, Homo sapiens
aaaagtctatttta

SEQ ID NO: 5341580 - DNA, 19 bp, Homo sapiens
aaaagtctatttttttaac

SEQ ID NO: 5341581 - DNA, 20 bp, Homo sapiens
aaaagtctctatttaaattc

SEQ ID NO: 5341582 - DNA, 17 bp, Homo sapiens
aaaagtctgcattacat

SEQ ID NO: 5341583 - DNA, 13 bp, Homo sapiens
aaaagtcttccta

SEQ ID NO: 5341584 - DNA, 18 bp, Homo sapiens
aaaagtcttttaaaaagt

SEQ ID NO: 5341585 - DNA, 19 bp, Homo sapiens
aaaagtcttttaaaaagta

SEQ ID NO: 5341586 - DNA, 21 bp, Homo sapiens
aaaagtgaaaaaaagaaacga

SEQ ID NO: 5341587 - DNA, 23 bp, Homo sapiens
aaaagtgaaccatctcagacctt

SEQ ID NO: 5341588 - DNA, 16 bp, Homo sapiens
aaaagtgaacttttgt

SEQ ID NO: 5341589 - DNA, 20 bp, Homo sapiens
aaaagtgaatgaaagattaa

SEQ ID NO: 5341590 - DNA, 13 bp, Homo sapiens
aaaagtgacacag

SEQ ID NO: 5341591 - DNA, 15 bp, Homo sapiens
aaaagtgacacagca

SEQ ID NO: 5341592 - DNA, 21 bp, Homo sapiens
aaaagtgatcaataaaatgtg

SEQ ID NO: 5341593 - DNA, 18 bp, Homo sapiens
aaaagtgatgtattttca

SEQ ID NO: 5341594 - DNA, 22 bp, Homo sapiens
aaaagtgatgtattttcatagt

SEQ ID NO: 5341595 - DNA, 12 bp, Homo sapiens
aaaagtgatgtg

SEQ ID NO: 5341596 - DNA, 15 bp, Homo sapiens
aaaagtgatgtgatt

SEQ ID NO: 5341597 - DNA, 13 bp, Homo sapiens
aaaagtgcatgat

SEQ ID NO: 5341598 - DNA, 14 bp, Homo sapiens
aaaagtgcattcaa

SEQ ID NO: 5341599 - DNA, 19 bp, Homo sapiens
aaaagtgcattcaacctta

SEQ ID NO: 5341600 - DNA, 15 bp, Homo sapiens
aaaagtgcatttaag

SEQ ID NO: 5341601 - DNA, 14 bp, Homo sapiens
aaaagtgcctcaag

SEQ ID NO: 5341602 - DNA, 20 bp, Homo sapiens
aaaagtgcctcaagaggaat

SEQ ID NO: 5341603 - DNA, 22 bp, Homo sapiens
aaaagtgctgcagggctttaaa

SEQ ID NO: 5341604 - DNA, 17 bp, Homo sapiens
aaaagtgcttagaaagt

SEQ ID NO: 5341605 - DNA, 16 bp, Homo sapiens
aaaagtggaagtgaca

SEQ ID NO: 5341606 - DNA, 19 bp, Homo sapiens
aaaagtggaatcactgtat

SEQ ID NO: 5341607 - DNA, 18 bp, Homo sapiens
aaaagtggattttcctga

SEQ ID NO: 5341608 - DNA, 16 bp, Homo sapiens
aaaagtggcgttgttc

SEQ ID NO: 5341609 - DNA, 21 bp, Homo sapiens
aaaagtggctaattcaattta

SEQ ID NO: 5341610 - DNA, 19 bp, Homo sapiens
aaaagtgggctgcagcagc

SEQ ID NO: 5341611 - DNA, 18 bp, Homo sapiens
aaaagtgggcttgattct

SEQ ID NO: 5341612 - DNA, 18 bp, Homo sapiens
aaaagtggggcagagcct

SEQ ID NO: 5341613 - DNA, 20 bp, Homo sapiens
aaaagtggggctaaatgaag

SEQ ID NO: 5341614 - DNA, 23 bp, Homo sapiens
aaaagtgggttttttagttgaat

SEQ ID NO: 5341615 - DNA, 19 bp, Homo sapiens
aaaagtggtgtaaacttgt

SEQ ID NO: 5341616 - DNA, 12 bp, Homo sapiens
aaaagtgtacaa

SEQ ID NO: 5341617 - DNA, 19 bp, Homo sapiens
aaaagtgtacatgaagaat

SEQ ID NO: 5341618 - DNA, 17 bp, Homo sapiens
aaaagtgtattagatgt

SEQ ID NO: 5341619 - DNA, 20 bp, Homo sapiens
aaaagtgtattttattcagt

SEQ ID NO: 5341620 - DNA, 18 bp, Homo sapiens
aaaagtgtcaccttttct

SEQ ID NO: 5341621 - DNA, 13 bp, Homo sapiens
aaaagtgtccttc

SEQ ID NO: 5341622 - DNA, 15 bp, Homo sapiens
aaaagtgtctcaaag

SEQ ID NO: 5341623 - DNA, 19 bp, Homo sapiens
aaaagtgtgtatatatttt

SEQ ID NO: 5341624 - DNA, 20 bp, Homo sapiens
aaaagtgtgtatatattttg

SEQ ID NO: 5341625 - DNA, 19 bp, Homo sapiens
aaaagtgttgactgtgtca

SEQ ID NO: 5341626 - DNA, 21 bp, Homo sapiens
aaaagtgttgctgattgtcaa

SEQ ID NO: 5341627 - DNA, 21 bp, Homo sapiens
aaaagtgtttatttttcatat

SEQ ID NO: 5341628 - DNA, 23 bp, Homo sapiens
aaaagtgttttgttttttaattc

SEQ ID NO: 5341629 - DNA, 20 bp, Homo sapiens
aaaagtgtttttacatatag

SEQ ID NO: 5341630 - DNA, 14 bp, Homo sapiens
aaaagttaaactaa

SEQ ID NO: 5341631 - DNA, 12 bp, Homo sapiens
aaaagttaagct

SEQ ID NO: 5341632 - DNA, 18 bp, Homo sapiens
aaaagttaatgcttaaga

SEQ ID NO: 5341633 - DNA, 15 bp, Homo sapiens
aaaagttacagaaat

SEQ ID NO: 5341634 - DNA, 22 bp, Homo sapiens
aaaagttactaatatatctgta

SEQ ID NO: 5341635 - DNA, 14 bp, Homo sapiens
aaaagttagctgag

SEQ ID NO: 5341636 - DNA, 18 bp, Homo sapiens
aaaagttagtattaaaat

SEQ ID NO: 5341637 - DNA, 21 bp, Homo sapiens
aaaagttagtattaaaatcta

SEQ ID NO: 5341638 - DNA, 12 bp, Homo sapiens
aaaagttataac

SEQ ID NO: 5341639 - DNA, 17 bp, Homo sapiens
aaaagttataataactg

SEQ ID NO: 5341640 - DNA, 20 bp, Homo sapiens
aaaagttataataactgaac

SEQ ID NO: 5341641 - DNA, 22 bp, Homo sapiens
aaaagttataataactgaactg

SEQ ID NO: 5341642 - DNA, 12 bp, Homo sapiens
aaaagttatata

SEQ ID NO: 5341643 - DNA, 14 bp, Homo sapiens
aaaagttatatcta

SEQ ID NO: 5341644 - DNA, 20 bp, Homo sapiens
aaaagttattacctttacat

SEQ ID NO: 5341645 - DNA, 13 bp, Homo sapiens
aaaagttcagagt

SEQ ID NO: 5341646 - DNA, 13 bp, Homo sapiens
aaaagttcatgtt

SEQ ID NO: 5341647 - DNA, 13 bp, Homo sapiens
aaaagttccaaga

SEQ ID NO: 5341648 - DNA, 23 bp, Homo sapiens
aaaagttccaagagtctaaagat

SEQ ID NO: 5341649 - DNA, 19 bp, Homo sapiens
aaaagttcctctcccttcc

SEQ ID NO: 5341650 - DNA, 21 bp, Homo sapiens
aaaagttcctctcccttccct

SEQ ID NO: 5341651 - DNA, 15 bp, Homo sapiens
aaaagttctttcaac

SEQ ID NO: 5341652 - DNA, 14 bp, Homo sapiens
aaaagttgaaaagc

SEQ ID NO: 5341653 - DNA, 18 bp, Homo sapiens
aaaagttgaagatcgtga

SEQ ID NO: 5341654 - DNA, 16 bp, Homo sapiens
aaaagttgcacattag

SEQ ID NO: 5341655 - DNA, 17 bp, Homo sapiens
aaaagttgcagtctcag

SEQ ID NO: 5341656 - DNA, 18 bp, Homo sapiens
aaaagttgcagtctcaga

SEQ ID NO: 5341657 - DNA, 17 bp, Homo sapiens
aaaagttgcattttaac

SEQ ID NO: 5341658 - DNA, 14 bp, Homo sapiens
aaaagttgctattt

SEQ ID NO: 5341659 - DNA, 14 bp, Homo sapiens
aaaagttgggagtt

SEQ ID NO: 5341660 - DNA, 22 bp, Homo sapiens
aaaagttggtattttataagca

SEQ ID NO: 5341661 - DNA, 18 bp, Homo sapiens
aaaagttgtaatagagaa

SEQ ID NO: 5341662 - DNA, 13 bp, Homo sapiens
aaaagttgttcaa

SEQ ID NO: 5341663 - DNA, 14 bp, Homo sapiens
aaaagttgttcttt

SEQ ID NO: 5341664 - DNA, 18 bp, Homo sapiens
aaaagttgtttaataagt

SEQ ID NO: 5341665 - DNA, 21 bp, Homo sapiens
aaaagtttaacctaaataatt

SEQ ID NO: 5341666 - DNA, 18 bp, Homo sapiens
aaaagtttaatattaaag

SEQ ID NO: 5341667 - DNA, 13 bp, Homo sapiens
aaaagtttacaac

SEQ ID NO: 5341668 - DNA, 23 bp, Homo sapiens
aaaagtttacaacataatctagt

SEQ ID NO: 5341669 - DNA, 16 bp, Homo sapiens
aaaagtttacaagtgt

SEQ ID NO: 5341670 - DNA, 22 bp, Homo sapiens
aaaagtttacaagtgtatatca

SEQ ID NO: 5341671 - DNA, 22 bp, Homo sapiens
aaaagtttattgtttgatgttt

SEQ ID NO: 5341672 - DNA, 12 bp, Homo sapiens
aaaagtttcaat

SEQ ID NO: 5341673 - DNA, 15 bp, Homo sapiens
aaaatgaaaattgta

SEQ ID NO: 5341674 - DNA, 15 bp, Homo sapiens
aaaatgaaagatgat

SEQ ID NO: 5341675 - DNA, 15 bp, Homo sapiens
aaaatgaaagatttt

SEQ ID NO: 5341676 - DNA, 19 bp, Homo sapiens
aaaatgaaagcatgtctca

SEQ ID NO: 5341677 - DNA, 21 bp, Homo sapiens
aaaatgaaagccaaatttata

SEQ ID NO: 5341678 - DNA, 14 bp, Homo sapiens
aaaatgaaagctac

SEQ ID NO: 5341679 - DNA, 13 bp, Homo sapiens
aaaatgaaataaa

SEQ ID NO: 5341680 - DNA, 15 bp, Homo sapiens
aaaatgaaatatttt

SEQ ID NO: 5341681 - DNA, 13 bp, Homo sapiens
aaaatgaaatgca

SEQ ID NO: 5341682 - DNA, 16 bp, Homo sapiens
aaaatgaaatgctaca

SEQ ID NO: 5341683 - DNA, 15 bp, Homo sapiens
aaaatgaaatgtttt

SEQ ID NO: 5341684 - DNA, 16 bp, Homo sapiens
aaaatgaaatgtttta

SEQ ID NO: 5341685 - DNA, 17 bp, Homo sapiens
aaaatgaaatgtttttg

SEQ ID NO: 5341686 - DNA, 20 bp, Homo sapiens
aaaatgaaatttaagcacaa

SEQ ID NO: 5341687 - DNA, 15 bp, Homo sapiens
aaaatgaacatctct

SEQ ID NO: 5341688 - DNA, 18 bp, Homo sapiens
aaaatgaacctgatcact

SEQ ID NO: 5341689 - DNA, 20 bp, Homo sapiens
aaaatgaacctgcaagcctt

SEQ ID NO: 5341690 - DNA, 18 bp, Homo sapiens
aaaatgaactgtattatt

SEQ ID NO: 5341691 - DNA, 11 bp, Homo sapiens
aaaatgaagaa

SEQ ID NO: 5341692 - DNA, 23 bp, Homo sapiens
aaaatgaagattattttttatga

SEQ ID NO: 5341693 - DNA, 18 bp, Homo sapiens
aaaatgaataaaagtgag

SEQ ID NO: 5341694 - DNA, 18 bp, Homo sapiens
aaaatgaatatctattaa

SEQ ID NO: 5341695 - DNA, 15 bp, Homo sapiens
aaaatgaatcctaca

SEQ ID NO: 5341696 - DNA, 16 bp, Homo sapiens
aaaatgaatcctacac

SEQ ID NO: 5341697 - DNA, 13 bp, Homo sapiens
aaaatgaattgaa

SEQ ID NO: 5341698 - DNA, 21 bp, Homo sapiens
aaaatgaattgaaaaacaatt

SEQ ID NO: 5341699 - DNA, 13 bp, Homo sapiens
aaaatgaattgcc

SEQ ID NO: 5341700 - DNA, 16 bp, Homo sapiens
aaaatgaattggttgg

SEQ ID NO: 5341701 - DNA, 15 bp, Homo sapiens
aaaatgaatttggga

SEQ ID NO: 5341702 - DNA, 15 bp, Homo sapiens
aaaatgaattttgta

SEQ ID NO: 5341703 - DNA, 15 bp, Homo sapiens
aaaatgacaacagaa

SEQ ID NO: 5341704 - DNA, 17 bp, Homo sapiens
aaaatgacaacagaaaa

SEQ ID NO: 5341705 - DNA, 18 bp, Homo sapiens
aaaatgacaacagaaaaa

SEQ ID NO: 5341706 - DNA, 15 bp, Homo sapiens
aaaatgacaattgtg

SEQ ID NO: 5341707 - DNA, 15 bp, Homo sapiens
aaaatgacagatgtt

SEQ ID NO: 5341708 - DNA, 15 bp, Homo sapiens
aaaatgacagtttca

SEQ ID NO: 5341709 - DNA, 15 bp, Homo sapiens
aaaatgacatctttt

SEQ ID NO: 5341710 - DNA, 21 bp, Homo sapiens
aaaatgactaaaaatattata

SEQ ID NO: 5341711 - DNA, 14 bp, Homo sapiens
aaaatgactactta

SEQ ID NO: 5341712 - DNA, 13 bp, Homo sapiens
aaaatgactttga

SEQ ID NO: 5341713 - DNA, 14 bp, Homo sapiens
aaaatgagaaagga

SEQ ID NO: 5341714 - DNA, 22 bp, Homo sapiens
aaaatgagactttctaaatcaa

SEQ ID NO: 5341715 - DNA, 14 bp, Homo sapiens
aaaatgagactttt

SEQ ID NO: 5341716 - DNA, 19 bp, Homo sapiens
aaaatgagagctgtaactg

SEQ ID NO: 5341717 - DNA, 18 bp, Homo sapiens
aaaatgagatatgcaata

SEQ ID NO: 5341718 - DNA, 15 bp, Homo sapiens
aaaatgagccctggc

SEQ ID NO: 5341719 - DNA, 22 bp, Homo sapiens
aaaatgagccgtgccaaagtct

SEQ ID NO: 5341720 - DNA, 17 bp, Homo sapiens
aaaatgagctaggcatg

SEQ ID NO: 5341721 - DNA, 18 bp, Homo sapiens
aaaatgaggaatagcaaa

SEQ ID NO: 5341722 - DNA, 15 bp, Homo sapiens
aaaatgaggaatgta

SEQ ID NO: 5341723 - DNA, 19 bp, Homo sapiens
aaaatgaggaatgtatatg

SEQ ID NO: 5341724 - DNA, 16 bp, Homo sapiens
aaaatgaggacatgtt

SEQ ID NO: 5341725 - DNA, 18 bp, Homo sapiens
aaaatgaggatccagggc

SEQ ID NO: 5341726 - DNA, 19 bp, Homo sapiens
aaaatgagggtctcactgc

SEQ ID NO: 5341727 - DNA, 21 bp, Homo sapiens
aaaatgagggtctcactgctt

SEQ ID NO: 5341728 - DNA, 18 bp, Homo sapiens
aaaatgaggttcaactgt

SEQ ID NO: 5341729 - DNA, 16 bp, Homo sapiens
aaaatgagttgtcaca

SEQ ID NO: 5341730 - DNA, 20 bp, Homo sapiens
aaaatgagttgtgaaagttt

SEQ ID NO: 5341731 - DNA, 16 bp, Homo sapiens
aaaatgagttgtgatg

SEQ ID NO: 5341732 - DNA, 14 bp, Homo sapiens
aaaatgagtttgta

SEQ ID NO: 5341733 - DNA, 23 bp, Homo sapiens
aaaatgatacgctggtctggatg

SEQ ID NO: 5341734 - DNA, 16 bp, Homo sapiens
aaaatgatatattaaa

SEQ ID NO: 5341735 - DNA, 23 bp, Homo sapiens
aaaatgatgtgtacccaaacgtg

SEQ ID NO: 5341736 - DNA, 16 bp, Homo sapiens
aaaatgcaaaaaatct

SEQ ID NO: 5341737 - DNA, 22 bp, Homo sapiens
aaaatgcaaatcctatgtgatt

SEQ ID NO: 5341738 - DNA, 15 bp, Homo sapiens
aaaatgcaaatgaat

SEQ ID NO: 5341739 - DNA, 16 bp, Homo sapiens
aaaatgcaaatgaatc

SEQ ID NO: 5341740 - DNA, 19 bp, Homo sapiens
aaaatgcaaatgaatcatt

SEQ ID NO: 5341741 - DNA, 17 bp, Homo sapiens
aaaatgcaatatttgta

SEQ ID NO: 5341742 - DNA, 16 bp, Homo sapiens
aaaatgcaatcaggat

SEQ ID NO: 5341743 - DNA, 20 bp, Homo sapiens
aaaatgcacaaacaatgcaa

SEQ ID NO: 5341744 - DNA, 15 bp, Homo sapiens
aaaatgcaccaaata

SEQ ID NO: 5341745 - DNA, 15 bp, Homo sapiens
aaaatgcatactgtt

SEQ ID NO: 5341746 - DNA, 15 bp, Homo sapiens
aaaatgcatgtgatt

SEQ ID NO: 5341747 - DNA, 20 bp, Homo sapiens
aaaatgcattgaaagaatta

SEQ ID NO: 5341748 - DNA, 13 bp, Homo sapiens
aaaatgcatttaa

SEQ ID NO: 5341749 - DNA, 23 bp, Homo sapiens
aaaatgcatttaaactcatttga

SEQ ID NO: 5341750 - DNA, 20 bp, Homo sapiens
aaaatgcatttaagttgtaa

SEQ ID NO: 5341751 - DNA, 12 bp, Homo sapiens
aaaatgcatttt

SEQ ID NO: 5341752 - DNA, 17 bp, Homo sapiens
aaaatgccaagacatga

SEQ ID NO: 5341753 - DNA, 22 bp, Homo sapiens
aaaatgccacattttgctttat

SEQ ID NO: 5341754 - DNA, 22 bp, Homo sapiens
aaaatgccaccatccaataaaa

SEQ ID NO: 5341755 - DNA, 18 bp, Homo sapiens
aaaatgccagatgttgtt

SEQ ID NO: 5341756 - DNA, 15 bp, Homo sapiens
aaaatgccataatac

SEQ ID NO: 5341757 - DNA, 15 bp, Homo sapiens
aaaatgcccatttgc

SEQ ID NO: 5341758 - DNA, 20 bp, Homo sapiens
aaaatgcctcagtgtatttg

SEQ ID NO: 5341759 - DNA, 11 bp, Homo sapiens
aaaatgccttt

SEQ ID NO: 5341760 - DNA, 23 bp, Homo sapiens
aaaatgcctttgagacagtttct

SEQ ID NO: 5341761 - DNA, 16 bp, Homo sapiens
aaaatgcgaaattatt

SEQ ID NO: 5341762 - DNA, 18 bp, Homo sapiens
aaaatgcggttataaaaa

SEQ ID NO: 5341763 - DNA, 22 bp, Homo sapiens
aaaatgctatctcaaagtttaa

SEQ ID NO: 5341764 - DNA, 23 bp, Homo sapiens
aaaatgctattttaaaattcatg

SEQ ID NO: 5341765 - DNA, 20 bp, Homo sapiens
aaaatgctgcttccactcag

SEQ ID NO: 5341766 - DNA, 22 bp, Homo sapiens
aaaatgctgcttttaaaacata

SEQ ID NO: 5341767 - DNA, 19 bp, Homo sapiens
aaaatgctggctatagatg

SEQ ID NO: 5341768 - DNA, 18 bp, Homo sapiens
aaaatgctggctgagctg

SEQ ID NO: 5341769 - DNA, 21 bp, Homo sapiens
aaaatgctgtattagtcacag

SEQ ID NO: 5341770 - DNA, 23 bp, Homo sapiens
aaaatgctgtattagtcacagag

SEQ ID NO: 5341771 - DNA, 16 bp, Homo sapiens
aaaatgctgttctcaa

SEQ ID NO: 5341772 - DNA, 19 bp, Homo sapiens
aaaatgcttctgttgtaat

SEQ ID NO: 5341773 - DNA, 15 bp, Homo sapiens
aaaatgcttgaccct

SEQ ID NO: 5341774 - DNA, 12 bp, Homo sapiens
aaaatgctttct

SEQ ID NO: 5341775 - DNA, 14 bp, Homo sapiens
aaaatgctttctca

SEQ ID NO: 5341776 - DNA, 15 bp, Homo sapiens
aaaatgctttctcat

SEQ ID NO: 5341777 - DNA, 17 bp, Homo sapiens
aaaatgctttctcatgc

SEQ ID NO: 5341778 - DNA, 22 bp, Homo sapiens
aaaatgctttctcatgcataga

SEQ ID NO: 5341779 - DNA, 20 bp, Homo sapiens
aaaatggaaaaaaacataaa

SEQ ID NO: 5341780 - DNA, 18 bp, Homo sapiens
aaaatggaaaagagagat

SEQ ID NO: 5341781 - DNA, 17 bp, Homo sapiens
aaaatggaaaatataca

SEQ ID NO: 5341782 - DNA, 13 bp, Homo sapiens
aaaatggaaagaa

SEQ ID NO: 5341783 - DNA, 15 bp, Homo sapiens
aaaatggaaagaagg

SEQ ID NO: 5341784 - DNA, 19 bp, Homo sapiens
aaaatggaaagaaggaaaa

SEQ ID NO: 5341785 - DNA, 14 bp, Homo sapiens
aaaatggaaatgta

SEQ ID NO: 5341786 - DNA, 15 bp, Homo sapiens
aaaatggaaatgtaa

SEQ ID NO: 5341787 - DNA, 13 bp, Homo sapiens
aaaatggaaattt

SEQ ID NO: 5341788 - DNA, 23 bp, Homo sapiens
aaaatggaagcaaagacaaaaga

SEQ ID NO: 5341789 - DNA, 14 bp, Homo sapiens
aaaatggaataaaa

SEQ ID NO: 5341790 - DNA, 12 bp, Homo sapiens
aaaatggaatac

SEQ ID NO: 5341791 - DNA, 19 bp, Homo sapiens
aaaatggaattactccaaa

SEQ ID NO: 5341792 - DNA, 20 bp, Homo sapiens
aaaatggacttttgttcatg

SEQ ID NO: 5341793 - DNA, 23 bp, Homo sapiens
aaaatggacttttgttcatggga

SEQ ID NO: 5341794 - DNA, 16 bp, Homo sapiens
aaaatggaggtggaaa

SEQ ID NO: 5341795 - DNA, 14 bp, Homo sapiens
aaaatggatacata

SEQ ID NO: 5341796 - DNA, 17 bp, Homo sapiens
aaaatggatagaaaaaa

SEQ ID NO: 5341797 - DNA, 23 bp, Homo sapiens
aaaatggatagaaaaaaactaaa

SEQ ID NO: 5341798 - DNA, 22 bp, Homo sapiens
aaaatggatattattagaaatt

SEQ ID NO: 5341799 - DNA, 19 bp, Homo sapiens
aaaatggatttaatccatt

SEQ ID NO: 5341800 - DNA, 17 bp, Homo sapiens
aaaatggcaagagatca

SEQ ID NO: 5341801 - DNA, 18 bp, Homo sapiens
aaaatggcaagagatcat

SEQ ID NO: 5341802 - DNA, 15 bp, Homo sapiens
aaaatggcagtgact

SEQ ID NO: 5341803 - DNA, 14 bp, Homo sapiens
aaaatggcagtgat

SEQ ID NO: 5341804 - DNA, 20 bp, Homo sapiens
aaaatggcagtgatgaattt

SEQ ID NO: 5341805 - DNA, 12 bp, Homo sapiens
aaaatggcattt

SEQ ID NO: 5341806 - DNA, 15 bp, Homo sapiens
aaaatggcatttagc

SEQ ID NO: 5341807 - DNA, 18 bp, Homo sapiens
aaaatggcgaacatgtgt

SEQ ID NO: 5341808 - DNA, 19 bp, Homo sapiens
aaaatggcgaacatgtgtt

SEQ ID NO: 5341809 - DNA, 21 bp, Homo sapiens
aaaatggctaactgatgaatt

SEQ ID NO: 5341810 - DNA, 15 bp, Homo sapiens
aaaatggctaataaa

SEQ ID NO: 5341811 - DNA, 20 bp, Homo sapiens
aaaatggctgaagaaacaca

SEQ ID NO: 5341812 - DNA, 21 bp, Homo sapiens
aaaatggctgaagaaacacag

SEQ ID NO: 5341813 - DNA, 17 bp, Homo sapiens
aaaatgggagccaggag

SEQ ID NO: 5341814 - DNA, 18 bp, Homo sapiens
aaaatgggagccaggagt

SEQ ID NO: 5341815 - DNA, 23 bp, Homo sapiens
aaaatggggtttgggcccctcag

SEQ ID NO: 5341816 - DNA, 16 bp, Homo sapiens
aaaatgggttttactg

SEQ ID NO: 5341817 - DNA, 15 bp, Homo sapiens
aaaatggtataagta

SEQ ID NO: 5341818 - DNA, 18 bp, Homo sapiens
aaaatggtatcaaaatta

SEQ ID NO: 5341819 - DNA, 14 bp, Homo sapiens
aaaatggtcagtat

SEQ ID NO: 5341820 - DNA, 22 bp, Homo sapiens
aaaatggtcctatttttgtgaa

SEQ ID NO: 5341821 - DNA, 15 bp, Homo sapiens
aaaatggtggcttca

SEQ ID NO: 5341822 - DNA, 20 bp, Homo sapiens
aaaatggtgttttatcttct

SEQ ID NO: 5341823 - DNA, 21 bp, Homo sapiens
aaaatggttcatattttatag

SEQ ID NO: 5341824 - DNA, 16 bp, Homo sapiens
aaaatggttgatggaa

SEQ ID NO: 5341825 - DNA, 17 bp, Homo sapiens
aaaatggttgatggaaa

SEQ ID NO: 5341826 - DNA, 16 bp, Homo sapiens
aaaatgtaaaggaggg

SEQ ID NO: 5341827 - DNA, 23 bp, Homo sapiens
aaaatgtaaatactcatgaatga

SEQ ID NO: 5341828 - DNA, 19 bp, Homo sapiens
aaaatgtaaattagtttga

SEQ ID NO: 5341829 - DNA, 19 bp, Homo sapiens
aaaatgtaacatcataatt

SEQ ID NO: 5341830 - DNA, 12 bp, Homo sapiens
aaaatgtaactg

SEQ ID NO: 5341831 - DNA, 22 bp, Homo sapiens
aaaatgtaagattatagattct

SEQ ID NO: 5341832 - DNA, 16 bp, Homo sapiens
aaaatgtaatttagaa

SEQ ID NO: 5341833 - DNA, 19 bp, Homo sapiens
aaaatgtaatttagaaact

SEQ ID NO: 5341834 - DNA, 19 bp, Homo sapiens
aaaatgtacaaaataaagt

SEQ ID NO: 5341835 - DNA, 21 bp, Homo sapiens
aaaatgtacactggatatgtt

SEQ ID NO: 5341836 - DNA, 16 bp, Homo sapiens
aaaatgtacatgtatt

SEQ ID NO: 5341837 - DNA, 18 bp, Homo sapiens
aaaatgtacatgtattaa

SEQ ID NO: 5341838 - DNA, 14 bp, Homo sapiens
aaaatgtacttaaa

SEQ ID NO: 5341839 - DNA, 15 bp, Homo sapiens
aaaatgtagaaattc

SEQ ID NO: 5341840 - DNA, 17 bp, Homo sapiens
aaaatgtagaaattcta

SEQ ID NO: 5341841 - DNA, 19 bp, Homo sapiens
aaaatgtagcgacagcatt

SEQ ID NO: 5341842 - DNA, 20 bp, Homo sapiens
aaaatgtagcgacagcattt

SEQ ID NO: 5341843 - DNA, 12 bp, Homo sapiens
aaaatgtaggag

SEQ ID NO: 5341844 - DNA, 18 bp, Homo sapiens
aaaatgtaggctttcatg

SEQ ID NO: 5341845 - DNA, 13 bp, Homo sapiens
aaaatgtagtttt

SEQ ID NO: 5341846 - DNA, 14 bp, Homo sapiens
aaaatgtagtttta

SEQ ID NO: 5341847 - DNA, 18 bp, Homo sapiens
aaaatgtagttttaaata

SEQ ID NO: 5341848 - DNA, 15 bp, Homo sapiens
aaaatgtataaatta

SEQ ID NO: 5341849 - DNA, 17 bp, Homo sapiens
aaaatgtataagttgag

SEQ ID NO: 5341850 - DNA, 14 bp, Homo sapiens
aaaatgtataatga

SEQ ID NO: 5341851 - DNA, 13 bp, Homo sapiens
aaacaaaacaaca

SEQ ID NO: 5341852 - DNA, 14 bp, Homo sapiens
aaacaaaaccaagc

SEQ ID NO: 5341853 - DNA, 22 bp, Homo sapiens
aaacaaaaccaattcatgaagt

SEQ ID NO: 5341854 - DNA, 12 bp, Homo sapiens
aaacaaaaccag

SEQ ID NO: 5341855 - DNA, 17 bp, Homo sapiens
aaacaaaacttgcatct

SEQ ID NO: 5341856 - DNA, 23 bp, Homo sapiens
aaacaaaagctgaacacatttct

SEQ ID NO: 5341857 - DNA, 17 bp, Homo sapiens
aaacaaaagttttaatt

SEQ ID NO: 5341858 - DNA, 12 bp, Homo sapiens
aaacaaaataga

SEQ ID NO: 5341859 - DNA, 21 bp, Homo sapiens
aaacaaaatatctgacatctt

SEQ ID NO: 5341860 - DNA, 22 bp, Homo sapiens
aaacaaaatccttgccttcaaa

SEQ ID NO: 5341861 - DNA, 15 bp, Homo sapiens
aaacaaaatctaaaa

SEQ ID NO: 5341862 - DNA, 16 bp, Homo sapiens
aaacaaaatctgaact

SEQ ID NO: 5341863 - DNA, 13 bp, Homo sapiens
aaacaaaatgatg

SEQ ID NO: 5341864 - DNA, 18 bp, Homo sapiens
aaacaaaattgcaatttc

SEQ ID NO: 5341865 - DNA, 17 bp, Homo sapiens
aaacaaaattgttcttg

SEQ ID NO: 5341866 - DNA, 13 bp, Homo sapiens
aaacaaaatttca

SEQ ID NO: 5341867 - DNA, 18 bp, Homo sapiens
aaacaaaatttcacagtt

SEQ ID NO: 5341868 - DNA, 23 bp, Homo sapiens
aaacaaaatttcacagttctgta

SEQ ID NO: 5341869 - DNA, 15 bp, Homo sapiens
aaacaaacaagctag

SEQ ID NO: 5341870 - DNA, 20 bp, Homo sapiens
aaacaaacatgcagtacttt

SEQ ID NO: 5341871 - DNA, 11 bp, Homo sapiens
aaacaaagaag

SEQ ID NO: 5341872 - DNA, 12 bp, Homo sapiens
aaacaaagacat

SEQ ID NO: 5341873 - DNA, 23 bp, Homo sapiens
aaacaaaggagcattaagcccaa

SEQ ID NO: 5341874 - DNA, 21 bp, Homo sapiens
aaacaaaggatttgaaaacac

SEQ ID NO: 5341875 - DNA, 18 bp, Homo sapiens
aaacaaagggaaaaaaga

SEQ ID NO: 5341876 - DNA, 17 bp, Homo sapiens
aaacaaagggttttctt

SEQ ID NO: 5341877 - DNA, 16 bp, Homo sapiens
aaacaaagtactcttt

SEQ ID NO: 5341878 - DNA, 13 bp, Homo sapiens
aaacaaagtgcaa

SEQ ID NO: 5341879 - DNA, 17 bp, Homo sapiens
aaacaaagttactaggt

SEQ ID NO: 5341880 - DNA, 16 bp, Homo sapiens
aaacaaagttctattt

SEQ ID NO: 5341881 - DNA, 23 bp, Homo sapiens
aaacaaagtttacattgtcctgt

SEQ ID NO: 5341882 - DNA, 14 bp, Homo sapiens
aaacaaataaataa

SEQ ID NO: 5341883 - DNA, 18 bp, Homo sapiens
aaacaaatatactcattt

SEQ ID NO: 5341884 - DNA, 17 bp, Homo sapiens
aaacaaatcattttgat

SEQ ID NO: 5341885 - DNA, 17 bp, Homo sapiens
aaacaaatctttccata

SEQ ID NO: 5341886 - DNA, 10 bp, Homo sapiens
aaacaaatga

SEQ ID NO: 5341887 - DNA, 13 bp, Homo sapiens
aaacaaatgaaat

SEQ ID NO: 5341888 - DNA, 13 bp, Homo sapiens
aaacaaatgattt

SEQ ID NO: 5341889 - DNA, 14 bp, Homo sapiens
aaacaaatggaaga

SEQ ID NO: 5341890 - DNA, 13 bp, Homo sapiens
aaacaaatgtgta

SEQ ID NO: 5341891 - DNA, 19 bp, Homo sapiens
aaacaaattcatattctgt

SEQ ID NO: 5341892 - DNA, 16 bp, Homo sapiens
aaacaaattggacagc

SEQ ID NO: 5341893 - DNA, 11 bp, Homo sapiens
aaacaacaaaa

SEQ ID NO: 5341894 - DNA, 12 bp, Homo sapiens
aaacaacaaaaa

SEQ ID NO: 5341895 - DNA, 18 bp, Homo sapiens
aaacaacaaaaaccaaaa

SEQ ID NO: 5341896 - DNA, 17 bp, Homo sapiens
aaacaacactcagtcct

SEQ ID NO: 5341897 - DNA, 12 bp, Homo sapiens
aaacaacagcaa

SEQ ID NO: 5341898 - DNA, 13 bp, Homo sapiens
aaacaacagcaac

SEQ ID NO: 5341899 - DNA, 20 bp, Homo sapiens
aaacaacagctcgatccaaa

SEQ ID NO: 5341900 - DNA, 22 bp, Homo sapiens
aaacaacagctcgatccaaatt

SEQ ID NO: 5341901 - DNA, 18 bp, Homo sapiens
aaacaacatcattccaaa

SEQ ID NO: 5341902 - DNA, 12 bp, Homo sapiens
aaacaacattta

SEQ ID NO: 5341903 - DNA, 17 bp, Homo sapiens
aaacaaccagttaaagc

SEQ ID NO: 5341904 - DNA, 17 bp, Homo sapiens
aaacaaccatcctgctc

SEQ ID NO: 5341905 - DNA, 23 bp, Homo sapiens
aaacaaccgtcctgctgtccctg

SEQ ID NO: 5341906 - DNA, 13 bp, Homo sapiens
aaacaacctgaat

SEQ ID NO: 5341907 - DNA, 16 bp, Homo sapiens
aaacaacctggtgcat

SEQ ID NO: 5341908 - DNA, 14 bp, Homo sapiens
aaacaaccttcagc

SEQ ID NO: 5341909 - DNA, 19 bp, Homo sapiens
aaacaactaaaaaaatttt

SEQ ID NO: 5341910 - DNA, 22 bp, Homo sapiens
aaacaactaaaaaaatttttga

SEQ ID NO: 5341911 - DNA, 18 bp, Homo sapiens
aaacaactatggctgttg

SEQ ID NO: 5341912 - DNA, 17 bp, Homo sapiens
aaacaactctttgagaa

SEQ ID NO: 5341913 - DNA, 14 bp, Homo sapiens
aaacaacttcagaa

SEQ ID NO: 5341914 - DNA, 20 bp, Homo sapiens
aaacaacttggcatttctat

SEQ ID NO: 5341915 - DNA, 13 bp, Homo sapiens
aaacaactttcac

SEQ ID NO: 5341916 - DNA, 21 bp, Homo sapiens
aaacaactttctggaaaaaca

SEQ ID NO: 5341917 - DNA, 16 bp, Homo sapiens
aaacaagaaagaaacg

SEQ ID NO: 5341918 - DNA, 17 bp, Homo sapiens
aaacaagaaagtttccc

SEQ ID NO: 5341919 - DNA, 18 bp, Homo sapiens
aaacaagaaagtttcccc

SEQ ID NO: 5341920 - DNA, 15 bp, Homo sapiens
aaacaagaatgaagg

SEQ ID NO: 5341921 - DNA, 16 bp, Homo sapiens
aaacaagactgcctcc

SEQ ID NO: 5341922 - DNA, 16 bp, Homo sapiens
aaacaagatacgtata

SEQ ID NO: 5341923 - DNA, 12 bp, Homo sapiens
aaacaagcatat

SEQ ID NO: 5341924 - DNA, 15 bp, Homo sapiens
aaacaagcatataaa

SEQ ID NO: 5341925 - DNA, 20 bp, Homo sapiens
aaacaagcctgagggaggag

SEQ ID NO: 5341926 - DNA, 13 bp, Homo sapiens
aaacaagccttaa

SEQ ID NO: 5341927 - DNA, 13 bp, Homo sapiens
aaacaagcgccac

SEQ ID NO: 5341928 - DNA, 22 bp, Homo sapiens
aaacaagcgtttatttgaatgt

SEQ ID NO: 5341929 - DNA, 13 bp, Homo sapiens
aaacaagctgtgc

SEQ ID NO: 5341930 - DNA, 15 bp, Homo sapiens
aaacaagctgtgcag

SEQ ID NO: 5341931 - DNA, 20 bp, Homo sapiens
aaacaagctgtgcaggcatg

SEQ ID NO: 5341932 - DNA, 12 bp, Homo sapiens
aaacaaggaagc

SEQ ID NO: 5341933 - DNA, 13 bp, Homo sapiens
aaacaaggaagcc

SEQ ID NO: 5341934 - DNA, 19 bp, Homo sapiens
aaacaaggcttaaaagagt

SEQ ID NO: 5341935 - DNA, 12 bp, Homo sapiens
aaacaagggaga

SEQ ID NO: 5341936 - DNA, 13 bp, Homo sapiens
aaacaagtatttg

SEQ ID NO: 5341937 - DNA, 23 bp, Homo sapiens
aaacaagtatttgttaatttaga

SEQ ID NO: 5341938 - DNA, 16 bp, Homo sapiens
aaacaagtgaccccag

SEQ ID NO: 5341939 - DNA, 21 bp, Homo sapiens
aaacaagttggctagaagaaa

SEQ ID NO: 5341940 - DNA, 17 bp, Homo sapiens
aaacaagttttagaaat

SEQ ID NO: 5341941 - DNA, 20 bp, Homo sapiens
aaacaataaagaaagaaata

SEQ ID NO: 5341942 - DNA, 14 bp, Homo sapiens
aaacaataaagaga

SEQ ID NO: 5341943 - DNA, 15 bp, Homo sapiens
aaacaataaagcaat

SEQ ID NO: 5341944 - DNA, 16 bp, Homo sapiens
aaacaataagaacaag

SEQ ID NO: 5341945 - DNA, 13 bp, Homo sapiens
aaacaataagaca

SEQ ID NO: 5341946 - DNA, 13 bp, Homo sapiens
aaacaataatgca

SEQ ID NO: 5341947 - DNA, 16 bp, Homo sapiens
aaacaataattttaac

SEQ ID NO: 5341948 - DNA, 17 bp, Homo sapiens
aaacaatacttttcagg

SEQ ID NO: 5341949 - DNA, 17 bp, Homo sapiens
aaacaatatatttgtca

SEQ ID NO: 5341950 - DNA, 17 bp, Homo sapiens
aaacaatattgtttcta

SEQ ID NO: 5341951 - DNA, 22 bp, Homo sapiens
aaacaatccaaatgcattcatg

SEQ ID NO: 5341952 - DNA, 15 bp, Homo sapiens
aaacaatcccaatct

SEQ ID NO: 5341953 - DNA, 21 bp, Homo sapiens
aaacaatccttttgataaatt

SEQ ID NO: 5341954 - DNA, 19 bp, Homo sapiens
aaacaatctatttaaaaaa

SEQ ID NO: 5341955 - DNA, 12 bp, Homo sapiens
aaacaatcttat

SEQ ID NO: 5341956 - DNA, 21 bp, Homo sapiens
aaacaatgaagaattatgtaa

SEQ ID NO: 5341957 - DNA, 20 bp, Homo sapiens
aaacaatgaagtgttttaca

SEQ ID NO: 5341958 - DNA, 12 bp, Homo sapiens
aaacaatgccat

SEQ ID NO: 5341959 - DNA, 18 bp, Homo sapiens
aaacaatgccatgaacaa

SEQ ID NO: 5341960 - DNA, 18 bp, Homo sapiens
aaacaatggggctggttt

SEQ ID NO: 5341961 - DNA, 22 bp, Homo sapiens
aaacaatggtgtctcttttatg

SEQ ID NO: 5341962 - DNA, 14 bp, Homo sapiens
aaacaatgtaatta

SEQ ID NO: 5341963 - DNA, 13 bp, Homo sapiens
aaacaatgtataa

SEQ ID NO: 5341964 - DNA, 15 bp, Homo sapiens
aaacaatgtataaag

SEQ ID NO: 5341965 - DNA, 20 bp, Homo sapiens
aaacaatgtggagtctccct

SEQ ID NO: 5341966 - DNA, 22 bp, Homo sapiens
aaacaatgttaacatttttggt

SEQ ID NO: 5341967 - DNA, 12 bp, Homo sapiens
aaacaatgttca

SEQ ID NO: 5341968 - DNA, 15 bp, Homo sapiens
aaacaatgtttttca

SEQ ID NO: 5341969 - DNA, 18 bp, Homo sapiens
aaacaattattgtacact

SEQ ID NO: 5341970 - DNA, 13 bp, Homo sapiens
aaacaattcaaag

SEQ ID NO: 5341971 - DNA, 19 bp, Homo sapiens
aaacaattcaatcaaagct

SEQ ID NO: 5341972 - DNA, 20 bp, Homo sapiens
aaacaattcttgtaactttc

SEQ ID NO: 5341973 - DNA, 16 bp, Homo sapiens
aaacaattgcaacaga

SEQ ID NO: 5341974 - DNA, 19 bp, Homo sapiens
aaacaattggttgtatata

SEQ ID NO: 5341975 - DNA, 20 bp, Homo sapiens
aaacaatttagccagaatgt

SEQ ID NO: 5341976 - DNA, 14 bp, Homo sapiens
aaacaatttctttt

SEQ ID NO: 5341977 - DNA, 14 bp, Homo sapiens
aaacaattttgtta

SEQ ID NO: 5341978 - DNA, 12 bp, Homo sapiens
aaacacaaaaaa

SEQ ID NO: 5341979 - DNA, 16 bp, Homo sapiens
aaacacaaaaaaagac

SEQ ID NO: 5341980 - DNA, 14 bp, Homo sapiens
aaacacaaaacaac

SEQ ID NO: 5341981 - DNA, 14 bp, Homo sapiens
aaacacaaaatgaa

SEQ ID NO: 5341982 - DNA, 19 bp, Homo sapiens
aaacacaaacgggctcagc

SEQ ID NO: 5341983 - DNA, 20 bp, Homo sapiens
aaacacaaatgtaaaataag

SEQ ID NO: 5341984 - DNA, 15 bp, Homo sapiens
aaacacaagattggt

SEQ ID NO: 5341985 - DNA, 14 bp, Homo sapiens
aaacacaataccta

SEQ ID NO: 5341986 - DNA, 17 bp, Homo sapiens
aaacacaatacctacaa

SEQ ID NO: 5341987 - DNA, 19 bp, Homo sapiens
aaacacacaggccatttca

SEQ ID NO: 5341988 - DNA, 16 bp, Homo sapiens
aaacacaccaggctgt

SEQ ID NO: 5341989 - DNA, 17 bp, Homo sapiens
aaacacaccaggctgtg

SEQ ID NO: 5341990 - DNA, 18 bp, Homo sapiens
aaacacaccaggctgtgg

SEQ ID NO: 5341991 - DNA, 18 bp, Homo sapiens
aaacacacgctcctctgc

SEQ ID NO: 5341992 - DNA, 19 bp, Homo sapiens
aaacacactactacctctt

SEQ ID NO: 5341993 - DNA, 13 bp, Homo sapiens
aaacacactgtaa

SEQ ID NO: 5341994 - DNA, 15 bp, Homo sapiens
aaacacactgtaaat

SEQ ID NO: 5341995 - DNA, 12 bp, Homo sapiens
aaacacactttt

SEQ ID NO: 5341996 - DNA, 12 bp, Homo sapiens
aaacacagagag

SEQ ID NO: 5341997 - DNA, 23 bp, Homo sapiens
aaacacagcctccctgagcctgc

SEQ ID NO: 5341998 - DNA, 11 bp, Homo sapiens
aaacacagctg

SEQ ID NO: 5341999 - DNA, 19 bp, Homo sapiens
aaacacaggcaggtactgt

SEQ ID NO: 5342000 - DNA, 19 bp, Homo sapiens
aaacacagggaaagcattt

SEQ ID NO: 5342001 - DNA, 19 bp, Homo sapiens
aaacacagtattgtagaaa

SEQ ID NO: 5342002 - DNA, 19 bp, Homo sapiens
aaacacagtcaaaataatt

SEQ ID NO: 5342003 - DNA, 21 bp, Homo sapiens
aaacacagtccagactcaaac

SEQ ID NO: 5342004 - DNA, 19 bp, Homo sapiens
aaacacagtgtttttgtaa

SEQ ID NO: 5342005 - DNA, 20 bp, Homo sapiens
aaacacagtgtttttgtaaa

SEQ ID NO: 5342006 - DNA, 13 bp, Homo sapiens
aaacacagttaca

SEQ ID NO: 5342007 - DNA, 14 bp, Homo sapiens
aaacacatagattc

SEQ ID NO: 5342008 - DNA, 11 bp, Homo sapiens
aaacacatgat

SEQ ID NO: 5342009 - DNA, 17 bp, Homo sapiens
aaacacattaggaaaag

SEQ ID NO: 5342010 - DNA, 20 bp, Homo sapiens
aaacacattatgtatcttag

SEQ ID NO: 5342011 - DNA, 21 bp, Homo sapiens
aaacacattatgtatcttagt

SEQ ID NO: 5342012 - DNA, 17 bp, Homo sapiens
aaacacattgagtttaa

SEQ ID NO: 5342013 - DNA, 15 bp, Homo sapiens
aaacaccaacataaa

SEQ ID NO: 5342014 - DNA, 19 bp, Homo sapiens
aaacaccaacataaaaatg

SEQ ID NO: 5342015 - DNA, 15 bp, Homo sapiens
aaacaccaagagtac

SEQ ID NO: 5342016 - DNA, 14 bp, Homo sapiens
aaacaccacttaat

SEQ ID NO: 5342017 - DNA, 17 bp, Homo sapiens
aaacaccacttaatctt

SEQ ID NO: 5342018 - DNA, 20 bp, Homo sapiens
aaacaccacttaatcttctc

SEQ ID NO: 5342019 - DNA, 24 bp, Homo sapiens
aaacaccacttaatcttctctctt

SEQ ID NO: 5342020 - DNA, 23 bp, Homo sapiens
aaacaccagctgtatatattttt

SEQ ID NO: 5342021 - DNA, 20 bp, Homo sapiens
aaacaccatcattaagaata

SEQ ID NO: 5342022 - DNA, 18 bp, Homo sapiens
aaacacccagaagcagta

SEQ ID NO: 5342023 - DNA, 13 bp, Homo sapiens
aaacacccctctg

SEQ ID NO: 5342024 - DNA, 16 bp, Homo sapiens
aaacacccctctgtct

SEQ ID NO: 5342025 - DNA, 20 bp, Homo sapiens
aaacacccctctgtctagga

SEQ ID NO: 5342026 - DNA, 17 bp, Homo sapiens
aaacaccgggttccagc

SEQ ID NO: 5342027 - DNA, 14 bp, Homo sapiens
aaacacctagcttt

SEQ ID NO: 5342028 - DNA, 13 bp, Homo sapiens
aaacacctcccca

SEQ ID NO: 5342029 - DNA, 15 bp, Homo sapiens
aaacacctctgcttt

SEQ ID NO: 5342030 - DNA, 12 bp, Homo sapiens
aaacacctgaca

SEQ ID NO: 5342031 - DNA, 17 bp, Homo sapiens
aaacacctgacacatct

SEQ ID NO: 5342032 - DNA, 19 bp, Homo sapiens
aaacatttcctttttctat

SEQ ID NO: 5342033 - DNA, 13 bp, Homo sapiens
aaacatttctgtg

SEQ ID NO: 5342034 - DNA, 20 bp, Homo sapiens
aaacatttctgtgaaactat

SEQ ID NO: 5342035 - DNA, 13 bp, Homo sapiens
aaacatttgagtt

SEQ ID NO: 5342036 - DNA, 19 bp, Homo sapiens
aaacatttgattaataaaa

SEQ ID NO: 5342037 - DNA, 13 bp, Homo sapiens
aaacatttgcacc

SEQ ID NO: 5342038 - DNA, 22 bp, Homo sapiens
aaacatttgccaaaaattcatg

SEQ ID NO: 5342039 - DNA, 14 bp, Homo sapiens
aaacatttgtcagt

SEQ ID NO: 5342040 - DNA, 16 bp, Homo sapiens
aaacattttaaaatca

SEQ ID NO: 5342041 - DNA, 17 bp, Homo sapiens
aaacattttaaatgaaa

SEQ ID NO: 5342042 - DNA, 19 bp, Homo sapiens
aaacattttaaatgaaagt

SEQ ID NO: 5342043 - DNA, 19 bp, Homo sapiens
aaacattttaaatgttaaa

SEQ ID NO: 5342044 - DNA, 14 bp, Homo sapiens
aaacattttacaga

SEQ ID NO: 5342045 - DNA, 14 bp, Homo sapiens
aaacattttatact

SEQ ID NO: 5342046 - DNA, 21 bp, Homo sapiens
aaacattttatactgtacatg

SEQ ID NO: 5342047 - DNA, 12 bp, Homo sapiens
aaacattttatt

SEQ ID NO: 5342048 - DNA, 14 bp, Homo sapiens
aaacattttatttt

SEQ ID NO: 5342049 - DNA, 13 bp, Homo sapiens
aaacattttcaca

SEQ ID NO: 5342050 - DNA, 18 bp, Homo sapiens
aaacattttcatgcacag

SEQ ID NO: 5342051 - DNA, 15 bp, Homo sapiens
aaacattttgtatca

SEQ ID NO: 5342052 - DNA, 13 bp, Homo sapiens
aaacattttgtcc

SEQ ID NO: 5342053 - DNA, 22 bp, Homo sapiens
aaacatttttaatttaacaaac

SEQ ID NO: 5342054 - DNA, 23 bp, Homo sapiens
aaacattttttaagaaaacattt

SEQ ID NO: 5342055 - DNA, 20 bp, Homo sapiens
aaacattttttaaggaggga

SEQ ID NO: 5342056 - DNA, 22 bp, Homo sapiens
aaacattttttaaggagggaga

SEQ ID NO: 5342057 - DNA, 14 bp, Homo sapiens
aaacattttttagt

SEQ ID NO: 5342058 - DNA, 20 bp, Homo sapiens
aaacattttttatacatttg

SEQ ID NO: 5342059 - DNA, 17 bp, Homo sapiens
aaacattttttcttcaa

SEQ ID NO: 5342060 - DNA, 15 bp, Homo sapiens
aaaccaaaaacattt

SEQ ID NO: 5342061 - DNA, 17 bp, Homo sapiens
aaaccaaaaacatttga

SEQ ID NO: 5342062 - DNA, 11 bp, Homo sapiens
aaaccaaaaca

SEQ ID NO: 5342063 - DNA, 19 bp, Homo sapiens
aaaccaaaagttattaaaa

SEQ ID NO: 5342064 - DNA, 13 bp, Homo sapiens
aaaccaaaataaa

SEQ ID NO: 5342065 - DNA, 16 bp, Homo sapiens
aaaccaaaataaaaat

SEQ ID NO: 5342066 - DNA, 17 bp, Homo sapiens
aaaccaaaatgacatct

SEQ ID NO: 5342067 - DNA, 23 bp, Homo sapiens
aaaccaaaatgacatctttttaa

SEQ ID NO: 5342068 - DNA, 17 bp, Homo sapiens
aaaccaaacacccagag

SEQ ID NO: 5342069 - DNA, 20 bp, Homo sapiens
aaaccaaacacccagaggtc

SEQ ID NO: 5342070 - DNA, 22 bp, Homo sapiens
aaaccaaactgggtcttcagct

SEQ ID NO: 5342071 - DNA, 19 bp, Homo sapiens
aaaccaaagagggcttcct

SEQ ID NO: 5342072 - DNA, 16 bp, Homo sapiens
aaaccaaagctgcctg

SEQ ID NO: 5342073 - DNA, 22 bp, Homo sapiens
aaaccaaagctgcctgtgccat

SEQ ID NO: 5342074 - DNA, 17 bp, Homo sapiens
aaaccaaagctttattt

SEQ ID NO: 5342075 - DNA, 17 bp, Homo sapiens
aaaccaaaggacattat

SEQ ID NO: 5342076 - DNA, 16 bp, Homo sapiens
aaaccaaagtctgccg

SEQ ID NO: 5342077 - DNA, 19 bp, Homo sapiens
aaaccaaagtctgccgccc

SEQ ID NO: 5342078 - DNA, 20 bp, Homo sapiens
aaaccaaataagcatctgtg

SEQ ID NO: 5342079 - DNA, 22 bp, Homo sapiens
aaaccaaattacaagtattcag

SEQ ID NO: 5342080 - DNA, 15 bp, Homo sapiens
aaaccaacaataaat

SEQ ID NO: 5342081 - DNA, 11 bp, Homo sapiens
aaaccaacagg

SEQ ID NO: 5342082 - DNA, 15 bp, Homo sapiens
aaaccaaccctgtgg

SEQ ID NO: 5342083 - DNA, 14 bp, Homo sapiens
aaaccaacctttaa

SEQ ID NO: 5342084 - DNA, 18 bp, Homo sapiens
aaaccaacctttaaaatt

SEQ ID NO: 5342085 - DNA, 22 bp, Homo sapiens
aaaccaacctttaaaattgtca

SEQ ID NO: 5342086 - DNA, 13 bp, Homo sapiens
aaaccaactaaat

SEQ ID NO: 5342087 - DNA, 15 bp, Homo sapiens
aaaccaactctctac

SEQ ID NO: 5342088 - DNA, 17 bp, Homo sapiens
aaaccaactgttgacat

SEQ ID NO: 5342089 - DNA, 16 bp, Homo sapiens
aaaccaagagattgct

SEQ ID NO: 5342090 - DNA, 20 bp, Homo sapiens
aaaccaagagattgctaatt

SEQ ID NO: 5342091 - DNA, 16 bp, Homo sapiens
aaaccaagataaatga

SEQ ID NO: 5342092 - DNA, 16 bp, Homo sapiens
aaaccaagccgtggct

SEQ ID NO: 5342093 - DNA, 14 bp, Homo sapiens
aaaccaaggactga

SEQ ID NO: 5342094 - DNA, 22 bp, Homo sapiens
aaaccaagggggatgacatgtg

SEQ ID NO: 5342095 - DNA, 18 bp, Homo sapiens
aaaccaagtctacttcac

SEQ ID NO: 5342096 - DNA, 16 bp, Homo sapiens
aaaccaagtgggctgg

SEQ ID NO: 5342097 - DNA, 20 bp, Homo sapiens
aaaccaagttatttttcttt

SEQ ID NO: 5342098 - DNA, 16 bp, Homo sapiens
aaaccaatcaagataa

SEQ ID NO: 5342099 - DNA, 14 bp, Homo sapiens
aaaccaatgaaatt

SEQ ID NO: 5342100 - DNA, 17 bp, Homo sapiens
aaaccaatgaaattttg

SEQ ID NO: 5342101 - DNA, 18 bp, Homo sapiens
aaaccaatgaagaagaca

SEQ ID NO: 5342102 - DNA, 15 bp, Homo sapiens
aaaccaatgattcat

SEQ ID NO: 5342103 - DNA, 17 bp, Homo sapiens
aaaccaatgattcataa

SEQ ID NO: 5342104 - DNA, 18 bp, Homo sapiens
aaaccaattaagcagctt

SEQ ID NO: 5342105 - DNA, 13 bp, Homo sapiens
aaaccaatttctt

SEQ ID NO: 5342106 - DNA, 20 bp, Homo sapiens
aaaccaatttcttccttcca

SEQ ID NO: 5342107 - DNA, 19 bp, Homo sapiens
aaaccaattttttgttctt

SEQ ID NO: 5342108 - DNA, 22 bp, Homo sapiens
aaaccaattttttgttcttcag

SEQ ID NO: 5342109 - DNA, 15 bp, Homo sapiens
aaaccacaaaggcca

SEQ ID NO: 5342110 - DNA, 19 bp, Homo sapiens
aaaccacaaaggccaaact

SEQ ID NO: 5342111 - DNA, 15 bp, Homo sapiens
aaaccacagccctgt

SEQ ID NO: 5342112 - DNA, 16 bp, Homo sapiens
aaaccacagccctgtc

SEQ ID NO: 5342113 - DNA, 13 bp, Homo sapiens
aaaccacagctgg

SEQ ID NO: 5342114 - DNA, 20 bp, Homo sapiens
aaaccacagctgggcagggt

SEQ ID NO: 5342115 - DNA, 20 bp, Homo sapiens
aaaccacaggttccatagaa

SEQ ID NO: 5342116 - DNA, 14 bp, Homo sapiens
aaaccacagttatt

SEQ ID NO: 5342117 - DNA, 19 bp, Homo sapiens
aaaccacagtttcattatt

SEQ ID NO: 5342118 - DNA, 21 bp, Homo sapiens
aaaccacagtttcattattct

SEQ ID NO: 5342119 - DNA, 22 bp, Homo sapiens
aaaccacataatttttgtacat

SEQ ID NO: 5342120 - DNA, 16 bp, Homo sapiens
aaaccacatgggctgg

SEQ ID NO: 5342121 - DNA, 19 bp, Homo sapiens
aaaccaccgtgaaccagag

SEQ ID NO: 5342122 - DNA, 23 bp, Homo sapiens
aaaccacctgggttcagcctctc

SEQ ID NO: 5342123 - DNA, 20 bp, Homo sapiens
aaaccacctgtccccagtta

SEQ ID NO: 5342124 - DNA, 15 bp, Homo sapiens
aaaccactaaagtag

SEQ ID NO: 5342125 - DNA, 20 bp, Homo sapiens
aaaccactatgcaaagaact

SEQ ID NO: 5342126 - DNA, 12 bp, Homo sapiens
aaaccactgaaa

SEQ ID NO: 5342127 - DNA, 18 bp, Homo sapiens
aaaccactgaaaaaatat

SEQ ID NO: 5342128 - DNA, 16 bp, Homo sapiens
aaaccactgaacattt

SEQ ID NO: 5342129 - DNA, 16 bp, Homo sapiens
aaaccactgtacatat

SEQ ID NO: 5342130 - DNA, 22 bp, Homo sapiens
aaaccacttaaacgaagagttc

SEQ ID NO: 5342131 - DNA, 13 bp, Homo sapiens
aaaccacttctcc

SEQ ID NO: 5342132 - DNA, 23 bp, Homo sapiens
aaaccacttctctgctgcctctg

SEQ ID NO: 5342133 - DNA, 19 bp, Homo sapiens
aaaccactttattgcaatg

SEQ ID NO: 5342134 - DNA, 23 bp, Homo sapiens
aaaccactttattgcaatgcaga

SEQ ID NO: 5342135 - DNA, 13 bp, Homo sapiens
aaaccagaaggaa

SEQ ID NO: 5342136 - DNA, 15 bp, Homo sapiens
aaaccagaaggaagc

SEQ ID NO: 5342137 - DNA, 16 bp, Homo sapiens
aaaccagaaggaagcc

SEQ ID NO: 5342138 - DNA, 18 bp, Homo sapiens
aaaccagaatgattttga

SEQ ID NO: 5342139 - DNA, 22 bp, Homo sapiens
aaaccagaatgattttgacata

SEQ ID NO: 5342140 - DNA, 18 bp, Homo sapiens
aaaccagagaatcttaag

SEQ ID NO: 5342141 - DNA, 14 bp, Homo sapiens
aaaccagcagaaaa

SEQ ID NO: 5342142 - DNA, 21 bp, Homo sapiens
aaaccagcagaaaagtgctta

SEQ ID NO: 5342143 - DNA, 13 bp, Homo sapiens
aaaccagccaggc

SEQ ID NO: 5342144 - DNA, 21 bp, Homo sapiens
aaaccagcctggggccttcct

SEQ ID NO: 5342145 - DNA, 13 bp, Homo sapiens
aaaccagctcagc

SEQ ID NO: 5342146 - DNA, 11 bp, Homo sapiens
aaaccagctgc

SEQ ID NO: 5342147 - DNA, 12 bp, Homo sapiens
aaaccagctgct

SEQ ID NO: 5342148 - DNA, 13 bp, Homo sapiens
aaaccagctgcta

SEQ ID NO: 5342149 - DNA, 17 bp, Homo sapiens
aaaccagcttccttcag

SEQ ID NO: 5342150 - DNA, 20 bp, Homo sapiens
aaaccagcttccttcagaga

SEQ ID NO: 5342151 - DNA, 12 bp, Homo sapiens
aaaccaggagca

SEQ ID NO: 5342152 - DNA, 15 bp, Homo sapiens
aaaccagggtgcatg

SEQ ID NO: 5342153 - DNA, 19 bp, Homo sapiens
aaaccagggtttatctttt

SEQ ID NO: 5342154 - DNA, 23 bp, Homo sapiens
aaaccagtaacgtgctgctcaag

SEQ ID NO: 5342155 - DNA, 15 bp, Homo sapiens
aaaccagtatcgtta

SEQ ID NO: 5342156 - DNA, 20 bp, Homo sapiens
aaaccagtatggaagggagg

SEQ ID NO: 5342157 - DNA, 22 bp, Homo sapiens
aaaccagtatggaagggagggg

SEQ ID NO: 5342158 - DNA, 16 bp, Homo sapiens
aaaccagtattgtaca

SEQ ID NO: 5342159 - DNA, 17 bp, Homo sapiens
aaaccagtattgtacaa

SEQ ID NO: 5342160 - DNA, 18 bp, Homo sapiens
aaaccagtatttaagctt

SEQ ID NO: 5342161 - DNA, 22 bp, Homo sapiens
aaaccagtctgtgtttacagac

SEQ ID NO: 5342162 - DNA, 17 bp, Homo sapiens
aaaccagtcttctccct

SEQ ID NO: 5342163 - DNA, 14 bp, Homo sapiens
aaaccagtgtgaac

SEQ ID NO: 5342164 - DNA, 19 bp, Homo sapiens
aaaccagtgttagggaagg

SEQ ID NO: 5342165 - DNA, 21 bp, Homo sapiens
aaaccagttaagaatggaaga

SEQ ID NO: 5342166 - DNA, 12 bp, Homo sapiens
aaaccagttacc

SEQ ID NO: 5342167 - DNA, 20 bp, Homo sapiens
aaaccagtttagatttcaag

SEQ ID NO: 5342168 - DNA, 18 bp, Homo sapiens
aaaccagtttattctgtg

SEQ ID NO: 5342169 - DNA, 21 bp, Homo sapiens
aaaccataaaataaataatct

SEQ ID NO: 5342170 - DNA, 16 bp, Homo sapiens
aaaccataatgtcttt

SEQ ID NO: 5342171 - DNA, 15 bp, Homo sapiens
aaaccatcctctccc

SEQ ID NO: 5342172 - DNA, 23 bp, Homo sapiens
aaaccatctccctggtgcttatg

SEQ ID NO: 5342173 - DNA, 21 bp, Homo sapiens
aaaccatgaaaagttttcaag

SEQ ID NO: 5342174 - DNA, 12 bp, Homo sapiens
aaaccatgacaa

SEQ ID NO: 5342175 - DNA, 21 bp, Homo sapiens
aaaccatgagaatttgcaaca

SEQ ID NO: 5342176 - DNA, 20 bp, Homo sapiens
aaaccatgcagcttcatcaa

SEQ ID NO: 5342177 - DNA, 15 bp, Homo sapiens
aaaccatgggataaa

SEQ ID NO: 5342178 - DNA, 13 bp, Homo sapiens
aaaccatgtagaa

SEQ ID NO: 5342179 - DNA, 22 bp, Homo sapiens
aaaccatgtagcagtgagtcat

SEQ ID NO: 5342180 - DNA, 17 bp, Homo sapiens
aaaccattactgagggg

SEQ ID NO: 5342181 - DNA, 19 bp, Homo sapiens
aaaccattactgaggggat

SEQ ID NO: 5342182 - DNA, 20 bp, Homo sapiens
aaaccattatttaataagag

SEQ ID NO: 5342183 - DNA, 15 bp, Homo sapiens
aaaccattgcttcac

SEQ ID NO: 5342184 - DNA, 22 bp, Homo sapiens
aaaccattggacagatttcagt

SEQ ID NO: 5342185 - DNA, 19 bp, Homo sapiens
aaaccattggggaggacta

SEQ ID NO: 5342186 - DNA, 18 bp, Homo sapiens
aaaccattgtaactatta

SEQ ID NO: 5342187 - DNA, 15 bp, Homo sapiens
aaaccatttaattca

SEQ ID NO: 5342188 - DNA, 18 bp, Homo sapiens
aaaccatttaattcataa

SEQ ID NO: 5342189 - DNA, 13 bp, Homo sapiens
aaaccatttcaaa

SEQ ID NO: 5342190 - DNA, 21 bp, Homo sapiens
aaaccattttattttttgggc

SEQ ID NO: 5342191 - DNA, 20 bp, Homo sapiens
aaaccatttttgctgaattc

SEQ ID NO: 5342192 - DNA, 16 bp, Homo sapiens
aaaccatttttgttac

SEQ ID NO: 5342193 - DNA, 23 bp, Homo sapiens
aaaccatttttgttactctcttc

SEQ ID NO: 5342194 - DNA, 13 bp, Homo sapiens
aaacccaaaatat

SEQ ID NO: 5342195 - DNA, 13 bp, Homo sapiens
aaacccaaagatg

SEQ ID NO: 5342196 - DNA, 19 bp, Homo sapiens
aaacccaagattattaaaa

SEQ ID NO: 5342197 - DNA, 14 bp, Homo sapiens
aaacccaaggaaca

SEQ ID NO: 5342198 - DNA, 22 bp, Homo sapiens
aaacccaagttatgcatcccca

SEQ ID NO: 5342199 - DNA, 23 bp, Homo sapiens
aaacccaagttatgcatccccat

SEQ ID NO: 5342200 - DNA, 17 bp, Homo sapiens
aaacccacaagctgcct

SEQ ID NO: 5342201 - DNA, 23 bp, Homo sapiens
aaacccaccagcctaagaagctc

SEQ ID NO: 5342202 - DNA, 17 bp, Homo sapiens
aaacccaccctttctac

SEQ ID NO: 5342203 - DNA, 16 bp, Homo sapiens
aaacccacctctctgg

SEQ ID NO: 5342204 - DNA, 18 bp, Homo sapiens
aaacccacctgctagtgt

SEQ ID NO: 5342205 - DNA, 22 bp, Homo sapiens
aaacccactcatgactgcatga

SEQ ID NO: 5342206 - DNA, 23 bp, Homo sapiens
aaacccacttctggcctccagcc

SEQ ID NO: 5342207 - DNA, 12 bp, Homo sapiens
aaacccagagag

SEQ ID NO: 5342208 - DNA, 10 bp, Homo sapiens
aaacccagcc

SEQ ID NO: 5342209 - DNA, 13 bp, Homo sapiens
aaacccagccact

SEQ ID NO: 5342210 - DNA, 23 bp, Homo sapiens
aaactgcatcccacgttctgtta

SEQ ID NO: 5342211 - DNA, 14 bp, Homo sapiens
aaactgcatctgga

SEQ ID NO: 5342212 - DNA, 16 bp, Homo sapiens
aaactgcatgcccaga

SEQ ID NO: 5342213 - DNA, 14 bp, Homo sapiens
aaactgcattagaa

SEQ ID NO: 5342214 - DNA, 16 bp, Homo sapiens
aaactgcatttttaat

SEQ ID NO: 5342215 - DNA, 15 bp, Homo sapiens
aaactgccagcaacg

SEQ ID NO: 5342216 - DNA, 19 bp, Homo sapiens
aaactgccagcaacgcagg

SEQ ID NO: 5342217 - DNA, 20 bp, Homo sapiens
aaactgcccccctcctttcc

SEQ ID NO: 5342218 - DNA, 12 bp, Homo sapiens
aaactgccccct

SEQ ID NO: 5342219 - DNA, 17 bp, Homo sapiens
aaactgccccctctgcc

SEQ ID NO: 5342220 - DNA, 19 bp, Homo sapiens
aaactgccccctctgccct

SEQ ID NO: 5342221 - DNA, 22 bp, Homo sapiens
aaactgccccctctgccctgcg

SEQ ID NO: 5342222 - DNA, 18 bp, Homo sapiens
aaactgcgaggacatcaa

SEQ ID NO: 5342223 - DNA, 18 bp, Homo sapiens
aaactgcgtaggagagaa

SEQ ID NO: 5342224 - DNA, 20 bp, Homo sapiens
aaactgctgtcaataaatga

SEQ ID NO: 5342225 - DNA, 22 bp, Homo sapiens
aaactgctgtcaataaatgaca

SEQ ID NO: 5342226 - DNA, 19 bp, Homo sapiens
aaactgcttcctttcttga

SEQ ID NO: 5342227 - DNA, 18 bp, Homo sapiens
aaactgcttgagcatcag

SEQ ID NO: 5342228 - DNA, 13 bp, Homo sapiens
aaactgcttgttt

SEQ ID NO: 5342229 - DNA, 14 bp, Homo sapiens
aaactgcttgtttc

SEQ ID NO: 5342230 - DNA, 19 bp, Homo sapiens
aaactgcttgtttcctagc

SEQ ID NO: 5342231 - DNA, 22 bp, Homo sapiens
aaactgcttgtttcctagcaca

SEQ ID NO: 5342232 - DNA, 14 bp, Homo sapiens
aaactgctttattt

SEQ ID NO: 5342233 - DNA, 15 bp, Homo sapiens
aaactgctttatttt

SEQ ID NO: 5342234 - DNA, 18 bp, Homo sapiens
aaactggaaacatctgat

SEQ ID NO: 5342235 - DNA, 19 bp, Homo sapiens
aaactggaaacatctgatt

SEQ ID NO: 5342236 - DNA, 14 bp, Homo sapiens
aaactggaaatact

SEQ ID NO: 5342237 - DNA, 14 bp, Homo sapiens
aaactggaataaga

SEQ ID NO: 5342238 - DNA, 13 bp, Homo sapiens
aaactggaatgag

SEQ ID NO: 5342239 - DNA, 14 bp, Homo sapiens
aaactggaatgagc

SEQ ID NO: 5342240 - DNA, 15 bp, Homo sapiens
aaactggaatgagca

SEQ ID NO: 5342241 - DNA, 10 bp, Homo sapiens
aaactggaga

SEQ ID NO: 5342242 - DNA, 12 bp, Homo sapiens
aaactggagact

SEQ ID NO: 5342243 - DNA, 17 bp, Homo sapiens
aaactggatactgtact

SEQ ID NO: 5342244 - DNA, 20 bp, Homo sapiens
aaactggatagaaaaatgct

SEQ ID NO: 5342245 - DNA, 21 bp, Homo sapiens
aaactggattaaaacaatttt

SEQ ID NO: 5342246 - DNA, 20 bp, Homo sapiens
aaactggcaaacttcagact

SEQ ID NO: 5342247 - DNA, 16 bp, Homo sapiens
aaactggcaaagcaga

SEQ ID NO: 5342248 - DNA, 18 bp, Homo sapiens
aaactggcatctgctcta

SEQ ID NO: 5342249 - DNA, 18 bp, Homo sapiens
aaactggcgatctcccag

SEQ ID NO: 5342250 - DNA, 14 bp, Homo sapiens
aaactggcttcccc

SEQ ID NO: 5342251 - DNA, 16 bp, Homo sapiens
aaactggctttttccc

SEQ ID NO: 5342252 - DNA, 19 bp, Homo sapiens
aaactggctttttcccagc

SEQ ID NO: 5342253 - DNA, 21 bp, Homo sapiens
aaactgggacgtgtatttcca

SEQ ID NO: 5342254 - DNA, 16 bp, Homo sapiens
aaactgggataactga

SEQ ID NO: 5342255 - DNA, 19 bp, Homo sapiens
aaactgggatgaaactaaa

SEQ ID NO: 5342256 - DNA, 15 bp, Homo sapiens
aaactgggatgtaag

SEQ ID NO: 5342257 - DNA, 17 bp, Homo sapiens
aaactggggcctccaga

SEQ ID NO: 5342258 - DNA, 23 bp, Homo sapiens
aaactggggcttgcaagaggagg

SEQ ID NO: 5342259 - DNA, 23 bp, Homo sapiens
aaactggggggaaaaagaccagg

SEQ ID NO: 5342260 - DNA, 16 bp, Homo sapiens
aaactgggtttctcat

SEQ ID NO: 5342261 - DNA, 14 bp, Homo sapiens
aaactggtgcatga

SEQ ID NO: 5342262 - DNA, 11 bp, Homo sapiens
aaactggttcc

SEQ ID NO: 5342263 - DNA, 15 bp, Homo sapiens
aaactggttcctaca

SEQ ID NO: 5342264 - DNA, 22 bp, Homo sapiens
aaactggttctacaaattttta

SEQ ID NO: 5342265 - DNA, 21 bp, Homo sapiens
aaactggttctgtgttgaaat

SEQ ID NO: 5342266 - DNA, 21 bp, Homo sapiens
aaactggttgtaaaagagaaa

SEQ ID NO: 5342267 - DNA, 22 bp, Homo sapiens
aaactggtttgttgcagccaaa

SEQ ID NO: 5342268 - DNA, 17 bp, Homo sapiens
aaactgtaaataaaatg

SEQ ID NO: 5342269 - DNA, 22 bp, Homo sapiens
aaactgtaaataaaatgtgtac

SEQ ID NO: 5342270 - DNA, 14 bp, Homo sapiens
aaactgtacagaat

SEQ ID NO: 5342271 - DNA, 18 bp, Homo sapiens
aaactgtacagaatttcc

SEQ ID NO: 5342272 - DNA, 16 bp, Homo sapiens
aaactgtacagtgtct

SEQ ID NO: 5342273 - DNA, 20 bp, Homo sapiens
aaactgtaccttttgcgatt

SEQ ID NO: 5342274 - DNA, 15 bp, Homo sapiens
aaactgtactttgat

SEQ ID NO: 5342275 - DNA, 22 bp, Homo sapiens
aaactgtactttgattcacatg

SEQ ID NO: 5342276 - DNA, 18 bp, Homo sapiens
aaactgtagaaatgatga

SEQ ID NO: 5342277 - DNA, 14 bp, Homo sapiens
aaactgtagcaaga

SEQ ID NO: 5342278 - DNA, 22 bp, Homo sapiens
aaactgtagcgaccccagactg

SEQ ID NO: 5342279 - DNA, 21 bp, Homo sapiens
aaactgtatgtcttataagaa

SEQ ID NO: 5342280 - DNA, 15 bp, Homo sapiens
aaactgtatttaagg

SEQ ID NO: 5342281 - DNA, 17 bp, Homo sapiens
aaactgtcaaagaatca

SEQ ID NO: 5342282 - DNA, 15 bp, Homo sapiens
aaactgtcactgttg

SEQ ID NO: 5342283 - DNA, 15 bp, Homo sapiens
aaactgtcctctttc

SEQ ID NO: 5342284 - DNA, 20 bp, Homo sapiens
aaactgtcgtctttttccaa

SEQ ID NO: 5342285 - DNA, 21 bp, Homo sapiens
aaactgtcgtgtcatactcga

SEQ ID NO: 5342286 - DNA, 18 bp, Homo sapiens
aaactgtgaaaaatcaga

SEQ ID NO: 5342287 - DNA, 22 bp, Homo sapiens
aaactgtgaaaatagtgtaaga

SEQ ID NO: 5342288 - DNA, 18 bp, Homo sapiens
aaactgtgaatgcttctg

SEQ ID NO: 5342289 - DNA, 20 bp, Homo sapiens
aaactgtgaatgcttctgat

SEQ ID NO: 5342290 - DNA, 14 bp, Homo sapiens
aaactgtgacattc

SEQ ID NO: 5342291 - DNA, 21 bp, Homo sapiens
aaactgtgactaggcatacac

SEQ ID NO: 5342292 - DNA, 22 bp, Homo sapiens
aaactgtgactaggcatacact

SEQ ID NO: 5342293 - DNA, 19 bp, Homo sapiens
aaactgtgagataaatatc

SEQ ID NO: 5342294 - DNA, 21 bp, Homo sapiens
aaactgtgagataaatatcat

SEQ ID NO: 5342295 - DNA, 21 bp, Homo sapiens
aaactgtgcaactttttaaag

SEQ ID NO: 5342296 - DNA, 14 bp, Homo sapiens
aaactgtgcaatcc

SEQ ID NO: 5342297 - DNA, 17 bp, Homo sapiens
aaactgtgccctgcctt

SEQ ID NO: 5342298 - DNA, 19 bp, Homo sapiens
aaactgtgccctgccttca

SEQ ID NO: 5342299 - DNA, 14 bp, Homo sapiens
aaactgtgcttctc

SEQ ID NO: 5342300 - DNA, 21 bp, Homo sapiens
aaactgtgggattctgatttg

SEQ ID NO: 5342301 - DNA, 10 bp, Homo sapiens
aaactgtgta

SEQ ID NO: 5342302 - DNA, 16 bp, Homo sapiens
aaactgtgtatcatta

SEQ ID NO: 5342303 - DNA, 18 bp, Homo sapiens
aaactgtgtatcattaaa

SEQ ID NO: 5342304 - DNA, 19 bp, Homo sapiens
aaactgtgtatcattaaaa

SEQ ID NO: 5342305 - DNA, 18 bp, Homo sapiens
aaactgtgtattccaaga

SEQ ID NO: 5342306 - DNA, 19 bp, Homo sapiens
aaactgtgtattccaagac

SEQ ID NO: 5342307 - DNA, 12 bp, Homo sapiens
aaactgttagca

SEQ ID NO: 5342308 - DNA, 19 bp, Homo sapiens
aaactgttagcactgttga

SEQ ID NO: 5342309 - DNA, 23 bp, Homo sapiens
aaactgttctctattagacttta

SEQ ID NO: 5342310 - DNA, 14 bp, Homo sapiens
aaactgttggaagt

SEQ ID NO: 5342311 - DNA, 19 bp, Homo sapiens
aaactgttggaatggattt

SEQ ID NO: 5342312 - DNA, 15 bp, Homo sapiens
aaactgttgttttgt

SEQ ID NO: 5342313 - DNA, 16 bp, Homo sapiens
aaactgtttatggtat

SEQ ID NO: 5342314 - DNA, 18 bp, Homo sapiens
aaactgtttctttaaaat

SEQ ID NO: 5342315 - DNA, 23 bp, Homo sapiens
aaactgtttgaaaacttcagaag

SEQ ID NO: 5342316 - DNA, 12 bp, Homo sapiens
aaactgtttgtt

SEQ ID NO: 5342317 - DNA, 13 bp, Homo sapiens
aaacttaaaaaca

SEQ ID NO: 5342318 - DNA, 12 bp, Homo sapiens
aaacttaaaact

SEQ ID NO: 5342319 - DNA, 18 bp, Homo sapiens
aaacttaaagcaaaatag

SEQ ID NO: 5342320 - DNA, 19 bp, Homo sapiens
aaacttaaagcaaaatagt

SEQ ID NO: 5342321 - DNA, 15 bp, Homo sapiens
aaacttaaatattgt

SEQ ID NO: 5342322 - DNA, 13 bp, Homo sapiens
aaacttaaatgaa

SEQ ID NO: 5342323 - DNA, 16 bp, Homo sapiens
aaacttaaatgttatt

SEQ ID NO: 5342324 - DNA, 23 bp, Homo sapiens
aaacttaactttaactgaacaat

SEQ ID NO: 5342325 - DNA, 14 bp, Homo sapiens
aaacttaagaaaca

SEQ ID NO: 5342326 - DNA, 15 bp, Homo sapiens
aaacttaagatattt

SEQ ID NO: 5342327 - DNA, 18 bp, Homo sapiens
aaacttaagatgggcctg

SEQ ID NO: 5342328 - DNA, 15 bp, Homo sapiens
aaacttaagggcaag

SEQ ID NO: 5342329 - DNA, 16 bp, Homo sapiens
aaacttaatctaaatg

SEQ ID NO: 5342330 - DNA, 17 bp, Homo sapiens
aaacttaatctaaatgg

SEQ ID NO: 5342331 - DNA, 16 bp, Homo sapiens
aaacttaccaattgat

SEQ ID NO: 5342332 - DNA, 18 bp, Homo sapiens
aaacttaccaattgatgt

SEQ ID NO: 5342333 - DNA, 15 bp, Homo sapiens
aaacttactattttg

SEQ ID NO: 5342334 - DNA, 17 bp, Homo sapiens
aaacttagaataaaatt

SEQ ID NO: 5342335 - DNA, 22 bp, Homo sapiens
aaacttagaataaaattgtaaa

SEQ ID NO: 5342336 - DNA, 23 bp, Homo sapiens
aaacttagcttttgatgtctcca

SEQ ID NO: 5342337 - DNA, 22 bp, Homo sapiens
aaacttataaatcatattctca

SEQ ID NO: 5342338 - DNA, 20 bp, Homo sapiens
aaacttataaatcatattga

SEQ ID NO: 5342339 - DNA, 21 bp, Homo sapiens
aaacttataaatcatattgat

SEQ ID NO: 5342340 - DNA, 14 bp, Homo sapiens
aaacttataatttc

SEQ ID NO: 5342341 - DNA, 20 bp, Homo sapiens
aaacttattaacaactgtga

SEQ ID NO: 5342342 - DNA, 12 bp, Homo sapiens
aaacttatttga

SEQ ID NO: 5342343 - DNA, 14 bp, Homo sapiens
aaacttatttgagt

SEQ ID NO: 5342344 - DNA, 14 bp, Homo sapiens
aaacttattttatc

SEQ ID NO: 5342345 - DNA, 13 bp, Homo sapiens
aaacttcaaagct

SEQ ID NO: 5342346 - DNA, 16 bp, Homo sapiens
aaacttcaaagctgaa

SEQ ID NO: 5342347 - DNA, 14 bp, Homo sapiens
aaacttcaaggaaa

SEQ ID NO: 5342348 - DNA, 16 bp, Homo sapiens
aaacttcactccaaag

SEQ ID NO: 5342349 - DNA, 11 bp, Homo sapiens
aaacttcagca

SEQ ID NO: 5342350 - DNA, 12 bp, Homo sapiens
aaacttcagcaa

SEQ ID NO: 5342351 - DNA, 20 bp, Homo sapiens
aaacttcagttttactgcat

SEQ ID NO: 5342352 - DNA, 21 bp, Homo sapiens
aaacttcagttttactgcatt

SEQ ID NO: 5342353 - DNA, 22 bp, Homo sapiens
aaacttcagttttactgcattt

SEQ ID NO: 5342354 - DNA, 16 bp, Homo sapiens
aaacttcatgtaattt

SEQ ID NO: 5342355 - DNA, 17 bp, Homo sapiens
aaacttccaaacagtgt

SEQ ID NO: 5342356 - DNA, 18 bp, Homo sapiens
aaacttccattctttctt

SEQ ID NO: 5342357 - DNA, 17 bp, Homo sapiens
aaacttccccatcttct

SEQ ID NO: 5342358 - DNA, 23 bp, Homo sapiens
aaacttcccgtcccatatcctgc

SEQ ID NO: 5342359 - DNA, 17 bp, Homo sapiens
aaacttcggaaacaagt

SEQ ID NO: 5342360 - DNA, 17 bp, Homo sapiens
aaacttctactgagcaa

SEQ ID NO: 5342361 - DNA, 22 bp, Homo sapiens
aaacttctcgcaactgaaggaa

SEQ ID NO: 5342362 - DNA, 18 bp, Homo sapiens
aaacttctctgaagggag

SEQ ID NO: 5342363 - DNA, 11 bp, Homo sapiens
aaacttctgct

SEQ ID NO: 5342364 - DNA, 17 bp, Homo sapiens
aaacttctggctccctc

SEQ ID NO: 5342365 - DNA, 20 bp, Homo sapiens
aaacttcttaaatatctttt

SEQ ID NO: 5342366 - DNA, 21 bp, Homo sapiens
aaacttcttaaatatctttta

SEQ ID NO: 5342367 - DNA, 10 bp, Homo sapiens
aaacttcttg

SEQ ID NO: 5342368 - DNA, 15 bp, Homo sapiens
aaacttcttgtcaga

SEQ ID NO: 5342369 - DNA, 13 bp, Homo sapiens
aaacttgaaaata

SEQ ID NO: 5342370 - DNA, 22 bp, Homo sapiens
aaacttgaaagaagttttatgc

SEQ ID NO: 5342371 - DNA, 11 bp, Homo sapiens
aaacttgaaat

SEQ ID NO: 5342372 - DNA, 12 bp, Homo sapiens
aaacttgaaata

SEQ ID NO: 5342373 - DNA, 13 bp, Homo sapiens
aaacttgaaatat

SEQ ID NO: 5342374 - DNA, 18 bp, Homo sapiens
aaacttgaaatatataat

SEQ ID NO: 5342375 - DNA, 15 bp, Homo sapiens
aaacttgaacaagaa

SEQ ID NO: 5342376 - DNA, 17 bp, Homo sapiens
aaacttgaagctttgta

SEQ ID NO: 5342377 - DNA, 22 bp, Homo sapiens
aaacttgaatctgttactgaaa

SEQ ID NO: 5342378 - DNA, 15 bp, Homo sapiens
aaacttgagtggctg

SEQ ID NO: 5342379 - DNA, 16 bp, Homo sapiens
aaacttgagtttgttt

SEQ ID NO: 5342380 - DNA, 15 bp, Homo sapiens
aaacttgcacatttg

SEQ ID NO: 5342381 - DNA, 16 bp, Homo sapiens
aaacttgcacatttga

SEQ ID NO: 5342382 - DNA, 19 bp, Homo sapiens
aaacttgcatcacttaacg

SEQ ID NO: 5342383 - DNA, 17 bp, Homo sapiens
aaacttgccttttttat

SEQ ID NO: 5342384 - DNA, 18 bp, Homo sapiens
aaacttggaatcaaggta

SEQ ID NO: 5342385 - DNA, 14 bp, Homo sapiens
aaacttggacattt

SEQ ID NO: 5342386 - DNA, 16 bp, Homo sapiens
aaacttggacatttat

SEQ ID NO: 5342387 - DNA, 19 bp, Homo sapiens
aaacttggacccttggaaa

SEQ ID NO: 5342388 - DNA, 13 bp, Homo sapiens
aaacttggatact

SEQ ID NO: 5342389 - DNA, 16 bp, Homo sapiens
aaagaaagaggaaaag

SEQ ID NO: 5342390 - DNA, 18 bp, Homo sapiens
aaagaaagattttatgtg

SEQ ID NO: 5342391 - DNA, 13 bp, Homo sapiens
aaagaaagcagaa

SEQ ID NO: 5342392 - DNA, 18 bp, Homo sapiens
aaagaaagcctcagagaa

SEQ ID NO: 5342393 - DNA, 16 bp, Homo sapiens
aaagaaagctgtgaaa

SEQ ID NO: 5342394 - DNA, 15 bp, Homo sapiens
aaagaaaggaaagaa

SEQ ID NO: 5342395 - DNA, 15 bp, Homo sapiens
aaagaaagggaaaag

SEQ ID NO: 5342396 - DNA, 21 bp, Homo sapiens
aaagaaagggaaactggctga

SEQ ID NO: 5342397 - DNA, 20 bp, Homo sapiens
aaagaaagggacccacctgc

SEQ ID NO: 5342398 - DNA, 17 bp, Homo sapiens
aaagaaagggttctgta

SEQ ID NO: 5342399 - DNA, 20 bp, Homo sapiens
aaagaaaggtgccatgtctt

SEQ ID NO: 5342400 - DNA, 17 bp, Homo sapiens
aaagaaaggttgcgttt

SEQ ID NO: 5342401 - DNA, 13 bp, Homo sapiens
aaagaaagtcata

SEQ ID NO: 5342402 - DNA, 23 bp, Homo sapiens
aaagaaagtggtcttaagaaatg

SEQ ID NO: 5342403 - DNA, 23 bp, Homo sapiens
aaagaaagttgcacggctgctga

SEQ ID NO: 5342404 - DNA, 14 bp, Homo sapiens
aaagaaataaccac

SEQ ID NO: 5342405 - DNA, 13 bp, Homo sapiens
aaagaaataattt

SEQ ID NO: 5342406 - DNA, 16 bp, Homo sapiens
aaagaaatacacaggg

SEQ ID NO: 5342407 - DNA, 12 bp, Homo sapiens
aaagaaatacag

SEQ ID NO: 5342408 - DNA, 15 bp, Homo sapiens
aaagaaatatacagt

SEQ ID NO: 5342409 - DNA, 16 bp, Homo sapiens
aaagaaatatacagtt

SEQ ID NO: 5342410 - DNA, 17 bp, Homo sapiens
aaagaaatatacagttt

SEQ ID NO: 5342411 - DNA, 17 bp, Homo sapiens
aaagaaatatacctaaa

SEQ ID NO: 5342412 - DNA, 19 bp, Homo sapiens
aaagaaatatattattcat

SEQ ID NO: 5342413 - DNA, 18 bp, Homo sapiens
aaagaaatatattttttg

SEQ ID NO: 5342414 - DNA, 12 bp, Homo sapiens
aaagaaatattt

SEQ ID NO: 5342415 - DNA, 14 bp, Homo sapiens
aaagaaatatttac

SEQ ID NO: 5342416 - DNA, 23 bp, Homo sapiens
aaagaaatccccccttcagaaca

SEQ ID NO: 5342417 - DNA, 20 bp, Homo sapiens
aaagaaatccggagaagctg

SEQ ID NO: 5342418 - DNA, 18 bp, Homo sapiens
aaagaaatctatagaaag

SEQ ID NO: 5342419 - DNA, 22 bp, Homo sapiens
aaagaaatctatagaaagtgtt

SEQ ID NO: 5342420 - DNA, 23 bp, Homo sapiens
aaagaaatctatagaaagtgttc

SEQ ID NO: 5342421 - DNA, 14 bp, Homo sapiens
aaagaaatgaacat

SEQ ID NO: 5342422 - DNA, 16 bp, Homo sapiens
aaagaaatgactaatt

SEQ ID NO: 5342423 - DNA, 17 bp, Homo sapiens
aaagaaatgcacaatgt

SEQ ID NO: 5342424 - DNA, 21 bp, Homo sapiens
aaagaaatgctaatgtaatca

SEQ ID NO: 5342425 - DNA, 16 bp, Homo sapiens
aaagaaatgggcctgc

SEQ ID NO: 5342426 - DNA, 11 bp, Homo sapiens
aaagaaatgta

SEQ ID NO: 5342427 - DNA, 19 bp, Homo sapiens
aaagaaatgtctattaagg

SEQ ID NO: 5342428 - DNA, 13 bp, Homo sapiens
aaagaaattacag

SEQ ID NO: 5342429 - DNA, 14 bp, Homo sapiens
aaagaaattatctt

SEQ ID NO: 5342430 - DNA, 11 bp, Homo sapiens
aaagaaattcg

SEQ ID NO: 5342431 - DNA, 20 bp, Homo sapiens
aaagaaattcgcatgtttaa

SEQ ID NO: 5342432 - DNA, 21 bp, Homo sapiens
aaagaaatttactatatatat

SEQ ID NO: 5342433 - DNA, 20 bp, Homo sapiens
aaagaaatttagagtcaatt

SEQ ID NO: 5342434 - DNA, 20 bp, Homo sapiens
aaagaaatttgaaaaaactt

SEQ ID NO: 5342435 - DNA, 16 bp, Homo sapiens
aaagaacagtgagaaa

SEQ ID NO: 5342436 - DNA, 20 bp, Homo sapiens
aaagaacatgcagtttgaaa

SEQ ID NO: 5342437 - DNA, 18 bp, Homo sapiens
aaagaacatggacttgta

SEQ ID NO: 5342438 - DNA, 13 bp, Homo sapiens
aaagaacattctt

SEQ ID NO: 5342439 - DNA, 14 bp, Homo sapiens
aaagaacattttgc

SEQ ID NO: 5342440 - DNA, 15 bp, Homo sapiens
aaagaacattttgcc

SEQ ID NO: 5342441 - DNA, 14 bp, Homo sapiens
aaagaaccaaaact

SEQ ID NO: 5342442 - DNA, 21 bp, Homo sapiens
aaagaaccaagaaaaaggaat

SEQ ID NO: 5342443 - DNA, 16 bp, Homo sapiens
aaagaaccatgcagga

SEQ ID NO: 5342444 - DNA, 21 bp, Homo sapiens
aaagaaccatgcaggaaggaa

SEQ ID NO: 5342445 - DNA, 18 bp, Homo sapiens
aaagaacccatttgccat

SEQ ID NO: 5342446 - DNA, 17 bp, Homo sapiens
aaagaacccccctcccc

SEQ ID NO: 5342447 - DNA, 20 bp, Homo sapiens
aaagaacccccctccccaag

SEQ ID NO: 5342448 - DNA, 15 bp, Homo sapiens
aaagaacgctgattt

SEQ ID NO: 5342449 - DNA, 18 bp, Homo sapiens
aaagaacggcatgtgaat

SEQ ID NO: 5342450 - DNA, 16 bp, Homo sapiens
aaagaactaaatatgc

SEQ ID NO: 5342451 - DNA, 16 bp, Homo sapiens
aaagaactatcttcat

SEQ ID NO: 5342452 - DNA, 20 bp, Homo sapiens
aaagaactatcttcatctga

SEQ ID NO: 5342453 - DNA, 13 bp, Homo sapiens
aaagaactcattt

SEQ ID NO: 5342454 - DNA, 16 bp, Homo sapiens
aaagaactccttattt

SEQ ID NO: 5342455 - DNA, 20 bp, Homo sapiens
aaagaactccttattttgta

SEQ ID NO: 5342456 - DNA, 21 bp, Homo sapiens
aaagaactccttattttgtat

SEQ ID NO: 5342457 - DNA, 13 bp, Homo sapiens
aaagaactgcccc

SEQ ID NO: 5342458 - DNA, 14 bp, Homo sapiens
aaagaactgcccca

SEQ ID NO: 5342459 - DNA, 15 bp, Homo sapiens
aaagaactgccccat

SEQ ID NO: 5342460 - DNA, 18 bp, Homo sapiens
aaagaacttaaattatgt

SEQ ID NO: 5342461 - DNA, 16 bp, Homo sapiens
aaagaacttggacttc

SEQ ID NO: 5342462 - DNA, 18 bp, Homo sapiens
aaagaactttaaagctca

SEQ ID NO: 5342463 - DNA, 10 bp, Homo sapiens
aaagaagaaa

SEQ ID NO: 5342464 - DNA, 13 bp, Homo sapiens
aaagaagaaaaga

SEQ ID NO: 5342465 - DNA, 17 bp, Homo sapiens
aaagaagaaacgtctat

SEQ ID NO: 5342466 - DNA, 16 bp, Homo sapiens
aaagaagaaagtctat

SEQ ID NO: 5342467 - DNA, 19 bp, Homo sapiens
aaagaagaaagtctatgct

SEQ ID NO: 5342468 - DNA, 21 bp, Homo sapiens
aaagaagaagaagaagaaaag

SEQ ID NO: 5342469 - DNA, 20 bp, Homo sapiens
aaagaagaaggtgggaggat

SEQ ID NO: 5342470 - DNA, 20 bp, Homo sapiens
aaagaagaatgtgtttcaaa

SEQ ID NO: 5342471 - DNA, 14 bp, Homo sapiens
aaagaagacatgtt

SEQ ID NO: 5342472 - DNA, 18 bp, Homo sapiens
aaagaagacatgttttag

SEQ ID NO: 5342473 - DNA, 19 bp, Homo sapiens
aaagaagaccctttgttga

SEQ ID NO: 5342474 - DNA, 20 bp, Homo sapiens
aaagaagacctgagaatgta

SEQ ID NO: 5342475 - DNA, 22 bp, Homo sapiens
aaagaagacctgagaatgtatc

SEQ ID NO: 5342476 - DNA, 16 bp, Homo sapiens
aaagaagagaggggaa

SEQ ID NO: 5342477 - DNA, 20 bp, Homo sapiens
aaagaagagaggggaagaat

SEQ ID NO: 5342478 - DNA, 23 bp, Homo sapiens
aaagaagagaggggaagaattta

SEQ ID NO: 5342479 - DNA, 20 bp, Homo sapiens
aaagaagagtaaaatggctg

SEQ ID NO: 5342480 - DNA, 19 bp, Homo sapiens
aaagaagagtttacagaca

SEQ ID NO: 5342481 - DNA, 19 bp, Homo sapiens
aaagaagagttttagagaa

SEQ ID NO: 5342482 - DNA, 13 bp, Homo sapiens
aaagaagatagct

SEQ ID NO: 5342483 - DNA, 12 bp, Homo sapiens
aaagaagatgtt

SEQ ID NO: 5342484 - DNA, 12 bp, Homo sapiens
aaagaagcaaga

SEQ ID NO: 5342485 - DNA, 14 bp, Homo sapiens
aaagaagcaagaca

SEQ ID NO: 5342486 - DNA, 21 bp, Homo sapiens
aaagaagcattgaaaacaaag

SEQ ID NO: 5342487 - DNA, 13 bp, Homo sapiens
aaagaagccacag

SEQ ID NO: 5342488 - DNA, 18 bp, Homo sapiens
aaagaagccacagctctt

SEQ ID NO: 5342489 - DNA, 12 bp, Homo sapiens
aaagaagccata

SEQ ID NO: 5342490 - DNA, 23 bp, Homo sapiens
aaagaagcctagaaaagaagcag

SEQ ID NO: 5342491 - DNA, 20 bp, Homo sapiens
aaagaagctcgccccacctc

SEQ ID NO: 5342492 - DNA, 12 bp, Homo sapiens
aaagaagctgca

SEQ ID NO: 5342493 - DNA, 19 bp, Homo sapiens
aaagaagcttccacaaaat

SEQ ID NO: 5342494 - DNA, 12 bp, Homo sapiens
aaagaaggagct

SEQ ID NO: 5342495 - DNA, 15 bp, Homo sapiens
aaagaaggagctgag

SEQ ID NO: 5342496 - DNA, 22 bp, Homo sapiens
aaagaagggatattaagaatct

SEQ ID NO: 5342497 - DNA, 21 bp, Homo sapiens
aaagaagggctggtattgttc

SEQ ID NO: 5342498 - DNA, 13 bp, Homo sapiens
aaagaaggtgctg

SEQ ID NO: 5342499 - DNA, 19 bp, Homo sapiens
aaagaaggtgctgatccta

SEQ ID NO: 5342500 - DNA, 16 bp, Homo sapiens
aaagaagtaaaagcta

SEQ ID NO: 5342501 - DNA, 15 bp, Homo sapiens
aaagaagtaaatttg

SEQ ID NO: 5342502 - DNA, 18 bp, Homo sapiens
aaagaagtaaatttgtcc

SEQ ID NO: 5342503 - DNA, 23 bp, Homo sapiens
aaagaagtaggggaagacatgca

SEQ ID NO: 5342504 - DNA, 15 bp, Homo sapiens
aaagaagtccatgtg

SEQ ID NO: 5342505 - DNA, 12 bp, Homo sapiens
aaagaagtgtga

SEQ ID NO: 5342506 - DNA, 15 bp, Homo sapiens
aaagaagttgtagtg

SEQ ID NO: 5342507 - DNA, 16 bp, Homo sapiens
aaagaataaaatgttt

SEQ ID NO: 5342508 - DNA, 18 bp, Homo sapiens
aaagaataaaatgtttct

SEQ ID NO: 5342509 - DNA, 18 bp, Homo sapiens
aaagaataaatgaatctt

SEQ ID NO: 5342510 - DNA, 15 bp, Homo sapiens
aaagaatacagaaag

SEQ ID NO: 5342511 - DNA, 15 bp, Homo sapiens
aaagaatagaaggat

SEQ ID NO: 5342512 - DNA, 18 bp, Homo sapiens
aaagaatatatttattta

SEQ ID NO: 5342513 - DNA, 15 bp, Homo sapiens
aaagaatatgacttt

SEQ ID NO: 5342514 - DNA, 18 bp, Homo sapiens
aaagaatatttaaataaa

SEQ ID NO: 5342515 - DNA, 20 bp, Homo sapiens
aaagaatattttgatgcaga

SEQ ID NO: 5342516 - DNA, 19 bp, Homo sapiens
aaagaatcagtaggaccag

SEQ ID NO: 5342517 - DNA, 20 bp, Homo sapiens
aaagaatcagtaggaccagg

SEQ ID NO: 5342518 - DNA, 11 bp, Homo sapiens
aaagaatccaa

SEQ ID NO: 5342519 - DNA, 17 bp, Homo sapiens
aaagaatccaagacaaa

SEQ ID NO: 5342520 - DNA, 19 bp, Homo sapiens
aaagaatccctgcagcctg

SEQ ID NO: 5342521 - DNA, 21 bp, Homo sapiens
aaagaatccctgttcattgta

SEQ ID NO: 5342522 - DNA, 17 bp, Homo sapiens
aaagaatccttatctat

SEQ ID NO: 5342523 - DNA, 19 bp, Homo sapiens
aaagaatccttatctataa

SEQ ID NO: 5342524 - DNA, 20 bp, Homo sapiens
aaagaatcggcagtattttc

SEQ ID NO: 5342525 - DNA, 14 bp, Homo sapiens
aaagaatctatcac

SEQ ID NO: 5342526 - DNA, 17 bp, Homo sapiens
aaagaatctgatactta

SEQ ID NO: 5342527 - DNA, 16 bp, Homo sapiens
aaagaatgaaaacaat

SEQ ID NO: 5342528 - DNA, 17 bp, Homo sapiens
aaagaatgaaaacaata

SEQ ID NO: 5342529 - DNA, 13 bp, Homo sapiens
aaagaatgaaaga

SEQ ID NO: 5342530 - DNA, 14 bp, Homo sapiens
aaagaatgaaagag

SEQ ID NO: 5342531 - DNA, 15 bp, Homo sapiens
aaagaatgaaagtag

SEQ ID NO: 5342532 - DNA, 13 bp, Homo sapiens
aaagaatgactat

SEQ ID NO: 5342533 - DNA, 15 bp, Homo sapiens
aaagaatgagaaaga

SEQ ID NO: 5342534 - DNA, 22 bp, Homo sapiens
aaagaatgagaaggagtcagaa

SEQ ID NO: 5342535 - DNA, 15 bp, Homo sapiens
aaagaatgcagagat

SEQ ID NO: 5342536 - DNA, 16 bp, Homo sapiens
aaagaatgcagagatg

SEQ ID NO: 5342537 - DNA, 17 bp, Homo sapiens
aaagaatggaaggtgga

SEQ ID NO: 5342538 - DNA, 18 bp, Homo sapiens
aaagaatgggcagttaca

SEQ ID NO: 5342539 - DNA, 12 bp, Homo sapiens
aaagaatgtaca

SEQ ID NO: 5342540 - DNA, 13 bp, Homo sapiens
aaagaatgtacag

SEQ ID NO: 5342541 - DNA, 14 bp, Homo sapiens
aaagaatgtacaga

SEQ ID NO: 5342542 - DNA, 17 bp, Homo sapiens
aaagaatgttttggaat

SEQ ID NO: 5342543 - DNA, 16 bp, Homo sapiens
aaagaattaaaaactt

SEQ ID NO: 5342544 - DNA, 21 bp, Homo sapiens
aaagaattaaacccacaagct

SEQ ID NO: 5342545 - DNA, 14 bp, Homo sapiens
aaagaattagccaa

SEQ ID NO: 5342546 - DNA, 21 bp, Homo sapiens
aaagaattcctgcagcagtta

SEQ ID NO: 5342547 - DNA, 15 bp, Homo sapiens
aaagaattctatttt

SEQ ID NO: 5342548 - DNA, 22 bp, Homo sapiens
aaagaattggtcttaatgttga

SEQ ID NO: 5342549 - DNA, 20 bp, Homo sapiens
aaagaattgttgggggtttt

SEQ ID NO: 5342550 - DNA, 22 bp, Homo sapiens
aaagaattgttgggggtttttt

SEQ ID NO: 5342551 - DNA, 16 bp, Homo sapiens
aaagaatttagtatta

SEQ ID NO: 5342552 - DNA, 13 bp, Homo sapiens
aaagaatttgaaa

SEQ ID NO: 5342553 - DNA, 23 bp, Homo sapiens
aaagacaaaaatcaaagaacaga

SEQ ID NO: 5342554 - DNA, 17 bp, Homo sapiens
aaagacaaaatgtgacc

SEQ ID NO: 5342555 - DNA, 15 bp, Homo sapiens
aaagacaaacagtag

SEQ ID NO: 5342556 - DNA, 15 bp, Homo sapiens
aaagacaaagaagga

SEQ ID NO: 5342557 - DNA, 12 bp, Homo sapiens
aaagacaaatag

SEQ ID NO: 5342558 - DNA, 13 bp, Homo sapiens
aaagacaaatgtg

SEQ ID NO: 5342559 - DNA, 14 bp, Homo sapiens
aaagacaaatgtgc

SEQ ID NO: 5342560 - DNA, 15 bp, Homo sapiens
aaagacaaatgtgct

SEQ ID NO: 5342561 - DNA, 21 bp, Homo sapiens
aaagacaaatgtgctctatgt

SEQ ID NO: 5342562 - DNA, 17 bp, Homo sapiens
aaagacaaattctgttt

SEQ ID NO: 5342563 - DNA, 15 bp, Homo sapiens
aaagacaacaaaaga

SEQ ID NO: 5342564 - DNA, 14 bp, Homo sapiens
aaagacaacacaac

SEQ ID NO: 5342565 - DNA, 17 bp, Homo sapiens
aaagacaatcactgaaa

SEQ ID NO: 5342566 - DNA, 11 bp, Homo sapiens
aaagacaattc

SEQ ID NO: 5342567 - DNA, 12 bp, Homo sapiens
aaagacaattct

SEQ ID NO: 5342568 - DNA, 16 bp, Homo sapiens
aaagacaattctttat

SEQ ID NO: 5342569 - DNA, 13 bp, Homo sapiens
aaagatttggaaa

SEQ ID NO: 5342570 - DNA, 15 bp, Homo sapiens
aaagatttggaaaat

SEQ ID NO: 5342571 - DNA, 21 bp, Homo sapiens
aaagatttgtgaactggaaga

SEQ ID NO: 5342572 - DNA, 16 bp, Homo sapiens
aaagatttgtggtaac

SEQ ID NO: 5342573 - DNA, 14 bp, Homo sapiens
aaagatttgttact

SEQ ID NO: 5342574 - DNA, 20 bp, Homo sapiens
aaagatttgttactgtattt

SEQ ID NO: 5342575 - DNA, 15 bp, Homo sapiens
aaagatttgttgaca

SEQ ID NO: 5342576 - DNA, 14 bp, Homo sapiens
aaagattttaatca

SEQ ID NO: 5342577 - DNA, 21 bp, Homo sapiens
aaagattttattgtataaaaa

SEQ ID NO: 5342578 - DNA, 13 bp, Homo sapiens
aaagattttcaga

SEQ ID NO: 5342579 - DNA, 21 bp, Homo sapiens
aaagattttcagaaaatatta

SEQ ID NO: 5342580 - DNA, 13 bp, Homo sapiens
aaagattttctaa

SEQ ID NO: 5342581 - DNA, 17 bp, Homo sapiens
aaagattttgtgaaatt

SEQ ID NO: 5342582 - DNA, 20 bp, Homo sapiens
aaagattttgtgaaatttca

SEQ ID NO: 5342583 - DNA, 21 bp, Homo sapiens
aaagattttgtgaaatttcat

SEQ ID NO: 5342584 - DNA, 22 bp, Homo sapiens
aaagattttgtgaaatttcatg

SEQ ID NO: 5342585 - DNA, 23 bp, Homo sapiens
aaagattttgtgaaatttcatga

SEQ ID NO: 5342586 - DNA, 16 bp, Homo sapiens
aaagatttttaaaatg

SEQ ID NO: 5342587 - DNA, 18 bp, Homo sapiens
aaagatttttactaatat

SEQ ID NO: 5342588 - DNA, 20 bp, Homo sapiens
aaagatttttactaatatat

SEQ ID NO: 5342589 - DNA, 21 bp, Homo sapiens
aaagatttttactaatatata

SEQ ID NO: 5342590 - DNA, 15 bp, Homo sapiens
aaagatttttgttaa

SEQ ID NO: 5342591 - DNA, 14 bp, Homo sapiens
aaagattttttaat

SEQ ID NO: 5342592 - DNA, 20 bp, Homo sapiens
aaagattttttaataattta

SEQ ID NO: 5342593 - DNA, 22 bp, Homo sapiens
aaagattttttaataatttaga

SEQ ID NO: 5342594 - DNA, 16 bp, Homo sapiens
aaagcaaaaaagaaaa

SEQ ID NO: 5342595 - DNA, 13 bp, Homo sapiens
aaagcaaaaaata

SEQ ID NO: 5342596 - DNA, 15 bp, Homo sapiens
aaagcaaaaaataaa

SEQ ID NO: 5342597 - DNA, 15 bp, Homo sapiens
aaagcaaaaatgcta

SEQ ID NO: 5342598 - DNA, 16 bp, Homo sapiens
aaagcaaaaatgctaa

SEQ ID NO: 5342599 - DNA, 18 bp, Homo sapiens
aaagcaaaaatgctaata

SEQ ID NO: 5342600 - DNA, 12 bp, Homo sapiens
aaagcaaaacat

SEQ ID NO: 5342601 - DNA, 19 bp, Homo sapiens
aaagcaaaacatctctgca

SEQ ID NO: 5342602 - DNA, 16 bp, Homo sapiens
aaagcaaaagagaaat

SEQ ID NO: 5342603 - DNA, 18 bp, Homo sapiens
aaagcaaaataaaaacta

SEQ ID NO: 5342604 - DNA, 12 bp, Homo sapiens
aaagcaaaatac

SEQ ID NO: 5342605 - DNA, 16 bp, Homo sapiens
aaagcaaaatatttgt

SEQ ID NO: 5342606 - DNA, 17 bp, Homo sapiens
aaagcaaaatatttgtg

SEQ ID NO: 5342607 - DNA, 18 bp, Homo sapiens
aaagcaaaatatttgtga

SEQ ID NO: 5342608 - DNA, 19 bp, Homo sapiens
aaagcaaacacaagaaatc

SEQ ID NO: 5342609 - DNA, 23 bp, Homo sapiens
aaagcaaaccttaatttgaaata

SEQ ID NO: 5342610 - DNA, 21 bp, Homo sapiens
aaagcaaacttaagaaacact

SEQ ID NO: 5342611 - DNA, 23 bp, Homo sapiens
aaagcaaacttaagaaacactga

SEQ ID NO: 5342612 - DNA, 17 bp, Homo sapiens
aaagcaaaggtgcactc

SEQ ID NO: 5342613 - DNA, 22 bp, Homo sapiens
aaagcaaaggtgcactccagac

SEQ ID NO: 5342614 - DNA, 20 bp, Homo sapiens
aaagcaaatatataatgcaa

SEQ ID NO: 5342615 - DNA, 15 bp, Homo sapiens
aaagcaaatcagaca

SEQ ID NO: 5342616 - DNA, 14 bp, Homo sapiens
aaagcaaatcattt

SEQ ID NO: 5342617 - DNA, 13 bp, Homo sapiens
aaagcaaatgata

SEQ ID NO: 5342618 - DNA, 15 bp, Homo sapiens
aaagcaaatttcatt

SEQ ID NO: 5342619 - DNA, 15 bp, Homo sapiens
aaagcaacaaagaaa

SEQ ID NO: 5342620 - DNA, 14 bp, Homo sapiens
aaagcaacagctgg

SEQ ID NO: 5342621 - DNA, 15 bp, Homo sapiens
aaagcaacagctgga

SEQ ID NO: 5342622 - DNA, 18 bp, Homo sapiens
aaagcaacagtagcaggg

SEQ ID NO: 5342623 - DNA, 19 bp, Homo sapiens
aaagcaaccacaaatgcat

SEQ ID NO: 5342624 - DNA, 13 bp, Homo sapiens
aaagcaaccacct

SEQ ID NO: 5342625 - DNA, 21 bp, Homo sapiens
aaagcaacgactactttgcta

SEQ ID NO: 5342626 - DNA, 22 bp, Homo sapiens
aaagcaactgatcatatttgtg

SEQ ID NO: 5342627 - DNA, 12 bp, Homo sapiens
aaagcaagaatt

SEQ ID NO: 5342628 - DNA, 14 bp, Homo sapiens
aaagcaagactgtt

SEQ ID NO: 5342629 - DNA, 23 bp, Homo sapiens
aaagcaagatctactacatccca

SEQ ID NO: 5342630 - DNA, 15 bp, Homo sapiens
aaagcaagcacctgg

SEQ ID NO: 5342631 - DNA, 19 bp, Homo sapiens
aaagcaagctgattaaatg

SEQ ID NO: 5342632 - DNA, 14 bp, Homo sapiens
aaagcaaggaaact

SEQ ID NO: 5342633 - DNA, 20 bp, Homo sapiens
aaagcaaggaaactatgtaa

SEQ ID NO: 5342634 - DNA, 14 bp, Homo sapiens
aaagcaaggatctt

SEQ ID NO: 5342635 - DNA, 21 bp, Homo sapiens
aaagcaaggcagaaggccagg

SEQ ID NO: 5342636 - DNA, 23 bp, Homo sapiens
aaagcaagggagaaaagagaaac

SEQ ID NO: 5342637 - DNA, 20 bp, Homo sapiens
aaagcaagggctccagcatc

SEQ ID NO: 5342638 - DNA, 22 bp, Homo sapiens
aaagcaagtgattgggacagag

SEQ ID NO: 5342639 - DNA, 17 bp, Homo sapiens
aaagcaatacaacttta

SEQ ID NO: 5342640 - DNA, 13 bp, Homo sapiens
aaagcaatagaaa

SEQ ID NO: 5342641 - DNA, 15 bp, Homo sapiens
aaagcaatagaaaca

SEQ ID NO: 5342642 - DNA, 22 bp, Homo sapiens
aaagcaatcattaagtgacttt

SEQ ID NO: 5342643 - DNA, 16 bp, Homo sapiens
aaagcaatctggaaga

SEQ ID NO: 5342644 - DNA, 12 bp, Homo sapiens
aaagcaatgcat

SEQ ID NO: 5342645 - DNA, 17 bp, Homo sapiens
aaagcaattaaatgata

SEQ ID NO: 5342646 - DNA, 19 bp, Homo sapiens
aaagcaattaaatgatatt

SEQ ID NO: 5342647 - DNA, 15 bp, Homo sapiens
aaagcaattatattg

SEQ ID NO: 5342648 - DNA, 17 bp, Homo sapiens
aaagcaattctgactgt

SEQ ID NO: 5342649 - DNA, 14 bp, Homo sapiens
aaagcaattgccct

SEQ ID NO: 5342650 - DNA, 14 bp, Homo sapiens
aaagcaattgtgaa

SEQ ID NO: 5342651 - DNA, 13 bp, Homo sapiens
aaagcaattttcc

SEQ ID NO: 5342652 - DNA, 16 bp, Homo sapiens
aaagcaattttccttg

SEQ ID NO: 5342653 - DNA, 19 bp, Homo sapiens
aaagcacaaaccctgggga

SEQ ID NO: 5342654 - DNA, 13 bp, Homo sapiens
aaagcacaaagga

SEQ ID NO: 5342655 - DNA, 20 bp, Homo sapiens
aaagcacaatcactaaactt

SEQ ID NO: 5342656 - DNA, 17 bp, Homo sapiens
aaagcacaatgtggatt

SEQ ID NO: 5342657 - DNA, 20 bp, Homo sapiens
aaagcacaatttaaaacaat

SEQ ID NO: 5342658 - DNA, 20 bp, Homo sapiens
aaagcacactcatcccctca

SEQ ID NO: 5342659 - DNA, 17 bp, Homo sapiens
aaagcacagatttgcat

SEQ ID NO: 5342660 - DNA, 21 bp, Homo sapiens
aaagcacatacattaaaacta

SEQ ID NO: 5342661 - DNA, 23 bp, Homo sapiens
aaagcacatgcttagcttatctt

SEQ ID NO: 5342662 - DNA, 16 bp, Homo sapiens
aaagcacattgaaaga

SEQ ID NO: 5342663 - DNA, 16 bp, Homo sapiens
aaagcaccaaaataag

SEQ ID NO: 5342664 - DNA, 18 bp, Homo sapiens
aaagcaccaaaataagaa

SEQ ID NO: 5342665 - DNA, 15 bp, Homo sapiens
aaagcacctcttgaa

SEQ ID NO: 5342666 - DNA, 16 bp, Homo sapiens
aaagcacctgaaccac

SEQ ID NO: 5342667 - DNA, 20 bp, Homo sapiens
aaagcacctgaaccactgtg

SEQ ID NO: 5342668 - DNA, 19 bp, Homo sapiens
aaagcacgaaatgttattt

SEQ ID NO: 5342669 - DNA, 16 bp, Homo sapiens
aaagcacgcagttatg

SEQ ID NO: 5342670 - DNA, 16 bp, Homo sapiens
aaagcacgtgcaagga

SEQ ID NO: 5342671 - DNA, 20 bp, Homo sapiens
aaagcactacaatcatggtc

SEQ ID NO: 5342672 - DNA, 22 bp, Homo sapiens
aaagcactcctccctgatgtac

SEQ ID NO: 5342673 - DNA, 12 bp, Homo sapiens
aaagcactctct

SEQ ID NO: 5342674 - DNA, 17 bp, Homo sapiens
aaagcactgacttctaa

SEQ ID NO: 5342675 - DNA, 21 bp, Homo sapiens
aaagcactgacttctaagtaa

SEQ ID NO: 5342676 - DNA, 20 bp, Homo sapiens
aaagcactggtttcaagaat

SEQ ID NO: 5342677 - DNA, 23 bp, Homo sapiens
aaagcactggtttcaagaatatg

SEQ ID NO: 5342678 - DNA, 14 bp, Homo sapiens
aaagcacttaagtg

SEQ ID NO: 5342679 - DNA, 17 bp, Homo sapiens
aaagcacttactttttt

SEQ ID NO: 5342680 - DNA, 16 bp, Homo sapiens
aaagcagaacagtgat

SEQ ID NO: 5342681 - DNA, 14 bp, Homo sapiens
aaagcagaactgaa

SEQ ID NO: 5342682 - DNA, 23 bp, Homo sapiens
aaagcagagatcgacagacagcc

SEQ ID NO: 5342683 - DNA, 18 bp, Homo sapiens
aaagcagagatgtattat

SEQ ID NO: 5342684 - DNA, 19 bp, Homo sapiens
aaagcagagatgtattatg

SEQ ID NO: 5342685 - DNA, 12 bp, Homo sapiens
aaagcagagcca

SEQ ID NO: 5342686 - DNA, 18 bp, Homo sapiens
aaagcagagccaaggcca

SEQ ID NO: 5342687 - DNA, 19 bp, Homo sapiens
aaagcagagccaaggccac

SEQ ID NO: 5342688 - DNA, 17 bp, Homo sapiens
aaagcagagcctcctgg

SEQ ID NO: 5342689 - DNA, 21 bp, Homo sapiens
aaagcagaggctggcctcaga

SEQ ID NO: 5342690 - DNA, 14 bp, Homo sapiens
aaagcagataaaat

SEQ ID NO: 5342691 - DNA, 22 bp, Homo sapiens
aaagcagattttcctaaggcca

SEQ ID NO: 5342692 - DNA, 21 bp, Homo sapiens
aaagcagcacacattgtgtta

SEQ ID NO: 5342693 - DNA, 20 bp, Homo sapiens
aaagcagcaggcctctggtt

SEQ ID NO: 5342694 - DNA, 20 bp, Homo sapiens
aaagcagcattctggagggg

SEQ ID NO: 5342695 - DNA, 12 bp, Homo sapiens
aaagcagccacg

SEQ ID NO: 5342696 - DNA, 20 bp, Homo sapiens
aaagcagctaaatgtaactt

SEQ ID NO: 5342697 - DNA, 18 bp, Homo sapiens
aaagcagctcaaaggcac

SEQ ID NO: 5342698 - DNA, 19 bp, Homo sapiens
aaagcagctcaaaggcaca

SEQ ID NO: 5342699 - DNA, 15 bp, Homo sapiens
aaagcagctctcccc

SEQ ID NO: 5342700 - DNA, 14 bp, Homo sapiens
aaagcaggaaaaaa

SEQ ID NO: 5342701 - DNA, 20 bp, Homo sapiens
aaagcaggaaagatcccaag

SEQ ID NO: 5342702 - DNA, 13 bp, Homo sapiens
aaagcaggagtgg

SEQ ID NO: 5342703 - DNA, 17 bp, Homo sapiens
aaagcaggcagaactca

SEQ ID NO: 5342704 - DNA, 17 bp, Homo sapiens
aaagcagggacttgaac

SEQ ID NO: 5342705 - DNA, 20 bp, Homo sapiens
aaagcaggggagtatgcaaa

SEQ ID NO: 5342706 - DNA, 18 bp, Homo sapiens
aaagcaggggctacaaga

SEQ ID NO: 5342707 - DNA, 15 bp, Homo sapiens
aaagcaggttcttgt

SEQ ID NO: 5342708 - DNA, 21 bp, Homo sapiens
aaagcaggttgataaatcatt

SEQ ID NO: 5342709 - DNA, 15 bp, Homo sapiens
aaagcaggtttttat

SEQ ID NO: 5342710 - DNA, 15 bp, Homo sapiens
aaagcagtatttttc

SEQ ID NO: 5342711 - DNA, 19 bp, Homo sapiens
aaagcagtcctgttcaaat

SEQ ID NO: 5342712 - DNA, 13 bp, Homo sapiens
aaagcagtgcatg

SEQ ID NO: 5342713 - DNA, 17 bp, Homo sapiens
aaagcagtgcatgctgt

SEQ ID NO: 5342714 - DNA, 21 bp, Homo sapiens
aaagcagtgcatgctgtccct

SEQ ID NO: 5342715 - DNA, 12 bp, Homo sapiens
aaagcagtgttt

SEQ ID NO: 5342716 - DNA, 13 bp, Homo sapiens
aaagcagtgtttt

SEQ ID NO: 5342717 - DNA, 14 bp, Homo sapiens
aaagcagttaattt

SEQ ID NO: 5342718 - DNA, 18 bp, Homo sapiens
aaagcagttcctgtccca

SEQ ID NO: 5342719 - DNA, 14 bp, Homo sapiens
aaagcagtttttaa

SEQ ID NO: 5342720 - DNA, 18 bp, Homo sapiens
aaagcataaaaacatttt

SEQ ID NO: 5342721 - DNA, 15 bp, Homo sapiens
aaagcataaaacttt

SEQ ID NO: 5342722 - DNA, 17 bp, Homo sapiens
aaagcatacatgcaaaa

SEQ ID NO: 5342723 - DNA, 21 bp, Homo sapiens
aaagcatatgggttagatgtt

SEQ ID NO: 5342724 - DNA, 19 bp, Homo sapiens
aaagcatattgtaccccct

SEQ ID NO: 5342725 - DNA, 22 bp, Homo sapiens
aaagcatcaccactcattttga

SEQ ID NO: 5342726 - DNA, 18 bp, Homo sapiens
aaagcatcacctcaggcc

SEQ ID NO: 5342727 - DNA, 18 bp, Homo sapiens
aaagcatcattgtaaatt

SEQ ID NO: 5342728 - DNA, 24 bp, Homo sapiens
aaagcatccctcacccatcctaga

SEQ ID NO: 5342729 - DNA, 16 bp, Homo sapiens
aaagcatccctgtgag

SEQ ID NO: 5342730 - DNA, 13 bp, Homo sapiens
aaagcatcctcct

SEQ ID NO: 5342731 - DNA, 21 bp, Homo sapiens
aaagcatcggtcatgtgtgta

SEQ ID NO: 5342732 - DNA, 18 bp, Homo sapiens
aaagcatgaaatgtgaat

SEQ ID NO: 5342733 - DNA, 13 bp, Homo sapiens
aaagcatgaattg

SEQ ID NO: 5342734 - DNA, 21 bp, Homo sapiens
aaagcatgaattggaactgca

SEQ ID NO: 5342735 - DNA, 18 bp, Homo sapiens
aaagcatgctcagtattg

SEQ ID NO: 5342736 - DNA, 18 bp, Homo sapiens
aaagcatggacatttaga

SEQ ID NO: 5342737 - DNA, 11 bp, Homo sapiens
aaagcatgtac

SEQ ID NO: 5342738 - DNA, 12 bp, Homo sapiens
aaagcatgtaca

SEQ ID NO: 5342739 - DNA, 14 bp, Homo sapiens
aaagcatgtacagt

SEQ ID NO: 5342740 - DNA, 22 bp, Homo sapiens
aaagcatgttcacccttatagt

SEQ ID NO: 5342741 - DNA, 16 bp, Homo sapiens
aaagcatgttttgcat

SEQ ID NO: 5342742 - DNA, 18 bp, Homo sapiens
aaagcattaacagcaggt

SEQ ID NO: 5342743 - DNA, 13 bp, Homo sapiens
aaagcattactct

SEQ ID NO: 5342744 - DNA, 15 bp, Homo sapiens
aaagcattgtaaatg

SEQ ID NO: 5342745 - DNA, 14 bp, Homo sapiens
aaagcattgtctct

SEQ ID NO: 5342746 - DNA, 23 bp, Homo sapiens
aaagcatttaacccccctgtaca

SEQ ID NO: 5342747 - DNA, 13 bp, Homo sapiens
aaatagttttcta

SEQ ID NO: 5342748 - DNA, 14 bp, Homo sapiens
aaatagttttgctt

SEQ ID NO: 5342749 - DNA, 12 bp, Homo sapiens
aaatataaaaat

SEQ ID NO: 5342750 - DNA, 17 bp, Homo sapiens
aaatataaaactgaaat

SEQ ID NO: 5342751 - DNA, 18 bp, Homo sapiens
aaatataaaactgaaata

SEQ ID NO: 5342752 - DNA, 14 bp, Homo sapiens
aaatataaaataca

SEQ ID NO: 5342753 - DNA, 13 bp, Homo sapiens
aaatataaaatat

SEQ ID NO: 5342754 - DNA, 13 bp, Homo sapiens
aaatataaaatta

SEQ ID NO: 5342755 - DNA, 18 bp, Homo sapiens
aaatataaacaatgttca

SEQ ID NO: 5342756 - DNA, 16 bp, Homo sapiens
aaatataaacagcaac

SEQ ID NO: 5342757 - DNA, 22 bp, Homo sapiens
aaatataaagcaagataataaa

SEQ ID NO: 5342758 - DNA, 18 bp, Homo sapiens
aaatataaagcatctaaa

SEQ ID NO: 5342759 - DNA, 20 bp, Homo sapiens
aaatataaagcatctaaact

SEQ ID NO: 5342760 - DNA, 15 bp, Homo sapiens
aaatataaatgaaaa

SEQ ID NO: 5342761 - DNA, 22 bp, Homo sapiens
aaatataaatgcatgattttat

SEQ ID NO: 5342762 - DNA, 20 bp, Homo sapiens
aaatataaattaagacttta

SEQ ID NO: 5342763 - DNA, 19 bp, Homo sapiens
aaatataaattgtacattt

SEQ ID NO: 5342764 - DNA, 14 bp, Homo sapiens
aaatataacacatt

SEQ ID NO: 5342765 - DNA, 17 bp, Homo sapiens
aaatataacacattttt

SEQ ID NO: 5342766 - DNA, 14 bp, Homo sapiens
aaatataacatgaa

SEQ ID NO: 5342767 - DNA, 17 bp, Homo sapiens
aaatataacatgaaagt

SEQ ID NO: 5342768 - DNA, 19 bp, Homo sapiens
aaatataaccattacatgt

SEQ ID NO: 5342769 - DNA, 20 bp, Homo sapiens
aaatataaccattacatgtt

SEQ ID NO: 5342770 - DNA, 14 bp, Homo sapiens
aaatataagaataa

SEQ ID NO: 5342771 - DNA, 22 bp, Homo sapiens
aaatataagccttttatactga

SEQ ID NO: 5342772 - DNA, 14 bp, Homo sapiens
aaatataatcagac

SEQ ID NO: 5342773 - DNA, 17 bp, Homo sapiens
aaatataattctgtaaa

SEQ ID NO: 5342774 - DNA, 20 bp, Homo sapiens
aaatataattgggattttaa

SEQ ID NO: 5342775 - DNA, 13 bp, Homo sapiens
aaatataattgta

SEQ ID NO: 5342776 - DNA, 15 bp, Homo sapiens
aaatatacaaaactt

SEQ ID NO: 5342777 - DNA, 14 bp, Homo sapiens
aaatatacaaacat

SEQ ID NO: 5342778 - DNA, 14 bp, Homo sapiens
aaatatacaacttt

SEQ ID NO: 5342779 - DNA, 13 bp, Homo sapiens
aaatatacagcat

SEQ ID NO: 5342780 - DNA, 16 bp, Homo sapiens
aaatatacagtttgac

SEQ ID NO: 5342781 - DNA, 13 bp, Homo sapiens
aaatatacatctg

SEQ ID NO: 5342782 - DNA, 14 bp, Homo sapiens
aaatatacatgttt

SEQ ID NO: 5342783 - DNA, 16 bp, Homo sapiens
aaatatacatgtttat

SEQ ID NO: 5342784 - DNA, 19 bp, Homo sapiens
aaatatacatgtttatgta

SEQ ID NO: 5342785 - DNA, 14 bp, Homo sapiens
aaatatacatttgt

SEQ ID NO: 5342786 - DNA, 16 bp, Homo sapiens
aaatatacattttcta

SEQ ID NO: 5342787 - DNA, 20 bp, Homo sapiens
aaatataccactctttacct

SEQ ID NO: 5342788 - DNA, 16 bp, Homo sapiens
aaatatactaataaaa

SEQ ID NO: 5342789 - DNA, 19 bp, Homo sapiens
aaatatactaataaaaagg

SEQ ID NO: 5342790 - DNA, 20 bp, Homo sapiens
aaatatactaataaaaaggt

SEQ ID NO: 5342791 - DNA, 21 bp, Homo sapiens
aaatatactaataaaaaggtt

SEQ ID NO: 5342792 - DNA, 21 bp, Homo sapiens
aaatatactcaagtttcaggt

SEQ ID NO: 5342793 - DNA, 16 bp, Homo sapiens
aaatatactcatttgg

SEQ ID NO: 5342794 - DNA, 17 bp, Homo sapiens
aaatatactctcccaga

SEQ ID NO: 5342795 - DNA, 22 bp, Homo sapiens
aaatatactgattttgaaaagt

SEQ ID NO: 5342796 - DNA, 13 bp, Homo sapiens
aaatatactgtaa

SEQ ID NO: 5342797 - DNA, 17 bp, Homo sapiens
aaatatactgtaaagaa

SEQ ID NO: 5342798 - DNA, 21 bp, Homo sapiens
aaatatactgtaaagaaagag

SEQ ID NO: 5342799 - DNA, 16 bp, Homo sapiens
aaatatacttgactct

SEQ ID NO: 5342800 - DNA, 19 bp, Homo sapiens
aaatatacttgactctaat

SEQ ID NO: 5342801 - DNA, 20 bp, Homo sapiens
aaatatacttgactctaata

SEQ ID NO: 5342802 - DNA, 24 bp, Homo sapiens
aaatatagaaagttgatattcaac

SEQ ID NO: 5342803 - DNA, 13 bp, Homo sapiens
aaatatagaattt

SEQ ID NO: 5342804 - DNA, 20 bp, Homo sapiens
aaatatagagatatttttgt

SEQ ID NO: 5342805 - DNA, 18 bp, Homo sapiens
aaatatagatcagttata

SEQ ID NO: 5342806 - DNA, 13 bp, Homo sapiens
aaatatagatgtt

SEQ ID NO: 5342807 - DNA, 17 bp, Homo sapiens
aaatatagattagaaaa

SEQ ID NO: 5342808 - DNA, 18 bp, Homo sapiens
aaatatagattagaaaaa

SEQ ID NO: 5342809 - DNA, 19 bp, Homo sapiens
aaatatagcaaatgcagaa

SEQ ID NO: 5342810 - DNA, 10 bp, Homo sapiens
aaatatagcg

SEQ ID NO: 5342811 - DNA, 17 bp, Homo sapiens
aaatatagctgtacaaa

SEQ ID NO: 5342812 - DNA, 21 bp, Homo sapiens
aaatatagctgtacaaatata

SEQ ID NO: 5342813 - DNA, 16 bp, Homo sapiens
aaatatagggtttttt

SEQ ID NO: 5342814 - DNA, 23 bp, Homo sapiens
aaatataggtttaatttcaaata

SEQ ID NO: 5342815 - DNA, 15 bp, Homo sapiens
aaatatagtgcaata

SEQ ID NO: 5342816 - DNA, 21 bp, Homo sapiens
aaatatagtgttgtgttacaa

SEQ ID NO: 5342817 - DNA, 18 bp, Homo sapiens
aaatatagttcctaagaa

SEQ ID NO: 5342818 - DNA, 16 bp, Homo sapiens
aaatatagttgaaagt

SEQ ID NO: 5342819 - DNA, 17 bp, Homo sapiens
aaatatagttgaaagta

SEQ ID NO: 5342820 - DNA, 16 bp, Homo sapiens
aaatatagttgtcttt

SEQ ID NO: 5342821 - DNA, 22 bp, Homo sapiens
aaatatagttgtctttctttgc

SEQ ID NO: 5342822 - DNA, 21 bp, Homo sapiens
aaatatataaaaagaaaagat

SEQ ID NO: 5342823 - DNA, 15 bp, Homo sapiens
aaatatataaacaaa

SEQ ID NO: 5342824 - DNA, 16 bp, Homo sapiens
aaatatataatggttt

SEQ ID NO: 5342825 - DNA, 18 bp, Homo sapiens
aaatatataatggtttac

SEQ ID NO: 5342826 - DNA, 23 bp, Homo sapiens
aaatatatacccccccatgcagt

SEQ ID NO: 5342827 - DNA, 16 bp, Homo sapiens
aaatatatactaaaca

SEQ ID NO: 5342828 - DNA, 24 bp, Homo sapiens
aaatatatagcttgaaagcagtta

SEQ ID NO: 5342829 - DNA, 21 bp, Homo sapiens
aaatatatataaagaatatat

SEQ ID NO: 5342830 - DNA, 14 bp, Homo sapiens
aaatatatatacat

SEQ ID NO: 5342831 - DNA, 22 bp, Homo sapiens
aaatatatatagatatgtatat

SEQ ID NO: 5342832 - DNA, 18 bp, Homo sapiens
aaatatatatagttagat

SEQ ID NO: 5342833 - DNA, 22 bp, Homo sapiens
aaatatatatagttagattcca

SEQ ID NO: 5342834 - DNA, 19 bp, Homo sapiens
aaatatatatataaaatat

SEQ ID NO: 5342835 - DNA, 14 bp, Homo sapiens
aaatatatatgtca

SEQ ID NO: 5342836 - DNA, 17 bp, Homo sapiens
aaatatatatgtcaata

SEQ ID NO: 5342837 - DNA, 17 bp, Homo sapiens
aaatatatatgttgatt

SEQ ID NO: 5342838 - DNA, 12 bp, Homo sapiens
aaatatatatta

SEQ ID NO: 5342839 - DNA, 18 bp, Homo sapiens
aaatatatattaaaattg

SEQ ID NO: 5342840 - DNA, 22 bp, Homo sapiens
aaatatatattatacttgtaat

SEQ ID NO: 5342841 - DNA, 23 bp, Homo sapiens
aaatatatattattctcatttag

SEQ ID NO: 5342842 - DNA, 21 bp, Homo sapiens
aaatatatattcacctagcaa

SEQ ID NO: 5342843 - DNA, 13 bp, Homo sapiens
aaatatatattgt

SEQ ID NO: 5342844 - DNA, 15 bp, Homo sapiens
aaatatatattgtaa

SEQ ID NO: 5342845 - DNA, 15 bp, Homo sapiens
aaatatatattttgt

SEQ ID NO: 5342846 - DNA, 22 bp, Homo sapiens
aaatatatatttttcaaccagc

SEQ ID NO: 5342847 - DNA, 21 bp, Homo sapiens
aaatatatctgtgattttaaa

SEQ ID NO: 5342848 - DNA, 16 bp, Homo sapiens
aaatatatctttgtaa

SEQ ID NO: 5342849 - DNA, 23 bp, Homo sapiens
aaatatatgattaactaatttta

SEQ ID NO: 5342850 - DNA, 14 bp, Homo sapiens
aaatatatgcttac

SEQ ID NO: 5342851 - DNA, 11 bp, Homo sapiens
aaatatatgta

SEQ ID NO: 5342852 - DNA, 17 bp, Homo sapiens
aaatatatgtaatatat

SEQ ID NO: 5342853 - DNA, 14 bp, Homo sapiens
aaatatatgtattt

SEQ ID NO: 5342854 - DNA, 16 bp, Homo sapiens
aaatatatgtatttaa

SEQ ID NO: 5342855 - DNA, 23 bp, Homo sapiens
aaatatatgttctgcaagaatta

SEQ ID NO: 5342856 - DNA, 17 bp, Homo sapiens
aaatatatgtttggctg

SEQ ID NO: 5342857 - DNA, 19 bp, Homo sapiens
aaatatatgtttggctgaa

SEQ ID NO: 5342858 - DNA, 19 bp, Homo sapiens
aaatatatgttttgagaaa

SEQ ID NO: 5342859 - DNA, 21 bp, Homo sapiens
aaatatatgttttgagaaaaa

SEQ ID NO: 5342860 - DNA, 19 bp, Homo sapiens
aaatatattacttaactgt

SEQ ID NO: 5342861 - DNA, 22 bp, Homo sapiens
aaatatattatatatggatgtg

SEQ ID NO: 5342862 - DNA, 21 bp, Homo sapiens
aaatatattattacttgtaaa

SEQ ID NO: 5342863 - DNA, 13 bp, Homo sapiens
aaatatattgctg

SEQ ID NO: 5342864 - DNA, 10 bp, Homo sapiens
aaatatattt

SEQ ID NO: 5342865 - DNA, 20 bp, Homo sapiens
aaatatatttaagataatta

SEQ ID NO: 5342866 - DNA, 15 bp, Homo sapiens
aaatatatttaatga

SEQ ID NO: 5342867 - DNA, 15 bp, Homo sapiens
aaatatatttgtcac

SEQ ID NO: 5342868 - DNA, 17 bp, Homo sapiens
aaatatattttatgatt

SEQ ID NO: 5342869 - DNA, 20 bp, Homo sapiens
aaatatatttttccctgttt

SEQ ID NO: 5342870 - DNA, 23 bp, Homo sapiens
aaatatatttttttcaactgcca

SEQ ID NO: 5342871 - DNA, 22 bp, Homo sapiens
aaatatcaaagtcattaaagac

SEQ ID NO: 5342872 - DNA, 12 bp, Homo sapiens
aaatatcaaatt

SEQ ID NO: 5342873 - DNA, 17 bp, Homo sapiens
aaatatcaatggtgctg

SEQ ID NO: 5342874 - DNA, 16 bp, Homo sapiens
aaatatcactttgtat

SEQ ID NO: 5342875 - DNA, 21 bp, Homo sapiens
aaatatcagtattctgacatg

SEQ ID NO: 5342876 - DNA, 20 bp, Homo sapiens
aaatatcagttactcagccc

SEQ ID NO: 5342877 - DNA, 21 bp, Homo sapiens
aaatatcatataaatattgag

SEQ ID NO: 5342878 - DNA, 15 bp, Homo sapiens
aaatatcatattaaa

SEQ ID NO: 5342879 - DNA, 15 bp, Homo sapiens
aaatatcattcagca

SEQ ID NO: 5342880 - DNA, 15 bp, Homo sapiens
aaatatcattctttg

SEQ ID NO: 5342881 - DNA, 18 bp, Homo sapiens
aaatatcatttatttttt

SEQ ID NO: 5342882 - DNA, 17 bp, Homo sapiens
aaatatccacagtactc

SEQ ID NO: 5342883 - DNA, 12 bp, Homo sapiens
aaatatccaggt

SEQ ID NO: 5342884 - DNA, 19 bp, Homo sapiens
aaatatccatttatctttt

SEQ ID NO: 5342885 - DNA, 13 bp, Homo sapiens
aaatatcccagag

SEQ ID NO: 5342886 - DNA, 17 bp, Homo sapiens
aaatatccctcatttca

SEQ ID NO: 5342887 - DNA, 22 bp, Homo sapiens
aaatatcccttggacattttat

SEQ ID NO: 5342888 - DNA, 19 bp, Homo sapiens
aaatatccctttttcacat

SEQ ID NO: 5342889 - DNA, 20 bp, Homo sapiens
aaatatcctaagactaacaa

SEQ ID NO: 5342890 - DNA, 23 bp, Homo sapiens
aaatatcctcaggggtggagaag

SEQ ID NO: 5342891 - DNA, 21 bp, Homo sapiens
aaatatcctccactttcagga

SEQ ID NO: 5342892 - DNA, 17 bp, Homo sapiens
aaatatccttgatgtac

SEQ ID NO: 5342893 - DNA, 18 bp, Homo sapiens
aaatatccttgatgtaca

SEQ ID NO: 5342894 - DNA, 19 bp, Homo sapiens
aaatatcctttcatcaatg

SEQ ID NO: 5342895 - DNA, 17 bp, Homo sapiens
aaatatcctttggaaca

SEQ ID NO: 5342896 - DNA, 20 bp, Homo sapiens
aaatatcgctgatgcagaca

SEQ ID NO: 5342897 - DNA, 21 bp, Homo sapiens
aaatatcgctgatgcagacac

SEQ ID NO: 5342898 - DNA, 15 bp, Homo sapiens
aaatatctatttatc

SEQ ID NO: 5342899 - DNA, 16 bp, Homo sapiens
aaatatctatttgaat

SEQ ID NO: 5342900 - DNA, 14 bp, Homo sapiens
aaatatctcctcca

SEQ ID NO: 5342901 - DNA, 12 bp, Homo sapiens
aaatatctgaaa

SEQ ID NO: 5342902 - DNA, 19 bp, Homo sapiens
aaatatctgaaaatgtatg

SEQ ID NO: 5342903 - DNA, 23 bp, Homo sapiens
aaatatctgagctctttgcacta

SEQ ID NO: 5342904 - DNA, 15 bp, Homo sapiens
aaatatctgtattta

SEQ ID NO: 5342905 - DNA, 12 bp, Homo sapiens
aaatatctgtga

SEQ ID NO: 5342906 - DNA, 15 bp, Homo sapiens
aaatatcttgaaagg

SEQ ID NO: 5342907 - DNA, 13 bp, Homo sapiens
aaatatctttctc

SEQ ID NO: 5342908 - DNA, 20 bp, Homo sapiens
aaatatcttttatgtttgaa

SEQ ID NO: 5342909 - DNA, 21 bp, Homo sapiens
aaatatcttttatgtttgaat

SEQ ID NO: 5342910 - DNA, 23 bp, Homo sapiens
aaatatcttttatgtttgaatat

SEQ ID NO: 5342911 - DNA, 16 bp, Homo sapiens
aaatatcttttgacct

SEQ ID NO: 5342912 - DNA, 17 bp, Homo sapiens
aaatatgaaaaatgtaa

SEQ ID NO: 5342913 - DNA, 22 bp, Homo sapiens
aaatatgaaaagtcattcagtt

SEQ ID NO: 5342914 - DNA, 13 bp, Homo sapiens
aaatatgaaattt

SEQ ID NO: 5342915 - DNA, 19 bp, Homo sapiens
aaatatgaaccctttgttt

SEQ ID NO: 5342916 - DNA, 13 bp, Homo sapiens
aaatatgaaccta

SEQ ID NO: 5342917 - DNA, 15 bp, Homo sapiens
aaatatgaagagttt

SEQ ID NO: 5342918 - DNA, 22 bp, Homo sapiens
aaatatgaagagtttttttctg

SEQ ID NO: 5342919 - DNA, 16 bp, Homo sapiens
aaatatgaatgaacaa

SEQ ID NO: 5342920 - DNA, 21 bp, Homo sapiens
aaatatgagtgggaaataaat

SEQ ID NO: 5342921 - DNA, 16 bp, Homo sapiens
aaatatgatatatatg

SEQ ID NO: 5342922 - DNA, 21 bp, Homo sapiens
aaatatgatgttaaaaaaata

SEQ ID NO: 5342923 - DNA, 21 bp, Homo sapiens
aaatatgattctcctctccca

SEQ ID NO: 5342924 - DNA, 17 bp, Homo sapiens
aaatccccccttcagaa

SEQ ID NO: 5342925 - DNA, 18 bp, Homo sapiens
aaatccccccttcagaac

SEQ ID NO: 5342926 - DNA, 21 bp, Homo sapiens
aaatcccctaactgatttcca

SEQ ID NO: 5342927 - DNA, 13 bp, Homo sapiens
aaatcccctcagc

SEQ ID NO: 5342928 - DNA, 19 bp, Homo sapiens
aaatccctcttcctccaaa

SEQ ID NO: 5342929 - DNA, 17 bp, Homo sapiens
aaatccctgcctcaggc

SEQ ID NO: 5342930 - DNA, 17 bp, Homo sapiens
aaatccctgtttaatat

SEQ ID NO: 5342931 - DNA, 22 bp, Homo sapiens
aaatccctttcatgtctttcca

SEQ ID NO: 5342932 - DNA, 13 bp, Homo sapiens
aaatccctttctg

SEQ ID NO: 5342933 - DNA, 19 bp, Homo sapiens
aaatccgaacctcctctgt

SEQ ID NO: 5342934 - DNA, 21 bp, Homo sapiens
aaatccgccagtgtttctgaa

SEQ ID NO: 5342935 - DNA, 19 bp, Homo sapiens
aaatcctaccaacctctga

SEQ ID NO: 5342936 - DNA, 20 bp, Homo sapiens
aaatcctatttaaagacctg

SEQ ID NO: 5342937 - DNA, 20 bp, Homo sapiens
aaatcctatttttgtagatc

SEQ ID NO: 5342938 - DNA, 11 bp, Homo sapiens
aaatcctcagc

SEQ ID NO: 5342939 - DNA, 11 bp, Homo sapiens
aaatcctctgg

SEQ ID NO: 5342940 - DNA, 14 bp, Homo sapiens
aaatcctcttcctc

SEQ ID NO: 5342941 - DNA, 18 bp, Homo sapiens
aaatcctcttcctctgag

SEQ ID NO: 5342942 - DNA, 18 bp, Homo sapiens
aaatcctcttctaactca

SEQ ID NO: 5342943 - DNA, 13 bp, Homo sapiens
aaatcctgaataa

SEQ ID NO: 5342944 - DNA, 12 bp, Homo sapiens
aaatcctggaag

SEQ ID NO: 5342945 - DNA, 18 bp, Homo sapiens
aaatcctggcaagtgacc

SEQ ID NO: 5342946 - DNA, 23 bp, Homo sapiens
aaatcctgggcatccccagcccc

SEQ ID NO: 5342947 - DNA, 16 bp, Homo sapiens
aaatccttaacatttc

SEQ ID NO: 5342948 - DNA, 16 bp, Homo sapiens
aaatccttattgttca

SEQ ID NO: 5342949 - DNA, 16 bp, Homo sapiens
aaatccttccatgaaa

SEQ ID NO: 5342950 - DNA, 21 bp, Homo sapiens
aaatccttcgtcctaacataa

SEQ ID NO: 5342951 - DNA, 15 bp, Homo sapiens
aaatcctttgtgaaa

SEQ ID NO: 5342952 - DNA, 17 bp, Homo sapiens
aaatccttttacctttt

SEQ ID NO: 5342953 - DNA, 18 bp, Homo sapiens
aaatcctttttctttata

SEQ ID NO: 5342954 - DNA, 19 bp, Homo sapiens
aaatcctttttctttataa

SEQ ID NO: 5342955 - DNA, 17 bp, Homo sapiens
aaatcgatccatgtttt

SEQ ID NO: 5342956 - DNA, 22 bp, Homo sapiens
aaatcgccttatgagaacatgg

SEQ ID NO: 5342957 - DNA, 16 bp, Homo sapiens
aaatcgcttatatgtc

SEQ ID NO: 5342958 - DNA, 22 bp, Homo sapiens
aaatcggatctggggctctggg

SEQ ID NO: 5342959 - DNA, 20 bp, Homo sapiens
aaatcgggaaggatgggaaa

SEQ ID NO: 5342960 - DNA, 15 bp, Homo sapiens
aaatcgttggaaaat

SEQ ID NO: 5342961 - DNA, 19 bp, Homo sapiens
aaatcgtttaatgtttata

SEQ ID NO: 5342962 - DNA, 20 bp, Homo sapiens
aaatctaaaaattgaactac

SEQ ID NO: 5342963 - DNA, 23 bp, Homo sapiens
aaatctaaaacaaaatctgaact

SEQ ID NO: 5342964 - DNA, 15 bp, Homo sapiens
aaatctaaaatgttt

SEQ ID NO: 5342965 - DNA, 17 bp, Homo sapiens
aaatctaaaatttcata

SEQ ID NO: 5342966 - DNA, 12 bp, Homo sapiens
aaatctaaacaa

SEQ ID NO: 5342967 - DNA, 15 bp, Homo sapiens
aaatctaaatctatt

SEQ ID NO: 5342968 - DNA, 17 bp, Homo sapiens
aaatctaaatctattta

SEQ ID NO: 5342969 - DNA, 20 bp, Homo sapiens
aaatctaaatctatttatta

SEQ ID NO: 5342970 - DNA, 19 bp, Homo sapiens
aaatctaaatgattatctt

SEQ ID NO: 5342971 - DNA, 20 bp, Homo sapiens
aaatctaaatttcttttgct

SEQ ID NO: 5342972 - DNA, 15 bp, Homo sapiens
aaatctaacattatt

SEQ ID NO: 5342973 - DNA, 14 bp, Homo sapiens
aaatctaagggaaa

SEQ ID NO: 5342974 - DNA, 19 bp, Homo sapiens
aaatctaatatttctagta

SEQ ID NO: 5342975 - DNA, 17 bp, Homo sapiens
aaatctaatctcttatt

SEQ ID NO: 5342976 - DNA, 21 bp, Homo sapiens
aaatctacaaacttttataaa

SEQ ID NO: 5342977 - DNA, 19 bp, Homo sapiens
aaatctacactccagtgag

SEQ ID NO: 5342978 - DNA, 17 bp, Homo sapiens
aaatctacagatccttt

SEQ ID NO: 5342979 - DNA, 14 bp, Homo sapiens
aaatctacaggcct

SEQ ID NO: 5342980 - DNA, 21 bp, Homo sapiens
aaatctacaggcctcagggtg

SEQ ID NO: 5342981 - DNA, 14 bp, Homo sapiens
aaatctacagtaca

SEQ ID NO: 5342982 - DNA, 17 bp, Homo sapiens
aaatctaccactgtatg

SEQ ID NO: 5342983 - DNA, 15 bp, Homo sapiens
aaatctaccttctgt

SEQ ID NO: 5342984 - DNA, 14 bp, Homo sapiens
aaatctagaattta

SEQ ID NO: 5342985 - DNA, 19 bp, Homo sapiens
aaatctagacatagatcct

SEQ ID NO: 5342986 - DNA, 15 bp, Homo sapiens
aaatctagacattct

SEQ ID NO: 5342987 - DNA, 16 bp, Homo sapiens
aaatctagacattctt

SEQ ID NO: 5342988 - DNA, 13 bp, Homo sapiens
aaatctagagttt

SEQ ID NO: 5342989 - DNA, 16 bp, Homo sapiens
aaatctagatcaatta

SEQ ID NO: 5342990 - DNA, 20 bp, Homo sapiens
aaatctaggaaaatattttg

SEQ ID NO: 5342991 - DNA, 17 bp, Homo sapiens
aaatctaggaaaattat

SEQ ID NO: 5342992 - DNA, 14 bp, Homo sapiens
aaatctagtatttg

SEQ ID NO: 5342993 - DNA, 21 bp, Homo sapiens
aaatctagttttttttgtaaa

SEQ ID NO: 5342994 - DNA, 21 bp, Homo sapiens
aaatctataaagaaggataaa

SEQ ID NO: 5342995 - DNA, 14 bp, Homo sapiens
aaatctataaatat

SEQ ID NO: 5342996 - DNA, 18 bp, Homo sapiens
aaatctatattaaagtgt

SEQ ID NO: 5342997 - DNA, 19 bp, Homo sapiens
aaatctatattaaagtgtt

SEQ ID NO: 5342998 - DNA, 14 bp, Homo sapiens
aaatctatctctat

SEQ ID NO: 5342999 - DNA, 15 bp, Homo sapiens
aaatctatgatatat

SEQ ID NO: 5343000 - DNA, 14 bp, Homo sapiens
aaatctatgattcc

SEQ ID NO: 5343001 - DNA, 13 bp, Homo sapiens
aaatctatgccac

SEQ ID NO: 5343002 - DNA, 20 bp, Homo sapiens
aaatctatgccactcagaat

SEQ ID NO: 5343003 - DNA, 17 bp, Homo sapiens
aaatctattacttttgc

SEQ ID NO: 5343004 - DNA, 15 bp, Homo sapiens
aaatctattctgtgt

SEQ ID NO: 5343005 - DNA, 20 bp, Homo sapiens
aaatctattgggttaatttc

SEQ ID NO: 5343006 - DNA, 19 bp, Homo sapiens
aaatctatttattaatatt

SEQ ID NO: 5343007 - DNA, 16 bp, Homo sapiens
aaatctcaaatttcta

SEQ ID NO: 5343008 - DNA, 17 bp, Homo sapiens
aaatctcaccccatccc

SEQ ID NO: 5343009 - DNA, 14 bp, Homo sapiens
aaatctcactgtat

SEQ ID NO: 5343010 - DNA, 22 bp, Homo sapiens
aaatctcagaattccttttcta

SEQ ID NO: 5343011 - DNA, 15 bp, Homo sapiens
aaatctcagttgttt

SEQ ID NO: 5343012 - DNA, 11 bp, Homo sapiens
aaatctcatac

SEQ ID NO: 5343013 - DNA, 23 bp, Homo sapiens
aaatctcatactcccccacagtt

SEQ ID NO: 5343014 - DNA, 14 bp, Homo sapiens
aaatctcatcccta

SEQ ID NO: 5343015 - DNA, 22 bp, Homo sapiens
aaatctcatctctacaaaaagt

SEQ ID NO: 5343016 - DNA, 15 bp, Homo sapiens
aaatctcattatttc

SEQ ID NO: 5343017 - DNA, 19 bp, Homo sapiens
aaatctcattatttcaaaa

SEQ ID NO: 5343018 - DNA, 12 bp, Homo sapiens
aaatctcattcc

SEQ ID NO: 5343019 - DNA, 22 bp, Homo sapiens
aaatctccaaaataaaactttt

SEQ ID NO: 5343020 - DNA, 18 bp, Homo sapiens
aaatctcccacaagtata

SEQ ID NO: 5343021 - DNA, 21 bp, Homo sapiens
aaatctcccattttggaattt

SEQ ID NO: 5343022 - DNA, 17 bp, Homo sapiens
aaatctcctcttttgta

SEQ ID NO: 5343023 - DNA, 15 bp, Homo sapiens
aaatctcctgtggag

SEQ ID NO: 5343024 - DNA, 12 bp, Homo sapiens
aaatctctaata

SEQ ID NO: 5343025 - DNA, 15 bp, Homo sapiens
aaatctctagcctct

SEQ ID NO: 5343026 - DNA, 21 bp, Homo sapiens
aaatctctccactttcagctg

SEQ ID NO: 5343027 - DNA, 15 bp, Homo sapiens
aaatctcttaaactc

SEQ ID NO: 5343028 - DNA, 17 bp, Homo sapiens
aaatctcttaaactctc

SEQ ID NO: 5343029 - DNA, 21 bp, Homo sapiens
aaatctcttgattataaatgt

SEQ ID NO: 5343030 - DNA, 13 bp, Homo sapiens
aaatctgaacatt

SEQ ID NO: 5343031 - DNA, 16 bp, Homo sapiens
aaatctgaacattctc

SEQ ID NO: 5343032 - DNA, 15 bp, Homo sapiens
aaatctgaactctca

SEQ ID NO: 5343033 - DNA, 13 bp, Homo sapiens
aaatctgaagaaa

SEQ ID NO: 5343034 - DNA, 13 bp, Homo sapiens
aaatctgaagacc

SEQ ID NO: 5343035 - DNA, 17 bp, Homo sapiens
aaatctgaagattgttt

SEQ ID NO: 5343036 - DNA, 18 bp, Homo sapiens
aaatctgaagattgttta

SEQ ID NO: 5343037 - DNA, 21 bp, Homo sapiens
aaatctgaagattgtttatct

SEQ ID NO: 5343038 - DNA, 16 bp, Homo sapiens
aaatctgaatttctaa

SEQ ID NO: 5343039 - DNA, 14 bp, Homo sapiens
aaatctgaatttta

SEQ ID NO: 5343040 - DNA, 21 bp, Homo sapiens
aaatctgaattttgcaatgta

SEQ ID NO: 5343041 - DNA, 22 bp, Homo sapiens
aaatctgaattttgcaatgtat

SEQ ID NO: 5343042 - DNA, 18 bp, Homo sapiens
aaatctgacataaaaaca

SEQ ID NO: 5343043 - DNA, 14 bp, Homo sapiens
aaatctgacccagt

SEQ ID NO: 5343044 - DNA, 17 bp, Homo sapiens
aaatctgacctaaaagt

SEQ ID NO: 5343045 - DNA, 13 bp, Homo sapiens
aaatctgactttt

SEQ ID NO: 5343046 - DNA, 20 bp, Homo sapiens
aaatctgactttttctgtgc

SEQ ID NO: 5343047 - DNA, 15 bp, Homo sapiens
aaatctgagaggtaa

SEQ ID NO: 5343048 - DNA, 20 bp, Homo sapiens
aaatctgagcctaaatctaa

SEQ ID NO: 5343049 - DNA, 22 bp, Homo sapiens
aaatctgatttaatgttttctg

SEQ ID NO: 5343050 - DNA, 19 bp, Homo sapiens
aaatctgccacaaaaacag

SEQ ID NO: 5343051 - DNA, 16 bp, Homo sapiens
aaatctgcctatgtca

SEQ ID NO: 5343052 - DNA, 13 bp, Homo sapiens
aaatctgcctggg

SEQ ID NO: 5343053 - DNA, 17 bp, Homo sapiens
aaatctgctagaaagtt

SEQ ID NO: 5343054 - DNA, 22 bp, Homo sapiens
aaatctgctgatctctgtagaa

SEQ ID NO: 5343055 - DNA, 20 bp, Homo sapiens
aaatctgctttagtttcaca

SEQ ID NO: 5343056 - DNA, 22 bp, Homo sapiens
aaatctgctttagtttcacatt

SEQ ID NO: 5343057 - DNA, 13 bp, Homo sapiens
aaatctgctttca

SEQ ID NO: 5343058 - DNA, 16 bp, Homo sapiens
aaatctggaaatctgt

SEQ ID NO: 5343059 - DNA, 22 bp, Homo sapiens
aaatctggctgtccttccattt

SEQ ID NO: 5343060 - DNA, 18 bp, Homo sapiens
aaatctggcttctggcca

SEQ ID NO: 5343061 - DNA, 21 bp, Homo sapiens
aaatctggcttctggccagga

SEQ ID NO: 5343062 - DNA, 19 bp, Homo sapiens
aaatctgggtatctttcca

SEQ ID NO: 5343063 - DNA, 17 bp, Homo sapiens
aaatctgtaaagccagt

SEQ ID NO: 5343064 - DNA, 23 bp, Homo sapiens
aaatctgtaacaggtattttgtt

SEQ ID NO: 5343065 - DNA, 23 bp, Homo sapiens
aaatctgtaagctctttgaaaca

SEQ ID NO: 5343066 - DNA, 20 bp, Homo sapiens
aaatctgtacttttttcaaa

SEQ ID NO: 5343067 - DNA, 15 bp, Homo sapiens
aaatctgtataaatg

SEQ ID NO: 5343068 - DNA, 17 bp, Homo sapiens
aaatctgtataaatgtc

SEQ ID NO: 5343069 - DNA, 18 bp, Homo sapiens
aaatctgtataaatgtga

SEQ ID NO: 5343070 - DNA, 22 bp, Homo sapiens
aaatctgtatatgttgtaataa

SEQ ID NO: 5343071 - DNA, 19 bp, Homo sapiens
aaatctgtattctgtttgc

SEQ ID NO: 5343072 - DNA, 16 bp, Homo sapiens
aaatctgtcaagagta

SEQ ID NO: 5343073 - DNA, 20 bp, Homo sapiens
aaatctgtcaagagtagtta

SEQ ID NO: 5343074 - DNA, 18 bp, Homo sapiens
aaatctgtcataagcatt

SEQ ID NO: 5343075 - DNA, 20 bp, Homo sapiens
aaatctgtcataagcattac

SEQ ID NO: 5343076 - DNA, 16 bp, Homo sapiens
aaatctgtcctctgta

SEQ ID NO: 5343077 - DNA, 19 bp, Homo sapiens
aaatctgtcctctgtagta

SEQ ID NO: 5343078 - DNA, 11 bp, Homo sapiens
aaatctgtcta

SEQ ID NO: 5343079 - DNA, 22 bp, Homo sapiens
aaatctgtctagaatcctgctt

SEQ ID NO: 5343080 - DNA, 15 bp, Homo sapiens
aaatctgtctcccca

SEQ ID NO: 5343081 - DNA, 18 bp, Homo sapiens
aaatctgtgaacttgaaa

SEQ ID NO: 5343082 - DNA, 21 bp, Homo sapiens
aaatctgtgaacttgaaattt

SEQ ID NO: 5343083 - DNA, 15 bp, Homo sapiens
aaatctgtgaattaa

SEQ ID NO: 5343084 - DNA, 20 bp, Homo sapiens
aaatctgtgaattaaaaaag

SEQ ID NO: 5343085 - DNA, 23 bp, Homo sapiens
aaatctgtgatgatcctcatatg

SEQ ID NO: 5343086 - DNA, 20 bp, Homo sapiens
aaatctgtgtatattatttg

SEQ ID NO: 5343087 - DNA, 21 bp, Homo sapiens
aaatctgttagcattattgcc

SEQ ID NO: 5343088 - DNA, 15 bp, Homo sapiens
aaatctgttctaaca

SEQ ID NO: 5343089 - DNA, 14 bp, Homo sapiens
aaatcttaaaaagt

SEQ ID NO: 5343090 - DNA, 15 bp, Homo sapiens
aaatcttaaacaatg

SEQ ID NO: 5343091 - DNA, 16 bp, Homo sapiens
aaatcttaaacaatgt

SEQ ID NO: 5343092 - DNA, 21 bp, Homo sapiens
aaatcttaaacaatgtataaa

SEQ ID NO: 5343093 - DNA, 22 bp, Homo sapiens
aaatcttaaccttcaaatacat

SEQ ID NO: 5343094 - DNA, 16 bp, Homo sapiens
aaatcttaagaaataa

SEQ ID NO: 5343095 - DNA, 14 bp, Homo sapiens
aaatcttaagtcat

SEQ ID NO: 5343096 - DNA, 13 bp, Homo sapiens
aaatcttaatgtt

SEQ ID NO: 5343097 - DNA, 18 bp, Homo sapiens
aaatcttacaaaatcctg

SEQ ID NO: 5343098 - DNA, 19 bp, Homo sapiens
aaatcttacccttcaatgt

SEQ ID NO: 5343099 - DNA, 20 bp, Homo sapiens
aaatcttacccttcaatgtt

SEQ ID NO: 5343100 - DNA, 21 bp, Homo sapiens
aaatcttattaaagtttcaaa

SEQ ID NO: 5343101 - DNA, 21 bp, Homo sapiens
aaatgccttttcccaaaatgt

SEQ ID NO: 5343102 - DNA, 18 bp, Homo sapiens
aaatgcgaaattattggt

SEQ ID NO: 5343103 - DNA, 23 bp, Homo sapiens
aaatgcgcacgacctacattaat

SEQ ID NO: 5343104 - DNA, 14 bp, Homo sapiens
aaatgcgctcttta

SEQ ID NO: 5343105 - DNA, 16 bp, Homo sapiens
aaatgcggggtggggg

SEQ ID NO: 5343106 - DNA, 16 bp, Homo sapiens
aaatgcggtctggtct

SEQ ID NO: 5343107 - DNA, 20 bp, Homo sapiens
aaatgcggtctggtctcgcc

SEQ ID NO: 5343108 - DNA, 22 bp, Homo sapiens
aaatgcggttataaaaaatggt

SEQ ID NO: 5343109 - DNA, 16 bp, Homo sapiens
aaatgcgtatttgcat

SEQ ID NO: 5343110 - DNA, 14 bp, Homo sapiens
aaatgctaaacttg

SEQ ID NO: 5343111 - DNA, 15 bp, Homo sapiens
aaatgctaaacttgg

SEQ ID NO: 5343112 - DNA, 13 bp, Homo sapiens
aaatgctagaagc

SEQ ID NO: 5343113 - DNA, 24 bp, Homo sapiens
aaatgctagaagctgtctaggtcc

SEQ ID NO: 5343114 - DNA, 16 bp, Homo sapiens
aaatgctaggttctac

SEQ ID NO: 5343115 - DNA, 18 bp, Homo sapiens
aaatgctatggaaataca

SEQ ID NO: 5343116 - DNA, 19 bp, Homo sapiens
aaatgctatggaaatacat

SEQ ID NO: 5343117 - DNA, 20 bp, Homo sapiens
aaatgctatggaaatacatt

SEQ ID NO: 5343118 - DNA, 21 bp, Homo sapiens
aaatgctatggaaatacattt

SEQ ID NO: 5343119 - DNA, 22 bp, Homo sapiens
aaatgctatggaaatacattta

SEQ ID NO: 5343120 - DNA, 16 bp, Homo sapiens
aaatgctatgtcattt

SEQ ID NO: 5343121 - DNA, 19 bp, Homo sapiens
aaatgctatgtcatttcat

SEQ ID NO: 5343122 - DNA, 20 bp, Homo sapiens
aaatgctatgtcatttcatg

SEQ ID NO: 5343123 - DNA, 22 bp, Homo sapiens
aaatgctatgtcatttcatgtc

SEQ ID NO: 5343124 - DNA, 21 bp, Homo sapiens
aaatgctattttaaaattcat

SEQ ID NO: 5343125 - DNA, 22 bp, Homo sapiens
aaatgctcataaagatgttaaa

SEQ ID NO: 5343126 - DNA, 24 bp, Homo sapiens
aaatgctcataaagatgttaaatg

SEQ ID NO: 5343127 - DNA, 18 bp, Homo sapiens
aaatgctcattttcttta

SEQ ID NO: 5343128 - DNA, 13 bp, Homo sapiens
aaatgctccagca

SEQ ID NO: 5343129 - DNA, 20 bp, Homo sapiens
aaatgctcccacctgaattt

SEQ ID NO: 5343130 - DNA, 19 bp, Homo sapiens
aaatgctcgtgtgatttcc

SEQ ID NO: 5343131 - DNA, 13 bp, Homo sapiens
aaatgctctctca

SEQ ID NO: 5343132 - DNA, 22 bp, Homo sapiens
aaatgctctctcaaattgtcag

SEQ ID NO: 5343133 - DNA, 18 bp, Homo sapiens
aaatgctctctcttctta

SEQ ID NO: 5343134 - DNA, 17 bp, Homo sapiens
aaatgctctgtcttcaa

SEQ ID NO: 5343135 - DNA, 14 bp, Homo sapiens
aaatgctcttttgc

SEQ ID NO: 5343136 - DNA, 21 bp, Homo sapiens
aaatgctcttttgcacaagga

SEQ ID NO: 5343137 - DNA, 18 bp, Homo sapiens
aaatgctgaaataaaatg

SEQ ID NO: 5343138 - DNA, 15 bp, Homo sapiens
aaatgctgaacattg

SEQ ID NO: 5343139 - DNA, 17 bp, Homo sapiens
aaatgctgaatgaatcc

SEQ ID NO: 5343140 - DNA, 21 bp, Homo sapiens
aaatgctgatttaaacttctt

SEQ ID NO: 5343141 - DNA, 14 bp, Homo sapiens
aaatgctgcctgcc

SEQ ID NO: 5343142 - DNA, 13 bp, Homo sapiens
aaatgctgctctc

SEQ ID NO: 5343143 - DNA, 21 bp, Homo sapiens
aaatgctgcttccactcaggg

SEQ ID NO: 5343144 - DNA, 14 bp, Homo sapiens
aaatgctgcttctc

SEQ ID NO: 5343145 - DNA, 13 bp, Homo sapiens
aaatgctgctttg

SEQ ID NO: 5343146 - DNA, 14 bp, Homo sapiens
aaatgctgctttgg

SEQ ID NO: 5343147 - DNA, 23 bp, Homo sapiens
aaatgctgctttttctcaaaatg

SEQ ID NO: 5343148 - DNA, 24 bp, Homo sapiens
aaatgctggatgagcaactcctgt

SEQ ID NO: 5343149 - DNA, 23 bp, Homo sapiens
aaatgctggctatagatgtcttt

SEQ ID NO: 5343150 - DNA, 19 bp, Homo sapiens
aaatgctgtaaatatttca

SEQ ID NO: 5343151 - DNA, 21 bp, Homo sapiens
aaatgctgtaaatatttcata

SEQ ID NO: 5343152 - DNA, 19 bp, Homo sapiens
aaatgctgtaactttctga

SEQ ID NO: 5343153 - DNA, 22 bp, Homo sapiens
aaatgctgtctttcttgctccc

SEQ ID NO: 5343154 - DNA, 14 bp, Homo sapiens
aaatgctgtgcaaa

SEQ ID NO: 5343155 - DNA, 16 bp, Homo sapiens
aaatgctgtgttgggt

SEQ ID NO: 5343156 - DNA, 14 bp, Homo sapiens
aaatgctgttctca

SEQ ID NO: 5343157 - DNA, 15 bp, Homo sapiens
aaatgcttaaaacaa

SEQ ID NO: 5343158 - DNA, 16 bp, Homo sapiens
aaatgcttaaatttca

SEQ ID NO: 5343159 - DNA, 19 bp, Homo sapiens
aaatgcttagaaattcagc

SEQ ID NO: 5343160 - DNA, 13 bp, Homo sapiens
aaatgcttatttt

SEQ ID NO: 5343161 - DNA, 18 bp, Homo sapiens
aaatgcttcactgtacgt

SEQ ID NO: 5343162 - DNA, 16 bp, Homo sapiens
aaatgcttcatttgta

SEQ ID NO: 5343163 - DNA, 11 bp, Homo sapiens
aaatgcttcta

SEQ ID NO: 5343164 - DNA, 19 bp, Homo sapiens
aaatgcttgaccctgaaat

SEQ ID NO: 5343165 - DNA, 21 bp, Homo sapiens
aaatgctttaaaaactattta

SEQ ID NO: 5343166 - DNA, 22 bp, Homo sapiens
aaatgctttaaaaactatttaa

SEQ ID NO: 5343167 - DNA, 19 bp, Homo sapiens
aaatgctttaaaaattaat

SEQ ID NO: 5343168 - DNA, 18 bp, Homo sapiens
aaatgctttatgcaaacc

SEQ ID NO: 5343169 - DNA, 13 bp, Homo sapiens
aaatgctttctca

SEQ ID NO: 5343170 - DNA, 13 bp, Homo sapiens
aaatgcttttaaa

SEQ ID NO: 5343171 - DNA, 20 bp, Homo sapiens
aaatgcttttaaatgctctc

SEQ ID NO: 5343172 - DNA, 17 bp, Homo sapiens
aaatggaaaatatacaa

SEQ ID NO: 5343173 - DNA, 14 bp, Homo sapiens
aaatggaaaatgta

SEQ ID NO: 5343174 - DNA, 20 bp, Homo sapiens
aaatggaaaattaattctaa

SEQ ID NO: 5343175 - DNA, 13 bp, Homo sapiens
aaatggaaagaag

SEQ ID NO: 5343176 - DNA, 18 bp, Homo sapiens
aaatggaaagaaggaaaa

SEQ ID NO: 5343177 - DNA, 20 bp, Homo sapiens
aaatggaaagtaactcattt

SEQ ID NO: 5343178 - DNA, 15 bp, Homo sapiens
aaatggaacattaac

SEQ ID NO: 5343179 - DNA, 19 bp, Homo sapiens
aaatggaagagaagagaaa

SEQ ID NO: 5343180 - DNA, 19 bp, Homo sapiens
aaatggaagcaaagacaaa

SEQ ID NO: 5343181 - DNA, 14 bp, Homo sapiens
aaatggaataacat

SEQ ID NO: 5343182 - DNA, 20 bp, Homo sapiens
aaatggaataacatatcaaa

SEQ ID NO: 5343183 - DNA, 17 bp, Homo sapiens
aaatggaatactcttat

SEQ ID NO: 5343184 - DNA, 17 bp, Homo sapiens
aaatggaatcaggtaga

SEQ ID NO: 5343185 - DNA, 22 bp, Homo sapiens
aaatggaatgtgcccctggccc

SEQ ID NO: 5343186 - DNA, 16 bp, Homo sapiens
aaatggaattactcca

SEQ ID NO: 5343187 - DNA, 16 bp, Homo sapiens
aaatggaattattttg

SEQ ID NO: 5343188 - DNA, 22 bp, Homo sapiens
aaatggaattgaaaaactcttt

SEQ ID NO: 5343189 - DNA, 22 bp, Homo sapiens
aaatggaattgcttctgtgtag

SEQ ID NO: 5343190 - DNA, 20 bp, Homo sapiens
aaatggacacaaattttcaa

SEQ ID NO: 5343191 - DNA, 16 bp, Homo sapiens
aaatggacactgtgcc

SEQ ID NO: 5343192 - DNA, 19 bp, Homo sapiens
aaatggacataggactcaa

SEQ ID NO: 5343193 - DNA, 14 bp, Homo sapiens
aaatggacattttc

SEQ ID NO: 5343194 - DNA, 15 bp, Homo sapiens
aaatggacgtgttat

SEQ ID NO: 5343195 - DNA, 22 bp, Homo sapiens
aaatggacgtgttatgactcca

SEQ ID NO: 5343196 - DNA, 19 bp, Homo sapiens
aaatggactggtttgagat

SEQ ID NO: 5343197 - DNA, 19 bp, Homo sapiens
aaatggactgtggtgactt

SEQ ID NO: 5343198 - DNA, 21 bp, Homo sapiens
aaatggactgtggtgactttg

SEQ ID NO: 5343199 - DNA, 17 bp, Homo sapiens
aaatggactgttacaga

SEQ ID NO: 5343200 - DNA, 23 bp, Homo sapiens
aaatggagaaacaggcccagaga

SEQ ID NO: 5343201 - DNA, 15 bp, Homo sapiens
aaatggagaagctct

SEQ ID NO: 5343202 - DNA, 17 bp, Homo sapiens
aaatggagaagctgcag

SEQ ID NO: 5343203 - DNA, 21 bp, Homo sapiens
aaatggagatttggaattgaa

SEQ ID NO: 5343204 - DNA, 18 bp, Homo sapiens
aaatggaggaaaccacaa

SEQ ID NO: 5343205 - DNA, 14 bp, Homo sapiens
aaatggagttggag

SEQ ID NO: 5343206 - DNA, 23 bp, Homo sapiens
aaatggagttggagttcattcat

SEQ ID NO: 5343207 - DNA, 14 bp, Homo sapiens
aaatggatatagaa

SEQ ID NO: 5343208 - DNA, 17 bp, Homo sapiens
aaatggatgccttgaat

SEQ ID NO: 5343209 - DNA, 21 bp, Homo sapiens
aaatggatgccttgaataata

SEQ ID NO: 5343210 - DNA, 19 bp, Homo sapiens
aaatggattaattactaat

SEQ ID NO: 5343211 - DNA, 14 bp, Homo sapiens
aaatggattcagta

SEQ ID NO: 5343212 - DNA, 12 bp, Homo sapiens
aaatggcaagag

SEQ ID NO: 5343213 - DNA, 15 bp, Homo sapiens
aaatggcaagagatc

SEQ ID NO: 5343214 - DNA, 17 bp, Homo sapiens
aaatggcacctgtatac

SEQ ID NO: 5343215 - DNA, 12 bp, Homo sapiens
aaatggcacctt

SEQ ID NO: 5343216 - DNA, 16 bp, Homo sapiens
aaatggcagtatttca

SEQ ID NO: 5343217 - DNA, 22 bp, Homo sapiens
aaatggcattgacagctgctct

SEQ ID NO: 5343218 - DNA, 18 bp, Homo sapiens
aaatggcattgggctgag

SEQ ID NO: 5343219 - DNA, 16 bp, Homo sapiens
aaatggcatttagcac

SEQ ID NO: 5343220 - DNA, 21 bp, Homo sapiens
aaatggcatttagcacagtat

SEQ ID NO: 5343221 - DNA, 14 bp, Homo sapiens
aaatggcatttttt

SEQ ID NO: 5343222 - DNA, 17 bp, Homo sapiens
aaatggccagtgctgct

SEQ ID NO: 5343223 - DNA, 17 bp, Homo sapiens
aaatggcccggacatgt

SEQ ID NO: 5343224 - DNA, 21 bp, Homo sapiens
aaatggcctgtccctagggct

SEQ ID NO: 5343225 - DNA, 11 bp, Homo sapiens
aaatggccttc

SEQ ID NO: 5343226 - DNA, 14 bp, Homo sapiens
aaatggcgtctgct

SEQ ID NO: 5343227 - DNA, 19 bp, Homo sapiens
aaatggctaactgatgaat

SEQ ID NO: 5343228 - DNA, 18 bp, Homo sapiens
aaatggctcaagtagaaa

SEQ ID NO: 5343229 - DNA, 16 bp, Homo sapiens
aaatggctcagatgcc

SEQ ID NO: 5343230 - DNA, 17 bp, Homo sapiens
aaatggctgaagaaaca

SEQ ID NO: 5343231 - DNA, 20 bp, Homo sapiens
aaatggctgaagaaacacag

SEQ ID NO: 5343232 - DNA, 22 bp, Homo sapiens
aaatggctgaagaaacacagca

SEQ ID NO: 5343233 - DNA, 22 bp, Homo sapiens
aaatggctggggccgctggggt

SEQ ID NO: 5343234 - DNA, 15 bp, Homo sapiens
aaatggctttctcag

SEQ ID NO: 5343235 - DNA, 13 bp, Homo sapiens
aaatgggaaaaaa

SEQ ID NO: 5343236 - DNA, 18 bp, Homo sapiens
aaatgggaaaaaaacaaa

SEQ ID NO: 5343237 - DNA, 21 bp, Homo sapiens
aaatgggaaaaaacttaaaaa

SEQ ID NO: 5343238 - DNA, 20 bp, Homo sapiens
aaatgggactctgaactgga

SEQ ID NO: 5343239 - DNA, 22 bp, Homo sapiens
aaatgggacttcttttcacatt

SEQ ID NO: 5343240 - DNA, 16 bp, Homo sapiens
aaatgggagcaacata

SEQ ID NO: 5343241 - DNA, 18 bp, Homo sapiens
aaatgggaggaggaaaga

SEQ ID NO: 5343242 - DNA, 18 bp, Homo sapiens
aaatgggatgaattcttt

SEQ ID NO: 5343243 - DNA, 15 bp, Homo sapiens
aaatgggcacttaaa

SEQ ID NO: 5343244 - DNA, 15 bp, Homo sapiens
aaatgggcagagcag

SEQ ID NO: 5343245 - DNA, 24 bp, Homo sapiens
aaatgggcagttctcccagggagt

SEQ ID NO: 5343246 - DNA, 15 bp, Homo sapiens
aaatgggcatttatt

SEQ ID NO: 5343247 - DNA, 22 bp, Homo sapiens
aaatgggcatttattttataac

SEQ ID NO: 5343248 - DNA, 22 bp, Homo sapiens
aaatgggcattttacaagaagt

SEQ ID NO: 5343249 - DNA, 20 bp, Homo sapiens
aaatgggcgcccccccctcc

SEQ ID NO: 5343250 - DNA, 22 bp, Homo sapiens
aaatggggaactcccccagagg

SEQ ID NO: 5343251 - DNA, 21 bp, Homo sapiens
aaatggggacattcactataa

SEQ ID NO: 5343252 - DNA, 17 bp, Homo sapiens
aaatggggcttgccctg

SEQ ID NO: 5343253 - DNA, 22 bp, Homo sapiens
aaatgggggcggctggaaagag

SEQ ID NO: 5343254 - DNA, 16 bp, Homo sapiens
aaatgggggtgcattt

SEQ ID NO: 5343255 - DNA, 18 bp, Homo sapiens
aaatgggtcatgacaaga

SEQ ID NO: 5343256 - DNA, 13 bp, Homo sapiens
aaatgggtctttt

SEQ ID NO: 5343257 - DNA, 14 bp, Homo sapiens
aaatgggtctttta

SEQ ID NO: 5343258 - DNA, 16 bp, Homo sapiens
aaatgggtcttttata

SEQ ID NO: 5343259 - DNA, 21 bp, Homo sapiens
aaatgggtgtatataatttta

SEQ ID NO: 5343260 - DNA, 21 bp, Homo sapiens
aaatgggttaatcctgaattc

SEQ ID NO: 5343261 - DNA, 22 bp, Homo sapiens
aaatggtacttaaacatttttg

SEQ ID NO: 5343262 - DNA, 20 bp, Homo sapiens
aaatggtagcattttaaaca

SEQ ID NO: 5343263 - DNA, 19 bp, Homo sapiens
aaatggtagctgaaaaaac

SEQ ID NO: 5343264 - DNA, 14 bp, Homo sapiens
aaatggtataaaag

SEQ ID NO: 5343265 - DNA, 20 bp, Homo sapiens
aaatggtataaaaggttgcc

SEQ ID NO: 5343266 - DNA, 21 bp, Homo sapiens
aaatggtatcaaaattacata

SEQ ID NO: 5343267 - DNA, 18 bp, Homo sapiens
aaatggtatccagaatgg

SEQ ID NO: 5343268 - DNA, 22 bp, Homo sapiens
aaatggtcagtgtgcaaagaaa

SEQ ID NO: 5343269 - DNA, 19 bp, Homo sapiens
aaatggtcccaattaagaa

SEQ ID NO: 5343270 - DNA, 22 bp, Homo sapiens
aaatggtccgctttcctggagc

SEQ ID NO: 5343271 - DNA, 21 bp, Homo sapiens
aaatggtcctatttttgtgaa

SEQ ID NO: 5343272 - DNA, 13 bp, Homo sapiens
aaatggtgaaaga

SEQ ID NO: 5343273 - DNA, 15 bp, Homo sapiens
aaatggtgaatgaca

SEQ ID NO: 5343274 - DNA, 18 bp, Homo sapiens
aaatggtgagaattaaaa

SEQ ID NO: 5343275 - DNA, 21 bp, Homo sapiens
aaatggtgatttaaaaacttg

SEQ ID NO: 5343276 - DNA, 13 bp, Homo sapiens
aaattatctgaat

SEQ ID NO: 5343277 - DNA, 15 bp, Homo sapiens
aaattatctgttcta

SEQ ID NO: 5343278 - DNA, 20 bp, Homo sapiens
aaattatctgttctatggac

SEQ ID NO: 5343279 - DNA, 23 bp, Homo sapiens
aaattatctgttctatggaccaa

SEQ ID NO: 5343280 - DNA, 21 bp, Homo sapiens
aaattatcttgatacattcaa

SEQ ID NO: 5343281 - DNA, 15 bp, Homo sapiens
aaattatctttaaaa

SEQ ID NO: 5343282 - DNA, 18 bp, Homo sapiens
aaattatgaaaatgtaag

SEQ ID NO: 5343283 - DNA, 13 bp, Homo sapiens
aaattatgaagct

SEQ ID NO: 5343284 - DNA, 17 bp, Homo sapiens
aaattatgacgtgcaca

SEQ ID NO: 5343285 - DNA, 17 bp, Homo sapiens
aaattatgataatatat

SEQ ID NO: 5343286 - DNA, 16 bp, Homo sapiens
aaattatgcaaaagca

SEQ ID NO: 5343287 - DNA, 21 bp, Homo sapiens
aaattatgcaaaagcagctaa

SEQ ID NO: 5343288 - DNA, 18 bp, Homo sapiens
aaattatggcatttctat

SEQ ID NO: 5343289 - DNA, 22 bp, Homo sapiens
aaattatgtaaattatcaggca

SEQ ID NO: 5343290 - DNA, 13 bp, Homo sapiens
aaattatgtaact

SEQ ID NO: 5343291 - DNA, 17 bp, Homo sapiens
aaattatgtatgtttac

SEQ ID NO: 5343292 - DNA, 18 bp, Homo sapiens
aaattatgtcaaatggat

SEQ ID NO: 5343293 - DNA, 13 bp, Homo sapiens
aaattatgtgaaa

SEQ ID NO: 5343294 - DNA, 23 bp, Homo sapiens
aaattatgtgccagatttatgca

SEQ ID NO: 5343295 - DNA, 12 bp, Homo sapiens
aaattatgtgtt

SEQ ID NO: 5343296 - DNA, 14 bp, Homo sapiens
aaattatgtttata

SEQ ID NO: 5343297 - DNA, 21 bp, Homo sapiens
aaattatgttttaaacacatg

SEQ ID NO: 5343298 - DNA, 19 bp, Homo sapiens
aaattatgtttttattaag

SEQ ID NO: 5343299 - DNA, 13 bp, Homo sapiens
aaattattaaaaa

SEQ ID NO: 5343300 - DNA, 19 bp, Homo sapiens
aaattattaaaaattatag

SEQ ID NO: 5343301 - DNA, 14 bp, Homo sapiens
aaattattaaagga

SEQ ID NO: 5343302 - DNA, 18 bp, Homo sapiens
aaattattagagattttc

SEQ ID NO: 5343303 - DNA, 16 bp, Homo sapiens
aaattattataagcat

SEQ ID NO: 5343304 - DNA, 14 bp, Homo sapiens
aaattattcagtta

SEQ ID NO: 5343305 - DNA, 13 bp, Homo sapiens
aaattattctagt

SEQ ID NO: 5343306 - DNA, 23 bp, Homo sapiens
aaattattgatacaacaggattt

SEQ ID NO: 5343307 - DNA, 21 bp, Homo sapiens
aaattattgatgattttgtaa

SEQ ID NO: 5343308 - DNA, 17 bp, Homo sapiens
aaattattggtatattt

SEQ ID NO: 5343309 - DNA, 17 bp, Homo sapiens
aaattattgtaaacttt

SEQ ID NO: 5343310 - DNA, 12 bp, Homo sapiens
aaattattgttt

SEQ ID NO: 5343311 - DNA, 13 bp, Homo sapiens
aaattatttaata

SEQ ID NO: 5343312 - DNA, 15 bp, Homo sapiens
aaattatttaataaa

SEQ ID NO: 5343313 - DNA, 15 bp, Homo sapiens
aaattatttcataca

SEQ ID NO: 5343314 - DNA, 14 bp, Homo sapiens
aaattatttctaaa

SEQ ID NO: 5343315 - DNA, 17 bp, Homo sapiens
aaattatttctaaaaca

SEQ ID NO: 5343316 - DNA, 21 bp, Homo sapiens
aaattatttctaaaacattaa

SEQ ID NO: 5343317 - DNA, 15 bp, Homo sapiens
aaattatttcttaat

SEQ ID NO: 5343318 - DNA, 14 bp, Homo sapiens
aaattatttgcagg

SEQ ID NO: 5343319 - DNA, 13 bp, Homo sapiens
aaattatttgcta

SEQ ID NO: 5343320 - DNA, 14 bp, Homo sapiens
aaattatttgctaa

SEQ ID NO: 5343321 - DNA, 16 bp, Homo sapiens
aaattatttgtaagat

SEQ ID NO: 5343322 - DNA, 21 bp, Homo sapiens
aaattatttgtaagatatttg

SEQ ID NO: 5343323 - DNA, 21 bp, Homo sapiens
aaattatttgtgttgggggaa

SEQ ID NO: 5343324 - DNA, 22 bp, Homo sapiens
aaattattttaaattataagga

SEQ ID NO: 5343325 - DNA, 12 bp, Homo sapiens
aaattattttat

SEQ ID NO: 5343326 - DNA, 22 bp, Homo sapiens
aaattattttatatcatacagt

SEQ ID NO: 5343327 - DNA, 14 bp, Homo sapiens
aaattattttatgt

SEQ ID NO: 5343328 - DNA, 15 bp, Homo sapiens
aaattattttatgtc

SEQ ID NO: 5343329 - DNA, 16 bp, Homo sapiens
aaattattttggattt

SEQ ID NO: 5343330 - DNA, 17 bp, Homo sapiens
aaattattttgttcata

SEQ ID NO: 5343331 - DNA, 19 bp, Homo sapiens
aaattatttttttttttgt

SEQ ID NO: 5343332 - DNA, 14 bp, Homo sapiens
aaattcaaaaagtg

SEQ ID NO: 5343333 - DNA, 21 bp, Homo sapiens
aaattcaaaaagtgtttattt

SEQ ID NO: 5343334 - DNA, 17 bp, Homo sapiens
aaattcaaaacctgcag

SEQ ID NO: 5343335 - DNA, 14 bp, Homo sapiens
aaattcaaaatgct

SEQ ID NO: 5343336 - DNA, 15 bp, Homo sapiens
aaattcaaaatgctc

SEQ ID NO: 5343337 - DNA, 22 bp, Homo sapiens
aaattcaaaccaattcacccag

SEQ ID NO: 5343338 - DNA, 21 bp, Homo sapiens
aaattcaaaccatttaattca

SEQ ID NO: 5343339 - DNA, 21 bp, Homo sapiens
aaattcaaagcatggacattt

SEQ ID NO: 5343340 - DNA, 11 bp, Homo sapiens
aaattcaaagg

SEQ ID NO: 5343341 - DNA, 14 bp, Homo sapiens
aaattcaacaaaca

SEQ ID NO: 5343342 - DNA, 20 bp, Homo sapiens
aaattcaacctgtgtcttat

SEQ ID NO: 5343343 - DNA, 20 bp, Homo sapiens
aaattcaactttgtaaaaat

SEQ ID NO: 5343344 - DNA, 16 bp, Homo sapiens
aaattcaagaagtatt

SEQ ID NO: 5343345 - DNA, 18 bp, Homo sapiens
aaattcaagagcctcccc

SEQ ID NO: 5343346 - DNA, 21 bp, Homo sapiens
aaattcaaggccacaaaaaca

SEQ ID NO: 5343347 - DNA, 18 bp, Homo sapiens
aaattcaatgcttgatgt

SEQ ID NO: 5343348 - DNA, 22 bp, Homo sapiens
aaattcaattcatagaataaca

SEQ ID NO: 5343349 - DNA, 20 bp, Homo sapiens
aaattcaattgtaaattgaa

SEQ ID NO: 5343350 - DNA, 17 bp, Homo sapiens
aaattcacaaactttta

SEQ ID NO: 5343351 - DNA, 18 bp, Homo sapiens
aaattcacaaacttttat

SEQ ID NO: 5343352 - DNA, 16 bp, Homo sapiens
aaattcacaaagttaa

SEQ ID NO: 5343353 - DNA, 18 bp, Homo sapiens
aaattcacaagttgtgtt

SEQ ID NO: 5343354 - DNA, 16 bp, Homo sapiens
aaattcacaatagaaa

SEQ ID NO: 5343355 - DNA, 13 bp, Homo sapiens
aaattcacactgt

SEQ ID NO: 5343356 - DNA, 14 bp, Homo sapiens
aaattcacactgtg

SEQ ID NO: 5343357 - DNA, 15 bp, Homo sapiens
aaattcacataataa

SEQ ID NO: 5343358 - DNA, 18 bp, Homo sapiens
aaattcacataataaacg

SEQ ID NO: 5343359 - DNA, 21 bp, Homo sapiens
aaattcacatgatgcacttca

SEQ ID NO: 5343360 - DNA, 13 bp, Homo sapiens
aaattcaccttcc

SEQ ID NO: 5343361 - DNA, 13 bp, Homo sapiens
aaattcactgttt

SEQ ID NO: 5343362 - DNA, 14 bp, Homo sapiens
aaattcactttcat

SEQ ID NO: 5343363 - DNA, 16 bp, Homo sapiens
aaattcagaacagcct

SEQ ID NO: 5343364 - DNA, 12 bp, Homo sapiens
aaattcagacaa

SEQ ID NO: 5343365 - DNA, 19 bp, Homo sapiens
aaattcagacaacattatg

SEQ ID NO: 5343366 - DNA, 22 bp, Homo sapiens
aaattcagataatggtaattta

SEQ ID NO: 5343367 - DNA, 12 bp, Homo sapiens
aaattcagattg

SEQ ID NO: 5343368 - DNA, 21 bp, Homo sapiens
aaattcagatttttacaagtc

SEQ ID NO: 5343369 - DNA, 12 bp, Homo sapiens
aaattcagcaaa

SEQ ID NO: 5343370 - DNA, 13 bp, Homo sapiens
aaattcagcattt

SEQ ID NO: 5343371 - DNA, 14 bp, Homo sapiens
aaattcagctctga

SEQ ID NO: 5343372 - DNA, 20 bp, Homo sapiens
aaattcaggatgctgtgata

SEQ ID NO: 5343373 - DNA, 22 bp, Homo sapiens
aaattcagggctttaaacatga

SEQ ID NO: 5343374 - DNA, 16 bp, Homo sapiens
aaattcaggtctgtat

SEQ ID NO: 5343375 - DNA, 22 bp, Homo sapiens
aaattcaggtgaaaatgttcat

SEQ ID NO: 5343376 - DNA, 17 bp, Homo sapiens
aaattcagtcctaagaa

SEQ ID NO: 5343377 - DNA, 13 bp, Homo sapiens
aaattcagtctct

SEQ ID NO: 5343378 - DNA, 17 bp, Homo sapiens
aaattcagtggacattt

SEQ ID NO: 5343379 - DNA, 20 bp, Homo sapiens
aaattcagtggacatttgtt

SEQ ID NO: 5343380 - DNA, 22 bp, Homo sapiens
aaattcagtggacatttgttct

SEQ ID NO: 5343381 - DNA, 18 bp, Homo sapiens
aaattcagttataaagtc

SEQ ID NO: 5343382 - DNA, 19 bp, Homo sapiens
aaattcagtttttgtatct

SEQ ID NO: 5343383 - DNA, 20 bp, Homo sapiens
aaattcagtttttgtatctt

SEQ ID NO: 5343384 - DNA, 23 bp, Homo sapiens
aaattcagtttttgtatcttggg

SEQ ID NO: 5343385 - DNA, 14 bp, Homo sapiens
aaattcataaccaa

SEQ ID NO: 5343386 - DNA, 18 bp, Homo sapiens
aaattcataaccaaagag

SEQ ID NO: 5343387 - DNA, 16 bp, Homo sapiens
aaattcatattctgtc

SEQ ID NO: 5343388 - DNA, 17 bp, Homo sapiens
aaattcatattctttta

SEQ ID NO: 5343389 - DNA, 19 bp, Homo sapiens
aaattcatgccccagtatt

SEQ ID NO: 5343390 - DNA, 14 bp, Homo sapiens
aaattcatggaact

SEQ ID NO: 5343391 - DNA, 22 bp, Homo sapiens
aaattcatggttttaaagctaa

SEQ ID NO: 5343392 - DNA, 13 bp, Homo sapiens
aaattcattaaag

SEQ ID NO: 5343393 - DNA, 20 bp, Homo sapiens
aaattcattgacttagggga

SEQ ID NO: 5343394 - DNA, 14 bp, Homo sapiens
aaattcatttcaca

SEQ ID NO: 5343395 - DNA, 17 bp, Homo sapiens
aaattcatttcacatta

SEQ ID NO: 5343396 - DNA, 16 bp, Homo sapiens
aaattcattttattct

SEQ ID NO: 5343397 - DNA, 22 bp, Homo sapiens
aaattcatttttttcactggag

SEQ ID NO: 5343398 - DNA, 19 bp, Homo sapiens
aaattccaaacttctaaat

SEQ ID NO: 5343399 - DNA, 13 bp, Homo sapiens
aaattccaaagat

SEQ ID NO: 5343400 - DNA, 22 bp, Homo sapiens
aaattccaaagtctctaattct

SEQ ID NO: 5343401 - DNA, 22 bp, Homo sapiens
aaattccaagtcctgaagtaga

SEQ ID NO: 5343402 - DNA, 21 bp, Homo sapiens
aaattccagaaaggatattta

SEQ ID NO: 5343403 - DNA, 18 bp, Homo sapiens
aaattccagcaataagaa

SEQ ID NO: 5343404 - DNA, 23 bp, Homo sapiens
aaattccagcaataagaaatgaa

SEQ ID NO: 5343405 - DNA, 19 bp, Homo sapiens
aaattccatagctcaataa

SEQ ID NO: 5343406 - DNA, 19 bp, Homo sapiens
aaattccatcacatcacat

SEQ ID NO: 5343407 - DNA, 16 bp, Homo sapiens
aaattccatctatcag

SEQ ID NO: 5343408 - DNA, 12 bp, Homo sapiens
aaattccatgtt

SEQ ID NO: 5343409 - DNA, 18 bp, Homo sapiens
aaattccattatcttatg

SEQ ID NO: 5343410 - DNA, 20 bp, Homo sapiens
aaattcccaacaaacattga

SEQ ID NO: 5343411 - DNA, 19 bp, Homo sapiens
aaattcccgtgttgcttca

SEQ ID NO: 5343412 - DNA, 14 bp, Homo sapiens
aaattccctaaagc

SEQ ID NO: 5343413 - DNA, 15 bp, Homo sapiens
aaattccctaaagcc

SEQ ID NO: 5343414 - DNA, 15 bp, Homo sapiens
aaattccctctggag

SEQ ID NO: 5343415 - DNA, 18 bp, Homo sapiens
aaattccctggcctttca

SEQ ID NO: 5343416 - DNA, 19 bp, Homo sapiens
aaattccgagtctttctca

SEQ ID NO: 5343417 - DNA, 20 bp, Homo sapiens
aaattcctaataagtttgat

SEQ ID NO: 5343418 - DNA, 14 bp, Homo sapiens
aaattcctaattct

SEQ ID NO: 5343419 - DNA, 16 bp, Homo sapiens
aaattcctagaaaagt

SEQ ID NO: 5343420 - DNA, 23 bp, Homo sapiens
aaattcctagaaaagtttgtttt

SEQ ID NO: 5343421 - DNA, 18 bp, Homo sapiens
aaattcctattgtgattt

SEQ ID NO: 5343422 - DNA, 12 bp, Homo sapiens
aaattcctcctt

SEQ ID NO: 5343423 - DNA, 20 bp, Homo sapiens
aaattcctctttgctttgct

SEQ ID NO: 5343424 - DNA, 14 bp, Homo sapiens
aaattcctgcaaaa

SEQ ID NO: 5343425 - DNA, 21 bp, Homo sapiens
aaattcctgtgttcaatattt

SEQ ID NO: 5343426 - DNA, 22 bp, Homo sapiens
aaattccttagcttagacctca

SEQ ID NO: 5343427 - DNA, 23 bp, Homo sapiens
aaattccttagcttagacctcag

SEQ ID NO: 5343428 - DNA, 16 bp, Homo sapiens
aaattccttgccccac

SEQ ID NO: 5343429 - DNA, 16 bp, Homo sapiens
aaattcctttcagagt

SEQ ID NO: 5343430 - DNA, 21 bp, Homo sapiens
aaattcctttcagagttttac

SEQ ID NO: 5343431 - DNA, 23 bp, Homo sapiens
aaattcctttcagagttttacta

SEQ ID NO: 5343432 - DNA, 15 bp, Homo sapiens
aaattcgtagcaaat

SEQ ID NO: 5343433 - DNA, 15 bp, Homo sapiens
aaattcgtgtgtttt

SEQ ID NO: 5343434 - DNA, 17 bp, Homo sapiens
aaattctaaattacaaa

SEQ ID NO: 5343435 - DNA, 21 bp, Homo sapiens
aaattctaaattacaaaggta

SEQ ID NO: 5343436 - DNA, 14 bp, Homo sapiens
aaattctagaagca

SEQ ID NO: 5343437 - DNA, 23 bp, Homo sapiens
aaattctataggaacatatgaaa

SEQ ID NO: 5343438 - DNA, 15 bp, Homo sapiens
aaattctatgttaaa

SEQ ID NO: 5343439 - DNA, 22 bp, Homo sapiens
aaattctatgttaaatactgtg

SEQ ID NO: 5343440 - DNA, 15 bp, Homo sapiens
aaattctattgaaaa

SEQ ID NO: 5343441 - DNA, 20 bp, Homo sapiens
aaattctcagtcagtaattg

SEQ ID NO: 5343442 - DNA, 22 bp, Homo sapiens
aaattctccaacagctgactct

SEQ ID NO: 5343443 - DNA, 15 bp, Homo sapiens
aaattctcttaaata

SEQ ID NO: 5343444 - DNA, 16 bp, Homo sapiens
aaattctcttcttttt

SEQ ID NO: 5343445 - DNA, 13 bp, Homo sapiens
aaattctgaaaac

SEQ ID NO: 5343446 - DNA, 16 bp, Homo sapiens
aaattctgaatgcaat

SEQ ID NO: 5343447 - DNA, 12 bp, Homo sapiens
aaattctgaatt

SEQ ID NO: 5343448 - DNA, 16 bp, Homo sapiens
aaattctgaatttgca

SEQ ID NO: 5343449 - DNA, 18 bp, Homo sapiens
aaattctgaatttgcaaa

SEQ ID NO: 5343450 - DNA, 17 bp, Homo sapiens
aaattctgacttatgaa

SEQ ID NO: 5343451 - DNA, 12 bp, Homo sapiens
aaattctgatta

SEQ ID NO: 5343452 - DNA, 13 bp, Homo sapiens
aaattctgattct

SEQ ID NO: 5343453 - DNA, 15 bp, Homo sapiens
aaattctgattcttc

SEQ ID NO: 5343454 - DNA, 16 bp, Homo sapiens
aaatttgactaatttt

SEQ ID NO: 5343455 - DNA, 18 bp, Homo sapiens
aaatttgactaattttac

SEQ ID NO: 5343456 - DNA, 13 bp, Homo sapiens
aaatttgataaac

SEQ ID NO: 5343457 - DNA, 15 bp, Homo sapiens
aaatttgataatgac

SEQ ID NO: 5343458 - DNA, 13 bp, Homo sapiens
aaatttgatactt

SEQ ID NO: 5343459 - DNA, 20 bp, Homo sapiens
aaatttgattctaaatagcg

SEQ ID NO: 5343460 - DNA, 22 bp, Homo sapiens
aaatttgatttacatatattat

SEQ ID NO: 5343461 - DNA, 13 bp, Homo sapiens
aaatttgatttcc

SEQ ID NO: 5343462 - DNA, 14 bp, Homo sapiens
aaatttgatttcta

SEQ ID NO: 5343463 - DNA, 12 bp, Homo sapiens
aaatttgcaaaa

SEQ ID NO: 5343464 - DNA, 19 bp, Homo sapiens
aaatttgcacacaaaacat

SEQ ID NO: 5343465 - DNA, 20 bp, Homo sapiens
aaatttgccaatctttccta

SEQ ID NO: 5343466 - DNA, 22 bp, Homo sapiens
aaatttgccaccactagagctg

SEQ ID NO: 5343467 - DNA, 22 bp, Homo sapiens
aaatttgccagttttattttct

SEQ ID NO: 5343468 - DNA, 18 bp, Homo sapiens
aaatttgcccctggcaaa

SEQ ID NO: 5343469 - DNA, 16 bp, Homo sapiens
aaatttgcctctgtcc

SEQ ID NO: 5343470 - DNA, 15 bp, Homo sapiens
aaatttgcttttatt

SEQ ID NO: 5343471 - DNA, 20 bp, Homo sapiens
aaatttggaattctgttcat

SEQ ID NO: 5343472 - DNA, 22 bp, Homo sapiens
aaatttggactgttttccttca

SEQ ID NO: 5343473 - DNA, 17 bp, Homo sapiens
aaatttggcattgatct

SEQ ID NO: 5343474 - DNA, 18 bp, Homo sapiens
aaatttggccatgaaagc

SEQ ID NO: 5343475 - DNA, 18 bp, Homo sapiens
aaatttggccttaagaac

SEQ ID NO: 5343476 - DNA, 21 bp, Homo sapiens
aaatttggccttaagaactgt

SEQ ID NO: 5343477 - DNA, 22 bp, Homo sapiens
aaatttggccttaagaactgtg

SEQ ID NO: 5343478 - DNA, 21 bp, Homo sapiens
aaatttggctcacttgcctta

SEQ ID NO: 5343479 - DNA, 13 bp, Homo sapiens
aaatttgggtttt

SEQ ID NO: 5343480 - DNA, 15 bp, Homo sapiens
aaatttggttctaat

SEQ ID NO: 5343481 - DNA, 16 bp, Homo sapiens
aaatttggttctaata

SEQ ID NO: 5343482 - DNA, 13 bp, Homo sapiens
aaatttgtaagtt

SEQ ID NO: 5343483 - DNA, 14 bp, Homo sapiens
aaatttgtaagttt

SEQ ID NO: 5343484 - DNA, 15 bp, Homo sapiens
aaatttgtaagtttc

SEQ ID NO: 5343485 - DNA, 17 bp, Homo sapiens
aaatttgtaagtttcag

SEQ ID NO: 5343486 - DNA, 15 bp, Homo sapiens
aaatttgtaatattt

SEQ ID NO: 5343487 - DNA, 12 bp, Homo sapiens
aaatttgtacta

SEQ ID NO: 5343488 - DNA, 12 bp, Homo sapiens
aaatttgtagaa

SEQ ID NO: 5343489 - DNA, 18 bp, Homo sapiens
aaatttgtgggttttttt

SEQ ID NO: 5343490 - DNA, 22 bp, Homo sapiens
aaatttgttgtcatgtgtatga

SEQ ID NO: 5343491 - DNA, 15 bp, Homo sapiens
aaatttgttgtttgt

SEQ ID NO: 5343492 - DNA, 22 bp, Homo sapiens
aaatttgtttaattaaatttaa

SEQ ID NO: 5343493 - DNA, 14 bp, Homo sapiens
aaattttaaaaaag

SEQ ID NO: 5343494 - DNA, 19 bp, Homo sapiens
aaattttaaaaaggaattt

SEQ ID NO: 5343495 - DNA, 15 bp, Homo sapiens
aaattttaaaaatct

SEQ ID NO: 5343496 - DNA, 14 bp, Homo sapiens
aaattttaaaattg

SEQ ID NO: 5343497 - DNA, 14 bp, Homo sapiens
aaattttaaagcct

SEQ ID NO: 5343498 - DNA, 12 bp, Homo sapiens
aaattttaactg

SEQ ID NO: 5343499 - DNA, 12 bp, Homo sapiens
aaattttaagaa

SEQ ID NO: 5343500 - DNA, 16 bp, Homo sapiens
aaattttaagctagga

SEQ ID NO: 5343501 - DNA, 14 bp, Homo sapiens
aaattttaatttat

SEQ ID NO: 5343502 - DNA, 21 bp, Homo sapiens
aaattttacaagggcataaag

SEQ ID NO: 5343503 - DNA, 14 bp, Homo sapiens
aaattttaccaagt

SEQ ID NO: 5343504 - DNA, 19 bp, Homo sapiens
aaattttactgacagaaat

SEQ ID NO: 5343505 - DNA, 11 bp, Homo sapiens
aaattttagag

SEQ ID NO: 5343506 - DNA, 22 bp, Homo sapiens
aaattttaggcaagttttccct

SEQ ID NO: 5343507 - DNA, 17 bp, Homo sapiens
aaattttagtacatttt

SEQ ID NO: 5343508 - DNA, 14 bp, Homo sapiens
aaattttatatcat

SEQ ID NO: 5343509 - DNA, 23 bp, Homo sapiens
aaattttatatcattttaaaatg

SEQ ID NO: 5343510 - DNA, 17 bp, Homo sapiens
aaattttatctcttatt

SEQ ID NO: 5343511 - DNA, 22 bp, Homo sapiens
aaattttatgtattttaaaata

SEQ ID NO: 5343512 - DNA, 13 bp, Homo sapiens
aaattttatgtca

SEQ ID NO: 5343513 - DNA, 19 bp, Homo sapiens
aaattttattgaatataat

SEQ ID NO: 5343514 - DNA, 20 bp, Homo sapiens
aaattttatttagttcttga

SEQ ID NO: 5343515 - DNA, 18 bp, Homo sapiens
aaattttatttcctggac

SEQ ID NO: 5343516 - DNA, 22 bp, Homo sapiens
aaattttatttttattactttt

SEQ ID NO: 5343517 - DNA, 13 bp, Homo sapiens
aaattttcaaact

SEQ ID NO: 5343518 - DNA, 14 bp, Homo sapiens
aaattttcaaactt

SEQ ID NO: 5343519 - DNA, 18 bp, Homo sapiens
aaattttcacataaaata

SEQ ID NO: 5343520 - DNA, 11 bp, Homo sapiens
aaattttcacc

SEQ ID NO: 5343521 - DNA, 15 bp, Homo sapiens
aaattttcagaaagc

SEQ ID NO: 5343522 - DNA, 17 bp, Homo sapiens
aaattttcccagtgaat

SEQ ID NO: 5343523 - DNA, 15 bp, Homo sapiens
aaattttctaaataa

SEQ ID NO: 5343524 - DNA, 15 bp, Homo sapiens
aaattttctacagta

SEQ ID NO: 5343525 - DNA, 18 bp, Homo sapiens
aaattttctacagtacat

SEQ ID NO: 5343526 - DNA, 19 bp, Homo sapiens
aaattttctagaatactaa

SEQ ID NO: 5343527 - DNA, 22 bp, Homo sapiens
aaattttctagaatactaataa

SEQ ID NO: 5343528 - DNA, 14 bp, Homo sapiens
aaattttctagact

SEQ ID NO: 5343529 - DNA, 15 bp, Homo sapiens
aaattttctccagtc

SEQ ID NO: 5343530 - DNA, 15 bp, Homo sapiens
aaattttctccttgg

SEQ ID NO: 5343531 - DNA, 20 bp, Homo sapiens
aaattttcttttaagcattt

SEQ ID NO: 5343532 - DNA, 22 bp, Homo sapiens
aaattttctttttgtttcactg

SEQ ID NO: 5343533 - DNA, 14 bp, Homo sapiens
aaattttgaatgta

SEQ ID NO: 5343534 - DNA, 23 bp, Homo sapiens
aaattttgagcaaagaaacttgt

SEQ ID NO: 5343535 - DNA, 23 bp, Homo sapiens
aaattttgatgttttaaggatgc

SEQ ID NO: 5343536 - DNA, 23 bp, Homo sapiens
aaattttgattaaccttttcaaa

SEQ ID NO: 5343537 - DNA, 14 bp, Homo sapiens
aaattttgcaaata

SEQ ID NO: 5343538 - DNA, 17 bp, Homo sapiens
aaattttgcatttagtt

SEQ ID NO: 5343539 - DNA, 18 bp, Homo sapiens
aaattttgcatttcatgc

SEQ ID NO: 5343540 - DNA, 19 bp, Homo sapiens
aaattttggaatatttgct

SEQ ID NO: 5343541 - DNA, 22 bp, Homo sapiens
aaattttggaatatttgcttta

SEQ ID NO: 5343542 - DNA, 11 bp, Homo sapiens
aaattttgtaa

SEQ ID NO: 5343543 - DNA, 15 bp, Homo sapiens
aaattttgtaatgaa

SEQ ID NO: 5343544 - DNA, 16 bp, Homo sapiens
aaattttgtacatttt

SEQ ID NO: 5343545 - DNA, 23 bp, Homo sapiens
aaattttgtgacccctttcactt

SEQ ID NO: 5343546 - DNA, 22 bp, Homo sapiens
aaattttgtgcaaaaaggactg

SEQ ID NO: 5343547 - DNA, 18 bp, Homo sapiens
aaattttgtgttcctttt

SEQ ID NO: 5343548 - DNA, 13 bp, Homo sapiens
aaattttgtttca

SEQ ID NO: 5343549 - DNA, 17 bp, Homo sapiens
aaattttgtttcagaat

SEQ ID NO: 5343550 - DNA, 14 bp, Homo sapiens
aaatttttaaatca

SEQ ID NO: 5343551 - DNA, 12 bp, Homo sapiens
aaatttttaagt

SEQ ID NO: 5343552 - DNA, 14 bp, Homo sapiens
aaatttttaagtgt

SEQ ID NO: 5343553 - DNA, 16 bp, Homo sapiens
aaatttttaagttttt

SEQ ID NO: 5343554 - DNA, 13 bp, Homo sapiens
aaatttttaatgt

SEQ ID NO: 5343555 - DNA, 15 bp, Homo sapiens
aaatttttaatgttt

SEQ ID NO: 5343556 - DNA, 18 bp, Homo sapiens
aaatttttacctgtttaa

SEQ ID NO: 5343557 - DNA, 19 bp, Homo sapiens
aaatttttacctttatctt

SEQ ID NO: 5343558 - DNA, 14 bp, Homo sapiens
aaatttttactcag

SEQ ID NO: 5343559 - DNA, 15 bp, Homo sapiens
aaatttttactcagg

SEQ ID NO: 5343560 - DNA, 22 bp, Homo sapiens
aaatttttactcaggctttcta

SEQ ID NO: 5343561 - DNA, 23 bp, Homo sapiens
aaatttttactcaggctttctat

SEQ ID NO: 5343562 - DNA, 17 bp, Homo sapiens
aaatttttaggcaaaga

SEQ ID NO: 5343563 - DNA, 19 bp, Homo sapiens
aaatttttatcttactttt

SEQ ID NO: 5343564 - DNA, 16 bp, Homo sapiens
aaatttttatttttga

SEQ ID NO: 5343565 - DNA, 20 bp, Homo sapiens
aaatttttcagatgcttctg

SEQ ID NO: 5343566 - DNA, 12 bp, Homo sapiens
aaatttttcata

SEQ ID NO: 5343567 - DNA, 13 bp, Homo sapiens
aaatttttcatag

SEQ ID NO: 5343568 - DNA, 13 bp, Homo sapiens
aaatttttcatat

SEQ ID NO: 5343569 - DNA, 19 bp, Homo sapiens
aaatttttcatattttaat

SEQ ID NO: 5343570 - DNA, 19 bp, Homo sapiens
aaatttttccacactatgt

SEQ ID NO: 5343571 - DNA, 20 bp, Homo sapiens
aaatttttccacactatgtg

SEQ ID NO: 5343572 - DNA, 13 bp, Homo sapiens
aaatttttcctgc

SEQ ID NO: 5343573 - DNA, 15 bp, Homo sapiens
aaatttttgacactt

SEQ ID NO: 5343574 - DNA, 22 bp, Homo sapiens
aaatttttgagttacaatttgg

SEQ ID NO: 5343575 - DNA, 17 bp, Homo sapiens
aaatttttgtagtagcg

SEQ ID NO: 5343576 - DNA, 20 bp, Homo sapiens
aaattttttacgtagctatt

SEQ ID NO: 5343577 - DNA, 16 bp, Homo sapiens
aaattttttagtatgt

SEQ ID NO: 5343578 - DNA, 13 bp, Homo sapiens
aaattttttgaaa
